United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 101

SEQ ID NO: 3594355 - RNA, 18 nt, Pseudomonas putida KT2440
cgucggccaugccacccc

SEQ ID NO: 3594356 - RNA, 13 nt, Pseudomonas putida KT2440
cgucggccccggc

SEQ ID NO: 3594357 - RNA, 18 nt, Pseudomonas putida KT2440
cgucggcgcgcaacagca

SEQ ID NO: 3594358 - RNA, 22 nt, Pseudomonas putida KT2440
cgucggcguauggcuucacggc

SEQ ID NO: 3594359 - RNA, 17 nt, Pseudomonas putida KT2440
cgucggcgucagccgcg

SEQ ID NO: 3594360 - RNA, 16 nt, Pseudomonas putida KT2440
cgucggcguggaacaa

SEQ ID NO: 3594361 - RNA, 19 nt, Pseudomonas putida KT2440
cgucgggcacgaucagcag

SEQ ID NO: 3594362 - RNA, 20 nt, Pseudomonas putida KT2440
cgucgggcacgaucagcagc

SEQ ID NO: 3594363 - RNA, 21 nt, Pseudomonas putida KT2440
cgucggggaauggcccagcca

SEQ ID NO: 3594364 - RNA, 17 nt, Pseudomonas putida KT2440
cgucgguuuccucgacg

SEQ ID NO: 3594365 - RNA, 18 nt, Pseudomonas putida KT2440
cgucgguuuccucgacgc

SEQ ID NO: 3594366 - RNA, 18 nt, Pseudomonas putida KT2440
cgucguacgccgauccuc

SEQ ID NO: 3594367 - RNA, 22 nt, Pseudomonas putida KT2440
cgucguaggagcggguucaccc

SEQ ID NO: 3594368 - RNA, 15 nt, Pseudomonas putida KT2440
cgucgucaaggaagc

SEQ ID NO: 3594369 - RNA, 13 nt, Pseudomonas putida KT2440
cgucgucacugcc

SEQ ID NO: 3594370 - RNA, 15 nt, Pseudomonas putida KT2440
cgucgucagcuuccg

SEQ ID NO: 3594371 - RNA, 12 nt, Pseudomonas putida KT2440
cgucgucauggu

SEQ ID NO: 3594372 - RNA, 20 nt, Pseudomonas putida KT2440
cgucgucauguucguucggc

SEQ ID NO: 3594373 - RNA, 23 nt, Pseudomonas putida KT2440
cgucguccgcagucccguuggcc

SEQ ID NO: 3594374 - RNA, 19 nt, Pseudomonas putida KT2440
cgucgucgacaaaugccgg

SEQ ID NO: 3594375 - RNA, 21 nt, Pseudomonas putida KT2440
cgucguggccuucgcgggcuc

SEQ ID NO: 3594376 - RNA, 16 nt, Pseudomonas putida KT2440
cgucguguaggagcgg

SEQ ID NO: 3594377 - RNA, 16 nt, Pseudomonas putida KT2440
cgucguucggcaucga

SEQ ID NO: 3594378 - RNA, 15 nt, Pseudomonas putida KT2440
cgucucgaacggcgc

SEQ ID NO: 3594379 - RNA, 22 nt, Pseudomonas putida KT2440
cgucucgaacggcgccagcagu

SEQ ID NO: 3594380 - RNA, 16 nt, Pseudomonas putida KT2440
cgucucgccgcuguac

SEQ ID NO: 3594381 - RNA, 21 nt, Pseudomonas putida KT2440
cgucucugaccggcacugcac

SEQ ID NO: 3594382 - RNA, 20 nt, Pseudomonas putida KT2440
cgucucuuucaggcacagca

SEQ ID NO: 3594383 - RNA, 19 nt, Pseudomonas putida KT2440
cgucugacuggcagcaagg

SEQ ID NO: 3594384 - RNA, 22 nt, Pseudomonas putida KT2440
cgucugacuggcagcaaggcca

SEQ ID NO: 3594385 - RNA, 20 nt, Pseudomonas putida KT2440
cgucugcaucauucgcgcca

SEQ ID NO: 3594386 - RNA, 17 nt, Pseudomonas putida KT2440
cgucugccgcagccccg

SEQ ID NO: 3594387 - RNA, 17 nt, Pseudomonas putida KT2440
cgucuggaucugaggcg

SEQ ID NO: 3594388 - RNA, 14 nt, Pseudomonas putida KT2440
cgucuggcgcggca

SEQ ID NO: 3594389 - RNA, 18 nt, Pseudomonas putida KT2440
cgucuuccaugccuucuu

SEQ ID NO: 3594390 - RNA, 20 nt, Pseudomonas putida KT2440
cgucuuuuccgugcaaccgc

SEQ ID NO: 3594391 - RNA, 22 nt, Pseudomonas putida KT2440
cgucuuuuccgugcaaccgcuc

SEQ ID NO: 3594392 - RNA, 23 nt, Pseudomonas putida KT2440
cgugaaaccgaaaaagccuacac

SEQ ID NO: 3594393 - RNA, 19 nt, Pseudomonas putida KT2440
cgugaaauccucaaccugg

SEQ ID NO: 3594394 - RNA, 23 nt, Pseudomonas putida KT2440
cgugaagucgguggucaccagca

SEQ ID NO: 3594395 - RNA, 17 nt, Pseudomonas putida KT2440
cgugaaucgcgcuugcg

SEQ ID NO: 3594396 - RNA, 11 nt, Pseudomonas putida KT2440
cgugaccagcc

SEQ ID NO: 3594397 - RNA, 17 nt, Pseudomonas putida KT2440
cgugacgugcgcuccug

SEQ ID NO: 3594398 - RNA, 21 nt, Pseudomonas putida KT2440
cgugacgugcgcuccugguca

SEQ ID NO: 3594399 - RNA, 15 nt, Pseudomonas putida KT2440
cgugacuaguggcca

SEQ ID NO: 3594400 - RNA, 13 nt, Pseudomonas putida KT2440
cgugagaccugca

SEQ ID NO: 3594401 - RNA, 20 nt, Pseudomonas putida KT2440
cgugagaccugcaaugccgc

SEQ ID NO: 3594402 - RNA, 17 nt, Pseudomonas putida KT2440
cgugagauguucaccag

SEQ ID NO: 3594403 - RNA, 17 nt, Pseudomonas putida KT2440
cgugagccugcacccgc

SEQ ID NO: 3594404 - RNA, 13 nt, Pseudomonas putida KT2440
cgugagggggcac

SEQ ID NO: 3594405 - RNA, 22 nt, Pseudomonas putida KT2440
cgugaguggccucgaacauggc

SEQ ID NO: 3594406 - RNA, 16 nt, Pseudomonas putida KT2440
cgugaucauccccagc

SEQ ID NO: 3594407 - RNA, 17 nt, Pseudomonas putida KT2440
cgugaucauccccagca

SEQ ID NO: 3594408 - RNA, 18 nt, Pseudomonas putida KT2440
cgugaucauccccagcau

SEQ ID NO: 3594409 - RNA, 15 nt, Pseudomonas putida KT2440
cgugauggcagcuac

SEQ ID NO: 3594410 - RNA, 17 nt, Pseudomonas putida KT2440
cgugcaaacaacuccga

SEQ ID NO: 3594411 - RNA, 17 nt, Pseudomonas putida KT2440
cgugcaaggaucaccaa

SEQ ID NO: 3594412 - RNA, 21 nt, Pseudomonas putida KT2440
cgugcaaggaucaccaaggcu

SEQ ID NO: 3594413 - RNA, 23 nt, Pseudomonas putida KT2440
cgugcaccacggucggccugcgc

SEQ ID NO: 3594414 - RNA, 13 nt, Pseudomonas putida KT2440
cgugcaccagcac

SEQ ID NO: 3594415 - RNA, 14 nt, Pseudomonas putida KT2440
cgugcaccagcacc

SEQ ID NO: 3594416 - RNA, 17 nt, Pseudomonas putida KT2440
cgugcacccaaccugcc

SEQ ID NO: 3594417 - RNA, 18 nt, Pseudomonas putida KT2440
cgugcaccggccuugccg

SEQ ID NO: 3594418 - RNA, 19 nt, Pseudomonas putida KT2440
cgugcacgcuugagcgcgc

SEQ ID NO: 3594419 - RNA, 23 nt, Pseudomonas putida KT2440
cgugcacggccuugucagcagcu

SEQ ID NO: 3594420 - RNA, 17 nt, Pseudomonas putida KT2440
cgugcagcugcaccgac

SEQ ID NO: 3594421 - RNA, 20 nt, Pseudomonas putida KT2440
cgugcaggggucugugcagc

SEQ ID NO: 3594422 - RNA, 15 nt, Pseudomonas putida KT2440
cgugcaggucagcgu

SEQ ID NO: 3594423 - RNA, 19 nt, Pseudomonas putida KT2440
cgugcagguugcuggugga

SEQ ID NO: 3594424 - RNA, 20 nt, Pseudomonas putida KT2440
cgugcauacacccggucgcu

SEQ ID NO: 3594425 - RNA, 13 nt, Pseudomonas putida KT2440
cguuccggcaaac

SEQ ID NO: 3594426 - RNA, 13 nt, Pseudomonas putida KT2440
cguucgaacuccg

SEQ ID NO: 3594427 - RNA, 15 nt, Pseudomonas putida KT2440
cguucgaacuccgcg

SEQ ID NO: 3594428 - RNA, 16 nt, Pseudomonas putida KT2440
cguucgagcaucggcu

SEQ ID NO: 3594429 - RNA, 20 nt, Pseudomonas putida KT2440
cguucgaugcgcagagccac

SEQ ID NO: 3594430 - RNA, 16 nt, Pseudomonas putida KT2440
cguucgcggucgguca

SEQ ID NO: 3594431 - RNA, 15 nt, Pseudomonas putida KT2440
cguucgcuacggcgg

SEQ ID NO: 3594432 - RNA, 22 nt, Pseudomonas putida KT2440
cguucggaucgucuggcacuga

SEQ ID NO: 3594433 - RNA, 15 nt, Pseudomonas putida KT2440
cguucggccagcacu

SEQ ID NO: 3594434 - RNA, 13 nt, Pseudomonas putida KT2440
cguucggcgcgcu

SEQ ID NO: 3594435 - RNA, 20 nt, Pseudomonas putida KT2440
cguucggguugauggucuug

SEQ ID NO: 3594436 - RNA, 16 nt, Pseudomonas putida KT2440
cguucgguguccuugc

SEQ ID NO: 3594437 - RNA, 12 nt, Pseudomonas putida KT2440
cguucuccagcu

SEQ ID NO: 3594438 - RNA, 13 nt, Pseudomonas putida KT2440
cguucugccgguu

SEQ ID NO: 3594439 - RNA, 19 nt, Pseudomonas putida KT2440
cguucugccgguuugcgcu

SEQ ID NO: 3594440 - RNA, 21 nt, Pseudomonas putida KT2440
cguucuggccuuggcgugcac

SEQ ID NO: 3594441 - RNA, 18 nt, Pseudomonas putida KT2440
cguucuugaagaugaccu

SEQ ID NO: 3594442 - RNA, 22 nt, Pseudomonas putida KT2440
cguucuuucucccaggccgaca

SEQ ID NO: 3594443 - RNA, 22 nt, Pseudomonas putida KT2440
cguugaagcgguugaccgccgc

SEQ ID NO: 3594444 - RNA, 23 nt, Pseudomonas putida KT2440
cguugaccagguuuaccggccgc

SEQ ID NO: 3594445 - RNA, 20 nt, Pseudomonas putida KT2440
cguugaccccgccgcuggcu

SEQ ID NO: 3594446 - RNA, 19 nt, Pseudomonas putida KT2440
cguugaccgacucuacugc

SEQ ID NO: 3594447 - RNA, 14 nt, Pseudomonas putida KT2440
cguugagccgccaa

SEQ ID NO: 3594448 - RNA, 13 nt, Pseudomonas putida KT2440
cguugaggccgaa

SEQ ID NO: 3594449 - RNA, 22 nt, Pseudomonas putida KT2440
cguugauccaggcuuggcgaac

SEQ ID NO: 3594450 - RNA, 21 nt, Pseudomonas putida KT2440
cguugaugcgcuugaagugau

SEQ ID NO: 3594451 - RNA, 14 nt, Pseudomonas putida KT2440
cguugaugcgugau

SEQ ID NO: 3594452 - RNA, 12 nt, Pseudomonas putida KT2440
cguugcagccau

SEQ ID NO: 3594453 - RNA, 12 nt, Pseudomonas putida KT2440
cguugcagcccc

SEQ ID NO: 3594454 - RNA, 17 nt, Pseudomonas putida KT2440
cguugcagccccagccu

SEQ ID NO: 3594455 - RNA, 15 nt, Pseudomonas putida KT2440
cguugcaggauuugc

SEQ ID NO: 3594456 - RNA, 20 nt, Pseudomonas putida KT2440
cguugcagucguuguccagg

SEQ ID NO: 3594457 - RNA, 17 nt, Pseudomonas putida KT2440
cguugcauuccaucauc

SEQ ID NO: 3594458 - RNA, 16 nt, Pseudomonas putida KT2440
cguugcgcagcagcag

SEQ ID NO: 3594459 - RNA, 15 nt, Pseudomonas putida KT2440
cguugcgcaucaccu

SEQ ID NO: 3594460 - RNA, 22 nt, Pseudomonas putida KT2440
cguugcgccgcucgcccagcag

SEQ ID NO: 3594461 - RNA, 15 nt, Pseudomonas putida KT2440
cguugcgcucgagcc

SEQ ID NO: 3594462 - RNA, 21 nt, Pseudomonas putida KT2440
cguugcgcuugagcaggucga

SEQ ID NO: 3594463 - RNA, 22 nt, Pseudomonas putida KT2440
cguugcggaacauacgcaucag

SEQ ID NO: 3594464 - RNA, 23 nt, Pseudomonas putida KT2440
cguugcggucgguggucagcucg

SEQ ID NO: 3594465 - RNA, 16 nt, Pseudomonas putida KT2440
cguugcguugcagcuu

SEQ ID NO: 3594466 - RNA, 18 nt, Pseudomonas putida KT2440
cguugcuacugcuuuauc

SEQ ID NO: 3594467 - RNA, 23 nt, Pseudomonas putida KT2440
cguugcuccagcucacagcacuc

SEQ ID NO: 3594468 - RNA, 18 nt, Pseudomonas putida KT2440
cguugcugccugugccgg

SEQ ID NO: 3594469 - RNA, 13 nt, Pseudomonas putida KT2440
cguugcuucugua

SEQ ID NO: 3594470 - RNA, 21 nt, Pseudomonas putida KT2440
cguugcuucuguaccgccguc

SEQ ID NO: 3594471 - RNA, 15 nt, Pseudomonas putida KT2440
cguuggcagcaccac

SEQ ID NO: 3594472 - RNA, 21 nt, Pseudomonas putida KT2440
cguuggccaaaccguccaggu

SEQ ID NO: 3594473 - RNA, 16 nt, Pseudomonas putida KT2440
cguuggccaggucgac

SEQ ID NO: 3594474 - RNA, 23 nt, Pseudomonas putida KT2440
cguuggcccgccaguaggcugca

SEQ ID NO: 3594475 - RNA, 13 nt, Pseudomonas putida KT2440
cguuggccgccag

SEQ ID NO: 3594476 - RNA, 14 nt, Pseudomonas putida KT2440
cguuggccgccagc

SEQ ID NO: 3594477 - RNA, 15 nt, Pseudomonas putida KT2440
cguuggccggguuua

SEQ ID NO: 3594478 - RNA, 13 nt, Pseudomonas putida KT2440
cguuggcugcuga

SEQ ID NO: 3594479 - RNA, 16 nt, Pseudomonas putida KT2440
cguuggcuuccacggc

SEQ ID NO: 3594480 - RNA, 14 nt, Pseudomonas putida KT2440
cguugguggugcgc

SEQ ID NO: 3594481 - RNA, 14 nt, Pseudomonas putida KT2440
cguugguguccuug

SEQ ID NO: 3594482 - RNA, 15 nt, Pseudomonas putida KT2440
cguuguaagccauga

SEQ ID NO: 3594483 - RNA, 17 nt, Pseudomonas putida KT2440
cguuguacaagcuggca

SEQ ID NO: 3594484 - RNA, 12 nt, Pseudomonas putida KT2440
cguugucagcaa

SEQ ID NO: 3594485 - RNA, 13 nt, Pseudomonas putida KT2440
cguuguccagcag

SEQ ID NO: 3594486 - RNA, 14 nt, Pseudomonas putida KT2440
cguuguccagcagc

SEQ ID NO: 3594487 - RNA, 15 nt, Pseudomonas putida KT2440
cguuguccagcagca

SEQ ID NO: 3594488 - RNA, 15 nt, Pseudomonas putida KT2440
cguugucgacugcac

SEQ ID NO: 3594489 - RNA, 20 nt, Pseudomonas putida KT2440
cguugucgcccgcccagccc

SEQ ID NO: 3594490 - RNA, 21 nt, Pseudomonas putida KT2440
cguugucgccuuucaggucga

SEQ ID NO: 3594491 - RNA, 22 nt, Pseudomonas putida KT2440
cguugucggucucgaaccacag

SEQ ID NO: 3594492 - RNA, 17 nt, Pseudomonas putida KT2440
cguuguguugcugggcg

SEQ ID NO: 3594493 - RNA, 14 nt, Pseudomonas putida KT2440
cguuguucagcagc

SEQ ID NO: 3594494 - RNA, 15 nt, Pseudomonas putida KT2440
cguuguucagcagcg

SEQ ID NO: 3594495 - RNA, 20 nt, Pseudomonas putida KT2440
cguuguucuucaggcgcgca

SEQ ID NO: 3594496 - RNA, 20 nt, Pseudomonas putida KT2440
cguuguuguugaacaugcgg

SEQ ID NO: 3594497 - RNA, 14 nt, Pseudomonas putida KT2440
cguuuaccugcagc

SEQ ID NO: 3594498 - RNA, 21 nt, Pseudomonas putida KT2440
cguuuaccugcagcucagcca

SEQ ID NO: 3594499 - RNA, 17 nt, Pseudomonas putida KT2440
cguuuacugcugaugcg

SEQ ID NO: 3594500 - RNA, 21 nt, Pseudomonas putida KT2440
cguuuauugguuugacgcugc

SEQ ID NO: 3594501 - RNA, 17 nt, Pseudomonas putida KT2440
cguuucaguacagccgu

SEQ ID NO: 3594502 - RNA, 23 nt, Pseudomonas putida KT2440
cguuucauucaagaaugcccggg

SEQ ID NO: 3594503 - RNA, 13 nt, Pseudomonas putida KT2440
cguuuccagcaac

SEQ ID NO: 3594504 - RNA, 13 nt, Pseudomonas putida KT2440
cguuuccaggcuu

SEQ ID NO: 3594505 - RNA, 20 nt, Pseudomonas putida KT2440
cguuucggcggccugcagcu

SEQ ID NO: 3594506 - RNA, 21 nt, Pseudomonas putida KT2440
cguuucggcggccugcagcuu

SEQ ID NO: 3594507 - RNA, 23 nt, Pseudomonas putida KT2440
cguuugcgaagguaaccugguuc

SEQ ID NO: 3594508 - RNA, 13 nt, Pseudomonas putida KT2440
cguuuuauaaaga

SEQ ID NO: 3594509 - RNA, 23 nt, Pseudomonas putida KT2440
cguuuuucucgaugaugcugguc

SEQ ID NO: 3594510 - RNA, 15 nt, Pseudomonas putida KT2440
cguuuuuugggagcg

SEQ ID NO: 3594511 - RNA, 18 nt, Pseudomonas putida KT2440
cuaaaccgcgaugcugca

SEQ ID NO: 3594512 - RNA, 14 nt, Pseudomonas putida KT2440
cuaaagcauuucga

SEQ ID NO: 3594513 - RNA, 17 nt, Pseudomonas putida KT2440
cuaaagccgcaccuaca

SEQ ID NO: 3594514 - RNA, 20 nt, Pseudomonas putida KT2440
cuaaagccgcaccuacaggg

SEQ ID NO: 3594515 - RNA, 15 nt, Pseudomonas putida KT2440
cuaaaucgaccugca

SEQ ID NO: 3594516 - RNA, 19 nt, Pseudomonas putida KT2440
cuaacaggugcucaccaga

SEQ ID NO: 3594517 - RNA, 19 nt, Pseudomonas putida KT2440
cuaaccgcgcugguaagcc

SEQ ID NO: 3594518 - RNA, 15 nt, Pseudomonas putida KT2440
cuaaccucugcaugc

SEQ ID NO: 3594519 - RNA, 14 nt, Pseudomonas putida KT2440
cuaagcagggaaau

SEQ ID NO: 3594520 - RNA, 23 nt, Pseudomonas putida KT2440
cuaagcagggaaaugaccugaag

SEQ ID NO: 3594521 - RNA, 20 nt, Pseudomonas putida KT2440
cuaaggggaagguugcaggu

SEQ ID NO: 3594522 - RNA, 14 nt, Pseudomonas putida KT2440
cuaauggcgcgccu

SEQ ID NO: 3594523 - RNA, 15 nt, Pseudomonas putida KT2440
cuacaacauaccgcu

SEQ ID NO: 3594524 - RNA, 18 nt, Pseudomonas putida KT2440
cuacaacauaccgcuggg

SEQ ID NO: 3594525 - RNA, 21 nt, Pseudomonas putida KT2440
cuacaacauaccgcugggcac

SEQ ID NO: 3594526 - RNA, 22 nt, Pseudomonas putida KT2440
cuacaccuaacgcaaccaucag

SEQ ID NO: 3594527 - RNA, 16 nt, Pseudomonas putida KT2440
cuacagcggccugugc

SEQ ID NO: 3594528 - RNA, 16 nt, Pseudomonas putida KT2440
cuacaggauggccgca

SEQ ID NO: 3594529 - RNA, 17 nt, Pseudomonas putida KT2440
cuacaggcaaccgcauc

SEQ ID NO: 3594530 - RNA, 16 nt, Pseudomonas putida KT2440
cucaacgccagggcaa

SEQ ID NO: 3594531 - RNA, 21 nt, Pseudomonas putida KT2440
cucaacgccagggcaaucgcc

SEQ ID NO: 3594532 - RNA, 16 nt, Pseudomonas putida KT2440
cucaacgccuccccca

SEQ ID NO: 3594533 - RNA, 19 nt, Pseudomonas putida KT2440
cucaacgccucccccaccc

SEQ ID NO: 3594534 - RNA, 19 nt, Pseudomonas putida KT2440
cucaacggguuugccguga

SEQ ID NO: 3594535 - RNA, 19 nt, Pseudomonas putida KT2440
cucaacuccauggccaggg

SEQ ID NO: 3594536 - RNA, 18 nt, Pseudomonas putida KT2440
cucaacuggcaggguucg

SEQ ID NO: 3594537 - RNA, 20 nt, Pseudomonas putida KT2440
cucaacuucccucugccugc

SEQ ID NO: 3594538 - RNA, 21 nt, Pseudomonas putida KT2440
cucaacuucccucugccugcc

SEQ ID NO: 3594539 - RNA, 22 nt, Pseudomonas putida KT2440
cucaacuucccucugccugccc

SEQ ID NO: 3594540 - RNA, 17 nt, Pseudomonas putida KT2440
cucaagccucgcgcaac

SEQ ID NO: 3594541 - RNA, 18 nt, Pseudomonas putida KT2440
cucaagcgaggugacugc

SEQ ID NO: 3594542 - RNA, 12 nt, Pseudomonas putida KT2440
cucaagcgccag

SEQ ID NO: 3594543 - RNA, 17 nt, Pseudomonas putida KT2440
cucaagcgccagggcau

SEQ ID NO: 3594544 - RNA, 20 nt, Pseudomonas putida KT2440
cucaagcgccagggcaucga

SEQ ID NO: 3594545 - RNA, 14 nt, Pseudomonas putida KT2440
cucaaggccggcag

SEQ ID NO: 3594546 - RNA, 17 nt, Pseudomonas putida KT2440
cucaaggccggcagcca

SEQ ID NO: 3594547 - RNA, 14 nt, Pseudomonas putida KT2440
cucaaggcuuucca

SEQ ID NO: 3594548 - RNA, 15 nt, Pseudomonas putida KT2440
cucaagggauuggca

SEQ ID NO: 3594549 - RNA, 17 nt, Pseudomonas putida KT2440
cucaagggauuggcaac

SEQ ID NO: 3594550 - RNA, 23 nt, Pseudomonas putida KT2440
cucaagggauuggcaacaaugua

SEQ ID NO: 3594551 - RNA, 19 nt, Pseudomonas putida KT2440
cucaaggucacggcuguca

SEQ ID NO: 3594552 - RNA, 23 nt, Pseudomonas putida KT2440
cucaaggugucgauacucacccg

SEQ ID NO: 3594553 - RNA, 16 nt, Pseudomonas putida KT2440
cucaagguuguauuua

SEQ ID NO: 3594554 - RNA, 21 nt, Pseudomonas putida KT2440
cucaagugccuuggcggcgga

SEQ ID NO: 3594555 - RNA, 16 nt, Pseudomonas putida KT2440
cucaaucaaccagccc

SEQ ID NO: 3594556 - RNA, 12 nt, Pseudomonas putida KT2440
cucaauggcacc

SEQ ID NO: 3594557 - RNA, 10 nt, Pseudomonas putida KT2440
cucaauucca

SEQ ID NO: 3594558 - RNA, 20 nt, Pseudomonas putida KT2440
cucaauuucuuucagcucgg

SEQ ID NO: 3594559 - RNA, 16 nt, Pseudomonas putida KT2440
cucacaaagcccuugu

SEQ ID NO: 3594560 - RNA, 14 nt, Pseudomonas putida KT2440
cucacacccaggcu

SEQ ID NO: 3594561 - RNA, 15 nt, Pseudomonas putida KT2440
cucacacccaggcuc

SEQ ID NO: 3594562 - RNA, 16 nt, Pseudomonas putida KT2440
cucacagcacucguug

SEQ ID NO: 3594563 - RNA, 18 nt, Pseudomonas putida KT2440
cucacagcgccgcggcca

SEQ ID NO: 3594564 - RNA, 18 nt, Pseudomonas putida KT2440
cucacaggcgaugaaagc

SEQ ID NO: 3594565 - RNA, 21 nt, Pseudomonas putida KT2440
cucacaggcucagucgcaucg

SEQ ID NO: 3594566 - RNA, 17 nt, Pseudomonas putida KT2440
cucacagggaccgugca

SEQ ID NO: 3594567 - RNA, 12 nt, Pseudomonas putida KT2440
cucacaucaucg

SEQ ID NO: 3594568 - RNA, 21 nt, Pseudomonas putida KT2440
cucacaucgcgcagggcgcga

SEQ ID NO: 3594569 - RNA, 12 nt, Pseudomonas putida KT2440
cucacauucacc

SEQ ID NO: 3594570 - RNA, 15 nt, Pseudomonas putida KT2440
cucacauucaccgcc

SEQ ID NO: 3594571 - RNA, 15 nt, Pseudomonas putida KT2440
cucaccaacugccug

SEQ ID NO: 3594572 - RNA, 18 nt, Pseudomonas putida KT2440
cucaccacaucggcggca

SEQ ID NO: 3594573 - RNA, 15 nt, Pseudomonas putida KT2440
cucaccauguuccag

SEQ ID NO: 3594574 - RNA, 20 nt, Pseudomonas putida KT2440
cucaccccguagcgcuucag

SEQ ID NO: 3594575 - RNA, 13 nt, Pseudomonas putida KT2440
cucacccgaccag

SEQ ID NO: 3594576 - RNA, 20 nt, Pseudomonas putida KT2440
cucacccgaccagaucaggc

SEQ ID NO: 3594577 - RNA, 22 nt, Pseudomonas putida KT2440
cucacccgaccagaucaggccg

SEQ ID NO: 3594578 - RNA, 22 nt, Pseudomonas putida KT2440
cucacccgccccacgcccgacc

SEQ ID NO: 3594579 - RNA, 12 nt, Pseudomonas putida KT2440
cucacccgcuug

SEQ ID NO: 3594580 - RNA, 16 nt, Pseudomonas putida KT2440
cucacccgcuugccac

SEQ ID NO: 3594581 - RNA, 16 nt, Pseudomonas putida KT2440
cucaccgcagcccagc

SEQ ID NO: 3594582 - RNA, 19 nt, Pseudomonas putida KT2440
cucaccgcagcccagcgcc

SEQ ID NO: 3594583 - RNA, 14 nt, Pseudomonas putida KT2440
cucaccgccgcccc

SEQ ID NO: 3594584 - RNA, 21 nt, Pseudomonas putida KT2440
cucaccggcaaucgacucaag

SEQ ID NO: 3594585 - RNA, 16 nt, Pseudomonas putida KT2440
cucaccggccagcgcg

SEQ ID NO: 3594586 - RNA, 17 nt, Pseudomonas putida KT2440
cucaccggccagcgcgc

SEQ ID NO: 3594587 - RNA, 21 nt, Pseudomonas putida KT2440
cucaccuccaccgauccuugg

SEQ ID NO: 3594588 - RNA, 21 nt, Pseudomonas putida KT2440
cucacgaugacccuuccagcc

SEQ ID NO: 3594589 - RNA, 22 nt, Pseudomonas putida KT2440
cucacgaugacccuuccagccc

SEQ ID NO: 3594590 - RNA, 22 nt, Pseudomonas putida KT2440
cucacgcaacucuaccucacug

SEQ ID NO: 3594591 - RNA, 21 nt, Pseudomonas putida KT2440
cucacgcaagcggcccugauc

SEQ ID NO: 3594592 - RNA, 13 nt, Pseudomonas putida KT2440
cucacgcacgauc

SEQ ID NO: 3594593 - RNA, 14 nt, Pseudomonas putida KT2440
cucacgcagccagu

SEQ ID NO: 3594594 - RNA, 14 nt, Pseudomonas putida KT2440
cucacgcagcccuu

SEQ ID NO: 3594595 - RNA, 13 nt, Pseudomonas putida KT2440
cucacgcagcucg

SEQ ID NO: 3594596 - RNA, 17 nt, Pseudomonas putida KT2440
cucacgccccgugaagu

SEQ ID NO: 3594597 - RNA, 16 nt, Pseudomonas putida KT2440
cucacgccccuuggca

SEQ ID NO: 3594598 - RNA, 22 nt, Pseudomonas putida KT2440
cucacgccccuuggcacggcca

SEQ ID NO: 3594599 - RNA, 12 nt, Pseudomonas putida KT2440
cucacgcgccag

SEQ ID NO: 3594600 - RNA, 15 nt, Pseudomonas putida KT2440
cucacgcgccagggu

SEQ ID NO: 3594601 - RNA, 18 nt, Pseudomonas putida KT2440
cucacgcgccaggguuug

SEQ ID NO: 3594602 - RNA, 20 nt, Pseudomonas putida KT2440
cucacgcucguuguccagca

SEQ ID NO: 3594603 - RNA, 21 nt, Pseudomonas putida KT2440
cucacgcucguuguccagcag

SEQ ID NO: 3594604 - RNA, 13 nt, Pseudomonas putida KT2440
cucacgcuugcca

SEQ ID NO: 3594605 - RNA, 19 nt, Pseudomonas putida KT2440
cucacggccauccugcugu

SEQ ID NO: 3594606 - RNA, 20 nt, Pseudomonas putida KT2440
cucacguuugggcggcguga

SEQ ID NO: 3594607 - RNA, 14 nt, Pseudomonas putida KT2440
cucacucgucgauc

SEQ ID NO: 3594608 - RNA, 13 nt, Pseudomonas putida KT2440
cucacugaccagg

SEQ ID NO: 3594609 - RNA, 14 nt, Pseudomonas putida KT2440
cucacugcgaugaa

SEQ ID NO: 3594610 - RNA, 19 nt, Pseudomonas putida KT2440
cucacuggcauccggcagc

SEQ ID NO: 3594611 - RNA, 15 nt, Pseudomonas putida KT2440
cucacuuucugcgcu

SEQ ID NO: 3594612 - RNA, 19 nt, Pseudomonas putida KT2440
cucagaaucagcuugccau

SEQ ID NO: 3594613 - RNA, 15 nt, Pseudomonas putida KT2440
cucagaccaacaacu

SEQ ID NO: 3594614 - RNA, 15 nt, Pseudomonas putida KT2440
cucagcaacugggca

SEQ ID NO: 3594615 - RNA, 16 nt, Pseudomonas putida KT2440
cucagcaacugggcaa

SEQ ID NO: 3594616 - RNA, 23 nt, Pseudomonas putida KT2440
cucagcacauucagcagcgccug

SEQ ID NO: 3594617 - RNA, 20 nt, Pseudomonas putida KT2440
cucagcaccauuugucuuga

SEQ ID NO: 3594618 - RNA, 17 nt, Pseudomonas putida KT2440
cucagccaaccgcccca

SEQ ID NO: 3594619 - RNA, 18 nt, Pseudomonas putida KT2440
cucagccaaccgccccac

SEQ ID NO: 3594620 - RNA, 21 nt, Pseudomonas putida KT2440
cucagccaaccgccccaccca

SEQ ID NO: 3594621 - RNA, 19 nt, Pseudomonas putida KT2440
cucagccacgcuggcaccc

SEQ ID NO: 3594622 - RNA, 16 nt, Pseudomonas putida KT2440
cucagccaggcugagc

SEQ ID NO: 3594623 - RNA, 22 nt, Pseudomonas putida KT2440
cucagcccauuucaccugcucu

SEQ ID NO: 3594624 - RNA, 16 nt, Pseudomonas putida KT2440
cucagccgccacaugc

SEQ ID NO: 3594625 - RNA, 21 nt, Pseudomonas putida KT2440
cucagccgcugcgccugccgg

SEQ ID NO: 3594626 - RNA, 22 nt, Pseudomonas putida KT2440
cucagccgcugcgccugccggg

SEQ ID NO: 3594627 - RNA, 21 nt, Pseudomonas putida KT2440
cucagcgcccgcugcgccgcu

SEQ ID NO: 3594628 - RNA, 16 nt, Pseudomonas putida KT2440
cucagcgcuugccgcu

SEQ ID NO: 3594629 - RNA, 13 nt, Pseudomonas putida KT2440
cucagcggcaccu

SEQ ID NO: 3594630 - RNA, 16 nt, Pseudomonas putida KT2440
cucagcggcuggcccu

SEQ ID NO: 3594631 - RNA, 17 nt, Pseudomonas putida KT2440
cucagcggcuggcccug

SEQ ID NO: 3594632 - RNA, 20 nt, Pseudomonas putida KT2440
cucagcgggcguaccuggcu

SEQ ID NO: 3594633 - RNA, 20 nt, Pseudomonas putida KT2440
cucagcgugacgauggccac

SEQ ID NO: 3594634 - RNA, 22 nt, Pseudomonas putida KT2440
cucagcgugacgauggccacca

SEQ ID NO: 3594635 - RNA, 17 nt, Pseudomonas putida KT2440
cuccagcaacugcgccg

SEQ ID NO: 3594636 - RNA, 14 nt, Pseudomonas putida KT2440
cuccagcaagcgcu

SEQ ID NO: 3594637 - RNA, 17 nt, Pseudomonas putida KT2440
cuccagcaagcgcucau

SEQ ID NO: 3594638 - RNA, 15 nt, Pseudomonas putida KT2440
cuccagcacaccgcg

SEQ ID NO: 3594639 - RNA, 14 nt, Pseudomonas putida KT2440
cuccagcacccgcu

SEQ ID NO: 3594640 - RNA, 15 nt, Pseudomonas putida KT2440
cuccagcacccgcuu

SEQ ID NO: 3594641 - RNA, 22 nt, Pseudomonas putida KT2440
cuccagcaccgauucaaagcca

SEQ ID NO: 3594642 - RNA, 17 nt, Pseudomonas putida KT2440
cuccagcaccucgcuca

SEQ ID NO: 3594643 - RNA, 11 nt, Pseudomonas putida KT2440
cuccagcagcg

SEQ ID NO: 3594644 - RNA, 22 nt, Pseudomonas putida KT2440
cuccagcagcgacaccagcgca

SEQ ID NO: 3594645 - RNA, 14 nt, Pseudomonas putida KT2440
cuccagcagcgcau

SEQ ID NO: 3594646 - RNA, 22 nt, Pseudomonas putida KT2440
cuccagcagcgcauccaccucg

SEQ ID NO: 3594647 - RNA, 14 nt, Pseudomonas putida KT2440
cuccagcagcucca

SEQ ID NO: 3594648 - RNA, 14 nt, Pseudomonas putida KT2440
cuccagcagguuca

SEQ ID NO: 3594649 - RNA, 14 nt, Pseudomonas putida KT2440
cuccagcagugccg

SEQ ID NO: 3594650 - RNA, 16 nt, Pseudomonas putida KT2440
cuccagcagugccgcc

SEQ ID NO: 3594651 - RNA, 23 nt, Pseudomonas putida KT2440
cuccagccaacggucgaucagcu

SEQ ID NO: 3594652 - RNA, 14 nt, Pseudomonas putida KT2440
cuccagcccagcgc

SEQ ID NO: 3594653 - RNA, 15 nt, Pseudomonas putida KT2440
cuccagcccagcgcc

SEQ ID NO: 3594654 - RNA, 16 nt, Pseudomonas putida KT2440
cuccagcccagcgcca

SEQ ID NO: 3594655 - RNA, 17 nt, Pseudomonas putida KT2440
cuccagcccagcgccag

SEQ ID NO: 3594656 - RNA, 17 nt, Pseudomonas putida KT2440
cuccagcccggcuucac

SEQ ID NO: 3594657 - RNA, 16 nt, Pseudomonas putida KT2440
cuccagccgacggcca

SEQ ID NO: 3594658 - RNA, 14 nt, Pseudomonas putida KT2440
cuccagccgcugcu

SEQ ID NO: 3594659 - RNA, 15 nt, Pseudomonas putida KT2440
cuccagcgccagcag

SEQ ID NO: 3594660 - RNA, 23 nt, Pseudomonas putida KT2440
cuccagcgccagcagccgggccu

SEQ ID NO: 3594661 - RNA, 22 nt, Pseudomonas putida KT2440
cuccagcucaaccccaaaccgc

SEQ ID NO: 3594662 - RNA, 15 nt, Pseudomonas putida KT2440
cuccagcucacagca

SEQ ID NO: 3594663 - RNA, 16 nt, Pseudomonas putida KT2440
cuccagcucacagcac

SEQ ID NO: 3594664 - RNA, 17 nt, Pseudomonas putida KT2440
cuccagcucacagcacu

SEQ ID NO: 3594665 - RNA, 23 nt, Pseudomonas putida KT2440
cuccagcucacagcacucguuga

SEQ ID NO: 3594666 - RNA, 14 nt, Pseudomonas putida KT2440
cuccagcuccaggc

SEQ ID NO: 3594667 - RNA, 15 nt, Pseudomonas putida KT2440
cuccagcuccuggcc

SEQ ID NO: 3594668 - RNA, 16 nt, Pseudomonas putida KT2440
cuccagcuccuggccc

SEQ ID NO: 3594669 - RNA, 14 nt, Pseudomonas putida KT2440
cuccagcucgcgcg

SEQ ID NO: 3594670 - RNA, 17 nt, Pseudomonas putida KT2440
cuccagcucgcgcgggu

SEQ ID NO: 3594671 - RNA, 13 nt, Pseudomonas putida KT2440
cuccagcuggcca

SEQ ID NO: 3594672 - RNA, 14 nt, Pseudomonas putida KT2440
cuccagcuggccau

SEQ ID NO: 3594673 - RNA, 17 nt, Pseudomonas putida KT2440
cuccagcuuuggcugca

SEQ ID NO: 3594674 - RNA, 20 nt, Pseudomonas putida KT2440
cuccaggcagccugccaggu

SEQ ID NO: 3594675 - RNA, 19 nt, Pseudomonas putida KT2440
cuccaggcgaccaugcggc

SEQ ID NO: 3594676 - RNA, 17 nt, Pseudomonas putida KT2440
cuccaggugcucgauga

SEQ ID NO: 3594677 - RNA, 18 nt, Pseudomonas putida KT2440
cuccagguggaucggcgu

SEQ ID NO: 3594678 - RNA, 17 nt, Pseudomonas putida KT2440
cuccaguggugcaaggu

SEQ ID NO: 3594679 - RNA, 19 nt, Pseudomonas putida KT2440
cuccaguucauucccggcc

SEQ ID NO: 3594680 - RNA, 14 nt, Pseudomonas putida KT2440
cuccaucuccagcu

SEQ ID NO: 3594681 - RNA, 17 nt, Pseudomonas putida KT2440
cuccaucuccagcucaa

SEQ ID NO: 3594682 - RNA, 16 nt, Pseudomonas putida KT2440
cuccaugaaggccggc

SEQ ID NO: 3594683 - RNA, 22 nt, Pseudomonas putida KT2440
cuccauggcaauuggcuuccag

SEQ ID NO: 3594684 - RNA, 20 nt, Pseudomonas putida KT2440
cuccaugggcaggcccaggu

SEQ ID NO: 3594685 - RNA, 22 nt, Pseudomonas putida KT2440
cuccaugggcaggcccagguaa

SEQ ID NO: 3594686 - RNA, 19 nt, Pseudomonas putida KT2440
cuccauguaacgcuccaca

SEQ ID NO: 3594687 - RNA, 16 nt, Pseudomonas putida KT2440
cuccaugucgaauaac

SEQ ID NO: 3594688 - RNA, 18 nt, Pseudomonas putida KT2440
cuccaugucggaagccug

SEQ ID NO: 3594689 - RNA, 22 nt, Pseudomonas putida KT2440
cuccauugcgccugucacguug

SEQ ID NO: 3594690 - RNA, 22 nt, Pseudomonas putida KT2440
cucccacaaaggaaauccccau

SEQ ID NO: 3594691 - RNA, 20 nt, Pseudomonas putida KT2440
cucccacagauauugcaccg

SEQ ID NO: 3594692 - RNA, 24 nt, Pseudomonas putida KT2440
cucccacaggaaugucaccgcggc

SEQ ID NO: 3594693 - RNA, 21 nt, Pseudomonas putida KT2440
cucccacaggaauuacgcagg

SEQ ID NO: 3594694 - RNA, 17 nt, Pseudomonas putida KT2440
cucccacagggaccgca

SEQ ID NO: 3594695 - RNA, 21 nt, Pseudomonas putida KT2440
cucccacagggaccucacagc

SEQ ID NO: 3594696 - RNA, 21 nt, Pseudomonas putida KT2440
cucccacaggggaucgcgcaa

SEQ ID NO: 3594697 - RNA, 20 nt, Pseudomonas putida KT2440
cucccacaggggccgcgcag

SEQ ID NO: 3594698 - RNA, 22 nt, Pseudomonas putida KT2440
cucccacagguaaugcacaagu

SEQ ID NO: 3594699 - RNA, 16 nt, Pseudomonas putida KT2440
cucccacagguccagc

SEQ ID NO: 3594700 - RNA, 17 nt, Pseudomonas putida KT2440
cucccacagguccagcg

SEQ ID NO: 3594701 - RNA, 20 nt, Pseudomonas putida KT2440
cucccacagguccagcgcag

SEQ ID NO: 3594702 - RNA, 17 nt, Pseudomonas putida KT2440
cucccacaggugcagca

SEQ ID NO: 3594703 - RNA, 20 nt, Pseudomonas putida KT2440
cucccacaggugcagcacag

SEQ ID NO: 3594704 - RNA, 22 nt, Pseudomonas putida KT2440
cucccacagguuuagcgcuggc

SEQ ID NO: 3594705 - RNA, 15 nt, Pseudomonas putida KT2440
cucccaggccucgaa

SEQ ID NO: 3594706 - RNA, 22 nt, Pseudomonas putida KT2440
cucccauguagaccaccagcgu

SEQ ID NO: 3594707 - RNA, 14 nt, Pseudomonas putida KT2440
cuccccacccaggu

SEQ ID NO: 3594708 - RNA, 19 nt, Pseudomonas putida KT2440
cuccccaguccgucucuuc

SEQ ID NO: 3594709 - RNA, 13 nt, Pseudomonas putida KT2440
cuccccaucagca

SEQ ID NO: 3594710 - RNA, 15 nt, Pseudomonas putida KT2440
cuccccaucagcagc

SEQ ID NO: 3594711 - RNA, 21 nt, Pseudomonas putida KT2440
cucccccaggcugccaaaccg

SEQ ID NO: 3594712 - RNA, 14 nt, Pseudomonas putida KT2440
cuccccucagacag

SEQ ID NO: 3594713 - RNA, 24 nt, Pseudomonas putida KT2440
cucccgcacauuucacagcaaaaa

SEQ ID NO: 3594714 - RNA, 16 nt, Pseudomonas putida KT2440
cucccgcacugcugcc

SEQ ID NO: 3594715 - RNA, 21 nt, Pseudomonas putida KT2440
cucccgcgcauccuccgcccu

SEQ ID NO: 3594716 - RNA, 23 nt, Pseudomonas putida KT2440
cucccgcgcaugcugccaggcaa

SEQ ID NO: 3594717 - RNA, 14 nt, Pseudomonas putida KT2440
cucccgcugccuuc

SEQ ID NO: 3594718 - RNA, 14 nt, Pseudomonas putida KT2440
cucccgcugcugcg

SEQ ID NO: 3594719 - RNA, 14 nt, Pseudomonas putida KT2440
cucccggcauugcc

SEQ ID NO: 3594720 - RNA, 14 nt, Pseudomonas putida KT2440
cucccggcucauca

SEQ ID NO: 3594721 - RNA, 21 nt, Pseudomonas putida KT2440
cucccucgguuucucaccccg

SEQ ID NO: 3594722 - RNA, 18 nt, Pseudomonas putida KT2440
cucccuuacagaugcugc

SEQ ID NO: 3594723 - RNA, 13 nt, Pseudomonas putida KT2440
cuccgaggccggg

SEQ ID NO: 3594724 - RNA, 14 nt, Pseudomonas putida KT2440
cuccgcacaggcug

SEQ ID NO: 3594725 - RNA, 20 nt, Pseudomonas putida KT2440
cuccgcacaggcuggccacc

SEQ ID NO: 3594726 - RNA, 22 nt, Pseudomonas putida KT2440
cuccgcacaggcuggccaccau

SEQ ID NO: 3594727 - RNA, 17 nt, Pseudomonas putida KT2440
cuccgccaaaccccagc

SEQ ID NO: 3594728 - RNA, 19 nt, Pseudomonas putida KT2440
cuccgccaagcacgcacag

SEQ ID NO: 3594729 - RNA, 17 nt, Pseudomonas putida KT2440
cuccgccaauugcgcca

SEQ ID NO: 3594730 - RNA, 12 nt, Pseudomonas putida KT2440
cuccgccccaaa

SEQ ID NO: 3594731 - RNA, 20 nt, Pseudomonas putida KT2440
cuccgccccaaaccaggccg

SEQ ID NO: 3594732 - RNA, 19 nt, Pseudomonas putida KT2440
cuccgcccguaugcauccg

SEQ ID NO: 3594733 - RNA, 21 nt, Pseudomonas putida KT2440
cuccgcccguaugcauccgcc

SEQ ID NO: 3594734 - RNA, 12 nt, Pseudomonas putida KT2440
cuccgcccugcc

SEQ ID NO: 3594735 - RNA, 20 nt, Pseudomonas putida KT2440
cuccgccuaccgcgucgcca

SEQ ID NO: 3594736 - RNA, 19 nt, Pseudomonas putida KT2440
cuccgccugcggcaccguc

SEQ ID NO: 3594737 - RNA, 22 nt, Pseudomonas putida KT2440
cuccgcgagggcaucagcgcac

SEQ ID NO: 3594738 - RNA, 23 nt, Pseudomonas putida KT2440
cuccggaauccgcacacgcucca

SEQ ID NO: 3594739 - RNA, 17 nt, Pseudomonas putida KT2440
cuccggaucguugcggg

SEQ ID NO: 3594740 - RNA, 17 nt, Pseudomonas putida KT2440
cucgaucccgccgccag

SEQ ID NO: 3594741 - RNA, 18 nt, Pseudomonas putida KT2440
cucgaucccgccgccaga

SEQ ID NO: 3594742 - RNA, 20 nt, Pseudomonas putida KT2440
cucgaucccgccgccagacc

SEQ ID NO: 3594743 - RNA, 13 nt, Pseudomonas putida KT2440
cucgauccugugg

SEQ ID NO: 3594744 - RNA, 20 nt, Pseudomonas putida KT2440
cucgaucgucgacaacgcac

SEQ ID NO: 3594745 - RNA, 16 nt, Pseudomonas putida KT2440
cucgaucucacaggcg

SEQ ID NO: 3594746 - RNA, 16 nt, Pseudomonas putida KT2440
cucgaucugccugccu

SEQ ID NO: 3594747 - RNA, 22 nt, Pseudomonas putida KT2440
cucgaucuugccuucggccaca

SEQ ID NO: 3594748 - RNA, 22 nt, Pseudomonas putida KT2440
cucgaucuuguuggucaggcca

SEQ ID NO: 3594749 - RNA, 18 nt, Pseudomonas putida KT2440
cucgaugcccuccagccc

SEQ ID NO: 3594750 - RNA, 13 nt, Pseudomonas putida KT2440
cucgaugcugcgu

SEQ ID NO: 3594751 - RNA, 14 nt, Pseudomonas putida KT2440
cucgauggccagga

SEQ ID NO: 3594752 - RNA, 15 nt, Pseudomonas putida KT2440
cucgaugggccgcuc

SEQ ID NO: 3594753 - RNA, 18 nt, Pseudomonas putida KT2440
cucgaugguuaucuucuc

SEQ ID NO: 3594754 - RNA, 21 nt, Pseudomonas putida KT2440
cucgauuagcuccaccagcgg

SEQ ID NO: 3594755 - RNA, 16 nt, Pseudomonas putida KT2440
cucgauucgccgggcc

SEQ ID NO: 3594756 - RNA, 17 nt, Pseudomonas putida KT2440
cucgauuuccaccggcu

SEQ ID NO: 3594757 - RNA, 20 nt, Pseudomonas putida KT2440
cucgauuuccaccggcuugc

SEQ ID NO: 3594758 - RNA, 13 nt, Pseudomonas putida KT2440
cucgcacuccgcc

SEQ ID NO: 3594759 - RNA, 12 nt, Pseudomonas putida KT2440
cucgcagcagca

SEQ ID NO: 3594760 - RNA, 15 nt, Pseudomonas putida KT2440
cucgcagcagcaccg

SEQ ID NO: 3594761 - RNA, 20 nt, Pseudomonas putida KT2440
cucgcagccaaugcugauga

SEQ ID NO: 3594762 - RNA, 21 nt, Pseudomonas putida KT2440
cucgcagguaaucggccugug

SEQ ID NO: 3594763 - RNA, 17 nt, Pseudomonas putida KT2440
cucgcagguauccgggu

SEQ ID NO: 3594764 - RNA, 20 nt, Pseudomonas putida KT2440
cucgcaggucuucucggcag

SEQ ID NO: 3594765 - RNA, 23 nt, Pseudomonas putida KT2440
cucgccaaaccauggcgucaggc

SEQ ID NO: 3594766 - RNA, 15 nt, Pseudomonas putida KT2440
cucgccaaacugcug

SEQ ID NO: 3594767 - RNA, 13 nt, Pseudomonas putida KT2440
cucgccaagcauu

SEQ ID NO: 3594768 - RNA, 13 nt, Pseudomonas putida KT2440
cucgccagccugc

SEQ ID NO: 3594769 - RNA, 15 nt, Pseudomonas putida KT2440
cucgccaucgccccg

SEQ ID NO: 3594770 - RNA, 16 nt, Pseudomonas putida KT2440
cucgccauucaccagc

SEQ ID NO: 3594771 - RNA, 17 nt, Pseudomonas putida KT2440
cucgccauucucgauca

SEQ ID NO: 3594772 - RNA, 15 nt, Pseudomonas putida KT2440
cucgcccacacggca

SEQ ID NO: 3594773 - RNA, 21 nt, Pseudomonas putida KT2440
cucgcccaugcgcgugcgugu

SEQ ID NO: 3594774 - RNA, 15 nt, Pseudomonas putida KT2440
cucgcccaugggcuu

SEQ ID NO: 3594775 - RNA, 21 nt, Pseudomonas putida KT2440
cucgcccgcgaagaagcuaac

SEQ ID NO: 3594776 - RNA, 16 nt, Pseudomonas putida KT2440
cucgcccgggucaggu

SEQ ID NO: 3594777 - RNA, 17 nt, Pseudomonas putida KT2440
cucgcccgggucagguc

SEQ ID NO: 3594778 - RNA, 19 nt, Pseudomonas putida KT2440
cucgcccuuguccaugaag

SEQ ID NO: 3594779 - RNA, 12 nt, Pseudomonas putida KT2440
cucgccgcgcau

SEQ ID NO: 3594780 - RNA, 20 nt, Pseudomonas putida KT2440
cucgccguacucggucuggu

SEQ ID NO: 3594781 - RNA, 16 nt, Pseudomonas putida KT2440
cucgccucacagcgcc

SEQ ID NO: 3594782 - RNA, 14 nt, Pseudomonas putida KT2440
cucgccucagcgcc

SEQ ID NO: 3594783 - RNA, 16 nt, Pseudomonas putida KT2440
cucgccucagcgccaa

SEQ ID NO: 3594784 - RNA, 18 nt, Pseudomonas putida KT2440
cucgccugcuuggcaccu

SEQ ID NO: 3594785 - RNA, 17 nt, Pseudomonas putida KT2440
cucgcgauccaucuuca

SEQ ID NO: 3594786 - RNA, 13 nt, Pseudomonas putida KT2440
cucgcgcagcaca

SEQ ID NO: 3594787 - RNA, 18 nt, Pseudomonas putida KT2440
cucgcgcaggaaccgcgu

SEQ ID NO: 3594788 - RNA, 14 nt, Pseudomonas putida KT2440
cucgcgcaggcggu

SEQ ID NO: 3594789 - RNA, 23 nt, Pseudomonas putida KT2440
cucgcgcaggguuuucagcgccg

SEQ ID NO: 3594790 - RNA, 14 nt, Pseudomonas putida KT2440
cucgcgcauggccg

SEQ ID NO: 3594791 - RNA, 18 nt, Pseudomonas putida KT2440
cucgcgcccacgcggguc

SEQ ID NO: 3594792 - RNA, 12 nt, Pseudomonas putida KT2440
cucgcgccgccg

SEQ ID NO: 3594793 - RNA, 21 nt, Pseudomonas putida KT2440
cucgcgccgccgcugcugcgc

SEQ ID NO: 3594794 - RNA, 21 nt, Pseudomonas putida KT2440
cucgcgccuugaggaccuugc

SEQ ID NO: 3594795 - RNA, 21 nt, Pseudomonas putida KT2440
cucgcgcgcguauugcuccca

SEQ ID NO: 3594796 - RNA, 14 nt, Pseudomonas putida KT2440
cucgcgcugcgcag

SEQ ID NO: 3594797 - RNA, 18 nt, Pseudomonas putida KT2440
cucgcgcugcgcagccaa

SEQ ID NO: 3594798 - RNA, 12 nt, Pseudomonas putida KT2440
cucgcggcuggu

SEQ ID NO: 3594799 - RNA, 18 nt, Pseudomonas putida KT2440
cucgcgggcaaacccgcg

SEQ ID NO: 3594800 - RNA, 19 nt, Pseudomonas putida KT2440
cucgcgggcaaacccgcgc

SEQ ID NO: 3594801 - RNA, 17 nt, Pseudomonas putida KT2440
cucgcgggccuggagca

SEQ ID NO: 3594802 - RNA, 16 nt, Pseudomonas putida KT2440
cucgcggugccuucag

SEQ ID NO: 3594803 - RNA, 19 nt, Pseudomonas putida KT2440
cucgcucagcaacugggca

SEQ ID NO: 3594804 - RNA, 16 nt, Pseudomonas putida KT2440
cucgcucagcguacgc

SEQ ID NO: 3594805 - RNA, 14 nt, Pseudomonas putida KT2440
cucgcucaggcucu

SEQ ID NO: 3594806 - RNA, 15 nt, Pseudomonas putida KT2440
cucgcucagguaggc

SEQ ID NO: 3594807 - RNA, 16 nt, Pseudomonas putida KT2440
cucgcugccacgcaug

SEQ ID NO: 3594808 - RNA, 13 nt, Pseudomonas putida KT2440
cucgcugccccag

SEQ ID NO: 3594809 - RNA, 13 nt, Pseudomonas putida KT2440
cucgcugccggcg

SEQ ID NO: 3594810 - RNA, 15 nt, Pseudomonas putida KT2440
cucgcuggccaccag

SEQ ID NO: 3594811 - RNA, 18 nt, Pseudomonas putida KT2440
cucgcuggcuuguucggc

SEQ ID NO: 3594812 - RNA, 20 nt, Pseudomonas putida KT2440
cucgcugucguccagcucgc

SEQ ID NO: 3594813 - RNA, 22 nt, Pseudomonas putida KT2440
cucgcugucguccagcucgcgc

SEQ ID NO: 3594814 - RNA, 21 nt, Pseudomonas putida KT2440
cucgcuucauggccccaccca

SEQ ID NO: 3594815 - RNA, 20 nt, Pseudomonas putida KT2440
cucgcuuuccuugcacgcga

SEQ ID NO: 3594816 - RNA, 17 nt, Pseudomonas putida KT2440
cucggaaaggucggcgg

SEQ ID NO: 3594817 - RNA, 19 nt, Pseudomonas putida KT2440
cucggacaaauccaggucg

SEQ ID NO: 3594818 - RNA, 23 nt, Pseudomonas putida KT2440
cucggacggugguaucugguagg

SEQ ID NO: 3594819 - RNA, 17 nt, Pseudomonas putida KT2440
cucggcaaagcggcuga

SEQ ID NO: 3594820 - RNA, 23 nt, Pseudomonas putida KT2440
cucggcaaucacccgcagggucg

SEQ ID NO: 3594821 - RNA, 19 nt, Pseudomonas putida KT2440
cucggcaaucugcagcagc

SEQ ID NO: 3594822 - RNA, 15 nt, Pseudomonas putida KT2440
cucggcaaucugcuu

SEQ ID NO: 3594823 - RNA, 23 nt, Pseudomonas putida KT2440
cucggcaauugcguucuugccug

SEQ ID NO: 3594824 - RNA, 11 nt, Pseudomonas putida KT2440
cucggcacgcg

SEQ ID NO: 3594825 - RNA, 13 nt, Pseudomonas putida KT2440
cucggcacgcgcc

SEQ ID NO: 3594826 - RNA, 17 nt, Pseudomonas putida KT2440
cucggcagugaacucca

SEQ ID NO: 3594827 - RNA, 20 nt, Pseudomonas putida KT2440
cucggcaucuuuggcuucgc

SEQ ID NO: 3594828 - RNA, 16 nt, Pseudomonas putida KT2440
cucggccaccacccgc

SEQ ID NO: 3594829 - RNA, 18 nt, Pseudomonas putida KT2440
cucggccaccuggccuuc

SEQ ID NO: 3594830 - RNA, 11 nt, Pseudomonas putida KT2440
cucggccagca

SEQ ID NO: 3594831 - RNA, 11 nt, Pseudomonas putida KT2440
cucggccagcg

SEQ ID NO: 3594832 - RNA, 13 nt, Pseudomonas putida KT2440
cucggccagcggc

SEQ ID NO: 3594833 - RNA, 21 nt, Pseudomonas putida KT2440
cucggccagguacucgcgcug

SEQ ID NO: 3594834 - RNA, 16 nt, Pseudomonas putida KT2440
cucggccaggucgauc

SEQ ID NO: 3594835 - RNA, 23 nt, Pseudomonas putida KT2440
cucggccaguaccaggucgccag

SEQ ID NO: 3594836 - RNA, 13 nt, Pseudomonas putida KT2440
cucggccagugcg

SEQ ID NO: 3594837 - RNA, 15 nt, Pseudomonas putida KT2440
cucggccgaugccag

SEQ ID NO: 3594838 - RNA, 18 nt, Pseudomonas putida KT2440
cucggccggggccaggcg

SEQ ID NO: 3594839 - RNA, 14 nt, Pseudomonas putida KT2440
cucggccucccgcu

SEQ ID NO: 3594840 - RNA, 19 nt, Pseudomonas putida KT2440
cucggccucccgcuugcgg

SEQ ID NO: 3594841 - RNA, 22 nt, Pseudomonas putida KT2440
cucggccucgguacccgccagc

SEQ ID NO: 3594842 - RNA, 16 nt, Pseudomonas putida KT2440
cucggccugggcaggu

SEQ ID NO: 3594843 - RNA, 14 nt, Pseudomonas putida KT2440
cucggccuugccgu

SEQ ID NO: 3594844 - RNA, 17 nt, Pseudomonas putida KT2440
cucggccuugucuggca

SEQ ID NO: 3594845 - RNA, 16 nt, Pseudomonas putida KT2440
cucggcgaaaagccgg

SEQ ID NO: 3594846 - RNA, 15 nt, Pseudomonas putida KT2440
cucuuccuggcuggc

SEQ ID NO: 3594847 - RNA, 16 nt, Pseudomonas putida KT2440
cucuuccuggcuggca

SEQ ID NO: 3594848 - RNA, 17 nt, Pseudomonas putida KT2440
cucuucgauccgcgcca

SEQ ID NO: 3594849 - RNA, 22 nt, Pseudomonas putida KT2440
cucuucgauccgcgccaucagc

SEQ ID NO: 3594850 - RNA, 19 nt, Pseudomonas putida KT2440
cucuucgaucucuucggua

SEQ ID NO: 3594851 - RNA, 14 nt, Pseudomonas putida KT2440
cucuucgcagcaca

SEQ ID NO: 3594852 - RNA, 22 nt, Pseudomonas putida KT2440
cucuucgcggccuugcccgcga

SEQ ID NO: 3594853 - RNA, 17 nt, Pseudomonas putida KT2440
cucuucgcgggcucgcc

SEQ ID NO: 3594854 - RNA, 23 nt, Pseudomonas putida KT2440
cucuucgcgggcucgcccacucc

SEQ ID NO: 3594855 - RNA, 12 nt, Pseudomonas putida KT2440
cucuucgcgggu

SEQ ID NO: 3594856 - RNA, 20 nt, Pseudomonas putida KT2440
cucuucugccaguugcuucu

SEQ ID NO: 3594857 - RNA, 20 nt, Pseudomonas putida KT2440
cucuucuucaaggcugcucu

SEQ ID NO: 3594858 - RNA, 14 nt, Pseudomonas putida KT2440
cucuucuuucaggu

SEQ ID NO: 3594859 - RNA, 22 nt, Pseudomonas putida KT2440
cucuucuuucagguaacgggca

SEQ ID NO: 3594860 - RNA, 19 nt, Pseudomonas putida KT2440
cucuugaacugggcaucca

SEQ ID NO: 3594861 - RNA, 22 nt, Pseudomonas putida KT2440
cucuugaacugggcauccagcu

SEQ ID NO: 3594862 - RNA, 22 nt, Pseudomonas putida KT2440
cucuugagcuggccguccagcu

SEQ ID NO: 3594863 - RNA, 17 nt, Pseudomonas putida KT2440
cucuugcagcgagugcg

SEQ ID NO: 3594864 - RNA, 20 nt, Pseudomonas putida KT2440
cucuugcugcaacagcucca

SEQ ID NO: 3594865 - RNA, 17 nt, Pseudomonas putida KT2440
cucuugucgacagugaa

SEQ ID NO: 3594866 - RNA, 20 nt, Pseudomonas putida KT2440
cucuuguguugccacccggc

SEQ ID NO: 3594867 - RNA, 18 nt, Pseudomonas putida KT2440
cucuuucaggcacagcac

SEQ ID NO: 3594868 - RNA, 20 nt, Pseudomonas putida KT2440
cucuuucggcagcacccgcu

SEQ ID NO: 3594869 - RNA, 18 nt, Pseudomonas putida KT2440
cugaaaacaacccgauuu

SEQ ID NO: 3594870 - RNA, 15 nt, Pseudomonas putida KT2440
cugaaacccauccac

SEQ ID NO: 3594871 - RNA, 22 nt, Pseudomonas putida KT2440
cugaaacgcaaaaacgccccuc

SEQ ID NO: 3594872 - RNA, 15 nt, Pseudomonas putida KT2440
cugaaacgcccuugu

SEQ ID NO: 3594873 - RNA, 18 nt, Pseudomonas putida KT2440
cugaacaaggccuggccc

SEQ ID NO: 3594874 - RNA, 19 nt, Pseudomonas putida KT2440
cugaacaaggccuggccca

SEQ ID NO: 3594875 - RNA, 21 nt, Pseudomonas putida KT2440
cugaacaaggccuggcccagu

SEQ ID NO: 3594876 - RNA, 20 nt, Pseudomonas putida KT2440
cugaacaccugccagccccg

SEQ ID NO: 3594877 - RNA, 21 nt, Pseudomonas putida KT2440
cugaacaccugccagccccgc

SEQ ID NO: 3594878 - RNA, 23 nt, Pseudomonas putida KT2440
cugaacagcaucagccaugggca

SEQ ID NO: 3594879 - RNA, 13 nt, Pseudomonas putida KT2440
cugaacagcgccu

SEQ ID NO: 3594880 - RNA, 16 nt, Pseudomonas putida KT2440
cugaacagcgccuuga

SEQ ID NO: 3594881 - RNA, 17 nt, Pseudomonas putida KT2440
cugaacagcuucaacaa

SEQ ID NO: 3594882 - RNA, 20 nt, Pseudomonas putida KT2440
cugaacauugcagggcggcc

SEQ ID NO: 3594883 - RNA, 15 nt, Pseudomonas putida KT2440
cugaaccaccagugg

SEQ ID NO: 3594884 - RNA, 14 nt, Pseudomonas putida KT2440
cugaaccucaccgc

SEQ ID NO: 3594885 - RNA, 16 nt, Pseudomonas putida KT2440
cugaacgaugcccggg

SEQ ID NO: 3594886 - RNA, 23 nt, Pseudomonas putida KT2440
cugaacgaugcccgggccuucaa

SEQ ID NO: 3594887 - RNA, 16 nt, Pseudomonas putida KT2440
cugaacgcugcgcggg

SEQ ID NO: 3594888 - RNA, 17 nt, Pseudomonas putida KT2440
cugaacgcugcgcgggu

SEQ ID NO: 3594889 - RNA, 20 nt, Pseudomonas putida KT2440
cugaacggugaagucaacca

SEQ ID NO: 3594890 - RNA, 23 nt, Pseudomonas putida KT2440
cugaacggugaagucaaccaacu

SEQ ID NO: 3594891 - RNA, 16 nt, Pseudomonas putida KT2440
cugaacuauccgacac

SEQ ID NO: 3594892 - RNA, 22 nt, Pseudomonas putida KT2440
cugaacuauccgacacagucgu

SEQ ID NO: 3594893 - RNA, 18 nt, Pseudomonas putida KT2440
cugaacuucaaccgcacc

SEQ ID NO: 3594894 - RNA, 14 nt, Pseudomonas putida KT2440
cugaacuuccaggu

SEQ ID NO: 3594895 - RNA, 19 nt, Pseudomonas putida KT2440
cugaacuuggccuccagca

SEQ ID NO: 3594896 - RNA, 19 nt, Pseudomonas putida KT2440
cugaagaagcuaccccaca

SEQ ID NO: 3594897 - RNA, 18 nt, Pseudomonas putida KT2440
cugaagauuuucagccaa

SEQ ID NO: 3594898 - RNA, 15 nt, Pseudomonas putida KT2440
cugaagcccuggaug

SEQ ID NO: 3594899 - RNA, 12 nt, Pseudomonas putida KT2440
cugaagcucucc

SEQ ID NO: 3594900 - RNA, 15 nt, Pseudomonas putida KT2440
cugaagcucuccagc

SEQ ID NO: 3594901 - RNA, 16 nt, Pseudomonas putida KT2440
cugaagcucuccagca

SEQ ID NO: 3594902 - RNA, 17 nt, Pseudomonas putida KT2440
cugaagcucuccagcag

SEQ ID NO: 3594903 - RNA, 20 nt, Pseudomonas putida KT2440
cugaagcucuccagcagguu

SEQ ID NO: 3594904 - RNA, 20 nt, Pseudomonas putida KT2440
cugaagggccgaaaggugca

SEQ ID NO: 3594905 - RNA, 14 nt, Pseudomonas putida KT2440
cugaaggugcugua

SEQ ID NO: 3594906 - RNA, 21 nt, Pseudomonas putida KT2440
cugaagucauaccacacguug

SEQ ID NO: 3594907 - RNA, 16 nt, Pseudomonas putida KT2440
cugaagugccaaggcu

SEQ ID NO: 3594908 - RNA, 18 nt, Pseudomonas putida KT2440
cugaaucagcaaaccgac

SEQ ID NO: 3594909 - RNA, 21 nt, Pseudomonas putida KT2440
cugaaucagcaaaccgaccag

SEQ ID NO: 3594910 - RNA, 18 nt, Pseudomonas putida KT2440
cugaaucuugcgcgccag

SEQ ID NO: 3594911 - RNA, 20 nt, Pseudomonas putida KT2440
cugaaucuugcgcgccagcg

SEQ ID NO: 3594912 - RNA, 23 nt, Pseudomonas putida KT2440
cugaaucuugcgcgccagcgcau

SEQ ID NO: 3594913 - RNA, 13 nt, Pseudomonas putida KT2440
cugaaugaaaaag

SEQ ID NO: 3594914 - RNA, 22 nt, Pseudomonas putida KT2440
cugaauggccuuggccaucacu

SEQ ID NO: 3594915 - RNA, 21 nt, Pseudomonas putida KT2440
cugaauucguauauguauuug

SEQ ID NO: 3594916 - RNA, 16 nt, Pseudomonas putida KT2440
cugacaaagccugcac

SEQ ID NO: 3594917 - RNA, 18 nt, Pseudomonas putida KT2440
cugacaaugcgacugagc

SEQ ID NO: 3594918 - RNA, 20 nt, Pseudomonas putida KT2440
cugacacauaggcagccacc

SEQ ID NO: 3594919 - RNA, 16 nt, Pseudomonas putida KT2440
cugacagcaggaacag

SEQ ID NO: 3594920 - RNA, 17 nt, Pseudomonas putida KT2440
cugacagcaggaacagc

SEQ ID NO: 3594921 - RNA, 13 nt, Pseudomonas putida KT2440
cugacagcaugcc

SEQ ID NO: 3594922 - RNA, 22 nt, Pseudomonas putida KT2440
cugacagcaugccccgggugca

SEQ ID NO: 3594923 - RNA, 19 nt, Pseudomonas putida KT2440
cugacaggcgaucagucag

SEQ ID NO: 3594924 - RNA, 21 nt, Pseudomonas putida KT2440
cugacauaacaagaacaacac

SEQ ID NO: 3594925 - RNA, 16 nt, Pseudomonas putida KT2440
cugaccaacaggcugg

SEQ ID NO: 3594926 - RNA, 15 nt, Pseudomonas putida KT2440
cugaccaauccagcc

SEQ ID NO: 3594927 - RNA, 17 nt, Pseudomonas putida KT2440
cugaccaauccagcccu

SEQ ID NO: 3594928 - RNA, 18 nt, Pseudomonas putida KT2440
cugaccaauccagcccuc

SEQ ID NO: 3594929 - RNA, 21 nt, Pseudomonas putida KT2440
cugaccaccguuacgccguug

SEQ ID NO: 3594930 - RNA, 16 nt, Pseudomonas putida KT2440
cugaccacgccgaagc

SEQ ID NO: 3594931 - RNA, 18 nt, Pseudomonas putida KT2440
cugaccacgccgaagcgc

SEQ ID NO: 3594932 - RNA, 14 nt, Pseudomonas putida KT2440
cugaccagcccggc

SEQ ID NO: 3594933 - RNA, 18 nt, Pseudomonas putida KT2440
cugaccauaccucccgca

SEQ ID NO: 3594934 - RNA, 22 nt, Pseudomonas putida KT2440
cugaccaucagccuguggguau

SEQ ID NO: 3594935 - RNA, 11 nt, Pseudomonas putida KT2440
cugaccccacc

SEQ ID NO: 3594936 - RNA, 19 nt, Pseudomonas putida KT2440
cugacccgcgccucgaucc

SEQ ID NO: 3594937 - RNA, 11 nt, Pseudomonas putida KT2440
cugacccgcuu

SEQ ID NO: 3594938 - RNA, 15 nt, Pseudomonas putida KT2440
cugacccucaagugc

SEQ ID NO: 3594939 - RNA, 23 nt, Pseudomonas putida KT2440
cugaccgaugaucugccgggcca

SEQ ID NO: 3594940 - RNA, 19 nt, Pseudomonas putida KT2440
cugaccgaugccgccguug

SEQ ID NO: 3594941 - RNA, 14 nt, Pseudomonas putida KT2440
cugaccgccugcgc

SEQ ID NO: 3594942 - RNA, 21 nt, Pseudomonas putida KT2440
cugaccgcgcauuugcuccag

SEQ ID NO: 3594943 - RNA, 12 nt, Pseudomonas putida KT2440
cugaccggcacu

SEQ ID NO: 3594944 - RNA, 17 nt, Pseudomonas putida KT2440
cugaccggcacugcaca

SEQ ID NO: 3594945 - RNA, 17 nt, Pseudomonas putida KT2440
cugaccgggacgcaggc

SEQ ID NO: 3594946 - RNA, 14 nt, Pseudomonas putida KT2440
cugaccggucagcc

SEQ ID NO: 3594947 - RNA, 15 nt, Pseudomonas putida KT2440
cugaccugugcugaa

SEQ ID NO: 3594948 - RNA, 19 nt, Pseudomonas putida KT2440
cugaccugugcugaauuuu

SEQ ID NO: 3594949 - RNA, 15 nt, Pseudomonas putida KT2440
cugaccuugcugcuc

SEQ ID NO: 3594950 - RNA, 15 nt, Pseudomonas putida KT2440
cugaccuuggacagg

SEQ ID NO: 3594951 - RNA, 17 nt, Pseudomonas putida KT2440
cugcaacuccucgauca

SEQ ID NO: 3594952 - RNA, 17 nt, Pseudomonas putida KT2440
cugcaagccggcgaaca

SEQ ID NO: 3594953 - RNA, 18 nt, Pseudomonas putida KT2440
cugcaagcgaugcacgcc

SEQ ID NO: 3594954 - RNA, 21 nt, Pseudomonas putida KT2440
cugcaagcgaugcacgccagc

SEQ ID NO: 3594955 - RNA, 23 nt, Pseudomonas putida KT2440
cugcaaggcaaugcccauggcca

SEQ ID NO: 3594956 - RNA, 16 nt, Pseudomonas putida KT2440
cugcaaggccagcgga

SEQ ID NO: 3594957 - RNA, 21 nt, Pseudomonas putida KT2440
cugcaagguccaggcgugggu

SEQ ID NO: 3594958 - RNA, 21 nt, Pseudomonas putida KT2440
cugcaauaacgccguuucagc

SEQ ID NO: 3594959 - RNA, 15 nt, Pseudomonas putida KT2440
cugcaaucagcucac

SEQ ID NO: 3594960 - RNA, 19 nt, Pseudomonas putida KT2440
cugcaaucagcucacaggc

SEQ ID NO: 3594961 - RNA, 18 nt, Pseudomonas putida KT2440
cugcaauccgaacuuaau

SEQ ID NO: 3594962 - RNA, 13 nt, Pseudomonas putida KT2440
cugcaaugccgcu

SEQ ID NO: 3594963 - RNA, 18 nt, Pseudomonas putida KT2440
cugcaauucgcuguacag

SEQ ID NO: 3594964 - RNA, 17 nt, Pseudomonas putida KT2440
cugcacacugcccagca

SEQ ID NO: 3594965 - RNA, 14 nt, Pseudomonas putida KT2440
cugcacacugcgcu

SEQ ID NO: 3594966 - RNA, 15 nt, Pseudomonas putida KT2440
cugcacacugcgcuu

SEQ ID NO: 3594967 - RNA, 14 nt, Pseudomonas putida KT2440
cugcacagcgcgga

SEQ ID NO: 3594968 - RNA, 13 nt, Pseudomonas putida KT2440
cugcacaggccag

SEQ ID NO: 3594969 - RNA, 14 nt, Pseudomonas putida KT2440
cugcacaggccagc

SEQ ID NO: 3594970 - RNA, 16 nt, Pseudomonas putida KT2440
cugcacaggccagccc

SEQ ID NO: 3594971 - RNA, 17 nt, Pseudomonas putida KT2440
cugcacaggccagcccc

SEQ ID NO: 3594972 - RNA, 21 nt, Pseudomonas putida KT2440
cugcacauacaaaaugugccg

SEQ ID NO: 3594973 - RNA, 17 nt, Pseudomonas putida KT2440
cugcacaucgcuucugc

SEQ ID NO: 3594974 - RNA, 20 nt, Pseudomonas putida KT2440
cugcacaucggccaccgccg

SEQ ID NO: 3594975 - RNA, 18 nt, Pseudomonas putida KT2440
cugcaccacaugcacggc

SEQ ID NO: 3594976 - RNA, 18 nt, Pseudomonas putida KT2440
cugcaccaccugcuccug

SEQ ID NO: 3594977 - RNA, 24 nt, Pseudomonas putida KT2440
cugcaccaccugcuccugguccug

SEQ ID NO: 3594978 - RNA, 18 nt, Pseudomonas putida KT2440
cugcaccacggcaguggc

SEQ ID NO: 3594979 - RNA, 13 nt, Pseudomonas putida KT2440
cugcaccaguucc

SEQ ID NO: 3594980 - RNA, 18 nt, Pseudomonas putida KT2440
cugcaccaguuccuggcg

SEQ ID NO: 3594981 - RNA, 20 nt, Pseudomonas putida KT2440
cugcaccaguuccuggcgcu

SEQ ID NO: 3594982 - RNA, 16 nt, Pseudomonas putida KT2440
cugcaccaugaauucc

SEQ ID NO: 3594983 - RNA, 22 nt, Pseudomonas putida KT2440
cugcacccagcguauagccacc

SEQ ID NO: 3594984 - RNA, 23 nt, Pseudomonas putida KT2440
cugcacccagcguauagccaccg

SEQ ID NO: 3594985 - RNA, 21 nt, Pseudomonas putida KT2440
cugcacccaggcucucagccc

SEQ ID NO: 3594986 - RNA, 15 nt, Pseudomonas putida KT2440
cugcacccgccagcc

SEQ ID NO: 3594987 - RNA, 18 nt, Pseudomonas putida KT2440
cugcacccgcgcgcccgc

SEQ ID NO: 3594988 - RNA, 19 nt, Pseudomonas putida KT2440
cugcacccgugcagggcug

SEQ ID NO: 3594989 - RNA, 19 nt, Pseudomonas putida KT2440
cugcaccgaagcaccacug

SEQ ID NO: 3594990 - RNA, 16 nt, Pseudomonas putida KT2440
cugcaccgaaggccgc

SEQ ID NO: 3594991 - RNA, 18 nt, Pseudomonas putida KT2440
cugcaccgaaggccgccg

SEQ ID NO: 3594992 - RNA, 21 nt, Pseudomonas putida KT2440
cugcaccgaaggccgccggca

SEQ ID NO: 3594993 - RNA, 16 nt, Pseudomonas putida KT2440
cugcaccgaccgugca

SEQ ID NO: 3594994 - RNA, 22 nt, Pseudomonas putida KT2440
cugcaccgaccgugcauacacc

SEQ ID NO: 3594995 - RNA, 17 nt, Pseudomonas putida KT2440
cugcaccgcagccccag

SEQ ID NO: 3594996 - RNA, 18 nt, Pseudomonas putida KT2440
cugcaccgccaccccggc

SEQ ID NO: 3594997 - RNA, 14 nt, Pseudomonas putida KT2440
cugcaccgccuugu

SEQ ID NO: 3594998 - RNA, 17 nt, Pseudomonas putida KT2440
cugcaccggcagcgcaa

SEQ ID NO: 3594999 - RNA, 22 nt, Pseudomonas putida KT2440
cugcaccugacgagcgaaauag

SEQ ID NO: 3595000 - RNA, 12 nt, Pseudomonas putida KT2440
cugcaccuggcu

SEQ ID NO: 3595001 - RNA, 18 nt, Pseudomonas putida KT2440
cugcaccuggcugagguu

SEQ ID NO: 3595002 - RNA, 14 nt, Pseudomonas putida KT2440
cugcacgcgugccu

SEQ ID NO: 3595003 - RNA, 16 nt, Pseudomonas putida KT2440
cugcacgcucagugug

SEQ ID NO: 3595004 - RNA, 22 nt, Pseudomonas putida KT2440
cugcacgcuucgauccgcgccc

SEQ ID NO: 3595005 - RNA, 19 nt, Pseudomonas putida KT2440
cugcacggcaauugccacc

SEQ ID NO: 3595006 - RNA, 19 nt, Pseudomonas putida KT2440
cugcacgucgcgcagggcc

SEQ ID NO: 3595007 - RNA, 23 nt, Pseudomonas putida KT2440
cugcacgucgcgcagggccuugu

SEQ ID NO: 3595008 - RNA, 23 nt, Pseudomonas putida KT2440
cugcacgucgcugucuucugcca

SEQ ID NO: 3595009 - RNA, 19 nt, Pseudomonas putida KT2440
cugcacuaagggcaggccu

SEQ ID NO: 3595010 - RNA, 17 nt, Pseudomonas putida KT2440
cugcacucccgcugcug

SEQ ID NO: 3595011 - RNA, 17 nt, Pseudomonas putida KT2440
cugcacugcacccucuu

SEQ ID NO: 3595012 - RNA, 13 nt, Pseudomonas putida KT2440
cugcacugccagc

SEQ ID NO: 3595013 - RNA, 16 nt, Pseudomonas putida KT2440
cugcacugccagcgcc

SEQ ID NO: 3595014 - RNA, 13 nt, Pseudomonas putida KT2440
cugcacuggccuc

SEQ ID NO: 3595015 - RNA, 16 nt, Pseudomonas putida KT2440
cugcacuggccucuuc

SEQ ID NO: 3595016 - RNA, 14 nt, Pseudomonas putida KT2440
cugcacuuccacac

SEQ ID NO: 3595017 - RNA, 15 nt, Pseudomonas putida KT2440
cugcagaacauggcc

SEQ ID NO: 3595018 - RNA, 16 nt, Pseudomonas putida KT2440
cugcagaacauggccg

SEQ ID NO: 3595019 - RNA, 17 nt, Pseudomonas putida KT2440
cugcagaacauggccga

SEQ ID NO: 3595020 - RNA, 17 nt, Pseudomonas putida KT2440
cugcagaaccgccagca

SEQ ID NO: 3595021 - RNA, 18 nt, Pseudomonas putida KT2440
cugcagaaccgccagcac

SEQ ID NO: 3595022 - RNA, 14 nt, Pseudomonas putida KT2440
cugcagacaguggu

SEQ ID NO: 3595023 - RNA, 16 nt, Pseudomonas putida KT2440
cugcagacgccgucaa

SEQ ID NO: 3595024 - RNA, 17 nt, Pseudomonas putida KT2440
cugcagagacaucucca

SEQ ID NO: 3595025 - RNA, 22 nt, Pseudomonas putida KT2440
cugcagagcgucaaccaggcgc

SEQ ID NO: 3595026 - RNA, 13 nt, Pseudomonas putida KT2440
cugcagagcucag

SEQ ID NO: 3595027 - RNA, 17 nt, Pseudomonas putida KT2440
cugcagagcucagcgug

SEQ ID NO: 3595028 - RNA, 15 nt, Pseudomonas putida KT2440
cugcagaucaccagc

SEQ ID NO: 3595029 - RNA, 18 nt, Pseudomonas putida KT2440
cugcagaucaccagcucg

SEQ ID NO: 3595030 - RNA, 20 nt, Pseudomonas putida KT2440
cugcagaucaccagcucgcc

SEQ ID NO: 3595031 - RNA, 14 nt, Pseudomonas putida KT2440
cugcagcaccagcu

SEQ ID NO: 3595032 - RNA, 23 nt, Pseudomonas putida KT2440
cugcagcaccagcuuguugccgg

SEQ ID NO: 3595033 - RNA, 14 nt, Pseudomonas putida KT2440
cugcagcacugccu

SEQ ID NO: 3595034 - RNA, 16 nt, Pseudomonas putida KT2440
cugcagcacugccugc

SEQ ID NO: 3595035 - RNA, 17 nt, Pseudomonas putida KT2440
cugcagcacugccugca

SEQ ID NO: 3595036 - RNA, 19 nt, Pseudomonas putida KT2440
cugcagcagcgcgccgaac

SEQ ID NO: 3595037 - RNA, 13 nt, Pseudomonas putida KT2440
cugcagcagcuuc

SEQ ID NO: 3595038 - RNA, 13 nt, Pseudomonas putida KT2440
cugcagcaggcug

SEQ ID NO: 3595039 - RNA, 20 nt, Pseudomonas putida KT2440
cugcagcauggcgucggcga

SEQ ID NO: 3595040 - RNA, 14 nt, Pseudomonas putida KT2440
cugcagcccggcaa

SEQ ID NO: 3595041 - RNA, 18 nt, Pseudomonas putida KT2440
cugcagcccggcaaacuc

SEQ ID NO: 3595042 - RNA, 14 nt, Pseudomonas putida KT2440
cugcagccgcaccu

SEQ ID NO: 3595043 - RNA, 17 nt, Pseudomonas putida KT2440
cugcagccgcaccugcc

SEQ ID NO: 3595044 - RNA, 18 nt, Pseudomonas putida KT2440
cugcagccgcaccugccc

SEQ ID NO: 3595045 - RNA, 19 nt, Pseudomonas putida KT2440
cugcagccugacgcgccgc

SEQ ID NO: 3595046 - RNA, 23 nt, Pseudomonas putida KT2440
cugcagcgaacacgaaaaagcca

SEQ ID NO: 3595047 - RNA, 18 nt, Pseudomonas putida KT2440
cugcagcgcgucauccgc

SEQ ID NO: 3595048 - RNA, 20 nt, Pseudomonas putida KT2440
cugcagcgcguuggcgaucg

SEQ ID NO: 3595049 - RNA, 15 nt, Pseudomonas putida KT2440
cugcagcggcaaggu

SEQ ID NO: 3595050 - RNA, 19 nt, Pseudomonas putida KT2440
cugcagcggcaagguagcc

SEQ ID NO: 3595051 - RNA, 23 nt, Pseudomonas putida KT2440
cugcagcguauucagauuacgcg

SEQ ID NO: 3595052 - RNA, 13 nt, Pseudomonas putida KT2440
cugcagcucagcc

SEQ ID NO: 3595053 - RNA, 15 nt, Pseudomonas putida KT2440
cugcagcucagccag

SEQ ID NO: 3595054 - RNA, 10 nt, Pseudomonas putida KT2440
cugcagcuuc

SEQ ID NO: 3595055 - RNA, 15 nt, Pseudomonas putida KT2440
cugcagcuucccggc

SEQ ID NO: 3595056 - RNA, 21 nt, Pseudomonas putida KT2440
cugcccauaaaagccucagcg

SEQ ID NO: 3595057 - RNA, 15 nt, Pseudomonas putida KT2440
cugccccagcgucac

SEQ ID NO: 3595058 - RNA, 19 nt, Pseudomonas putida KT2440
cugccccaugcgaacugca

SEQ ID NO: 3595059 - RNA, 23 nt, Pseudomonas putida KT2440
cugcccccccauacggucgauga

SEQ ID NO: 3595060 - RNA, 17 nt, Pseudomonas putida KT2440
cugccccucgaucaacg

SEQ ID NO: 3595061 - RNA, 12 nt, Pseudomonas putida KT2440
cugcccgagagc

SEQ ID NO: 3595062 - RNA, 15 nt, Pseudomonas putida KT2440
cugcccgagagcagu

SEQ ID NO: 3595063 - RNA, 18 nt, Pseudomonas putida KT2440
cugcccgagagcaguucc

SEQ ID NO: 3595064 - RNA, 15 nt, Pseudomonas putida KT2440
cugcccgcagcuuca

SEQ ID NO: 3595065 - RNA, 20 nt, Pseudomonas putida KT2440
cugcccgccccccaccuggc

SEQ ID NO: 3595066 - RNA, 17 nt, Pseudomonas putida KT2440
cugcccgcccucacuca

SEQ ID NO: 3595067 - RNA, 22 nt, Pseudomonas putida KT2440
cugcccgcgccacccgcugggc

SEQ ID NO: 3595068 - RNA, 21 nt, Pseudomonas putida KT2440
cugcccggcauacuugggcgc

SEQ ID NO: 3595069 - RNA, 14 nt, Pseudomonas putida KT2440
cugcccggccagca

SEQ ID NO: 3595070 - RNA, 20 nt, Pseudomonas putida KT2440
cugcccggcguucaggcgcg

SEQ ID NO: 3595071 - RNA, 15 nt, Pseudomonas putida KT2440
cugcccgggcaaagc

SEQ ID NO: 3595072 - RNA, 16 nt, Pseudomonas putida KT2440
cugcccgggcaaagca

SEQ ID NO: 3595073 - RNA, 13 nt, Pseudomonas putida KT2440
cugcccgggccgc

SEQ ID NO: 3595074 - RNA, 19 nt, Pseudomonas putida KT2440
cugcccgggccgcuugcuc

SEQ ID NO: 3595075 - RNA, 13 nt, Pseudomonas putida KT2440
cugcccgguacgc

SEQ ID NO: 3595076 - RNA, 22 nt, Pseudomonas putida KT2440
cugcccgucaguuugggcgggc

SEQ ID NO: 3595077 - RNA, 16 nt, Pseudomonas putida KT2440
cugcccguccggcaug

SEQ ID NO: 3595078 - RNA, 22 nt, Pseudomonas putida KT2440
cugcccguccggcaugcgccga

SEQ ID NO: 3595079 - RNA, 18 nt, Pseudomonas putida KT2440
cugcccgugccucgcgca

SEQ ID NO: 3595080 - RNA, 16 nt, Pseudomonas putida KT2440
cugcccguugcgcauc

SEQ ID NO: 3595081 - RNA, 17 nt, Pseudomonas putida KT2440
cugcccucggccggggc

SEQ ID NO: 3595082 - RNA, 13 nt, Pseudomonas putida KT2440
cugcccucgggca

SEQ ID NO: 3595083 - RNA, 14 nt, Pseudomonas putida KT2440
cugcccucgggcag

SEQ ID NO: 3595084 - RNA, 15 nt, Pseudomonas putida KT2440
cugcccucgggcagc

SEQ ID NO: 3595085 - RNA, 22 nt, Pseudomonas putida KT2440
cugcccugcauggcauucgcca

SEQ ID NO: 3595086 - RNA, 13 nt, Pseudomonas putida KT2440
cugcccuuccugg

SEQ ID NO: 3595087 - RNA, 19 nt, Pseudomonas putida KT2440
cugccgaaacuccgguaac

SEQ ID NO: 3595088 - RNA, 20 nt, Pseudomonas putida KT2440
cugccgaagaacgcgagcgu

SEQ ID NO: 3595089 - RNA, 19 nt, Pseudomonas putida KT2440
cugccgacaaacguaccag

SEQ ID NO: 3595090 - RNA, 19 nt, Pseudomonas putida KT2440
cugccgaccugcgccggga

SEQ ID NO: 3595091 - RNA, 16 nt, Pseudomonas putida KT2440
cugccgaccuugggcc

SEQ ID NO: 3595092 - RNA, 15 nt, Pseudomonas putida KT2440
cugccgaggccaugu

SEQ ID NO: 3595093 - RNA, 17 nt, Pseudomonas putida KT2440
cugccgaggccaugugc

SEQ ID NO: 3595094 - RNA, 18 nt, Pseudomonas putida KT2440
cugccgaggccaugugcu

SEQ ID NO: 3595095 - RNA, 21 nt, Pseudomonas putida KT2440
cugccgaggcgccgacgauac

SEQ ID NO: 3595096 - RNA, 17 nt, Pseudomonas putida KT2440
cugccgaucaccgugcc

SEQ ID NO: 3595097 - RNA, 21 nt, Pseudomonas putida KT2440
cugccgaucuucgcccugggc

SEQ ID NO: 3595098 - RNA, 17 nt, Pseudomonas putida KT2440
cugccgaugcgcgugca

SEQ ID NO: 3595099 - RNA, 23 nt, Pseudomonas putida KT2440
cugccgaugggcacuggccaccc

SEQ ID NO: 3595100 - RNA, 20 nt, Pseudomonas putida KT2440
cugccgcaccagguccacca

SEQ ID NO: 3595101 - RNA, 13 nt, Pseudomonas putida KT2440
cugccgcaccugc

SEQ ID NO: 3595102 - RNA, 13 nt, Pseudomonas putida KT2440
cugccgcagcugg

SEQ ID NO: 3595103 - RNA, 17 nt, Pseudomonas putida KT2440
cugccgcauucgcgggu

SEQ ID NO: 3595104 - RNA, 17 nt, Pseudomonas putida KT2440
cugccgccaaccagcuc

SEQ ID NO: 3595105 - RNA, 15 nt, Pseudomonas putida KT2440
cugccgcccucuugc

SEQ ID NO: 3595106 - RNA, 13 nt, Pseudomonas putida KT2440
cugccgccuucuc

SEQ ID NO: 3595107 - RNA, 16 nt, Pseudomonas putida KT2440
cugccgccuucuccag

SEQ ID NO: 3595108 - RNA, 15 nt, Pseudomonas putida KT2440
cugccgccuugugca

SEQ ID NO: 3595109 - RNA, 23 nt, Pseudomonas putida KT2440
cugccgcgauaagcgcgauaggg

SEQ ID NO: 3595110 - RNA, 16 nt, Pseudomonas putida KT2440
cugccgcgcagcccaa

SEQ ID NO: 3595111 - RNA, 15 nt, Pseudomonas putida KT2440
cugccgcgccgccgc

SEQ ID NO: 3595112 - RNA, 18 nt, Pseudomonas putida KT2440
cugccgcggguggcuucg

SEQ ID NO: 3595113 - RNA, 14 nt, Pseudomonas putida KT2440
cugccgcugaccug

SEQ ID NO: 3595114 - RNA, 21 nt, Pseudomonas putida KT2440
cugccgcuucgcggaacucgg

SEQ ID NO: 3595115 - RNA, 16 nt, Pseudomonas putida KT2440
cugccggaccugccgc

SEQ ID NO: 3595116 - RNA, 19 nt, Pseudomonas putida KT2440
cugccggaccugccgcagc

SEQ ID NO: 3595117 - RNA, 15 nt, Pseudomonas putida KT2440
cugccggaucuggca

SEQ ID NO: 3595118 - RNA, 17 nt, Pseudomonas putida KT2440
cugccggaucuggcagc

SEQ ID NO: 3595119 - RNA, 15 nt, Pseudomonas putida KT2440
cugccggcaccgugg

SEQ ID NO: 3595120 - RNA, 16 nt, Pseudomonas putida KT2440
cugccggcaccguggc

SEQ ID NO: 3595121 - RNA, 19 nt, Pseudomonas putida KT2440
cugccggcauaacggcugg

SEQ ID NO: 3595122 - RNA, 17 nt, Pseudomonas putida KT2440
cugccggccagcgccug

SEQ ID NO: 3595123 - RNA, 18 nt, Pseudomonas putida KT2440
cugccggccagcgccugc

SEQ ID NO: 3595124 - RNA, 18 nt, Pseudomonas putida KT2440
cugccggcgaauccagcc

SEQ ID NO: 3595125 - RNA, 17 nt, Pseudomonas putida KT2440
cugccggcgccuccagc

SEQ ID NO: 3595126 - RNA, 18 nt, Pseudomonas putida KT2440
cugccggcguggcgagcu

SEQ ID NO: 3595127 - RNA, 21 nt, Pseudomonas putida KT2440
cugccgggcaaagcgggucgc

SEQ ID NO: 3595128 - RNA, 16 nt, Pseudomonas putida KT2440
cugccgggcaucgauc

SEQ ID NO: 3595129 - RNA, 16 nt, Pseudomonas putida KT2440
cugccgggccagggua

SEQ ID NO: 3595130 - RNA, 15 nt, Pseudomonas putida KT2440
cugccgggccgggca

SEQ ID NO: 3595131 - RNA, 15 nt, Pseudomonas putida KT2440
cugccggggcuuugu

SEQ ID NO: 3595132 - RNA, 24 nt, Pseudomonas putida KT2440
cugccggggcuuuguuuacaaccu

SEQ ID NO: 3595133 - RNA, 16 nt, Pseudomonas putida KT2440
cugccgggucaaggcc

SEQ ID NO: 3595134 - RNA, 18 nt, Pseudomonas putida KT2440
cugccgggucaaggccag

SEQ ID NO: 3595135 - RNA, 22 nt, Pseudomonas putida KT2440
cugccgggucaaggccagcgcc

SEQ ID NO: 3595136 - RNA, 23 nt, Pseudomonas putida KT2440
cugccgggucaaggccagcgccu

SEQ ID NO: 3595137 - RNA, 16 nt, Pseudomonas putida KT2440
cugccgggucggccug

SEQ ID NO: 3595138 - RNA, 18 nt, Pseudomonas putida KT2440
cugccgggucggccugcu

SEQ ID NO: 3595139 - RNA, 20 nt, Pseudomonas putida KT2440
cugccgggucggccugcucg

SEQ ID NO: 3595140 - RNA, 19 nt, Pseudomonas putida KT2440
cugccgguacagccuacca

SEQ ID NO: 3595141 - RNA, 23 nt, Pseudomonas putida KT2440
cugccgguagugaugcaucagcu

SEQ ID NO: 3595142 - RNA, 14 nt, Pseudomonas putida KT2440
cugccggucggccu

SEQ ID NO: 3595143 - RNA, 19 nt, Pseudomonas putida KT2440
cugccgguguucgcgggug

SEQ ID NO: 3595144 - RNA, 13 nt, Pseudomonas putida KT2440
cugccgucagccg

SEQ ID NO: 3595145 - RNA, 20 nt, Pseudomonas putida KT2440
cugccgucauugcucaccgu

SEQ ID NO: 3595146 - RNA, 19 nt, Pseudomonas putida KT2440
cugccgugaucgccgggcg

SEQ ID NO: 3595147 - RNA, 16 nt, Pseudomonas putida KT2440
cugccguucacugaug

SEQ ID NO: 3595148 - RNA, 16 nt, Pseudomonas putida KT2440
cugccguuguucggca

SEQ ID NO: 3595149 - RNA, 22 nt, Pseudomonas putida KT2440
cugccguuguucggcaaaggcc

SEQ ID NO: 3595150 - RNA, 18 nt, Pseudomonas putida KT2440
cugccguuugcuggccug

SEQ ID NO: 3595151 - RNA, 20 nt, Pseudomonas putida KT2440
cugccguuugcuggccugca

SEQ ID NO: 3595152 - RNA, 15 nt, Pseudomonas putida KT2440
cugccuaccaccgca

SEQ ID NO: 3595153 - RNA, 22 nt, Pseudomonas putida KT2440
cugccucaauaccccgcccucu

SEQ ID NO: 3595154 - RNA, 16 nt, Pseudomonas putida KT2440
cugccuccgccaagca

SEQ ID NO: 3595155 - RNA, 20 nt, Pseudomonas putida KT2440
cugccuccgccaagcacgca

SEQ ID NO: 3595156 - RNA, 21 nt, Pseudomonas putida KT2440
cugccugcaauucgcuguaca

SEQ ID NO: 3595157 - RNA, 19 nt, Pseudomonas putida KT2440
cugccugcaugcgugccuu

SEQ ID NO: 3595158 - RNA, 17 nt, Pseudomonas putida KT2440
cugccugcugcaacagc

SEQ ID NO: 3595159 - RNA, 15 nt, Pseudomonas putida KT2440
cugccuggccacugu

SEQ ID NO: 3595160 - RNA, 17 nt, Pseudomonas putida KT2440
cugccuggccacuguug

SEQ ID NO: 3595161 - RNA, 13 nt, Pseudomonas putida KT2440
cugcgggugucga

SEQ ID NO: 3595162 - RNA, 16 nt, Pseudomonas putida KT2440
cugcggucgagcugcc

SEQ ID NO: 3595163 - RNA, 23 nt, Pseudomonas putida KT2440
cugcgguggucugguugaccgag

SEQ ID NO: 3595164 - RNA, 12 nt, Pseudomonas putida KT2440
cugcgguguguu

SEQ ID NO: 3595165 - RNA, 20 nt, Pseudomonas putida KT2440
cugcgguguguuugucgaca

SEQ ID NO: 3595166 - RNA, 16 nt, Pseudomonas putida KT2440
cugcguacccagcccc

SEQ ID NO: 3595167 - RNA, 21 nt, Pseudomonas putida KT2440
cugcguauuuuugcgccaggc

SEQ ID NO: 3595168 - RNA, 16 nt, Pseudomonas putida KT2440
cugcgucgacucuucc

SEQ ID NO: 3595169 - RNA, 14 nt, Pseudomonas putida KT2440
cugcgugaccgccc

SEQ ID NO: 3595170 - RNA, 15 nt, Pseudomonas putida KT2440
cugcgugaccgcccc

SEQ ID NO: 3595171 - RNA, 15 nt, Pseudomonas putida KT2440
cugcgugauggcagc

SEQ ID NO: 3595172 - RNA, 17 nt, Pseudomonas putida KT2440
cugcgugauggcagcua

SEQ ID NO: 3595173 - RNA, 17 nt, Pseudomonas putida KT2440
cugcgugccugcugcuc

SEQ ID NO: 3595174 - RNA, 13 nt, Pseudomonas putida KT2440
cugcguggugccu

SEQ ID NO: 3595175 - RNA, 12 nt, Pseudomonas putida KT2440
cugcguucaggc

SEQ ID NO: 3595176 - RNA, 14 nt, Pseudomonas putida KT2440
cugcguucaggcag

SEQ ID NO: 3595177 - RNA, 17 nt, Pseudomonas putida KT2440
cugcguucaggcaggaa

SEQ ID NO: 3595178 - RNA, 11 nt, Pseudomonas putida KT2440
cugcguuguug

SEQ ID NO: 3595179 - RNA, 14 nt, Pseudomonas putida KT2440
cugcguuucgcugg

SEQ ID NO: 3595180 - RNA, 21 nt, Pseudomonas putida KT2440
cugcguuucgcuggccugccc

SEQ ID NO: 3595181 - RNA, 20 nt, Pseudomonas putida KT2440
cugcuaaaggcauucgcggg

SEQ ID NO: 3595182 - RNA, 18 nt, Pseudomonas putida KT2440
cugcuaggauucagcacg

SEQ ID NO: 3595183 - RNA, 23 nt, Pseudomonas putida KT2440
cugcuauaucucugguacaacaa

SEQ ID NO: 3595184 - RNA, 15 nt, Pseudomonas putida KT2440
cugcucaaucaacca

SEQ ID NO: 3595185 - RNA, 22 nt, Pseudomonas putida KT2440
cugcucaccauguuccaguucg

SEQ ID NO: 3595186 - RNA, 12 nt, Pseudomonas putida KT2440
cugcucagccaa

SEQ ID NO: 3595187 - RNA, 16 nt, Pseudomonas putida KT2440
cugcucagccaaccgc

SEQ ID NO: 3595188 - RNA, 19 nt, Pseudomonas putida KT2440
cugcucagccaaccgcccc

SEQ ID NO: 3595189 - RNA, 19 nt, Pseudomonas putida KT2440
cugcucagcuacgcuggac

SEQ ID NO: 3595190 - RNA, 16 nt, Pseudomonas putida KT2440
cugcucagugcuggcg

SEQ ID NO: 3595191 - RNA, 17 nt, Pseudomonas putida KT2440
cugcucagugcuggcgu

SEQ ID NO: 3595192 - RNA, 15 nt, Pseudomonas putida KT2440
cugcucauacugcug

SEQ ID NO: 3595193 - RNA, 18 nt, Pseudomonas putida KT2440
cugcucauccagcaaaua

SEQ ID NO: 3595194 - RNA, 17 nt, Pseudomonas putida KT2440
cugcucauccuuuuuug

SEQ ID NO: 3595195 - RNA, 17 nt, Pseudomonas putida KT2440
cugcucaucugcgccag

SEQ ID NO: 3595196 - RNA, 14 nt, Pseudomonas putida KT2440
cugcuccacaaucu

SEQ ID NO: 3595197 - RNA, 12 nt, Pseudomonas putida KT2440
cugcuccacccg

SEQ ID NO: 3595198 - RNA, 22 nt, Pseudomonas putida KT2440
cugcuccacccgugcagggguc

SEQ ID NO: 3595199 - RNA, 12 nt, Pseudomonas putida KT2440
cugcuccaggca

SEQ ID NO: 3595200 - RNA, 13 nt, Pseudomonas putida KT2440
cugcuccaggcag

SEQ ID NO: 3595201 - RNA, 14 nt, Pseudomonas putida KT2440
cugcuccaugaucu

SEQ ID NO: 3595202 - RNA, 17 nt, Pseudomonas putida KT2440
cugcuccaugggcaggc

SEQ ID NO: 3595203 - RNA, 20 nt, Pseudomonas putida KT2440
cugcuccaugggcaggccca

SEQ ID NO: 3595204 - RNA, 17 nt, Pseudomonas putida KT2440
cugcuccccaaccaccu

SEQ ID NO: 3595205 - RNA, 17 nt, Pseudomonas putida KT2440
cugcucccgcaggggcu

SEQ ID NO: 3595206 - RNA, 20 nt, Pseudomonas putida KT2440
cugcuccggaauccgcacac

SEQ ID NO: 3595207 - RNA, 19 nt, Pseudomonas putida KT2440
cugcuccugguccugcgcg

SEQ ID NO: 3595208 - RNA, 22 nt, Pseudomonas putida KT2440
cugcuccugguccugcgcgucg

SEQ ID NO: 3595209 - RNA, 13 nt, Pseudomonas putida KT2440
cugcucgacgaag

SEQ ID NO: 3595210 - RNA, 17 nt, Pseudomonas putida KT2440
cugcucgaucagguuga

SEQ ID NO: 3595211 - RNA, 13 nt, Pseudomonas putida KT2440
cugcucgccaucu

SEQ ID NO: 3595212 - RNA, 13 nt, Pseudomonas putida KT2440
cugcucgcccgcc

SEQ ID NO: 3595213 - RNA, 17 nt, Pseudomonas putida KT2440
cugcucgcccgcccgcu

SEQ ID NO: 3595214 - RNA, 16 nt, Pseudomonas putida KT2440
cugcucgccucaccgc

SEQ ID NO: 3595215 - RNA, 15 nt, Pseudomonas putida KT2440
cugcucgcucaggcu

SEQ ID NO: 3595216 - RNA, 16 nt, Pseudomonas putida KT2440
cugcucgcucaggcuc

SEQ ID NO: 3595217 - RNA, 23 nt, Pseudomonas putida KT2440
cugcucgcugccacgcaugccua

SEQ ID NO: 3595218 - RNA, 12 nt, Pseudomonas putida KT2440
cugcucgcuggc

SEQ ID NO: 3595219 - RNA, 14 nt, Pseudomonas putida KT2440
cugcucguccauca

SEQ ID NO: 3595220 - RNA, 18 nt, Pseudomonas putida KT2440
cugcucguccaucaccgc

SEQ ID NO: 3595221 - RNA, 15 nt, Pseudomonas putida KT2440
cugcucgucguccuc

SEQ ID NO: 3595222 - RNA, 16 nt, Pseudomonas putida KT2440
cugcucgucguccucg

SEQ ID NO: 3595223 - RNA, 20 nt, Pseudomonas putida KT2440
cugcucuaccaacugagcua

SEQ ID NO: 3595224 - RNA, 13 nt, Pseudomonas putida KT2440
cugcucucggcgc

SEQ ID NO: 3595225 - RNA, 14 nt, Pseudomonas putida KT2440
cugcucucggcgcu

SEQ ID NO: 3595226 - RNA, 15 nt, Pseudomonas putida KT2440
cugcucugcaaugcc

SEQ ID NO: 3595227 - RNA, 21 nt, Pseudomonas putida KT2440
cugcucugcaaugccgccaac

SEQ ID NO: 3595228 - RNA, 17 nt, Pseudomonas putida KT2440
cugcucugccgccgcag

SEQ ID NO: 3595229 - RNA, 20 nt, Pseudomonas putida KT2440
cugcucuggcccgaacagca

SEQ ID NO: 3595230 - RNA, 22 nt, Pseudomonas putida KT2440
cugcucuggcccgaacagcacg

SEQ ID NO: 3595231 - RNA, 21 nt, Pseudomonas putida KT2440
cugcucuucgauccgcgccau

SEQ ID NO: 3595232 - RNA, 15 nt, Pseudomonas putida KT2440
cugcucuucgccgcc

SEQ ID NO: 3595233 - RNA, 21 nt, Pseudomonas putida KT2440
cugcugacccggaaucggcuu

SEQ ID NO: 3595234 - RNA, 16 nt, Pseudomonas putida KT2440
cugcugacgcagggua

SEQ ID NO: 3595235 - RNA, 16 nt, Pseudomonas putida KT2440
cugcugcagccaaccu

SEQ ID NO: 3595236 - RNA, 19 nt, Pseudomonas putida KT2440
cugcugcagccaaccuuca

SEQ ID NO: 3595237 - RNA, 14 nt, Pseudomonas putida KT2440
cugcugcagcuccg

SEQ ID NO: 3595238 - RNA, 13 nt, Pseudomonas putida KT2440
cugcugcaggcuc

SEQ ID NO: 3595239 - RNA, 19 nt, Pseudomonas putida KT2440
cugcugcaggcucugaaug

SEQ ID NO: 3595240 - RNA, 14 nt, Pseudomonas putida KT2440
cugcugcagggccc

SEQ ID NO: 3595241 - RNA, 17 nt, Pseudomonas putida KT2440
cugcugcauacgcacca

SEQ ID NO: 3595242 - RNA, 17 nt, Pseudomonas putida KT2440
cugcugccaaucgauca

SEQ ID NO: 3595243 - RNA, 23 nt, Pseudomonas putida KT2440
cugcugccaaucgaucacuucca

SEQ ID NO: 3595244 - RNA, 13 nt, Pseudomonas putida KT2440
cugcugccaggcc

SEQ ID NO: 3595245 - RNA, 14 nt, Pseudomonas putida KT2440
cugcugccaggccg

SEQ ID NO: 3595246 - RNA, 16 nt, Pseudomonas putida KT2440
cugcugccaggccgca

SEQ ID NO: 3595247 - RNA, 21 nt, Pseudomonas putida KT2440
cugcugccaggccgcacgcgc

SEQ ID NO: 3595248 - RNA, 22 nt, Pseudomonas putida KT2440
cugcugccauccuugaagaaca

SEQ ID NO: 3595249 - RNA, 22 nt, Pseudomonas putida KT2440
cugcugcgaaacgaaacccugc

SEQ ID NO: 3595250 - RNA, 15 nt, Pseudomonas putida KT2440
cugcugcgcagcccc

SEQ ID NO: 3595251 - RNA, 17 nt, Pseudomonas putida KT2440
cugcugcgcagccccaa

SEQ ID NO: 3595252 - RNA, 20 nt, Pseudomonas putida KT2440
cugcugcggauacagcgccc

SEQ ID NO: 3595253 - RNA, 23 nt, Pseudomonas putida KT2440
cugcugcggcaccucguccaggu

SEQ ID NO: 3595254 - RNA, 12 nt, Pseudomonas putida KT2440
cugcugcggccg

SEQ ID NO: 3595255 - RNA, 14 nt, Pseudomonas putida KT2440
cugcugcgucagca

SEQ ID NO: 3595256 - RNA, 15 nt, Pseudomonas putida KT2440
cugcugcgucagcau

SEQ ID NO: 3595257 - RNA, 13 nt, Pseudomonas putida KT2440
cugcugcucccca

SEQ ID NO: 3595258 - RNA, 19 nt, Pseudomonas putida KT2440
cugcugcuggcacgccuuc

SEQ ID NO: 3595259 - RNA, 14 nt, Pseudomonas putida KT2440
cugcugcuggccgc

SEQ ID NO: 3595260 - RNA, 16 nt, Pseudomonas putida KT2440
cugcugcuggccgcca

SEQ ID NO: 3595261 - RNA, 17 nt, Pseudomonas putida KT2440
cugcugcuggccgccag

SEQ ID NO: 3595262 - RNA, 21 nt, Pseudomonas putida KT2440
cugcugcugucgguaccuggc

SEQ ID NO: 3595263 - RNA, 15 nt, Pseudomonas putida KT2440
cugcuggauacccag

SEQ ID NO: 3595264 - RNA, 15 nt, Pseudomonas putida KT2440
cugcuggccaauuuc

SEQ ID NO: 3595265 - RNA, 23 nt, Pseudomonas putida KT2440
cugcuggcccgcgaugccgacag

SEQ ID NO: 3595266 - RNA, 20 nt, Pseudomonas putida KT2440
cugcuggccgcgcaggaaga

SEQ ID NO: 3595267 - RNA, 21 nt, Pseudomonas putida KT2440
cuggcaggguucgcuguccug

SEQ ID NO: 3595268 - RNA, 12 nt, Pseudomonas putida KT2440
cuggcauccagc

SEQ ID NO: 3595269 - RNA, 19 nt, Pseudomonas putida KT2440
cuggcauccagcgccacca

SEQ ID NO: 3595270 - RNA, 22 nt, Pseudomonas putida KT2440
cuggcauccggcagcucaccgg

SEQ ID NO: 3595271 - RNA, 13 nt, Pseudomonas putida KT2440
cuggcaugccccu

SEQ ID NO: 3595272 - RNA, 18 nt, Pseudomonas putida KT2440
cuggcaugccccucgaac

SEQ ID NO: 3595273 - RNA, 16 nt, Pseudomonas putida KT2440
cuggccaacuccccac

SEQ ID NO: 3595274 - RNA, 17 nt, Pseudomonas putida KT2440
cuggccaacuccccacc

SEQ ID NO: 3595275 - RNA, 15 nt, Pseudomonas putida KT2440
cuggccaagcggcuc

SEQ ID NO: 3595276 - RNA, 16 nt, Pseudomonas putida KT2440
cuggccaaggccucua

SEQ ID NO: 3595277 - RNA, 21 nt, Pseudomonas putida KT2440
cuggccaaggucuccagcacc

SEQ ID NO: 3595278 - RNA, 19 nt, Pseudomonas putida KT2440
cuggccaauugcgccauca

SEQ ID NO: 3595279 - RNA, 20 nt, Pseudomonas putida KT2440
cuggccaauuucuacccgcc

SEQ ID NO: 3595280 - RNA, 19 nt, Pseudomonas putida KT2440
cuggccacauggaucagcu

SEQ ID NO: 3595281 - RNA, 22 nt, Pseudomonas putida KT2440
cuggccaccaccaucucgccca

SEQ ID NO: 3595282 - RNA, 13 nt, Pseudomonas putida KT2440
cuggccaccagca

SEQ ID NO: 3595283 - RNA, 14 nt, Pseudomonas putida KT2440
cuggccaccagcau

SEQ ID NO: 3595284 - RNA, 17 nt, Pseudomonas putida KT2440
cuggccaccagcauggc

SEQ ID NO: 3595285 - RNA, 20 nt, Pseudomonas putida KT2440
cuggccaccaugaacagcac

SEQ ID NO: 3595286 - RNA, 12 nt, Pseudomonas putida KT2440
cuggccacccgg

SEQ ID NO: 3595287 - RNA, 14 nt, Pseudomonas putida KT2440
cuggccacccggcu

SEQ ID NO: 3595288 - RNA, 21 nt, Pseudomonas putida KT2440
cuggccacuguugcagcgcca

SEQ ID NO: 3595289 - RNA, 19 nt, Pseudomonas putida KT2440
cuggccagcaagugccccu

SEQ ID NO: 3595290 - RNA, 18 nt, Pseudomonas putida KT2440
cuggccagcagauggcuc

SEQ ID NO: 3595291 - RNA, 21 nt, Pseudomonas putida KT2440
cuggccagcagccccccuucc

SEQ ID NO: 3595292 - RNA, 13 nt, Pseudomonas putida KT2440
cuggccagcaggg

SEQ ID NO: 3595293 - RNA, 16 nt, Pseudomonas putida KT2440
cuggccagcagggccg

SEQ ID NO: 3595294 - RNA, 22 nt, Pseudomonas putida KT2440
cuggccagcggcgcggccucgu

SEQ ID NO: 3595295 - RNA, 19 nt, Pseudomonas putida KT2440
cuggccaguuguucgucga

SEQ ID NO: 3595296 - RNA, 21 nt, Pseudomonas putida KT2440
cuggccaguuguucgucgagc

SEQ ID NO: 3595297 - RNA, 22 nt, Pseudomonas putida KT2440
cuggccaguuguucgucgagca

SEQ ID NO: 3595298 - RNA, 17 nt, Pseudomonas putida KT2440
cuggccauaguugacca

SEQ ID NO: 3595299 - RNA, 16 nt, Pseudomonas putida KT2440
cuggccauccagucga

SEQ ID NO: 3595300 - RNA, 19 nt, Pseudomonas putida KT2440
cuggccauccagucgauca

SEQ ID NO: 3595301 - RNA, 22 nt, Pseudomonas putida KT2440
cuggccauugaccuuggugauc

SEQ ID NO: 3595302 - RNA, 13 nt, Pseudomonas putida KT2440
cuggcccacccgg

SEQ ID NO: 3595303 - RNA, 18 nt, Pseudomonas putida KT2440
cuggcccacccggcugaa

SEQ ID NO: 3595304 - RNA, 17 nt, Pseudomonas putida KT2440
cuggcccacgccuucca

SEQ ID NO: 3595305 - RNA, 16 nt, Pseudomonas putida KT2440
cuggccccacccaacu

SEQ ID NO: 3595306 - RNA, 14 nt, Pseudomonas putida KT2440
cuggcccgaacgca

SEQ ID NO: 3595307 - RNA, 16 nt, Pseudomonas putida KT2440
cuggcccgaacgcagc

SEQ ID NO: 3595308 - RNA, 21 nt, Pseudomonas putida KT2440
cuggcccgaacgcagcgccgc

SEQ ID NO: 3595309 - RNA, 15 nt, Pseudomonas putida KT2440
cuggcccgcagcgcu

SEQ ID NO: 3595310 - RNA, 21 nt, Pseudomonas putida KT2440
cuggcccgcagcgcuucgauc

SEQ ID NO: 3595311 - RNA, 12 nt, Pseudomonas putida KT2440
cuggcccgccgc

SEQ ID NO: 3595312 - RNA, 16 nt, Pseudomonas putida KT2440
cuggcccgcgaugccg

SEQ ID NO: 3595313 - RNA, 19 nt, Pseudomonas putida KT2440
cuggcccgcgaugccgaca

SEQ ID NO: 3595314 - RNA, 23 nt, Pseudomonas putida KT2440
cuggcccgcuugcccgaggaacg

SEQ ID NO: 3595315 - RNA, 18 nt, Pseudomonas putida KT2440
cuggcccucugcguggua

SEQ ID NO: 3595316 - RNA, 19 nt, Pseudomonas putida KT2440
cuggcccucugcgugguau

SEQ ID NO: 3595317 - RNA, 13 nt, Pseudomonas putida KT2440
cuggcccugggag

SEQ ID NO: 3595318 - RNA, 20 nt, Pseudomonas putida KT2440
cuggcccuguacauccagcu

SEQ ID NO: 3595319 - RNA, 13 nt, Pseudomonas putida KT2440
cuggcccugugcu

SEQ ID NO: 3595320 - RNA, 14 nt, Pseudomonas putida KT2440
cuggcccuugccau

SEQ ID NO: 3595321 - RNA, 15 nt, Pseudomonas putida KT2440
cuggcccuugccauc

SEQ ID NO: 3595322 - RNA, 17 nt, Pseudomonas putida KT2440
cuggcccuuucgcgggu

SEQ ID NO: 3595323 - RNA, 14 nt, Pseudomonas putida KT2440
cuggccgaugccca

SEQ ID NO: 3595324 - RNA, 22 nt, Pseudomonas putida KT2440
cuggccgaugcccaccuuggcg

SEQ ID NO: 3595325 - RNA, 23 nt, Pseudomonas putida KT2440
cuggccgaugcccaccuuggcgg

SEQ ID NO: 3595326 - RNA, 14 nt, Pseudomonas putida KT2440
cuggccgccacggu

SEQ ID NO: 3595327 - RNA, 14 nt, Pseudomonas putida KT2440
cuggccgcccgccu

SEQ ID NO: 3595328 - RNA, 15 nt, Pseudomonas putida KT2440
cuggccgcccgccuc

SEQ ID NO: 3595329 - RNA, 15 nt, Pseudomonas putida KT2440
cuggccgccucccag

SEQ ID NO: 3595330 - RNA, 16 nt, Pseudomonas putida KT2440
cuggccgcgcaggaag

SEQ ID NO: 3595331 - RNA, 20 nt, Pseudomonas putida KT2440
cuggccgcguucgcccaggc

SEQ ID NO: 3595332 - RNA, 15 nt, Pseudomonas putida KT2440
cuggccgcugcgccc

SEQ ID NO: 3595333 - RNA, 19 nt, Pseudomonas putida KT2440
cuggccggcuuggcaccuc

SEQ ID NO: 3595334 - RNA, 15 nt, Pseudomonas putida KT2440
cuggccgguguggcc

SEQ ID NO: 3595335 - RNA, 18 nt, Pseudomonas putida KT2440
cuggccgguguggccaag

SEQ ID NO: 3595336 - RNA, 14 nt, Pseudomonas putida KT2440
cuggccguccagcu

SEQ ID NO: 3595337 - RNA, 17 nt, Pseudomonas putida KT2440
cuggccguccagcugag

SEQ ID NO: 3595338 - RNA, 17 nt, Pseudomonas putida KT2440
cuggccguguucgacga

SEQ ID NO: 3595339 - RNA, 18 nt, Pseudomonas putida KT2440
cuggccucuucgcgggua

SEQ ID NO: 3595340 - RNA, 22 nt, Pseudomonas putida KT2440
cuggccucuucucgggcaagcc

SEQ ID NO: 3595341 - RNA, 16 nt, Pseudomonas putida KT2440
cuggccugcagccguu

SEQ ID NO: 3595342 - RNA, 17 nt, Pseudomonas putida KT2440
cuggccugcaugcucau

SEQ ID NO: 3595343 - RNA, 14 nt, Pseudomonas putida KT2440
cuggccuuccagcu

SEQ ID NO: 3595344 - RNA, 15 nt, Pseudomonas putida KT2440
cuggccuuccagcug

SEQ ID NO: 3595345 - RNA, 20 nt, Pseudomonas putida KT2440
cuggccuuccuugcccagcc

SEQ ID NO: 3595346 - RNA, 16 nt, Pseudomonas putida KT2440
cuggccuugcaggaag

SEQ ID NO: 3595347 - RNA, 12 nt, Pseudomonas putida KT2440
cuggccuugcgg

SEQ ID NO: 3595348 - RNA, 21 nt, Pseudomonas putida KT2440
cuggccuuggacaccaggcug

SEQ ID NO: 3595349 - RNA, 18 nt, Pseudomonas putida KT2440
cuggccuuggcgugcacg

SEQ ID NO: 3595350 - RNA, 17 nt, Pseudomonas putida KT2440
cuggccuuuucgcgggu

SEQ ID NO: 3595351 - RNA, 18 nt, Pseudomonas putida KT2440
cuggcgaaacaaucggug

SEQ ID NO: 3595352 - RNA, 17 nt, Pseudomonas putida KT2440
cuggcgaagaguccagu

SEQ ID NO: 3595353 - RNA, 23 nt, Pseudomonas putida KT2440
cuggcgacgaguuuaccuccauc

SEQ ID NO: 3595354 - RNA, 17 nt, Pseudomonas putida KT2440
cuggcgagaauacccau

SEQ ID NO: 3595355 - RNA, 14 nt, Pseudomonas putida KT2440
cuggcgaucaggca

SEQ ID NO: 3595356 - RNA, 17 nt, Pseudomonas putida KT2440
cuggcgaucgaacaacu

SEQ ID NO: 3595357 - RNA, 23 nt, Pseudomonas putida KT2440
cuggcgaucgaacaacuguccug

SEQ ID NO: 3595358 - RNA, 17 nt, Pseudomonas putida KT2440
cuggcgcaagccgugcc

SEQ ID NO: 3595359 - RNA, 18 nt, Pseudomonas putida KT2440
cuggcgcaagccgugccu

SEQ ID NO: 3595360 - RNA, 20 nt, Pseudomonas putida KT2440
cuggcgcacguacuccacca

SEQ ID NO: 3595361 - RNA, 22 nt, Pseudomonas putida KT2440
cuggcgcacguacuccaccaag

SEQ ID NO: 3595362 - RNA, 11 nt, Pseudomonas putida KT2440
cuggcgcagca

SEQ ID NO: 3595363 - RNA, 20 nt, Pseudomonas putida KT2440
cuggcgcagcagguccagcu

SEQ ID NO: 3595364 - RNA, 19 nt, Pseudomonas putida KT2440
cuggcgcaggaagucuucc

SEQ ID NO: 3595365 - RNA, 23 nt, Pseudomonas putida KT2440
cuggcgcaggaagucuuccuggu

SEQ ID NO: 3595366 - RNA, 20 nt, Pseudomonas putida KT2440
cuggcgcaggccgcuggccg

SEQ ID NO: 3595367 - RNA, 17 nt, Pseudomonas putida KT2440
cuggcgcaucuuccagc

SEQ ID NO: 3595368 - RNA, 13 nt, Pseudomonas putida KT2440
cuggcgcccggca

SEQ ID NO: 3595369 - RNA, 20 nt, Pseudomonas putida KT2440
cuggcgcccggcaucgcuca

SEQ ID NO: 3595370 - RNA, 12 nt, Pseudomonas putida KT2440
cuggcgccugcg

SEQ ID NO: 3595371 - RNA, 21 nt, Pseudomonas putida KT2440
cuggcgccugcgccagugccu

SEQ ID NO: 3595372 - RNA, 15 nt, Pseudomonas putida KT2440
cugggucagcgcuga

SEQ ID NO: 3595373 - RNA, 14 nt, Pseudomonas putida KT2440
cugggucagcuccu

SEQ ID NO: 3595374 - RNA, 12 nt, Pseudomonas putida KT2440
cuggguccaggc

SEQ ID NO: 3595375 - RNA, 15 nt, Pseudomonas putida KT2440
cuggguccaggcaca

SEQ ID NO: 3595376 - RNA, 17 nt, Pseudomonas putida KT2440
cuggguccaggcacacc

SEQ ID NO: 3595377 - RNA, 20 nt, Pseudomonas putida KT2440
cugggugaugcgcuugccag

SEQ ID NO: 3595378 - RNA, 20 nt, Pseudomonas putida KT2440
cugggugguaucugccgaug

SEQ ID NO: 3595379 - RNA, 14 nt, Pseudomonas putida KT2440
cuggguggugucga

SEQ ID NO: 3595380 - RNA, 22 nt, Pseudomonas putida KT2440
cuggguggugucgaccaaaaau

SEQ ID NO: 3595381 - RNA, 21 nt, Pseudomonas putida KT2440
cuggguuacggcggccugcug

SEQ ID NO: 3595382 - RNA, 23 nt, Pseudomonas putida KT2440
cuggguuuauuucucuuccuggc

SEQ ID NO: 3595383 - RNA, 21 nt, Pseudomonas putida KT2440
cuggguuuuuuuaugggcagc

SEQ ID NO: 3595384 - RNA, 20 nt, Pseudomonas putida KT2440
cugguaaaugaacggcuguu

SEQ ID NO: 3595385 - RNA, 15 nt, Pseudomonas putida KT2440
cugguacaacaacaa

SEQ ID NO: 3595386 - RNA, 16 nt, Pseudomonas putida KT2440
cugguacaacaacaaa

SEQ ID NO: 3595387 - RNA, 19 nt, Pseudomonas putida KT2440
cugguacaacaacaaaaaa

SEQ ID NO: 3595388 - RNA, 14 nt, Pseudomonas putida KT2440
cugguacagcucac

SEQ ID NO: 3595389 - RNA, 19 nt, Pseudomonas putida KT2440
cugguacaucacacuacac

SEQ ID NO: 3595390 - RNA, 21 nt, Pseudomonas putida KT2440
cugguaccccucgacgccuug

SEQ ID NO: 3595391 - RNA, 17 nt, Pseudomonas putida KT2440
cugguacuccacuucca

SEQ ID NO: 3595392 - RNA, 21 nt, Pseudomonas putida KT2440
cugguaggucacuucagugcu

SEQ ID NO: 3595393 - RNA, 20 nt, Pseudomonas putida KT2440
cugguauugccuggcgacac

SEQ ID NO: 3595394 - RNA, 21 nt, Pseudomonas putida KT2440
cuggucaaacaaugcacagcg

SEQ ID NO: 3595395 - RNA, 13 nt, Pseudomonas putida KT2440
cuggucacccuga

SEQ ID NO: 3595396 - RNA, 13 nt, Pseudomonas putida KT2440
cuggucacggcca

SEQ ID NO: 3595397 - RNA, 14 nt, Pseudomonas putida KT2440
cuggucacggccac

SEQ ID NO: 3595398 - RNA, 15 nt, Pseudomonas putida KT2440
cuggucacucugccg

SEQ ID NO: 3595399 - RNA, 18 nt, Pseudomonas putida KT2440
cuggucagucgagucgac

SEQ ID NO: 3595400 - RNA, 18 nt, Pseudomonas putida KT2440
cuggucaucagauggccc

SEQ ID NO: 3595401 - RNA, 18 nt, Pseudomonas putida KT2440
cuggucaucguccaccca

SEQ ID NO: 3595402 - RNA, 21 nt, Pseudomonas putida KT2440
cugguccacgguucuggcagc

SEQ ID NO: 3595403 - RNA, 17 nt, Pseudomonas putida KT2440
cugguccgaggucagca

SEQ ID NO: 3595404 - RNA, 20 nt, Pseudomonas putida KT2440
cugguccgaggucagcacca

SEQ ID NO: 3595405 - RNA, 20 nt, Pseudomonas putida KT2440
cuggucgaaggucaggcgcg

SEQ ID NO: 3595406 - RNA, 16 nt, Pseudomonas putida KT2440
cuggucgaaugcgugc

SEQ ID NO: 3595407 - RNA, 20 nt, Pseudomonas putida KT2440
cuggucgaaugcgugcaacg

SEQ ID NO: 3595408 - RNA, 18 nt, Pseudomonas putida KT2440
cuggucgaucuucagcgc

SEQ ID NO: 3595409 - RNA, 14 nt, Pseudomonas putida KT2440
cuggucgccgugca

SEQ ID NO: 3595410 - RNA, 18 nt, Pseudomonas putida KT2440
cuggucgccucgacgcag

SEQ ID NO: 3595411 - RNA, 20 nt, Pseudomonas putida KT2440
cuggucgccucgacgcagac

SEQ ID NO: 3595412 - RNA, 14 nt, Pseudomonas putida KT2440
cuggucgcgugccg

SEQ ID NO: 3595413 - RNA, 17 nt, Pseudomonas putida KT2440
cuggucggccuugccgc

SEQ ID NO: 3595414 - RNA, 17 nt, Pseudomonas putida KT2440
cuggugaaagucgacca

SEQ ID NO: 3595415 - RNA, 20 nt, Pseudomonas putida KT2440
cuggugaaagucgaccagca

SEQ ID NO: 3595416 - RNA, 21 nt, Pseudomonas putida KT2440
cuggugaaagucgaccagcag

SEQ ID NO: 3595417 - RNA, 14 nt, Pseudomonas putida KT2440
cuggugaaggcagg

SEQ ID NO: 3595418 - RNA, 15 nt, Pseudomonas putida KT2440
cuggugaaggcaggu

SEQ ID NO: 3595419 - RNA, 20 nt, Pseudomonas putida KT2440
cuggugaaucagccccagcc

SEQ ID NO: 3595420 - RNA, 22 nt, Pseudomonas putida KT2440
cuggugaaucagccccagccgg

SEQ ID NO: 3595421 - RNA, 20 nt, Pseudomonas putida KT2440
cuggugcaggcguucgucaa

SEQ ID NO: 3595422 - RNA, 21 nt, Pseudomonas putida KT2440
cuggugcagguugauccagcc

SEQ ID NO: 3595423 - RNA, 17 nt, Pseudomonas putida KT2440
cuggugccggccucuuc

SEQ ID NO: 3595424 - RNA, 19 nt, Pseudomonas putida KT2440
cuggugccugucgucagcu

SEQ ID NO: 3595425 - RNA, 13 nt, Pseudomonas putida KT2440
cugguggccacgc

SEQ ID NO: 3595426 - RNA, 13 nt, Pseudomonas putida KT2440
cugguggcggcau

SEQ ID NO: 3595427 - RNA, 20 nt, Pseudomonas putida KT2440
cuggugguggcccugaccgc

SEQ ID NO: 3595428 - RNA, 14 nt, Pseudomonas putida KT2440
cuggugucggccag

SEQ ID NO: 3595429 - RNA, 18 nt, Pseudomonas putida KT2440
cuggugucggccagggcc

SEQ ID NO: 3595430 - RNA, 17 nt, Pseudomonas putida KT2440
cugguguguugaagucc

SEQ ID NO: 3595431 - RNA, 22 nt, Pseudomonas putida KT2440
cugguuacccaacagaccaccu

SEQ ID NO: 3595432 - RNA, 23 nt, Pseudomonas putida KT2440
cugguuacccaacagaccaccug

SEQ ID NO: 3595433 - RNA, 18 nt, Pseudomonas putida KT2440
cugguuagcgucgaugcg

SEQ ID NO: 3595434 - RNA, 23 nt, Pseudomonas putida KT2440
cugguuccugggaagcugcagca

SEQ ID NO: 3595435 - RNA, 17 nt, Pseudomonas putida KT2440
cugguucgaguccaggu

SEQ ID NO: 3595436 - RNA, 14 nt, Pseudomonas putida KT2440
cugguucuccaggu

SEQ ID NO: 3595437 - RNA, 15 nt, Pseudomonas putida KT2440
cugguucuccagguu

SEQ ID NO: 3595438 - RNA, 18 nt, Pseudomonas putida KT2440
cugguucugcugcagcca

SEQ ID NO: 3595439 - RNA, 13 nt, Pseudomonas putida KT2440
cugguugaacugc

SEQ ID NO: 3595440 - RNA, 15 nt, Pseudomonas putida KT2440
cugguugcuggcgcc

SEQ ID NO: 3595441 - RNA, 20 nt, Pseudomonas putida KT2440
cugguuguagcccgggcagc

SEQ ID NO: 3595442 - RNA, 17 nt, Pseudomonas putida KT2440
cugguuucagaaccagc

SEQ ID NO: 3595443 - RNA, 21 nt, Pseudomonas putida KT2440
cugguuugaggaaugugugca

SEQ ID NO: 3595444 - RNA, 18 nt, Pseudomonas putida KT2440
cugguuuuccaccggcac

SEQ ID NO: 3595445 - RNA, 14 nt, Pseudomonas putida KT2440
cugguuuucgcggu

SEQ ID NO: 3595446 - RNA, 15 nt, Pseudomonas putida KT2440
cuguaaccugguugu

SEQ ID NO: 3595447 - RNA, 21 nt, Pseudomonas putida KT2440
cuguaaccugguuguagcccg

SEQ ID NO: 3595448 - RNA, 18 nt, Pseudomonas putida KT2440
cuguacagcacaccuucc

SEQ ID NO: 3595449 - RNA, 21 nt, Pseudomonas putida KT2440
cuguacaguggcacuggcgcg

SEQ ID NO: 3595450 - RNA, 14 nt, Pseudomonas putida KT2440
cuguacccgcuggc

SEQ ID NO: 3595451 - RNA, 16 nt, Pseudomonas putida KT2440
cuguacccgcuggcug

SEQ ID NO: 3595452 - RNA, 13 nt, Pseudomonas putida KT2440
cuguaccgaccuc

SEQ ID NO: 3595453 - RNA, 15 nt, Pseudomonas putida KT2440
cuguacgcuggccaa

SEQ ID NO: 3595454 - RNA, 18 nt, Pseudomonas putida KT2440
cuguacgcuggccaaggc

SEQ ID NO: 3595455 - RNA, 16 nt, Pseudomonas putida KT2440
cuguacguccaaucgg

SEQ ID NO: 3595456 - RNA, 16 nt, Pseudomonas putida KT2440
cuguacugacugacgu

SEQ ID NO: 3595457 - RNA, 19 nt, Pseudomonas putida KT2440
cuguacuggcccuuucgcg

SEQ ID NO: 3595458 - RNA, 19 nt, Pseudomonas putida KT2440
cuguagagcgccuugucgg

SEQ ID NO: 3595459 - RNA, 17 nt, Pseudomonas putida KT2440
cuguagauaugugaccg

SEQ ID NO: 3595460 - RNA, 15 nt, Pseudomonas putida KT2440
cuguaggagcgggcu

SEQ ID NO: 3595461 - RNA, 14 nt, Pseudomonas putida KT2440
cuguaggagcgggu

SEQ ID NO: 3595462 - RNA, 24 nt, Pseudomonas putida KT2440
cuguaggagcggguucacccgcga

SEQ ID NO: 3595463 - RNA, 23 nt, Pseudomonas putida KT2440
cuguaggagcggguuuacccgcg

SEQ ID NO: 3595464 - RNA, 23 nt, Pseudomonas putida KT2440
cuguaggaucggguuuacccgcg

SEQ ID NO: 3595465 - RNA, 18 nt, Pseudomonas putida KT2440
cuguaggggcgggccugc

SEQ ID NO: 3595466 - RNA, 20 nt, Pseudomonas putida KT2440
cuguaggugcggcuuuagcc

SEQ ID NO: 3595467 - RNA, 16 nt, Pseudomonas putida KT2440
cuguaucgaacaggca

SEQ ID NO: 3595468 - RNA, 16 nt, Pseudomonas putida KT2440
cuguaugauucgccuc

SEQ ID NO: 3595469 - RNA, 17 nt, Pseudomonas putida KT2440
cuguauguguguguccg

SEQ ID NO: 3595470 - RNA, 22 nt, Pseudomonas putida KT2440
cugucaaucuugcgcacgcgcu

SEQ ID NO: 3595471 - RNA, 22 nt, Pseudomonas putida KT2440
cugucacccuugggcaccagcu

SEQ ID NO: 3595472 - RNA, 13 nt, Pseudomonas putida KT2440
cugucacgacagg

SEQ ID NO: 3595473 - RNA, 13 nt, Pseudomonas putida KT2440
cugucacgccuuc

SEQ ID NO: 3595474 - RNA, 22 nt, Pseudomonas putida KT2440
cugucagguguggcucagcucg

SEQ ID NO: 3595475 - RNA, 20 nt, Pseudomonas putida KT2440
cugucaguggucuucaaggc

SEQ ID NO: 3595476 - RNA, 18 nt, Pseudomonas putida KT2440
cuguccagauuacaaaag

SEQ ID NO: 3595477 - RNA, 21 nt, Pseudomonas putida KT2440
cuguuguccaagggagagucc

SEQ ID NO: 3595478 - RNA, 18 nt, Pseudomonas putida KT2440
cuguuguccccgccgugc

SEQ ID NO: 3595479 - RNA, 23 nt, Pseudomonas putida KT2440
cuguuucaccagcaggucggcac

SEQ ID NO: 3595480 - RNA, 16 nt, Pseudomonas putida KT2440
cuguuucaugcugcga

SEQ ID NO: 3595481 - RNA, 20 nt, Pseudomonas putida KT2440
cuguuucugccccuggccca

SEQ ID NO: 3595482 - RNA, 13 nt, Pseudomonas putida KT2440
cuguuucuucaag

SEQ ID NO: 3595483 - RNA, 15 nt, Pseudomonas putida KT2440
cuguuugagccggcg

SEQ ID NO: 3595484 - RNA, 20 nt, Pseudomonas putida KT2440
cuguuugggcugcgcggcag

SEQ ID NO: 3595485 - RNA, 16 nt, Pseudomonas putida KT2440
cuguuuuccauugcac

SEQ ID NO: 3595486 - RNA, 13 nt, Pseudomonas putida KT2440
cuguuuugagagg

SEQ ID NO: 3595487 - RNA, 12 nt, Pseudomonas putida KT2440
cuuaacgcuugg

SEQ ID NO: 3595488 - RNA, 15 nt, Pseudomonas putida KT2440
cuuaacgcuuggcca

SEQ ID NO: 3595489 - RNA, 13 nt, Pseudomonas putida KT2440
cuuaagucuucuc

SEQ ID NO: 3595490 - RNA, 16 nt, Pseudomonas putida KT2440
cuuaaucaaugcaagu

SEQ ID NO: 3595491 - RNA, 18 nt, Pseudomonas putida KT2440
cuuacaacugcuccaggc

SEQ ID NO: 3595492 - RNA, 18 nt, Pseudomonas putida KT2440
cuuacagguagugcgcgg

SEQ ID NO: 3595493 - RNA, 20 nt, Pseudomonas putida KT2440
cuuacaggucguaaucgccc

SEQ ID NO: 3595494 - RNA, 16 nt, Pseudomonas putida KT2440
cuuaccagcuuggcgc

SEQ ID NO: 3595495 - RNA, 17 nt, Pseudomonas putida KT2440
cuuaccagcuuggcgcc

SEQ ID NO: 3595496 - RNA, 19 nt, Pseudomonas putida KT2440
cuuaccaguaguucucgac

SEQ ID NO: 3595497 - RNA, 23 nt, Pseudomonas putida KT2440
cuuaccaguaguucucgacagcc

SEQ ID NO: 3595498 - RNA, 16 nt, Pseudomonas putida KT2440
cuuacgaacggguugg

SEQ ID NO: 3595499 - RNA, 15 nt, Pseudomonas putida KT2440
cuuacguacagucuc

SEQ ID NO: 3595500 - RNA, 23 nt, Pseudomonas putida KT2440
cuuagacgguuacgugcaggcgc

SEQ ID NO: 3595501 - RNA, 12 nt, Pseudomonas putida KT2440
cuuagcgggcaa

SEQ ID NO: 3595502 - RNA, 13 nt, Pseudomonas putida KT2440
cuuauaagcagca

SEQ ID NO: 3595503 - RNA, 20 nt, Pseudomonas putida KT2440
cuuauccgcuggcuuguccu

SEQ ID NO: 3595504 - RNA, 19 nt, Pseudomonas putida KT2440
cuuauucuucuggcuuucu

SEQ ID NO: 3595505 - RNA, 20 nt, Pseudomonas putida KT2440
cuucaaaauagucgaaggcu

SEQ ID NO: 3595506 - RNA, 16 nt, Pseudomonas putida KT2440
cuucaaaucgcugcgc

SEQ ID NO: 3595507 - RNA, 22 nt, Pseudomonas putida KT2440
cuucaaaucgcugcgcaugaaa

SEQ ID NO: 3595508 - RNA, 20 nt, Pseudomonas putida KT2440
cuucaacaaaucggccuugc

SEQ ID NO: 3595509 - RNA, 19 nt, Pseudomonas putida KT2440
cuucaacaccaacuugcca

SEQ ID NO: 3595510 - RNA, 14 nt, Pseudomonas putida KT2440
cuucaacagcuucu

SEQ ID NO: 3595511 - RNA, 17 nt, Pseudomonas putida KT2440
cuucaaccucacuggca

SEQ ID NO: 3595512 - RNA, 23 nt, Pseudomonas putida KT2440
cuucaaccuguuccggccucuuc

SEQ ID NO: 3595513 - RNA, 16 nt, Pseudomonas putida KT2440
cuucaacgcggcuucg

SEQ ID NO: 3595514 - RNA, 17 nt, Pseudomonas putida KT2440
cuucaacgcggcuucga

SEQ ID NO: 3595515 - RNA, 13 nt, Pseudomonas putida KT2440
cuucaacuccacc

SEQ ID NO: 3595516 - RNA, 20 nt, Pseudomonas putida KT2440
cuucaacuccaccaucaagu

SEQ ID NO: 3595517 - RNA, 21 nt, Pseudomonas putida KT2440
cuucaacuccaccaucaaguc

SEQ ID NO: 3595518 - RNA, 15 nt, Pseudomonas putida KT2440
cuucaaggccaccac

SEQ ID NO: 3595519 - RNA, 17 nt, Pseudomonas putida KT2440
cuucaaggccacgcggu

SEQ ID NO: 3595520 - RNA, 15 nt, Pseudomonas putida KT2440
cuucaaggcccaguu

SEQ ID NO: 3595521 - RNA, 21 nt, Pseudomonas putida KT2440
cuucaaggccgccaccucgcu

SEQ ID NO: 3595522 - RNA, 16 nt, Pseudomonas putida KT2440
cuucaauagcggccaa

SEQ ID NO: 3595523 - RNA, 13 nt, Pseudomonas putida KT2440
cuucaaugcccag

SEQ ID NO: 3595524 - RNA, 19 nt, Pseudomonas putida KT2440
cuucacaccggccuuggcc

SEQ ID NO: 3595525 - RNA, 19 nt, Pseudomonas putida KT2440
cuucacagauacuggcgcu

SEQ ID NO: 3595526 - RNA, 22 nt, Pseudomonas putida KT2440
cuucaccagcucguucaacacc

SEQ ID NO: 3595527 - RNA, 14 nt, Pseudomonas putida KT2440
cuucaccaugggcc

SEQ ID NO: 3595528 - RNA, 19 nt, Pseudomonas putida KT2440
cuucacccaaugcaugcau

SEQ ID NO: 3595529 - RNA, 16 nt, Pseudomonas putida KT2440
cuucaccccguggccc

SEQ ID NO: 3595530 - RNA, 14 nt, Pseudomonas putida KT2440
cuucacccgcagca

SEQ ID NO: 3595531 - RNA, 18 nt, Pseudomonas putida KT2440
cuucacccucgcgcagca

SEQ ID NO: 3595532 - RNA, 14 nt, Pseudomonas putida KT2440
cuucaccuugccua

SEQ ID NO: 3595533 - RNA, 15 nt, Pseudomonas putida KT2440
cuucaccuugccuac

SEQ ID NO: 3595534 - RNA, 18 nt, Pseudomonas putida KT2440
cuucaccuugccuaccug

SEQ ID NO: 3595535 - RNA, 14 nt, Pseudomonas putida KT2440
cuucaccuugccug

SEQ ID NO: 3595536 - RNA, 15 nt, Pseudomonas putida KT2440
cuucacggcaagccu

SEQ ID NO: 3595537 - RNA, 14 nt, Pseudomonas putida KT2440
cuucacggcuuugu

SEQ ID NO: 3595538 - RNA, 18 nt, Pseudomonas putida KT2440
cuucacgggucaggugcg

SEQ ID NO: 3595539 - RNA, 18 nt, Pseudomonas putida KT2440
cuucacgggucaugccac

SEQ ID NO: 3595540 - RNA, 23 nt, Pseudomonas putida KT2440
cuucacguccagccacuuguucg

SEQ ID NO: 3595541 - RNA, 16 nt, Pseudomonas putida KT2440
cuucacgucuggcacc

SEQ ID NO: 3595542 - RNA, 19 nt, Pseudomonas putida KT2440
cuucacgucuggcaccagu

SEQ ID NO: 3595543 - RNA, 17 nt, Pseudomonas putida KT2440
cuucacucaaccaccgc

SEQ ID NO: 3595544 - RNA, 21 nt, Pseudomonas putida KT2440
cuucacugcucaucugcgcca

SEQ ID NO: 3595545 - RNA, 13 nt, Pseudomonas putida KT2440
cuucacuguccug

SEQ ID NO: 3595546 - RNA, 22 nt, Pseudomonas putida KT2440
cuucacuguggucauccaggcu

SEQ ID NO: 3595547 - RNA, 21 nt, Pseudomonas putida KT2440
cuucagaucacccuuggccac

SEQ ID NO: 3595548 - RNA, 22 nt, Pseudomonas putida KT2440
cuucagaucacccuuggccacc

SEQ ID NO: 3595549 - RNA, 22 nt, Pseudomonas putida KT2440
cuucagcaggaagcuguacagc

SEQ ID NO: 3595550 - RNA, 23 nt, Pseudomonas putida KT2440
cuucagcaggaagcuguacagcg

SEQ ID NO: 3595551 - RNA, 18 nt, Pseudomonas putida KT2440
cuucagccaccgcacucu

SEQ ID NO: 3595552 - RNA, 22 nt, Pseudomonas putida KT2440
cuucagccaccgcacucugcug

SEQ ID NO: 3595553 - RNA, 14 nt, Pseudomonas putida KT2440
cuucagccuuuucc

SEQ ID NO: 3595554 - RNA, 23 nt, Pseudomonas putida KT2440
cuucagccuuuuccagcucggcc

SEQ ID NO: 3595555 - RNA, 15 nt, Pseudomonas putida KT2440
cuucagcgccccauc

SEQ ID NO: 3595556 - RNA, 21 nt, Pseudomonas putida KT2440
cuucagcgcggcaaccugcuc

SEQ ID NO: 3595557 - RNA, 23 nt, Pseudomonas putida KT2440
cuucagcgcggcaaccugcucgc

SEQ ID NO: 3595558 - RNA, 22 nt, Pseudomonas putida KT2440
cuucagcggccgcgcaauugcc

SEQ ID NO: 3595559 - RNA, 19 nt, Pseudomonas putida KT2440
cuucagcgggcuacacgcg

SEQ ID NO: 3595560 - RNA, 13 nt, Pseudomonas putida KT2440
cuucagcgggucg

SEQ ID NO: 3595561 - RNA, 18 nt, Pseudomonas putida KT2440
cuucagcgggucgagcca

SEQ ID NO: 3595562 - RNA, 18 nt, Pseudomonas putida KT2440
cuucagcucgaacccacu

SEQ ID NO: 3595563 - RNA, 21 nt, Pseudomonas putida KT2440
cuucagcuugagggucuugcc

SEQ ID NO: 3595564 - RNA, 23 nt, Pseudomonas putida KT2440
cuucaggcaucacgucacagcca

SEQ ID NO: 3595565 - RNA, 20 nt, Pseudomonas putida KT2440
cuucaggccccagucauccg

SEQ ID NO: 3595566 - RNA, 20 nt, Pseudomonas putida KT2440
cuucaggcgcucaccccgcc

SEQ ID NO: 3595567 - RNA, 19 nt, Pseudomonas putida KT2440
cuucaggcugcgccgccuc

SEQ ID NO: 3595568 - RNA, 17 nt, Pseudomonas putida KT2440
cuucagggucgggcaca

SEQ ID NO: 3595569 - RNA, 19 nt, Pseudomonas putida KT2440
cuucagggucgggcacagg

SEQ ID NO: 3595570 - RNA, 22 nt, Pseudomonas putida KT2440
cuucaggguuguggugagcccu

SEQ ID NO: 3595571 - RNA, 14 nt, Pseudomonas putida KT2440
cuucagguaaucca

SEQ ID NO: 3595572 - RNA, 17 nt, Pseudomonas putida KT2440
cuucagguucacuucca

SEQ ID NO: 3595573 - RNA, 14 nt, Pseudomonas putida KT2440
cuucagugcuucac

SEQ ID NO: 3595574 - RNA, 15 nt, Pseudomonas putida KT2440
cuucagugcuucaca

SEQ ID NO: 3595575 - RNA, 15 nt, Pseudomonas putida KT2440
cuucauacagcgccu

SEQ ID NO: 3595576 - RNA, 13 nt, Pseudomonas putida KT2440
cuucauaucacaa

SEQ ID NO: 3595577 - RNA, 21 nt, Pseudomonas putida KT2440
cuucaucacgcaccaggucgc

SEQ ID NO: 3595578 - RNA, 16 nt, Pseudomonas putida KT2440
cuucaucgccaagccg

SEQ ID NO: 3595579 - RNA, 19 nt, Pseudomonas putida KT2440
cuucaucgcugacuuccag

SEQ ID NO: 3595580 - RNA, 19 nt, Pseudomonas putida KT2440
cuucaucugcgccugugca

SEQ ID NO: 3595581 - RNA, 19 nt, Pseudomonas putida KT2440
cuucaugaagucagccagg

SEQ ID NO: 3595582 - RNA, 19 nt, Pseudomonas putida KT2440
cuucgccguacuggcugca

SEQ ID NO: 3595583 - RNA, 14 nt, Pseudomonas putida KT2440
cuucgccugcagca

SEQ ID NO: 3595584 - RNA, 14 nt, Pseudomonas putida KT2440
cuucgccuuccucg

SEQ ID NO: 3595585 - RNA, 23 nt, Pseudomonas putida KT2440
cuucgcgcucgaacaacgccucg

SEQ ID NO: 3595586 - RNA, 22 nt, Pseudomonas putida KT2440
cuucgcgcuugagcaaggcauu

SEQ ID NO: 3595587 - RNA, 20 nt, Pseudomonas putida KT2440
cuucgcggaagauacccgcc

SEQ ID NO: 3595588 - RNA, 18 nt, Pseudomonas putida KT2440
cuucgcggccaagccgcu

SEQ ID NO: 3595589 - RNA, 16 nt, Pseudomonas putida KT2440
cuucgcgggcaagccc

SEQ ID NO: 3595590 - RNA, 20 nt, Pseudomonas putida KT2440
cuucgcgggcaagcccgcuc

SEQ ID NO: 3595591 - RNA, 12 nt, Pseudomonas putida KT2440
cuucgcgggcac

SEQ ID NO: 3595592 - RNA, 17 nt, Pseudomonas putida KT2440
cuucgcgggcacgcccg

SEQ ID NO: 3595593 - RNA, 12 nt, Pseudomonas putida KT2440
cuucgcgggcau

SEQ ID NO: 3595594 - RNA, 13 nt, Pseudomonas putida KT2440
cuucgcgggcaug

SEQ ID NO: 3595595 - RNA, 15 nt, Pseudomonas putida KT2440
cuucgcgggcaugcc

SEQ ID NO: 3595596 - RNA, 20 nt, Pseudomonas putida KT2440
cuucgcgggcaugcccgcuc

SEQ ID NO: 3595597 - RNA, 20 nt, Pseudomonas putida KT2440
cuucgcggguaaacccgcgc

SEQ ID NO: 3595598 - RNA, 20 nt, Pseudomonas putida KT2440
cuucgcggguaagcccgcuc

SEQ ID NO: 3595599 - RNA, 20 nt, Pseudomonas putida KT2440
cuucgcgggugaacccgcuc

SEQ ID NO: 3595600 - RNA, 21 nt, Pseudomonas putida KT2440
cuucgcgugaacuggagguga

SEQ ID NO: 3595601 - RNA, 17 nt, Pseudomonas putida KT2440
cuucgcucacaaagccc

SEQ ID NO: 3595602 - RNA, 15 nt, Pseudomonas putida KT2440
cuucgcucaggugca

SEQ ID NO: 3595603 - RNA, 23 nt, Pseudomonas putida KT2440
cuucgcucaggugcaccuccgcc

SEQ ID NO: 3595604 - RNA, 17 nt, Pseudomonas putida KT2440
cuucgcucaucacuacu

SEQ ID NO: 3595605 - RNA, 23 nt, Pseudomonas putida KT2440
cuucgcuguaaccugguuguagc

SEQ ID NO: 3595606 - RNA, 21 nt, Pseudomonas putida KT2440
cuucggagguagccaccugau

SEQ ID NO: 3595607 - RNA, 22 nt, Pseudomonas putida KT2440
cuucggagguagccaccugaug

SEQ ID NO: 3595608 - RNA, 15 nt, Pseudomonas putida KT2440
cuucggcaucggccu

SEQ ID NO: 3595609 - RNA, 17 nt, Pseudomonas putida KT2440
cuucggccagcaguucg

SEQ ID NO: 3595610 - RNA, 18 nt, Pseudomonas putida KT2440
cuucggccagcaguucgu

SEQ ID NO: 3595611 - RNA, 21 nt, Pseudomonas putida KT2440
cuucggccaguuucagcgccu

SEQ ID NO: 3595612 - RNA, 18 nt, Pseudomonas putida KT2440
cuucggcgacaggugccu

SEQ ID NO: 3595613 - RNA, 22 nt, Pseudomonas putida KT2440
cuucggcgauauggcuccacca

SEQ ID NO: 3595614 - RNA, 14 nt, Pseudomonas putida KT2440
cuucggcggcuuuc

SEQ ID NO: 3595615 - RNA, 15 nt, Pseudomonas putida KT2440
cuucgggaauaccag

SEQ ID NO: 3595616 - RNA, 15 nt, Pseudomonas putida KT2440
cuucggucagcuggu

SEQ ID NO: 3595617 - RNA, 18 nt, Pseudomonas putida KT2440
cuucggucuggccgagcu

SEQ ID NO: 3595618 - RNA, 18 nt, Pseudomonas putida KT2440
cuucgguggugaucauca

SEQ ID NO: 3595619 - RNA, 16 nt, Pseudomonas putida KT2440
cuucggugugcuccag

SEQ ID NO: 3595620 - RNA, 23 nt, Pseudomonas putida KT2440
cuucguagguaacaagcccuucg

SEQ ID NO: 3595621 - RNA, 23 nt, Pseudomonas putida KT2440
cuucguaguaauggccgaugaac

SEQ ID NO: 3595622 - RNA, 14 nt, Pseudomonas putida KT2440
cuucgucaccgugc

SEQ ID NO: 3595623 - RNA, 12 nt, Pseudomonas putida KT2440
cuucguccaggg

SEQ ID NO: 3595624 - RNA, 20 nt, Pseudomonas putida KT2440
cuucguccaggguggcguug

SEQ ID NO: 3595625 - RNA, 21 nt, Pseudomonas putida KT2440
cuucguccaggguggcguuga

SEQ ID NO: 3595626 - RNA, 14 nt, Pseudomonas putida KT2440
cuucgucgcuggcc

SEQ ID NO: 3595627 - RNA, 15 nt, Pseudomonas putida KT2440
cuucgucgcuggcca

SEQ ID NO: 3595628 - RNA, 23 nt, Pseudomonas putida KT2440
cuucguugucgccuuucaggucg

SEQ ID NO: 3595629 - RNA, 19 nt, Pseudomonas putida KT2440
cuucuauuaaugcacgccu

SEQ ID NO: 3595630 - RNA, 16 nt, Pseudomonas putida KT2440
cuucucacugaugucg

SEQ ID NO: 3595631 - RNA, 14 nt, Pseudomonas putida KT2440
cuucucaggcacca

SEQ ID NO: 3595632 - RNA, 20 nt, Pseudomonas putida KT2440
cuucucaggcaccagcgcug

SEQ ID NO: 3595633 - RNA, 18 nt, Pseudomonas putida KT2440
cuucucgccucagcgcca

SEQ ID NO: 3595634 - RNA, 19 nt, Pseudomonas putida KT2440
cuucucgccucagcgccaa

SEQ ID NO: 3595635 - RNA, 19 nt, Pseudomonas putida KT2440
cuucucgcgcaggcggucg

SEQ ID NO: 3595636 - RNA, 18 nt, Pseudomonas putida KT2440
cuucucgcgcuuggccag

SEQ ID NO: 3595637 - RNA, 19 nt, Pseudomonas putida KT2440
cuucucggcaaagcguucg

SEQ ID NO: 3595638 - RNA, 20 nt, Pseudomonas putida KT2440
cuucucggccucagccggcu

SEQ ID NO: 3595639 - RNA, 20 nt, Pseudomonas putida KT2440
cuucucggucgccaacccca

SEQ ID NO: 3595640 - RNA, 14 nt, Pseudomonas putida KT2440
cuucucuuccgcca

SEQ ID NO: 3595641 - RNA, 20 nt, Pseudomonas putida KT2440
cuucucuuccgccagccaac

SEQ ID NO: 3595642 - RNA, 18 nt, Pseudomonas putida KT2440
cuucugaccaauccagcc

SEQ ID NO: 3595643 - RNA, 23 nt, Pseudomonas putida KT2440
cuucugcacgcccgaaacacccu

SEQ ID NO: 3595644 - RNA, 14 nt, Pseudomonas putida KT2440
cuucugccguucac

SEQ ID NO: 3595645 - RNA, 17 nt, Pseudomonas putida KT2440
cuucugcggccagggca

SEQ ID NO: 3595646 - RNA, 17 nt, Pseudomonas putida KT2440
cuucugcugguccuugc

SEQ ID NO: 3595647 - RNA, 15 nt, Pseudomonas putida KT2440
cuucugcuucagcuc

SEQ ID NO: 3595648 - RNA, 14 nt, Pseudomonas putida KT2440
cuucugcuugcucu

SEQ ID NO: 3595649 - RNA, 17 nt, Pseudomonas putida KT2440
cuucuggcccugggagu

SEQ ID NO: 3595650 - RNA, 15 nt, Pseudomonas putida KT2440
cuucuggcugggcuu

SEQ ID NO: 3595651 - RNA, 12 nt, Pseudomonas putida KT2440
cuucuggugaaa

SEQ ID NO: 3595652 - RNA, 21 nt, Pseudomonas putida KT2440
cuucuguggaaaaccgcucga

SEQ ID NO: 3595653 - RNA, 16 nt, Pseudomonas putida KT2440
cuucuguuugugccag

SEQ ID NO: 3595654 - RNA, 20 nt, Pseudomonas putida KT2440
cuucuucgcgggcaugcccg

SEQ ID NO: 3595655 - RNA, 18 nt, Pseudomonas putida KT2440
cuucuucgcggguaaacc

SEQ ID NO: 3595656 - RNA, 15 nt, Pseudomonas putida KT2440
cuucuucggucagcu

SEQ ID NO: 3595657 - RNA, 17 nt, Pseudomonas putida KT2440
cuucuucggucagcugg

SEQ ID NO: 3595658 - RNA, 22 nt, Pseudomonas putida KT2440
cuucuugaagcguucagucagu

SEQ ID NO: 3595659 - RNA, 21 nt, Pseudomonas putida KT2440
cuucuugacgggugaccaggc

SEQ ID NO: 3595660 - RNA, 16 nt, Pseudomonas putida KT2440
cuucuugcaccgcucc

SEQ ID NO: 3595661 - RNA, 12 nt, Pseudomonas putida KT2440
cuucuugcaguu

SEQ ID NO: 3595662 - RNA, 16 nt, Pseudomonas putida KT2440
cuucuuucagcucaau

SEQ ID NO: 3595663 - RNA, 15 nt, Pseudomonas putida KT2440
cuugaacggcauuuc

SEQ ID NO: 3595664 - RNA, 17 nt, Pseudomonas putida KT2440
cuugaacugggcaucca

SEQ ID NO: 3595665 - RNA, 16 nt, Pseudomonas putida KT2440
cuugaagaacaccugc

SEQ ID NO: 3595666 - RNA, 17 nt, Pseudomonas putida KT2440
cuugaagaugaccuugu

SEQ ID NO: 3595667 - RNA, 19 nt, Pseudomonas putida KT2440
cuugaagcgcggcaugccc

SEQ ID NO: 3595668 - RNA, 20 nt, Pseudomonas putida KT2440
cuugaagcgcggcaugcccg

SEQ ID NO: 3595669 - RNA, 12 nt, Pseudomonas putida KT2440
cuugaagcggcc

SEQ ID NO: 3595670 - RNA, 23 nt, Pseudomonas putida KT2440
cuugaaguaguccccaucacgca

SEQ ID NO: 3595671 - RNA, 14 nt, Pseudomonas putida KT2440
cuugaauccccuua

SEQ ID NO: 3595672 - RNA, 20 nt, Pseudomonas putida KT2440
cuugaccaccagggacgaac

SEQ ID NO: 3595673 - RNA, 22 nt, Pseudomonas putida KT2440
cuugaccacuucgacauggcug

SEQ ID NO: 3595674 - RNA, 21 nt, Pseudomonas putida KT2440
cuugaccagcaacggccgcgc

SEQ ID NO: 3595675 - RNA, 17 nt, Pseudomonas putida KT2440
cuugaccauggcgauga

SEQ ID NO: 3595676 - RNA, 23 nt, Pseudomonas putida KT2440
cuugaccccuucaucacccaguu

SEQ ID NO: 3595677 - RNA, 20 nt, Pseudomonas putida KT2440
cuugaccucgaccaggcgcu

SEQ ID NO: 3595678 - RNA, 16 nt, Pseudomonas putida KT2440
cuugaccuugucagca

SEQ ID NO: 3595679 - RNA, 17 nt, Pseudomonas putida KT2440
cuugacgaucgccagcc

SEQ ID NO: 3595680 - RNA, 20 nt, Pseudomonas putida KT2440
cuugacgaucgccagcccca

SEQ ID NO: 3595681 - RNA, 14 nt, Pseudomonas putida KT2440
cuugacgggugacc

SEQ ID NO: 3595682 - RNA, 19 nt, Pseudomonas putida KT2440
cuugacgggugaccaggcc

SEQ ID NO: 3595683 - RNA, 18 nt, Pseudomonas putida KT2440
cuugacggugcgcgccag

SEQ ID NO: 3595684 - RNA, 17 nt, Pseudomonas putida KT2440
cuugacuauuucuagua

SEQ ID NO: 3595685 - RNA, 19 nt, Pseudomonas putida KT2440
cuugacuuccagcuugccg

SEQ ID NO: 3595686 - RNA, 14 nt, Pseudomonas putida KT2440
cuugagaucagcaa

SEQ ID NO: 3595687 - RNA, 16 nt, Pseudomonas putida KT2440
cuugcgugccucagcc

SEQ ID NO: 3595688 - RNA, 22 nt, Pseudomonas putida KT2440
cuugcgugccucagccaggcug

SEQ ID NO: 3595689 - RNA, 16 nt, Pseudomonas putida KT2440
cuugcguuucuucauc

SEQ ID NO: 3595690 - RNA, 19 nt, Pseudomonas putida KT2440
cuugcguuucuucaucccu

SEQ ID NO: 3595691 - RNA, 21 nt, Pseudomonas putida KT2440
cuugcuaugggaagucgccgc

SEQ ID NO: 3595692 - RNA, 17 nt, Pseudomonas putida KT2440
cuugcucgaaugccgcu

SEQ ID NO: 3595693 - RNA, 17 nt, Pseudomonas putida KT2440
cuugcucgcggcgcagg

SEQ ID NO: 3595694 - RNA, 17 nt, Pseudomonas putida KT2440
cuugcucuguucgcugg

SEQ ID NO: 3595695 - RNA, 14 nt, Pseudomonas putida KT2440
cuugcugaucaauc

SEQ ID NO: 3595696 - RNA, 16 nt, Pseudomonas putida KT2440
cuugcugaucaccagg

SEQ ID NO: 3595697 - RNA, 23 nt, Pseudomonas putida KT2440
cuugcugauggugucuuccaggu

SEQ ID NO: 3595698 - RNA, 18 nt, Pseudomonas putida KT2440
cuugcugcagcaggcugg

SEQ ID NO: 3595699 - RNA, 20 nt, Pseudomonas putida KT2440
cuugcugcagggcacgccaa

SEQ ID NO: 3595700 - RNA, 15 nt, Pseudomonas putida KT2440
cuugcugcucugcaa

SEQ ID NO: 3595701 - RNA, 15 nt, Pseudomonas putida KT2440
cuugcuggaacugcu

SEQ ID NO: 3595702 - RNA, 13 nt, Pseudomonas putida KT2440
cuugcuggccacc

SEQ ID NO: 3595703 - RNA, 13 nt, Pseudomonas putida KT2440
cuugcuggccggu

SEQ ID NO: 3595704 - RNA, 23 nt, Pseudomonas putida KT2440
cuugcuguagcccaccaggucau

SEQ ID NO: 3595705 - RNA, 20 nt, Pseudomonas putida KT2440
cuugcuuggcagcggcuggc

SEQ ID NO: 3595706 - RNA, 22 nt, Pseudomonas putida KT2440
cuuggaaauguucaacagccgc

SEQ ID NO: 3595707 - RNA, 13 nt, Pseudomonas putida KT2440
cuuggacaggccc

SEQ ID NO: 3595708 - RNA, 17 nt, Pseudomonas putida KT2440
cuuggacgcuggcagcu

SEQ ID NO: 3595709 - RNA, 23 nt, Pseudomonas putida KT2440
cuuggagcgcgcccccgaccacc

SEQ ID NO: 3595710 - RNA, 20 nt, Pseudomonas putida KT2440
cuuggaguugcucgagugcg

SEQ ID NO: 3595711 - RNA, 22 nt, Pseudomonas putida KT2440
cuuggauggggcucagucccag

SEQ ID NO: 3595712 - RNA, 19 nt, Pseudomonas putida KT2440
cuuggcaccggcagcagca

SEQ ID NO: 3595713 - RNA, 19 nt, Pseudomonas putida KT2440
cuuggcaccuaucgcugcc

SEQ ID NO: 3595714 - RNA, 23 nt, Pseudomonas putida KT2440
cuuggcacgaaacgccacgccca

SEQ ID NO: 3595715 - RNA, 14 nt, Pseudomonas putida KT2440
cuuggcacgcuggc

SEQ ID NO: 3595716 - RNA, 15 nt, Pseudomonas putida KT2440
cuuggcacgcuggcu

SEQ ID NO: 3595717 - RNA, 13 nt, Pseudomonas putida KT2440
cuuggcagccucg

SEQ ID NO: 3595718 - RNA, 17 nt, Pseudomonas putida KT2440
cuuggcagcggcuggcg

SEQ ID NO: 3595719 - RNA, 20 nt, Pseudomonas putida KT2440
cuuggcagcggcuggcgcuc

SEQ ID NO: 3595720 - RNA, 13 nt, Pseudomonas putida KT2440
cuuggcagugaug

SEQ ID NO: 3595721 - RNA, 23 nt, Pseudomonas putida KT2440
cuuggcauagcgcucgcgcaggg

SEQ ID NO: 3595722 - RNA, 22 nt, Pseudomonas putida KT2440
cuuggcauuggugccagcgcca

SEQ ID NO: 3595723 - RNA, 23 nt, Pseudomonas putida KT2440
cuuggcauuggugccagcgccaa

SEQ ID NO: 3595724 - RNA, 22 nt, Pseudomonas putida KT2440
cuuggccaaaccgggaaagucu

SEQ ID NO: 3595725 - RNA, 17 nt, Pseudomonas putida KT2440
cuuggccaacugcagca

SEQ ID NO: 3595726 - RNA, 17 nt, Pseudomonas putida KT2440
cuuggccaaugccagga

SEQ ID NO: 3595727 - RNA, 16 nt, Pseudomonas putida KT2440
cuuggccaccuucacc

SEQ ID NO: 3595728 - RNA, 23 nt, Pseudomonas putida KT2440
cuuggccagacucagcugcugcu

SEQ ID NO: 3595729 - RNA, 15 nt, Pseudomonas putida KT2440
cuuggccagggccuu

SEQ ID NO: 3595730 - RNA, 18 nt, Pseudomonas putida KT2440
cuuggccauuuccggccc

SEQ ID NO: 3595731 - RNA, 17 nt, Pseudomonas putida KT2440
cuuggcccaguacgccu

SEQ ID NO: 3595732 - RNA, 14 nt, Pseudomonas putida KT2440
cuuggccccaggga

SEQ ID NO: 3595733 - RNA, 18 nt, Pseudomonas putida KT2440
cuuggcccuguagagcgc

SEQ ID NO: 3595734 - RNA, 19 nt, Pseudomonas putida KT2440
cuuggcccuguagagcgcc

SEQ ID NO: 3595735 - RNA, 17 nt, Pseudomonas putida KT2440
cuuggccgacuggcgca

SEQ ID NO: 3595736 - RNA, 18 nt, Pseudomonas putida KT2440
cuuggccgacuggcgcac

SEQ ID NO: 3595737 - RNA, 18 nt, Pseudomonas putida KT2440
cuuggccgcaauggcgcc

SEQ ID NO: 3595738 - RNA, 22 nt, Pseudomonas putida KT2440
cuuggccucacauucaccgcca

SEQ ID NO: 3595739 - RNA, 17 nt, Pseudomonas putida KT2440
cuuggccugcucacccg

SEQ ID NO: 3595740 - RNA, 14 nt, Pseudomonas putida KT2440
cuuggccugggcuu

SEQ ID NO: 3595741 - RNA, 13 nt, Pseudomonas putida KT2440
cuuggccuggggc

SEQ ID NO: 3595742 - RNA, 23 nt, Pseudomonas putida KT2440
cuuggcgaaugcgcucauccagc

SEQ ID NO: 3595743 - RNA, 18 nt, Pseudomonas putida KT2440
cuuggcgaugaugugcgc

SEQ ID NO: 3595744 - RNA, 14 nt, Pseudomonas putida KT2440
cuuggcgcacuugu

SEQ ID NO: 3595745 - RNA, 23 nt, Pseudomonas putida KT2440
cuuggcgcacuuguuccagccgc

SEQ ID NO: 3595746 - RNA, 13 nt, Pseudomonas putida KT2440
cuuggcgccgccc

SEQ ID NO: 3595747 - RNA, 23 nt, Pseudomonas putida KT2440
cuuggcggcccauucgcggguaa

SEQ ID NO: 3595748 - RNA, 16 nt, Pseudomonas putida KT2440
cuuggcggcugggugc

SEQ ID NO: 3595749 - RNA, 22 nt, Pseudomonas putida KT2440
cuuggcguccacagccaugccg

SEQ ID NO: 3595750 - RNA, 15 nt, Pseudomonas putida KT2440
cuuggcguccaggua

SEQ ID NO: 3595751 - RNA, 17 nt, Pseudomonas putida KT2440
cuuggcguuggcugccg

SEQ ID NO: 3595752 - RNA, 19 nt, Pseudomonas putida KT2440
cuuggcguuggcugccgcu

SEQ ID NO: 3595753 - RNA, 14 nt, Pseudomonas putida KT2440
cuuggcucgacgcg

SEQ ID NO: 3595754 - RNA, 20 nt, Pseudomonas putida KT2440
cuuggcucgacgcgggccaa

SEQ ID NO: 3595755 - RNA, 14 nt, Pseudomonas putida KT2440
cuuggcugccggcc

SEQ ID NO: 3595756 - RNA, 11 nt, Pseudomonas putida KT2440
cuuggcuucac

SEQ ID NO: 3595757 - RNA, 17 nt, Pseudomonas putida KT2440
cuuggcuuucggcgcac

SEQ ID NO: 3595758 - RNA, 23 nt, Pseudomonas putida KT2440
cuugggaaugugucagggcugca

SEQ ID NO: 3595759 - RNA, 23 nt, Pseudomonas putida KT2440
cuugggcucagccgccacaugcc

SEQ ID NO: 3595760 - RNA, 23 nt, Pseudomonas putida KT2440
cuugggggugaagcccugcugcu

SEQ ID NO: 3595761 - RNA, 16 nt, Pseudomonas putida KT2440
cuuggucagcaucacc

SEQ ID NO: 3595762 - RNA, 13 nt, Pseudomonas putida KT2440
cuuggucagggca

SEQ ID NO: 3595763 - RNA, 18 nt, Pseudomonas putida KT2440
cuuggucccccacuucug

SEQ ID NO: 3595764 - RNA, 23 nt, Pseudomonas putida KT2440
cuuggucccccacuucugccggu

SEQ ID NO: 3595765 - RNA, 23 nt, Pseudomonas putida KT2440
cuugguccggucacugcgcggcc

SEQ ID NO: 3595766 - RNA, 16 nt, Pseudomonas putida KT2440
cuuggucucgaucagc

SEQ ID NO: 3595767 - RNA, 17 nt, Pseudomonas putida KT2440
cuuggucucgaucagcg

SEQ ID NO: 3595768 - RNA, 16 nt, Pseudomonas putida KT2440
cuuggugcaccagcuu

SEQ ID NO: 3595769 - RNA, 14 nt, Pseudomonas putida KT2440
cuuggugcgcgcau

SEQ ID NO: 3595770 - RNA, 21 nt, Pseudomonas putida KT2440
cuuggugcgcgcauccagcag

SEQ ID NO: 3595771 - RNA, 18 nt, Pseudomonas putida KT2440
cuugguggucagccaggc

SEQ ID NO: 3595772 - RNA, 17 nt, Pseudomonas putida KT2440
cuuguaagagcggccuu

SEQ ID NO: 3595773 - RNA, 13 nt, Pseudomonas putida KT2440
cuuguaccgagag

SEQ ID NO: 3595774 - RNA, 14 nt, Pseudomonas putida KT2440
cuuguagccggcag

SEQ ID NO: 3595775 - RNA, 19 nt, Pseudomonas putida KT2440
cuuguagcggucgaacaug

SEQ ID NO: 3595776 - RNA, 17 nt, Pseudomonas putida KT2440
cuuguaggagcggguuu

SEQ ID NO: 3595777 - RNA, 15 nt, Pseudomonas putida KT2440
cuuguaguucaucuu

SEQ ID NO: 3595778 - RNA, 19 nt, Pseudomonas putida KT2440
cuuguaguucaucuucuug

SEQ ID NO: 3595779 - RNA, 15 nt, Pseudomonas putida KT2440
cuuguaucccaggcg

SEQ ID NO: 3595780 - RNA, 14 nt, Pseudomonas putida KT2440
cuuguauuggccaa

SEQ ID NO: 3595781 - RNA, 17 nt, Pseudomonas putida KT2440
cuuguauuggccaagaa

SEQ ID NO: 3595782 - RNA, 16 nt, Pseudomonas putida KT2440
cuugucagcagcuuca

SEQ ID NO: 3595783 - RNA, 17 nt, Pseudomonas putida KT2440
cuuguccagguuugggu

SEQ ID NO: 3595784 - RNA, 12 nt, Pseudomonas putida KT2440
cuugucccaggc

SEQ ID NO: 3595785 - RNA, 13 nt, Pseudomonas putida KT2440
cuugucccaggcc

SEQ ID NO: 3595786 - RNA, 13 nt, Pseudomonas putida KT2440
cuuguccuggauc

SEQ ID NO: 3595787 - RNA, 14 nt, Pseudomonas putida KT2440
cuugucgaccuggu

SEQ ID NO: 3595788 - RNA, 15 nt, Pseudomonas putida KT2440
cuugucgaccugguc

SEQ ID NO: 3595789 - RNA, 18 nt, Pseudomonas putida KT2440
cuugucggcacgcgccag

SEQ ID NO: 3595790 - RNA, 14 nt, Pseudomonas putida KT2440
cuugucggugguga

SEQ ID NO: 3595791 - RNA, 20 nt, Pseudomonas putida KT2440
cuugucuccaugucgaauaa

SEQ ID NO: 3595792 - RNA, 15 nt, Pseudomonas putida KT2440
cuuuuuuauugcugu

SEQ ID NO: 3595793 - RNA, 19 nt, Pseudomonas putida KT2440
cuuuuuucgggcugcugcc

SEQ ID NO: 3595794 - RNA, 15 nt, Pseudomonas putida KT2440
gaaaaaaagauuugc

SEQ ID NO: 3595795 - RNA, 22 nt, Pseudomonas putida KT2440
gaaaaaaucaugcgcuggccac

SEQ ID NO: 3595796 - RNA, 16 nt, Pseudomonas putida KT2440
gaaaaaauuuuugaau

SEQ ID NO: 3595797 - RNA, 20 nt, Pseudomonas putida KT2440
gaaaaacagcaguuugcugc

SEQ ID NO: 3595798 - RNA, 14 nt, Pseudomonas putida KT2440
gaaaaagcccggcc

SEQ ID NO: 3595799 - RNA, 17 nt, Pseudomonas putida KT2440
gaaaaaggggugcaaag

SEQ ID NO: 3595800 - RNA, 12 nt, Pseudomonas putida KT2440
gaaaaccuccca

SEQ ID NO: 3595801 - RNA, 16 nt, Pseudomonas putida KT2440
gaaaacuccugcuggu

SEQ ID NO: 3595802 - RNA, 19 nt, Pseudomonas putida KT2440
gaaaacugggcagcccuca

SEQ ID NO: 3595803 - RNA, 17 nt, Pseudomonas putida KT2440
gaaaagcaaggcucagg

SEQ ID NO: 3595804 - RNA, 14 nt, Pseudomonas putida KT2440
gaaaagcaucaacu

SEQ ID NO: 3595805 - RNA, 15 nt, Pseudomonas putida KT2440
gaaaagccugcacca

SEQ ID NO: 3595806 - RNA, 15 nt, Pseudomonas putida KT2440
gaaaagcgagguacg

SEQ ID NO: 3595807 - RNA, 23 nt, Pseudomonas putida KT2440
gaaaaggccaaccacccgggcag

SEQ ID NO: 3595808 - RNA, 14 nt, Pseudomonas putida KT2440
gaaaaggcccugca

SEQ ID NO: 3595809 - RNA, 21 nt, Pseudomonas putida KT2440
gaaaaggcccugcauaugcag

SEQ ID NO: 3595810 - RNA, 20 nt, Pseudomonas putida KT2440
gaaaaucgacccaccuaccc

SEQ ID NO: 3595811 - RNA, 20 nt, Pseudomonas putida KT2440
gaaaaucgccuugcgucggc

SEQ ID NO: 3595812 - RNA, 21 nt, Pseudomonas putida KT2440
gaaaaucucguucaugcccuu

SEQ ID NO: 3595813 - RNA, 23 nt, Pseudomonas putida KT2440
gaaaaucucguucaugcccuucu

SEQ ID NO: 3595814 - RNA, 20 nt, Pseudomonas putida KT2440
gaaaaugcccccgccgaagc

SEQ ID NO: 3595815 - RNA, 14 nt, Pseudomonas putida KT2440
gaaaaugcccgcug

SEQ ID NO: 3595816 - RNA, 19 nt, Pseudomonas putida KT2440
gaaaauguuacccaagcac

SEQ ID NO: 3595817 - RNA, 16 nt, Pseudomonas putida KT2440
gaaacacagcaggcca

SEQ ID NO: 3595818 - RNA, 21 nt, Pseudomonas putida KT2440
gaaacacgaaguugagcaccg

SEQ ID NO: 3595819 - RNA, 15 nt, Pseudomonas putida KT2440
gaaacaucagccggu

SEQ ID NO: 3595820 - RNA, 19 nt, Pseudomonas putida KT2440
gaaaccacaguggguggca

SEQ ID NO: 3595821 - RNA, 20 nt, Pseudomonas putida KT2440
gaaaccacaguggguggcac

SEQ ID NO: 3595822 - RNA, 13 nt, Pseudomonas putida KT2440
gaaaccacugcug

SEQ ID NO: 3595823 - RNA, 19 nt, Pseudomonas putida KT2440
gaaaccaugcaggucgacg

SEQ ID NO: 3595824 - RNA, 18 nt, Pseudomonas putida KT2440
gaaacccgcaucaucacg

SEQ ID NO: 3595825 - RNA, 14 nt, Pseudomonas putida KT2440
gaaacccggcgcag

SEQ ID NO: 3595826 - RNA, 17 nt, Pseudomonas putida KT2440
gaaacccggcgcagcgg

SEQ ID NO: 3595827 - RNA, 18 nt, Pseudomonas putida KT2440
gaaaccgaaaccacugcu

SEQ ID NO: 3595828 - RNA, 20 nt, Pseudomonas putida KT2440
gaaaccgcgaaucgcucacc

SEQ ID NO: 3595829 - RNA, 15 nt, Pseudomonas putida KT2440
gaaaccgcgugccga

SEQ ID NO: 3595830 - RNA, 11 nt, Pseudomonas putida KT2440
gaaaccggcaa

SEQ ID NO: 3595831 - RNA, 18 nt, Pseudomonas putida KT2440
gaaaccguuggucagcga

SEQ ID NO: 3595832 - RNA, 21 nt, Pseudomonas putida KT2440
gaaaccuaaacugugggagca

SEQ ID NO: 3595833 - RNA, 23 nt, Pseudomonas putida KT2440
gaaaccuccggcaucauccugcu

SEQ ID NO: 3595834 - RNA, 17 nt, Pseudomonas putida KT2440
gaaacgauacuccggca

SEQ ID NO: 3595835 - RNA, 19 nt, Pseudomonas putida KT2440
gaaacgauacuccggcaac

SEQ ID NO: 3595836 - RNA, 17 nt, Pseudomonas putida KT2440
gaaacgcaggcucugcg

SEQ ID NO: 3595837 - RNA, 15 nt, Pseudomonas putida KT2440
gaaacgccacgccca

SEQ ID NO: 3595838 - RNA, 15 nt, Pseudomonas putida KT2440
gaaacgccagcuguu

SEQ ID NO: 3595839 - RNA, 14 nt, Pseudomonas putida KT2440
gaaacgccaggcac

SEQ ID NO: 3595840 - RNA, 18 nt, Pseudomonas putida KT2440
gaaacgcggcaaccugca

SEQ ID NO: 3595841 - RNA, 21 nt, Pseudomonas putida KT2440
gaaacggcaaugaccaagcaa

SEQ ID NO: 3595842 - RNA, 16 nt, Pseudomonas putida KT2440
gaaacucacgcauggc

SEQ ID NO: 3595843 - RNA, 18 nt, Pseudomonas putida KT2440
gaaacucacgcgccaggg

SEQ ID NO: 3595844 - RNA, 18 nt, Pseudomonas putida KT2440
gaaacucguucagugccu

SEQ ID NO: 3595845 - RNA, 18 nt, Pseudomonas putida KT2440
gaaacugaucagcuucga

SEQ ID NO: 3595846 - RNA, 15 nt, Pseudomonas putida KT2440
gaaacugcgcucaac

SEQ ID NO: 3595847 - RNA, 20 nt, Pseudomonas putida KT2440
gaaacugcgcucaaccagcc

SEQ ID NO: 3595848 - RNA, 22 nt, Pseudomonas putida KT2440
gaaacugcgcucaaccagccgc

SEQ ID NO: 3595849 - RNA, 14 nt, Pseudomonas putida KT2440
gaaacugcgcuggu

SEQ ID NO: 3595850 - RNA, 21 nt, Pseudomonas putida KT2440
gaaacugucguuuggcgcgau

SEQ ID NO: 3595851 - RNA, 23 nt, Pseudomonas putida KT2440
gaaagaacuugguccagaaaaua

SEQ ID NO: 3595852 - RNA, 16 nt, Pseudomonas putida KT2440
gaaagcaagguagcgg

SEQ ID NO: 3595853 - RNA, 19 nt, Pseudomonas putida KT2440
gaaagccacugcaccaaug

SEQ ID NO: 3595854 - RNA, 21 nt, Pseudomonas putida KT2440
gaaagcccccgccugcuggcc

SEQ ID NO: 3595855 - RNA, 15 nt, Pseudomonas putida KT2440
gaaagcgauugccca

SEQ ID NO: 3595856 - RNA, 21 nt, Pseudomonas putida KT2440
gaaagcgcaaucaaagcagac

SEQ ID NO: 3595857 - RNA, 15 nt, Pseudomonas putida KT2440
gaaagcgguugagau

SEQ ID NO: 3595858 - RNA, 20 nt, Pseudomonas putida KT2440
gaaaggagacaaccaacagg

SEQ ID NO: 3595859 - RNA, 23 nt, Pseudomonas putida KT2440
gaaagggccagcacaaccacugc

SEQ ID NO: 3595860 - RNA, 20 nt, Pseudomonas putida KT2440
gaaagggccaguacaggcaa

SEQ ID NO: 3595861 - RNA, 18 nt, Pseudomonas putida KT2440
gaaagggccaguccaggc

SEQ ID NO: 3595862 - RNA, 14 nt, Pseudomonas putida KT2440
gaaagggccgcaaa

SEQ ID NO: 3595863 - RNA, 20 nt, Pseudomonas putida KT2440
gaaagggccgcaaggccgcu

SEQ ID NO: 3595864 - RNA, 14 nt, Pseudomonas putida KT2440
gaaaggggcgcaau

SEQ ID NO: 3595865 - RNA, 16 nt, Pseudomonas putida KT2440
gaaaguccaucugcuu

SEQ ID NO: 3595866 - RNA, 22 nt, Pseudomonas putida KT2440
gaaaguggccaagccaccgcca

SEQ ID NO: 3595867 - RNA, 19 nt, Pseudomonas putida KT2440
gaaauaccagacgcaggca

SEQ ID NO: 3595868 - RNA, 19 nt, Pseudomonas putida KT2440
gaaauacccaacuccagcg

SEQ ID NO: 3595869 - RNA, 19 nt, Pseudomonas putida KT2440
gaaauagguaaagccaccg

SEQ ID NO: 3595870 - RNA, 22 nt, Pseudomonas putida KT2440
gaaaucagccuucagugcuuca

SEQ ID NO: 3595871 - RNA, 14 nt, Pseudomonas putida KT2440
gaaauccaccagcu

SEQ ID NO: 3595872 - RNA, 15 nt, Pseudomonas putida KT2440
gaaauccaccagcuc

SEQ ID NO: 3595873 - RNA, 18 nt, Pseudomonas putida KT2440
gaaaucgggucauccccg

SEQ ID NO: 3595874 - RNA, 21 nt, Pseudomonas putida KT2440
gaaaucugccugcugcaacag

SEQ ID NO: 3595875 - RNA, 23 nt, Pseudomonas putida KT2440
gaaaucugccugcugcaacagcu

SEQ ID NO: 3595876 - RNA, 12 nt, Pseudomonas putida KT2440
gaaauggaauuu

SEQ ID NO: 3595877 - RNA, 21 nt, Pseudomonas putida KT2440
gaaauggcuuccggcgcuggu

SEQ ID NO: 3595878 - RNA, 22 nt, Pseudomonas putida KT2440
gaaauucaaguacaaacaccac

SEQ ID NO: 3595879 - RNA, 19 nt, Pseudomonas putida KT2440
gaaauucaccugccgggca

SEQ ID NO: 3595880 - RNA, 16 nt, Pseudomonas putida KT2440
gaaauuggccagcagg

SEQ ID NO: 3595881 - RNA, 18 nt, Pseudomonas putida KT2440
gaaauuggccagcaggcc

SEQ ID NO: 3595882 - RNA, 20 nt, Pseudomonas putida KT2440
gaacaaccugaacaaggccu

SEQ ID NO: 3595883 - RNA, 15 nt, Pseudomonas putida KT2440
gaacaauaaaacuac

SEQ ID NO: 3595884 - RNA, 15 nt, Pseudomonas putida KT2440
gaacacauagaacag

SEQ ID NO: 3595885 - RNA, 21 nt, Pseudomonas putida KT2440
gaacacauagucgauacccag

SEQ ID NO: 3595886 - RNA, 22 nt, Pseudomonas putida KT2440
gaacacauagucgauacccagg

SEQ ID NO: 3595887 - RNA, 15 nt, Pseudomonas putida KT2440
gaacacaucaccugc

SEQ ID NO: 3595888 - RNA, 23 nt, Pseudomonas putida KT2440
gaacacauccucaaaggcagccu

SEQ ID NO: 3595889 - RNA, 19 nt, Pseudomonas putida KT2440
gaacaccacccggucggcc

SEQ ID NO: 3595890 - RNA, 22 nt, Pseudomonas putida KT2440
gaacaccacccggucggccagc

SEQ ID NO: 3595891 - RNA, 20 nt, Pseudomonas putida KT2440
gaacaccacugucagccagc

SEQ ID NO: 3595892 - RNA, 21 nt, Pseudomonas putida KT2440
gaacaccacugucagccagcg

SEQ ID NO: 3595893 - RNA, 16 nt, Pseudomonas putida KT2440
gaacaccagccccagc

SEQ ID NO: 3595894 - RNA, 24 nt, Pseudomonas putida KT2440
gaacaccccgauucacagcagauc

SEQ ID NO: 3595895 - RNA, 19 nt, Pseudomonas putida KT2440
gaacacccgcgugugcucg

SEQ ID NO: 3595896 - RNA, 13 nt, Pseudomonas putida KT2440
gaacgggcucacc

SEQ ID NO: 3595897 - RNA, 19 nt, Pseudomonas putida KT2440
gaacgggcugucgagcagg

SEQ ID NO: 3595898 - RNA, 16 nt, Pseudomonas putida KT2440
gaacguggugcgggcc

SEQ ID NO: 3595899 - RNA, 20 nt, Pseudomonas putida KT2440
gaacuacgcgccagcaugga

SEQ ID NO: 3595900 - RNA, 23 nt, Pseudomonas putida KT2440
gaacucacccgccccacgcccga

SEQ ID NO: 3595901 - RNA, 15 nt, Pseudomonas putida KT2440
gaacucaguuacaga

SEQ ID NO: 3595902 - RNA, 17 nt, Pseudomonas putida KT2440
gaacucaugcuccugcg

SEQ ID NO: 3595903 - RNA, 18 nt, Pseudomonas putida KT2440
gaacuccccaccaggcaa

SEQ ID NO: 3595904 - RNA, 11 nt, Pseudomonas putida KT2440
gaacuccucca

SEQ ID NO: 3595905 - RNA, 18 nt, Pseudomonas putida KT2440
gaacuccuccagcucgcg

SEQ ID NO: 3595906 - RNA, 13 nt, Pseudomonas putida KT2440
gaacuccugcacc

SEQ ID NO: 3595907 - RNA, 14 nt, Pseudomonas putida KT2440
gaacuccugcaccg

SEQ ID NO: 3595908 - RNA, 22 nt, Pseudomonas putida KT2440
gaacucgaucggcacccccuuc

SEQ ID NO: 3595909 - RNA, 17 nt, Pseudomonas putida KT2440
gaacucggcgagccgcc

SEQ ID NO: 3595910 - RNA, 16 nt, Pseudomonas putida KT2440
gaacugauaacucuuc

SEQ ID NO: 3595911 - RNA, 21 nt, Pseudomonas putida KT2440
gaacugcaacuugcccgcgua

SEQ ID NO: 3595912 - RNA, 23 nt, Pseudomonas putida KT2440
gaacugcuugaacgagccagcca

SEQ ID NO: 3595913 - RNA, 17 nt, Pseudomonas putida KT2440
gaacuggaggugauggu

SEQ ID NO: 3595914 - RNA, 23 nt, Pseudomonas putida KT2440
gaacuggaugauccagcccacca

SEQ ID NO: 3595915 - RNA, 24 nt, Pseudomonas putida KT2440
gaacuggaugauccagcccaccac

SEQ ID NO: 3595916 - RNA, 13 nt, Pseudomonas putida KT2440
gaacuggcugccg

SEQ ID NO: 3595917 - RNA, 18 nt, Pseudomonas putida KT2440
gaacugggcauccagcuu

SEQ ID NO: 3595918 - RNA, 21 nt, Pseudomonas putida KT2440
gaacuuacuucggcgguugca

SEQ ID NO: 3595919 - RNA, 23 nt, Pseudomonas putida KT2440
gaacuucuucgggucuucggcgu

SEQ ID NO: 3595920 - RNA, 20 nt, Pseudomonas putida KT2440
gaacuugucuguacugcggc

SEQ ID NO: 3595921 - RNA, 16 nt, Pseudomonas putida KT2440
gaagaacagcgaagcc

SEQ ID NO: 3595922 - RNA, 15 nt, Pseudomonas putida KT2440
gaagaacgcgagcgu

SEQ ID NO: 3595923 - RNA, 13 nt, Pseudomonas putida KT2440
gaagaagaucagg

SEQ ID NO: 3595924 - RNA, 13 nt, Pseudomonas putida KT2440
gaagaauucaggc

SEQ ID NO: 3595925 - RNA, 23 nt, Pseudomonas putida KT2440
gaagaccacuuuuggcgugaggc

SEQ ID NO: 3595926 - RNA, 18 nt, Pseudomonas putida KT2440
gaagaccgccgcccaggu

SEQ ID NO: 3595927 - RNA, 19 nt, Pseudomonas putida KT2440
gaagaccgccgcccagguc

SEQ ID NO: 3595928 - RNA, 21 nt, Pseudomonas putida KT2440
gaagaccgccgcccaggucau

SEQ ID NO: 3595929 - RNA, 14 nt, Pseudomonas putida KT2440
gaagacgcucgaca

SEQ ID NO: 3595930 - RNA, 17 nt, Pseudomonas putida KT2440
gaagacgcucgacagca

SEQ ID NO: 3595931 - RNA, 20 nt, Pseudomonas putida KT2440
gaagacgcucgacagcaacu

SEQ ID NO: 3595932 - RNA, 12 nt, Pseudomonas putida KT2440
gaagaggccagg

SEQ ID NO: 3595933 - RNA, 14 nt, Pseudomonas putida KT2440
gaagaggccaggac

SEQ ID NO: 3595934 - RNA, 13 nt, Pseudomonas putida KT2440
gaagaggccagua

SEQ ID NO: 3595935 - RNA, 22 nt, Pseudomonas putida KT2440
gaagaggccaguaccagcagca

SEQ ID NO: 3595936 - RNA, 13 nt, Pseudomonas putida KT2440
gaagaggcccgaa

SEQ ID NO: 3595937 - RNA, 11 nt, Pseudomonas putida KT2440
gaagaggccgg

SEQ ID NO: 3595938 - RNA, 21 nt, Pseudomonas putida KT2440
gaagaggccggaccugcuggc

SEQ ID NO: 3595939 - RNA, 13 nt, Pseudomonas putida KT2440
gaagaggccggca

SEQ ID NO: 3595940 - RNA, 19 nt, Pseudomonas putida KT2440
gaagaggccggcacaggaa

SEQ ID NO: 3595941 - RNA, 23 nt, Pseudomonas putida KT2440
gaagaggccggcacaggaaggca

SEQ ID NO: 3595942 - RNA, 13 nt, Pseudomonas putida KT2440
gaagaggccggcc

SEQ ID NO: 3595943 - RNA, 20 nt, Pseudomonas putida KT2440
gaagaggccgguacaggcuu

SEQ ID NO: 3595944 - RNA, 14 nt, Pseudomonas putida KT2440
gaagagggcgacac

SEQ ID NO: 3595945 - RNA, 16 nt, Pseudomonas putida KT2440
gaagauacccgccacc

SEQ ID NO: 3595946 - RNA, 14 nt, Pseudomonas putida KT2440
gaagaucaggucgc

SEQ ID NO: 3595947 - RNA, 20 nt, Pseudomonas putida KT2440
gaagaucagguucagcagga

SEQ ID NO: 3595948 - RNA, 16 nt, Pseudomonas putida KT2440
gaagaucgccgcgcug

SEQ ID NO: 3595949 - RNA, 18 nt, Pseudomonas putida KT2440
gaagaugaagaaaccacc

SEQ ID NO: 3595950 - RNA, 15 nt, Pseudomonas putida KT2440
gaagaugacuggccg

SEQ ID NO: 3595951 - RNA, 14 nt, Pseudomonas putida KT2440
gaagaugguuucca

SEQ ID NO: 3595952 - RNA, 15 nt, Pseudomonas putida KT2440
gaagauuuucagcca

SEQ ID NO: 3595953 - RNA, 16 nt, Pseudomonas putida KT2440
gaagcaagcgcauggu

SEQ ID NO: 3595954 - RNA, 17 nt, Pseudomonas putida KT2440
gaagcaccacuggauga

SEQ ID NO: 3595955 - RNA, 15 nt, Pseudomonas putida KT2440
gaagcaccgccacaa

SEQ ID NO: 3595956 - RNA, 17 nt, Pseudomonas putida KT2440
gaagcacgucgcgauug

SEQ ID NO: 3595957 - RNA, 18 nt, Pseudomonas putida KT2440
gaagcagacaacgcggcg

SEQ ID NO: 3595958 - RNA, 14 nt, Pseudomonas putida KT2440
gaagcagaucauca

SEQ ID NO: 3595959 - RNA, 13 nt, Pseudomonas putida KT2440
gaagcagccacca

SEQ ID NO: 3595960 - RNA, 22 nt, Pseudomonas putida KT2440
gaagcaggccgaguaaccggcg

SEQ ID NO: 3595961 - RNA, 22 nt, Pseudomonas putida KT2440
gaagcaggccgguugcuccagc

SEQ ID NO: 3595962 - RNA, 15 nt, Pseudomonas putida KT2440
gaagcagugcugcca

SEQ ID NO: 3595963 - RNA, 19 nt, Pseudomonas putida KT2440
gaagccaaccccgcagaca

SEQ ID NO: 3595964 - RNA, 18 nt, Pseudomonas putida KT2440
gaagccaagcgccgucga

SEQ ID NO: 3595965 - RNA, 20 nt, Pseudomonas putida KT2440
gaagccauaucccgccaggu

SEQ ID NO: 3595966 - RNA, 17 nt, Pseudomonas putida KT2440
gaagccaugagcgagcu

SEQ ID NO: 3595967 - RNA, 22 nt, Pseudomonas putida KT2440
gaagccaugagcgagcucaacc

SEQ ID NO: 3595968 - RNA, 15 nt, Pseudomonas putida KT2440
gaagccaugucuuca

SEQ ID NO: 3595969 - RNA, 13 nt, Pseudomonas putida KT2440
gaagcccggccgc

SEQ ID NO: 3595970 - RNA, 18 nt, Pseudomonas putida KT2440
gaagcccguacagaccgc

SEQ ID NO: 3595971 - RNA, 13 nt, Pseudomonas putida KT2440
gaagcccgugcca

SEQ ID NO: 3595972 - RNA, 20 nt, Pseudomonas putida KT2440
gaagccuucacggauggcag

SEQ ID NO: 3595973 - RNA, 14 nt, Pseudomonas putida KT2440
gaagcgaccgguuu

SEQ ID NO: 3595974 - RNA, 18 nt, Pseudomonas putida KT2440
gaagcgcaccaguguagu

SEQ ID NO: 3595975 - RNA, 13 nt, Pseudomonas putida KT2440
gaagcgcaccucg

SEQ ID NO: 3595976 - RNA, 16 nt, Pseudomonas putida KT2440
gaagcgcaccucggcc

SEQ ID NO: 3595977 - RNA, 21 nt, Pseudomonas putida KT2440
gaagcgcaccucggccagugc

SEQ ID NO: 3595978 - RNA, 23 nt, Pseudomonas putida KT2440
gaagcgcacuuggccugcugauu

SEQ ID NO: 3595979 - RNA, 14 nt, Pseudomonas putida KT2440
gaagcgcgccuggu

SEQ ID NO: 3595980 - RNA, 14 nt, Pseudomonas putida KT2440
gaagcgcgggucuu

SEQ ID NO: 3595981 - RNA, 23 nt, Pseudomonas putida KT2440
gaagcgcgggucuuccaccaccu

SEQ ID NO: 3595982 - RNA, 20 nt, Pseudomonas putida KT2440
gaagcgcugacugccaggcc

SEQ ID NO: 3595983 - RNA, 15 nt, Pseudomonas putida KT2440
gaagcggaaguucac

SEQ ID NO: 3595984 - RNA, 21 nt, Pseudomonas putida KT2440
gaagcggccaccugccccagc

SEQ ID NO: 3595985 - RNA, 13 nt, Pseudomonas putida KT2440
gaagcggccggcc

SEQ ID NO: 3595986 - RNA, 16 nt, Pseudomonas putida KT2440
gaagcggcgcuuuucu

SEQ ID NO: 3595987 - RNA, 23 nt, Pseudomonas putida KT2440
gaagcggcugccuacccaggcaa

SEQ ID NO: 3595988 - RNA, 16 nt, Pseudomonas putida KT2440
gaagcggggaggccgg

SEQ ID NO: 3595989 - RNA, 21 nt, Pseudomonas putida KT2440
gaagcgguacaccucaucacg

SEQ ID NO: 3595990 - RNA, 20 nt, Pseudomonas putida KT2440
gaagcggucguuacccaggu

SEQ ID NO: 3595991 - RNA, 18 nt, Pseudomonas putida KT2440
gaagcuaccccacaaccc

SEQ ID NO: 3595992 - RNA, 14 nt, Pseudomonas putida KT2440
gaagcuaucgccag

SEQ ID NO: 3595993 - RNA, 20 nt, Pseudomonas putida KT2440
gaagcuaucgccagcaggcc

SEQ ID NO: 3595994 - RNA, 17 nt, Pseudomonas putida KT2440
gaagcuccaggcgacca

SEQ ID NO: 3595995 - RNA, 14 nt, Pseudomonas putida KT2440
gaagcucccggcau

SEQ ID NO: 3595996 - RNA, 17 nt, Pseudomonas putida KT2440
gaagcucgaucugccug

SEQ ID NO: 3595997 - RNA, 17 nt, Pseudomonas putida KT2440
gaagcucuccagcaggu

SEQ ID NO: 3595998 - RNA, 18 nt, Pseudomonas putida KT2440
gaagcuguggggcugacu

SEQ ID NO: 3595999 - RNA, 18 nt, Pseudomonas putida KT2440
gaagcuguuggcacggcu

SEQ ID NO: 3596000 - RNA, 21 nt, Pseudomonas putida KT2440
gaagcuucaugaaaaacccgg

SEQ ID NO: 3596001 - RNA, 18 nt, Pseudomonas putida KT2440
gaauuacgcaggcuccaa

SEQ ID NO: 3596002 - RNA, 15 nt, Pseudomonas putida KT2440
gaauuccuugcuggu

SEQ ID NO: 3596003 - RNA, 23 nt, Pseudomonas putida KT2440
gaauucgagcuggucaucgucca

SEQ ID NO: 3596004 - RNA, 15 nt, Pseudomonas putida KT2440
gaauucguuuucggu

SEQ ID NO: 3596005 - RNA, 22 nt, Pseudomonas putida KT2440
gaauugacccagucagcgccga

SEQ ID NO: 3596006 - RNA, 11 nt, Pseudomonas putida KT2440
gaauugcagcc

SEQ ID NO: 3596007 - RNA, 19 nt, Pseudomonas putida KT2440
gaauugcagcccgcaggcu

SEQ ID NO: 3596008 - RNA, 17 nt, Pseudomonas putida KT2440
gaauuggccggcgcuga

SEQ ID NO: 3596009 - RNA, 19 nt, Pseudomonas putida KT2440
gaauuucugcaccuugccc

SEQ ID NO: 3596010 - RNA, 17 nt, Pseudomonas putida KT2440
gaauuugguggaaguug

SEQ ID NO: 3596011 - RNA, 19 nt, Pseudomonas putida KT2440
gaauuugguggaaguugcc

SEQ ID NO: 3596012 - RNA, 17 nt, Pseudomonas putida KT2440
gacaaacccgugcucuu

SEQ ID NO: 3596013 - RNA, 12 nt, Pseudomonas putida KT2440
gacaaaccgcac

SEQ ID NO: 3596014 - RNA, 20 nt, Pseudomonas putida KT2440
gacaaacgccagcaugcugg

SEQ ID NO: 3596015 - RNA, 16 nt, Pseudomonas putida KT2440
gacaaacguaccagcc

SEQ ID NO: 3596016 - RNA, 19 nt, Pseudomonas putida KT2440
gacaaacugcugagucagc

SEQ ID NO: 3596017 - RNA, 14 nt, Pseudomonas putida KT2440
gacaaagcucaaau

SEQ ID NO: 3596018 - RNA, 23 nt, Pseudomonas putida KT2440
gacaaaggccggcaccgacagca

SEQ ID NO: 3596019 - RNA, 12 nt, Pseudomonas putida KT2440
gacaaauccagg

SEQ ID NO: 3596020 - RNA, 13 nt, Pseudomonas putida KT2440
gacaacagcaugc

SEQ ID NO: 3596021 - RNA, 14 nt, Pseudomonas putida KT2440
gacaacagcaugcu

SEQ ID NO: 3596022 - RNA, 21 nt, Pseudomonas putida KT2440
gacaaccaagcgaacuauccu

SEQ ID NO: 3596023 - RNA, 21 nt, Pseudomonas putida KT2440
gacaaccgaaaaggccaacca

SEQ ID NO: 3596024 - RNA, 15 nt, Pseudomonas putida KT2440
gacaacgcacccgcc

SEQ ID NO: 3596025 - RNA, 17 nt, Pseudomonas putida KT2440
gacaacgcacccgccuc

SEQ ID NO: 3596026 - RNA, 18 nt, Pseudomonas putida KT2440
gacaacgguguggccagu

SEQ ID NO: 3596027 - RNA, 16 nt, Pseudomonas putida KT2440
gacaacuuggcaccga

SEQ ID NO: 3596028 - RNA, 18 nt, Pseudomonas putida KT2440
gacaagaagcggcugccu

SEQ ID NO: 3596029 - RNA, 17 nt, Pseudomonas putida KT2440
gacaagccaaccaaagg

SEQ ID NO: 3596030 - RNA, 17 nt, Pseudomonas putida KT2440
gacaagccgacaaaaac

SEQ ID NO: 3596031 - RNA, 12 nt, Pseudomonas putida KT2440
gacaagccgcug

SEQ ID NO: 3596032 - RNA, 19 nt, Pseudomonas putida KT2440
gacaagccgcugggcuuca

SEQ ID NO: 3596033 - RNA, 21 nt, Pseudomonas putida KT2440
gacaagcgagguaggccguca

SEQ ID NO: 3596034 - RNA, 13 nt, Pseudomonas putida KT2440
gacaagguagcgg

SEQ ID NO: 3596035 - RNA, 20 nt, Pseudomonas putida KT2440
gacaagguagcggccagccc

SEQ ID NO: 3596036 - RNA, 15 nt, Pseudomonas putida KT2440
gacaauacgguaagc

SEQ ID NO: 3596037 - RNA, 21 nt, Pseudomonas putida KT2440
gacaaucaggcgucaggcuug

SEQ ID NO: 3596038 - RNA, 19 nt, Pseudomonas putida KT2440
gacaaucggcucaacagcc

SEQ ID NO: 3596039 - RNA, 19 nt, Pseudomonas putida KT2440
gacacaaggccgcucccac

SEQ ID NO: 3596040 - RNA, 16 nt, Pseudomonas putida KT2440
gacacauaacccccca

SEQ ID NO: 3596041 - RNA, 16 nt, Pseudomonas putida KT2440
gacacaucacgcacau

SEQ ID NO: 3596042 - RNA, 19 nt, Pseudomonas putida KT2440
gacacaucacgcacauuca

SEQ ID NO: 3596043 - RNA, 16 nt, Pseudomonas putida KT2440
gacacaugcaaacccu

SEQ ID NO: 3596044 - RNA, 17 nt, Pseudomonas putida KT2440
gacacaugcaaacccug

SEQ ID NO: 3596045 - RNA, 12 nt, Pseudomonas putida KT2440
gacaccagcgca

SEQ ID NO: 3596046 - RNA, 15 nt, Pseudomonas putida KT2440
gacaccagcgcacca

SEQ ID NO: 3596047 - RNA, 19 nt, Pseudomonas putida KT2440
gacaccagcgcaccacugu

SEQ ID NO: 3596048 - RNA, 21 nt, Pseudomonas putida KT2440
gacaccagcgcaccacuguuc

SEQ ID NO: 3596049 - RNA, 20 nt, Pseudomonas putida KT2440
gacaccagguucuguagcgc

SEQ ID NO: 3596050 - RNA, 12 nt, Pseudomonas putida KT2440
gacaccauggcc

SEQ ID NO: 3596051 - RNA, 13 nt, Pseudomonas putida KT2440
gacacccagcacc

SEQ ID NO: 3596052 - RNA, 20 nt, Pseudomonas putida KT2440
gacacccagcacccgcaggc

SEQ ID NO: 3596053 - RNA, 19 nt, Pseudomonas putida KT2440
gacacccagucgccccgcc

SEQ ID NO: 3596054 - RNA, 22 nt, Pseudomonas putida KT2440
gacacccagucgccccgccagc

SEQ ID NO: 3596055 - RNA, 15 nt, Pseudomonas putida KT2440
gacacccucuugaau

SEQ ID NO: 3596056 - RNA, 19 nt, Pseudomonas putida KT2440
gacaccgcaaaucacugac

SEQ ID NO: 3596057 - RNA, 22 nt, Pseudomonas putida KT2440
gacaccgcugccgggcaaagcg

SEQ ID NO: 3596058 - RNA, 21 nt, Pseudomonas putida KT2440
gacacgcgaaucgccagggcu

SEQ ID NO: 3596059 - RNA, 18 nt, Pseudomonas putida KT2440
gacacgcuuuucaggggu

SEQ ID NO: 3596060 - RNA, 22 nt, Pseudomonas putida KT2440
gacacggacucauagcucagcu

SEQ ID NO: 3596061 - RNA, 21 nt, Pseudomonas putida KT2440
gacacggcgaugcgcccccca

SEQ ID NO: 3596062 - RNA, 15 nt, Pseudomonas putida KT2440
gacacugaucucgcg

SEQ ID NO: 3596063 - RNA, 20 nt, Pseudomonas putida KT2440
gacacuugguccagggccau

SEQ ID NO: 3596064 - RNA, 14 nt, Pseudomonas putida KT2440
gacagacagggccu

SEQ ID NO: 3596065 - RNA, 22 nt, Pseudomonas putida KT2440
gacagcacgggcacacuggcca

SEQ ID NO: 3596066 - RNA, 17 nt, Pseudomonas putida KT2440
gacagcagguccggccu

SEQ ID NO: 3596067 - RNA, 14 nt, Pseudomonas putida KT2440
gacagcaucaucag

SEQ ID NO: 3596068 - RNA, 17 nt, Pseudomonas putida KT2440
gacagcaucaucaggcc

SEQ ID NO: 3596069 - RNA, 14 nt, Pseudomonas putida KT2440
gacagcaucggcag

SEQ ID NO: 3596070 - RNA, 16 nt, Pseudomonas putida KT2440
gacagcaucugcacca

SEQ ID NO: 3596071 - RNA, 18 nt, Pseudomonas putida KT2440
gacagcaucugcaccagg

SEQ ID NO: 3596072 - RNA, 22 nt, Pseudomonas putida KT2440
gacagcaucugcaccaggaagc

SEQ ID NO: 3596073 - RNA, 15 nt, Pseudomonas putida KT2440
gacagccacaugcca

SEQ ID NO: 3596074 - RNA, 19 nt, Pseudomonas putida KT2440
gacagccacaugccagcua

SEQ ID NO: 3596075 - RNA, 17 nt, Pseudomonas putida KT2440
gacagcccaaggccugc

SEQ ID NO: 3596076 - RNA, 15 nt, Pseudomonas putida KT2440
gacagccucaaggcc

SEQ ID NO: 3596077 - RNA, 17 nt, Pseudomonas putida KT2440
gacagccucaaggccgg

SEQ ID NO: 3596078 - RNA, 21 nt, Pseudomonas putida KT2440
gacagcgcagucaccacacgg

SEQ ID NO: 3596079 - RNA, 20 nt, Pseudomonas putida KT2440
gacagcgcguuaggcgagau

SEQ ID NO: 3596080 - RNA, 18 nt, Pseudomonas putida KT2440
gacagcgcuuccaagugc

SEQ ID NO: 3596081 - RNA, 14 nt, Pseudomonas putida KT2440
gacagcggccagcu

SEQ ID NO: 3596082 - RNA, 13 nt, Pseudomonas putida KT2440
gacagcucaagcc

SEQ ID NO: 3596083 - RNA, 14 nt, Pseudomonas putida KT2440
gacagcugcggcau

SEQ ID NO: 3596084 - RNA, 23 nt, Pseudomonas putida KT2440
gacagcuucugguuguaagcguc

SEQ ID NO: 3596085 - RNA, 17 nt, Pseudomonas putida KT2440
gacagcuugcccagcug

SEQ ID NO: 3596086 - RNA, 23 nt, Pseudomonas putida KT2440
gacagcuuguugccagcggcgau

SEQ ID NO: 3596087 - RNA, 16 nt, Pseudomonas putida KT2440
gacaggccgugaacca

SEQ ID NO: 3596088 - RNA, 21 nt, Pseudomonas putida KT2440
gacaggcgucggggccggaga

SEQ ID NO: 3596089 - RNA, 18 nt, Pseudomonas putida KT2440
gacaggcuuacaucggcg

SEQ ID NO: 3596090 - RNA, 14 nt, Pseudomonas putida KT2440
gacagggcgcccgu

SEQ ID NO: 3596091 - RNA, 18 nt, Pseudomonas putida KT2440
gacagggugcggauaccg

SEQ ID NO: 3596092 - RNA, 18 nt, Pseudomonas putida KT2440
gacagguaguuggccggg

SEQ ID NO: 3596093 - RNA, 22 nt, Pseudomonas putida KT2440
gacagguaguuggccgggccuu

SEQ ID NO: 3596094 - RNA, 16 nt, Pseudomonas putida KT2440
gacagguccaccgcuu

SEQ ID NO: 3596095 - RNA, 22 nt, Pseudomonas putida KT2440
gacagguccauguugugcuggc

SEQ ID NO: 3596096 - RNA, 23 nt, Pseudomonas putida KT2440
gacagguccauguugugcuggcg

SEQ ID NO: 3596097 - RNA, 17 nt, Pseudomonas putida KT2440
gacaggucggcgauggu

SEQ ID NO: 3596098 - RNA, 15 nt, Pseudomonas putida KT2440
gacagguucgcccug

SEQ ID NO: 3596099 - RNA, 14 nt, Pseudomonas putida KT2440
gacagguuguggua

SEQ ID NO: 3596100 - RNA, 20 nt, Pseudomonas putida KT2440
gacagugaauuccuugcugg

SEQ ID NO: 3596101 - RNA, 17 nt, Pseudomonas putida KT2440
gacauaacaagaacaac

SEQ ID NO: 3596102 - RNA, 16 nt, Pseudomonas putida KT2440
gacaucaccaggccgg

SEQ ID NO: 3596103 - RNA, 21 nt, Pseudomonas putida KT2440
gacauccacguccuggucacg

SEQ ID NO: 3596104 - RNA, 15 nt, Pseudomonas putida KT2440
gacauugaagaagcc

SEQ ID NO: 3596105 - RNA, 16 nt, Pseudomonas putida KT2440
gacauugaagaagccc

SEQ ID NO: 3596106 - RNA, 14 nt, Pseudomonas putida KT2440
gaccguuccgcaaa

SEQ ID NO: 3596107 - RNA, 17 nt, Pseudomonas putida KT2440
gaccguuucauugccgu

SEQ ID NO: 3596108 - RNA, 15 nt, Pseudomonas putida KT2440
gaccguuugcagcgu

SEQ ID NO: 3596109 - RNA, 15 nt, Pseudomonas putida KT2440
gaccucacagccuuc

SEQ ID NO: 3596110 - RNA, 18 nt, Pseudomonas putida KT2440
gaccucagccgugguuuc

SEQ ID NO: 3596111 - RNA, 22 nt, Pseudomonas putida KT2440
gaccuccgagucuccgcgcuug

SEQ ID NO: 3596112 - RNA, 17 nt, Pseudomonas putida KT2440
gaccucgaccaggcgcu

SEQ ID NO: 3596113 - RNA, 22 nt, Pseudomonas putida KT2440
gaccucgacccgcccgccaugc

SEQ ID NO: 3596114 - RNA, 19 nt, Pseudomonas putida KT2440
gaccucgaugcccuccagc

SEQ ID NO: 3596115 - RNA, 16 nt, Pseudomonas putida KT2440
gaccucugguuuuguc

SEQ ID NO: 3596116 - RNA, 17 nt, Pseudomonas putida KT2440
gaccugauacacccgcu

SEQ ID NO: 3596117 - RNA, 19 nt, Pseudomonas putida KT2440
gaccugcaacgucgccacg

SEQ ID NO: 3596118 - RNA, 16 nt, Pseudomonas putida KT2440
gaccugccagccuucg

SEQ ID NO: 3596119 - RNA, 19 nt, Pseudomonas putida KT2440
gaccugccagucgcacagg

SEQ ID NO: 3596120 - RNA, 14 nt, Pseudomonas putida KT2440
gaccugccgcagcg

SEQ ID NO: 3596121 - RNA, 21 nt, Pseudomonas putida KT2440
gaccugcuggcacugcggcuc

SEQ ID NO: 3596122 - RNA, 22 nt, Pseudomonas putida KT2440
gaccugcuggcacugcggcuca

SEQ ID NO: 3596123 - RNA, 22 nt, Pseudomonas putida KT2440
gaccugcugggucagcgcugac

SEQ ID NO: 3596124 - RNA, 15 nt, Pseudomonas putida KT2440
gaccuggaucgccag

SEQ ID NO: 3596125 - RNA, 21 nt, Pseudomonas putida KT2440
gaccuggcucuucaacaccag

SEQ ID NO: 3596126 - RNA, 22 nt, Pseudomonas putida KT2440
gaccuggcucuucaacaccagc

SEQ ID NO: 3596127 - RNA, 16 nt, Pseudomonas putida KT2440
gaccugugcugaauuu

SEQ ID NO: 3596128 - RNA, 17 nt, Pseudomonas putida KT2440
gaccugugggagcgggc

SEQ ID NO: 3596129 - RNA, 18 nt, Pseudomonas putida KT2440
gaccugugggagcgggca

SEQ ID NO: 3596130 - RNA, 21 nt, Pseudomonas putida KT2440
gaccugugggagcgggcaugc

SEQ ID NO: 3596131 - RNA, 18 nt, Pseudomonas putida KT2440
gaccuugauuucgucgcu

SEQ ID NO: 3596132 - RNA, 13 nt, Pseudomonas putida KT2440
gaccuugccuuuc

SEQ ID NO: 3596133 - RNA, 18 nt, Pseudomonas putida KT2440
gaccuuggacagggugcg

SEQ ID NO: 3596134 - RNA, 18 nt, Pseudomonas putida KT2440
gaccuugucagcaaccac

SEQ ID NO: 3596135 - RNA, 23 nt, Pseudomonas putida KT2440
gacgaacaacgccaccgaaggcg

SEQ ID NO: 3596136 - RNA, 17 nt, Pseudomonas putida KT2440
gacgaacagcgccgcga

SEQ ID NO: 3596137 - RNA, 10 nt, Pseudomonas putida KT2440
gacgaacagg

SEQ ID NO: 3596138 - RNA, 15 nt, Pseudomonas putida KT2440
gacgaacccuugacc

SEQ ID NO: 3596139 - RNA, 21 nt, Pseudomonas putida KT2440
gacgaacucaacgcaacugcg

SEQ ID NO: 3596140 - RNA, 20 nt, Pseudomonas putida KT2440
gacgaaggcgguauggguga

SEQ ID NO: 3596141 - RNA, 19 nt, Pseudomonas putida KT2440
gacgaaguacggcuugccg

SEQ ID NO: 3596142 - RNA, 13 nt, Pseudomonas putida KT2440
gacgaccagcaug

SEQ ID NO: 3596143 - RNA, 22 nt, Pseudomonas putida KT2440
gacgaccaguucgacgcugcug

SEQ ID NO: 3596144 - RNA, 17 nt, Pseudomonas putida KT2440
gacgaccucggccaggu

SEQ ID NO: 3596145 - RNA, 15 nt, Pseudomonas putida KT2440
gacgacgcgauaaug

SEQ ID NO: 3596146 - RNA, 21 nt, Pseudomonas putida KT2440
gacgacuuauccgcuggcuug

SEQ ID NO: 3596147 - RNA, 17 nt, Pseudomonas putida KT2440
gacgaggccgagcgcga

SEQ ID NO: 3596148 - RNA, 18 nt, Pseudomonas putida KT2440
gacgauacccagcgcgcg

SEQ ID NO: 3596149 - RNA, 23 nt, Pseudomonas putida KT2440
gacgaucaccagguugcgugccu

SEQ ID NO: 3596150 - RNA, 15 nt, Pseudomonas putida KT2440
gacgaucgccagccc

SEQ ID NO: 3596151 - RNA, 17 nt, Pseudomonas putida KT2440
gacgaucgccagcccca

SEQ ID NO: 3596152 - RNA, 18 nt, Pseudomonas putida KT2440
gacgaugaccuugccuuu

SEQ ID NO: 3596153 - RNA, 14 nt, Pseudomonas putida KT2440
gacgaugaggccgg

SEQ ID NO: 3596154 - RNA, 20 nt, Pseudomonas putida KT2440
gacgaugaucagguugacgu

SEQ ID NO: 3596155 - RNA, 21 nt, Pseudomonas putida KT2440
gacgaugcccgaucggguacu

SEQ ID NO: 3596156 - RNA, 15 nt, Pseudomonas putida KT2440
gacgauggacagccc

SEQ ID NO: 3596157 - RNA, 18 nt, Pseudomonas putida KT2440
gacgauggacagcccaag

SEQ ID NO: 3596158 - RNA, 16 nt, Pseudomonas putida KT2440
gacgauggccaccagc

SEQ ID NO: 3596159 - RNA, 23 nt, Pseudomonas putida KT2440
gacgauggccaccaggguggcga

SEQ ID NO: 3596160 - RNA, 15 nt, Pseudomonas putida KT2440
gacgcaagcgcgccg

SEQ ID NO: 3596161 - RNA, 18 nt, Pseudomonas putida KT2440
gacgcaaggccgcuccca

SEQ ID NO: 3596162 - RNA, 19 nt, Pseudomonas putida KT2440
gacgcaaggccgcucccac

SEQ ID NO: 3596163 - RNA, 20 nt, Pseudomonas putida KT2440
gacgcagacaaaacgcugcg

SEQ ID NO: 3596164 - RNA, 18 nt, Pseudomonas putida KT2440
gacgcaggguagccccga

SEQ ID NO: 3596165 - RNA, 16 nt, Pseudomonas putida KT2440
gacgcagugcagccgc

SEQ ID NO: 3596166 - RNA, 14 nt, Pseudomonas putida KT2440
gacgcaucagggca

SEQ ID NO: 3596167 - RNA, 15 nt, Pseudomonas putida KT2440
gacgcauguugaaac

SEQ ID NO: 3596168 - RNA, 22 nt, Pseudomonas putida KT2440
gacgcauucgcgggugaacccg

SEQ ID NO: 3596169 - RNA, 12 nt, Pseudomonas putida KT2440
gacgccaccaag

SEQ ID NO: 3596170 - RNA, 12 nt, Pseudomonas putida KT2440
gacgccgcagcc

SEQ ID NO: 3596171 - RNA, 15 nt, Pseudomonas putida KT2440
gacgccgcagccggg

SEQ ID NO: 3596172 - RNA, 16 nt, Pseudomonas putida KT2440
gacgccgcagccgggc

SEQ ID NO: 3596173 - RNA, 17 nt, Pseudomonas putida KT2440
gacgccgcagccgggcg

SEQ ID NO: 3596174 - RNA, 22 nt, Pseudomonas putida KT2440
gacgccgcagugacacggcgau

SEQ ID NO: 3596175 - RNA, 21 nt, Pseudomonas putida KT2440
gacgccgccagcgcuccagca

SEQ ID NO: 3596176 - RNA, 16 nt, Pseudomonas putida KT2440
gacgccgccauccugg

SEQ ID NO: 3596177 - RNA, 16 nt, Pseudomonas putida KT2440
gacgccggccugccgc

SEQ ID NO: 3596178 - RNA, 17 nt, Pseudomonas putida KT2440
gacgcgcgcagccuggc

SEQ ID NO: 3596179 - RNA, 19 nt, Pseudomonas putida KT2440
gacgcggaccuugucgcca

SEQ ID NO: 3596180 - RNA, 14 nt, Pseudomonas putida KT2440
gacgcggagccggc

SEQ ID NO: 3596181 - RNA, 15 nt, Pseudomonas putida KT2440
gacgcggugcucgau

SEQ ID NO: 3596182 - RNA, 17 nt, Pseudomonas putida KT2440
gacgcggugcucgaugc

SEQ ID NO: 3596183 - RNA, 21 nt, Pseudomonas putida KT2440
gacgcguacgccguugccgcc

SEQ ID NO: 3596184 - RNA, 15 nt, Pseudomonas putida KT2440
gacgcgugguccuga

SEQ ID NO: 3596185 - RNA, 18 nt, Pseudomonas putida KT2440
gacgcuccagacgcugua

SEQ ID NO: 3596186 - RNA, 12 nt, Pseudomonas putida KT2440
gacgcugccguc

SEQ ID NO: 3596187 - RNA, 15 nt, Pseudomonas putida KT2440
gacgcugccgucucg

SEQ ID NO: 3596188 - RNA, 22 nt, Pseudomonas putida KT2440
gacgcugccgucucgucacugg

SEQ ID NO: 3596189 - RNA, 20 nt, Pseudomonas putida KT2440
gacgcuggcagcuuggccau

SEQ ID NO: 3596190 - RNA, 23 nt, Pseudomonas putida KT2440
gacgcuggcagcuuggccauuuc

SEQ ID NO: 3596191 - RNA, 23 nt, Pseudomonas putida KT2440
gacgcuuccuuguccgccaagau

SEQ ID NO: 3596192 - RNA, 15 nt, Pseudomonas putida KT2440
gacgcuugccaccca

SEQ ID NO: 3596193 - RNA, 19 nt, Pseudomonas putida KT2440
gacggauacaccagaaagc

SEQ ID NO: 3596194 - RNA, 15 nt, Pseudomonas putida KT2440
gacggaucggcacac

SEQ ID NO: 3596195 - RNA, 16 nt, Pseudomonas putida KT2440
gacggauuggaaaaug

SEQ ID NO: 3596196 - RNA, 23 nt, Pseudomonas putida KT2440
gacggcauggccgaagcggucgu

SEQ ID NO: 3596197 - RNA, 23 nt, Pseudomonas putida KT2440
gacggccugcgcccgaucaccga

SEQ ID NO: 3596198 - RNA, 22 nt, Pseudomonas putida KT2440
gacggcgaggugauugaaggca

SEQ ID NO: 3596199 - RNA, 23 nt, Pseudomonas putida KT2440
gacggcggugauaugcguacccg

SEQ ID NO: 3596200 - RNA, 15 nt, Pseudomonas putida KT2440
gacgggaagugcacu

SEQ ID NO: 3596201 - RNA, 22 nt, Pseudomonas putida KT2440
gacgggaagugcacugccuggc

SEQ ID NO: 3596202 - RNA, 22 nt, Pseudomonas putida KT2440
gacgggugaccaggcccagcag

SEQ ID NO: 3596203 - RNA, 14 nt, Pseudomonas putida KT2440
gacggguuacccug

SEQ ID NO: 3596204 - RNA, 14 nt, Pseudomonas putida KT2440
gacggucagugaag

SEQ ID NO: 3596205 - RNA, 13 nt, Pseudomonas putida KT2440
gacggugcgcgcc

SEQ ID NO: 3596206 - RNA, 20 nt, Pseudomonas putida KT2440
gacggugcgcgccagcgggu

SEQ ID NO: 3596207 - RNA, 17 nt, Pseudomonas putida KT2440
gacgguggcguggccac

SEQ ID NO: 3596208 - RNA, 12 nt, Pseudomonas putida KT2440
gacgguggcugc

SEQ ID NO: 3596209 - RNA, 17 nt, Pseudomonas putida KT2440
gacggugguggccgcgc

SEQ ID NO: 3596210 - RNA, 16 nt, Pseudomonas putida KT2440
gacgguuacgugcagg

SEQ ID NO: 3596211 - RNA, 18 nt, Pseudomonas putida KT2440
gagcagggcugcgcgccc

SEQ ID NO: 3596212 - RNA, 18 nt, Pseudomonas putida KT2440
gagcagggugccuucagg

SEQ ID NO: 3596213 - RNA, 20 nt, Pseudomonas putida KT2440
gagcaggucgaacagccccc

SEQ ID NO: 3596214 - RNA, 22 nt, Pseudomonas putida KT2440
gagcaggucgaacagcccccgg

SEQ ID NO: 3596215 - RNA, 17 nt, Pseudomonas putida KT2440
gagcagguucaggcgca

SEQ ID NO: 3596216 - RNA, 24 nt, Pseudomonas putida KT2440
gagcagguucaggcgcagcacgcc

SEQ ID NO: 3596217 - RNA, 18 nt, Pseudomonas putida KT2440
gagcaguggugcucagcg

SEQ ID NO: 3596218 - RNA, 19 nt, Pseudomonas putida KT2440
gagcaucgcguacgaagcu

SEQ ID NO: 3596219 - RNA, 15 nt, Pseudomonas putida KT2440
gagcaucggcucgca

SEQ ID NO: 3596220 - RNA, 21 nt, Pseudomonas putida KT2440
gagcaucugcugcggcaggcu

SEQ ID NO: 3596221 - RNA, 14 nt, Pseudomonas putida KT2440
gagcaugaucaccg

SEQ ID NO: 3596222 - RNA, 14 nt, Pseudomonas putida KT2440
gagcauggccagcc

SEQ ID NO: 3596223 - RNA, 16 nt, Pseudomonas putida KT2440
gagcauggccagccgg

SEQ ID NO: 3596224 - RNA, 15 nt, Pseudomonas putida KT2440
gagcauuacaggcag

SEQ ID NO: 3596225 - RNA, 12 nt, Pseudomonas putida KT2440
gagccaaccgcu

SEQ ID NO: 3596226 - RNA, 13 nt, Pseudomonas putida KT2440
gagccaaggccgc

SEQ ID NO: 3596227 - RNA, 21 nt, Pseudomonas putida KT2440
gagccaaggccgcccaguuca

SEQ ID NO: 3596228 - RNA, 20 nt, Pseudomonas putida KT2440
gagccaaguguuugaagcua

SEQ ID NO: 3596229 - RNA, 13 nt, Pseudomonas putida KT2440
gagccaauuucaa

SEQ ID NO: 3596230 - RNA, 13 nt, Pseudomonas putida KT2440
gagccaccggcau

SEQ ID NO: 3596231 - RNA, 16 nt, Pseudomonas putida KT2440
gagccagacauugaag

SEQ ID NO: 3596232 - RNA, 23 nt, Pseudomonas putida KT2440
gagccagaucauggcgguccacc

SEQ ID NO: 3596233 - RNA, 15 nt, Pseudomonas putida KT2440
gagccagccagguug

SEQ ID NO: 3596234 - RNA, 19 nt, Pseudomonas putida KT2440
gagccaggagaacacccag

SEQ ID NO: 3596235 - RNA, 23 nt, Pseudomonas putida KT2440
gagccaggcguauucggccacca

SEQ ID NO: 3596236 - RNA, 14 nt, Pseudomonas putida KT2440
gagccagggcgcug

SEQ ID NO: 3596237 - RNA, 13 nt, Pseudomonas putida KT2440
gagccccaccagg

SEQ ID NO: 3596238 - RNA, 14 nt, Pseudomonas putida KT2440
gagcccccagcaca

SEQ ID NO: 3596239 - RNA, 17 nt, Pseudomonas putida KT2440
gagcccccgcugcucga

SEQ ID NO: 3596240 - RNA, 19 nt, Pseudomonas putida KT2440
gagcccgccagcaggccac

SEQ ID NO: 3596241 - RNA, 21 nt, Pseudomonas putida KT2440
gagcccgccagcaggccaccg

SEQ ID NO: 3596242 - RNA, 18 nt, Pseudomonas putida KT2440
gagcccggguugaccuug

SEQ ID NO: 3596243 - RNA, 20 nt, Pseudomonas putida KT2440
gagcccugugggagcgggca

SEQ ID NO: 3596244 - RNA, 21 nt, Pseudomonas putida KT2440
gagcccugugggagcgggcau

SEQ ID NO: 3596245 - RNA, 17 nt, Pseudomonas putida KT2440
gagccgaacagcaggca

SEQ ID NO: 3596246 - RNA, 17 nt, Pseudomonas putida KT2440
gagccgauaugcggggu

SEQ ID NO: 3596247 - RNA, 16 nt, Pseudomonas putida KT2440
gagccgaucaggaagc

SEQ ID NO: 3596248 - RNA, 18 nt, Pseudomonas putida KT2440
gagccgaucaggaagccc

SEQ ID NO: 3596249 - RNA, 13 nt, Pseudomonas putida KT2440
gagccgccaaccc

SEQ ID NO: 3596250 - RNA, 15 nt, Pseudomonas putida KT2440
gagccggaucgacgc

SEQ ID NO: 3596251 - RNA, 12 nt, Pseudomonas putida KT2440
gagccggcuggc

SEQ ID NO: 3596252 - RNA, 14 nt, Pseudomonas putida KT2440
gagccggguccacc

SEQ ID NO: 3596253 - RNA, 16 nt, Pseudomonas putida KT2440
gagccggguccacccg

SEQ ID NO: 3596254 - RNA, 19 nt, Pseudomonas putida KT2440
gagccggguccacccggua

SEQ ID NO: 3596255 - RNA, 14 nt, Pseudomonas putida KT2440
gagccggucacgau

SEQ ID NO: 3596256 - RNA, 12 nt, Pseudomonas putida KT2440
gagccggugcca

SEQ ID NO: 3596257 - RNA, 15 nt, Pseudomonas putida KT2440
gagccguccaggaac

SEQ ID NO: 3596258 - RNA, 21 nt, Pseudomonas putida KT2440
gagccuacagcaaccgcguga

SEQ ID NO: 3596259 - RNA, 15 nt, Pseudomonas putida KT2440
gagccugcacccagg

SEQ ID NO: 3596260 - RNA, 16 nt, Pseudomonas putida KT2440
gagccugcacccaggc

SEQ ID NO: 3596261 - RNA, 15 nt, Pseudomonas putida KT2440
gagccugcagggccu

SEQ ID NO: 3596262 - RNA, 20 nt, Pseudomonas putida KT2440
gagccuggccgguguggcca

SEQ ID NO: 3596263 - RNA, 18 nt, Pseudomonas putida KT2440
gagccuuauagggucagu

SEQ ID NO: 3596264 - RNA, 19 nt, Pseudomonas putida KT2440
gagcgaaauagguaaagcc

SEQ ID NO: 3596265 - RNA, 19 nt, Pseudomonas putida KT2440
gagcgacgcugccgcaccu

SEQ ID NO: 3596266 - RNA, 13 nt, Pseudomonas putida KT2440
gagcgaugcgcug

SEQ ID NO: 3596267 - RNA, 16 nt, Pseudomonas putida KT2440
gagcgcauuaucugug

SEQ ID NO: 3596268 - RNA, 12 nt, Pseudomonas putida KT2440
gagcgccagcaa

SEQ ID NO: 3596269 - RNA, 14 nt, Pseudomonas putida KT2440
gagcgccagcaucg

SEQ ID NO: 3596270 - RNA, 16 nt, Pseudomonas putida KT2440
gagcgccauccaccug

SEQ ID NO: 3596271 - RNA, 21 nt, Pseudomonas putida KT2440
gagcgccgcccgggaggguga

SEQ ID NO: 3596272 - RNA, 11 nt, Pseudomonas putida KT2440
gagcgccgcgc

SEQ ID NO: 3596273 - RNA, 20 nt, Pseudomonas putida KT2440
gagcgccgcgcgggcggcgc

SEQ ID NO: 3596274 - RNA, 21 nt, Pseudomonas putida KT2440
gagcgccgcgcgggcggcgcu

SEQ ID NO: 3596275 - RNA, 14 nt, Pseudomonas putida KT2440
gagcgcgcccccga

SEQ ID NO: 3596276 - RNA, 19 nt, Pseudomonas putida KT2440
gagcgcgccgccuucgcca

SEQ ID NO: 3596277 - RNA, 17 nt, Pseudomonas putida KT2440
gagcgcggcgcccagca

SEQ ID NO: 3596278 - RNA, 17 nt, Pseudomonas putida KT2440
gagcgcgggcagacacu

SEQ ID NO: 3596279 - RNA, 14 nt, Pseudomonas putida KT2440
gagcggcucgcgcu

SEQ ID NO: 3596280 - RNA, 18 nt, Pseudomonas putida KT2440
gagcggcuucuaccgcac

SEQ ID NO: 3596281 - RNA, 13 nt, Pseudomonas putida KT2440
gagcgggcgacgc

SEQ ID NO: 3596282 - RNA, 20 nt, Pseudomonas putida KT2440
gagcgggcgcgcccgcgaag

SEQ ID NO: 3596283 - RNA, 19 nt, Pseudomonas putida KT2440
gagcgggcgugcccgcgaa

SEQ ID NO: 3596284 - RNA, 20 nt, Pseudomonas putida KT2440
gagcgggcgugcccgcgaag

SEQ ID NO: 3596285 - RNA, 20 nt, Pseudomonas putida KT2440
gagcgggcuuacccgcgaag

SEQ ID NO: 3596286 - RNA, 19 nt, Pseudomonas putida KT2440
gagcgggcuugcccgcgaa

SEQ ID NO: 3596287 - RNA, 20 nt, Pseudomonas putida KT2440
gagcgggcuugcccgcgaag

SEQ ID NO: 3596288 - RNA, 22 nt, Pseudomonas putida KT2440
gagcgggcuugcccgcgaagca

SEQ ID NO: 3596289 - RNA, 20 nt, Pseudomonas putida KT2440
gagcgggcuugcccgcgaau

SEQ ID NO: 3596290 - RNA, 13 nt, Pseudomonas putida KT2440
gagcgggucagcc

SEQ ID NO: 3596291 - RNA, 17 nt, Pseudomonas putida KT2440
gagcgggugccgcagca

SEQ ID NO: 3596292 - RNA, 18 nt, Pseudomonas putida KT2440
gagcggguucacccgcga

SEQ ID NO: 3596293 - RNA, 22 nt, Pseudomonas putida KT2440
gagcggguucacccgcgaagca

SEQ ID NO: 3596294 - RNA, 20 nt, Pseudomonas putida KT2440
gagcggguucacccgcgaau

SEQ ID NO: 3596295 - RNA, 18 nt, Pseudomonas putida KT2440
gagcggguuuacccgcga

SEQ ID NO: 3596296 - RNA, 20 nt, Pseudomonas putida KT2440
gagcggguuuacccgcgaac

SEQ ID NO: 3596297 - RNA, 20 nt, Pseudomonas putida KT2440
gagcggguuuacccgcgaau

SEQ ID NO: 3596298 - RNA, 20 nt, Pseudomonas putida KT2440
gagcgucaaccaggcgcagc

SEQ ID NO: 3596299 - RNA, 14 nt, Pseudomonas putida KT2440
gagcguggcaaacc

SEQ ID NO: 3596300 - RNA, 22 nt, Pseudomonas putida KT2440
gagcuaaaccgcgaugcugcaa

SEQ ID NO: 3596301 - RNA, 21 nt, Pseudomonas putida KT2440
gagcuaacgacccggaaaaug

SEQ ID NO: 3596302 - RNA, 15 nt, Pseudomonas putida KT2440
gagcuacagccccuu

SEQ ID NO: 3596303 - RNA, 23 nt, Pseudomonas putida KT2440
gagcuacagccccuuccccaggc

SEQ ID NO: 3596304 - RNA, 23 nt, Pseudomonas putida KT2440
gagcucaaccagcugcguggcau

SEQ ID NO: 3596305 - RNA, 19 nt, Pseudomonas putida KT2440
gagcucagcgugacgaugg

SEQ ID NO: 3596306 - RNA, 11 nt, Pseudomonas putida KT2440
gagcuccccuc

SEQ ID NO: 3596307 - RNA, 21 nt, Pseudomonas putida KT2440
gagcuccccucagacagagcu

SEQ ID NO: 3596308 - RNA, 19 nt, Pseudomonas putida KT2440
gagcucgaucuugccuucg

SEQ ID NO: 3596309 - RNA, 19 nt, Pseudomonas putida KT2440
gagcugauucagcacaccg

SEQ ID NO: 3596310 - RNA, 21 nt, Pseudomonas putida KT2440
gagcuggagaucuugucgacc

SEQ ID NO: 3596311 - RNA, 19 nt, Pseudomonas putida KT2440
gagcuggagccggaucgac

SEQ ID NO: 3596312 - RNA, 10 nt, Pseudomonas putida KT2440
gagcuggccg

SEQ ID NO: 3596313 - RNA, 18 nt, Pseudomonas putida KT2440
gagcuggccguccagcug

SEQ ID NO: 3596314 - RNA, 22 nt, Pseudomonas putida KT2440
gagcuggucaucguccacccac

SEQ ID NO: 3596315 - RNA, 14 nt, Pseudomonas putida KT2440
gagcugucgcgcca

SEQ ID NO: 3596316 - RNA, 21 nt, Pseudomonas putida KT2440
gauaaccuggcucggcugggc

SEQ ID NO: 3596317 - RNA, 23 nt, Pseudomonas putida KT2440
gauaacguccagagggccugcau

SEQ ID NO: 3596318 - RNA, 17 nt, Pseudomonas putida KT2440
gauaagaucacugcgca

SEQ ID NO: 3596319 - RNA, 21 nt, Pseudomonas putida KT2440
gauacaccacuggugccggca

SEQ ID NO: 3596320 - RNA, 15 nt, Pseudomonas putida KT2440
gauacccaauaaaaa

SEQ ID NO: 3596321 - RNA, 19 nt, Pseudomonas putida KT2440
gauacccaauaaaaacaac

SEQ ID NO: 3596322 - RNA, 16 nt, Pseudomonas putida KT2440
gauacccacgccaugu

SEQ ID NO: 3596323 - RNA, 23 nt, Pseudomonas putida KT2440
gauacccacgcccaaccccaggc

SEQ ID NO: 3596324 - RNA, 16 nt, Pseudomonas putida KT2440
gauacccagcgccgaa

SEQ ID NO: 3596325 - RNA, 14 nt, Pseudomonas putida KT2440
gauacccaggcgcg

SEQ ID NO: 3596326 - RNA, 22 nt, Pseudomonas putida KT2440
gauacccgcacgaacagcggca

SEQ ID NO: 3596327 - RNA, 13 nt, Pseudomonas putida KT2440
gauaccgaacagc

SEQ ID NO: 3596328 - RNA, 15 nt, Pseudomonas putida KT2440
gauaccgaggaggag

SEQ ID NO: 3596329 - RNA, 22 nt, Pseudomonas putida KT2440
gauaccgggauucgacuaucag

SEQ ID NO: 3596330 - RNA, 20 nt, Pseudomonas putida KT2440
gauaccuggguccaggcaca

SEQ ID NO: 3596331 - RNA, 19 nt, Pseudomonas putida KT2440
gauacgacgcaucagggca

SEQ ID NO: 3596332 - RNA, 22 nt, Pseudomonas putida KT2440
gauacgcuucgaacacccgcuu

SEQ ID NO: 3596333 - RNA, 23 nt, Pseudomonas putida KT2440
gauacggggaggccgucaggccu

SEQ ID NO: 3596334 - RNA, 16 nt, Pseudomonas putida KT2440
gauacggucuuuuccc

SEQ ID NO: 3596335 - RNA, 12 nt, Pseudomonas putida KT2440
gauacucacccg

SEQ ID NO: 3596336 - RNA, 15 nt, Pseudomonas putida KT2440
gauacucacccgcuu

SEQ ID NO: 3596337 - RNA, 21 nt, Pseudomonas putida KT2440
gauacuggcgcugaucaucga

SEQ ID NO: 3596338 - RNA, 18 nt, Pseudomonas putida KT2440
gauagaaccguuucagua

SEQ ID NO: 3596339 - RNA, 13 nt, Pseudomonas putida KT2440
gauagagccgccu

SEQ ID NO: 3596340 - RNA, 12 nt, Pseudomonas putida KT2440
gauagcaaaccg

SEQ ID NO: 3596341 - RNA, 15 nt, Pseudomonas putida KT2440
gauagcacgggcuuc

SEQ ID NO: 3596342 - RNA, 14 nt, Pseudomonas putida KT2440
gauagcagcaccga

SEQ ID NO: 3596343 - RNA, 19 nt, Pseudomonas putida KT2440
gauagcagcgcuaugccuu

SEQ ID NO: 3596344 - RNA, 14 nt, Pseudomonas putida KT2440
gauagccgccagca

SEQ ID NO: 3596345 - RNA, 22 nt, Pseudomonas putida KT2440
gauagccuguggggcaacugcg

SEQ ID NO: 3596346 - RNA, 18 nt, Pseudomonas putida KT2440
gauagcggcagcgacgau

SEQ ID NO: 3596347 - RNA, 13 nt, Pseudomonas putida KT2440
gauagcggcggca

SEQ ID NO: 3596348 - RNA, 16 nt, Pseudomonas putida KT2440
gauagcgugaagcggc

SEQ ID NO: 3596349 - RNA, 16 nt, Pseudomonas putida KT2440
gauagcucagucggua

SEQ ID NO: 3596350 - RNA, 15 nt, Pseudomonas putida KT2440
gauaguccagcaacu

SEQ ID NO: 3596351 - RNA, 20 nt, Pseudomonas putida KT2440
gauaucaaagcgguacgccg

SEQ ID NO: 3596352 - RNA, 12 nt, Pseudomonas putida KT2440
gauauccagcac

SEQ ID NO: 3596353 - RNA, 18 nt, Pseudomonas putida KT2440
gauauccgcagccccgcc

SEQ ID NO: 3596354 - RNA, 23 nt, Pseudomonas putida KT2440
gauaugccgccguucaggcgccu

SEQ ID NO: 3596355 - RNA, 20 nt, Pseudomonas putida KT2440
gauauggcuccaccacagcu

SEQ ID NO: 3596356 - RNA, 17 nt, Pseudomonas putida KT2440
gauauguccauccaugc

SEQ ID NO: 3596357 - RNA, 17 nt, Pseudomonas putida KT2440
gaucaaacggucccgau

SEQ ID NO: 3596358 - RNA, 17 nt, Pseudomonas putida KT2440
gaucaaagucgccuaca

SEQ ID NO: 3596359 - RNA, 14 nt, Pseudomonas putida KT2440
gaucaacgcaggcu

SEQ ID NO: 3596360 - RNA, 20 nt, Pseudomonas putida KT2440
gaucaacgccgccagcggcu

SEQ ID NO: 3596361 - RNA, 19 nt, Pseudomonas putida KT2440
gaucaagcuguacaacgca

SEQ ID NO: 3596362 - RNA, 22 nt, Pseudomonas putida KT2440
gaucaauaucaucacugccacc

SEQ ID NO: 3596363 - RNA, 11 nt, Pseudomonas putida KT2440
gaucaaugccc

SEQ ID NO: 3596364 - RNA, 13 nt, Pseudomonas putida KT2440
gaucaaugggccg

SEQ ID NO: 3596365 - RNA, 20 nt, Pseudomonas putida KT2440
gaucaaugggccgaucacga

SEQ ID NO: 3596366 - RNA, 17 nt, Pseudomonas putida KT2440
gaucaccagguuguggc

SEQ ID NO: 3596367 - RNA, 17 nt, Pseudomonas putida KT2440
gaucacccuuggccacc

SEQ ID NO: 3596368 - RNA, 19 nt, Pseudomonas putida KT2440
gaucaccgcaagcugcacc

SEQ ID NO: 3596369 - RNA, 17 nt, Pseudomonas putida KT2440
gaucaccgccagcagcu

SEQ ID NO: 3596370 - RNA, 15 nt, Pseudomonas putida KT2440
gaucaccgccgccac

SEQ ID NO: 3596371 - RNA, 17 nt, Pseudomonas putida KT2440
gaucaccuggucgaccg

SEQ ID NO: 3596372 - RNA, 19 nt, Pseudomonas putida KT2440
gaucacgaacacaucaccu

SEQ ID NO: 3596373 - RNA, 14 nt, Pseudomonas putida KT2440
gaucacgcaggccc

SEQ ID NO: 3596374 - RNA, 20 nt, Pseudomonas putida KT2440
gaucacgcaggcccagcagg

SEQ ID NO: 3596375 - RNA, 19 nt, Pseudomonas putida KT2440
gaucacgcuuaagucuucu

SEQ ID NO: 3596376 - RNA, 16 nt, Pseudomonas putida KT2440
gaucacgggcaggccc

SEQ ID NO: 3596377 - RNA, 17 nt, Pseudomonas putida KT2440
gaucacgggcaggcccc

SEQ ID NO: 3596378 - RNA, 18 nt, Pseudomonas putida KT2440
gaucacgggcaggccccu

SEQ ID NO: 3596379 - RNA, 19 nt, Pseudomonas putida KT2440
gaucacguggcugaugcca

SEQ ID NO: 3596380 - RNA, 14 nt, Pseudomonas putida KT2440
gaucacucggcagg

SEQ ID NO: 3596381 - RNA, 15 nt, Pseudomonas putida KT2440
gaucacugccagcac

SEQ ID NO: 3596382 - RNA, 20 nt, Pseudomonas putida KT2440
gaucacugccagcaccuggc

SEQ ID NO: 3596383 - RNA, 13 nt, Pseudomonas putida KT2440
gaucacugcgcag

SEQ ID NO: 3596384 - RNA, 20 nt, Pseudomonas putida KT2440
gaucacuguugucggccaga

SEQ ID NO: 3596385 - RNA, 17 nt, Pseudomonas putida KT2440
gaucacuuccaccugcg

SEQ ID NO: 3596386 - RNA, 16 nt, Pseudomonas putida KT2440
gaucacuuccauggca

SEQ ID NO: 3596387 - RNA, 14 nt, Pseudomonas putida KT2440
gaucagcaaugcca

SEQ ID NO: 3596388 - RNA, 19 nt, Pseudomonas putida KT2440
gaucagcacgcccaucagc

SEQ ID NO: 3596389 - RNA, 11 nt, Pseudomonas putida KT2440
gaucagcagca

SEQ ID NO: 3596390 - RNA, 14 nt, Pseudomonas putida KT2440
gaucagcagcaccg

SEQ ID NO: 3596391 - RNA, 18 nt, Pseudomonas putida KT2440
gaucagcagcaccgaggc

SEQ ID NO: 3596392 - RNA, 14 nt, Pseudomonas putida KT2440
gaucagcauguccc

SEQ ID NO: 3596393 - RNA, 15 nt, Pseudomonas putida KT2440
gaucagcaugucccg

SEQ ID NO: 3596394 - RNA, 14 nt, Pseudomonas putida KT2440
gaucagccacgggc

SEQ ID NO: 3596395 - RNA, 15 nt, Pseudomonas putida KT2440
gaucagccacgggcu

SEQ ID NO: 3596396 - RNA, 16 nt, Pseudomonas putida KT2440
gaucagccacgggcuu

SEQ ID NO: 3596397 - RNA, 19 nt, Pseudomonas putida KT2440
gaucagcccuugccaguga

SEQ ID NO: 3596398 - RNA, 16 nt, Pseudomonas putida KT2440
gaucagccgcgcugac

SEQ ID NO: 3596399 - RNA, 20 nt, Pseudomonas putida KT2440
gaucagccgcgcugacgcag

SEQ ID NO: 3596400 - RNA, 12 nt, Pseudomonas putida KT2440
gaucagcgccuc

SEQ ID NO: 3596401 - RNA, 15 nt, Pseudomonas putida KT2440
gaucagcgccugcug

SEQ ID NO: 3596402 - RNA, 19 nt, Pseudomonas putida KT2440
gaucagcgcggugaccagc

SEQ ID NO: 3596403 - RNA, 20 nt, Pseudomonas putida KT2440
gaucagcgcggugaccagcg

SEQ ID NO: 3596404 - RNA, 20 nt, Pseudomonas putida KT2440
gaucagcggcacggccacca

SEQ ID NO: 3596405 - RNA, 13 nt, Pseudomonas putida KT2440
gaucagcggcgcc

SEQ ID NO: 3596406 - RNA, 11 nt, Pseudomonas putida KT2440
gaucagcucau

SEQ ID NO: 3596407 - RNA, 17 nt, Pseudomonas putida KT2440
gaucagcucggcaacga

SEQ ID NO: 3596408 - RNA, 17 nt, Pseudomonas putida KT2440
gaucagcugccacucuu

SEQ ID NO: 3596409 - RNA, 23 nt, Pseudomonas putida KT2440
gaucagcuugccgaucagcgagu

SEQ ID NO: 3596410 - RNA, 16 nt, Pseudomonas putida KT2440
gaucaggaaggcacca

SEQ ID NO: 3596411 - RNA, 17 nt, Pseudomonas putida KT2440
gaucaggcuucagaagc

SEQ ID NO: 3596412 - RNA, 18 nt, Pseudomonas putida KT2440
gaucaggcuucagaagcc

SEQ ID NO: 3596413 - RNA, 19 nt, Pseudomonas putida KT2440
gaucaggcuucagaagccu

SEQ ID NO: 3596414 - RNA, 21 nt, Pseudomonas putida KT2440
gaucagggucagggccaggcc

SEQ ID NO: 3596415 - RNA, 17 nt, Pseudomonas putida KT2440
gaucagguaauccggca

SEQ ID NO: 3596416 - RNA, 16 nt, Pseudomonas putida KT2440
gaucagguuacuggcc

SEQ ID NO: 3596417 - RNA, 14 nt, Pseudomonas putida KT2440
gaucagguugccca

SEQ ID NO: 3596418 - RNA, 17 nt, Pseudomonas putida KT2440
gaucagguugcccagca

SEQ ID NO: 3596419 - RNA, 20 nt, Pseudomonas putida KT2440
gaucaguuccgcguccuuga

SEQ ID NO: 3596420 - RNA, 13 nt, Pseudomonas putida KT2440
gaucaucagcgcc

SEQ ID NO: 3596421 - RNA, 21 nt, Pseudomonas putida KT2440
gaucauccacaaucagcacug

SEQ ID NO: 3596422 - RNA, 20 nt, Pseudomonas putida KT2440
gaugaacccggcaaugguca

SEQ ID NO: 3596423 - RNA, 13 nt, Pseudomonas putida KT2440
gaugaacgacagg

SEQ ID NO: 3596424 - RNA, 19 nt, Pseudomonas putida KT2440
gaugaacgacagggucgcu

SEQ ID NO: 3596425 - RNA, 16 nt, Pseudomonas putida KT2440
gaugaacuggaugauc

SEQ ID NO: 3596426 - RNA, 22 nt, Pseudomonas putida KT2440
gaugaacuggaugauccagccc

SEQ ID NO: 3596427 - RNA, 19 nt, Pseudomonas putida KT2440
gaugaacuugcgcucaagc

SEQ ID NO: 3596428 - RNA, 17 nt, Pseudomonas putida KT2440
gaugaagaaugcgcagg

SEQ ID NO: 3596429 - RNA, 21 nt, Pseudomonas putida KT2440
gaugaagacgcucgacagcaa

SEQ ID NO: 3596430 - RNA, 14 nt, Pseudomonas putida KT2440
gaugaagcaggccg

SEQ ID NO: 3596431 - RNA, 16 nt, Pseudomonas putida KT2440
gaugaagucggcaacc

SEQ ID NO: 3596432 - RNA, 13 nt, Pseudomonas putida KT2440
gaugaaucgcgua

SEQ ID NO: 3596433 - RNA, 19 nt, Pseudomonas putida KT2440
gaugacccuuccagcccgc

SEQ ID NO: 3596434 - RNA, 20 nt, Pseudomonas putida KT2440
gaugacccuuccagcccgcc

SEQ ID NO: 3596435 - RNA, 18 nt, Pseudomonas putida KT2440
gaugacuggccggagcug

SEQ ID NO: 3596436 - RNA, 20 nt, Pseudomonas putida KT2440
gaugacuggccggagcugga

SEQ ID NO: 3596437 - RNA, 23 nt, Pseudomonas putida KT2440
gaugacuuucaugcccgcgucug

SEQ ID NO: 3596438 - RNA, 13 nt, Pseudomonas putida KT2440
gaugagccuucac

SEQ ID NO: 3596439 - RNA, 14 nt, Pseudomonas putida KT2440
gaugagggaaggcu

SEQ ID NO: 3596440 - RNA, 16 nt, Pseudomonas putida KT2440
gaugauaccgaacagc

SEQ ID NO: 3596441 - RNA, 24 nt, Pseudomonas putida KT2440
gaugauauuugccacucaggcgca

SEQ ID NO: 3596442 - RNA, 23 nt, Pseudomonas putida KT2440
gaugaucaauaucaucacugcca

SEQ ID NO: 3596443 - RNA, 13 nt, Pseudomonas putida KT2440
gaugaucagggac

SEQ ID NO: 3596444 - RNA, 23 nt, Pseudomonas putida KT2440
gaugaucgcggcguugucagccu

SEQ ID NO: 3596445 - RNA, 13 nt, Pseudomonas putida KT2440
gaugauggcugcc

SEQ ID NO: 3596446 - RNA, 20 nt, Pseudomonas putida KT2440
gaugaugguugacagcgcuu

SEQ ID NO: 3596447 - RNA, 21 nt, Pseudomonas putida KT2440
gaugcacagcucgcgcugcca

SEQ ID NO: 3596448 - RNA, 18 nt, Pseudomonas putida KT2440
gaugcacgccagcaucac

SEQ ID NO: 3596449 - RNA, 20 nt, Pseudomonas putida KT2440
gaugcacgccagcaucaccc

SEQ ID NO: 3596450 - RNA, 14 nt, Pseudomonas putida KT2440
gaugcagauggggg

SEQ ID NO: 3596451 - RNA, 15 nt, Pseudomonas putida KT2440
gaugcagcagugcca

SEQ ID NO: 3596452 - RNA, 21 nt, Pseudomonas putida KT2440
gaugcagcagugccagcaaca

SEQ ID NO: 3596453 - RNA, 12 nt, Pseudomonas putida KT2440
gaugcagggcug

SEQ ID NO: 3596454 - RNA, 15 nt, Pseudomonas putida KT2440
gaugcaucaauggcu

SEQ ID NO: 3596455 - RNA, 18 nt, Pseudomonas putida KT2440
gaugcaucaauggcuggg

SEQ ID NO: 3596456 - RNA, 23 nt, Pseudomonas putida KT2440
gaugcaucaauggcugggggcgc

SEQ ID NO: 3596457 - RNA, 23 nt, Pseudomonas putida KT2440
gaugccaauuuccauaccaaugg

SEQ ID NO: 3596458 - RNA, 16 nt, Pseudomonas putida KT2440
gaugccagcggugcca

SEQ ID NO: 3596459 - RNA, 20 nt, Pseudomonas putida KT2440
gaugccagcggugccaguca

SEQ ID NO: 3596460 - RNA, 19 nt, Pseudomonas putida KT2440
gaugccaucgaguaucgcc

SEQ ID NO: 3596461 - RNA, 21 nt, Pseudomonas putida KT2440
gaugccauugaucaccuccac

SEQ ID NO: 3596462 - RNA, 15 nt, Pseudomonas putida KT2440
gaugcccauggggau

SEQ ID NO: 3596463 - RNA, 18 nt, Pseudomonas putida KT2440
gaugcccgaucggguacu

SEQ ID NO: 3596464 - RNA, 20 nt, Pseudomonas putida KT2440
gaugcccgggccuucaaccu

SEQ ID NO: 3596465 - RNA, 17 nt, Pseudomonas putida KT2440
gaugcccuccagcccug

SEQ ID NO: 3596466 - RNA, 20 nt, Pseudomonas putida KT2440
gaugccguaguaagccagcc

SEQ ID NO: 3596467 - RNA, 19 nt, Pseudomonas putida KT2440
gaugccgugcgcggcauca

SEQ ID NO: 3596468 - RNA, 23 nt, Pseudomonas putida KT2440
gaugccgugcgcggcaucagcuc

SEQ ID NO: 3596469 - RNA, 22 nt, Pseudomonas putida KT2440
gaugccguucggcccgcugcca

SEQ ID NO: 3596470 - RNA, 23 nt, Pseudomonas putida KT2440
gaugccuuuguacgucucaucgu

SEQ ID NO: 3596471 - RNA, 15 nt, Pseudomonas putida KT2440
gaugcgccaguacgc

SEQ ID NO: 3596472 - RNA, 16 nt, Pseudomonas putida KT2440
gaugcgccccccaggc

SEQ ID NO: 3596473 - RNA, 13 nt, Pseudomonas putida KT2440
gaugcgcccuucg

SEQ ID NO: 3596474 - RNA, 17 nt, Pseudomonas putida KT2440
gaugcgcccuucgcgga

SEQ ID NO: 3596475 - RNA, 14 nt, Pseudomonas putida KT2440
gaugcgcgcugcaa

SEQ ID NO: 3596476 - RNA, 15 nt, Pseudomonas putida KT2440
gaugcgcgugcauuu

SEQ ID NO: 3596477 - RNA, 22 nt, Pseudomonas putida KT2440
gaugcgcuucauccagcgggau

SEQ ID NO: 3596478 - RNA, 15 nt, Pseudomonas putida KT2440
gaugcggacccagcg

SEQ ID NO: 3596479 - RNA, 22 nt, Pseudomonas putida KT2440
gaugcggacccagcggucagca

SEQ ID NO: 3596480 - RNA, 15 nt, Pseudomonas putida KT2440
gaugcgggaccagca

SEQ ID NO: 3596481 - RNA, 16 nt, Pseudomonas putida KT2440
gaugcgggaccagcac

SEQ ID NO: 3596482 - RNA, 22 nt, Pseudomonas putida KT2440
gaugcgguaggcacggucggua

SEQ ID NO: 3596483 - RNA, 16 nt, Pseudomonas putida KT2440
gaugcgguccgcccuu

SEQ ID NO: 3596484 - RNA, 17 nt, Pseudomonas putida KT2440
gaugcgguugcaggacu

SEQ ID NO: 3596485 - RNA, 16 nt, Pseudomonas putida KT2440
gaugcguacggccuug

SEQ ID NO: 3596486 - RNA, 14 nt, Pseudomonas putida KT2440
gaugcucugcagca

SEQ ID NO: 3596487 - RNA, 17 nt, Pseudomonas putida KT2440
gaugcucugcagcagcg

SEQ ID NO: 3596488 - RNA, 20 nt, Pseudomonas putida KT2440
gaugcugaagcucuccagca

SEQ ID NO: 3596489 - RNA, 12 nt, Pseudomonas putida KT2440
gaugcugcgggc

SEQ ID NO: 3596490 - RNA, 16 nt, Pseudomonas putida KT2440
gaugcugcgggcguug

SEQ ID NO: 3596491 - RNA, 12 nt, Pseudomonas putida KT2440
gaugcugcugca

SEQ ID NO: 3596492 - RNA, 15 nt, Pseudomonas putida KT2440
gaugcugcugcagug

SEQ ID NO: 3596493 - RNA, 20 nt, Pseudomonas putida KT2440
gaugcugucgucaagcucuu

SEQ ID NO: 3596494 - RNA, 17 nt, Pseudomonas putida KT2440
gauggacagcccaaggc

SEQ ID NO: 3596495 - RNA, 18 nt, Pseudomonas putida KT2440
gauggcaaucacgaacag

SEQ ID NO: 3596496 - RNA, 20 nt, Pseudomonas putida KT2440
gauggcaccggcuucgccgg

SEQ ID NO: 3596497 - RNA, 16 nt, Pseudomonas putida KT2440
gauggcagacaagucc

SEQ ID NO: 3596498 - RNA, 16 nt, Pseudomonas putida KT2440
gauggcauccacacgc

SEQ ID NO: 3596499 - RNA, 21 nt, Pseudomonas putida KT2440
gauggcauccacacgcugcug

SEQ ID NO: 3596500 - RNA, 11 nt, Pseudomonas putida KT2440
gauggccaaua

SEQ ID NO: 3596501 - RNA, 19 nt, Pseudomonas putida KT2440
gauggccaauaccgcugca

SEQ ID NO: 3596502 - RNA, 13 nt, Pseudomonas putida KT2440
gauggccaccagc

SEQ ID NO: 3596503 - RNA, 15 nt, Pseudomonas putida KT2440
gauggccaccagcac

SEQ ID NO: 3596504 - RNA, 16 nt, Pseudomonas putida KT2440
gauggccaccagcacc

SEQ ID NO: 3596505 - RNA, 15 nt, Pseudomonas putida KT2440
gauggccaggaacag

SEQ ID NO: 3596506 - RNA, 16 nt, Pseudomonas putida KT2440
gauggccaggaacagc

SEQ ID NO: 3596507 - RNA, 18 nt, Pseudomonas putida KT2440
gauggccaggaacagcgc

SEQ ID NO: 3596508 - RNA, 22 nt, Pseudomonas putida KT2440
gauggccgcuugcugaucaauc

SEQ ID NO: 3596509 - RNA, 19 nt, Pseudomonas putida KT2440
gauggccuugaucaggccc

SEQ ID NO: 3596510 - RNA, 23 nt, Pseudomonas putida KT2440
gauggcggaucagcgcguccagc

SEQ ID NO: 3596511 - RNA, 14 nt, Pseudomonas putida KT2440
gauggcggcuucaa

SEQ ID NO: 3596512 - RNA, 18 nt, Pseudomonas putida KT2440
gauggcggugaugcgcuc

SEQ ID NO: 3596513 - RNA, 18 nt, Pseudomonas putida KT2440
gauggcguccuugacgau

SEQ ID NO: 3596514 - RNA, 16 nt, Pseudomonas putida KT2440
gauggcucaucgccgu

SEQ ID NO: 3596515 - RNA, 18 nt, Pseudomonas putida KT2440
gauggcugaaaucuuugc

SEQ ID NO: 3596516 - RNA, 14 nt, Pseudomonas putida KT2440
gaugggcacuggcc

SEQ ID NO: 3596517 - RNA, 16 nt, Pseudomonas putida KT2440
gaugggcacuggccac

SEQ ID NO: 3596518 - RNA, 13 nt, Pseudomonas putida KT2440
gaugggcugcaaa

SEQ ID NO: 3596519 - RNA, 16 nt, Pseudomonas putida KT2440
gauggucuccgugcuc

SEQ ID NO: 3596520 - RNA, 15 nt, Pseudomonas putida KT2440
gauggugacugccag

SEQ ID NO: 3596521 - RNA, 18 nt, Pseudomonas putida KT2440
gauggugacugccagcac

SEQ ID NO: 3596522 - RNA, 14 nt, Pseudomonas putida KT2440
gaugguggcauagc

SEQ ID NO: 3596523 - RNA, 16 nt, Pseudomonas putida KT2440
gaugguugacagcgcu

SEQ ID NO: 3596524 - RNA, 16 nt, Pseudomonas putida KT2440
gauguacggcagaacg

SEQ ID NO: 3596525 - RNA, 12 nt, Pseudomonas putida KT2440
gauguaguucuu

SEQ ID NO: 3596526 - RNA, 14 nt, Pseudomonas putida KT2440
gauguccucggcgu

SEQ ID NO: 3596527 - RNA, 23 nt, Pseudomonas putida KT2440
gcaaauccgccccuacgcugguu

SEQ ID NO: 3596528 - RNA, 13 nt, Pseudomonas putida KT2440
gcaaauccuccug

SEQ ID NO: 3596529 - RNA, 12 nt, Pseudomonas putida KT2440
gcaaaucgccgc

SEQ ID NO: 3596530 - RNA, 14 nt, Pseudomonas putida KT2440
gcaaaugcaccccu

SEQ ID NO: 3596531 - RNA, 23 nt, Pseudomonas putida KT2440
gcaaaugcaccccugccaccagu

SEQ ID NO: 3596532 - RNA, 17 nt, Pseudomonas putida KT2440
gcaaaugcugccaugca

SEQ ID NO: 3596533 - RNA, 19 nt, Pseudomonas putida KT2440
gcaaauucucgagcugaug

SEQ ID NO: 3596534 - RNA, 21 nt, Pseudomonas putida KT2440
gcaaauugcccggccagcgau

SEQ ID NO: 3596535 - RNA, 15 nt, Pseudomonas putida KT2440
gcaacaccagcagcc

SEQ ID NO: 3596536 - RNA, 15 nt, Pseudomonas putida KT2440
gcaacaccgccagaa

SEQ ID NO: 3596537 - RNA, 19 nt, Pseudomonas putida KT2440
gcaacaccgccagcgggcu

SEQ ID NO: 3596538 - RNA, 14 nt, Pseudomonas putida KT2440
gcaacaccgccauu

SEQ ID NO: 3596539 - RNA, 16 nt, Pseudomonas putida KT2440
gcaacaccuccacgcc

SEQ ID NO: 3596540 - RNA, 18 nt, Pseudomonas putida KT2440
gcaacaccugccgcagcu

SEQ ID NO: 3596541 - RNA, 16 nt, Pseudomonas putida KT2440
gcaacacgacgauggc

SEQ ID NO: 3596542 - RNA, 17 nt, Pseudomonas putida KT2440
gcaacacgacgauggcc

SEQ ID NO: 3596543 - RNA, 21 nt, Pseudomonas putida KT2440
gcaacacgacgauggccacca

SEQ ID NO: 3596544 - RNA, 18 nt, Pseudomonas putida KT2440
gcaacagaaaaugcccgc

SEQ ID NO: 3596545 - RNA, 20 nt, Pseudomonas putida KT2440
gcaacagaaaaugcccgcug

SEQ ID NO: 3596546 - RNA, 20 nt, Pseudomonas putida KT2440
gcaacagcaaggcaucggcg

SEQ ID NO: 3596547 - RNA, 16 nt, Pseudomonas putida KT2440
gcaacagccccaucac

SEQ ID NO: 3596548 - RNA, 17 nt, Pseudomonas putida KT2440
gcaacagcgccuggcga

SEQ ID NO: 3596549 - RNA, 15 nt, Pseudomonas putida KT2440
gcaacagcggcgagu

SEQ ID NO: 3596550 - RNA, 22 nt, Pseudomonas putida KT2440
gcaacagcggcgagucgaucgg

SEQ ID NO: 3596551 - RNA, 16 nt, Pseudomonas putida KT2440
gcaacagcucauccag

SEQ ID NO: 3596552 - RNA, 22 nt, Pseudomonas putida KT2440
gcaacagcucauccaggcugca

SEQ ID NO: 3596553 - RNA, 14 nt, Pseudomonas putida KT2440
gcaacagcuccagc

SEQ ID NO: 3596554 - RNA, 17 nt, Pseudomonas putida KT2440
gcaacagcuccagcaac

SEQ ID NO: 3596555 - RNA, 22 nt, Pseudomonas putida KT2440
gcaacagcuccagcagugccgu

SEQ ID NO: 3596556 - RNA, 12 nt, Pseudomonas putida KT2440
gcaacagcugcg

SEQ ID NO: 3596557 - RNA, 18 nt, Pseudomonas putida KT2440
gcaacaggucgaccugcc

SEQ ID NO: 3596558 - RNA, 20 nt, Pseudomonas putida KT2440
gcaacaggucgaccugcccg

SEQ ID NO: 3596559 - RNA, 20 nt, Pseudomonas putida KT2440
gcaacaguuucuugccuucc

SEQ ID NO: 3596560 - RNA, 19 nt, Pseudomonas putida KT2440
gcaacaucgaucuggugac

SEQ ID NO: 3596561 - RNA, 21 nt, Pseudomonas putida KT2440
gcaacaucgaucuggugacug

SEQ ID NO: 3596562 - RNA, 19 nt, Pseudomonas putida KT2440
gcaacaucgcccccgcugc

SEQ ID NO: 3596563 - RNA, 15 nt, Pseudomonas putida KT2440
gcaacaugaagccau

SEQ ID NO: 3596564 - RNA, 17 nt, Pseudomonas putida KT2440
gcaacaugaagccaugg

SEQ ID NO: 3596565 - RNA, 16 nt, Pseudomonas putida KT2440
gcaacauguccacacc

SEQ ID NO: 3596566 - RNA, 17 nt, Pseudomonas putida KT2440
gcaacauguccacaccc

SEQ ID NO: 3596567 - RNA, 18 nt, Pseudomonas putida KT2440
gcaacauguccacacccg

SEQ ID NO: 3596568 - RNA, 14 nt, Pseudomonas putida KT2440
gcaacauucaccag

SEQ ID NO: 3596569 - RNA, 13 nt, Pseudomonas putida KT2440
gcaaccaccaaca

SEQ ID NO: 3596570 - RNA, 16 nt, Pseudomonas putida KT2440
gcaaccaccaacagca

SEQ ID NO: 3596571 - RNA, 22 nt, Pseudomonas putida KT2440
gcaaccaggcgccgagcgcggc

SEQ ID NO: 3596572 - RNA, 14 nt, Pseudomonas putida KT2440
gcaaccauggcuuc

SEQ ID NO: 3596573 - RNA, 21 nt, Pseudomonas putida KT2440
gcaaccauuuggcccgacaaa

SEQ ID NO: 3596574 - RNA, 16 nt, Pseudomonas putida KT2440
gcaacccggccaggcc

SEQ ID NO: 3596575 - RNA, 20 nt, Pseudomonas putida KT2440
gcaacccggccuuggccgcu

SEQ ID NO: 3596576 - RNA, 18 nt, Pseudomonas putida KT2440
gcaacccuucggccagca

SEQ ID NO: 3596577 - RNA, 22 nt, Pseudomonas putida KT2440
gcaaccgccgcgccucgcggug

SEQ ID NO: 3596578 - RNA, 16 nt, Pseudomonas putida KT2440
gcaaccgcgugacgcg

SEQ ID NO: 3596579 - RNA, 16 nt, Pseudomonas putida KT2440
gcaaccgggucggcgc

SEQ ID NO: 3596580 - RNA, 17 nt, Pseudomonas putida KT2440
gcaaccgggucuugaag

SEQ ID NO: 3596581 - RNA, 13 nt, Pseudomonas putida KT2440
gcaaccgugacug

SEQ ID NO: 3596582 - RNA, 20 nt, Pseudomonas putida KT2440
gcaaccucggccgcauccug

SEQ ID NO: 3596583 - RNA, 19 nt, Pseudomonas putida KT2440
gcaaccugggugugccgcu

SEQ ID NO: 3596584 - RNA, 18 nt, Pseudomonas putida KT2440
gcaacgaaaaaaagggca

SEQ ID NO: 3596585 - RNA, 22 nt, Pseudomonas putida KT2440
gcaacgaaaaaaagggcaccuc

SEQ ID NO: 3596586 - RNA, 19 nt, Pseudomonas putida KT2440
gcaacgaacuugcggaacg

SEQ ID NO: 3596587 - RNA, 16 nt, Pseudomonas putida KT2440
gcaacgauaauuaccg

SEQ ID NO: 3596588 - RNA, 15 nt, Pseudomonas putida KT2440
gcaacgccagcaaug

SEQ ID NO: 3596589 - RNA, 23 nt, Pseudomonas putida KT2440
gcaacgccgagcauuacaggcag

SEQ ID NO: 3596590 - RNA, 20 nt, Pseudomonas putida KT2440
gcaacgccgguagcugcgca

SEQ ID NO: 3596591 - RNA, 18 nt, Pseudomonas putida KT2440
gcaacgccuucaggcgaa

SEQ ID NO: 3596592 - RNA, 12 nt, Pseudomonas putida KT2440
gcaacgcgccau

SEQ ID NO: 3596593 - RNA, 19 nt, Pseudomonas putida KT2440
gcaacgcggcccuggguuu

SEQ ID NO: 3596594 - RNA, 21 nt, Pseudomonas putida KT2440
gcaacgcuuggcaaucaaggu

SEQ ID NO: 3596595 - RNA, 22 nt, Pseudomonas putida KT2440
gcaacggacgucccagcaggca

SEQ ID NO: 3596596 - RNA, 18 nt, Pseudomonas putida KT2440
gcaacggcacacgcacca

SEQ ID NO: 3596597 - RNA, 17 nt, Pseudomonas putida KT2440
gcaacggccacgcugcg

SEQ ID NO: 3596598 - RNA, 23 nt, Pseudomonas putida KT2440
gcaacgugcgccgagaccugugg

SEQ ID NO: 3596599 - RNA, 13 nt, Pseudomonas putida KT2440
gcaacucagcgca

SEQ ID NO: 3596600 - RNA, 18 nt, Pseudomonas putida KT2440
gcaacuccuccagccgac

SEQ ID NO: 3596601 - RNA, 20 nt, Pseudomonas putida KT2440
gcaacuccucgaucaccugc

SEQ ID NO: 3596602 - RNA, 15 nt, Pseudomonas putida KT2440
gcaacucgcgcccac

SEQ ID NO: 3596603 - RNA, 20 nt, Pseudomonas putida KT2440
gcaacugcccacccaaccgc

SEQ ID NO: 3596604 - RNA, 14 nt, Pseudomonas putida KT2440
gcaacugcccagga

SEQ ID NO: 3596605 - RNA, 15 nt, Pseudomonas putida KT2440
gcaacugcccaggau

SEQ ID NO: 3596606 - RNA, 23 nt, Pseudomonas putida KT2440
gcaacugcccaggaucacuggcc

SEQ ID NO: 3596607 - RNA, 17 nt, Pseudomonas putida KT2440
gcaacugcgccguggcc

SEQ ID NO: 3596608 - RNA, 22 nt, Pseudomonas putida KT2440
gcaacugcgcgauagccugugg

SEQ ID NO: 3596609 - RNA, 13 nt, Pseudomonas putida KT2440
gcaacugcggccc

SEQ ID NO: 3596610 - RNA, 21 nt, Pseudomonas putida KT2440
gcaacuggcccgcgccaggcu

SEQ ID NO: 3596611 - RNA, 19 nt, Pseudomonas putida KT2440
gcaacuggcgcaggccgcu

SEQ ID NO: 3596612 - RNA, 23 nt, Pseudomonas putida KT2440
gcaacuggugaaucagccccagc

SEQ ID NO: 3596613 - RNA, 15 nt, Pseudomonas putida KT2440
gcaacugugucucga

SEQ ID NO: 3596614 - RNA, 17 nt, Pseudomonas putida KT2440
gcaacuucucggucgcc

SEQ ID NO: 3596615 - RNA, 18 nt, Pseudomonas putida KT2440
gcaagaccggguccagca

SEQ ID NO: 3596616 - RNA, 15 nt, Pseudomonas putida KT2440
gcaagcaaacgccag

SEQ ID NO: 3596617 - RNA, 21 nt, Pseudomonas putida KT2440
gcaagcaggugcgcaggcuuu

SEQ ID NO: 3596618 - RNA, 17 nt, Pseudomonas putida KT2440
gcaagcagucccagcac

SEQ ID NO: 3596619 - RNA, 15 nt, Pseudomonas putida KT2440
gcaagccacgccaga

SEQ ID NO: 3596620 - RNA, 16 nt, Pseudomonas putida KT2440
gcaagccacgccagaa

SEQ ID NO: 3596621 - RNA, 21 nt, Pseudomonas putida KT2440
gcaagccacgccagaaccuga

SEQ ID NO: 3596622 - RNA, 14 nt, Pseudomonas putida KT2440
gcaagccagccucc

SEQ ID NO: 3596623 - RNA, 21 nt, Pseudomonas putida KT2440
gcaagcccaauggacgcgcaa

SEQ ID NO: 3596624 - RNA, 18 nt, Pseudomonas putida KT2440
gcaagcccauggcuggca

SEQ ID NO: 3596625 - RNA, 15 nt, Pseudomonas putida KT2440
gcaagcccgcgaaga

SEQ ID NO: 3596626 - RNA, 12 nt, Pseudomonas putida KT2440
gcaagcccgcuc

SEQ ID NO: 3596627 - RNA, 20 nt, Pseudomonas putida KT2440
gcaagcccgcucccacagga

SEQ ID NO: 3596628 - RNA, 23 nt, Pseudomonas putida KT2440
gcaagcccgcuccuacaggggac

SEQ ID NO: 3596629 - RNA, 17 nt, Pseudomonas putida KT2440
gcaagccgucucugacc

SEQ ID NO: 3596630 - RNA, 12 nt, Pseudomonas putida KT2440
gcaagccucagg

SEQ ID NO: 3596631 - RNA, 15 nt, Pseudomonas putida KT2440
gcaagccucaggcau

SEQ ID NO: 3596632 - RNA, 22 nt, Pseudomonas putida KT2440
gcacaaggcucaagcgcagccu

SEQ ID NO: 3596633 - RNA, 15 nt, Pseudomonas putida KT2440
gcacaaggcugcgcu

SEQ ID NO: 3596634 - RNA, 16 nt, Pseudomonas putida KT2440
gcacaaggcuguucca

SEQ ID NO: 3596635 - RNA, 20 nt, Pseudomonas putida KT2440
gcacaaggcuguuccacagc

SEQ ID NO: 3596636 - RNA, 23 nt, Pseudomonas putida KT2440
gcacaaguuucaaaaacggugca

SEQ ID NO: 3596637 - RNA, 13 nt, Pseudomonas putida KT2440
gcacaaucagcuc

SEQ ID NO: 3596638 - RNA, 18 nt, Pseudomonas putida KT2440
gcacacagcccaaagggc

SEQ ID NO: 3596639 - RNA, 21 nt, Pseudomonas putida KT2440
gcacacagcccaaagggcugg

SEQ ID NO: 3596640 - RNA, 13 nt, Pseudomonas putida KT2440
gcacaccaugggc

SEQ ID NO: 3596641 - RNA, 13 nt, Pseudomonas putida KT2440
gcacacccagcac

SEQ ID NO: 3596642 - RNA, 15 nt, Pseudomonas putida KT2440
gcacaccgcucaacc

SEQ ID NO: 3596643 - RNA, 22 nt, Pseudomonas putida KT2440
gcacaccgcugguggcguggcu

SEQ ID NO: 3596644 - RNA, 18 nt, Pseudomonas putida KT2440
gcacaccuggugcgccuu

SEQ ID NO: 3596645 - RNA, 19 nt, Pseudomonas putida KT2440
gcacaccuugggcccacac

SEQ ID NO: 3596646 - RNA, 14 nt, Pseudomonas putida KT2440
gcacacgaccuugg

SEQ ID NO: 3596647 - RNA, 13 nt, Pseudomonas putida KT2440
gcacacgcaccac

SEQ ID NO: 3596648 - RNA, 12 nt, Pseudomonas putida KT2440
gcacacgcucca

SEQ ID NO: 3596649 - RNA, 18 nt, Pseudomonas putida KT2440
gcacacgcuccagguagu

SEQ ID NO: 3596650 - RNA, 17 nt, Pseudomonas putida KT2440
gcacacgucgccugggc

SEQ ID NO: 3596651 - RNA, 15 nt, Pseudomonas putida KT2440
gcacacugagcacca

SEQ ID NO: 3596652 - RNA, 17 nt, Pseudomonas putida KT2440
gcacacugcccagcagc

SEQ ID NO: 3596653 - RNA, 21 nt, Pseudomonas putida KT2440
gcacacugcccagcagcccca

SEQ ID NO: 3596654 - RNA, 12 nt, Pseudomonas putida KT2440
gcacacuggcca

SEQ ID NO: 3596655 - RNA, 13 nt, Pseudomonas putida KT2440
gcacacuggccac

SEQ ID NO: 3596656 - RNA, 14 nt, Pseudomonas putida KT2440
gcacagaacaauaa

SEQ ID NO: 3596657 - RNA, 16 nt, Pseudomonas putida KT2440
gcacagaacaauaaaa

SEQ ID NO: 3596658 - RNA, 16 nt, Pseudomonas putida KT2440
gcacagacaccgcaaa

SEQ ID NO: 3596659 - RNA, 21 nt, Pseudomonas putida KT2440
gcacagacaccgcaaaucacu

SEQ ID NO: 3596660 - RNA, 12 nt, Pseudomonas putida KT2440
gcacagaccgca

SEQ ID NO: 3596661 - RNA, 16 nt, Pseudomonas putida KT2440
gcacagaccgcaacag

SEQ ID NO: 3596662 - RNA, 16 nt, Pseudomonas putida KT2440
gcacagauaaaccugc

SEQ ID NO: 3596663 - RNA, 17 nt, Pseudomonas putida KT2440
gcacagauaaaccugcc

SEQ ID NO: 3596664 - RNA, 17 nt, Pseudomonas putida KT2440
gcacagaucaacgccgc

SEQ ID NO: 3596665 - RNA, 18 nt, Pseudomonas putida KT2440
gcacagcacguucagcgg

SEQ ID NO: 3596666 - RNA, 19 nt, Pseudomonas putida KT2440
gcacagcacguucagcggg

SEQ ID NO: 3596667 - RNA, 19 nt, Pseudomonas putida KT2440
gcacagcaucacccgcgaa

SEQ ID NO: 3596668 - RNA, 16 nt, Pseudomonas putida KT2440
gcacagcgagcagccu

SEQ ID NO: 3596669 - RNA, 18 nt, Pseudomonas putida KT2440
gcacagcgagcagccugg

SEQ ID NO: 3596670 - RNA, 15 nt, Pseudomonas putida KT2440
gcacagcucgaugcc

SEQ ID NO: 3596671 - RNA, 18 nt, Pseudomonas putida KT2440
gcacagcucgcgcugcca

SEQ ID NO: 3596672 - RNA, 22 nt, Pseudomonas putida KT2440
gcacagcucgcgcugccaggcc

SEQ ID NO: 3596673 - RNA, 20 nt, Pseudomonas putida KT2440
gcacagcugccggccagcgc

SEQ ID NO: 3596674 - RNA, 20 nt, Pseudomonas putida KT2440
gcacaggaaaacugcgggcu

SEQ ID NO: 3596675 - RNA, 14 nt, Pseudomonas putida KT2440
gcacaggcauaccg

SEQ ID NO: 3596676 - RNA, 14 nt, Pseudomonas putida KT2440
gcacaggcccagca

SEQ ID NO: 3596677 - RNA, 16 nt, Pseudomonas putida KT2440
gcacaggcccagcaac

SEQ ID NO: 3596678 - RNA, 17 nt, Pseudomonas putida KT2440
gcacaggcccagcauga

SEQ ID NO: 3596679 - RNA, 18 nt, Pseudomonas putida KT2440
gcacaggcccagcaugaa

SEQ ID NO: 3596680 - RNA, 14 nt, Pseudomonas putida KT2440
gcacaggccgccug

SEQ ID NO: 3596681 - RNA, 17 nt, Pseudomonas putida KT2440
gcacaggccgccugacc

SEQ ID NO: 3596682 - RNA, 22 nt, Pseudomonas putida KT2440
gcacaggccgccugaccugugc

SEQ ID NO: 3596683 - RNA, 17 nt, Pseudomonas putida KT2440
gcacaggccgcgcauga

SEQ ID NO: 3596684 - RNA, 19 nt, Pseudomonas putida KT2440
gcacaggccgcgcaugaug

SEQ ID NO: 3596685 - RNA, 16 nt, Pseudomonas putida KT2440
gcacaggcgcagcagc

SEQ ID NO: 3596686 - RNA, 22 nt, Pseudomonas putida KT2440
gcacaggcuuacaacugcucca

SEQ ID NO: 3596687 - RNA, 15 nt, Pseudomonas putida KT2440
gcacagggcgaugcc

SEQ ID NO: 3596688 - RNA, 23 nt, Pseudomonas putida KT2440
gcacagggcggccaaggcguggc

SEQ ID NO: 3596689 - RNA, 18 nt, Pseudomonas putida KT2440
gcacagguaucgccgccc

SEQ ID NO: 3596690 - RNA, 18 nt, Pseudomonas putida KT2440
gcacagugguguacagca

SEQ ID NO: 3596691 - RNA, 18 nt, Pseudomonas putida KT2440
gcacauacaaaaugugcc

SEQ ID NO: 3596692 - RNA, 17 nt, Pseudomonas putida KT2440
gcacauagcccugcucg

SEQ ID NO: 3596693 - RNA, 21 nt, Pseudomonas putida KT2440
gcacauagcccugcucgucca

SEQ ID NO: 3596694 - RNA, 19 nt, Pseudomonas putida KT2440
gcacaucacacagcggcag

SEQ ID NO: 3596695 - RNA, 19 nt, Pseudomonas putida KT2440
gcacaucacggcgcaggcc

SEQ ID NO: 3596696 - RNA, 20 nt, Pseudomonas putida KT2440
gcacaucacggcgcaggccg

SEQ ID NO: 3596697 - RNA, 21 nt, Pseudomonas putida KT2440
gcacaucacggcgcaggccga

SEQ ID NO: 3596698 - RNA, 23 nt, Pseudomonas putida KT2440
gcacaucacguuuggcagugcca

SEQ ID NO: 3596699 - RNA, 12 nt, Pseudomonas putida KT2440
gcacaucccaga

SEQ ID NO: 3596700 - RNA, 19 nt, Pseudomonas putida KT2440
gcacauccugcaaggcaau

SEQ ID NO: 3596701 - RNA, 19 nt, Pseudomonas putida KT2440
gcacaucggcaaucgccgg

SEQ ID NO: 3596702 - RNA, 15 nt, Pseudomonas putida KT2440
gcacaucggccaccg

SEQ ID NO: 3596703 - RNA, 14 nt, Pseudomonas putida KT2440
gcacaucguccgcc

SEQ ID NO: 3596704 - RNA, 16 nt, Pseudomonas putida KT2440
gcacaucuugcugaug

SEQ ID NO: 3596705 - RNA, 16 nt, Pseudomonas putida KT2440
gcacaugcagguugcc

SEQ ID NO: 3596706 - RNA, 22 nt, Pseudomonas putida KT2440
gcaccaaagaaaaucgacccac

SEQ ID NO: 3596707 - RNA, 20 nt, Pseudomonas putida KT2440
gcaccaacacuuccagcauc

SEQ ID NO: 3596708 - RNA, 21 nt, Pseudomonas putida KT2440
gcaccaacuggucggccuugc

SEQ ID NO: 3596709 - RNA, 18 nt, Pseudomonas putida KT2440
gcaccacaucauccauga

SEQ ID NO: 3596710 - RNA, 22 nt, Pseudomonas putida KT2440
gcaccaccaagucgauuuucac

SEQ ID NO: 3596711 - RNA, 16 nt, Pseudomonas putida KT2440
gcaccacccaccagca

SEQ ID NO: 3596712 - RNA, 22 nt, Pseudomonas putida KT2440
gcaccacccaccagcagugccc

SEQ ID NO: 3596713 - RNA, 13 nt, Pseudomonas putida KT2440
gcaccacccccag

SEQ ID NO: 3596714 - RNA, 14 nt, Pseudomonas putida KT2440
gcaccacccccagc

SEQ ID NO: 3596715 - RNA, 16 nt, Pseudomonas putida KT2440
gcaccacccccagcgc

SEQ ID NO: 3596716 - RNA, 18 nt, Pseudomonas putida KT2440
gcaccacccccagcgccu

SEQ ID NO: 3596717 - RNA, 23 nt, Pseudomonas putida KT2440
gcaccaccccggggcgcuccagc

SEQ ID NO: 3596718 - RNA, 23 nt, Pseudomonas putida KT2440
gcaccaccggacgcuugccaccc

SEQ ID NO: 3596719 - RNA, 20 nt, Pseudomonas putida KT2440
gcaccaccugugccggcagc

SEQ ID NO: 3596720 - RNA, 15 nt, Pseudomonas putida KT2440
gcaccacgccauagc

SEQ ID NO: 3596721 - RNA, 16 nt, Pseudomonas putida KT2440
gcaccacgccauagcu

SEQ ID NO: 3596722 - RNA, 22 nt, Pseudomonas putida KT2440
gcaccacgcgcaaaugcuugcc

SEQ ID NO: 3596723 - RNA, 18 nt, Pseudomonas putida KT2440
gcaccacggaaggccacg

SEQ ID NO: 3596724 - RNA, 13 nt, Pseudomonas putida KT2440
gcaccacggcagu

SEQ ID NO: 3596725 - RNA, 14 nt, Pseudomonas putida KT2440
gcaccacgggcggc

SEQ ID NO: 3596726 - RNA, 20 nt, Pseudomonas putida KT2440
gcaccacgggcggcucacag

SEQ ID NO: 3596727 - RNA, 18 nt, Pseudomonas putida KT2440
gcaccacggucggccugc

SEQ ID NO: 3596728 - RNA, 16 nt, Pseudomonas putida KT2440
gcaccacguccggcca

SEQ ID NO: 3596729 - RNA, 18 nt, Pseudomonas putida KT2440
gcaccacuggaugacgcc

SEQ ID NO: 3596730 - RNA, 12 nt, Pseudomonas putida KT2440
gcaccacuguuc

SEQ ID NO: 3596731 - RNA, 13 nt, Pseudomonas putida KT2440
gcaccacuguuca

SEQ ID NO: 3596732 - RNA, 14 nt, Pseudomonas putida KT2440
gcaccagaccagca

SEQ ID NO: 3596733 - RNA, 16 nt, Pseudomonas putida KT2440
gcaccagaccagcagc

SEQ ID NO: 3596734 - RNA, 12 nt, Pseudomonas putida KT2440
gcaccagcacca

SEQ ID NO: 3596735 - RNA, 15 nt, Pseudomonas putida KT2440
gcaccagcaccagcu

SEQ ID NO: 3596736 - RNA, 17 nt, Pseudomonas putida KT2440
gcaccagcaccagcucc

SEQ ID NO: 3596737 - RNA, 15 nt, Pseudomonas putida KT2440
gcaccuaucgcugcc

SEQ ID NO: 3596738 - RNA, 17 nt, Pseudomonas putida KT2440
gcaccuaucgcugccgc

SEQ ID NO: 3596739 - RNA, 20 nt, Pseudomonas putida KT2440
gcaccuaucgcugccgccuu

SEQ ID NO: 3596740 - RNA, 18 nt, Pseudomonas putida KT2440
gcaccucauagaucagca

SEQ ID NO: 3596741 - RNA, 21 nt, Pseudomonas putida KT2440
gcaccucauagaucagcaucg

SEQ ID NO: 3596742 - RNA, 14 nt, Pseudomonas putida KT2440
gcaccuccaccuuc

SEQ ID NO: 3596743 - RNA, 11 nt, Pseudomonas putida KT2440
gcaccuccaga

SEQ ID NO: 3596744 - RNA, 12 nt, Pseudomonas putida KT2440
gcaccuccagag

SEQ ID NO: 3596745 - RNA, 14 nt, Pseudomonas putida KT2440
gcaccuccugcaca

SEQ ID NO: 3596746 - RNA, 19 nt, Pseudomonas putida KT2440
gcaccucggaugccacgcu

SEQ ID NO: 3596747 - RNA, 17 nt, Pseudomonas putida KT2440
gcaccugacgagcgaaa

SEQ ID NO: 3596748 - RNA, 15 nt, Pseudomonas putida KT2440
gcaccugacgcaagc

SEQ ID NO: 3596749 - RNA, 18 nt, Pseudomonas putida KT2440
gcaccugacgcaagcgcg

SEQ ID NO: 3596750 - RNA, 22 nt, Pseudomonas putida KT2440
gcaccugacgcaagcgcgccgc

SEQ ID NO: 3596751 - RNA, 22 nt, Pseudomonas putida KT2440
gcaccugcagguaaugcgccgc

SEQ ID NO: 3596752 - RNA, 17 nt, Pseudomonas putida KT2440
gcaccugcagguacagc

SEQ ID NO: 3596753 - RNA, 18 nt, Pseudomonas putida KT2440
gcaccugcagguacagca

SEQ ID NO: 3596754 - RNA, 21 nt, Pseudomonas putida KT2440
gcaccugcagguacagcagcu

SEQ ID NO: 3596755 - RNA, 22 nt, Pseudomonas putida KT2440
gcaccugcagguacagcagcug

SEQ ID NO: 3596756 - RNA, 15 nt, Pseudomonas putida KT2440
gcaccugccagccgc

SEQ ID NO: 3596757 - RNA, 14 nt, Pseudomonas putida KT2440
gcaccugcccgccc

SEQ ID NO: 3596758 - RNA, 21 nt, Pseudomonas putida KT2440
gcaccugccgcugauaaccug

SEQ ID NO: 3596759 - RNA, 17 nt, Pseudomonas putida KT2440
gcaccuggccgggcuuu

SEQ ID NO: 3596760 - RNA, 15 nt, Pseudomonas putida KT2440
gcaccuggcggcccg

SEQ ID NO: 3596761 - RNA, 17 nt, Pseudomonas putida KT2440
gcaccuggcggcccgcc

SEQ ID NO: 3596762 - RNA, 21 nt, Pseudomonas putida KT2440
gcaccuggcggcccgccggca

SEQ ID NO: 3596763 - RNA, 16 nt, Pseudomonas putida KT2440
gcaccugucccagcug

SEQ ID NO: 3596764 - RNA, 13 nt, Pseudomonas putida KT2440
gcaccuuggcguc

SEQ ID NO: 3596765 - RNA, 20 nt, Pseudomonas putida KT2440
gcaccuugugcacgaacaga

SEQ ID NO: 3596766 - RNA, 16 nt, Pseudomonas putida KT2440
gcacgaacacguccag

SEQ ID NO: 3596767 - RNA, 18 nt, Pseudomonas putida KT2440
gcacgaacagcaacacau

SEQ ID NO: 3596768 - RNA, 14 nt, Pseudomonas putida KT2440
gcacgaacagcggc

SEQ ID NO: 3596769 - RNA, 14 nt, Pseudomonas putida KT2440
gcacgaagcccagu

SEQ ID NO: 3596770 - RNA, 18 nt, Pseudomonas putida KT2440
gcacgaagcccaguugcu

SEQ ID NO: 3596771 - RNA, 14 nt, Pseudomonas putida KT2440
gcacgaaggccagc

SEQ ID NO: 3596772 - RNA, 15 nt, Pseudomonas putida KT2440
gcacgaaggccagca

SEQ ID NO: 3596773 - RNA, 19 nt, Pseudomonas putida KT2440
gcacgaaguaacggccacg

SEQ ID NO: 3596774 - RNA, 21 nt, Pseudomonas putida KT2440
gcacgaaguaacggccacggu

SEQ ID NO: 3596775 - RNA, 16 nt, Pseudomonas putida KT2440
gcacgaauacgcucga

SEQ ID NO: 3596776 - RNA, 19 nt, Pseudomonas putida KT2440
gcacgacugaacaccugcc

SEQ ID NO: 3596777 - RNA, 20 nt, Pseudomonas putida KT2440
gcacgacugaacaccugcca

SEQ ID NO: 3596778 - RNA, 13 nt, Pseudomonas putida KT2440
gcacgagcaugcc

SEQ ID NO: 3596779 - RNA, 14 nt, Pseudomonas putida KT2440
gcacgaucagcagc

SEQ ID NO: 3596780 - RNA, 20 nt, Pseudomonas putida KT2440
gcacgaucagcgcggcaaag

SEQ ID NO: 3596781 - RNA, 21 nt, Pseudomonas putida KT2440
gcacgaucauggggaugccga

SEQ ID NO: 3596782 - RNA, 13 nt, Pseudomonas putida KT2440
gcacgaucgaccg

SEQ ID NO: 3596783 - RNA, 23 nt, Pseudomonas putida KT2440
gcacgaucgaccggguaaucgcc

SEQ ID NO: 3596784 - RNA, 14 nt, Pseudomonas putida KT2440
gcacgauggcgguc

SEQ ID NO: 3596785 - RNA, 19 nt, Pseudomonas putida KT2440
gcacgauggcggucgaacc

SEQ ID NO: 3596786 - RNA, 18 nt, Pseudomonas putida KT2440
gcacgcaacaggucgacc

SEQ ID NO: 3596787 - RNA, 13 nt, Pseudomonas putida KT2440
gcacgcagcaauu

SEQ ID NO: 3596788 - RNA, 13 nt, Pseudomonas putida KT2440
gcacgcaggccag

SEQ ID NO: 3596789 - RNA, 15 nt, Pseudomonas putida KT2440
gcacgcaggccagcg

SEQ ID NO: 3596790 - RNA, 17 nt, Pseudomonas putida KT2440
gcacgcaggccagcgca

SEQ ID NO: 3596791 - RNA, 19 nt, Pseudomonas putida KT2440
gcacgcaugucaggggugc

SEQ ID NO: 3596792 - RNA, 20 nt, Pseudomonas putida KT2440
gcacgcauguccuuggccca

SEQ ID NO: 3596793 - RNA, 17 nt, Pseudomonas putida KT2440
gcacgccaaucaccugc

SEQ ID NO: 3596794 - RNA, 17 nt, Pseudomonas putida KT2440
gcacgcccaagccggcc

SEQ ID NO: 3596795 - RNA, 18 nt, Pseudomonas putida KT2440
gcacgcccgaaacacccu

SEQ ID NO: 3596796 - RNA, 15 nt, Pseudomonas putida KT2440
gcacgcccgcuccca

SEQ ID NO: 3596797 - RNA, 20 nt, Pseudomonas putida KT2440
gcacgcccgcucccacagga

SEQ ID NO: 3596798 - RNA, 20 nt, Pseudomonas putida KT2440
gcacgcccgcucccacaggc

SEQ ID NO: 3596799 - RNA, 22 nt, Pseudomonas putida KT2440
gcacgcccgcucccacagggac

SEQ ID NO: 3596800 - RNA, 21 nt, Pseudomonas putida KT2440
gcacgcccgcucccacaggug

SEQ ID NO: 3596801 - RNA, 17 nt, Pseudomonas putida KT2440
gcacgccgccgauaccg

SEQ ID NO: 3596802 - RNA, 20 nt, Pseudomonas putida KT2440
gcacgccgguaucacccagu

SEQ ID NO: 3596803 - RNA, 23 nt, Pseudomonas putida KT2440
gcacgccugucuagccgccugcc

SEQ ID NO: 3596804 - RNA, 17 nt, Pseudomonas putida KT2440
gcacgccuucagcagcc

SEQ ID NO: 3596805 - RNA, 23 nt, Pseudomonas putida KT2440
gcacgccuucagcagccggucgu

SEQ ID NO: 3596806 - RNA, 15 nt, Pseudomonas putida KT2440
gcacgcgaucggcag

SEQ ID NO: 3596807 - RNA, 16 nt, Pseudomonas putida KT2440
gcacgcgcagagaagc

SEQ ID NO: 3596808 - RNA, 18 nt, Pseudomonas putida KT2440
gcacgcgcagagaagccg

SEQ ID NO: 3596809 - RNA, 13 nt, Pseudomonas putida KT2440
gcacgcgccagca

SEQ ID NO: 3596810 - RNA, 19 nt, Pseudomonas putida KT2440
gcacgcgccagcagcgcgu

SEQ ID NO: 3596811 - RNA, 16 nt, Pseudomonas putida KT2440
gcacgcgcuuuuccag

SEQ ID NO: 3596812 - RNA, 21 nt, Pseudomonas putida KT2440
gcacgcgggcgcgacaaucag

SEQ ID NO: 3596813 - RNA, 17 nt, Pseudomonas putida KT2440
gcacgcuaccaccuggc

SEQ ID NO: 3596814 - RNA, 15 nt, Pseudomonas putida KT2440
gcacgcugcccaggu

SEQ ID NO: 3596815 - RNA, 23 nt, Pseudomonas putida KT2440
gcacgcugcccaggugccaggcu

SEQ ID NO: 3596816 - RNA, 20 nt, Pseudomonas putida KT2440
gcacgcuucgauccgcgccc

SEQ ID NO: 3596817 - RNA, 18 nt, Pseudomonas putida KT2440
gcacgcuuucacaaauag

SEQ ID NO: 3596818 - RNA, 16 nt, Pseudomonas putida KT2440
gcacggcaaucaggcu

SEQ ID NO: 3596819 - RNA, 16 nt, Pseudomonas putida KT2440
gcacggcaauugccac

SEQ ID NO: 3596820 - RNA, 15 nt, Pseudomonas putida KT2440
gcacggcaccagcac

SEQ ID NO: 3596821 - RNA, 14 nt, Pseudomonas putida KT2440
gcacggccagcacc

SEQ ID NO: 3596822 - RNA, 15 nt, Pseudomonas putida KT2440
gcacggccagcaccg

SEQ ID NO: 3596823 - RNA, 18 nt, Pseudomonas putida KT2440
gcacggccagccagcagc

SEQ ID NO: 3596824 - RNA, 20 nt, Pseudomonas putida KT2440
gcacggccuucccgccuggc

SEQ ID NO: 3596825 - RNA, 23 nt, Pseudomonas putida KT2440
gcacggccuucccgccuggcgcc

SEQ ID NO: 3596826 - RNA, 23 nt, Pseudomonas putida KT2440
gcacggccuugucagcagcuuca

SEQ ID NO: 3596827 - RNA, 15 nt, Pseudomonas putida KT2440
gcacggcgccgaccg

SEQ ID NO: 3596828 - RNA, 21 nt, Pseudomonas putida KT2440
gcacggcgcugucggucagca

SEQ ID NO: 3596829 - RNA, 15 nt, Pseudomonas putida KT2440
gcacggcguagggcu

SEQ ID NO: 3596830 - RNA, 15 nt, Pseudomonas putida KT2440
gcacggcgugcucca

SEQ ID NO: 3596831 - RNA, 15 nt, Pseudomonas putida KT2440
gcacggcugcccugc

SEQ ID NO: 3596832 - RNA, 18 nt, Pseudomonas putida KT2440
gcacgggccagcgcggua

SEQ ID NO: 3596833 - RNA, 22 nt, Pseudomonas putida KT2440
gcacgggccgauugccugggcg

SEQ ID NO: 3596834 - RNA, 20 nt, Pseudomonas putida KT2440
gcacggguacccgcguuggc

SEQ ID NO: 3596835 - RNA, 13 nt, Pseudomonas putida KT2440
gcacgggucaccu

SEQ ID NO: 3596836 - RNA, 16 nt, Pseudomonas putida KT2440
gcacggucuccggcga

SEQ ID NO: 3596837 - RNA, 18 nt, Pseudomonas putida KT2440
gcacgguugcgcccggcg

SEQ ID NO: 3596838 - RNA, 20 nt, Pseudomonas putida KT2440
gcacguaccuggcugcagug

SEQ ID NO: 3596839 - RNA, 20 nt, Pseudomonas putida KT2440
gcacguaguaauccggcaac

SEQ ID NO: 3596840 - RNA, 21 nt, Pseudomonas putida KT2440
gcacguaguaauccggcaacu

SEQ ID NO: 3596841 - RNA, 22 nt, Pseudomonas putida KT2440
gcacgucacugcagaucaccag

SEQ ID NO: 3596842 - RNA, 18 nt, Pseudomonas putida KT2440
gcagauuuuuuuggaguc

SEQ ID NO: 3596843 - RNA, 19 nt, Pseudomonas putida KT2440
gcagcaaagguuugucgcc

SEQ ID NO: 3596844 - RNA, 14 nt, Pseudomonas putida KT2440
gcagcaacacgacg

SEQ ID NO: 3596845 - RNA, 21 nt, Pseudomonas putida KT2440
gcagcaacaguuucuugccuu

SEQ ID NO: 3596846 - RNA, 16 nt, Pseudomonas putida KT2440
gcagcaacgccuuggc

SEQ ID NO: 3596847 - RNA, 13 nt, Pseudomonas putida KT2440
gcagcaaggccau

SEQ ID NO: 3596848 - RNA, 14 nt, Pseudomonas putida KT2440
gcagcaaggucgcc

SEQ ID NO: 3596849 - RNA, 20 nt, Pseudomonas putida KT2440
gcagcaaguugaagaacagu

SEQ ID NO: 3596850 - RNA, 18 nt, Pseudomonas putida KT2440
gcagcaauacgcacaggc

SEQ ID NO: 3596851 - RNA, 22 nt, Pseudomonas putida KT2440
gcagcaauacgcacaggcgcag

SEQ ID NO: 3596852 - RNA, 17 nt, Pseudomonas putida KT2440
gcagcaaucgccgccug

SEQ ID NO: 3596853 - RNA, 19 nt, Pseudomonas putida KT2440
gcagcaaucgccgccugga

SEQ ID NO: 3596854 - RNA, 19 nt, Pseudomonas putida KT2440
gcagcaaucggcagcgcgc

SEQ ID NO: 3596855 - RNA, 13 nt, Pseudomonas putida KT2440
gcagcacaaggcu

SEQ ID NO: 3596856 - RNA, 19 nt, Pseudomonas putida KT2440
gcagcacaaggcugcgccu

SEQ ID NO: 3596857 - RNA, 16 nt, Pseudomonas putida KT2440
gcagcacacuccacga

SEQ ID NO: 3596858 - RNA, 20 nt, Pseudomonas putida KT2440
gcagcacaucacacagcggc

SEQ ID NO: 3596859 - RNA, 21 nt, Pseudomonas putida KT2440
gcagcaccacgaagcgcggca

SEQ ID NO: 3596860 - RNA, 13 nt, Pseudomonas putida KT2440
gcagcacccuucc

SEQ ID NO: 3596861 - RNA, 15 nt, Pseudomonas putida KT2440
gcagcaccgccacca

SEQ ID NO: 3596862 - RNA, 18 nt, Pseudomonas putida KT2440
gcagcaccgccaccaugc

SEQ ID NO: 3596863 - RNA, 21 nt, Pseudomonas putida KT2440
gcagcaccgccaccaugcuca

SEQ ID NO: 3596864 - RNA, 22 nt, Pseudomonas putida KT2440
gcagcaccgccaccaugcucac

SEQ ID NO: 3596865 - RNA, 16 nt, Pseudomonas putida KT2440
gcagcaccgcugccag

SEQ ID NO: 3596866 - RNA, 22 nt, Pseudomonas putida KT2440
gcagcaccgcugccagcugcgc

SEQ ID NO: 3596867 - RNA, 16 nt, Pseudomonas putida KT2440
gcagcaccgucgagga

SEQ ID NO: 3596868 - RNA, 18 nt, Pseudomonas putida KT2440
gcagcaccuccaccuuca

SEQ ID NO: 3596869 - RNA, 15 nt, Pseudomonas putida KT2440
gcagcaccuccugca

SEQ ID NO: 3596870 - RNA, 12 nt, Pseudomonas putida KT2440
gcagcaccugcc

SEQ ID NO: 3596871 - RNA, 14 nt, Pseudomonas putida KT2440
gcagcacgaucagc

SEQ ID NO: 3596872 - RNA, 21 nt, Pseudomonas putida KT2440
gcagcacgaucagcgcggcaa

SEQ ID NO: 3596873 - RNA, 22 nt, Pseudomonas putida KT2440
gcagcacggaaucacgcggcgu

SEQ ID NO: 3596874 - RNA, 19 nt, Pseudomonas putida KT2440
gcagcacgucggcgccgaa

SEQ ID NO: 3596875 - RNA, 18 nt, Pseudomonas putida KT2440
gcagcacuuccucggcac

SEQ ID NO: 3596876 - RNA, 23 nt, Pseudomonas putida KT2440
gcagcagagagauugagaggacu

SEQ ID NO: 3596877 - RNA, 17 nt, Pseudomonas putida KT2440
gcagcagcagccccagc

SEQ ID NO: 3596878 - RNA, 14 nt, Pseudomonas putida KT2440
gcagcagccccagc

SEQ ID NO: 3596879 - RNA, 20 nt, Pseudomonas putida KT2440
gcagcagccccagcggcaac

SEQ ID NO: 3596880 - RNA, 12 nt, Pseudomonas putida KT2440
gcagcagcccuu

SEQ ID NO: 3596881 - RNA, 12 nt, Pseudomonas putida KT2440
gcagcagcgcga

SEQ ID NO: 3596882 - RNA, 13 nt, Pseudomonas putida KT2440
gcagcagcgcgau

SEQ ID NO: 3596883 - RNA, 19 nt, Pseudomonas putida KT2440
gcagcagcgcgauaccgac

SEQ ID NO: 3596884 - RNA, 13 nt, Pseudomonas putida KT2440
gcagcagcgcgcc

SEQ ID NO: 3596885 - RNA, 21 nt, Pseudomonas putida KT2440
gcagcagcucccgagccagga

SEQ ID NO: 3596886 - RNA, 22 nt, Pseudomonas putida KT2440
gcagcagcuuccugugccgcuu

SEQ ID NO: 3596887 - RNA, 13 nt, Pseudomonas putida KT2440
gcagcagcuugca

SEQ ID NO: 3596888 - RNA, 17 nt, Pseudomonas putida KT2440
gcagcagcuugcagcgc

SEQ ID NO: 3596889 - RNA, 18 nt, Pseudomonas putida KT2440
gcagcagcuugcagcgcc

SEQ ID NO: 3596890 - RNA, 22 nt, Pseudomonas putida KT2440
gcagcagcuugcagcgccgagc

SEQ ID NO: 3596891 - RNA, 16 nt, Pseudomonas putida KT2440
gcagcagguccagcuc

SEQ ID NO: 3596892 - RNA, 17 nt, Pseudomonas putida KT2440
gcagcagguccagcucc

SEQ ID NO: 3596893 - RNA, 12 nt, Pseudomonas putida KT2440
gcagcagugcca

SEQ ID NO: 3596894 - RNA, 17 nt, Pseudomonas putida KT2440
gcagcagugccagcaac

SEQ ID NO: 3596895 - RNA, 18 nt, Pseudomonas putida KT2440
gcagcaguggcaagccga

SEQ ID NO: 3596896 - RNA, 12 nt, Pseudomonas putida KT2440
gcagcaucacca

SEQ ID NO: 3596897 - RNA, 13 nt, Pseudomonas putida KT2440
gcagcaucaccac

SEQ ID NO: 3596898 - RNA, 14 nt, Pseudomonas putida KT2440
gcagcaucaccacg

SEQ ID NO: 3596899 - RNA, 16 nt, Pseudomonas putida KT2440
gcagcaucugcacguc

SEQ ID NO: 3596900 - RNA, 17 nt, Pseudomonas putida KT2440
gcagcaucuucuucacg

SEQ ID NO: 3596901 - RNA, 17 nt, Pseudomonas putida KT2440
gcagcaugaacagcgcu

SEQ ID NO: 3596902 - RNA, 18 nt, Pseudomonas putida KT2440
gcagcaugaacagcgcug

SEQ ID NO: 3596903 - RNA, 13 nt, Pseudomonas putida KT2440
gcagcaugacccu

SEQ ID NO: 3596904 - RNA, 18 nt, Pseudomonas putida KT2440
gcagcauggcgucggcga

SEQ ID NO: 3596905 - RNA, 20 nt, Pseudomonas putida KT2440
gcagccaacgccccaggccg

SEQ ID NO: 3596906 - RNA, 13 nt, Pseudomonas putida KT2440
gcagccaacuggu

SEQ ID NO: 3596907 - RNA, 12 nt, Pseudomonas putida KT2440
gcagccaccacg

SEQ ID NO: 3596908 - RNA, 19 nt, Pseudomonas putida KT2440
gcagccaccacgguggcug

SEQ ID NO: 3596909 - RNA, 21 nt, Pseudomonas putida KT2440
gcagccacccuccgcacaggc

SEQ ID NO: 3596910 - RNA, 21 nt, Pseudomonas putida KT2440
gcagccacgggugcgggcucc

SEQ ID NO: 3596911 - RNA, 21 nt, Pseudomonas putida KT2440
gcagccagcaucucggccagu

SEQ ID NO: 3596912 - RNA, 13 nt, Pseudomonas putida KT2440
gcagccagggccu

SEQ ID NO: 3596913 - RNA, 19 nt, Pseudomonas putida KT2440
gcagccagggccugaccgc

SEQ ID NO: 3596914 - RNA, 18 nt, Pseudomonas putida KT2440
gcagcccaaacagcauca

SEQ ID NO: 3596915 - RNA, 19 nt, Pseudomonas putida KT2440
gcagcccauucgcgggcaa

SEQ ID NO: 3596916 - RNA, 11 nt, Pseudomonas putida KT2440
gcagccccaaa

SEQ ID NO: 3596917 - RNA, 22 nt, Pseudomonas putida KT2440
gcagccccaaccuuccagcaaa

SEQ ID NO: 3596918 - RNA, 16 nt, Pseudomonas putida KT2440
gcagccccacgcccag

SEQ ID NO: 3596919 - RNA, 18 nt, Pseudomonas putida KT2440
gcagccccacgcccaggc

SEQ ID NO: 3596920 - RNA, 22 nt, Pseudomonas putida KT2440
gcagccccacgcccaggcggcg

SEQ ID NO: 3596921 - RNA, 20 nt, Pseudomonas putida KT2440
gcagccccagccucagcugg

SEQ ID NO: 3596922 - RNA, 18 nt, Pseudomonas putida KT2440
gcagccccagggcccuca

SEQ ID NO: 3596923 - RNA, 22 nt, Pseudomonas putida KT2440
gcagccccccuuccgcgugccc

SEQ ID NO: 3596924 - RNA, 13 nt, Pseudomonas putida KT2440
gcagccccgccaa

SEQ ID NO: 3596925 - RNA, 15 nt, Pseudomonas putida KT2440
gcagcccgcaggcua

SEQ ID NO: 3596926 - RNA, 13 nt, Pseudomonas putida KT2440
gcagcccggcaaa

SEQ ID NO: 3596927 - RNA, 15 nt, Pseudomonas putida KT2440
gcagcccuucgcagg

SEQ ID NO: 3596928 - RNA, 17 nt, Pseudomonas putida KT2440
gcagcccuucgccggca

SEQ ID NO: 3596929 - RNA, 22 nt, Pseudomonas putida KT2440
gcagcccuucgccggcacgccc

SEQ ID NO: 3596930 - RNA, 18 nt, Pseudomonas putida KT2440
gcagcccuucgcggcaag

SEQ ID NO: 3596931 - RNA, 22 nt, Pseudomonas putida KT2440
gcagcccuucgcgggcacgccc

SEQ ID NO: 3596932 - RNA, 19 nt, Pseudomonas putida KT2440
gcagccgacugacagguga

SEQ ID NO: 3596933 - RNA, 12 nt, Pseudomonas putida KT2440
gcagccgauacg

SEQ ID NO: 3596934 - RNA, 18 nt, Pseudomonas putida KT2440
gcagccgcacccaggcca

SEQ ID NO: 3596935 - RNA, 18 nt, Pseudomonas putida KT2440
gcagccgcaccugcccgc

SEQ ID NO: 3596936 - RNA, 19 nt, Pseudomonas putida KT2440
gcagccgcaccugcccgcc

SEQ ID NO: 3596937 - RNA, 14 nt, Pseudomonas putida KT2440
gcagccgcccgccc

SEQ ID NO: 3596938 - RNA, 16 nt, Pseudomonas putida KT2440
gcagccgcccuugagc

SEQ ID NO: 3596939 - RNA, 16 nt, Pseudomonas putida KT2440
gcagccggcaccgcca

SEQ ID NO: 3596940 - RNA, 20 nt, Pseudomonas putida KT2440
gcagccggcaccgccauggu

SEQ ID NO: 3596941 - RNA, 14 nt, Pseudomonas putida KT2440
gcagccggccuugc

SEQ ID NO: 3596942 - RNA, 22 nt, Pseudomonas putida KT2440
gcagccgggcgguugucgaccu

SEQ ID NO: 3596943 - RNA, 23 nt, Pseudomonas putida KT2440
gcagccgggcgguugucgaccug

SEQ ID NO: 3596944 - RNA, 15 nt, Pseudomonas putida KT2440
gcagccguucccggg

SEQ ID NO: 3596945 - RNA, 16 nt, Pseudomonas putida KT2440
gcagccguucccgggc

SEQ ID NO: 3596946 - RNA, 16 nt, Pseudomonas putida KT2440
gcagccguugcugggc

SEQ ID NO: 3596947 - RNA, 19 nt, Pseudomonas putida KT2440
gcagcuugaacaacggcgc

SEQ ID NO: 3596948 - RNA, 22 nt, Pseudomonas putida KT2440
gcagcuugaggucgccaggggu

SEQ ID NO: 3596949 - RNA, 16 nt, Pseudomonas putida KT2440
gcagcuugcagcgccg

SEQ ID NO: 3596950 - RNA, 18 nt, Pseudomonas putida KT2440
gcagcuugcagcgccgag

SEQ ID NO: 3596951 - RNA, 19 nt, Pseudomonas putida KT2440
gcagcuugcgcaagggguc

SEQ ID NO: 3596952 - RNA, 15 nt, Pseudomonas putida KT2440
gcagcuugcgcgccu

SEQ ID NO: 3596953 - RNA, 14 nt, Pseudomonas putida KT2440
gcagcuuggccauu

SEQ ID NO: 3596954 - RNA, 17 nt, Pseudomonas putida KT2440
gcagcuuuugcgcagcg

SEQ ID NO: 3596955 - RNA, 14 nt, Pseudomonas putida KT2440
gcaggaaacaccag

SEQ ID NO: 3596956 - RNA, 17 nt, Pseudomonas putida KT2440
gcaggaaauacgccgcc

SEQ ID NO: 3596957 - RNA, 16 nt, Pseudomonas putida KT2440
gcaggaacaaccugaa

SEQ ID NO: 3596958 - RNA, 22 nt, Pseudomonas putida KT2440
gcaggaacaaccugaacaaggc

SEQ ID NO: 3596959 - RNA, 21 nt, Pseudomonas putida KT2440
gcaggaacagcggcagcaaca

SEQ ID NO: 3596960 - RNA, 16 nt, Pseudomonas putida KT2440
gcaggaaccuccguug

SEQ ID NO: 3596961 - RNA, 21 nt, Pseudomonas putida KT2440
gcaggacuacaucuucgcgcu

SEQ ID NO: 3596962 - RNA, 23 nt, Pseudomonas putida KT2440
gcaggacuacaucuucgcgcucg

SEQ ID NO: 3596963 - RNA, 13 nt, Pseudomonas putida KT2440
gcaggagcaaaca

SEQ ID NO: 3596964 - RNA, 13 nt, Pseudomonas putida KT2440
gcaggagcggcuu

SEQ ID NO: 3596965 - RNA, 21 nt, Pseudomonas putida KT2440
gcaggagcggcuuugcguccc

SEQ ID NO: 3596966 - RNA, 15 nt, Pseudomonas putida KT2440
gcaggagcugaacug

SEQ ID NO: 3596967 - RNA, 23 nt, Pseudomonas putida KT2440
gcaggauauccacacccgccacg

SEQ ID NO: 3596968 - RNA, 22 nt, Pseudomonas putida KT2440
gcaggaucgcaagcuggcgcaa

SEQ ID NO: 3596969 - RNA, 20 nt, Pseudomonas putida KT2440
gcaggaucuagcccaauaga

SEQ ID NO: 3596970 - RNA, 22 nt, Pseudomonas putida KT2440
gcaggaucugcugcagcauggc

SEQ ID NO: 3596971 - RNA, 17 nt, Pseudomonas putida KT2440
gcaggaucuucaugcca

SEQ ID NO: 3596972 - RNA, 13 nt, Pseudomonas putida KT2440
gcaggaugucagg

SEQ ID NO: 3596973 - RNA, 16 nt, Pseudomonas putida KT2440
gcaggauuugcccgca

SEQ ID NO: 3596974 - RNA, 17 nt, Pseudomonas putida KT2440
gcaggauuugcccgcaa

SEQ ID NO: 3596975 - RNA, 17 nt, Pseudomonas putida KT2440
gcaggcaaacgcgguca

SEQ ID NO: 3596976 - RNA, 18 nt, Pseudomonas putida KT2440
gcaggcaaagaaugccgc

SEQ ID NO: 3596977 - RNA, 22 nt, Pseudomonas putida KT2440
gcaggcaauaaaaaaccccggc

SEQ ID NO: 3596978 - RNA, 13 nt, Pseudomonas putida KT2440
gcaggcacacccg

SEQ ID NO: 3596979 - RNA, 15 nt, Pseudomonas putida KT2440
gcaggcacacccgga

SEQ ID NO: 3596980 - RNA, 20 nt, Pseudomonas putida KT2440
gcaggcagcacaugccacgc

SEQ ID NO: 3596981 - RNA, 15 nt, Pseudomonas putida KT2440
gcaggcagcgauggc

SEQ ID NO: 3596982 - RNA, 16 nt, Pseudomonas putida KT2440
gcaggcagcucgaugu

SEQ ID NO: 3596983 - RNA, 13 nt, Pseudomonas putida KT2440
gcaggcaguaggc

SEQ ID NO: 3596984 - RNA, 14 nt, Pseudomonas putida KT2440
gcaggcaguaggcc

SEQ ID NO: 3596985 - RNA, 17 nt, Pseudomonas putida KT2440
gcaggcaguaggccacc

SEQ ID NO: 3596986 - RNA, 16 nt, Pseudomonas putida KT2440
gcaggcagucuugaaa

SEQ ID NO: 3596987 - RNA, 19 nt, Pseudomonas putida KT2440
gcaggcaguucgagcgccu

SEQ ID NO: 3596988 - RNA, 15 nt, Pseudomonas putida KT2440
gcaggcauacaggac

SEQ ID NO: 3596989 - RNA, 12 nt, Pseudomonas putida KT2440
gcaggccaagga

SEQ ID NO: 3596990 - RNA, 16 nt, Pseudomonas putida KT2440
gcaggccaaggaacgu

SEQ ID NO: 3596991 - RNA, 17 nt, Pseudomonas putida KT2440
gcaggccaaugcagcuu

SEQ ID NO: 3596992 - RNA, 21 nt, Pseudomonas putida KT2440
gcaggccaaugcccaugccca

SEQ ID NO: 3596993 - RNA, 13 nt, Pseudomonas putida KT2440
gcaggccaccggc

SEQ ID NO: 3596994 - RNA, 14 nt, Pseudomonas putida KT2440
gcaggccaccggca

SEQ ID NO: 3596995 - RNA, 20 nt, Pseudomonas putida KT2440
gcaggccaccggcagcaccu

SEQ ID NO: 3596996 - RNA, 14 nt, Pseudomonas putida KT2440
gcaggccagcgcac

SEQ ID NO: 3596997 - RNA, 22 nt, Pseudomonas putida KT2440
gcaggccauacagggccuggcg

SEQ ID NO: 3596998 - RNA, 21 nt, Pseudomonas putida KT2440
gcaggccauauugcugagcca

SEQ ID NO: 3596999 - RNA, 23 nt, Pseudomonas putida KT2440
gcaggccauauugcugagccagu

SEQ ID NO: 3597000 - RNA, 15 nt, Pseudomonas putida KT2440
gcaggcccagcaggu

SEQ ID NO: 3597001 - RNA, 18 nt, Pseudomonas putida KT2440
gcaggcccagcagguaca

SEQ ID NO: 3597002 - RNA, 13 nt, Pseudomonas putida KT2440
gcaggcccaggua

SEQ ID NO: 3597003 - RNA, 21 nt, Pseudomonas putida KT2440
gcaggcccagguaacugccga

SEQ ID NO: 3597004 - RNA, 20 nt, Pseudomonas putida KT2440
gcaggccccugcaacagggc

SEQ ID NO: 3597005 - RNA, 22 nt, Pseudomonas putida KT2440
gcaggccccugcaacagggcgc

SEQ ID NO: 3597006 - RNA, 21 nt, Pseudomonas putida KT2440
gcaggcccggcccauucgcgg

SEQ ID NO: 3597007 - RNA, 21 nt, Pseudomonas putida KT2440
gcaggcccggcccuuucgcgg

SEQ ID NO: 3597008 - RNA, 20 nt, Pseudomonas putida KT2440
gcaggccgacaacagcaugc

SEQ ID NO: 3597009 - RNA, 14 nt, Pseudomonas putida KT2440
gcaggccgcagccu

SEQ ID NO: 3597010 - RNA, 23 nt, Pseudomonas putida KT2440
gcaggccuggguacgccgaaauu

SEQ ID NO: 3597011 - RNA, 16 nt, Pseudomonas putida KT2440
gcaggcgcacauccac

SEQ ID NO: 3597012 - RNA, 14 nt, Pseudomonas putida KT2440
gcaggcgcagggug

SEQ ID NO: 3597013 - RNA, 13 nt, Pseudomonas putida KT2440
gcaggcgcaggug

SEQ ID NO: 3597014 - RNA, 15 nt, Pseudomonas putida KT2440
gcaggcgcaggugca

SEQ ID NO: 3597015 - RNA, 17 nt, Pseudomonas putida KT2440
gcaggcgcaggugcagc

SEQ ID NO: 3597016 - RNA, 22 nt, Pseudomonas putida KT2440
gcaggcgcaggugcagccagcc

SEQ ID NO: 3597017 - RNA, 16 nt, Pseudomonas putida KT2440
gcaggcgcgagccuug

SEQ ID NO: 3597018 - RNA, 18 nt, Pseudomonas putida KT2440
gcaggcgcgagccuugcc

SEQ ID NO: 3597019 - RNA, 23 nt, Pseudomonas putida KT2440
gcaggcgcggcguggccucacgg

SEQ ID NO: 3597020 - RNA, 23 nt, Pseudomonas putida KT2440
gcaggcgcucgggggugcacagc

SEQ ID NO: 3597021 - RNA, 14 nt, Pseudomonas putida KT2440
gcaggcggcgacaa

SEQ ID NO: 3597022 - RNA, 21 nt, Pseudomonas putida KT2440
gcaggcggcgacaaccgaaaa

SEQ ID NO: 3597023 - RNA, 18 nt, Pseudomonas putida KT2440
gcaggcgguccagcaagc

SEQ ID NO: 3597024 - RNA, 17 nt, Pseudomonas putida KT2440
gcaggcgguuggccaug

SEQ ID NO: 3597025 - RNA, 22 nt, Pseudomonas putida KT2440
gcaggcguaacucagcaacgcu

SEQ ID NO: 3597026 - RNA, 20 nt, Pseudomonas putida KT2440
gcaggcguucgucaagcucg

SEQ ID NO: 3597027 - RNA, 19 nt, Pseudomonas putida KT2440
gcaggcuaauggcgcgccu

SEQ ID NO: 3597028 - RNA, 17 nt, Pseudomonas putida KT2440
gcaggcucagggcagca

SEQ ID NO: 3597029 - RNA, 14 nt, Pseudomonas putida KT2440
gcaggcucagggcc

SEQ ID NO: 3597030 - RNA, 19 nt, Pseudomonas putida KT2440
gcaggcucagggccgcaga

SEQ ID NO: 3597031 - RNA, 22 nt, Pseudomonas putida KT2440
gcaggcucagggccgcagagcg

SEQ ID NO: 3597032 - RNA, 15 nt, Pseudomonas putida KT2440
gcaggcuccaaagcc

SEQ ID NO: 3597033 - RNA, 15 nt, Pseudomonas putida KT2440
gcaggcucuccacgu

SEQ ID NO: 3597034 - RNA, 17 nt, Pseudomonas putida KT2440
gcaggcucuccacgucc

SEQ ID NO: 3597035 - RNA, 21 nt, Pseudomonas putida KT2440
gcaggcucugaaugucagcgc

SEQ ID NO: 3597036 - RNA, 22 nt, Pseudomonas putida KT2440
gcaggcucugaaugucagcgcu

SEQ ID NO: 3597037 - RNA, 14 nt, Pseudomonas putida KT2440
gcaggcugacccgc

SEQ ID NO: 3597038 - RNA, 14 nt, Pseudomonas putida KT2440
gcaggcugccgcgc

SEQ ID NO: 3597039 - RNA, 18 nt, Pseudomonas putida KT2440
gcaggcugcgugccugcu

SEQ ID NO: 3597040 - RNA, 15 nt, Pseudomonas putida KT2440
gcaggcuggcaauca

SEQ ID NO: 3597041 - RNA, 19 nt, Pseudomonas putida KT2440
gcaggcuggcggccaaugc

SEQ ID NO: 3597042 - RNA, 21 nt, Pseudomonas putida KT2440
gcaggcuggcgggguggccgg

SEQ ID NO: 3597043 - RNA, 15 nt, Pseudomonas putida KT2440
gcaggcuggcguggu

SEQ ID NO: 3597044 - RNA, 16 nt, Pseudomonas putida KT2440
gcaggcugucgaacag

SEQ ID NO: 3597045 - RNA, 17 nt, Pseudomonas putida KT2440
gcaggcugucgaacagg

SEQ ID NO: 3597046 - RNA, 21 nt, Pseudomonas putida KT2440
gcaggcugucgaacaggcugc

SEQ ID NO: 3597047 - RNA, 21 nt, Pseudomonas putida KT2440
gcaggcuguuguacggcagcu

SEQ ID NO: 3597048 - RNA, 22 nt, Pseudomonas putida KT2440
gcaggcuucaaggccacgcggu

SEQ ID NO: 3597049 - RNA, 15 nt, Pseudomonas putida KT2440
gcaggcuucaugacu

SEQ ID NO: 3597050 - RNA, 21 nt, Pseudomonas putida KT2440
gcaggcuuucggccacccgga

SEQ ID NO: 3597051 - RNA, 17 nt, Pseudomonas putida KT2440
gcagggaagguggccgg

SEQ ID NO: 3597052 - RNA, 13 nt, Pseudomonas putida KT2440
gcagugaugccgu

SEQ ID NO: 3597053 - RNA, 21 nt, Pseudomonas putida KT2440
gcagugcacccaucggcgcga

SEQ ID NO: 3597054 - RNA, 23 nt, Pseudomonas putida KT2440
gcagugcacccaucggcgcgaag

SEQ ID NO: 3597055 - RNA, 21 nt, Pseudomonas putida KT2440
gcagugcaucgaagcaggccg

SEQ ID NO: 3597056 - RNA, 13 nt, Pseudomonas putida KT2440
gcagugccagcaa

SEQ ID NO: 3597057 - RNA, 15 nt, Pseudomonas putida KT2440
gcagugccagcaaca

SEQ ID NO: 3597058 - RNA, 19 nt, Pseudomonas putida KT2440
gcagugccagcaacaagcu

SEQ ID NO: 3597059 - RNA, 15 nt, Pseudomonas putida KT2440
gcagugccaucgccu

SEQ ID NO: 3597060 - RNA, 18 nt, Pseudomonas putida KT2440
gcagugcccagucgaugg

SEQ ID NO: 3597061 - RNA, 21 nt, Pseudomonas putida KT2440
gcagugccgugaguggccucg

SEQ ID NO: 3597062 - RNA, 20 nt, Pseudomonas putida KT2440
gcagugccucgaccaccauc

SEQ ID NO: 3597063 - RNA, 22 nt, Pseudomonas putida KT2440
gcagugccucgaccaccaucgc

SEQ ID NO: 3597064 - RNA, 20 nt, Pseudomonas putida KT2440
gcagugccuggaugcgggcu

SEQ ID NO: 3597065 - RNA, 20 nt, Pseudomonas putida KT2440
gcagugccugugagaucgag

SEQ ID NO: 3597066 - RNA, 14 nt, Pseudomonas putida KT2440
gcagugcggcaacc

SEQ ID NO: 3597067 - RNA, 22 nt, Pseudomonas putida KT2440
gcagugcggcaaccaccaacag

SEQ ID NO: 3597068 - RNA, 14 nt, Pseudomonas putida KT2440
gcagugcugccacg

SEQ ID NO: 3597069 - RNA, 13 nt, Pseudomonas putida KT2440
gcaguggcaagcc

SEQ ID NO: 3597070 - RNA, 13 nt, Pseudomonas putida KT2440
gcaguggccgagu

SEQ ID NO: 3597071 - RNA, 18 nt, Pseudomonas putida KT2440
gcaguggugcucagcggc

SEQ ID NO: 3597072 - RNA, 22 nt, Pseudomonas putida KT2440
gcaguggugcucagcggcaccu

SEQ ID NO: 3597073 - RNA, 16 nt, Pseudomonas putida KT2440
gcaguguacauggccg

SEQ ID NO: 3597074 - RNA, 19 nt, Pseudomonas putida KT2440
gcaguguacauggccgcca

SEQ ID NO: 3597075 - RNA, 22 nt, Pseudomonas putida KT2440
gcaguuacucggcuaccgcauu

SEQ ID NO: 3597076 - RNA, 20 nt, Pseudomonas putida KT2440
gcaguucagggcguggugaa

SEQ ID NO: 3597077 - RNA, 17 nt, Pseudomonas putida KT2440
gcaguucauccggcggc

SEQ ID NO: 3597078 - RNA, 19 nt, Pseudomonas putida KT2440
gcaguucauccggcggcau

SEQ ID NO: 3597079 - RNA, 18 nt, Pseudomonas putida KT2440
gcaguucgcacagcucga

SEQ ID NO: 3597080 - RNA, 20 nt, Pseudomonas putida KT2440
gcaguucgcgcaccaucggc

SEQ ID NO: 3597081 - RNA, 14 nt, Pseudomonas putida KT2440
gcaguucgcugcgc

SEQ ID NO: 3597082 - RNA, 15 nt, Pseudomonas putida KT2440
gcaguucgucgaccg

SEQ ID NO: 3597083 - RNA, 21 nt, Pseudomonas putida KT2440
gcaguucgucgaccgccgccu

SEQ ID NO: 3597084 - RNA, 21 nt, Pseudomonas putida KT2440
gcaguucuuccagcggcaagg

SEQ ID NO: 3597085 - RNA, 21 nt, Pseudomonas putida KT2440
gcaguugcaggcgcagggugu

SEQ ID NO: 3597086 - RNA, 14 nt, Pseudomonas putida KT2440
gcaguugcccuggg

SEQ ID NO: 3597087 - RNA, 15 nt, Pseudomonas putida KT2440
gcaguugcugcugcc

SEQ ID NO: 3597088 - RNA, 15 nt, Pseudomonas putida KT2440
gcaguuggccgacga

SEQ ID NO: 3597089 - RNA, 20 nt, Pseudomonas putida KT2440
gcauaaaaaaaccggccacg

SEQ ID NO: 3597090 - RNA, 14 nt, Pseudomonas putida KT2440
gcauaacggcuggc

SEQ ID NO: 3597091 - RNA, 12 nt, Pseudomonas putida KT2440
gcauacagcgca

SEQ ID NO: 3597092 - RNA, 17 nt, Pseudomonas putida KT2440
gcauacaggaccaggcc

SEQ ID NO: 3597093 - RNA, 13 nt, Pseudomonas putida KT2440
gcauaccgcaaca

SEQ ID NO: 3597094 - RNA, 17 nt, Pseudomonas putida KT2440
gcauaccgcaacaccug

SEQ ID NO: 3597095 - RNA, 16 nt, Pseudomonas putida KT2440
gcauacgaggccgucg

SEQ ID NO: 3597096 - RNA, 20 nt, Pseudomonas putida KT2440
gcauagauggcugucugcag

SEQ ID NO: 3597097 - RNA, 17 nt, Pseudomonas putida KT2440
gcauagcagaacagaaa

SEQ ID NO: 3597098 - RNA, 19 nt, Pseudomonas putida KT2440
gcauagcgguacagcaccc

SEQ ID NO: 3597099 - RNA, 22 nt, Pseudomonas putida KT2440
gcauaggccaagguugccacca

SEQ ID NO: 3597100 - RNA, 19 nt, Pseudomonas putida KT2440
gcauaguccaggaagcagg

SEQ ID NO: 3597101 - RNA, 23 nt, Pseudomonas putida KT2440
gcaucaaacgaugcgggcuuucu

SEQ ID NO: 3597102 - RNA, 19 nt, Pseudomonas putida KT2440
gcaucaaauuuagagugcc

SEQ ID NO: 3597103 - RNA, 21 nt, Pseudomonas putida KT2440
gcaucaacguucccaauguca

SEQ ID NO: 3597104 - RNA, 13 nt, Pseudomonas putida KT2440
gcaucaaucgcuc

SEQ ID NO: 3597105 - RNA, 20 nt, Pseudomonas putida KT2440
gcaucaaucgcuccaggcgg

SEQ ID NO: 3597106 - RNA, 14 nt, Pseudomonas putida KT2440
gcaucaaugcagga

SEQ ID NO: 3597107 - RNA, 15 nt, Pseudomonas putida KT2440
gcaucaauggcuggg

SEQ ID NO: 3597108 - RNA, 15 nt, Pseudomonas putida KT2440
gcaucacgccgcgcu

SEQ ID NO: 3597109 - RNA, 12 nt, Pseudomonas putida KT2440
gcaucacgcugg

SEQ ID NO: 3597110 - RNA, 16 nt, Pseudomonas putida KT2440
gcaucacgcuggccau

SEQ ID NO: 3597111 - RNA, 17 nt, Pseudomonas putida KT2440
gcaucacgucacagcca

SEQ ID NO: 3597112 - RNA, 16 nt, Pseudomonas putida KT2440
gcaucagcacacccag

SEQ ID NO: 3597113 - RNA, 17 nt, Pseudomonas putida KT2440
gcaucagcacacccagc

SEQ ID NO: 3597114 - RNA, 18 nt, Pseudomonas putida KT2440
gcaucagcacacccagca

SEQ ID NO: 3597115 - RNA, 12 nt, Pseudomonas putida KT2440
gcaucagccggc

SEQ ID NO: 3597116 - RNA, 16 nt, Pseudomonas putida KT2440
gcaucagccggcuucc

SEQ ID NO: 3597117 - RNA, 14 nt, Pseudomonas putida KT2440
gcaucagcgcagca

SEQ ID NO: 3597118 - RNA, 20 nt, Pseudomonas putida KT2440
gcaucaggcugcgcccgcac

SEQ ID NO: 3597119 - RNA, 16 nt, Pseudomonas putida KT2440
gcaucagggucugagc

SEQ ID NO: 3597120 - RNA, 15 nt, Pseudomonas putida KT2440
gcaucagugcaggug

SEQ ID NO: 3597121 - RNA, 17 nt, Pseudomonas putida KT2440
gcaucagugcaggugca

SEQ ID NO: 3597122 - RNA, 18 nt, Pseudomonas putida KT2440
gcaucagugcaggugcac

SEQ ID NO: 3597123 - RNA, 22 nt, Pseudomonas putida KT2440
gcaucauccgagcugagcagcg

SEQ ID NO: 3597124 - RNA, 17 nt, Pseudomonas putida KT2440
gcaucauccugcucgac

SEQ ID NO: 3597125 - RNA, 21 nt, Pseudomonas putida KT2440
gcaucauccugcucgacaagc

SEQ ID NO: 3597126 - RNA, 15 nt, Pseudomonas putida KT2440
gcaucauccugcugg

SEQ ID NO: 3597127 - RNA, 17 nt, Pseudomonas putida KT2440
gcaucauccugcuggcc

SEQ ID NO: 3597128 - RNA, 24 nt, Pseudomonas putida KT2440
gcauccaaagccaauuugccagcg

SEQ ID NO: 3597129 - RNA, 15 nt, Pseudomonas putida KT2440
gcauccaacgcugcc

SEQ ID NO: 3597130 - RNA, 18 nt, Pseudomonas putida KT2440
gcauccaacgcugccuug

SEQ ID NO: 3597131 - RNA, 19 nt, Pseudomonas putida KT2440
gcauccacaccagcggcgc

SEQ ID NO: 3597132 - RNA, 22 nt, Pseudomonas putida KT2440
gcauccacaccagcggcgcgau

SEQ ID NO: 3597133 - RNA, 22 nt, Pseudomonas putida KT2440
gcauccacaccguacugcuuca

SEQ ID NO: 3597134 - RNA, 16 nt, Pseudomonas putida KT2440
gcauccagcacugccu

SEQ ID NO: 3597135 - RNA, 18 nt, Pseudomonas putida KT2440
gcauccagcacugccugg

SEQ ID NO: 3597136 - RNA, 15 nt, Pseudomonas putida KT2440
gcauccagcagggug

SEQ ID NO: 3597137 - RNA, 14 nt, Pseudomonas putida KT2440
gcauccagcgccag

SEQ ID NO: 3597138 - RNA, 15 nt, Pseudomonas putida KT2440
gcauccagcgccaga

SEQ ID NO: 3597139 - RNA, 12 nt, Pseudomonas putida KT2440
gcauccaggcgu

SEQ ID NO: 3597140 - RNA, 17 nt, Pseudomonas putida KT2440
gcaucccauucaucgau

SEQ ID NO: 3597141 - RNA, 20 nt, Pseudomonas putida KT2440
gcaucccccuccuaagggga

SEQ ID NO: 3597142 - RNA, 22 nt, Pseudomonas putida KT2440
gcauccccggccuccucgcggg

SEQ ID NO: 3597143 - RNA, 23 nt, Pseudomonas putida KT2440
gcaucccuggcacgcccggcacc

SEQ ID NO: 3597144 - RNA, 14 nt, Pseudomonas putida KT2440
gcauccgccccagg

SEQ ID NO: 3597145 - RNA, 16 nt, Pseudomonas putida KT2440
gcauccgccccaggug

SEQ ID NO: 3597146 - RNA, 18 nt, Pseudomonas putida KT2440
gcauccggcagcucaccg

SEQ ID NO: 3597147 - RNA, 20 nt, Pseudomonas putida KT2440
gcauccuccgcccugcccuc

SEQ ID NO: 3597148 - RNA, 19 nt, Pseudomonas putida KT2440
gcauccucggugcgcggua

SEQ ID NO: 3597149 - RNA, 19 nt, Pseudomonas putida KT2440
gcauccugcacugcaacac

SEQ ID NO: 3597150 - RNA, 16 nt, Pseudomonas putida KT2440
gcauccugcgugcugu

SEQ ID NO: 3597151 - RNA, 19 nt, Pseudomonas putida KT2440
gcauccugcgugcugugca

SEQ ID NO: 3597152 - RNA, 19 nt, Pseudomonas putida KT2440
gcauccuggucacucugcc

SEQ ID NO: 3597153 - RNA, 11 nt, Pseudomonas putida KT2440
gcauccuuggg

SEQ ID NO: 3597154 - RNA, 14 nt, Pseudomonas putida KT2440
gcaucgaacgccgc

SEQ ID NO: 3597155 - RNA, 16 nt, Pseudomonas putida KT2440
gcaucgaacgccgccu

SEQ ID NO: 3597156 - RNA, 22 nt, Pseudomonas putida KT2440
gcaucgaacuccugcaccgaag

SEQ ID NO: 3597157 - RNA, 17 nt, Pseudomonas putida KT2440
gcauguccugaagcagg

SEQ ID NO: 3597158 - RNA, 18 nt, Pseudomonas putida KT2440
gcauguccugaagcaggg

SEQ ID NO: 3597159 - RNA, 15 nt, Pseudomonas putida KT2440
gcauguccugcugca

SEQ ID NO: 3597160 - RNA, 15 nt, Pseudomonas putida KT2440
gcauguccuuggccc

SEQ ID NO: 3597161 - RNA, 20 nt, Pseudomonas putida KT2440
gcaugugcacuggcaggccu

SEQ ID NO: 3597162 - RNA, 12 nt, Pseudomonas putida KT2440
gcaugugccagg

SEQ ID NO: 3597163 - RNA, 22 nt, Pseudomonas putida KT2440
gcauguucaacgcaaugggcac

SEQ ID NO: 3597164 - RNA, 15 nt, Pseudomonas putida KT2440
gcauguucaccaggu

SEQ ID NO: 3597165 - RNA, 13 nt, Pseudomonas putida KT2440
gcauguucaucac

SEQ ID NO: 3597166 - RNA, 18 nt, Pseudomonas putida KT2440
gcauguucaucaccggcc

SEQ ID NO: 3597167 - RNA, 12 nt, Pseudomonas putida KT2440
gcauuacaggca

SEQ ID NO: 3597168 - RNA, 13 nt, Pseudomonas putida KT2440
gcauuacaggcag

SEQ ID NO: 3597169 - RNA, 18 nt, Pseudomonas putida KT2440
gcauuaccagcaccauca

SEQ ID NO: 3597170 - RNA, 17 nt, Pseudomonas putida KT2440
gcauuacgcggcagcag

SEQ ID NO: 3597171 - RNA, 15 nt, Pseudomonas putida KT2440
gcauucccggcgcca

SEQ ID NO: 3597172 - RNA, 16 nt, Pseudomonas putida KT2440
gcauucccggcgccau

SEQ ID NO: 3597173 - RNA, 18 nt, Pseudomonas putida KT2440
gcauucccggcgccaugc

SEQ ID NO: 3597174 - RNA, 19 nt, Pseudomonas putida KT2440
gcauucgcauuaccagcac

SEQ ID NO: 3597175 - RNA, 21 nt, Pseudomonas putida KT2440
gcauucgcauuaccagcacca

SEQ ID NO: 3597176 - RNA, 20 nt, Pseudomonas putida KT2440
gcauucgcgcccgcagugca

SEQ ID NO: 3597177 - RNA, 18 nt, Pseudomonas putida KT2440
gcauucgcgggugaaccc

SEQ ID NO: 3597178 - RNA, 22 nt, Pseudomonas putida KT2440
gcauucgcgggugaacccgcuc

SEQ ID NO: 3597179 - RNA, 22 nt, Pseudomonas putida KT2440
gcauucggugugcucggcgaug

SEQ ID NO: 3597180 - RNA, 17 nt, Pseudomonas putida KT2440
gcauucugccaugaucc

SEQ ID NO: 3597181 - RNA, 17 nt, Pseudomonas putida KT2440
gcauucuucuccaacug

SEQ ID NO: 3597182 - RNA, 18 nt, Pseudomonas putida KT2440
gcauucuucuccaacugg

SEQ ID NO: 3597183 - RNA, 16 nt, Pseudomonas putida KT2440
gcauugcaggccagcg

SEQ ID NO: 3597184 - RNA, 16 nt, Pseudomonas putida KT2440
gcauugcucacugacc

SEQ ID NO: 3597185 - RNA, 16 nt, Pseudomonas putida KT2440
gcauuggagcguugca

SEQ ID NO: 3597186 - RNA, 20 nt, Pseudomonas putida KT2440
gcauuggagcguugcaggcg

SEQ ID NO: 3597187 - RNA, 20 nt, Pseudomonas putida KT2440
gcauuggaggugcgcggcag

SEQ ID NO: 3597188 - RNA, 19 nt, Pseudomonas putida KT2440
gcauuggccaacuccaugu

SEQ ID NO: 3597189 - RNA, 16 nt, Pseudomonas putida KT2440
gcauuggcggcaggcg

SEQ ID NO: 3597190 - RNA, 18 nt, Pseudomonas putida KT2440
gcauuggugccagcgcca

SEQ ID NO: 3597191 - RNA, 13 nt, Pseudomonas putida KT2440
gcauuguccucgu

SEQ ID NO: 3597192 - RNA, 21 nt, Pseudomonas putida KT2440
gcauuuccagcgucagugaca

SEQ ID NO: 3597193 - RNA, 18 nt, Pseudomonas putida KT2440
gcauuuccauacgugcac

SEQ ID NO: 3597194 - RNA, 16 nt, Pseudomonas putida KT2440
gcauuucguccaggcu

SEQ ID NO: 3597195 - RNA, 23 nt, Pseudomonas putida KT2440
gccaaaaaaaccccagggcaucg

SEQ ID NO: 3597196 - RNA, 19 nt, Pseudomonas putida KT2440
gccaaaaccuguuccagcc

SEQ ID NO: 3597197 - RNA, 16 nt, Pseudomonas putida KT2440
gccaaaaggcccgaaa

SEQ ID NO: 3597198 - RNA, 19 nt, Pseudomonas putida KT2440
gccaaacaaaaaagccgcu

SEQ ID NO: 3597199 - RNA, 20 nt, Pseudomonas putida KT2440
gccaaacaaaaaagccgcuc

SEQ ID NO: 3597200 - RNA, 17 nt, Pseudomonas putida KT2440
gccaaacaggccgaucu

SEQ ID NO: 3597201 - RNA, 20 nt, Pseudomonas putida KT2440
gccaaaccauggcgucaggc

SEQ ID NO: 3597202 - RNA, 15 nt, Pseudomonas putida KT2440
gccaaaccccagcaa

SEQ ID NO: 3597203 - RNA, 20 nt, Pseudomonas putida KT2440
gccaaaccccagcaaggcaa

SEQ ID NO: 3597204 - RNA, 21 nt, Pseudomonas putida KT2440
gccaaaccucaaaugcgcccu

SEQ ID NO: 3597205 - RNA, 13 nt, Pseudomonas putida KT2440
gccaaacugcugg

SEQ ID NO: 3597206 - RNA, 19 nt, Pseudomonas putida KT2440
gccaaacuggaugauggua

SEQ ID NO: 3597207 - RNA, 13 nt, Pseudomonas putida KT2440
gccaaagcgagca

SEQ ID NO: 3597208 - RNA, 22 nt, Pseudomonas putida KT2440
gccaaagcugaaugaaaaagcc

SEQ ID NO: 3597209 - RNA, 20 nt, Pseudomonas putida KT2440
gccaaaguccggcgaagcac

SEQ ID NO: 3597210 - RNA, 22 nt, Pseudomonas putida KT2440
gccaaaguccugcaaaggcccu

SEQ ID NO: 3597211 - RNA, 20 nt, Pseudomonas putida KT2440
gccaacaacaagcgcuggua

SEQ ID NO: 3597212 - RNA, 21 nt, Pseudomonas putida KT2440
gccaacaccaccuccaccccg

SEQ ID NO: 3597213 - RNA, 18 nt, Pseudomonas putida KT2440
gccaacacccucacccac

SEQ ID NO: 3597214 - RNA, 13 nt, Pseudomonas putida KT2440
gccaacagaggcc

SEQ ID NO: 3597215 - RNA, 12 nt, Pseudomonas putida KT2440
gccaacagcgca

SEQ ID NO: 3597216 - RNA, 15 nt, Pseudomonas putida KT2440
gccaacaggcagcau

SEQ ID NO: 3597217 - RNA, 13 nt, Pseudomonas putida KT2440
gccaaccacccgg

SEQ ID NO: 3597218 - RNA, 15 nt, Pseudomonas putida KT2440
gccaaccacccgggc

SEQ ID NO: 3597219 - RNA, 14 nt, Pseudomonas putida KT2440
gccaaccacgccug

SEQ ID NO: 3597220 - RNA, 19 nt, Pseudomonas putida KT2440
gccaaccacgccugcgccg

SEQ ID NO: 3597221 - RNA, 15 nt, Pseudomonas putida KT2440
gccaaccagcucacc

SEQ ID NO: 3597222 - RNA, 18 nt, Pseudomonas putida KT2440
gccaaccccuccagcaca

SEQ ID NO: 3597223 - RNA, 16 nt, Pseudomonas putida KT2440
gccaaccccuccuuca

SEQ ID NO: 3597224 - RNA, 13 nt, Pseudomonas putida KT2440
gccaaccgcccca

SEQ ID NO: 3597225 - RNA, 20 nt, Pseudomonas putida KT2440
gccaaccgcuaugccaagcc

SEQ ID NO: 3597226 - RNA, 21 nt, Pseudomonas putida KT2440
gccaaccgcuucaccgcgcac

SEQ ID NO: 3597227 - RNA, 15 nt, Pseudomonas putida KT2440
gccaaccggcuugua

SEQ ID NO: 3597228 - RNA, 14 nt, Pseudomonas putida KT2440
gccaaccuugacca

SEQ ID NO: 3597229 - RNA, 19 nt, Pseudomonas putida KT2440
gccaacgccccacccgcuc

SEQ ID NO: 3597230 - RNA, 15 nt, Pseudomonas putida KT2440
gccaacggucgauca

SEQ ID NO: 3597231 - RNA, 15 nt, Pseudomonas putida KT2440
gccaacuccccaccc

SEQ ID NO: 3597232 - RNA, 20 nt, Pseudomonas putida KT2440
gccaacuccccacccaggug

SEQ ID NO: 3597233 - RNA, 19 nt, Pseudomonas putida KT2440
gccaacuccuugcgcauca

SEQ ID NO: 3597234 - RNA, 17 nt, Pseudomonas putida KT2440
gccaacugcgcccgccc

SEQ ID NO: 3597235 - RNA, 12 nt, Pseudomonas putida KT2440
gccaacugcucu

SEQ ID NO: 3597236 - RNA, 16 nt, Pseudomonas putida KT2440
gccaagauccgcggca

SEQ ID NO: 3597237 - RNA, 17 nt, Pseudomonas putida KT2440
gccaagauccgcggcau

SEQ ID NO: 3597238 - RNA, 19 nt, Pseudomonas putida KT2440
gccaagcacgcacaguggu

SEQ ID NO: 3597239 - RNA, 13 nt, Pseudomonas putida KT2440
gccaagccacugg

SEQ ID NO: 3597240 - RNA, 14 nt, Pseudomonas putida KT2440
gccaagcccacaca

SEQ ID NO: 3597241 - RNA, 18 nt, Pseudomonas putida KT2440
gccaagcccacacaccgc

SEQ ID NO: 3597242 - RNA, 22 nt, Pseudomonas putida KT2440
gccaagccgccauugcccagcc

SEQ ID NO: 3597243 - RNA, 17 nt, Pseudomonas putida KT2440
gccaagccgcugccaca

SEQ ID NO: 3597244 - RNA, 20 nt, Pseudomonas putida KT2440
gccaagccgcugccacaggu

SEQ ID NO: 3597245 - RNA, 17 nt, Pseudomonas putida KT2440
gccaagccuugaucugc

SEQ ID NO: 3597246 - RNA, 19 nt, Pseudomonas putida KT2440
gccaagcggccccaaugaa

SEQ ID NO: 3597247 - RNA, 16 nt, Pseudomonas putida KT2440
gccaagcggccccaga

SEQ ID NO: 3597248 - RNA, 17 nt, Pseudomonas putida KT2440
gccaagcggccccagau

SEQ ID NO: 3597249 - RNA, 23 nt, Pseudomonas putida KT2440
gccaagcggcucgucaaccacag

SEQ ID NO: 3597250 - RNA, 16 nt, Pseudomonas putida KT2440
gccaaggccgcccagu

SEQ ID NO: 3597251 - RNA, 22 nt, Pseudomonas putida KT2440
gccaaggccucgaacagcaguu

SEQ ID NO: 3597252 - RNA, 15 nt, Pseudomonas putida KT2440
gccaaggcgcauccu

SEQ ID NO: 3597253 - RNA, 18 nt, Pseudomonas putida KT2440
gccaaggcggcgaucgac

SEQ ID NO: 3597254 - RNA, 14 nt, Pseudomonas putida KT2440
gccaaggcuagcca

SEQ ID NO: 3597255 - RNA, 17 nt, Pseudomonas putida KT2440
gccaaggucagcaagcc

SEQ ID NO: 3597256 - RNA, 21 nt, Pseudomonas putida KT2440
gccaaggucaucgggaucagc

SEQ ID NO: 3597257 - RNA, 14 nt, Pseudomonas putida KT2440
gccaagguccagcc

SEQ ID NO: 3597258 - RNA, 20 nt, Pseudomonas putida KT2440
gccaagguccagccacgaau

SEQ ID NO: 3597259 - RNA, 19 nt, Pseudomonas putida KT2440
gccaaggucuccagcaccg

SEQ ID NO: 3597260 - RNA, 16 nt, Pseudomonas putida KT2440
gccaagguugccacca

SEQ ID NO: 3597261 - RNA, 19 nt, Pseudomonas putida KT2440
gccaagguugccaccagca

SEQ ID NO: 3597262 - RNA, 19 nt, Pseudomonas putida KT2440
gccaccgaucucgccagcc

SEQ ID NO: 3597263 - RNA, 21 nt, Pseudomonas putida KT2440
gccaccgcacucugcugcucu

SEQ ID NO: 3597264 - RNA, 12 nt, Pseudomonas putida KT2440
gccaccgccacu

SEQ ID NO: 3597265 - RNA, 21 nt, Pseudomonas putida KT2440
gccaccgccacugaccagccc

SEQ ID NO: 3597266 - RNA, 20 nt, Pseudomonas putida KT2440
gccaccgccucgcccaggcc

SEQ ID NO: 3597267 - RNA, 15 nt, Pseudomonas putida KT2440
gccaccgcgagcugu

SEQ ID NO: 3597268 - RNA, 22 nt, Pseudomonas putida KT2440
gccaccgcgagcugucgcgcca

SEQ ID NO: 3597269 - RNA, 20 nt, Pseudomonas putida KT2440
gccaccgcgauggauggcac

SEQ ID NO: 3597270 - RNA, 14 nt, Pseudomonas putida KT2440
gccaccgcgcgcca

SEQ ID NO: 3597271 - RNA, 16 nt, Pseudomonas putida KT2440
gccaccgcgcgccagu

SEQ ID NO: 3597272 - RNA, 19 nt, Pseudomonas putida KT2440
gccaccgcgcgccaguucg

SEQ ID NO: 3597273 - RNA, 22 nt, Pseudomonas putida KT2440
gccaccggacagaaucgcgguc

SEQ ID NO: 3597274 - RNA, 12 nt, Pseudomonas putida KT2440
gccaccggcagc

SEQ ID NO: 3597275 - RNA, 13 nt, Pseudomonas putida KT2440
gccaccggcagca

SEQ ID NO: 3597276 - RNA, 18 nt, Pseudomonas putida KT2440
gccaccggcagcaccugc

SEQ ID NO: 3597277 - RNA, 22 nt, Pseudomonas putida KT2440
gccaccggcagcaccugccagc

SEQ ID NO: 3597278 - RNA, 22 nt, Pseudomonas putida KT2440
gccaccggcauucccggcgcca

SEQ ID NO: 3597279 - RNA, 18 nt, Pseudomonas putida KT2440
gccaccggccacgcgcag

SEQ ID NO: 3597280 - RNA, 16 nt, Pseudomonas putida KT2440
gccaccggcgcugcgu

SEQ ID NO: 3597281 - RNA, 20 nt, Pseudomonas putida KT2440
gccaccggcgcugcguuggc

SEQ ID NO: 3597282 - RNA, 22 nt, Pseudomonas putida KT2440
gccaccguaaggaaaaucagcu

SEQ ID NO: 3597283 - RNA, 14 nt, Pseudomonas putida KT2440
gccaccgucgaaca

SEQ ID NO: 3597284 - RNA, 16 nt, Pseudomonas putida KT2440
gccaccgugagcaugg

SEQ ID NO: 3597285 - RNA, 18 nt, Pseudomonas putida KT2440
gccaccgugagcauggca

SEQ ID NO: 3597286 - RNA, 13 nt, Pseudomonas putida KT2440
gccaccguggcaa

SEQ ID NO: 3597287 - RNA, 18 nt, Pseudomonas putida KT2440
gccaccguugcgcucgag

SEQ ID NO: 3597288 - RNA, 14 nt, Pseudomonas putida KT2440
gccaccucaucuac

SEQ ID NO: 3597289 - RNA, 15 nt, Pseudomonas putida KT2440
gccaccucgcuaccc

SEQ ID NO: 3597290 - RNA, 23 nt, Pseudomonas putida KT2440
gccaccugccacacacccgggcc

SEQ ID NO: 3597291 - RNA, 16 nt, Pseudomonas putida KT2440
gccaccugcccgggcc

SEQ ID NO: 3597292 - RNA, 19 nt, Pseudomonas putida KT2440
gccaccugcccgggccgcu

SEQ ID NO: 3597293 - RNA, 21 nt, Pseudomonas putida KT2440
gccaccuggccuuccagcugc

SEQ ID NO: 3597294 - RNA, 13 nt, Pseudomonas putida KT2440
gccaccuggcugc

SEQ ID NO: 3597295 - RNA, 19 nt, Pseudomonas putida KT2440
gccaccuggcugcgggugc

SEQ ID NO: 3597296 - RNA, 22 nt, Pseudomonas putida KT2440
gccaccuggucgaaugcgugca

SEQ ID NO: 3597297 - RNA, 23 nt, Pseudomonas putida KT2440
gccaccuuacuugcacaucccag

SEQ ID NO: 3597298 - RNA, 20 nt, Pseudomonas putida KT2440
gccaccuucaccccguggcc

SEQ ID NO: 3597299 - RNA, 16 nt, Pseudomonas putida KT2440
gccaccuucagcgggu

SEQ ID NO: 3597300 - RNA, 12 nt, Pseudomonas putida KT2440
gccaccuuccag

SEQ ID NO: 3597301 - RNA, 14 nt, Pseudomonas putida KT2440
gccaccuucgccag

SEQ ID NO: 3597302 - RNA, 15 nt, Pseudomonas putida KT2440
gccaccuucgccagg

SEQ ID NO: 3597303 - RNA, 13 nt, Pseudomonas putida KT2440
gccacgaacaggc

SEQ ID NO: 3597304 - RNA, 14 nt, Pseudomonas putida KT2440
gccacgaacaggcg

SEQ ID NO: 3597305 - RNA, 15 nt, Pseudomonas putida KT2440
gccacgaacaggcgc

SEQ ID NO: 3597306 - RNA, 16 nt, Pseudomonas putida KT2440
gccacgaacaggcgcu

SEQ ID NO: 3597307 - RNA, 22 nt, Pseudomonas putida KT2440
gccacgaauuucaaggcgccga

SEQ ID NO: 3597308 - RNA, 16 nt, Pseudomonas putida KT2440
gccacgacaccgggau

SEQ ID NO: 3597309 - RNA, 13 nt, Pseudomonas putida KT2440
gccacgaccacga

SEQ ID NO: 3597310 - RNA, 22 nt, Pseudomonas putida KT2440
gccacgauagcgucagcagggc

SEQ ID NO: 3597311 - RNA, 20 nt, Pseudomonas putida KT2440
gccacgaucgacaaccccag

SEQ ID NO: 3597312 - RNA, 23 nt, Pseudomonas putida KT2440
gccacgaucgacaaccccagccc

SEQ ID NO: 3597313 - RNA, 17 nt, Pseudomonas putida KT2440
gccacgaucucuucacc

SEQ ID NO: 3597314 - RNA, 23 nt, Pseudomonas putida KT2440
gccacgaucucuucaccguacuu

SEQ ID NO: 3597315 - RNA, 13 nt, Pseudomonas putida KT2440
gccacgaugguca

SEQ ID NO: 3597316 - RNA, 15 nt, Pseudomonas putida KT2440
gccacgcaccagggc

SEQ ID NO: 3597317 - RNA, 17 nt, Pseudomonas putida KT2440
gccacgcaccagggcug

SEQ ID NO: 3597318 - RNA, 23 nt, Pseudomonas putida KT2440
gccacgcaccagggcuggcagcg

SEQ ID NO: 3597319 - RNA, 17 nt, Pseudomonas putida KT2440
gccacgcaccucggcca

SEQ ID NO: 3597320 - RNA, 21 nt, Pseudomonas putida KT2440
gccacgcccaacccagccagc

SEQ ID NO: 3597321 - RNA, 15 nt, Pseudomonas putida KT2440
gccacgcccaacccc

SEQ ID NO: 3597322 - RNA, 17 nt, Pseudomonas putida KT2440
gccacgcccaaccccag

SEQ ID NO: 3597323 - RNA, 18 nt, Pseudomonas putida KT2440
gccacgcccaaccccagc

SEQ ID NO: 3597324 - RNA, 21 nt, Pseudomonas putida KT2440
gccacgcccauggcuccaccc

SEQ ID NO: 3597325 - RNA, 13 nt, Pseudomonas putida KT2440
gccacgcccgcug

SEQ ID NO: 3597326 - RNA, 20 nt, Pseudomonas putida KT2440
gccacgcccgucaccuugcc

SEQ ID NO: 3597327 - RNA, 16 nt, Pseudomonas putida KT2440
gccacgccgccuucgg

SEQ ID NO: 3597328 - RNA, 22 nt, Pseudomonas putida KT2440
gccacgcucaaccccaucaccu

SEQ ID NO: 3597329 - RNA, 20 nt, Pseudomonas putida KT2440
gccacgcucgugcaggcugu

SEQ ID NO: 3597330 - RNA, 22 nt, Pseudomonas putida KT2440
gccacgcugaacacgcccgcgu

SEQ ID NO: 3597331 - RNA, 14 nt, Pseudomonas putida KT2440
gccacgcugccagg

SEQ ID NO: 3597332 - RNA, 16 nt, Pseudomonas putida KT2440
gccacgcugccaggac

SEQ ID NO: 3597333 - RNA, 23 nt, Pseudomonas putida KT2440
gccacgcugcggcgaaagccagc

SEQ ID NO: 3597334 - RNA, 16 nt, Pseudomonas putida KT2440
gccacgcuggcaccca

SEQ ID NO: 3597335 - RNA, 18 nt, Pseudomonas putida KT2440
gccacggaacaucgaggc

SEQ ID NO: 3597336 - RNA, 19 nt, Pseudomonas putida KT2440
gccacggcaauggcccgcu

SEQ ID NO: 3597337 - RNA, 13 nt, Pseudomonas putida KT2440
gccacggccaccu

SEQ ID NO: 3597338 - RNA, 21 nt, Pseudomonas putida KT2440
gccacggcggaaggcgucacg

SEQ ID NO: 3597339 - RNA, 13 nt, Pseudomonas putida KT2440
gccacggcggcau

SEQ ID NO: 3597340 - RNA, 17 nt, Pseudomonas putida KT2440
gccacggcggcauccag

SEQ ID NO: 3597341 - RNA, 16 nt, Pseudomonas putida KT2440
gccacggcguggagcg

SEQ ID NO: 3597342 - RNA, 16 nt, Pseudomonas putida KT2440
gccacggucuggcgca

SEQ ID NO: 3597343 - RNA, 16 nt, Pseudomonas putida KT2440
gccacgguguauccag

SEQ ID NO: 3597344 - RNA, 19 nt, Pseudomonas putida KT2440
gccacgguguauccagccc

SEQ ID NO: 3597345 - RNA, 20 nt, Pseudomonas putida KT2440
gccacgguguauccagcccg

SEQ ID NO: 3597346 - RNA, 19 nt, Pseudomonas putida KT2440
gccacguacagagauacgc

SEQ ID NO: 3597347 - RNA, 17 nt, Pseudomonas putida KT2440
gccacgucgccagcggc

SEQ ID NO: 3597348 - RNA, 19 nt, Pseudomonas putida KT2440
gccacguucugcagccuga

SEQ ID NO: 3597349 - RNA, 13 nt, Pseudomonas putida KT2440
gccacguuuucgc

SEQ ID NO: 3597350 - RNA, 18 nt, Pseudomonas putida KT2440
gccacguuuucgcggccc

SEQ ID NO: 3597351 - RNA, 21 nt, Pseudomonas putida KT2440
gccacuaagaagcaaccgcug

SEQ ID NO: 3597352 - RNA, 12 nt, Pseudomonas putida KT2440
gccacucggcaa

SEQ ID NO: 3597353 - RNA, 22 nt, Pseudomonas putida KT2440
gccacucguccgggcgccagga

SEQ ID NO: 3597354 - RNA, 20 nt, Pseudomonas putida KT2440
gccacucuucaccaugggcc

SEQ ID NO: 3597355 - RNA, 16 nt, Pseudomonas putida KT2440
gccacugguaguucau

SEQ ID NO: 3597356 - RNA, 20 nt, Pseudomonas putida KT2440
gccacugguaguucaucgcc

SEQ ID NO: 3597357 - RNA, 21 nt, Pseudomonas putida KT2440
gccacuggucgccucgacgca

SEQ ID NO: 3597358 - RNA, 15 nt, Pseudomonas putida KT2440
gccacuguugcagcg

SEQ ID NO: 3597359 - RNA, 20 nt, Pseudomonas putida KT2440
gccacuucgccguacuggcu

SEQ ID NO: 3597360 - RNA, 21 nt, Pseudomonas putida KT2440
gccacuucgcggaaggcgacc

SEQ ID NO: 3597361 - RNA, 14 nt, Pseudomonas putida KT2440
gccacuucgucgag

SEQ ID NO: 3597362 - RNA, 14 nt, Pseudomonas putida KT2440
gccacuucuuccac

SEQ ID NO: 3597363 - RNA, 20 nt, Pseudomonas putida KT2440
gccagaaaaguuggccaugu

SEQ ID NO: 3597364 - RNA, 22 nt, Pseudomonas putida KT2440
gccagaaaaguuggccaugucc

SEQ ID NO: 3597365 - RNA, 16 nt, Pseudomonas putida KT2440
gccagaaagccacugc

SEQ ID NO: 3597366 - RNA, 22 nt, Pseudomonas putida KT2440
gccagaaagccacugcaccaau

SEQ ID NO: 3597367 - RNA, 14 nt, Pseudomonas putida KT2440
gccaggcugagccc

SEQ ID NO: 3597368 - RNA, 18 nt, Pseudomonas putida KT2440
gccaggcugagcccggca

SEQ ID NO: 3597369 - RNA, 21 nt, Pseudomonas putida KT2440
gccaggcugcgcuccaacugg

SEQ ID NO: 3597370 - RNA, 13 nt, Pseudomonas putida KT2440
gccaggcuugguu

SEQ ID NO: 3597371 - RNA, 22 nt, Pseudomonas putida KT2440
gccagggcaaaaugcagcaagc

SEQ ID NO: 3597372 - RNA, 15 nt, Pseudomonas putida KT2440
gccagggcaacggca

SEQ ID NO: 3597373 - RNA, 13 nt, Pseudomonas putida KT2440
gccagggcaagca

SEQ ID NO: 3597374 - RNA, 15 nt, Pseudomonas putida KT2440
gccagggcccgccgc

SEQ ID NO: 3597375 - RNA, 17 nt, Pseudomonas putida KT2440
gccagggcccgccgcgc

SEQ ID NO: 3597376 - RNA, 18 nt, Pseudomonas putida KT2440
gccagggcccgccgcgcg

SEQ ID NO: 3597377 - RNA, 21 nt, Pseudomonas putida KT2440
gccagggcccgccgcgcggcu

SEQ ID NO: 3597378 - RNA, 13 nt, Pseudomonas putida KT2440
gccagggccgggg

SEQ ID NO: 3597379 - RNA, 14 nt, Pseudomonas putida KT2440
gccagggccugacc

SEQ ID NO: 3597380 - RNA, 22 nt, Pseudomonas putida KT2440
gccaggguacgauagggcggug

SEQ ID NO: 3597381 - RNA, 12 nt, Pseudomonas putida KT2440
gccagggugcca

SEQ ID NO: 3597382 - RNA, 15 nt, Pseudomonas putida KT2440
gccagggugccagac

SEQ ID NO: 3597383 - RNA, 23 nt, Pseudomonas putida KT2440
gccagggugcgggcgucuuccag

SEQ ID NO: 3597384 - RNA, 15 nt, Pseudomonas putida KT2440
gccaggguuaccugc

SEQ ID NO: 3597385 - RNA, 19 nt, Pseudomonas putida KT2440
gccaggguuugcaagcggc

SEQ ID NO: 3597386 - RNA, 15 nt, Pseudomonas putida KT2440
gccagguacaggcaa

SEQ ID NO: 3597387 - RNA, 17 nt, Pseudomonas putida KT2440
gccagguacaggcaaag

SEQ ID NO: 3597388 - RNA, 14 nt, Pseudomonas putida KT2440
gccaggucaccgcc

SEQ ID NO: 3597389 - RNA, 20 nt, Pseudomonas putida KT2440
gccaggucaccgcccagcuu

SEQ ID NO: 3597390 - RNA, 19 nt, Pseudomonas putida KT2440
gccagguccaggcugcgcg

SEQ ID NO: 3597391 - RNA, 21 nt, Pseudomonas putida KT2440
gccagguccaggcugcgcgcc

SEQ ID NO: 3597392 - RNA, 19 nt, Pseudomonas putida KT2440
gccagguccgagugcucga

SEQ ID NO: 3597393 - RNA, 21 nt, Pseudomonas putida KT2440
gccagguccgguaacuggccc

SEQ ID NO: 3597394 - RNA, 20 nt, Pseudomonas putida KT2440
gccaggucggacagggucag

SEQ ID NO: 3597395 - RNA, 18 nt, Pseudomonas putida KT2440
gccaggugauaguccagc

SEQ ID NO: 3597396 - RNA, 21 nt, Pseudomonas putida KT2440
gccaggugauuuccucuucac

SEQ ID NO: 3597397 - RNA, 15 nt, Pseudomonas putida KT2440
gccaggugccgggcu

SEQ ID NO: 3597398 - RNA, 18 nt, Pseudomonas putida KT2440
gccaggugccgucgggca

SEQ ID NO: 3597399 - RNA, 20 nt, Pseudomonas putida KT2440
gccaggugccgucgggcacg

SEQ ID NO: 3597400 - RNA, 19 nt, Pseudomonas putida KT2440
gccagguuggcccugaacu

SEQ ID NO: 3597401 - RNA, 19 nt, Pseudomonas putida KT2440
gccagguuguucaguggcg

SEQ ID NO: 3597402 - RNA, 21 nt, Pseudomonas putida KT2440
gccagguuuuugaugucgccg

SEQ ID NO: 3597403 - RNA, 14 nt, Pseudomonas putida KT2440
gccaguaaggcuug

SEQ ID NO: 3597404 - RNA, 14 nt, Pseudomonas putida KT2440
gccaguaccagcag

SEQ ID NO: 3597405 - RNA, 17 nt, Pseudomonas putida KT2440
gccaguaccagcagcac

SEQ ID NO: 3597406 - RNA, 20 nt, Pseudomonas putida KT2440
gccaguaccuuggcguaggc

SEQ ID NO: 3597407 - RNA, 17 nt, Pseudomonas putida KT2440
gccaguacgccagcagc

SEQ ID NO: 3597408 - RNA, 20 nt, Pseudomonas putida KT2440
gccaguacgcgccugcaccu

SEQ ID NO: 3597409 - RNA, 22 nt, Pseudomonas putida KT2440
gccaguacggccaucagcaagc

SEQ ID NO: 3597410 - RNA, 16 nt, Pseudomonas putida KT2440
gccaguagcaaucagg

SEQ ID NO: 3597411 - RNA, 23 nt, Pseudomonas putida KT2440
gccaguagcacagugcggcggca

SEQ ID NO: 3597412 - RNA, 14 nt, Pseudomonas putida KT2440
gccaguaggcugca

SEQ ID NO: 3597413 - RNA, 15 nt, Pseudomonas putida KT2440
gccaguaggcugcag

SEQ ID NO: 3597414 - RNA, 20 nt, Pseudomonas putida KT2440
gccagucccuccugugcccg

SEQ ID NO: 3597415 - RNA, 22 nt, Pseudomonas putida KT2440
gccaguccuuggccaaugccag

SEQ ID NO: 3597416 - RNA, 15 nt, Pseudomonas putida KT2440
gccagucgcacaggu

SEQ ID NO: 3597417 - RNA, 23 nt, Pseudomonas putida KT2440
gccagucgcacagguccagccgc

SEQ ID NO: 3597418 - RNA, 13 nt, Pseudomonas putida KT2440
gccagucgcgcaa

SEQ ID NO: 3597419 - RNA, 18 nt, Pseudomonas putida KT2440
gccagucgcgcaacugcc

SEQ ID NO: 3597420 - RNA, 21 nt, Pseudomonas putida KT2440
gccagucgcgcaacugcccag

SEQ ID NO: 3597421 - RNA, 14 nt, Pseudomonas putida KT2440
gccagugaccgcug

SEQ ID NO: 3597422 - RNA, 17 nt, Pseudomonas putida KT2440
gccagugaccgcuggcg

SEQ ID NO: 3597423 - RNA, 19 nt, Pseudomonas putida KT2440
gccagugaccgcuggcgcc

SEQ ID NO: 3597424 - RNA, 15 nt, Pseudomonas putida KT2440
gccagugccgcaagc

SEQ ID NO: 3597425 - RNA, 16 nt, Pseudomonas putida KT2440
gccagugccgcaagca

SEQ ID NO: 3597426 - RNA, 19 nt, Pseudomonas putida KT2440
gccagugcgcccgaggcaa

SEQ ID NO: 3597427 - RNA, 16 nt, Pseudomonas putida KT2440
gccagugcggugaccg

SEQ ID NO: 3597428 - RNA, 21 nt, Pseudomonas putida KT2440
gccaguggcacccacagcgcc

SEQ ID NO: 3597429 - RNA, 14 nt, Pseudomonas putida KT2440
gccaguggccuugg

SEQ ID NO: 3597430 - RNA, 19 nt, Pseudomonas putida KT2440
gccagugggcacgguuggc

SEQ ID NO: 3597431 - RNA, 19 nt, Pseudomonas putida KT2440
gccaguuacccuguacccg

SEQ ID NO: 3597432 - RNA, 22 nt, Pseudomonas putida KT2440
gccaguuacccuguacccgcug

SEQ ID NO: 3597433 - RNA, 20 nt, Pseudomonas putida KT2440
gccaguucacggaucgccag

SEQ ID NO: 3597434 - RNA, 16 nt, Pseudomonas putida KT2440
gccaguucgacgcugc

SEQ ID NO: 3597435 - RNA, 22 nt, Pseudomonas putida KT2440
gccaguucgcggcgcaccgcuu

SEQ ID NO: 3597436 - RNA, 19 nt, Pseudomonas putida KT2440
gccaguugccccaggccca

SEQ ID NO: 3597437 - RNA, 22 nt, Pseudomonas putida KT2440
gccaguuggcguauuuuggcag

SEQ ID NO: 3597438 - RNA, 17 nt, Pseudomonas putida KT2440
gccaguuguccgggugu

SEQ ID NO: 3597439 - RNA, 23 nt, Pseudomonas putida KT2440
gccaguuucaccugaccaucagc

SEQ ID NO: 3597440 - RNA, 20 nt, Pseudomonas putida KT2440
gccaguuuccgucuuucagg

SEQ ID NO: 3597441 - RNA, 13 nt, Pseudomonas putida KT2440
gccaguuugcacu

SEQ ID NO: 3597442 - RNA, 17 nt, Pseudomonas putida KT2440
gccaguuugugcucgag

SEQ ID NO: 3597443 - RNA, 18 nt, Pseudomonas putida KT2440
gccauaacuccagcgcca

SEQ ID NO: 3597444 - RNA, 19 nt, Pseudomonas putida KT2440
gccauaacuccagcgccag

SEQ ID NO: 3597445 - RNA, 16 nt, Pseudomonas putida KT2440
gccauaccgcauccca

SEQ ID NO: 3597446 - RNA, 13 nt, Pseudomonas putida KT2440
gccauagcaccag

SEQ ID NO: 3597447 - RNA, 19 nt, Pseudomonas putida KT2440
gccauagcaccagcgggcc

SEQ ID NO: 3597448 - RNA, 14 nt, Pseudomonas putida KT2440
gccauagcgcugca

SEQ ID NO: 3597449 - RNA, 18 nt, Pseudomonas putida KT2440
gccauagcgcugcaccga

SEQ ID NO: 3597450 - RNA, 17 nt, Pseudomonas putida KT2440
gccauaguuuugugcca

SEQ ID NO: 3597451 - RNA, 20 nt, Pseudomonas putida KT2440
gccauaguuuugugccaccu

SEQ ID NO: 3597452 - RNA, 22 nt, Pseudomonas putida KT2440
gccauaucaggauugccgcagc

SEQ ID NO: 3597453 - RNA, 21 nt, Pseudomonas putida KT2440
gccauaugaaaaggcccugca

SEQ ID NO: 3597454 - RNA, 16 nt, Pseudomonas putida KT2440
gccauauucagcuuca

SEQ ID NO: 3597455 - RNA, 17 nt, Pseudomonas putida KT2440
gccauauucagcuucaa

SEQ ID NO: 3597456 - RNA, 19 nt, Pseudomonas putida KT2440
gccauauucgcggcggccg

SEQ ID NO: 3597457 - RNA, 19 nt, Pseudomonas putida KT2440
gccaucaauaccggcaugc

SEQ ID NO: 3597458 - RNA, 21 nt, Pseudomonas putida KT2440
gccaucaauaccggcaugccc

SEQ ID NO: 3597459 - RNA, 15 nt, Pseudomonas putida KT2440
gccaucaccgcccgc

SEQ ID NO: 3597460 - RNA, 16 nt, Pseudomonas putida KT2440
gccaucagaggcgaug

SEQ ID NO: 3597461 - RNA, 19 nt, Pseudomonas putida KT2440
gccaucagaggcgauggca

SEQ ID NO: 3597462 - RNA, 18 nt, Pseudomonas putida KT2440
gccaucagcaagccgccg

SEQ ID NO: 3597463 - RNA, 19 nt, Pseudomonas putida KT2440
gccaucagcaagccgccga

SEQ ID NO: 3597464 - RNA, 14 nt, Pseudomonas putida KT2440
gccaucaggcagcu

SEQ ID NO: 3597465 - RNA, 16 nt, Pseudomonas putida KT2440
gccaucagggcgaugc

SEQ ID NO: 3597466 - RNA, 19 nt, Pseudomonas putida KT2440
gccaucagggcgaugcgca

SEQ ID NO: 3597467 - RNA, 17 nt, Pseudomonas putida KT2440
gccaucagugcccccgc

SEQ ID NO: 3597468 - RNA, 14 nt, Pseudomonas putida KT2440
gccaucaucugcug

SEQ ID NO: 3597469 - RNA, 23 nt, Pseudomonas putida KT2440
gccauccaccugugaggccuuca

SEQ ID NO: 3597470 - RNA, 15 nt, Pseudomonas putida KT2440
gccauccccccagcc

SEQ ID NO: 3597471 - RNA, 19 nt, Pseudomonas putida KT2440
gccauccccccagcccuug

SEQ ID NO: 3597472 - RNA, 23 nt, Pseudomonas putida KT2440
gcccaccgcauugcaggccagcg

SEQ ID NO: 3597473 - RNA, 17 nt, Pseudomonas putida KT2440
gcccaccgucaggcuca

SEQ ID NO: 3597474 - RNA, 19 nt, Pseudomonas putida KT2440
gcccaccgucaggcucagc

SEQ ID NO: 3597475 - RNA, 22 nt, Pseudomonas putida KT2440
gcccaccgucaggcucagcagg

SEQ ID NO: 3597476 - RNA, 17 nt, Pseudomonas putida KT2440
gcccaccuuggcgguga

SEQ ID NO: 3597477 - RNA, 19 nt, Pseudomonas putida KT2440
gcccacgaucucacgcgcc

SEQ ID NO: 3597478 - RNA, 23 nt, Pseudomonas putida KT2440
gcccacgaucucacgcgccacau

SEQ ID NO: 3597479 - RNA, 16 nt, Pseudomonas putida KT2440
gcccacgccgcuggua

SEQ ID NO: 3597480 - RNA, 14 nt, Pseudomonas putida KT2440
gcccacgccuucca

SEQ ID NO: 3597481 - RNA, 17 nt, Pseudomonas putida KT2440
gcccacgcggguccagc

SEQ ID NO: 3597482 - RNA, 19 nt, Pseudomonas putida KT2440
gcccacgcggguccagcgc

SEQ ID NO: 3597483 - RNA, 21 nt, Pseudomonas putida KT2440
gcccacgcucuguaucgaaca

SEQ ID NO: 3597484 - RNA, 16 nt, Pseudomonas putida KT2440
gcccacggcgaugguc

SEQ ID NO: 3597485 - RNA, 19 nt, Pseudomonas putida KT2440
gcccacggcguccaggccc

SEQ ID NO: 3597486 - RNA, 15 nt, Pseudomonas putida KT2440
gcccacucaauacuc

SEQ ID NO: 3597487 - RNA, 22 nt, Pseudomonas putida KT2440
gcccacucacgcaacucuaccu

SEQ ID NO: 3597488 - RNA, 14 nt, Pseudomonas putida KT2440
gcccacugcagcca

SEQ ID NO: 3597489 - RNA, 19 nt, Pseudomonas putida KT2440
gcccacuguaggagauucu

SEQ ID NO: 3597490 - RNA, 19 nt, Pseudomonas putida KT2440
gcccacuucugcggccagg

SEQ ID NO: 3597491 - RNA, 17 nt, Pseudomonas putida KT2440
gcccagaaucucaacca

SEQ ID NO: 3597492 - RNA, 22 nt, Pseudomonas putida KT2440
gcccagauagccauugcggcug

SEQ ID NO: 3597493 - RNA, 12 nt, Pseudomonas putida KT2440
gcccagaucacu

SEQ ID NO: 3597494 - RNA, 15 nt, Pseudomonas putida KT2440
gcccagaucacuucc

SEQ ID NO: 3597495 - RNA, 17 nt, Pseudomonas putida KT2440
gcccagaucacuuccac

SEQ ID NO: 3597496 - RNA, 15 nt, Pseudomonas putida KT2440
gcccagaucagcagc

SEQ ID NO: 3597497 - RNA, 16 nt, Pseudomonas putida KT2440
gcccagaucagcagca

SEQ ID NO: 3597498 - RNA, 19 nt, Pseudomonas putida KT2440
gcccagaucagcagcaccg

SEQ ID NO: 3597499 - RNA, 18 nt, Pseudomonas putida KT2440
gcccagcaacagccccau

SEQ ID NO: 3597500 - RNA, 23 nt, Pseudomonas putida KT2440
gcccagcaacagccccaucacca

SEQ ID NO: 3597501 - RNA, 14 nt, Pseudomonas putida KT2440
gcccagcaacugcg

SEQ ID NO: 3597502 - RNA, 16 nt, Pseudomonas putida KT2440
gcccagcagcaacgca

SEQ ID NO: 3597503 - RNA, 13 nt, Pseudomonas putida KT2440
gcccagcagccaa

SEQ ID NO: 3597504 - RNA, 16 nt, Pseudomonas putida KT2440
gcccagcagccaacgc

SEQ ID NO: 3597505 - RNA, 19 nt, Pseudomonas putida KT2440
gcccagcagccaacgcccc

SEQ ID NO: 3597506 - RNA, 13 nt, Pseudomonas putida KT2440
gcccagcagcccc

SEQ ID NO: 3597507 - RNA, 14 nt, Pseudomonas putida KT2440
gcccagcagguaca

SEQ ID NO: 3597508 - RNA, 19 nt, Pseudomonas putida KT2440
gcccagcagguacaccgcc

SEQ ID NO: 3597509 - RNA, 22 nt, Pseudomonas putida KT2440
gcccagcagguagacgaugccg

SEQ ID NO: 3597510 - RNA, 18 nt, Pseudomonas putida KT2440
gcccagcaggugcccaag

SEQ ID NO: 3597511 - RNA, 19 nt, Pseudomonas putida KT2440
gcccagcaugcgcuugagc

SEQ ID NO: 3597512 - RNA, 22 nt, Pseudomonas putida KT2440
gcccagccaacccucgaccucg

SEQ ID NO: 3597513 - RNA, 15 nt, Pseudomonas putida KT2440
gcccagccaccgacg

SEQ ID NO: 3597514 - RNA, 23 nt, Pseudomonas putida KT2440
gcccagccaccgacgaacagggc

SEQ ID NO: 3597515 - RNA, 12 nt, Pseudomonas putida KT2440
gcccagccagcg

SEQ ID NO: 3597516 - RNA, 13 nt, Pseudomonas putida KT2440
gcccagccagcgu

SEQ ID NO: 3597517 - RNA, 15 nt, Pseudomonas putida KT2440
gcccagcccagcccg

SEQ ID NO: 3597518 - RNA, 22 nt, Pseudomonas putida KT2440
gcccagccccgagcaaagcccg

SEQ ID NO: 3597519 - RNA, 18 nt, Pseudomonas putida KT2440
gcccagcccggacugcac

SEQ ID NO: 3597520 - RNA, 21 nt, Pseudomonas putida KT2440
gcccagcccggacugcaccag

SEQ ID NO: 3597521 - RNA, 17 nt, Pseudomonas putida KT2440
gcccagcgccaccggca

SEQ ID NO: 3597522 - RNA, 20 nt, Pseudomonas putida KT2440
gcccagcgccaccggcagca

SEQ ID NO: 3597523 - RNA, 13 nt, Pseudomonas putida KT2440
gcccagcgccgcc

SEQ ID NO: 3597524 - RNA, 14 nt, Pseudomonas putida KT2440
gcccagcgccgccg

SEQ ID NO: 3597525 - RNA, 16 nt, Pseudomonas putida KT2440
gcccagcgccgccggc

SEQ ID NO: 3597526 - RNA, 18 nt, Pseudomonas putida KT2440
gcccagcgccgccggcug

SEQ ID NO: 3597527 - RNA, 21 nt, Pseudomonas putida KT2440
gcccagcgcucguaggcuuca

SEQ ID NO: 3597528 - RNA, 20 nt, Pseudomonas putida KT2440
gcccagcgucgucugcguga

SEQ ID NO: 3597529 - RNA, 18 nt, Pseudomonas putida KT2440
gcccagcuacgcgagcca

SEQ ID NO: 3597530 - RNA, 20 nt, Pseudomonas putida KT2440
gcccagcuacgcgagccacc

SEQ ID NO: 3597531 - RNA, 16 nt, Pseudomonas putida KT2440
gcccagcucgcuggcc

SEQ ID NO: 3597532 - RNA, 17 nt, Pseudomonas putida KT2440
gcccagcucgcuggcca

SEQ ID NO: 3597533 - RNA, 18 nt, Pseudomonas putida KT2440
gcccagcucgcuggccac

SEQ ID NO: 3597534 - RNA, 22 nt, Pseudomonas putida KT2440
gcccagcucgcuggccaccagc

SEQ ID NO: 3597535 - RNA, 22 nt, Pseudomonas putida KT2440
gcccagcugaagugccaaggcu

SEQ ID NO: 3597536 - RNA, 19 nt, Pseudomonas putida KT2440
gcccagcuggagacgaaca

SEQ ID NO: 3597537 - RNA, 12 nt, Pseudomonas putida KT2440
gcccagcuggcu

SEQ ID NO: 3597538 - RNA, 14 nt, Pseudomonas putida KT2440
gcccagcuggcuca

SEQ ID NO: 3597539 - RNA, 17 nt, Pseudomonas putida KT2440
gcccagcuucuccagca

SEQ ID NO: 3597540 - RNA, 20 nt, Pseudomonas putida KT2440
gcccagcuucuccagcaagc

SEQ ID NO: 3597541 - RNA, 13 nt, Pseudomonas putida KT2440
gcccaggaucacu

SEQ ID NO: 3597542 - RNA, 18 nt, Pseudomonas putida KT2440
gcccaggaucacuggccu

SEQ ID NO: 3597543 - RNA, 23 nt, Pseudomonas putida KT2440
gcccaggcccaacgggcgcgacu

SEQ ID NO: 3597544 - RNA, 14 nt, Pseudomonas putida KT2440
gcccaggccgccga

SEQ ID NO: 3597545 - RNA, 16 nt, Pseudomonas putida KT2440
gcccaggcgccgcagc

SEQ ID NO: 3597546 - RNA, 17 nt, Pseudomonas putida KT2440
gcccaggcgccgcagca

SEQ ID NO: 3597547 - RNA, 21 nt, Pseudomonas putida KT2440
gcccaggcgcuugggugccga

SEQ ID NO: 3597548 - RNA, 13 nt, Pseudomonas putida KT2440
gcccagggcugcu

SEQ ID NO: 3597549 - RNA, 21 nt, Pseudomonas putida KT2440
gcccagggcugcuucacgggu

SEQ ID NO: 3597550 - RNA, 22 nt, Pseudomonas putida KT2440
gcccagguaacugccgaccuug

SEQ ID NO: 3597551 - RNA, 18 nt, Pseudomonas putida KT2440
gcccaggugccaggcuca

SEQ ID NO: 3597552 - RNA, 21 nt, Pseudomonas putida KT2440
gcccagguguuguugcaacca

SEQ ID NO: 3597553 - RNA, 19 nt, Pseudomonas putida KT2440
gcccagguuauacgccgcc

SEQ ID NO: 3597554 - RNA, 20 nt, Pseudomonas putida KT2440
gcccagguuauacgccgccg

SEQ ID NO: 3597555 - RNA, 21 nt, Pseudomonas putida KT2440
gcccagguuauacgccgccga

SEQ ID NO: 3597556 - RNA, 15 nt, Pseudomonas putida KT2440
gcccagguugccuca

SEQ ID NO: 3597557 - RNA, 21 nt, Pseudomonas putida KT2440
gcccagguugccucaucaccu

SEQ ID NO: 3597558 - RNA, 14 nt, Pseudomonas putida KT2440
gcccaguacgccac

SEQ ID NO: 3597559 - RNA, 15 nt, Pseudomonas putida KT2440
gcccaguacgccacc

SEQ ID NO: 3597560 - RNA, 18 nt, Pseudomonas putida KT2440
gcccaguacgccacccag

SEQ ID NO: 3597561 - RNA, 20 nt, Pseudomonas putida KT2440
gcccaguacgccacccagau

SEQ ID NO: 3597562 - RNA, 22 nt, Pseudomonas putida KT2440
gcccaguacuucgcgugaacug

SEQ ID NO: 3597563 - RNA, 17 nt, Pseudomonas putida KT2440
gcccaguagcgccacca

SEQ ID NO: 3597564 - RNA, 19 nt, Pseudomonas putida KT2440
gcccaguagcgccaccauc

SEQ ID NO: 3597565 - RNA, 23 nt, Pseudomonas putida KT2440
gcccagugcgcgcaacagugccc

SEQ ID NO: 3597566 - RNA, 22 nt, Pseudomonas putida KT2440
gcccaguggcacaccaugggca

SEQ ID NO: 3597567 - RNA, 17 nt, Pseudomonas putida KT2440
gcccaguucagcucgcu

SEQ ID NO: 3597568 - RNA, 14 nt, Pseudomonas putida KT2440
gcccaguucggaca

SEQ ID NO: 3597569 - RNA, 20 nt, Pseudomonas putida KT2440
gcccaguucggacaggcgcu

SEQ ID NO: 3597570 - RNA, 16 nt, Pseudomonas putida KT2440
gcccaguucguccacc

SEQ ID NO: 3597571 - RNA, 16 nt, Pseudomonas putida KT2440
gcccaguucuccggca

SEQ ID NO: 3597572 - RNA, 18 nt, Pseudomonas putida KT2440
gcccaguucuccggcagg

SEQ ID NO: 3597573 - RNA, 21 nt, Pseudomonas putida KT2440
gcccaguucuuggcggcuggg

SEQ ID NO: 3597574 - RNA, 16 nt, Pseudomonas putida KT2440
gcccauaccgccguau

SEQ ID NO: 3597575 - RNA, 17 nt, Pseudomonas putida KT2440
gcccaucaccggcaccg

SEQ ID NO: 3597576 - RNA, 17 nt, Pseudomonas putida KT2440
gcccaucagcgccgcca

SEQ ID NO: 3597577 - RNA, 19 nt, Pseudomonas putida KT2440
gcccaucaggaacagcucg

SEQ ID NO: 3597578 - RNA, 20 nt, Pseudomonas putida KT2440
gcccaucaggaacagcucga

SEQ ID NO: 3597579 - RNA, 22 nt, Pseudomonas putida KT2440
gcccauccagaaauccauccag

SEQ ID NO: 3597580 - RNA, 16 nt, Pseudomonas putida KT2440
gcccaucccgcuucgc

SEQ ID NO: 3597581 - RNA, 15 nt, Pseudomonas putida KT2440
gcccaucucaggccc

SEQ ID NO: 3597582 - RNA, 16 nt, Pseudomonas putida KT2440
gcccaucucaggccca

SEQ ID NO: 3597583 - RNA, 17 nt, Pseudomonas putida KT2440
gcccaucucaggcccac

SEQ ID NO: 3597584 - RNA, 15 nt, Pseudomonas putida KT2440
gcccaugaagcggcc

SEQ ID NO: 3597585 - RNA, 18 nt, Pseudomonas putida KT2440
gcccaugaagcggccggc

SEQ ID NO: 3597586 - RNA, 14 nt, Pseudomonas putida KT2440
gcccaugccaagcc

SEQ ID NO: 3597587 - RNA, 20 nt, Pseudomonas putida KT2440
gcccaugccacccaugccac

SEQ ID NO: 3597588 - RNA, 23 nt, Pseudomonas putida KT2440
gcccaugcccagcucgcuggcca

SEQ ID NO: 3597589 - RNA, 14 nt, Pseudomonas putida KT2440
gcccauggccagcg

SEQ ID NO: 3597590 - RNA, 17 nt, Pseudomonas putida KT2440
gcccauggcccugaucu

SEQ ID NO: 3597591 - RNA, 14 nt, Pseudomonas putida KT2440
gcccauggcgcagc

SEQ ID NO: 3597592 - RNA, 22 nt, Pseudomonas putida KT2440
gcccauggcgcagcuccacugg

SEQ ID NO: 3597593 - RNA, 17 nt, Pseudomonas putida KT2440
gcccauggcuccaccca

SEQ ID NO: 3597594 - RNA, 19 nt, Pseudomonas putida KT2440
gcccauggcuggcagcacg

SEQ ID NO: 3597595 - RNA, 17 nt, Pseudomonas putida KT2440
gcccauggggauuggaa

SEQ ID NO: 3597596 - RNA, 14 nt, Pseudomonas putida KT2440
gcccaugucgauca

SEQ ID NO: 3597597 - RNA, 15 nt, Pseudomonas putida KT2440
gcccauguggcgcag

SEQ ID NO: 3597598 - RNA, 21 nt, Pseudomonas putida KT2440
gcccauuccgggucgccagug

SEQ ID NO: 3597599 - RNA, 14 nt, Pseudomonas putida KT2440
gcccauucgcgggc

SEQ ID NO: 3597600 - RNA, 17 nt, Pseudomonas putida KT2440
gcccauucgcgggcaag

SEQ ID NO: 3597601 - RNA, 20 nt, Pseudomonas putida KT2440
gcccauucgcgggcaagccc

SEQ ID NO: 3597602 - RNA, 11 nt, Pseudomonas putida KT2440
gcccauugccg

SEQ ID NO: 3597603 - RNA, 22 nt, Pseudomonas putida KT2440
gcccauuuccgggcaaugcagg

SEQ ID NO: 3597604 - RNA, 22 nt, Pseudomonas putida KT2440
gcccauuucugcauguccagcc

SEQ ID NO: 3597605 - RNA, 23 nt, Pseudomonas putida KT2440
gcccauuucugcauguccagccc

SEQ ID NO: 3597606 - RNA, 18 nt, Pseudomonas putida KT2440
gccccaaaaaaccggggu

SEQ ID NO: 3597607 - RNA, 15 nt, Pseudomonas putida KT2440
gccccaaaccaggcc

SEQ ID NO: 3597608 - RNA, 11 nt, Pseudomonas putida KT2440
gccccaaagga

SEQ ID NO: 3597609 - RNA, 15 nt, Pseudomonas putida KT2440
gccccaacugcaucc

SEQ ID NO: 3597610 - RNA, 13 nt, Pseudomonas putida KT2440
gccccaagcgccu

SEQ ID NO: 3597611 - RNA, 14 nt, Pseudomonas putida KT2440
gccccaagcgccug

SEQ ID NO: 3597612 - RNA, 18 nt, Pseudomonas putida KT2440
gccccaagcgggccaagg

SEQ ID NO: 3597613 - RNA, 22 nt, Pseudomonas putida KT2440
gccccaagcgggccaaggucau

SEQ ID NO: 3597614 - RNA, 14 nt, Pseudomonas putida KT2440
gccccaauggcgaa

SEQ ID NO: 3597615 - RNA, 20 nt, Pseudomonas putida KT2440
gccccaauggcgaaccccag

SEQ ID NO: 3597616 - RNA, 14 nt, Pseudomonas putida KT2440
gccccaccacaucc

SEQ ID NO: 3597617 - RNA, 14 nt, Pseudomonas putida KT2440
gccccaccaggaag

SEQ ID NO: 3597618 - RNA, 11 nt, Pseudomonas putida KT2440
gccccaccucg

SEQ ID NO: 3597619 - RNA, 17 nt, Pseudomonas putida KT2440
gccccacucgcgcagca

SEQ ID NO: 3597620 - RNA, 20 nt, Pseudomonas putida KT2440
gccccacucgcgcagcacau

SEQ ID NO: 3597621 - RNA, 18 nt, Pseudomonas putida KT2440
gccccagauuucucagcu

SEQ ID NO: 3597622 - RNA, 17 nt, Pseudomonas putida KT2440
gccccagcagcgcuucg

SEQ ID NO: 3597623 - RNA, 14 nt, Pseudomonas putida KT2440
gccccagcccgccc

SEQ ID NO: 3597624 - RNA, 14 nt, Pseudomonas putida KT2440
gccccagccucagc

SEQ ID NO: 3597625 - RNA, 15 nt, Pseudomonas putida KT2440
gccccagccucagcu

SEQ ID NO: 3597626 - RNA, 21 nt, Pseudomonas putida KT2440
gccccagcgccuuggccugcu

SEQ ID NO: 3597627 - RNA, 14 nt, Pseudomonas putida KT2440
gccccagcgcgcca

SEQ ID NO: 3597628 - RNA, 19 nt, Pseudomonas putida KT2440
gccccagcgcgccagcagg

SEQ ID NO: 3597629 - RNA, 15 nt, Pseudomonas putida KT2440
gccccagcggcagca

SEQ ID NO: 3597630 - RNA, 17 nt, Pseudomonas putida KT2440
gccccagcggcagcagc

SEQ ID NO: 3597631 - RNA, 21 nt, Pseudomonas putida KT2440
gccccagcgucacccguggca

SEQ ID NO: 3597632 - RNA, 16 nt, Pseudomonas putida KT2440
gccccaggccgcggcc

SEQ ID NO: 3597633 - RNA, 17 nt, Pseudomonas putida KT2440
gccccaggccgcggccg

SEQ ID NO: 3597634 - RNA, 21 nt, Pseudomonas putida KT2440
gccccagggaucgaugcccug

SEQ ID NO: 3597635 - RNA, 18 nt, Pseudomonas putida KT2440
gccccagggcccucaacc

SEQ ID NO: 3597636 - RNA, 15 nt, Pseudomonas putida KT2440
gccccagggggcagc

SEQ ID NO: 3597637 - RNA, 19 nt, Pseudomonas putida KT2440
gccccagucauccgggccg

SEQ ID NO: 3597638 - RNA, 20 nt, Pseudomonas putida KT2440
gccccagucauccgggccgu

SEQ ID NO: 3597639 - RNA, 21 nt, Pseudomonas putida KT2440
gccccagucauccgggccguc

SEQ ID NO: 3597640 - RNA, 23 nt, Pseudomonas putida KT2440
gccccagucuucguacaugcgcg

SEQ ID NO: 3597641 - RNA, 23 nt, Pseudomonas putida KT2440
gccccagugugcaaacacccagc

SEQ ID NO: 3597642 - RNA, 21 nt, Pseudomonas putida KT2440
gccccauagccugcugcuccc

SEQ ID NO: 3597643 - RNA, 13 nt, Pseudomonas putida KT2440
gccccaucaccag

SEQ ID NO: 3597644 - RNA, 15 nt, Pseudomonas putida KT2440
gccccaucacccccg

SEQ ID NO: 3597645 - RNA, 23 nt, Pseudomonas putida KT2440
gccccaugcgaacugcagagccu

SEQ ID NO: 3597646 - RNA, 17 nt, Pseudomonas putida KT2440
gccccaugcgaccagua

SEQ ID NO: 3597647 - RNA, 22 nt, Pseudomonas putida KT2440
gcccccaaaccgcugcccagcg

SEQ ID NO: 3597648 - RNA, 16 nt, Pseudomonas putida KT2440
gcccccaacccucacu

SEQ ID NO: 3597649 - RNA, 22 nt, Pseudomonas putida KT2440
gcccccaacccucacucgcggc

SEQ ID NO: 3597650 - RNA, 20 nt, Pseudomonas putida KT2440
gcccccacgccgaccgcgcg

SEQ ID NO: 3597651 - RNA, 13 nt, Pseudomonas putida KT2440
gcccccagcacag

SEQ ID NO: 3597652 - RNA, 12 nt, Pseudomonas putida KT2440
gcccccagcccg

SEQ ID NO: 3597653 - RNA, 22 nt, Pseudomonas putida KT2440
gcccccagcccggcgccgagcc

SEQ ID NO: 3597654 - RNA, 13 nt, Pseudomonas putida KT2440
gcccccagccggu

SEQ ID NO: 3597655 - RNA, 22 nt, Pseudomonas putida KT2440
gcccccagccggucauccagca

SEQ ID NO: 3597656 - RNA, 13 nt, Pseudomonas putida KT2440
gcccccaucgcag

SEQ ID NO: 3597657 - RNA, 14 nt, Pseudomonas putida KT2440
gcccccaugaugac

SEQ ID NO: 3597658 - RNA, 15 nt, Pseudomonas putida KT2440
gccccccagccagca

SEQ ID NO: 3597659 - RNA, 13 nt, Pseudomonas putida KT2440
gccccccaggcgg

SEQ ID NO: 3597660 - RNA, 14 nt, Pseudomonas putida KT2440
gcccccccagcaac

SEQ ID NO: 3597661 - RNA, 13 nt, Pseudomonas putida KT2440
gccccccgccagc

SEQ ID NO: 3597662 - RNA, 16 nt, Pseudomonas putida KT2440
gccccccggcuccaca

SEQ ID NO: 3597663 - RNA, 17 nt, Pseudomonas putida KT2440
gccccccuguaggagcg

SEQ ID NO: 3597664 - RNA, 20 nt, Pseudomonas putida KT2440
gccccccuguaggagcgggu

SEQ ID NO: 3597665 - RNA, 18 nt, Pseudomonas putida KT2440
gccccccuuccgcgugcc

SEQ ID NO: 3597666 - RNA, 20 nt, Pseudomonas putida KT2440
gccccccuuccgcgugcccc

SEQ ID NO: 3597667 - RNA, 17 nt, Pseudomonas putida KT2440
gcccccgauuccaaggu

SEQ ID NO: 3597668 - RNA, 13 nt, Pseudomonas putida KT2440
gcccccgccacag

SEQ ID NO: 3597669 - RNA, 17 nt, Pseudomonas putida KT2440
gcccccgccacagguga

SEQ ID NO: 3597670 - RNA, 20 nt, Pseudomonas putida KT2440
gcccccgccacccccgccgc

SEQ ID NO: 3597671 - RNA, 14 nt, Pseudomonas putida KT2440
gcccccgccgaagc

SEQ ID NO: 3597672 - RNA, 17 nt, Pseudomonas putida KT2440
gcccccgccugcuggcc

SEQ ID NO: 3597673 - RNA, 22 nt, Pseudomonas putida KT2440
gcccccgcucccacaggggccg

SEQ ID NO: 3597674 - RNA, 14 nt, Pseudomonas putida KT2440
gcccccgcugcaca

SEQ ID NO: 3597675 - RNA, 18 nt, Pseudomonas putida KT2440
gcccccgcugcacaggcc

SEQ ID NO: 3597676 - RNA, 15 nt, Pseudomonas putida KT2440
gcccccgucagcggc

SEQ ID NO: 3597677 - RNA, 17 nt, Pseudomonas putida KT2440
gcccccgucagcggcaa

SEQ ID NO: 3597678 - RNA, 20 nt, Pseudomonas putida KT2440
gcccccuguaggagcggguu

SEQ ID NO: 3597679 - RNA, 21 nt, Pseudomonas putida KT2440
gccccgaggaaguacgccggc

SEQ ID NO: 3597680 - RNA, 23 nt, Pseudomonas putida KT2440
gccccgaggaaguacgccggcgc

SEQ ID NO: 3597681 - RNA, 13 nt, Pseudomonas putida KT2440
gccccgauacagc

SEQ ID NO: 3597682 - RNA, 13 nt, Pseudomonas putida KT2440
gcccgcacagcac

SEQ ID NO: 3597683 - RNA, 23 nt, Pseudomonas putida KT2440
gcccgcacagcacguucagcggg

SEQ ID NO: 3597684 - RNA, 15 nt, Pseudomonas putida KT2440
gcccgcagcgcuucg

SEQ ID NO: 3597685 - RNA, 16 nt, Pseudomonas putida KT2440
gcccgcagcgcuucga

SEQ ID NO: 3597686 - RNA, 17 nt, Pseudomonas putida KT2440
gcccgcagcgcuucgau

SEQ ID NO: 3597687 - RNA, 11 nt, Pseudomonas putida KT2440
gcccgcagcuu

SEQ ID NO: 3597688 - RNA, 18 nt, Pseudomonas putida KT2440
gcccgcagcuucaacucc

SEQ ID NO: 3597689 - RNA, 22 nt, Pseudomonas putida KT2440
gcccgcagcuucaacuccacca

SEQ ID NO: 3597690 - RNA, 13 nt, Pseudomonas putida KT2440
gcccgcaggugcg

SEQ ID NO: 3597691 - RNA, 15 nt, Pseudomonas putida KT2440
gcccgcaugcaaccc

SEQ ID NO: 3597692 - RNA, 17 nt, Pseudomonas putida KT2440
gcccgccaaaaggcccg

SEQ ID NO: 3597693 - RNA, 16 nt, Pseudomonas putida KT2440
gcccgccacaccugcc

SEQ ID NO: 3597694 - RNA, 14 nt, Pseudomonas putida KT2440
gcccgccagcaggc

SEQ ID NO: 3597695 - RNA, 15 nt, Pseudomonas putida KT2440
gcccgccagcaggcc

SEQ ID NO: 3597696 - RNA, 17 nt, Pseudomonas putida KT2440
gcccgccagcaggccac

SEQ ID NO: 3597697 - RNA, 13 nt, Pseudomonas putida KT2440
gcccgccaggcag

SEQ ID NO: 3597698 - RNA, 15 nt, Pseudomonas putida KT2440
gcccgccaggcgcaa

SEQ ID NO: 3597699 - RNA, 20 nt, Pseudomonas putida KT2440
gcccgccaguaggcugcagc

SEQ ID NO: 3597700 - RNA, 20 nt, Pseudomonas putida KT2440
gcccgccauaucaggauugc

SEQ ID NO: 3597701 - RNA, 13 nt, Pseudomonas putida KT2440
gcccgcccaccac

SEQ ID NO: 3597702 - RNA, 18 nt, Pseudomonas putida KT2440
gcccgcccaccaccagcc

SEQ ID NO: 3597703 - RNA, 19 nt, Pseudomonas putida KT2440
gcccgcccaccaccagccc

SEQ ID NO: 3597704 - RNA, 22 nt, Pseudomonas putida KT2440
gcccgcccacgccgcugguaca

SEQ ID NO: 3597705 - RNA, 14 nt, Pseudomonas putida KT2440
gcccgcccagccca

SEQ ID NO: 3597706 - RNA, 15 nt, Pseudomonas putida KT2440
gcccgcccagcuggc

SEQ ID NO: 3597707 - RNA, 16 nt, Pseudomonas putida KT2440
gcccgcccagcuggcu

SEQ ID NO: 3597708 - RNA, 18 nt, Pseudomonas putida KT2440
gcccgcccccacagagcc

SEQ ID NO: 3597709 - RNA, 21 nt, Pseudomonas putida KT2440
gcccgccccccaccuggcccu

SEQ ID NO: 3597710 - RNA, 20 nt, Pseudomonas putida KT2440
gcccgccccucgucacugac

SEQ ID NO: 3597711 - RNA, 20 nt, Pseudomonas putida KT2440
gcccgccccugccagcacca

SEQ ID NO: 3597712 - RNA, 23 nt, Pseudomonas putida KT2440
gcccgccccugccagcaccagcg

SEQ ID NO: 3597713 - RNA, 21 nt, Pseudomonas putida KT2440
gcccgccccuuuagcaggcaa

SEQ ID NO: 3597714 - RNA, 19 nt, Pseudomonas putida KT2440
gcccgccgccaccagcgcc

SEQ ID NO: 3597715 - RNA, 13 nt, Pseudomonas putida KT2440
gcccgccgccagu

SEQ ID NO: 3597716 - RNA, 14 nt, Pseudomonas putida KT2440
gcccgccgccaguu

SEQ ID NO: 3597717 - RNA, 21 nt, Pseudomonas putida KT2440
gcccgccgccaguuucaccug

SEQ ID NO: 3597718 - RNA, 14 nt, Pseudomonas putida KT2440
gcccgccgcgcggc

SEQ ID NO: 3597719 - RNA, 19 nt, Pseudomonas putida KT2440
gcccgccggcaacuccucc

SEQ ID NO: 3597720 - RNA, 20 nt, Pseudomonas putida KT2440
gcccgccggcaacuccucca

SEQ ID NO: 3597721 - RNA, 14 nt, Pseudomonas putida KT2440
gcccgccggcacuu

SEQ ID NO: 3597722 - RNA, 14 nt, Pseudomonas putida KT2440
gcccgccguccagc

SEQ ID NO: 3597723 - RNA, 15 nt, Pseudomonas putida KT2440
gcccgccugcucaau

SEQ ID NO: 3597724 - RNA, 19 nt, Pseudomonas putida KT2440
gcccgccuuccuugggggu

SEQ ID NO: 3597725 - RNA, 20 nt, Pseudomonas putida KT2440
gcccgccuuggcauagcgcu

SEQ ID NO: 3597726 - RNA, 21 nt, Pseudomonas putida KT2440
gcccgcgaaaugcccaaagcc

SEQ ID NO: 3597727 - RNA, 23 nt, Pseudomonas putida KT2440
gcccgcgaaaugcccaaagcccg

SEQ ID NO: 3597728 - RNA, 15 nt, Pseudomonas putida KT2440
gcccgcgaacaaggc

SEQ ID NO: 3597729 - RNA, 18 nt, Pseudomonas putida KT2440
gcccgcgaacacgggcga

SEQ ID NO: 3597730 - RNA, 14 nt, Pseudomonas putida KT2440
gcccgcgaagaagc

SEQ ID NO: 3597731 - RNA, 20 nt, Pseudomonas putida KT2440
gcccgcgaagaauucaacgc

SEQ ID NO: 3597732 - RNA, 22 nt, Pseudomonas putida KT2440
gcccgcgaagaggccagcacag

SEQ ID NO: 3597733 - RNA, 21 nt, Pseudomonas putida KT2440
gcccgcgaagaggccggcacu

SEQ ID NO: 3597734 - RNA, 23 nt, Pseudomonas putida KT2440
gcccgcgaagaggccggcacugg

SEQ ID NO: 3597735 - RNA, 21 nt, Pseudomonas putida KT2440
gcccgcgaagaggccgguacu

SEQ ID NO: 3597736 - RNA, 18 nt, Pseudomonas putida KT2440
gcccgcgaagagguccug

SEQ ID NO: 3597737 - RNA, 17 nt, Pseudomonas putida KT2440
gcccgcgaaggcuccag

SEQ ID NO: 3597738 - RNA, 20 nt, Pseudomonas putida KT2440
gcccgcgaaggcuccagcac

SEQ ID NO: 3597739 - RNA, 21 nt, Pseudomonas putida KT2440
gcccgcgaaggcuccagcacc

SEQ ID NO: 3597740 - RNA, 14 nt, Pseudomonas putida KT2440
gcccgcgaagggcc

SEQ ID NO: 3597741 - RNA, 21 nt, Pseudomonas putida KT2440
gcccgcgaagggccgcgaagc

SEQ ID NO: 3597742 - RNA, 17 nt, Pseudomonas putida KT2440
gcccgcgaagggccgcu

SEQ ID NO: 3597743 - RNA, 21 nt, Pseudomonas putida KT2440
gcccgcgaagggcucaacacc

SEQ ID NO: 3597744 - RNA, 23 nt, Pseudomonas putida KT2440
gcccgcgaagggcugccgcgcag

SEQ ID NO: 3597745 - RNA, 14 nt, Pseudomonas putida KT2440
gcccgcgaaucgcc

SEQ ID NO: 3597746 - RNA, 18 nt, Pseudomonas putida KT2440
gcccgcgaaucguccugg

SEQ ID NO: 3597747 - RNA, 14 nt, Pseudomonas putida KT2440
gcccgcgaaugcaa

SEQ ID NO: 3597748 - RNA, 17 nt, Pseudomonas putida KT2440
gcccgcgaaugggcugc

SEQ ID NO: 3597749 - RNA, 11 nt, Pseudomonas putida KT2440
gcccgcgcaaa

SEQ ID NO: 3597750 - RNA, 15 nt, Pseudomonas putida KT2440
gcccgcgcaaaggcg

SEQ ID NO: 3597751 - RNA, 18 nt, Pseudomonas putida KT2440
gcccgcgcaaaucgccgc

SEQ ID NO: 3597752 - RNA, 15 nt, Pseudomonas putida KT2440
gcccgcgcaggauca

SEQ ID NO: 3597753 - RNA, 13 nt, Pseudomonas putida KT2440
gcccgcgccaggc

SEQ ID NO: 3597754 - RNA, 14 nt, Pseudomonas putida KT2440
gcccgcgccaggcu

SEQ ID NO: 3597755 - RNA, 17 nt, Pseudomonas putida KT2440
gcccgcgccgacagccu

SEQ ID NO: 3597756 - RNA, 16 nt, Pseudomonas putida KT2440
gcccgcgccuugcgca

SEQ ID NO: 3597757 - RNA, 18 nt, Pseudomonas putida KT2440
gcccgcgccuugcgcacg

SEQ ID NO: 3597758 - RNA, 20 nt, Pseudomonas putida KT2440
gcccgcgcggcgcaucgcga

SEQ ID NO: 3597759 - RNA, 24 nt, Pseudomonas putida KT2440
gcccgcgcggcgcaucgcgagcaa

SEQ ID NO: 3597760 - RNA, 16 nt, Pseudomonas putida KT2440
gcccgcgcuucccggg

SEQ ID NO: 3597761 - RNA, 17 nt, Pseudomonas putida KT2440
gcccgcggcccacagug

SEQ ID NO: 3597762 - RNA, 17 nt, Pseudomonas putida KT2440
gcccgcggcgaacacag

SEQ ID NO: 3597763 - RNA, 16 nt, Pseudomonas putida KT2440
gcccgcggcucaccca

SEQ ID NO: 3597764 - RNA, 19 nt, Pseudomonas putida KT2440
gcccgcggcucacccacca

SEQ ID NO: 3597765 - RNA, 21 nt, Pseudomonas putida KT2440
gcccgcgguaaugcgcacggc

SEQ ID NO: 3597766 - RNA, 23 nt, Pseudomonas putida KT2440
gcccgcgguaaugcgcacggcuu

SEQ ID NO: 3597767 - RNA, 16 nt, Pseudomonas putida KT2440
gcccgcguacucggcc

SEQ ID NO: 3597768 - RNA, 17 nt, Pseudomonas putida KT2440
gcccgcguacucggcca

SEQ ID NO: 3597769 - RNA, 19 nt, Pseudomonas putida KT2440
gcccgcgucugccgcagcc

SEQ ID NO: 3597770 - RNA, 21 nt, Pseudomonas putida KT2440
gcccgcgucugccgcagcccc

SEQ ID NO: 3597771 - RNA, 22 nt, Pseudomonas putida KT2440
gcccgcgugagauguucaccag

SEQ ID NO: 3597772 - RNA, 14 nt, Pseudomonas putida KT2440
gcccgcgugcgccc

SEQ ID NO: 3597773 - RNA, 18 nt, Pseudomonas putida KT2440
gcccgcgugcgcccagau

SEQ ID NO: 3597774 - RNA, 19 nt, Pseudomonas putida KT2440
gcccgcgugcuucaagcca

SEQ ID NO: 3597775 - RNA, 20 nt, Pseudomonas putida KT2440
gcccgcgugcuucaagccau

SEQ ID NO: 3597776 - RNA, 18 nt, Pseudomonas putida KT2440
gcccgcguucaugccggc

SEQ ID NO: 3597777 - RNA, 23 nt, Pseudomonas putida KT2440
gcccgcguucaugccggccccag

SEQ ID NO: 3597778 - RNA, 17 nt, Pseudomonas putida KT2440
gcccgcuaagaggucgg

SEQ ID NO: 3597779 - RNA, 14 nt, Pseudomonas putida KT2440
gcccgcucccacag

SEQ ID NO: 3597780 - RNA, 20 nt, Pseudomonas putida KT2440
gcccgcucccacagggaccg

SEQ ID NO: 3597781 - RNA, 19 nt, Pseudomonas putida KT2440
gcccgcucccacagguaau

SEQ ID NO: 3597782 - RNA, 20 nt, Pseudomonas putida KT2440
gcccgcucccacagguaaug

SEQ ID NO: 3597783 - RNA, 22 nt, Pseudomonas putida KT2440
gcccgcucccacagguaaugca

SEQ ID NO: 3597784 - RNA, 19 nt, Pseudomonas putida KT2440
gcccgcucccacagguacu

SEQ ID NO: 3597785 - RNA, 20 nt, Pseudomonas putida KT2440
gcccgcucccacagguacug

SEQ ID NO: 3597786 - RNA, 19 nt, Pseudomonas putida KT2440
gcccgcucccacaggucca

SEQ ID NO: 3597787 - RNA, 16 nt, Pseudomonas putida KT2440
gcccuccagcccuggc

SEQ ID NO: 3597788 - RNA, 13 nt, Pseudomonas putida KT2440
gcccuccagccgc

SEQ ID NO: 3597789 - RNA, 20 nt, Pseudomonas putida KT2440
gcccuccccguuuggcagcu

SEQ ID NO: 3597790 - RNA, 18 nt, Pseudomonas putida KT2440
gcccuccgguucugccgg

SEQ ID NO: 3597791 - RNA, 16 nt, Pseudomonas putida KT2440
gcccuccugcagcagg

SEQ ID NO: 3597792 - RNA, 17 nt, Pseudomonas putida KT2440
gcccuccugcagcaggc

SEQ ID NO: 3597793 - RNA, 14 nt, Pseudomonas putida KT2440
gcccuccuugggua

SEQ ID NO: 3597794 - RNA, 18 nt, Pseudomonas putida KT2440
gcccucgacaaucgccag

SEQ ID NO: 3597795 - RNA, 15 nt, Pseudomonas putida KT2440
gcccucgagugcgcu

SEQ ID NO: 3597796 - RNA, 21 nt, Pseudomonas putida KT2440
gcccucgaugucuuccagacc

SEQ ID NO: 3597797 - RNA, 23 nt, Pseudomonas putida KT2440
gcccucgaugucuuccagaccag

SEQ ID NO: 3597798 - RNA, 23 nt, Pseudomonas putida KT2440
gcccucgcggcggcuaagcgcca

SEQ ID NO: 3597799 - RNA, 18 nt, Pseudomonas putida KT2440
gcccucggccaccuggcc

SEQ ID NO: 3597800 - RNA, 20 nt, Pseudomonas putida KT2440
gcccucggccggggccaggc

SEQ ID NO: 3597801 - RNA, 20 nt, Pseudomonas putida KT2440
gcccucguucgcgggcacgc

SEQ ID NO: 3597802 - RNA, 15 nt, Pseudomonas putida KT2440
gcccucugcguggua

SEQ ID NO: 3597803 - RNA, 12 nt, Pseudomonas putida KT2440
gcccucuuccgc

SEQ ID NO: 3597804 - RNA, 15 nt, Pseudomonas putida KT2440
gcccucuuccgcacg

SEQ ID NO: 3597805 - RNA, 22 nt, Pseudomonas putida KT2440
gcccucuuccgcacgggucacc

SEQ ID NO: 3597806 - RNA, 16 nt, Pseudomonas putida KT2440
gcccucuucgcgggca

SEQ ID NO: 3597807 - RNA, 21 nt, Pseudomonas putida KT2440
gcccucuucgcgggcaugccc

SEQ ID NO: 3597808 - RNA, 13 nt, Pseudomonas putida KT2440
gcccucuugcugc

SEQ ID NO: 3597809 - RNA, 24 nt, Pseudomonas putida KT2440
gcccucuugcugcaacagcuccag

SEQ ID NO: 3597810 - RNA, 14 nt, Pseudomonas putida KT2440
gcccugaacagggc

SEQ ID NO: 3597811 - RNA, 14 nt, Pseudomonas putida KT2440
gcccugaaggccgc

SEQ ID NO: 3597812 - RNA, 14 nt, Pseudomonas putida KT2440
gcccugacaggcga

SEQ ID NO: 3597813 - RNA, 22 nt, Pseudomonas putida KT2440
gcccugacaggcgaucagucag

SEQ ID NO: 3597814 - RNA, 16 nt, Pseudomonas putida KT2440
gcccugacgccagcgc

SEQ ID NO: 3597815 - RNA, 14 nt, Pseudomonas putida KT2440
gcccugaucccggc

SEQ ID NO: 3597816 - RNA, 23 nt, Pseudomonas putida KT2440
gcccugaucgccuccaggcguug

SEQ ID NO: 3597817 - RNA, 19 nt, Pseudomonas putida KT2440
gcccugaucugccccucga

SEQ ID NO: 3597818 - RNA, 22 nt, Pseudomonas putida KT2440
gcccugaucugccccucgauca

SEQ ID NO: 3597819 - RNA, 13 nt, Pseudomonas putida KT2440
gcccugcagcgcu

SEQ ID NO: 3597820 - RNA, 13 nt, Pseudomonas putida KT2440
gcccugcagcuuc

SEQ ID NO: 3597821 - RNA, 23 nt, Pseudomonas putida KT2440
gcccugcagcuucccggccuggc

SEQ ID NO: 3597822 - RNA, 20 nt, Pseudomonas putida KT2440
gcccugcauaugcagggccu

SEQ ID NO: 3597823 - RNA, 22 nt, Pseudomonas putida KT2440
gcccugcccucgacaaucgcca

SEQ ID NO: 3597824 - RNA, 13 nt, Pseudomonas putida KT2440
gcccugccgccuu

SEQ ID NO: 3597825 - RNA, 19 nt, Pseudomonas putida KT2440
gcccugccgccuucuccag

SEQ ID NO: 3597826 - RNA, 21 nt, Pseudomonas putida KT2440
gcccugccgccuucuccagcu

SEQ ID NO: 3597827 - RNA, 21 nt, Pseudomonas putida KT2440
gcccugccggccucaauucca

SEQ ID NO: 3597828 - RNA, 16 nt, Pseudomonas putida KT2440
gcccugcgccugcagu

SEQ ID NO: 3597829 - RNA, 19 nt, Pseudomonas putida KT2440
gcccugcggcuguucgcag

SEQ ID NO: 3597830 - RNA, 22 nt, Pseudomonas putida KT2440
gcccugcggcuguucgcagcac

SEQ ID NO: 3597831 - RNA, 21 nt, Pseudomonas putida KT2440
gcccugcucacgcagcucggu

SEQ ID NO: 3597832 - RNA, 18 nt, Pseudomonas putida KT2440
gcccugcucauccagcaa

SEQ ID NO: 3597833 - RNA, 16 nt, Pseudomonas putida KT2440
gcccugcucgccaaau

SEQ ID NO: 3597834 - RNA, 18 nt, Pseudomonas putida KT2440
gcccugcucgccaaaugu

SEQ ID NO: 3597835 - RNA, 21 nt, Pseudomonas putida KT2440
gcccugcucuucgauccgcgc

SEQ ID NO: 3597836 - RNA, 14 nt, Pseudomonas putida KT2440
gcccugcugccgca

SEQ ID NO: 3597837 - RNA, 19 nt, Pseudomonas putida KT2440
gcccugcuugcggaacagg

SEQ ID NO: 3597838 - RNA, 17 nt, Pseudomonas putida KT2440
gcccuggaugacacgga

SEQ ID NO: 3597839 - RNA, 18 nt, Pseudomonas putida KT2440
gcccuggaugacacggau

SEQ ID NO: 3597840 - RNA, 22 nt, Pseudomonas putida KT2440
gcccuggaugacacggauggca

SEQ ID NO: 3597841 - RNA, 18 nt, Pseudomonas putida KT2440
gcccuggcccgccgccac

SEQ ID NO: 3597842 - RNA, 15 nt, Pseudomonas putida KT2440
gcccuggcggccacg

SEQ ID NO: 3597843 - RNA, 22 nt, Pseudomonas putida KT2440
gcccugggcgagcaggugaccc

SEQ ID NO: 3597844 - RNA, 23 nt, Pseudomonas putida KT2440
gcccugggguuuuuuuggcuggu

SEQ ID NO: 3597845 - RNA, 15 nt, Pseudomonas putida KT2440
gcccuguacauccag

SEQ ID NO: 3597846 - RNA, 17 nt, Pseudomonas putida KT2440
gcccuguacauccagcu

SEQ ID NO: 3597847 - RNA, 23 nt, Pseudomonas putida KT2440
gcccuguacauccagcuccagca

SEQ ID NO: 3597848 - RNA, 15 nt, Pseudomonas putida KT2440
gcccuguagagcgcc

SEQ ID NO: 3597849 - RNA, 21 nt, Pseudomonas putida KT2440
gcccugugcuuugagcaggcg

SEQ ID NO: 3597850 - RNA, 16 nt, Pseudomonas putida KT2440
gcccuguggcuguggu

SEQ ID NO: 3597851 - RNA, 17 nt, Pseudomonas putida KT2440
gcccuguggcugugguu

SEQ ID NO: 3597852 - RNA, 20 nt, Pseudomonas putida KT2440
gcccugugggagcggccuug

SEQ ID NO: 3597853 - RNA, 16 nt, Pseudomonas putida KT2440
gcccuguguaggagcg

SEQ ID NO: 3597854 - RNA, 20 nt, Pseudomonas putida KT2440
gcccuguguaggagcggguu

SEQ ID NO: 3597855 - RNA, 20 nt, Pseudomonas putida KT2440
gcccuguuucuucaaggccg

SEQ ID NO: 3597856 - RNA, 21 nt, Pseudomonas putida KT2440
gcccuguuucuucaaggccgc

SEQ ID NO: 3597857 - RNA, 23 nt, Pseudomonas putida KT2440
gcccuuaaggucaaucagggaua

SEQ ID NO: 3597858 - RNA, 16 nt, Pseudomonas putida KT2440
gcccuuacaggucgua

SEQ ID NO: 3597859 - RNA, 15 nt, Pseudomonas putida KT2440
gcccuucacgcucau

SEQ ID NO: 3597860 - RNA, 22 nt, Pseudomonas putida KT2440
gcccuucacuguggucauccag

SEQ ID NO: 3597861 - RNA, 17 nt, Pseudomonas putida KT2440
gcccuucaugcgcccug

SEQ ID NO: 3597862 - RNA, 14 nt, Pseudomonas putida KT2440
gcccuuccaccaca

SEQ ID NO: 3597863 - RNA, 18 nt, Pseudomonas putida KT2440
gcccuuccugaguauucu

SEQ ID NO: 3597864 - RNA, 13 nt, Pseudomonas putida KT2440
gcccuucgcaggc

SEQ ID NO: 3597865 - RNA, 14 nt, Pseudomonas putida KT2440
gcccuucgcaggca

SEQ ID NO: 3597866 - RNA, 16 nt, Pseudomonas putida KT2440
gcccuucgcaggcacg

SEQ ID NO: 3597867 - RNA, 14 nt, Pseudomonas putida KT2440
gcccuucgcgggca

SEQ ID NO: 3597868 - RNA, 15 nt, Pseudomonas putida KT2440
gcccuucgcggguga

SEQ ID NO: 3597869 - RNA, 19 nt, Pseudomonas putida KT2440
gcccuucgcgggugaaccc

SEQ ID NO: 3597870 - RNA, 21 nt, Pseudomonas putida KT2440
gcccuucgcgggugaacccgc

SEQ ID NO: 3597871 - RNA, 16 nt, Pseudomonas putida KT2440
gcccuucuccgccuac

SEQ ID NO: 3597872 - RNA, 15 nt, Pseudomonas putida KT2440
gcccuucucgcucag

SEQ ID NO: 3597873 - RNA, 16 nt, Pseudomonas putida KT2440
gcccuucugcgccaaa

SEQ ID NO: 3597874 - RNA, 23 nt, Pseudomonas putida KT2440
gcccuucugcgccaaagcgagca

SEQ ID NO: 3597875 - RNA, 15 nt, Pseudomonas putida KT2440
gcccuucugcugcuc

SEQ ID NO: 3597876 - RNA, 13 nt, Pseudomonas putida KT2440
gcccuugcucaau

SEQ ID NO: 3597877 - RNA, 22 nt, Pseudomonas putida KT2440
gcccuugcucaggucguacggc

SEQ ID NO: 3597878 - RNA, 17 nt, Pseudomonas putida KT2440
gcccuugcucggccagc

SEQ ID NO: 3597879 - RNA, 18 nt, Pseudomonas putida KT2440
gcccuugcucggccagcc

SEQ ID NO: 3597880 - RNA, 18 nt, Pseudomonas putida KT2440
gcccuugcugcagcaggc

SEQ ID NO: 3597881 - RNA, 19 nt, Pseudomonas putida KT2440
gcccuugcugcagcaggcu

SEQ ID NO: 3597882 - RNA, 20 nt, Pseudomonas putida KT2440
gcccuugcugcagcaggcug

SEQ ID NO: 3597883 - RNA, 21 nt, Pseudomonas putida KT2440
gcccuuggcagcgcugcaagc

SEQ ID NO: 3597884 - RNA, 15 nt, Pseudomonas putida KT2440
gcccuugucagccgc

SEQ ID NO: 3597885 - RNA, 14 nt, Pseudomonas putida KT2440
gcccuugucgaaca

SEQ ID NO: 3597886 - RNA, 16 nt, Pseudomonas putida KT2440
gcccuuucacggcggu

SEQ ID NO: 3597887 - RNA, 14 nt, Pseudomonas putida KT2440
gcccuuucgcgggu

SEQ ID NO: 3597888 - RNA, 18 nt, Pseudomonas putida KT2440
gcccuuucgcggguaaac

SEQ ID NO: 3597889 - RNA, 19 nt, Pseudomonas putida KT2440
gcccuuucgcggguaaacc

SEQ ID NO: 3597890 - RNA, 17 nt, Pseudomonas putida KT2440
gcccuuucgcgggugaa

SEQ ID NO: 3597891 - RNA, 22 nt, Pseudomonas putida KT2440
gcccuuucgcgggugaacccgc

SEQ ID NO: 3597892 - RNA, 14 nt, Pseudomonas putida KT2440
gccgaugcccaccu

SEQ ID NO: 3597893 - RNA, 21 nt, Pseudomonas putida KT2440
gccgaugcccaccuuggcggu

SEQ ID NO: 3597894 - RNA, 20 nt, Pseudomonas putida KT2440
gccgaugcucgucagccccu

SEQ ID NO: 3597895 - RNA, 14 nt, Pseudomonas putida KT2440
gccgauggccaaua

SEQ ID NO: 3597896 - RNA, 22 nt, Pseudomonas putida KT2440
gccgauggcgcaaacccucggc

SEQ ID NO: 3597897 - RNA, 16 nt, Pseudomonas putida KT2440
gccgaugggcaggcca

SEQ ID NO: 3597898 - RNA, 21 nt, Pseudomonas putida KT2440
gccgaugucggcgugcaccac

SEQ ID NO: 3597899 - RNA, 17 nt, Pseudomonas putida KT2440
gccgauguuggucacca

SEQ ID NO: 3597900 - RNA, 14 nt, Pseudomonas putida KT2440
gccgauugccuggg

SEQ ID NO: 3597901 - RNA, 14 nt, Pseudomonas putida KT2440
gccgcaaagcggcc

SEQ ID NO: 3597902 - RNA, 21 nt, Pseudomonas putida KT2440
gccgcaaagcggccccagcgu

SEQ ID NO: 3597903 - RNA, 17 nt, Pseudomonas putida KT2440
gccgcaaagcggccccu

SEQ ID NO: 3597904 - RNA, 16 nt, Pseudomonas putida KT2440
gccgcaaagcggcccu

SEQ ID NO: 3597905 - RNA, 16 nt, Pseudomonas putida KT2440
gccgcaaccgggucgg

SEQ ID NO: 3597906 - RNA, 19 nt, Pseudomonas putida KT2440
gccgcaaccgggucggcgc

SEQ ID NO: 3597907 - RNA, 22 nt, Pseudomonas putida KT2440
gccgcaaccugggcaaccacau

SEQ ID NO: 3597908 - RNA, 15 nt, Pseudomonas putida KT2440
gccgcaacgcggccc

SEQ ID NO: 3597909 - RNA, 12 nt, Pseudomonas putida KT2440
gccgcaagcagu

SEQ ID NO: 3597910 - RNA, 19 nt, Pseudomonas putida KT2440
gccgcaagcagucccagca

SEQ ID NO: 3597911 - RNA, 14 nt, Pseudomonas putida KT2440
gccgcaaggccgcu

SEQ ID NO: 3597912 - RNA, 15 nt, Pseudomonas putida KT2440
gccgcaaggccgcuc

SEQ ID NO: 3597913 - RNA, 19 nt, Pseudomonas putida KT2440
gccgcaaggccgcucccac

SEQ ID NO: 3597914 - RNA, 14 nt, Pseudomonas putida KT2440
gccgcaaggcggcc

SEQ ID NO: 3597915 - RNA, 16 nt, Pseudomonas putida KT2440
gccgcaaggcggccca

SEQ ID NO: 3597916 - RNA, 18 nt, Pseudomonas putida KT2440
gccgcaauggucuuacca

SEQ ID NO: 3597917 - RNA, 16 nt, Pseudomonas putida KT2440
gccgcacaaggccgcu

SEQ ID NO: 3597918 - RNA, 22 nt, Pseudomonas putida KT2440
gccgcaccagguccaccagcag

SEQ ID NO: 3597919 - RNA, 15 nt, Pseudomonas putida KT2440
gccgcacccaggcca

SEQ ID NO: 3597920 - RNA, 16 nt, Pseudomonas putida KT2440
gccgcaccugcccgcc

SEQ ID NO: 3597921 - RNA, 13 nt, Pseudomonas putida KT2440
gccgcacgcgccu

SEQ ID NO: 3597922 - RNA, 21 nt, Pseudomonas putida KT2440
gccgcacguuauccacagcgu

SEQ ID NO: 3597923 - RNA, 22 nt, Pseudomonas putida KT2440
gccgcacguuauccacagcguu

SEQ ID NO: 3597924 - RNA, 22 nt, Pseudomonas putida KT2440
gccgcagagcggcccugagccu

SEQ ID NO: 3597925 - RNA, 15 nt, Pseudomonas putida KT2440
gccgcagcaguuggc

SEQ ID NO: 3597926 - RNA, 16 nt, Pseudomonas putida KT2440
gccgcagccaugccgc

SEQ ID NO: 3597927 - RNA, 16 nt, Pseudomonas putida KT2440
gccgcagccccgccaa

SEQ ID NO: 3597928 - RNA, 20 nt, Pseudomonas putida KT2440
gccgcagccucuucggccag

SEQ ID NO: 3597929 - RNA, 21 nt, Pseudomonas putida KT2440
gccgcagccucuucggccagc

SEQ ID NO: 3597930 - RNA, 18 nt, Pseudomonas putida KT2440
gccgcagcuggcgcaaau

SEQ ID NO: 3597931 - RNA, 14 nt, Pseudomonas putida KT2440
gccgcagguccacc

SEQ ID NO: 3597932 - RNA, 15 nt, Pseudomonas putida KT2440
gccgcagugacacgg

SEQ ID NO: 3597933 - RNA, 19 nt, Pseudomonas putida KT2440
gccgcauauacgccggcgu

SEQ ID NO: 3597934 - RNA, 13 nt, Pseudomonas putida KT2440
gccgcaucagccg

SEQ ID NO: 3597935 - RNA, 14 nt, Pseudomonas putida KT2440
gccgcauccagcac

SEQ ID NO: 3597936 - RNA, 20 nt, Pseudomonas putida KT2440
gccgcaucguuauccagcac

SEQ ID NO: 3597937 - RNA, 21 nt, Pseudomonas putida KT2440
gccgcaucguuauccagcacc

SEQ ID NO: 3597938 - RNA, 16 nt, Pseudomonas putida KT2440
gccgcauucgcgggua

SEQ ID NO: 3597939 - RNA, 16 nt, Pseudomonas putida KT2440
gccgcauuggccgggu

SEQ ID NO: 3597940 - RNA, 21 nt, Pseudomonas putida KT2440
gccgcauuggccgggucgacc

SEQ ID NO: 3597941 - RNA, 22 nt, Pseudomonas putida KT2440
gccgcauuucgacgcagaggug

SEQ ID NO: 3597942 - RNA, 23 nt, Pseudomonas putida KT2440
gccgccaaaaaauccgccuggcc

SEQ ID NO: 3597943 - RNA, 13 nt, Pseudomonas putida KT2440
gccgccaacagcg

SEQ ID NO: 3597944 - RNA, 16 nt, Pseudomonas putida KT2440
gccgccaacagcgcag

SEQ ID NO: 3597945 - RNA, 15 nt, Pseudomonas putida KT2440
gccgccaagcggccc

SEQ ID NO: 3597946 - RNA, 19 nt, Pseudomonas putida KT2440
gccgccaagcggccccaga

SEQ ID NO: 3597947 - RNA, 14 nt, Pseudomonas putida KT2440
gccgccaaggcgau

SEQ ID NO: 3597948 - RNA, 15 nt, Pseudomonas putida KT2440
gccgccacauccagc

SEQ ID NO: 3597949 - RNA, 20 nt, Pseudomonas putida KT2440
gccgccacauccagcgccuc

SEQ ID NO: 3597950 - RNA, 15 nt, Pseudomonas putida KT2440
gccgccaccagcgcc

SEQ ID NO: 3597951 - RNA, 19 nt, Pseudomonas putida KT2440
gccgccacccaccacggcc

SEQ ID NO: 3597952 - RNA, 15 nt, Pseudomonas putida KT2440
gccgccaccucgcua

SEQ ID NO: 3597953 - RNA, 22 nt, Pseudomonas putida KT2440
gccgccaccugcggcagguggg

SEQ ID NO: 3597954 - RNA, 21 nt, Pseudomonas putida KT2440
gccgccacuaccguauucgcg

SEQ ID NO: 3597955 - RNA, 23 nt, Pseudomonas putida KT2440
gccgccacuaccguauucgcggg

SEQ ID NO: 3597956 - RNA, 22 nt, Pseudomonas putida KT2440
gccgccagacaacuggccaggg

SEQ ID NO: 3597957 - RNA, 15 nt, Pseudomonas putida KT2440
gccgccagaccaccu

SEQ ID NO: 3597958 - RNA, 16 nt, Pseudomonas putida KT2440
gccgccagaccaccuc

SEQ ID NO: 3597959 - RNA, 18 nt, Pseudomonas putida KT2440
gccgccagaccauaagcg

SEQ ID NO: 3597960 - RNA, 12 nt, Pseudomonas putida KT2440
gccgccagcccc

SEQ ID NO: 3597961 - RNA, 18 nt, Pseudomonas putida KT2440
gccgccagcgcuccagca

SEQ ID NO: 3597962 - RNA, 13 nt, Pseudomonas putida KT2440
gccgccagcggca

SEQ ID NO: 3597963 - RNA, 15 nt, Pseudomonas putida KT2440
gccgccagcggcagu

SEQ ID NO: 3597964 - RNA, 21 nt, Pseudomonas putida KT2440
gccgccagcggcaguugcagg

SEQ ID NO: 3597965 - RNA, 13 nt, Pseudomonas putida KT2440
gccgccagcggcg

SEQ ID NO: 3597966 - RNA, 14 nt, Pseudomonas putida KT2440
gccgccagcggcuc

SEQ ID NO: 3597967 - RNA, 13 nt, Pseudomonas putida KT2440
gccgccagcgugc

SEQ ID NO: 3597968 - RNA, 14 nt, Pseudomonas putida KT2440
gccgccagcugcug

SEQ ID NO: 3597969 - RNA, 14 nt, Pseudomonas putida KT2440
gccgccaggcagca

SEQ ID NO: 3597970 - RNA, 15 nt, Pseudomonas putida KT2440
gccgccaggcagcag

SEQ ID NO: 3597971 - RNA, 13 nt, Pseudomonas putida KT2440
gccgccaggccca

SEQ ID NO: 3597972 - RNA, 15 nt, Pseudomonas putida KT2440
gccgccaggcccacc

SEQ ID NO: 3597973 - RNA, 21 nt, Pseudomonas putida KT2440
gccgccaggcccaccaccggu

SEQ ID NO: 3597974 - RNA, 13 nt, Pseudomonas putida KT2440
gccgccagggcaa

SEQ ID NO: 3597975 - RNA, 16 nt, Pseudomonas putida KT2440
gccgccaguucgcccu

SEQ ID NO: 3597976 - RNA, 21 nt, Pseudomonas putida KT2440
gccgccaguucgcccuucagc

SEQ ID NO: 3597977 - RNA, 14 nt, Pseudomonas putida KT2440
gccgccauccucgg

SEQ ID NO: 3597978 - RNA, 17 nt, Pseudomonas putida KT2440
gccgccaugcagcccgc

SEQ ID NO: 3597979 - RNA, 18 nt, Pseudomonas putida KT2440
gccgccauguacguugcc

SEQ ID NO: 3597980 - RNA, 17 nt, Pseudomonas putida KT2440
gccgccauugaggaagu

SEQ ID NO: 3597981 - RNA, 15 nt, Pseudomonas putida KT2440
gccgccauugaugcc

SEQ ID NO: 3597982 - RNA, 22 nt, Pseudomonas putida KT2440
gccgccauugaugccgaaggcc

SEQ ID NO: 3597983 - RNA, 13 nt, Pseudomonas putida KT2440
gccgccauugccc

SEQ ID NO: 3597984 - RNA, 17 nt, Pseudomonas putida KT2440
gccgccauugcccagcc

SEQ ID NO: 3597985 - RNA, 12 nt, Pseudomonas putida KT2440
gccgcccaauac

SEQ ID NO: 3597986 - RNA, 15 nt, Pseudomonas putida KT2440
gccgcccacgccggc

SEQ ID NO: 3597987 - RNA, 17 nt, Pseudomonas putida KT2440
gccgcccacgccggcaa

SEQ ID NO: 3597988 - RNA, 18 nt, Pseudomonas putida KT2440
gccgcccacgccggcaac

SEQ ID NO: 3597989 - RNA, 13 nt, Pseudomonas putida KT2440
gccgcccagcucu

SEQ ID NO: 3597990 - RNA, 13 nt, Pseudomonas putida KT2440
gccgcccagguca

SEQ ID NO: 3597991 - RNA, 14 nt, Pseudomonas putida KT2440
gccgcccaggucau

SEQ ID NO: 3597992 - RNA, 14 nt, Pseudomonas putida KT2440
gccgcccagguugc

SEQ ID NO: 3597993 - RNA, 16 nt, Pseudomonas putida KT2440
gccgcccaucaccggc

SEQ ID NO: 3597994 - RNA, 14 nt, Pseudomonas putida KT2440
gccgccccgcacca

SEQ ID NO: 3597995 - RNA, 16 nt, Pseudomonas putida KT2440
gccgccccgcaccaga

SEQ ID NO: 3597996 - RNA, 21 nt, Pseudomonas putida KT2440
gccgccccgcaccagaccagc

SEQ ID NO: 3597997 - RNA, 21 nt, Pseudomonas putida KT2440
gccgccccgugcccgaucacc

SEQ ID NO: 3597998 - RNA, 22 nt, Pseudomonas putida KT2440
gccgcugcugcgccucgcaggu

SEQ ID NO: 3597999 - RNA, 24 nt, Pseudomonas putida KT2440
gccgcuggcauccaccaggucggu

SEQ ID NO: 3598000 - RNA, 12 nt, Pseudomonas putida KT2440
gccgcuggcccu

SEQ ID NO: 3598001 - RNA, 20 nt, Pseudomonas putida KT2440
gccgcuggcccuucgcggaa

SEQ ID NO: 3598002 - RNA, 21 nt, Pseudomonas putida KT2440
gccgcuggcccuucgcggaag

SEQ ID NO: 3598003 - RNA, 13 nt, Pseudomonas putida KT2440
gccgcuggcggcg

SEQ ID NO: 3598004 - RNA, 16 nt, Pseudomonas putida KT2440
gccgcuggcuuccuca

SEQ ID NO: 3598005 - RNA, 19 nt, Pseudomonas putida KT2440
gccgcugguagucauccuc

SEQ ID NO: 3598006 - RNA, 14 nt, Pseudomonas putida KT2440
gccgcugugccagc

SEQ ID NO: 3598007 - RNA, 16 nt, Pseudomonas putida KT2440
gccgcuguucagcccu

SEQ ID NO: 3598008 - RNA, 21 nt, Pseudomonas putida KT2440
gccgcuguugaucagguuacu

SEQ ID NO: 3598009 - RNA, 21 nt, Pseudomonas putida KT2440
gccgcuuacgaacggguuggc

SEQ ID NO: 3598010 - RNA, 17 nt, Pseudomonas putida KT2440
gccgcuucacuguccug

SEQ ID NO: 3598011 - RNA, 17 nt, Pseudomonas putida KT2440
gccgcuucgaccauugg

SEQ ID NO: 3598012 - RNA, 12 nt, Pseudomonas putida KT2440
gccgcuucgcga

SEQ ID NO: 3598013 - RNA, 15 nt, Pseudomonas putida KT2440
gccgcuucgcggcca

SEQ ID NO: 3598014 - RNA, 15 nt, Pseudomonas putida KT2440
gccgcuucggcaugc

SEQ ID NO: 3598015 - RNA, 20 nt, Pseudomonas putida KT2440
gccgcuucggcaugcacggc

SEQ ID NO: 3598016 - RNA, 14 nt, Pseudomonas putida KT2440
gccgcuucuggaca

SEQ ID NO: 3598017 - RNA, 19 nt, Pseudomonas putida KT2440
gccgcuugaucuuguccug

SEQ ID NO: 3598018 - RNA, 21 nt, Pseudomonas putida KT2440
gccgcuugaucuuguccugga

SEQ ID NO: 3598019 - RNA, 23 nt, Pseudomonas putida KT2440
gccgcuuucggucagggcgauga

SEQ ID NO: 3598020 - RNA, 15 nt, Pseudomonas putida KT2440
gccgcuuugcggccc

SEQ ID NO: 3598021 - RNA, 18 nt, Pseudomonas putida KT2440
gccgcuuugcggccccuu

SEQ ID NO: 3598022 - RNA, 17 nt, Pseudomonas putida KT2440
gccgcuuuggcagcagc

SEQ ID NO: 3598023 - RNA, 23 nt, Pseudomonas putida KT2440
gccggaacaaccccuugcucaac

SEQ ID NO: 3598024 - RNA, 16 nt, Pseudomonas putida KT2440
gccggaacguuuccag

SEQ ID NO: 3598025 - RNA, 18 nt, Pseudomonas putida KT2440
gccggaacguuuccagca

SEQ ID NO: 3598026 - RNA, 14 nt, Pseudomonas putida KT2440
gccggaagaucagg

SEQ ID NO: 3598027 - RNA, 14 nt, Pseudomonas putida KT2440
gccggacucacccg

SEQ ID NO: 3598028 - RNA, 15 nt, Pseudomonas putida KT2440
gccggacuucuucaa

SEQ ID NO: 3598029 - RNA, 22 nt, Pseudomonas putida KT2440
gccggacuucuucaacgcggcu

SEQ ID NO: 3598030 - RNA, 19 nt, Pseudomonas putida KT2440
gccggagaacaugaaagug

SEQ ID NO: 3598031 - RNA, 14 nt, Pseudomonas putida KT2440
gccggagcuggagc

SEQ ID NO: 3598032 - RNA, 23 nt, Pseudomonas putida KT2440
gccggaguggaagauggucucga

SEQ ID NO: 3598033 - RNA, 17 nt, Pseudomonas putida KT2440
gccggauagagcccggc

SEQ ID NO: 3598034 - RNA, 21 nt, Pseudomonas putida KT2440
gccggauagagcccggcgcag

SEQ ID NO: 3598035 - RNA, 22 nt, Pseudomonas putida KT2440
gccggauagagcccggcgcagc

SEQ ID NO: 3598036 - RNA, 13 nt, Pseudomonas putida KT2440
gccggaucuggca

SEQ ID NO: 3598037 - RNA, 19 nt, Pseudomonas putida KT2440
gccggauuucuuccauggc

SEQ ID NO: 3598038 - RNA, 22 nt, Pseudomonas putida KT2440
gccggauuucuuccauggccug

SEQ ID NO: 3598039 - RNA, 21 nt, Pseudomonas putida KT2440
gccggcaaacaaaaagcaccu

SEQ ID NO: 3598040 - RNA, 22 nt, Pseudomonas putida KT2440
gccggcaaacaaaaagcaccuc

SEQ ID NO: 3598041 - RNA, 16 nt, Pseudomonas putida KT2440
gccggcaaccccugca

SEQ ID NO: 3598042 - RNA, 17 nt, Pseudomonas putida KT2440
gccggcaaccccugcag

SEQ ID NO: 3598043 - RNA, 21 nt, Pseudomonas putida KT2440
gccggcaacgaacuugcggaa

SEQ ID NO: 3598044 - RNA, 18 nt, Pseudomonas putida KT2440
gccggcaacgauacccac

SEQ ID NO: 3598045 - RNA, 21 nt, Pseudomonas putida KT2440
gccggcaacuccuccagccga

SEQ ID NO: 3598046 - RNA, 22 nt, Pseudomonas putida KT2440
gccggcaacuccuccagccgac

SEQ ID NO: 3598047 - RNA, 19 nt, Pseudomonas putida KT2440
gccggcaagcuggucaggu

SEQ ID NO: 3598048 - RNA, 20 nt, Pseudomonas putida KT2440
gccggcaagcuggucaggug

SEQ ID NO: 3598049 - RNA, 14 nt, Pseudomonas putida KT2440
gccggcaauaccgg

SEQ ID NO: 3598050 - RNA, 23 nt, Pseudomonas putida KT2440
gccggcaauaccggccacgcgcg

SEQ ID NO: 3598051 - RNA, 22 nt, Pseudomonas putida KT2440
gccggcaauuuccugcgcggcc

SEQ ID NO: 3598052 - RNA, 21 nt, Pseudomonas putida KT2440
gccggcacagacaccgcaaau

SEQ ID NO: 3598053 - RNA, 16 nt, Pseudomonas putida KT2440
gccggcacagaccgca

SEQ ID NO: 3598054 - RNA, 21 nt, Pseudomonas putida KT2440
gccggcacagaccgcaacagu

SEQ ID NO: 3598055 - RNA, 17 nt, Pseudomonas putida KT2440
gccggcacaggaaggca

SEQ ID NO: 3598056 - RNA, 23 nt, Pseudomonas putida KT2440
gccggcacaggcuuacaacugcu

SEQ ID NO: 3598057 - RNA, 16 nt, Pseudomonas putida KT2440
gccggcaccgacagca

SEQ ID NO: 3598058 - RNA, 17 nt, Pseudomonas putida KT2440
gccggcaccgacagcaa

SEQ ID NO: 3598059 - RNA, 13 nt, Pseudomonas putida KT2440
gccggcaccgcca

SEQ ID NO: 3598060 - RNA, 17 nt, Pseudomonas putida KT2440
gccggcacgcuaccacc

SEQ ID NO: 3598061 - RNA, 16 nt, Pseudomonas putida KT2440
gccggcacugaccacu

SEQ ID NO: 3598062 - RNA, 13 nt, Pseudomonas putida KT2440
gccggcacuuccu

SEQ ID NO: 3598063 - RNA, 17 nt, Pseudomonas putida KT2440
gccggcacuuccucgug

SEQ ID NO: 3598064 - RNA, 15 nt, Pseudomonas putida KT2440
gccggcagcaaggca

SEQ ID NO: 3598065 - RNA, 19 nt, Pseudomonas putida KT2440
gccggcagcaaggcaucca

SEQ ID NO: 3598066 - RNA, 23 nt, Pseudomonas putida KT2440
gccggcagcgagcgcuggaucug

SEQ ID NO: 3598067 - RNA, 19 nt, Pseudomonas putida KT2440
gccggcagcgcggccgggu

SEQ ID NO: 3598068 - RNA, 17 nt, Pseudomonas putida KT2440
gccggcagcucgcgcug

SEQ ID NO: 3598069 - RNA, 20 nt, Pseudomonas putida KT2440
gccggcagcucgcgcugcgc

SEQ ID NO: 3598070 - RNA, 22 nt, Pseudomonas putida KT2440
gccggcagcucgcgcugcgcag

SEQ ID NO: 3598071 - RNA, 18 nt, Pseudomonas putida KT2440
gccggcaggcccggcccu

SEQ ID NO: 3598072 - RNA, 23 nt, Pseudomonas putida KT2440
gccggcaggcccggcccuuucgc

SEQ ID NO: 3598073 - RNA, 22 nt, Pseudomonas putida KT2440
gccggcaguccacuugcguucg

SEQ ID NO: 3598074 - RNA, 18 nt, Pseudomonas putida KT2440
gccggcauaacggcuggc

SEQ ID NO: 3598075 - RNA, 18 nt, Pseudomonas putida KT2440
gccggcauagauggcugu

SEQ ID NO: 3598076 - RNA, 13 nt, Pseudomonas putida KT2440
gccggcaucgcca

SEQ ID NO: 3598077 - RNA, 18 nt, Pseudomonas putida KT2440
gccggcaucgccuccagc

SEQ ID NO: 3598078 - RNA, 12 nt, Pseudomonas putida KT2440
gccggcauggcg

SEQ ID NO: 3598079 - RNA, 13 nt, Pseudomonas putida KT2440
gccggcauggcgg

SEQ ID NO: 3598080 - RNA, 17 nt, Pseudomonas putida KT2440
gccggcauggcgguggc

SEQ ID NO: 3598081 - RNA, 16 nt, Pseudomonas putida KT2440
gccggccaaggucagc

SEQ ID NO: 3598082 - RNA, 17 nt, Pseudomonas putida KT2440
gccggccaaggucagca

SEQ ID NO: 3598083 - RNA, 22 nt, Pseudomonas putida KT2440
gccggccaaggucagcaagccg

SEQ ID NO: 3598084 - RNA, 18 nt, Pseudomonas putida KT2440
gccggccaaguggccuug

SEQ ID NO: 3598085 - RNA, 15 nt, Pseudomonas putida KT2440
gccggccaccacacu

SEQ ID NO: 3598086 - RNA, 21 nt, Pseudomonas putida KT2440
gccggccaccacacuggucac

SEQ ID NO: 3598087 - RNA, 15 nt, Pseudomonas putida KT2440
gccggccagaccuug

SEQ ID NO: 3598088 - RNA, 16 nt, Pseudomonas putida KT2440
gccggccagcgccugc

SEQ ID NO: 3598089 - RNA, 17 nt, Pseudomonas putida KT2440
gccggccagcgccugca

SEQ ID NO: 3598090 - RNA, 16 nt, Pseudomonas putida KT2440
gccggccagcggcaug

SEQ ID NO: 3598091 - RNA, 14 nt, Pseudomonas putida KT2440
gccggccauaccgg

SEQ ID NO: 3598092 - RNA, 22 nt, Pseudomonas putida KT2440
gccggccauugccgcgccgcaa

SEQ ID NO: 3598093 - RNA, 17 nt, Pseudomonas putida KT2440
gccggcccaaggcacca

SEQ ID NO: 3598094 - RNA, 23 nt, Pseudomonas putida KT2440
gccggcccaaggcaccaacugca

SEQ ID NO: 3598095 - RNA, 14 nt, Pseudomonas putida KT2440
gccggccccggcaa

SEQ ID NO: 3598096 - RNA, 18 nt, Pseudomonas putida KT2440
gccggcccugcuggccaa

SEQ ID NO: 3598097 - RNA, 16 nt, Pseudomonas putida KT2440
gccggcccuuucgcgg

SEQ ID NO: 3598098 - RNA, 16 nt, Pseudomonas putida KT2440
gccggccgcacuucug

SEQ ID NO: 3598099 - RNA, 16 nt, Pseudomonas putida KT2440
gccggccucagcagcg

SEQ ID NO: 3598100 - RNA, 10 nt, Pseudomonas putida KT2440
gccggccucu

SEQ ID NO: 3598101 - RNA, 11 nt, Pseudomonas putida KT2440
gccggccucuu

SEQ ID NO: 3598102 - RNA, 15 nt, Pseudomonas putida KT2440
gccggccucuucgcg

SEQ ID NO: 3598103 - RNA, 15 nt, Pseudomonas putida KT2440
gccguaggccaggua

SEQ ID NO: 3598104 - RNA, 16 nt, Pseudomonas putida KT2440
gccguaggugaucagc

SEQ ID NO: 3598105 - RNA, 21 nt, Pseudomonas putida KT2440
gccguaguaagccagcccugc

SEQ ID NO: 3598106 - RNA, 19 nt, Pseudomonas putida KT2440
gccguaguaggagcggguu

SEQ ID NO: 3598107 - RNA, 17 nt, Pseudomonas putida KT2440
gccguaguccuuggugu

SEQ ID NO: 3598108 - RNA, 18 nt, Pseudomonas putida KT2440
gccguaguggcgccggau

SEQ ID NO: 3598109 - RNA, 21 nt, Pseudomonas putida KT2440
gccgucaacgaggccgccauu

SEQ ID NO: 3598110 - RNA, 21 nt, Pseudomonas putida KT2440
gccgucaccagcgucaccccu

SEQ ID NO: 3598111 - RNA, 14 nt, Pseudomonas putida KT2440
gccgucagcagcag

SEQ ID NO: 3598112 - RNA, 16 nt, Pseudomonas putida KT2440
gccgucagcagcaggc

SEQ ID NO: 3598113 - RNA, 17 nt, Pseudomonas putida KT2440
gccgucagcagcaggcg

SEQ ID NO: 3598114 - RNA, 24 nt, Pseudomonas putida KT2440
gccgucagcagcaggcgcgagccu

SEQ ID NO: 3598115 - RNA, 14 nt, Pseudomonas putida KT2440
gccguccaccaucu

SEQ ID NO: 3598116 - RNA, 19 nt, Pseudomonas putida KT2440
gccguccagcaggcuggcg

SEQ ID NO: 3598117 - RNA, 20 nt, Pseudomonas putida KT2440
gccguccagcugagcgccau

SEQ ID NO: 3598118 - RNA, 14 nt, Pseudomonas putida KT2440
gccguccaggaacg

SEQ ID NO: 3598119 - RNA, 20 nt, Pseudomonas putida KT2440
gccguccaggaacgcugccu

SEQ ID NO: 3598120 - RNA, 14 nt, Pseudomonas putida KT2440
gccguccaggucca

SEQ ID NO: 3598121 - RNA, 22 nt, Pseudomonas putida KT2440
gccguccagguccaggccagcu

SEQ ID NO: 3598122 - RNA, 16 nt, Pseudomonas putida KT2440
gccguccccaaccggg

SEQ ID NO: 3598123 - RNA, 22 nt, Pseudomonas putida KT2440
gccguccggcaaucugcccaca

SEQ ID NO: 3598124 - RNA, 17 nt, Pseudomonas putida KT2440
gccguccucgacccagu

SEQ ID NO: 3598125 - RNA, 21 nt, Pseudomonas putida KT2440
gccgucgaacguccgcucuuc

SEQ ID NO: 3598126 - RNA, 13 nt, Pseudomonas putida KT2440
gccgucgaugccu

SEQ ID NO: 3598127 - RNA, 19 nt, Pseudomonas putida KT2440
gccgucgaugccugugucg

SEQ ID NO: 3598128 - RNA, 16 nt, Pseudomonas putida KT2440
gccgucgccgcuucgg

SEQ ID NO: 3598129 - RNA, 17 nt, Pseudomonas putida KT2440
gccgucgccucccccuc

SEQ ID NO: 3598130 - RNA, 18 nt, Pseudomonas putida KT2440
gccgucgcgcccaccggu

SEQ ID NO: 3598131 - RNA, 17 nt, Pseudomonas putida KT2440
gccgucgggcacgauca

SEQ ID NO: 3598132 - RNA, 20 nt, Pseudomonas putida KT2440
gccgucgggcacgaucagca

SEQ ID NO: 3598133 - RNA, 14 nt, Pseudomonas putida KT2440
gccgucgguaaaca

SEQ ID NO: 3598134 - RNA, 21 nt, Pseudomonas putida KT2440
gccgucucgucacuggcugcu

SEQ ID NO: 3598135 - RNA, 16 nt, Pseudomonas putida KT2440
gccgucucugaccggc

SEQ ID NO: 3598136 - RNA, 22 nt, Pseudomonas putida KT2440
gccgucuucccauccacuucgc

SEQ ID NO: 3598137 - RNA, 15 nt, Pseudomonas putida KT2440
gccgucuuuuccgug

SEQ ID NO: 3598138 - RNA, 20 nt, Pseudomonas putida KT2440
gccgugaagaggccagugag

SEQ ID NO: 3598139 - RNA, 19 nt, Pseudomonas putida KT2440
gccgugaguggccucgaac

SEQ ID NO: 3598140 - RNA, 20 nt, Pseudomonas putida KT2440
gccgugaugguaucugccag

SEQ ID NO: 3598141 - RNA, 20 nt, Pseudomonas putida KT2440
gccgugcaggucagcguugc

SEQ ID NO: 3598142 - RNA, 22 nt, Pseudomonas putida KT2440
gccgugcauaagcgacacccug

SEQ ID NO: 3598143 - RNA, 24 nt, Pseudomonas putida KT2440
gccgugccagguguuugggcuuga

SEQ ID NO: 3598144 - RNA, 15 nt, Pseudomonas putida KT2440
gccgugccugggugg

SEQ ID NO: 3598145 - RNA, 12 nt, Pseudomonas putida KT2440
gccgugcggcca

SEQ ID NO: 3598146 - RNA, 16 nt, Pseudomonas putida KT2440
gccgugcucuucgugg

SEQ ID NO: 3598147 - RNA, 17 nt, Pseudomonas putida KT2440
gccgugcuugaggccgc

SEQ ID NO: 3598148 - RNA, 15 nt, Pseudomonas putida KT2440
gccguggcaacgcca

SEQ ID NO: 3598149 - RNA, 17 nt, Pseudomonas putida KT2440
gccguggcaaggcccgc

SEQ ID NO: 3598150 - RNA, 12 nt, Pseudomonas putida KT2440
gccguggcaggc

SEQ ID NO: 3598151 - RNA, 18 nt, Pseudomonas putida KT2440
gccguggcaggcaguucg

SEQ ID NO: 3598152 - RNA, 19 nt, Pseudomonas putida KT2440
gccguggccgccaugaucu

SEQ ID NO: 3598153 - RNA, 17 nt, Pseudomonas putida KT2440
gccguggguugaacagg

SEQ ID NO: 3598154 - RNA, 22 nt, Pseudomonas putida KT2440
gccgugguaucgcuuacagaug

SEQ ID NO: 3598155 - RNA, 14 nt, Pseudomonas putida KT2440
gccguggugccggu

SEQ ID NO: 3598156 - RNA, 19 nt, Pseudomonas putida KT2440
gccgugguucaucaccagc

SEQ ID NO: 3598157 - RNA, 20 nt, Pseudomonas putida KT2440
gccgugguucaucaccagcc

SEQ ID NO: 3598158 - RNA, 22 nt, Pseudomonas putida KT2440
gccgugguucaucaccagcccc

SEQ ID NO: 3598159 - RNA, 23 nt, Pseudomonas putida KT2440
gccguguucgacgaucgacuuca

SEQ ID NO: 3598160 - RNA, 17 nt, Pseudomonas putida KT2440
gccguugaggccgaaca

SEQ ID NO: 3598161 - RNA, 22 nt, Pseudomonas putida KT2440
gccguugauccaggcuuggcga

SEQ ID NO: 3598162 - RNA, 18 nt, Pseudomonas putida KT2440
gccguuguacaagcuggc

SEQ ID NO: 3598163 - RNA, 19 nt, Pseudomonas putida KT2440
gccguuguacaagcuggca

SEQ ID NO: 3598164 - RNA, 15 nt, Pseudomonas putida KT2440
gccguugucacgcgc

SEQ ID NO: 3598165 - RNA, 19 nt, Pseudomonas putida KT2440
gccguugucacgcgccagg

SEQ ID NO: 3598166 - RNA, 17 nt, Pseudomonas putida KT2440
gccguuguucacgguca

SEQ ID NO: 3598167 - RNA, 22 nt, Pseudomonas putida KT2440
gccguuguucacggucaggccu

SEQ ID NO: 3598168 - RNA, 17 nt, Pseudomonas putida KT2440
gccguuguucggcaaag

SEQ ID NO: 3598169 - RNA, 23 nt, Pseudomonas putida KT2440
gccguuguucggcaaaggccucu

SEQ ID NO: 3598170 - RNA, 22 nt, Pseudomonas putida KT2440
gccguuuauugguuugacgcug

SEQ ID NO: 3598171 - RNA, 16 nt, Pseudomonas putida KT2440
gccguuugcuggccug

SEQ ID NO: 3598172 - RNA, 18 nt, Pseudomonas putida KT2440
gccguuuuuuuugcccgu

SEQ ID NO: 3598173 - RNA, 17 nt, Pseudomonas putida KT2440
gccuaaaggcaugcguc

SEQ ID NO: 3598174 - RNA, 18 nt, Pseudomonas putida KT2440
gccuaagguugcuccugc

SEQ ID NO: 3598175 - RNA, 17 nt, Pseudomonas putida KT2440
gccuacaaagcgcucga

SEQ ID NO: 3598176 - RNA, 19 nt, Pseudomonas putida KT2440
gccuacaaagcgcucgaag

SEQ ID NO: 3598177 - RNA, 11 nt, Pseudomonas putida KT2440
gccuacaccgc

SEQ ID NO: 3598178 - RNA, 15 nt, Pseudomonas putida KT2440
gccuacagcggccug

SEQ ID NO: 3598179 - RNA, 21 nt, Pseudomonas putida KT2440
gccuacaggaaucugucagcc

SEQ ID NO: 3598180 - RNA, 15 nt, Pseudomonas putida KT2440
gccuacaggcaaccg

SEQ ID NO: 3598181 - RNA, 18 nt, Pseudomonas putida KT2440
gccuacaggcaaccgcau

SEQ ID NO: 3598182 - RNA, 19 nt, Pseudomonas putida KT2440
gccuacaggcaaccgcauc

SEQ ID NO: 3598183 - RNA, 12 nt, Pseudomonas putida KT2440
gccuacaggccc

SEQ ID NO: 3598184 - RNA, 14 nt, Pseudomonas putida KT2440
gccuaccaacgcag

SEQ ID NO: 3598185 - RNA, 16 nt, Pseudomonas putida KT2440
gccuaccaacgcagca

SEQ ID NO: 3598186 - RNA, 18 nt, Pseudomonas putida KT2440
gccuaccaccgcauccgc

SEQ ID NO: 3598187 - RNA, 21 nt, Pseudomonas putida KT2440
gccuacccgggcgcagggguc

SEQ ID NO: 3598188 - RNA, 11 nt, Pseudomonas putida KT2440
gccuaccgccc

SEQ ID NO: 3598189 - RNA, 23 nt, Pseudomonas putida KT2440
gccuaccgcccgcgcuucccggg

SEQ ID NO: 3598190 - RNA, 16 nt, Pseudomonas putida KT2440
gccuaccgcgucgcca

SEQ ID NO: 3598191 - RNA, 16 nt, Pseudomonas putida KT2440
gccuaccugaucaccg

SEQ ID NO: 3598192 - RNA, 16 nt, Pseudomonas putida KT2440
gccuacgacggccugc

SEQ ID NO: 3598193 - RNA, 13 nt, Pseudomonas putida KT2440
gccuacgccccca

SEQ ID NO: 3598194 - RNA, 16 nt, Pseudomonas putida KT2440
gccuacugcuggcgcg

SEQ ID NO: 3598195 - RNA, 20 nt, Pseudomonas putida KT2440
gccuacugcuggcgcgacca

SEQ ID NO: 3598196 - RNA, 14 nt, Pseudomonas putida KT2440
gccuagcaaggccu

SEQ ID NO: 3598197 - RNA, 16 nt, Pseudomonas putida KT2440
gccuagcaaggccucc

SEQ ID NO: 3598198 - RNA, 17 nt, Pseudomonas putida KT2440
gccuaucaggccuucgg

SEQ ID NO: 3598199 - RNA, 18 nt, Pseudomonas putida KT2440
gccuauccugugggagcg

SEQ ID NO: 3598200 - RNA, 14 nt, Pseudomonas putida KT2440
gccuaucucuucca

SEQ ID NO: 3598201 - RNA, 16 nt, Pseudomonas putida KT2440
gccuaucucuuccagc

SEQ ID NO: 3598202 - RNA, 22 nt, Pseudomonas putida KT2440
gccuaucucuuccagcgucucg

SEQ ID NO: 3598203 - RNA, 20 nt, Pseudomonas putida KT2440
gccuaugaaaccgagcgccg

SEQ ID NO: 3598204 - RNA, 21 nt, Pseudomonas putida KT2440
gccuaugaaaccgagcgccgc

SEQ ID NO: 3598205 - RNA, 17 nt, Pseudomonas putida KT2440
gccuauguacucggcgc

SEQ ID NO: 3598206 - RNA, 12 nt, Pseudomonas putida KT2440
gccucaaggccg

SEQ ID NO: 3598207 - RNA, 13 nt, Pseudomonas putida KT2440
gccucaaggccgg

SEQ ID NO: 3598208 - RNA, 16 nt, Pseudomonas putida KT2440
gccugacgggccucuu

SEQ ID NO: 3598209 - RNA, 17 nt, Pseudomonas putida KT2440
gccugacgggccucuuc

SEQ ID NO: 3598210 - RNA, 17 nt, Pseudomonas putida KT2440
gccugacucagcccuga

SEQ ID NO: 3598211 - RNA, 21 nt, Pseudomonas putida KT2440
gccugacucagcccugagggc

SEQ ID NO: 3598212 - RNA, 13 nt, Pseudomonas putida KT2440
gccugaggcccuc

SEQ ID NO: 3598213 - RNA, 21 nt, Pseudomonas putida KT2440
gccugagggucgugagccugc

SEQ ID NO: 3598214 - RNA, 16 nt, Pseudomonas putida KT2440
gccugaucaaagucgc

SEQ ID NO: 3598215 - RNA, 22 nt, Pseudomonas putida KT2440
gccugaucaagguuucagcagc

SEQ ID NO: 3598216 - RNA, 17 nt, Pseudomonas putida KT2440
gccugaugccucaucag

SEQ ID NO: 3598217 - RNA, 20 nt, Pseudomonas putida KT2440
gccugauuacccugcgccag

SEQ ID NO: 3598218 - RNA, 21 nt, Pseudomonas putida KT2440
gccugauuacccugcgccagg

SEQ ID NO: 3598219 - RNA, 17 nt, Pseudomonas putida KT2440
gccugauugccuggcuu

SEQ ID NO: 3598220 - RNA, 19 nt, Pseudomonas putida KT2440
gccugauuggcaucgcugc

SEQ ID NO: 3598221 - RNA, 14 nt, Pseudomonas putida KT2440
gccugcaagccggc

SEQ ID NO: 3598222 - RNA, 20 nt, Pseudomonas putida KT2440
gccugcaagccggcgaacag

SEQ ID NO: 3598223 - RNA, 23 nt, Pseudomonas putida KT2440
gccugcaagccggcgaacagcac

SEQ ID NO: 3598224 - RNA, 18 nt, Pseudomonas putida KT2440
gccugcaagucaggcgaa

SEQ ID NO: 3598225 - RNA, 15 nt, Pseudomonas putida KT2440
gccugcaccaguucc

SEQ ID NO: 3598226 - RNA, 13 nt, Pseudomonas putida KT2440
gccugcacccagc

SEQ ID NO: 3598227 - RNA, 14 nt, Pseudomonas putida KT2440
gccugcacccgcgc

SEQ ID NO: 3598228 - RNA, 20 nt, Pseudomonas putida KT2440
gccugcacccgcgcgcccgc

SEQ ID NO: 3598229 - RNA, 13 nt, Pseudomonas putida KT2440
gccugcaccuggc

SEQ ID NO: 3598230 - RNA, 14 nt, Pseudomonas putida KT2440
gccugcaccuggcu

SEQ ID NO: 3598231 - RNA, 16 nt, Pseudomonas putida KT2440
gccugcacgaucgacc

SEQ ID NO: 3598232 - RNA, 22 nt, Pseudomonas putida KT2440
gccugcacgaucgaccggguaa

SEQ ID NO: 3598233 - RNA, 13 nt, Pseudomonas putida KT2440
gccugcacggcaa

SEQ ID NO: 3598234 - RNA, 20 nt, Pseudomonas putida KT2440
gccugcacuaccucgcucag

SEQ ID NO: 3598235 - RNA, 24 nt, Pseudomonas putida KT2440
gccugcacuaccucgcucaggcca

SEQ ID NO: 3598236 - RNA, 15 nt, Pseudomonas putida KT2440
gccugcacugcaccc

SEQ ID NO: 3598237 - RNA, 17 nt, Pseudomonas putida KT2440
gccugcacuggccucuu

SEQ ID NO: 3598238 - RNA, 21 nt, Pseudomonas putida KT2440
gccugcacuggccucuucgcg

SEQ ID NO: 3598239 - RNA, 14 nt, Pseudomonas putida KT2440
gccugcagcacccu

SEQ ID NO: 3598240 - RNA, 12 nt, Pseudomonas putida KT2440
gccugcagcccg

SEQ ID NO: 3598241 - RNA, 18 nt, Pseudomonas putida KT2440
gccugcagccguugcugg

SEQ ID NO: 3598242 - RNA, 19 nt, Pseudomonas putida KT2440
gccugcagccguugcuggg

SEQ ID NO: 3598243 - RNA, 17 nt, Pseudomonas putida KT2440
gccugcaggcccaggug

SEQ ID NO: 3598244 - RNA, 14 nt, Pseudomonas putida KT2440
gccugcaggcugcc

SEQ ID NO: 3598245 - RNA, 16 nt, Pseudomonas putida KT2440
gccugcagggccugga

SEQ ID NO: 3598246 - RNA, 23 nt, Pseudomonas putida KT2440
gccugcagucgaucccgagguca

SEQ ID NO: 3598247 - RNA, 15 nt, Pseudomonas putida KT2440
gccugcaguucgcug

SEQ ID NO: 3598248 - RNA, 19 nt, Pseudomonas putida KT2440
gccugcauccacaccagcg

SEQ ID NO: 3598249 - RNA, 21 nt, Pseudomonas putida KT2440
gccugcauccacaccagcggc

SEQ ID NO: 3598250 - RNA, 11 nt, Pseudomonas putida KT2440
gccugcaugcg

SEQ ID NO: 3598251 - RNA, 18 nt, Pseudomonas putida KT2440
gccugcaugcucaucgcg

SEQ ID NO: 3598252 - RNA, 15 nt, Pseudomonas putida KT2440
gccugcaugucggca

SEQ ID NO: 3598253 - RNA, 22 nt, Pseudomonas putida KT2440
gccugcauucaaagcuuucugg

SEQ ID NO: 3598254 - RNA, 14 nt, Pseudomonas putida KT2440
gccugccaaauccc

SEQ ID NO: 3598255 - RNA, 17 nt, Pseudomonas putida KT2440
gccugccaaaucccuuu

SEQ ID NO: 3598256 - RNA, 13 nt, Pseudomonas putida KT2440
gccugccagguca

SEQ ID NO: 3598257 - RNA, 14 nt, Pseudomonas putida KT2440
gccugccagguccg

SEQ ID NO: 3598258 - RNA, 22 nt, Pseudomonas putida KT2440
gccugcccgccccccaccuggc

SEQ ID NO: 3598259 - RNA, 12 nt, Pseudomonas putida KT2440
gccugcccgccg

SEQ ID NO: 3598260 - RNA, 18 nt, Pseudomonas putida KT2440
gccugcccgccguccagc

SEQ ID NO: 3598261 - RNA, 16 nt, Pseudomonas putida KT2440
gccugcccgguacgca

SEQ ID NO: 3598262 - RNA, 17 nt, Pseudomonas putida KT2440
gccugccgggccagggu

SEQ ID NO: 3598263 - RNA, 17 nt, Pseudomonas putida KT2440
gccugccgggucaaggc

SEQ ID NO: 3598264 - RNA, 21 nt, Pseudomonas putida KT2440
gccugccgggucaaggccagc

SEQ ID NO: 3598265 - RNA, 14 nt, Pseudomonas putida KT2440
gccugccuggcccu

SEQ ID NO: 3598266 - RNA, 15 nt, Pseudomonas putida KT2440
gccugcgaaaggcgc

SEQ ID NO: 3598267 - RNA, 16 nt, Pseudomonas putida KT2440
gccugcgaauggccgc

SEQ ID NO: 3598268 - RNA, 20 nt, Pseudomonas putida KT2440
gccugcgaauggccgcaacc

SEQ ID NO: 3598269 - RNA, 16 nt, Pseudomonas putida KT2440
gccugcgcacggcgcu

SEQ ID NO: 3598270 - RNA, 22 nt, Pseudomonas putida KT2440
gccugcgcacggcgcugggaca

SEQ ID NO: 3598271 - RNA, 23 nt, Pseudomonas putida KT2440
gccugcgcaggcgccgccagcug

SEQ ID NO: 3598272 - RNA, 16 nt, Pseudomonas putida KT2440
gccugcgccagugccu

SEQ ID NO: 3598273 - RNA, 15 nt, Pseudomonas putida KT2440
gccugcgcccaauca

SEQ ID NO: 3598274 - RNA, 16 nt, Pseudomonas putida KT2440
gccugcgcccaaucac

SEQ ID NO: 3598275 - RNA, 17 nt, Pseudomonas putida KT2440
gccugcgcuccagcagc

SEQ ID NO: 3598276 - RNA, 16 nt, Pseudomonas putida KT2440
gccugcggcaccgucg

SEQ ID NO: 3598277 - RNA, 16 nt, Pseudomonas putida KT2440
gccugcggcagccagc

SEQ ID NO: 3598278 - RNA, 17 nt, Pseudomonas putida KT2440
gccugcggcagccagca

SEQ ID NO: 3598279 - RNA, 15 nt, Pseudomonas putida KT2440
gccugcggccaggcc

SEQ ID NO: 3598280 - RNA, 18 nt, Pseudomonas putida KT2440
gccugcgggaaguccgcc

SEQ ID NO: 3598281 - RNA, 22 nt, Pseudomonas putida KT2440
gccugcgggugccguggguuga

SEQ ID NO: 3598282 - RNA, 14 nt, Pseudomonas putida KT2440
gccugcuaauauua

SEQ ID NO: 3598283 - RNA, 18 nt, Pseudomonas putida KT2440
gccugcucacccgaccag

SEQ ID NO: 3598284 - RNA, 13 nt, Pseudomonas putida KT2440
gccugcucaucca

SEQ ID NO: 3598285 - RNA, 14 nt, Pseudomonas putida KT2440
gccugcucauccac

SEQ ID NO: 3598286 - RNA, 12 nt, Pseudomonas putida KT2440
gccugcuccagc

SEQ ID NO: 3598287 - RNA, 14 nt, Pseudomonas putida KT2440
gccugcuccagcac

SEQ ID NO: 3598288 - RNA, 15 nt, Pseudomonas putida KT2440
gccugcuccagcacc

SEQ ID NO: 3598289 - RNA, 20 nt, Pseudomonas putida KT2440
gccugcuccagcacccgcuu

SEQ ID NO: 3598290 - RNA, 21 nt, Pseudomonas putida KT2440
gccugcuccggaauccgcaca

SEQ ID NO: 3598291 - RNA, 14 nt, Pseudomonas putida KT2440
gccugcuccucacu

SEQ ID NO: 3598292 - RNA, 15 nt, Pseudomonas putida KT2440
gccugcucgcuggcu

SEQ ID NO: 3598293 - RNA, 17 nt, Pseudomonas putida KT2440
gccugcucgcuggcuug

SEQ ID NO: 3598294 - RNA, 14 nt, Pseudomonas putida KT2440
gccugcugacgcag

SEQ ID NO: 3598295 - RNA, 16 nt, Pseudomonas putida KT2440
gccugcugcaacagcu

SEQ ID NO: 3598296 - RNA, 15 nt, Pseudomonas putida KT2440
gccugcugcagcucg

SEQ ID NO: 3598297 - RNA, 13 nt, Pseudomonas putida KT2440
gccugcugccagg

SEQ ID NO: 3598298 - RNA, 14 nt, Pseudomonas putida KT2440
gccugcugccaggc

SEQ ID NO: 3598299 - RNA, 15 nt, Pseudomonas putida KT2440
gccugcugcucccca

SEQ ID NO: 3598300 - RNA, 14 nt, Pseudomonas putida KT2440
gccugcuggccgcg

SEQ ID NO: 3598301 - RNA, 15 nt, Pseudomonas putida KT2440
gccugcuggcgaaga

SEQ ID NO: 3598302 - RNA, 17 nt, Pseudomonas putida KT2440
gccugcuggcgaagagu

SEQ ID NO: 3598303 - RNA, 23 nt, Pseudomonas putida KT2440
gccugcugguacagccggcugcg

SEQ ID NO: 3598304 - RNA, 23 nt, Pseudomonas putida KT2440
gccugcuuggcaccuaucgcugc

SEQ ID NO: 3598305 - RNA, 13 nt, Pseudomonas putida KT2440
gccugcuuggccg

SEQ ID NO: 3598306 - RNA, 18 nt, Pseudomonas putida KT2440
gccuggauauccagugcu

SEQ ID NO: 3598307 - RNA, 19 nt, Pseudomonas putida KT2440
gccuggaugcgggcuuucc

SEQ ID NO: 3598308 - RNA, 15 nt, Pseudomonas putida KT2440
gccuggccacuguug

SEQ ID NO: 3598309 - RNA, 23 nt, Pseudomonas putida KT2440
gccuggccacuguugcagcgcca

SEQ ID NO: 3598310 - RNA, 20 nt, Pseudomonas putida KT2440
gccuggccauaguugaccag

SEQ ID NO: 3598311 - RNA, 16 nt, Pseudomonas putida KT2440
gccuggcccgcagcgc

SEQ ID NO: 3598312 - RNA, 15 nt, Pseudomonas putida KT2440
gccuggcccggugca

SEQ ID NO: 3598313 - RNA, 23 nt, Pseudomonas putida KT2440
gccuggccgguguggccaaggcg

SEQ ID NO: 3598314 - RNA, 14 nt, Pseudomonas putida KT2440
gccuugcccagcuc

SEQ ID NO: 3598315 - RNA, 16 nt, Pseudomonas putida KT2440
gccuugcccagcucca

SEQ ID NO: 3598316 - RNA, 17 nt, Pseudomonas putida KT2440
gccuugcccagcuccag

SEQ ID NO: 3598317 - RNA, 18 nt, Pseudomonas putida KT2440
gccuugcccagcuccagc

SEQ ID NO: 3598318 - RNA, 18 nt, Pseudomonas putida KT2440
gccuugcccgaagccacg

SEQ ID NO: 3598319 - RNA, 15 nt, Pseudomonas putida KT2440
gccuugcccugcagc

SEQ ID NO: 3598320 - RNA, 16 nt, Pseudomonas putida KT2440
gccuugccgcucacca

SEQ ID NO: 3598321 - RNA, 18 nt, Pseudomonas putida KT2440
gccuugccgcuggcgaug

SEQ ID NO: 3598322 - RNA, 17 nt, Pseudomonas putida KT2440
gccuugcgauaccccgc

SEQ ID NO: 3598323 - RNA, 16 nt, Pseudomonas putida KT2440
gccuugcgcacgccgg

SEQ ID NO: 3598324 - RNA, 13 nt, Pseudomonas putida KT2440
gccuugcgccagg

SEQ ID NO: 3598325 - RNA, 14 nt, Pseudomonas putida KT2440
gccuugcgcugggc

SEQ ID NO: 3598326 - RNA, 15 nt, Pseudomonas putida KT2440
gccuugcgcugggca

SEQ ID NO: 3598327 - RNA, 22 nt, Pseudomonas putida KT2440
gccuugcgucgcgaugggcugc

SEQ ID NO: 3598328 - RNA, 17 nt, Pseudomonas putida KT2440
gccuugcuccaguucau

SEQ ID NO: 3598329 - RNA, 12 nt, Pseudomonas putida KT2440
gccuugcugauc

SEQ ID NO: 3598330 - RNA, 19 nt, Pseudomonas putida KT2440
gccuuggacaccaggcugg

SEQ ID NO: 3598331 - RNA, 22 nt, Pseudomonas putida KT2440
gccuuggacaccaggcugguga

SEQ ID NO: 3598332 - RNA, 19 nt, Pseudomonas putida KT2440
gccuuggcagccgcguccu

SEQ ID NO: 3598333 - RNA, 19 nt, Pseudomonas putida KT2440
gccuuggcauagcgcucgc

SEQ ID NO: 3598334 - RNA, 21 nt, Pseudomonas putida KT2440
gccuuggcauagcgcucgcgc

SEQ ID NO: 3598335 - RNA, 14 nt, Pseudomonas putida KT2440
gccuuggccaccuc

SEQ ID NO: 3598336 - RNA, 13 nt, Pseudomonas putida KT2440
gccuuggccagcg

SEQ ID NO: 3598337 - RNA, 16 nt, Pseudomonas putida KT2440
gccuuggccagcguca

SEQ ID NO: 3598338 - RNA, 21 nt, Pseudomonas putida KT2440
gccuuggccagcucauccagc

SEQ ID NO: 3598339 - RNA, 22 nt, Pseudomonas putida KT2440
gccuuggccaucacuucacggg

SEQ ID NO: 3598340 - RNA, 19 nt, Pseudomonas putida KT2440
gccuuggccgcuggcccuu

SEQ ID NO: 3598341 - RNA, 13 nt, Pseudomonas putida KT2440
gccuuggccucgc

SEQ ID NO: 3598342 - RNA, 21 nt, Pseudomonas putida KT2440
gccuuggccucgcugaccagu

SEQ ID NO: 3598343 - RNA, 14 nt, Pseudomonas putida KT2440
gccuuggccuggcg

SEQ ID NO: 3598344 - RNA, 15 nt, Pseudomonas putida KT2440
gccuuggccuggcga

SEQ ID NO: 3598345 - RNA, 16 nt, Pseudomonas putida KT2440
gccuuggccuggcgag

SEQ ID NO: 3598346 - RNA, 13 nt, Pseudomonas putida KT2440
gccuuggccuggg

SEQ ID NO: 3598347 - RNA, 17 nt, Pseudomonas putida KT2440
gccuuggcgcagcaagg

SEQ ID NO: 3598348 - RNA, 22 nt, Pseudomonas putida KT2440
gccuuggcgccggacuucuuca

SEQ ID NO: 3598349 - RNA, 21 nt, Pseudomonas putida KT2440
gccuuggcucgacacgcuugc

SEQ ID NO: 3598350 - RNA, 19 nt, Pseudomonas putida KT2440
gccuugggcaacaccgcca

SEQ ID NO: 3598351 - RNA, 14 nt, Pseudomonas putida KT2440
gccuuggucucgau

SEQ ID NO: 3598352 - RNA, 16 nt, Pseudomonas putida KT2440
gccuuguccgucagaa

SEQ ID NO: 3598353 - RNA, 19 nt, Pseudomonas putida KT2440
gccuugucggcacgcgcca

SEQ ID NO: 3598354 - RNA, 23 nt, Pseudomonas putida KT2440
gccuugucucugaacacaugcca

SEQ ID NO: 3598355 - RNA, 15 nt, Pseudomonas putida KT2440
gccuugucuggcacc

SEQ ID NO: 3598356 - RNA, 16 nt, Pseudomonas putida KT2440
gccuugugcugcgaag

SEQ ID NO: 3598357 - RNA, 22 nt, Pseudomonas putida KT2440
gccuugugggagcgggacugcc

SEQ ID NO: 3598358 - RNA, 21 nt, Pseudomonas putida KT2440
gccuuguuuguacggcgcaau

SEQ ID NO: 3598359 - RNA, 15 nt, Pseudomonas putida KT2440
gccuuucgcgccagu

SEQ ID NO: 3598360 - RNA, 15 nt, Pseudomonas putida KT2440
gccuuucugcuucca

SEQ ID NO: 3598361 - RNA, 17 nt, Pseudomonas putida KT2440
gccuuucugcuucgcug

SEQ ID NO: 3598362 - RNA, 18 nt, Pseudomonas putida KT2440
gccuuugaaaccggcaaa

SEQ ID NO: 3598363 - RNA, 15 nt, Pseudomonas putida KT2440
gccuuuggccgccag

SEQ ID NO: 3598364 - RNA, 14 nt, Pseudomonas putida KT2440
gccuuuuccagcuc

SEQ ID NO: 3598365 - RNA, 14 nt, Pseudomonas putida KT2440
gccuuuucgaacaa

SEQ ID NO: 3598366 - RNA, 18 nt, Pseudomonas putida KT2440
gccuuuucgcggguaaac

SEQ ID NO: 3598367 - RNA, 22 nt, Pseudomonas putida KT2440
gccuuuuuuccaguuggcaggg

SEQ ID NO: 3598368 - RNA, 19 nt, Pseudomonas putida KT2440
gccuuuuuucgggcugcug

SEQ ID NO: 3598369 - RNA, 16 nt, Pseudomonas putida KT2440
gccuuuuuuugccgca

SEQ ID NO: 3598370 - RNA, 22 nt, Pseudomonas putida KT2440
gcgaaacaaucggugccggcga

SEQ ID NO: 3598371 - RNA, 23 nt, Pseudomonas putida KT2440
gcgaaacacagcaggccaaggaa

SEQ ID NO: 3598372 - RNA, 18 nt, Pseudomonas putida KT2440
gcgaaacccggcgcagcg

SEQ ID NO: 3598373 - RNA, 23 nt, Pseudomonas putida KT2440
gcgaaacccucacgcgccagguc

SEQ ID NO: 3598374 - RNA, 23 nt, Pseudomonas putida KT2440
gcgaaacgaaacccugcugggcg

SEQ ID NO: 3598375 - RNA, 21 nt, Pseudomonas putida KT2440
gcgaaacgcggcaaccugcac

SEQ ID NO: 3598376 - RNA, 17 nt, Pseudomonas putida KT2440
gcgaaagggccagcaca

SEQ ID NO: 3598377 - RNA, 22 nt, Pseudomonas putida KT2440
gcgaaagggccgcaaggccgcu

SEQ ID NO: 3598378 - RNA, 23 nt, Pseudomonas putida KT2440
gcgaaagggccgcaaggccgcuc

SEQ ID NO: 3598379 - RNA, 14 nt, Pseudomonas putida KT2440
gcgaaagggccggg

SEQ ID NO: 3598380 - RNA, 15 nt, Pseudomonas putida KT2440
gcgaaagggccgggc

SEQ ID NO: 3598381 - RNA, 13 nt, Pseudomonas putida KT2440
gcgaaauacccaa

SEQ ID NO: 3598382 - RNA, 18 nt, Pseudomonas putida KT2440
gcgaacaaggcucagcug

SEQ ID NO: 3598383 - RNA, 13 nt, Pseudomonas putida KT2440
gcgaacacugacu

SEQ ID NO: 3598384 - RNA, 17 nt, Pseudomonas putida KT2440
gcgaacacuuggcagcc

SEQ ID NO: 3598385 - RNA, 18 nt, Pseudomonas putida KT2440
gcgaacacuuggcagccu

SEQ ID NO: 3598386 - RNA, 16 nt, Pseudomonas putida KT2440
gcgaacagcacugcca

SEQ ID NO: 3598387 - RNA, 18 nt, Pseudomonas putida KT2440
gcgaacagcacugccagc

SEQ ID NO: 3598388 - RNA, 13 nt, Pseudomonas putida KT2440
gcgaacaggcccu

SEQ ID NO: 3598389 - RNA, 20 nt, Pseudomonas putida KT2440
gcgaacaggcccugacaggc

SEQ ID NO: 3598390 - RNA, 17 nt, Pseudomonas putida KT2440
gcgaacaggccugucac

SEQ ID NO: 3598391 - RNA, 21 nt, Pseudomonas putida KT2440
gcgaaccaggugcgguccggc

SEQ ID NO: 3598392 - RNA, 20 nt, Pseudomonas putida KT2440
gcgaacggacaacaccguug

SEQ ID NO: 3598393 - RNA, 14 nt, Pseudomonas putida KT2440
gcgaagaagacacc

SEQ ID NO: 3598394 - RNA, 15 nt, Pseudomonas putida KT2440
gcgaagaccgccgcc

SEQ ID NO: 3598395 - RNA, 16 nt, Pseudomonas putida KT2440
gcgaagaggccagcac

SEQ ID NO: 3598396 - RNA, 23 nt, Pseudomonas putida KT2440
gcgaagaggccaguaccagcagc

SEQ ID NO: 3598397 - RNA, 18 nt, Pseudomonas putida KT2440
gcgaagaggccccgacag

SEQ ID NO: 3598398 - RNA, 16 nt, Pseudomonas putida KT2440
gcgaagaggcccgaac

SEQ ID NO: 3598399 - RNA, 17 nt, Pseudomonas putida KT2440
gcgaagaggccggcaca

SEQ ID NO: 3598400 - RNA, 15 nt, Pseudomonas putida KT2440
gcgaagagggcgaca

SEQ ID NO: 3598401 - RNA, 19 nt, Pseudomonas putida KT2440
gcgaagagguccugacagg

SEQ ID NO: 3598402 - RNA, 20 nt, Pseudomonas putida KT2440
gcgaagaugcguucggcauc

SEQ ID NO: 3598403 - RNA, 15 nt, Pseudomonas putida KT2440
gcgaagcaagcgcau

SEQ ID NO: 3598404 - RNA, 14 nt, Pseudomonas putida KT2440
gcgaagcaggcugc

SEQ ID NO: 3598405 - RNA, 19 nt, Pseudomonas putida KT2440
gcgaagcccaguucgcggg

SEQ ID NO: 3598406 - RNA, 17 nt, Pseudomonas putida KT2440
gcgaagcccguggcccu

SEQ ID NO: 3598407 - RNA, 16 nt, Pseudomonas putida KT2440
gcgaagcggccccaau

SEQ ID NO: 3598408 - RNA, 13 nt, Pseudomonas putida KT2440
gcgaagcggcggg

SEQ ID NO: 3598409 - RNA, 12 nt, Pseudomonas putida KT2440
gcgaaggcugcc

SEQ ID NO: 3598410 - RNA, 18 nt, Pseudomonas putida KT2440
gcgaagggcucaacgcca

SEQ ID NO: 3598411 - RNA, 14 nt, Pseudomonas putida KT2440
gcgaagggcugccg

SEQ ID NO: 3598412 - RNA, 17 nt, Pseudomonas putida KT2440
gcgaaggggccggcccu

SEQ ID NO: 3598413 - RNA, 20 nt, Pseudomonas putida KT2440
gcgaaggucagagcaaccag

SEQ ID NO: 3598414 - RNA, 18 nt, Pseudomonas putida KT2440
gcgaagucacaccaucgg

SEQ ID NO: 3598415 - RNA, 19 nt, Pseudomonas putida KT2440
gcgaagucacaccaucggc

SEQ ID NO: 3598416 - RNA, 16 nt, Pseudomonas putida KT2440
gcgaagucagguaggu

SEQ ID NO: 3598417 - RNA, 19 nt, Pseudomonas putida KT2440
gcgaaguuggucccugacu

SEQ ID NO: 3598418 - RNA, 15 nt, Pseudomonas putida KT2440
gcgaauacgauagcg

SEQ ID NO: 3598419 - RNA, 14 nt, Pseudomonas putida KT2440
gcgagcuaccugac

SEQ ID NO: 3598420 - RNA, 18 nt, Pseudomonas putida KT2440
gcgagcugucgcgccagu

SEQ ID NO: 3598421 - RNA, 15 nt, Pseudomonas putida KT2440
gcgagcuugcucgcg

SEQ ID NO: 3598422 - RNA, 16 nt, Pseudomonas putida KT2440
gcgaggaaacccgcgc

SEQ ID NO: 3598423 - RNA, 15 nt, Pseudomonas putida KT2440
gcgaggacagcaucu

SEQ ID NO: 3598424 - RNA, 16 nt, Pseudomonas putida KT2440
gcgaggaucagcgcau

SEQ ID NO: 3598425 - RNA, 12 nt, Pseudomonas putida KT2440
gcgagggcauca

SEQ ID NO: 3598426 - RNA, 16 nt, Pseudomonas putida KT2440
gcgaggguuccaggcc

SEQ ID NO: 3598427 - RNA, 16 nt, Pseudomonas putida KT2440
gcgaguaaagccagca

SEQ ID NO: 3598428 - RNA, 18 nt, Pseudomonas putida KT2440
gcgaguaaagccagcagc

SEQ ID NO: 3598429 - RNA, 19 nt, Pseudomonas putida KT2440
gcgaguaaagccagcagcc

SEQ ID NO: 3598430 - RNA, 20 nt, Pseudomonas putida KT2440
gcgaguaaagccagcagccu

SEQ ID NO: 3598431 - RNA, 20 nt, Pseudomonas putida KT2440
gcgaguagaagcuuggggcg

SEQ ID NO: 3598432 - RNA, 20 nt, Pseudomonas putida KT2440
gcgaguagaucaucagcgcc

SEQ ID NO: 3598433 - RNA, 12 nt, Pseudomonas putida KT2440
gcgagucaggcu

SEQ ID NO: 3598434 - RNA, 16 nt, Pseudomonas putida KT2440
gcgagucaggcugcac

SEQ ID NO: 3598435 - RNA, 22 nt, Pseudomonas putida KT2440
gcgagucaggcugcacaaggug

SEQ ID NO: 3598436 - RNA, 14 nt, Pseudomonas putida KT2440
gcgagucagggcuu

SEQ ID NO: 3598437 - RNA, 16 nt, Pseudomonas putida KT2440
gcgaguccuccaacuc

SEQ ID NO: 3598438 - RNA, 14 nt, Pseudomonas putida KT2440
gcgaguccugccuu

SEQ ID NO: 3598439 - RNA, 13 nt, Pseudomonas putida KT2440
gcgaguggccacg

SEQ ID NO: 3598440 - RNA, 16 nt, Pseudomonas putida KT2440
gcgaguggucggcgua

SEQ ID NO: 3598441 - RNA, 15 nt, Pseudomonas putida KT2440
gcgaguucaggcgcc

SEQ ID NO: 3598442 - RNA, 19 nt, Pseudomonas putida KT2440
gcgaguucaggcgcccugc

SEQ ID NO: 3598443 - RNA, 22 nt, Pseudomonas putida KT2440
gcgaguucaggcgcccugcgcc

SEQ ID NO: 3598444 - RNA, 14 nt, Pseudomonas putida KT2440
gcgaguucgagucu

SEQ ID NO: 3598445 - RNA, 14 nt, Pseudomonas putida KT2440
gcgauaaaccagca

SEQ ID NO: 3598446 - RNA, 22 nt, Pseudomonas putida KT2440
gcgauaaaccagcagcgccugc

SEQ ID NO: 3598447 - RNA, 18 nt, Pseudomonas putida KT2440
gcgauacccaauaaaaac

SEQ ID NO: 3598448 - RNA, 15 nt, Pseudomonas putida KT2440
gcgauaccgccaucg

SEQ ID NO: 3598449 - RNA, 15 nt, Pseudomonas putida KT2440
gcgauacucaccgcc

SEQ ID NO: 3598450 - RNA, 20 nt, Pseudomonas putida KT2440
gcgauagauguccagcgucu

SEQ ID NO: 3598451 - RNA, 16 nt, Pseudomonas putida KT2440
gcgauagccugugggg

SEQ ID NO: 3598452 - RNA, 17 nt, Pseudomonas putida KT2440
gcgauagggaacagggc

SEQ ID NO: 3598453 - RNA, 15 nt, Pseudomonas putida KT2440
gcgauaucagcgcca

SEQ ID NO: 3598454 - RNA, 16 nt, Pseudomonas putida KT2440
gcgauaucccaacgca

SEQ ID NO: 3598455 - RNA, 20 nt, Pseudomonas putida KT2440
gcgaucaacgaaaucauguu

SEQ ID NO: 3598456 - RNA, 19 nt, Pseudomonas putida KT2440
gcgaucaaugggccgauca

SEQ ID NO: 3598457 - RNA, 22 nt, Pseudomonas putida KT2440
gcgaucacauaaggcagcagcu

SEQ ID NO: 3598458 - RNA, 17 nt, Pseudomonas putida KT2440
gcgaucacgcaggccca

SEQ ID NO: 3598459 - RNA, 20 nt, Pseudomonas putida KT2440
gcgaucacgcaggcccagca

SEQ ID NO: 3598460 - RNA, 14 nt, Pseudomonas putida KT2440
gcgaucagcgcggu

SEQ ID NO: 3598461 - RNA, 14 nt, Pseudomonas putida KT2440
gcgaucaggcaggc

SEQ ID NO: 3598462 - RNA, 15 nt, Pseudomonas putida KT2440
gcgaucaggcaggcc

SEQ ID NO: 3598463 - RNA, 20 nt, Pseudomonas putida KT2440
gcgaucaggcaggccagcac

SEQ ID NO: 3598464 - RNA, 13 nt, Pseudomonas putida KT2440
gcgaucagugccu

SEQ ID NO: 3598465 - RNA, 13 nt, Pseudomonas putida KT2440
gcgaucaguuccg

SEQ ID NO: 3598466 - RNA, 17 nt, Pseudomonas putida KT2440
gcgauccaggaucacgu

SEQ ID NO: 3598467 - RNA, 17 nt, Pseudomonas putida KT2440
gcgaucccugugggagc

SEQ ID NO: 3598468 - RNA, 21 nt, Pseudomonas putida KT2440
gcgaucgaaaggcgacuccug

SEQ ID NO: 3598469 - RNA, 19 nt, Pseudomonas putida KT2440
gcgaucgaacaacuguccu

SEQ ID NO: 3598470 - RNA, 17 nt, Pseudomonas putida KT2440
gcgaucgaacgcuugcc

SEQ ID NO: 3598471 - RNA, 19 nt, Pseudomonas putida KT2440
gcgaucgaacgcuugcccg

SEQ ID NO: 3598472 - RNA, 13 nt, Pseudomonas putida KT2440
gcgaucgccaggu

SEQ ID NO: 3598473 - RNA, 20 nt, Pseudomonas putida KT2440
gcgaucgccagguggaagcg

SEQ ID NO: 3598474 - RNA, 23 nt, Pseudomonas putida KT2440
gcgaucgccagguggaagcgcgc

SEQ ID NO: 3598475 - RNA, 15 nt, Pseudomonas putida KT2440
gcgaucggcagcgau

SEQ ID NO: 3598476 - RNA, 14 nt, Pseudomonas putida KT2440
gcgaucggcugguc

SEQ ID NO: 3598477 - RNA, 16 nt, Pseudomonas putida KT2440
gcgaucggcugguccg

SEQ ID NO: 3598478 - RNA, 17 nt, Pseudomonas putida KT2440
gcgaucggcugguccgg

SEQ ID NO: 3598479 - RNA, 15 nt, Pseudomonas putida KT2440
gcgaucuccugcagg

SEQ ID NO: 3598480 - RNA, 16 nt, Pseudomonas putida KT2440
gcgaugagguagauca

SEQ ID NO: 3598481 - RNA, 21 nt, Pseudomonas putida KT2440
gcgaugagguagaucacaccg

SEQ ID NO: 3598482 - RNA, 19 nt, Pseudomonas putida KT2440
gcgaugaucgccuggccgg

SEQ ID NO: 3598483 - RNA, 23 nt, Pseudomonas putida KT2440
gcgaugaucgccuggccggccgg

SEQ ID NO: 3598484 - RNA, 14 nt, Pseudomonas putida KT2440
gcgaugcacgccag

SEQ ID NO: 3598485 - RNA, 16 nt, Pseudomonas putida KT2440
gcgaugcacgccagca

SEQ ID NO: 3598486 - RNA, 17 nt, Pseudomonas putida KT2440
gcgaugcacgccagcau

SEQ ID NO: 3598487 - RNA, 21 nt, Pseudomonas putida KT2440
gcgaugcacgcgcagagaagc

SEQ ID NO: 3598488 - RNA, 19 nt, Pseudomonas putida KT2440
gcgaugcccuucaggcccc

SEQ ID NO: 3598489 - RNA, 16 nt, Pseudomonas putida KT2440
gcgaugccgacagcca

SEQ ID NO: 3598490 - RNA, 14 nt, Pseudomonas putida KT2440
gcgaugccgcgcgc

SEQ ID NO: 3598491 - RNA, 15 nt, Pseudomonas putida KT2440
gcgaugccgcgcgcc

SEQ ID NO: 3598492 - RNA, 20 nt, Pseudomonas putida KT2440
gcgauggcggaucagcgcgu

SEQ ID NO: 3598493 - RNA, 23 nt, Pseudomonas putida KT2440
gcgauggcgucgacucgaugcca

SEQ ID NO: 3598494 - RNA, 21 nt, Pseudomonas putida KT2440
gcgaugggugcaaaaccugcc

SEQ ID NO: 3598495 - RNA, 22 nt, Pseudomonas putida KT2440
gcgaugguacagcucacuggcc

SEQ ID NO: 3598496 - RNA, 16 nt, Pseudomonas putida KT2440
gcgauggucaaccggc

SEQ ID NO: 3598497 - RNA, 19 nt, Pseudomonas putida KT2440
gcgauguagcaauggcccu

SEQ ID NO: 3598498 - RNA, 17 nt, Pseudomonas putida KT2440
gcgaugugcgcaucggc

SEQ ID NO: 3598499 - RNA, 20 nt, Pseudomonas putida KT2440
gcgauugcgauccgccccau

SEQ ID NO: 3598500 - RNA, 14 nt, Pseudomonas putida KT2440
gcgauugcggccua

SEQ ID NO: 3598501 - RNA, 21 nt, Pseudomonas putida KT2440
gcgauuuuuuugaaaaaaaga

SEQ ID NO: 3598502 - RNA, 16 nt, Pseudomonas putida KT2440
gcgcaaaaccaccagc

SEQ ID NO: 3598503 - RNA, 17 nt, Pseudomonas putida KT2440
gcgcaaaaccaccagcc

SEQ ID NO: 3598504 - RNA, 17 nt, Pseudomonas putida KT2440
gcgcaaacccucggcca

SEQ ID NO: 3598505 - RNA, 13 nt, Pseudomonas putida KT2440
gcgcaaaucgccg

SEQ ID NO: 3598506 - RNA, 20 nt, Pseudomonas putida KT2440
gcgcaaaugcuugcccgccu

SEQ ID NO: 3598507 - RNA, 17 nt, Pseudomonas putida KT2440
gcgcaaaugguugucca

SEQ ID NO: 3598508 - RNA, 19 nt, Pseudomonas putida KT2440
gcgcaaauugcccggccag

SEQ ID NO: 3598509 - RNA, 21 nt, Pseudomonas putida KT2440
gcgcaaauugcccggccagcg

SEQ ID NO: 3598510 - RNA, 22 nt, Pseudomonas putida KT2440
gcgcaaauugcccggccagcga

SEQ ID NO: 3598511 - RNA, 20 nt, Pseudomonas putida KT2440
gcgcaacaccgccagcgggc

SEQ ID NO: 3598512 - RNA, 22 nt, Pseudomonas putida KT2440
gcgcaacaccgccagcgggcug

SEQ ID NO: 3598513 - RNA, 15 nt, Pseudomonas putida KT2440
gcgcaacaccgccau

SEQ ID NO: 3598514 - RNA, 19 nt, Pseudomonas putida KT2440
gcgcaacacuucaggcugc

SEQ ID NO: 3598515 - RNA, 15 nt, Pseudomonas putida KT2440
gcgcaacagcaaggc

SEQ ID NO: 3598516 - RNA, 22 nt, Pseudomonas putida KT2440
gcgcaacagcaaggcaucggcg

SEQ ID NO: 3598517 - RNA, 23 nt, Pseudomonas putida KT2440
gcgcaacagcaaggcaucggcgc

SEQ ID NO: 3598518 - RNA, 19 nt, Pseudomonas putida KT2440
gcgcaaccgauagcgugaa

SEQ ID NO: 3598519 - RNA, 16 nt, Pseudomonas putida KT2440
gcgcaacgacaaggua

SEQ ID NO: 3598520 - RNA, 18 nt, Pseudomonas putida KT2440
gcgcaacgcgccauggcc

SEQ ID NO: 3598521 - RNA, 17 nt, Pseudomonas putida KT2440
gcgcaacucagcgcagc

SEQ ID NO: 3598522 - RNA, 16 nt, Pseudomonas putida KT2440
gcgcaacugcccagga

SEQ ID NO: 3598523 - RNA, 13 nt, Pseudomonas putida KT2440
gcgcaagcaaccg

SEQ ID NO: 3598524 - RNA, 15 nt, Pseudomonas putida KT2440
gcgcauaggccaagg

SEQ ID NO: 3598525 - RNA, 17 nt, Pseudomonas putida KT2440
gcgcaucaacguuccca

SEQ ID NO: 3598526 - RNA, 20 nt, Pseudomonas putida KT2440
gcgcaucaacguucccaaug

SEQ ID NO: 3598527 - RNA, 18 nt, Pseudomonas putida KT2440
gcgcaucacccgccccuc

SEQ ID NO: 3598528 - RNA, 21 nt, Pseudomonas putida KT2440
gcgcaucagccgcgcccucuu

SEQ ID NO: 3598529 - RNA, 23 nt, Pseudomonas putida KT2440
gcgcaucauccaccacccuggca

SEQ ID NO: 3598530 - RNA, 14 nt, Pseudomonas putida KT2440
gcgcaucauggcgg

SEQ ID NO: 3598531 - RNA, 19 nt, Pseudomonas putida KT2440
gcgcaucauggcggugaau

SEQ ID NO: 3598532 - RNA, 18 nt, Pseudomonas putida KT2440
gcgcauccacaggcgccc

SEQ ID NO: 3598533 - RNA, 14 nt, Pseudomonas putida KT2440
gcgcauccagccag

SEQ ID NO: 3598534 - RNA, 21 nt, Pseudomonas putida KT2440
gcgcauccggaauuucugcac

SEQ ID NO: 3598535 - RNA, 23 nt, Pseudomonas putida KT2440
gcgcauccggaauuucugcaccu

SEQ ID NO: 3598536 - RNA, 21 nt, Pseudomonas putida KT2440
gcgcauccuccgcccugcccu

SEQ ID NO: 3598537 - RNA, 17 nt, Pseudomonas putida KT2440
gcgcauccucggugcgc

SEQ ID NO: 3598538 - RNA, 20 nt, Pseudomonas putida KT2440
gcgcauccucggugcgcggu

SEQ ID NO: 3598539 - RNA, 15 nt, Pseudomonas putida KT2440
gcgcaucgaccggca

SEQ ID NO: 3598540 - RNA, 17 nt, Pseudomonas putida KT2440
gcgcaucgaccggcagg

SEQ ID NO: 3598541 - RNA, 20 nt, Pseudomonas putida KT2440
gcgcaucggcgcgacagcgu

SEQ ID NO: 3598542 - RNA, 19 nt, Pseudomonas putida KT2440
gcgcaucuuccagcacaag

SEQ ID NO: 3598543 - RNA, 23 nt, Pseudomonas putida KT2440
gcgcaugaaaaagccggcaacga

SEQ ID NO: 3598544 - RNA, 14 nt, Pseudomonas putida KT2440
gcgcaugaaacucg

SEQ ID NO: 3598545 - RNA, 16 nt, Pseudomonas putida KT2440
gcgcaugaaggacauc

SEQ ID NO: 3598546 - RNA, 21 nt, Pseudomonas putida KT2440
gcgcaugaaggacaucaccag

SEQ ID NO: 3598547 - RNA, 15 nt, Pseudomonas putida KT2440
gcgcaugaucagcug

SEQ ID NO: 3598548 - RNA, 16 nt, Pseudomonas putida KT2440
gcgcaugaucagcugc

SEQ ID NO: 3598549 - RNA, 18 nt, Pseudomonas putida KT2440
gcgcaugaucagcugcca

SEQ ID NO: 3598550 - RNA, 22 nt, Pseudomonas putida KT2440
gcgcaugaugaaguggcgcagg

SEQ ID NO: 3598551 - RNA, 23 nt, Pseudomonas putida KT2440
gcgcaugcccgcgcaaaucgccg

SEQ ID NO: 3598552 - RNA, 13 nt, Pseudomonas putida KT2440
gcgcaugcgcgcc

SEQ ID NO: 3598553 - RNA, 12 nt, Pseudomonas putida KT2440
gcgcaugcucgc

SEQ ID NO: 3598554 - RNA, 13 nt, Pseudomonas putida KT2440
gcgcaugcucgcg

SEQ ID NO: 3598555 - RNA, 16 nt, Pseudomonas putida KT2440
gcgcaugcucgcgggc

SEQ ID NO: 3598556 - RNA, 21 nt, Pseudomonas putida KT2440
gcgcaugcucgcgggccugga

SEQ ID NO: 3598557 - RNA, 13 nt, Pseudomonas putida KT2440
gcgcauggccgcc

SEQ ID NO: 3598558 - RNA, 23 nt, Pseudomonas putida KT2440
gcgcauggcucaacuggcagggu

SEQ ID NO: 3598559 - RNA, 17 nt, Pseudomonas putida KT2440
gcgcauguucaggucgu

SEQ ID NO: 3598560 - RNA, 14 nt, Pseudomonas putida KT2440
gcgcauugaucgcc

SEQ ID NO: 3598561 - RNA, 18 nt, Pseudomonas putida KT2440
gcgcauuucacgcacggc

SEQ ID NO: 3598562 - RNA, 22 nt, Pseudomonas putida KT2440
gcgcauuucacgcacggccuuc

SEQ ID NO: 3598563 - RNA, 20 nt, Pseudomonas putida KT2440
gcgcauuucguccaggcuca

SEQ ID NO: 3598564 - RNA, 19 nt, Pseudomonas putida KT2440
gcgcauuugcuccagggca

SEQ ID NO: 3598565 - RNA, 22 nt, Pseudomonas putida KT2440
gcgccaaaaccuguuccagccc

SEQ ID NO: 3598566 - RNA, 17 nt, Pseudomonas putida KT2440
gcgccaaacgccagggc

SEQ ID NO: 3598567 - RNA, 19 nt, Pseudomonas putida KT2440
gcgccaaacgccagggccg

SEQ ID NO: 3598568 - RNA, 12 nt, Pseudomonas putida KT2440
gcgccaaagcga

SEQ ID NO: 3598569 - RNA, 20 nt, Pseudomonas putida KT2440
gcgccaaagcgagcauggcg

SEQ ID NO: 3598570 - RNA, 13 nt, Pseudomonas putida KT2440
gcgccaaaggcgc

SEQ ID NO: 3598571 - RNA, 14 nt, Pseudomonas putida KT2440
gcgccaaccgcgcc

SEQ ID NO: 3598572 - RNA, 18 nt, Pseudomonas putida KT2440
gcgccaaccgcgccagca

SEQ ID NO: 3598573 - RNA, 21 nt, Pseudomonas putida KT2440
gcgccaaccgcgccagcaaug

SEQ ID NO: 3598574 - RNA, 23 nt, Pseudomonas putida KT2440
gcgccaauaccgcgcaucaucca

SEQ ID NO: 3598575 - RNA, 22 nt, Pseudomonas putida KT2440
gcgccaaucaucgccagcagcg

SEQ ID NO: 3598576 - RNA, 17 nt, Pseudomonas putida KT2440
gcgccacauagcuggca

SEQ ID NO: 3598577 - RNA, 15 nt, Pseudomonas putida KT2440
gcgccaccaccgcug

SEQ ID NO: 3598578 - RNA, 23 nt, Pseudomonas putida KT2440
gcgccacccagaacagccacagc

SEQ ID NO: 3598579 - RNA, 14 nt, Pseudomonas putida KT2440
gcgccaccggcagc

SEQ ID NO: 3598580 - RNA, 16 nt, Pseudomonas putida KT2440
gcgccaccggucgccu

SEQ ID NO: 3598581 - RNA, 12 nt, Pseudomonas putida KT2440
gcgccacggcgc

SEQ ID NO: 3598582 - RNA, 16 nt, Pseudomonas putida KT2440
gcgccacggcgcugac

SEQ ID NO: 3598583 - RNA, 22 nt, Pseudomonas putida KT2440
gcgccacuucgugcaaggcgau

SEQ ID NO: 3598584 - RNA, 17 nt, Pseudomonas putida KT2440
gcgccagaaucccuucg

SEQ ID NO: 3598585 - RNA, 20 nt, Pseudomonas putida KT2440
gcgccagaauggaggagggc

SEQ ID NO: 3598586 - RNA, 21 nt, Pseudomonas putida KT2440
gcgccagcaacgcagccagga

SEQ ID NO: 3598587 - RNA, 15 nt, Pseudomonas putida KT2440
gcgccagcaagcgca

SEQ ID NO: 3598588 - RNA, 18 nt, Pseudomonas putida KT2440
gcgccagcaaugcccgcu

SEQ ID NO: 3598589 - RNA, 18 nt, Pseudomonas putida KT2440
gcgccagcacgcaggcca

SEQ ID NO: 3598590 - RNA, 22 nt, Pseudomonas putida KT2440
gcgccagcacgcaggccagcgc

SEQ ID NO: 3598591 - RNA, 17 nt, Pseudomonas putida KT2440
gcgccagcagccgggcc

SEQ ID NO: 3598592 - RNA, 18 nt, Pseudomonas putida KT2440
gcgccagcagccgggccu

SEQ ID NO: 3598593 - RNA, 20 nt, Pseudomonas putida KT2440
gcgccagcagccgggccuga

SEQ ID NO: 3598594 - RNA, 17 nt, Pseudomonas putida KT2440
gcgccagcagcgcgugc

SEQ ID NO: 3598595 - RNA, 12 nt, Pseudomonas putida KT2440
gcgccagcaggu

SEQ ID NO: 3598596 - RNA, 14 nt, Pseudomonas putida KT2440
gcgccagcagugca

SEQ ID NO: 3598597 - RNA, 19 nt, Pseudomonas putida KT2440
gcgccagcauggaccauca

SEQ ID NO: 3598598 - RNA, 15 nt, Pseudomonas putida KT2440
gcgccagccgcgggu

SEQ ID NO: 3598599 - RNA, 18 nt, Pseudomonas putida KT2440
gcgccagccgcucagcca

SEQ ID NO: 3598600 - RNA, 17 nt, Pseudomonas putida KT2440
gcgccagcggccagcgc

SEQ ID NO: 3598601 - RNA, 15 nt, Pseudomonas putida KT2440
gcgccagcuccgaca

SEQ ID NO: 3598602 - RNA, 16 nt, Pseudomonas putida KT2440
gcgccaggaucgagac

SEQ ID NO: 3598603 - RNA, 18 nt, Pseudomonas putida KT2440
gcgccaggcauugcucga

SEQ ID NO: 3598604 - RNA, 19 nt, Pseudomonas putida KT2440
gcgccaggcauugcucgau

SEQ ID NO: 3598605 - RNA, 15 nt, Pseudomonas putida KT2440
gcgccaggcgcaggc

SEQ ID NO: 3598606 - RNA, 20 nt, Pseudomonas putida KT2440
gcgccaggcugcgcuccaac

SEQ ID NO: 3598607 - RNA, 13 nt, Pseudomonas putida KT2440
gcgccagggcaac

SEQ ID NO: 3598608 - RNA, 21 nt, Pseudomonas putida KT2440
gcgccagggcaucgaccagua

SEQ ID NO: 3598609 - RNA, 11 nt, Pseudomonas putida KT2440
gcgccaggucg

SEQ ID NO: 3598610 - RNA, 13 nt, Pseudomonas putida KT2440
gcgccaggucgga

SEQ ID NO: 3598611 - RNA, 19 nt, Pseudomonas putida KT2440
gcgccaggucggacagggu

SEQ ID NO: 3598612 - RNA, 13 nt, Pseudomonas putida KT2440
gcgccaggucggc

SEQ ID NO: 3598613 - RNA, 17 nt, Pseudomonas putida KT2440
gcgccaguacgccagca

SEQ ID NO: 3598614 - RNA, 22 nt, Pseudomonas putida KT2440
gcgccaguacgccagcagcgca

SEQ ID NO: 3598615 - RNA, 23 nt, Pseudomonas putida KT2440
gcgccaguacgccagcagcgcau

SEQ ID NO: 3598616 - RNA, 21 nt, Pseudomonas putida KT2440
gcgccaguacggccaucagca

SEQ ID NO: 3598617 - RNA, 20 nt, Pseudomonas putida KT2440
gcgccaguggcacccacagc

SEQ ID NO: 3598618 - RNA, 21 nt, Pseudomonas putida KT2440
gcgccaguuccacgaccguga

SEQ ID NO: 3598619 - RNA, 19 nt, Pseudomonas putida KT2440
gcgccaguucgacgcugcu

SEQ ID NO: 3598620 - RNA, 22 nt, Pseudomonas putida KT2440
gcgccaguucgacgcugcuguc

SEQ ID NO: 3598621 - RNA, 19 nt, Pseudomonas putida KT2440
gcgccaguucgcggcgcac

SEQ ID NO: 3598622 - RNA, 14 nt, Pseudomonas putida KT2440
gcgccaucaaggcc

SEQ ID NO: 3598623 - RNA, 19 nt, Pseudomonas putida KT2440
gcgccaucagaggcgaugg

SEQ ID NO: 3598624 - RNA, 13 nt, Pseudomonas putida KT2440
gcgccauccgcca

SEQ ID NO: 3598625 - RNA, 17 nt, Pseudomonas putida KT2440
gcgccaucgcccacggc

SEQ ID NO: 3598626 - RNA, 18 nt, Pseudomonas putida KT2440
gcgccaucgcccacggcg

SEQ ID NO: 3598627 - RNA, 19 nt, Pseudomonas putida KT2440
gcgccaucgcccacggcga

SEQ ID NO: 3598628 - RNA, 13 nt, Pseudomonas putida KT2440
gcgccaucggcac

SEQ ID NO: 3598629 - RNA, 13 nt, Pseudomonas putida KT2440
gcgccggccaagu

SEQ ID NO: 3598630 - RNA, 14 nt, Pseudomonas putida KT2440
gcgccggcuugccu

SEQ ID NO: 3598631 - RNA, 19 nt, Pseudomonas putida KT2440
gcgccgggacagcaccaug

SEQ ID NO: 3598632 - RNA, 18 nt, Pseudomonas putida KT2440
gcgccgguagcggcuggg

SEQ ID NO: 3598633 - RNA, 18 nt, Pseudomonas putida KT2440
gcgccgguauucgcgagc

SEQ ID NO: 3598634 - RNA, 20 nt, Pseudomonas putida KT2440
gcgccgguauucgcgagcca

SEQ ID NO: 3598635 - RNA, 20 nt, Pseudomonas putida KT2440
gcgccggucacuucggcaua

SEQ ID NO: 3598636 - RNA, 23 nt, Pseudomonas putida KT2440
gcgccgguggcggccgcagcccc

SEQ ID NO: 3598637 - RNA, 20 nt, Pseudomonas putida KT2440
gcgccgguguucgcgggcau

SEQ ID NO: 3598638 - RNA, 18 nt, Pseudomonas putida KT2440
gcgccgugcucggccuug

SEQ ID NO: 3598639 - RNA, 16 nt, Pseudomonas putida KT2440
gcgccguggccgccau

SEQ ID NO: 3598640 - RNA, 24 nt, Pseudomonas putida KT2440
gcgccuacaacauaccgcugggca

SEQ ID NO: 3598641 - RNA, 17 nt, Pseudomonas putida KT2440
gcgccuacaggcaaccg

SEQ ID NO: 3598642 - RNA, 15 nt, Pseudomonas putida KT2440
gcgccuacaggcccc

SEQ ID NO: 3598643 - RNA, 16 nt, Pseudomonas putida KT2440
gcgccuacaggcccca

SEQ ID NO: 3598644 - RNA, 19 nt, Pseudomonas putida KT2440
gcgccuaucagaucgagcg

SEQ ID NO: 3598645 - RNA, 20 nt, Pseudomonas putida KT2440
gcgccuauccugugggagcg

SEQ ID NO: 3598646 - RNA, 23 nt, Pseudomonas putida KT2440
gcgccuauccugugggagcgggc

SEQ ID NO: 3598647 - RNA, 15 nt, Pseudomonas putida KT2440
gcgccuccaccugga

SEQ ID NO: 3598648 - RNA, 12 nt, Pseudomonas putida KT2440
gcgccuccagca

SEQ ID NO: 3598649 - RNA, 14 nt, Pseudomonas putida KT2440
gcgccuccagcagc

SEQ ID NO: 3598650 - RNA, 15 nt, Pseudomonas putida KT2440
gcgccuccagcagcg

SEQ ID NO: 3598651 - RNA, 23 nt, Pseudomonas putida KT2440
gcgccuccagcaggggcagaugc

SEQ ID NO: 3598652 - RNA, 13 nt, Pseudomonas putida KT2440
gcgccuccagcug

SEQ ID NO: 3598653 - RNA, 13 nt, Pseudomonas putida KT2440
gcgccucccccag

SEQ ID NO: 3598654 - RNA, 17 nt, Pseudomonas putida KT2440
gcgccucccccagcgcg

SEQ ID NO: 3598655 - RNA, 21 nt, Pseudomonas putida KT2440
gcgccucuugcaccuguccca

SEQ ID NO: 3598656 - RNA, 16 nt, Pseudomonas putida KT2440
gcgccucuuugcccug

SEQ ID NO: 3598657 - RNA, 17 nt, Pseudomonas putida KT2440
gcgccugaaagcguauu

SEQ ID NO: 3598658 - RNA, 22 nt, Pseudomonas putida KT2440
gcgccugaaagcguauugccag

SEQ ID NO: 3598659 - RNA, 18 nt, Pseudomonas putida KT2440
gcgccugaacagcaucag

SEQ ID NO: 3598660 - RNA, 21 nt, Pseudomonas putida KT2440
gcgccugaacagcaucagcca

SEQ ID NO: 3598661 - RNA, 13 nt, Pseudomonas putida KT2440
gcgccugacacaa

SEQ ID NO: 3598662 - RNA, 15 nt, Pseudomonas putida KT2440
gcgccugacaugcac

SEQ ID NO: 3598663 - RNA, 20 nt, Pseudomonas putida KT2440
gcgccugcaaacgcaggugc

SEQ ID NO: 3598664 - RNA, 21 nt, Pseudomonas putida KT2440
gcgccugcaaacgcaggugcg

SEQ ID NO: 3598665 - RNA, 12 nt, Pseudomonas putida KT2440
gcgccugcagcg

SEQ ID NO: 3598666 - RNA, 14 nt, Pseudomonas putida KT2440
gcgccugcagcgcg

SEQ ID NO: 3598667 - RNA, 14 nt, Pseudomonas putida KT2440
gcgccugcaggccc

SEQ ID NO: 3598668 - RNA, 21 nt, Pseudomonas putida KT2440
gcgccugcaguucgcugcgca

SEQ ID NO: 3598669 - RNA, 19 nt, Pseudomonas putida KT2440
gcgccugccgggccagggu

SEQ ID NO: 3598670 - RNA, 20 nt, Pseudomonas putida KT2440
gcgccugccgggucaaggcc

SEQ ID NO: 3598671 - RNA, 14 nt, Pseudomonas putida KT2440
gcgccugccuggcc

SEQ ID NO: 3598672 - RNA, 17 nt, Pseudomonas putida KT2440
gcgccugcgccagugcc

SEQ ID NO: 3598673 - RNA, 14 nt, Pseudomonas putida KT2440
gcgccugcggcauc

SEQ ID NO: 3598674 - RNA, 18 nt, Pseudomonas putida KT2440
gcgccugcucauccacca

SEQ ID NO: 3598675 - RNA, 23 nt, Pseudomonas putida KT2440
gcgccugcugccaggccgcacgc

SEQ ID NO: 3598676 - RNA, 20 nt, Pseudomonas putida KT2440
gcgccugcugcuggaucagu

SEQ ID NO: 3598677 - RNA, 18 nt, Pseudomonas putida KT2440
gcgccugcugguacagcc

SEQ ID NO: 3598678 - RNA, 16 nt, Pseudomonas putida KT2440
gcgccuggcccgcagc

SEQ ID NO: 3598679 - RNA, 18 nt, Pseudomonas putida KT2440
gcgccuggcccgcagcgc

SEQ ID NO: 3598680 - RNA, 21 nt, Pseudomonas putida KT2440
gcgccuggcgagaaggcgugg

SEQ ID NO: 3598681 - RNA, 18 nt, Pseudomonas putida KT2440
gcgccuggguggcgcggu

SEQ ID NO: 3598682 - RNA, 14 nt, Pseudomonas putida KT2440
gcgccuggucauca

SEQ ID NO: 3598683 - RNA, 20 nt, Pseudomonas putida KT2440
gcgccuggucaucagauggc

SEQ ID NO: 3598684 - RNA, 15 nt, Pseudomonas putida KT2440
gcgccuggucgccgc

SEQ ID NO: 3598685 - RNA, 17 nt, Pseudomonas putida KT2440
gcgccuggucgccgcca

SEQ ID NO: 3598686 - RNA, 15 nt, Pseudomonas putida KT2440
gcgccugugaucgag

SEQ ID NO: 3598687 - RNA, 17 nt, Pseudomonas putida KT2440
gcgccugugaucgagcg

SEQ ID NO: 3598688 - RNA, 18 nt, Pseudomonas putida KT2440
gcgccuucauaggcggcc

SEQ ID NO: 3598689 - RNA, 19 nt, Pseudomonas putida KT2440
gcgccuucauaggcggcca

SEQ ID NO: 3598690 - RNA, 16 nt, Pseudomonas putida KT2440
gcgccuucgcccgacc

SEQ ID NO: 3598691 - RNA, 20 nt, Pseudomonas putida KT2440
gcgccuucgcccgaccgcca

SEQ ID NO: 3598692 - RNA, 13 nt, Pseudomonas putida KT2440
gcgccuucgcugg

SEQ ID NO: 3598693 - RNA, 14 nt, Pseudomonas putida KT2440
gcgccuucgcuggc

SEQ ID NO: 3598694 - RNA, 19 nt, Pseudomonas putida KT2440
gcgccuugauuaccagcgc

SEQ ID NO: 3598695 - RNA, 22 nt, Pseudomonas putida KT2440
gcgccuugauuaccagcgcccc

SEQ ID NO: 3598696 - RNA, 19 nt, Pseudomonas putida KT2440
gcgccuugcgcacgccggu

SEQ ID NO: 3598697 - RNA, 19 nt, Pseudomonas putida KT2440
gcgccuugcgccaggugcc

SEQ ID NO: 3598698 - RNA, 21 nt, Pseudomonas putida KT2440
gcgccuugucggcacgcgcca

SEQ ID NO: 3598699 - RNA, 23 nt, Pseudomonas putida KT2440
gcgccuugucggcacgcgccagc

SEQ ID NO: 3598700 - RNA, 20 nt, Pseudomonas putida KT2440
gcgccuuuuccaccagcccu

SEQ ID NO: 3598701 - RNA, 22 nt, Pseudomonas putida KT2440
gcgccuuuuccaccagcccuuc

SEQ ID NO: 3598702 - RNA, 20 nt, Pseudomonas putida KT2440
gcgcgaaacccucacgcgcc

SEQ ID NO: 3598703 - RNA, 23 nt, Pseudomonas putida KT2440
gcgcgaaacccucacgcgccagg

SEQ ID NO: 3598704 - RNA, 18 nt, Pseudomonas putida KT2440
gcgcgaagcccagcuugc

SEQ ID NO: 3598705 - RNA, 20 nt, Pseudomonas putida KT2440
gcgcgaaguggauauccagc

SEQ ID NO: 3598706 - RNA, 21 nt, Pseudomonas putida KT2440
gcgcgaaguggauauccagcg

SEQ ID NO: 3598707 - RNA, 14 nt, Pseudomonas putida KT2440
gcgcgaaucaccac

SEQ ID NO: 3598708 - RNA, 19 nt, Pseudomonas putida KT2440
gcgcgacaaucaggcguca

SEQ ID NO: 3598709 - RNA, 21 nt, Pseudomonas putida KT2440
gcgcgacagcaucaucaggcc

SEQ ID NO: 3598710 - RNA, 15 nt, Pseudomonas putida KT2440
gcgcgaccaucaccg

SEQ ID NO: 3598711 - RNA, 21 nt, Pseudomonas putida KT2440
gcgcgaccaucaccgccagca

SEQ ID NO: 3598712 - RNA, 16 nt, Pseudomonas putida KT2440
gcgcgacgcagcagcg

SEQ ID NO: 3598713 - RNA, 16 nt, Pseudomonas putida KT2440
gcgcgacuggugcucu

SEQ ID NO: 3598714 - RNA, 16 nt, Pseudomonas putida KT2440
gcgcgaggcgcguucu

SEQ ID NO: 3598715 - RNA, 14 nt, Pseudomonas putida KT2440
gcgcgauaccgacg

SEQ ID NO: 3598716 - RNA, 17 nt, Pseudomonas putida KT2440
gcgcgauagccuguggg

SEQ ID NO: 3598717 - RNA, 13 nt, Pseudomonas putida KT2440
gcgcgaucaccag

SEQ ID NO: 3598718 - RNA, 11 nt, Pseudomonas putida KT2440
gcgcgaucacg

SEQ ID NO: 3598719 - RNA, 17 nt, Pseudomonas putida KT2440
gcgcgaucccuguggga

SEQ ID NO: 3598720 - RNA, 12 nt, Pseudomonas putida KT2440
gcgcgauuggac

SEQ ID NO: 3598721 - RNA, 16 nt, Pseudomonas putida KT2440
gcgcgcaacagugccc

SEQ ID NO: 3598722 - RNA, 14 nt, Pseudomonas putida KT2440
gcgcgcaucagccg

SEQ ID NO: 3598723 - RNA, 15 nt, Pseudomonas putida KT2440
gcgcgcaucagccgc

SEQ ID NO: 3598724 - RNA, 15 nt, Pseudomonas putida KT2440
gcgcgcauccacagg

SEQ ID NO: 3598725 - RNA, 22 nt, Pseudomonas putida KT2440
gcgcgccacgcaccagggcugg

SEQ ID NO: 3598726 - RNA, 12 nt, Pseudomonas putida KT2440
gcgcgccagcag

SEQ ID NO: 3598727 - RNA, 16 nt, Pseudomonas putida KT2440
gcgcgccagcgcaugc

SEQ ID NO: 3598728 - RNA, 21 nt, Pseudomonas putida KT2440
gcgcgccaugccccuaccgcc

SEQ ID NO: 3598729 - RNA, 14 nt, Pseudomonas putida KT2440
gcgcgcccaggccc

SEQ ID NO: 3598730 - RNA, 22 nt, Pseudomonas putida KT2440
gcgcgcccaggcccaacgggcg

SEQ ID NO: 3598731 - RNA, 20 nt, Pseudomonas putida KT2440
gcgcgcccccgaccacccgg

SEQ ID NO: 3598732 - RNA, 13 nt, Pseudomonas putida KT2440
gcgcgcccgcgaa

SEQ ID NO: 3598733 - RNA, 12 nt, Pseudomonas putida KT2440
gcgcgcccgcgg

SEQ ID NO: 3598734 - RNA, 15 nt, Pseudomonas putida KT2440
gcgcugaucaagccc

SEQ ID NO: 3598735 - RNA, 23 nt, Pseudomonas putida KT2440
gcgcugaucaagcccgcucgcca

SEQ ID NO: 3598736 - RNA, 17 nt, Pseudomonas putida KT2440
gcgcugaucaucgacag

SEQ ID NO: 3598737 - RNA, 18 nt, Pseudomonas putida KT2440
gcgcugaugcggacccag

SEQ ID NO: 3598738 - RNA, 20 nt, Pseudomonas putida KT2440
gcgcugaugcggacccagcg

SEQ ID NO: 3598739 - RNA, 19 nt, Pseudomonas putida KT2440
gcgcugauucaacgcccca

SEQ ID NO: 3598740 - RNA, 19 nt, Pseudomonas putida KT2440
gcgcugcaagcgcaccugc

SEQ ID NO: 3598741 - RNA, 13 nt, Pseudomonas putida KT2440
gcgcugcagcucc

SEQ ID NO: 3598742 - RNA, 17 nt, Pseudomonas putida KT2440
gcgcugcagggcgccga

SEQ ID NO: 3598743 - RNA, 17 nt, Pseudomonas putida KT2440
gcgcugcauggcggcac

SEQ ID NO: 3598744 - RNA, 17 nt, Pseudomonas putida KT2440
gcgcugccaggccgggu

SEQ ID NO: 3598745 - RNA, 20 nt, Pseudomonas putida KT2440
gcgcugccaggccggguccu

SEQ ID NO: 3598746 - RNA, 23 nt, Pseudomonas putida KT2440
gcgcugccugcuggcggcugagc

SEQ ID NO: 3598747 - RNA, 18 nt, Pseudomonas putida KT2440
gcgcugcgaggccccaga

SEQ ID NO: 3598748 - RNA, 14 nt, Pseudomonas putida KT2440
gcgcugcgcaagga

SEQ ID NO: 3598749 - RNA, 22 nt, Pseudomonas putida KT2440
gcgcugcgcagccaacugguug

SEQ ID NO: 3598750 - RNA, 15 nt, Pseudomonas putida KT2440
gcgcugcgcagguau

SEQ ID NO: 3598751 - RNA, 16 nt, Pseudomonas putida KT2440
gcgcugcuggccuugc

SEQ ID NO: 3598752 - RNA, 22 nt, Pseudomonas putida KT2440
gcgcugcugguacaugccgccg

SEQ ID NO: 3598753 - RNA, 18 nt, Pseudomonas putida KT2440
gcgcuggaauuauuggcc

SEQ ID NO: 3598754 - RNA, 22 nt, Pseudomonas putida KT2440
gcgcuggaauuauuggccagca

SEQ ID NO: 3598755 - RNA, 14 nt, Pseudomonas putida KT2440
gcgcuggccaggcu

SEQ ID NO: 3598756 - RNA, 22 nt, Pseudomonas putida KT2440
gcgcuggccaggcuugguuugg

SEQ ID NO: 3598757 - RNA, 13 nt, Pseudomonas putida KT2440
gcgcuggcgcgcu

SEQ ID NO: 3598758 - RNA, 21 nt, Pseudomonas putida KT2440
gcgcuggcgggcaaacuggcg

SEQ ID NO: 3598759 - RNA, 22 nt, Pseudomonas putida KT2440
gcgcuggcgggcaaacuggcgc

SEQ ID NO: 3598760 - RNA, 19 nt, Pseudomonas putida KT2440
gcgcugguacagcaggaac

SEQ ID NO: 3598761 - RNA, 22 nt, Pseudomonas putida KT2440
gcgcugguucauugccaacagc

SEQ ID NO: 3598762 - RNA, 15 nt, Pseudomonas putida KT2440
gcgcuguccagcgca

SEQ ID NO: 3598763 - RNA, 18 nt, Pseudomonas putida KT2440
gcgcuguccagcgcauca

SEQ ID NO: 3598764 - RNA, 15 nt, Pseudomonas putida KT2440
gcgcugucccccagc

SEQ ID NO: 3598765 - RNA, 17 nt, Pseudomonas putida KT2440
gcgcugucccccagccc

SEQ ID NO: 3598766 - RNA, 17 nt, Pseudomonas putida KT2440
gcgcugucggcgcggau

SEQ ID NO: 3598767 - RNA, 16 nt, Pseudomonas putida KT2440
gcgcugucggucagca

SEQ ID NO: 3598768 - RNA, 14 nt, Pseudomonas putida KT2440
gcgcugugcucagc

SEQ ID NO: 3598769 - RNA, 14 nt, Pseudomonas putida KT2440
gcgcuguggcgccc

SEQ ID NO: 3598770 - RNA, 17 nt, Pseudomonas putida KT2440
gcgcuguggcgcccggc

SEQ ID NO: 3598771 - RNA, 20 nt, Pseudomonas putida KT2440
gcgcuguggcgcccggcgcu

SEQ ID NO: 3598772 - RNA, 19 nt, Pseudomonas putida KT2440
gcgcuuaaaucaagagccc

SEQ ID NO: 3598773 - RNA, 19 nt, Pseudomonas putida KT2440
gcgcuucaccuucguuugc

SEQ ID NO: 3598774 - RNA, 14 nt, Pseudomonas putida KT2440
gcgcuucauccagc

SEQ ID NO: 3598775 - RNA, 15 nt, Pseudomonas putida KT2440
gcgcuucauccagcg

SEQ ID NO: 3598776 - RNA, 14 nt, Pseudomonas putida KT2440
gcgcuuccuggccu

SEQ ID NO: 3598777 - RNA, 17 nt, Pseudomonas putida KT2440
gcgcuucgaucgccggc

SEQ ID NO: 3598778 - RNA, 20 nt, Pseudomonas putida KT2440
gcgcuugaagggggcuacga

SEQ ID NO: 3598779 - RNA, 13 nt, Pseudomonas putida KT2440
gcgcuugacccgg

SEQ ID NO: 3598780 - RNA, 18 nt, Pseudomonas putida KT2440
gcgcuugagaccaggccu

SEQ ID NO: 3598781 - RNA, 22 nt, Pseudomonas putida KT2440
gcgcuugagaccaggccuggau

SEQ ID NO: 3598782 - RNA, 16 nt, Pseudomonas putida KT2440
gcgcuugagcucggca

SEQ ID NO: 3598783 - RNA, 16 nt, Pseudomonas putida KT2440
gcgcuugaucugccag

SEQ ID NO: 3598784 - RNA, 19 nt, Pseudomonas putida KT2440
gcgcuugaucugccaggca

SEQ ID NO: 3598785 - RNA, 22 nt, Pseudomonas putida KT2440
gcgcuugaucugccaggcacca

SEQ ID NO: 3598786 - RNA, 17 nt, Pseudomonas putida KT2440
gcgcuugcccgccgaau

SEQ ID NO: 3598787 - RNA, 18 nt, Pseudomonas putida KT2440
gcgcuuggcaccggcagc

SEQ ID NO: 3598788 - RNA, 14 nt, Pseudomonas putida KT2440
gcgcuuggccaggg

SEQ ID NO: 3598789 - RNA, 15 nt, Pseudomonas putida KT2440
gcgcuuggcggcccu

SEQ ID NO: 3598790 - RNA, 16 nt, Pseudomonas putida KT2440
gcgcuuucacuggcga

SEQ ID NO: 3598791 - RNA, 21 nt, Pseudomonas putida KT2440
gcgcuuucucuuugaucagcg

SEQ ID NO: 3598792 - RNA, 15 nt, Pseudomonas putida KT2440
gcgcuuugcguggca

SEQ ID NO: 3598793 - RNA, 18 nt, Pseudomonas putida KT2440
gcgcuuuucaccuccagu

SEQ ID NO: 3598794 - RNA, 13 nt, Pseudomonas putida KT2440
gcgcuuuuccagu

SEQ ID NO: 3598795 - RNA, 16 nt, Pseudomonas putida KT2440
gcgcuuuuccaguucc

SEQ ID NO: 3598796 - RNA, 19 nt, Pseudomonas putida KT2440
gcggaacagguugaccaac

SEQ ID NO: 3598797 - RNA, 14 nt, Pseudomonas putida KT2440
gcggaacagugguu

SEQ ID NO: 3598798 - RNA, 14 nt, Pseudomonas putida KT2440
gcggaacauggugu

SEQ ID NO: 3598799 - RNA, 14 nt, Pseudomonas putida KT2440
gcggaacucggcga

SEQ ID NO: 3598800 - RNA, 19 nt, Pseudomonas putida KT2440
gcggaacuggcccuggcca

SEQ ID NO: 3598801 - RNA, 15 nt, Pseudomonas putida KT2440
gcggaagauacccgc

SEQ ID NO: 3598802 - RNA, 13 nt, Pseudomonas putida KT2440
gcggaaggcagcg

SEQ ID NO: 3598803 - RNA, 16 nt, Pseudomonas putida KT2440
gcggacccggcauccu

SEQ ID NO: 3598804 - RNA, 20 nt, Pseudomonas putida KT2440
gcggacccuugugugggccu

SEQ ID NO: 3598805 - RNA, 23 nt, Pseudomonas putida KT2440
gcggacccuugugugggccuugc

SEQ ID NO: 3598806 - RNA, 19 nt, Pseudomonas putida KT2440
gcggacucauagcucagcu

SEQ ID NO: 3598807 - RNA, 16 nt, Pseudomonas putida KT2440
gcggagauuggccagc

SEQ ID NO: 3598808 - RNA, 17 nt, Pseudomonas putida KT2440
gcggagauuggccagca

SEQ ID NO: 3598809 - RNA, 16 nt, Pseudomonas putida KT2440
gcggauacagcgccca

SEQ ID NO: 3598810 - RNA, 22 nt, Pseudomonas putida KT2440
gcggauagccccgcccagcagc

SEQ ID NO: 3598811 - RNA, 16 nt, Pseudomonas putida KT2440
gcggauaucaaagcgg

SEQ ID NO: 3598812 - RNA, 17 nt, Pseudomonas putida KT2440
gcggaucaacccgcgaa

SEQ ID NO: 3598813 - RNA, 11 nt, Pseudomonas putida KT2440
gcggaucaccg

SEQ ID NO: 3598814 - RNA, 22 nt, Pseudomonas putida KT2440
gcggaucagcgcguccagcaac

SEQ ID NO: 3598815 - RNA, 14 nt, Pseudomonas putida KT2440
gcggaucaucggca

SEQ ID NO: 3598816 - RNA, 21 nt, Pseudomonas putida KT2440
gcggauccgugcaccgcucag

SEQ ID NO: 3598817 - RNA, 22 nt, Pseudomonas putida KT2440
gcggaucgcgccuucgcuggcg

SEQ ID NO: 3598818 - RNA, 11 nt, Pseudomonas putida KT2440
gcggaucggcc

SEQ ID NO: 3598819 - RNA, 16 nt, Pseudomonas putida KT2440
gcggaucugacggcgc

SEQ ID NO: 3598820 - RNA, 17 nt, Pseudomonas putida KT2440
gcggaucugacggcgcu

SEQ ID NO: 3598821 - RNA, 16 nt, Pseudomonas putida KT2440
gcggauguucuugacc

SEQ ID NO: 3598822 - RNA, 14 nt, Pseudomonas putida KT2440
gcggauuugcccgc

SEQ ID NO: 3598823 - RNA, 23 nt, Pseudomonas putida KT2440
gcggcaaacacacccucgacguu

SEQ ID NO: 3598824 - RNA, 21 nt, Pseudomonas putida KT2440
gcggcaaacuucucgccucag

SEQ ID NO: 3598825 - RNA, 19 nt, Pseudomonas putida KT2440
gcggcaaagaucgcccagc

SEQ ID NO: 3598826 - RNA, 20 nt, Pseudomonas putida KT2440
gcggcaaagaucgcccagcu

SEQ ID NO: 3598827 - RNA, 21 nt, Pseudomonas putida KT2440
gcggcaaaugcggcgcgggcg

SEQ ID NO: 3598828 - RNA, 13 nt, Pseudomonas putida KT2440
gcggcaacaccag

SEQ ID NO: 3598829 - RNA, 14 nt, Pseudomonas putida KT2440
gcggcaacaccagc

SEQ ID NO: 3598830 - RNA, 15 nt, Pseudomonas putida KT2440
gcggcaacaccagca

SEQ ID NO: 3598831 - RNA, 16 nt, Pseudomonas putida KT2440
gcggcaacaccagcag

SEQ ID NO: 3598832 - RNA, 11 nt, Pseudomonas putida KT2440
gcggcaaccug

SEQ ID NO: 3598833 - RNA, 20 nt, Pseudomonas putida KT2440
gcggcaagcccgcuccuaca

SEQ ID NO: 3598834 - RNA, 14 nt, Pseudomonas putida KT2440
gcggcaagguagcc

SEQ ID NO: 3598835 - RNA, 19 nt, Pseudomonas putida KT2440
gcggcaagguagccugcug

SEQ ID NO: 3598836 - RNA, 17 nt, Pseudomonas putida KT2440
gcggcaaucacgaacac

SEQ ID NO: 3598837 - RNA, 21 nt, Pseudomonas putida KT2440
gcggcaaugcgccggucgcgu

SEQ ID NO: 3598838 - RNA, 15 nt, Pseudomonas putida KT2440
gcggcaauguugaag

SEQ ID NO: 3598839 - RNA, 20 nt, Pseudomonas putida KT2440
gcggcgguugucgucgaccg

SEQ ID NO: 3598840 - RNA, 21 nt, Pseudomonas putida KT2440
gcggcgguugucgucgaccgc

SEQ ID NO: 3598841 - RNA, 22 nt, Pseudomonas putida KT2440
gcggcguauacccggucagggu

SEQ ID NO: 3598842 - RNA, 23 nt, Pseudomonas putida KT2440
gcggcguauccgugagggcgccg

SEQ ID NO: 3598843 - RNA, 14 nt, Pseudomonas putida KT2440
gcggcgugcgcccg

SEQ ID NO: 3598844 - RNA, 16 nt, Pseudomonas putida KT2440
gcggcguuugcgagcg

SEQ ID NO: 3598845 - RNA, 22 nt, Pseudomonas putida KT2440
gcggcguuugcgagcgcgggca

SEQ ID NO: 3598846 - RNA, 16 nt, Pseudomonas putida KT2440
gcggcuaagcgccagc

SEQ ID NO: 3598847 - RNA, 17 nt, Pseudomonas putida KT2440
gcggcuaagcgccagca

SEQ ID NO: 3598848 - RNA, 16 nt, Pseudomonas putida KT2440
gcggcuacccagccgg

SEQ ID NO: 3598849 - RNA, 18 nt, Pseudomonas putida KT2440
gcggcuccaccgaaauca

SEQ ID NO: 3598850 - RNA, 15 nt, Pseudomonas putida KT2440
gcggcucgaugcugc

SEQ ID NO: 3598851 - RNA, 17 nt, Pseudomonas putida KT2440
gcggcucgaugcugcgu

SEQ ID NO: 3598852 - RNA, 19 nt, Pseudomonas putida KT2440
gcggcucgcugaacacgca

SEQ ID NO: 3598853 - RNA, 15 nt, Pseudomonas putida KT2440
gcggcucgcugcgcu

SEQ ID NO: 3598854 - RNA, 15 nt, Pseudomonas putida KT2440
gcggcucgucaacca

SEQ ID NO: 3598855 - RNA, 19 nt, Pseudomonas putida KT2440
gcggcucgucaaccacagc

SEQ ID NO: 3598856 - RNA, 15 nt, Pseudomonas putida KT2440
gcggcugaacacgcu

SEQ ID NO: 3598857 - RNA, 10 nt, Pseudomonas putida KT2440
gcggcugacc

SEQ ID NO: 3598858 - RNA, 18 nt, Pseudomonas putida KT2440
gcggcugacgaagcgccu

SEQ ID NO: 3598859 - RNA, 17 nt, Pseudomonas putida KT2440
gcggcugccccaacugc

SEQ ID NO: 3598860 - RNA, 22 nt, Pseudomonas putida KT2440
gcggcugcccgugcugucggug

SEQ ID NO: 3598861 - RNA, 22 nt, Pseudomonas putida KT2440
gcggcugccuacccaggcaacg

SEQ ID NO: 3598862 - RNA, 16 nt, Pseudomonas putida KT2440
gcggcugcgacggcga

SEQ ID NO: 3598863 - RNA, 20 nt, Pseudomonas putida KT2440
gcggcugcgacggcgaauga

SEQ ID NO: 3598864 - RNA, 18 nt, Pseudomonas putida KT2440
gcggcugcucgaucaggu

SEQ ID NO: 3598865 - RNA, 22 nt, Pseudomonas putida KT2440
gcggcugggccccaggcggugc

SEQ ID NO: 3598866 - RNA, 13 nt, Pseudomonas putida KT2440
gcggcugggcgcg

SEQ ID NO: 3598867 - RNA, 16 nt, Pseudomonas putida KT2440
gcggcugggcgcggcg

SEQ ID NO: 3598868 - RNA, 20 nt, Pseudomonas putida KT2440
gcggcugggucacccaggug

SEQ ID NO: 3598869 - RNA, 15 nt, Pseudomonas putida KT2440
gcggcugggugccau

SEQ ID NO: 3598870 - RNA, 18 nt, Pseudomonas putida KT2440
gcggcugggugccaucag

SEQ ID NO: 3598871 - RNA, 20 nt, Pseudomonas putida KT2440
gcggcugguauugccuggcg

SEQ ID NO: 3598872 - RNA, 13 nt, Pseudomonas putida KT2440
gcggcuggucgcc

SEQ ID NO: 3598873 - RNA, 19 nt, Pseudomonas putida KT2440
gcggcuggugucggccagg

SEQ ID NO: 3598874 - RNA, 22 nt, Pseudomonas putida KT2440
gcggcuguccagcaagggccug

SEQ ID NO: 3598875 - RNA, 17 nt, Pseudomonas putida KT2440
gcggcugucgcagaagc

SEQ ID NO: 3598876 - RNA, 19 nt, Pseudomonas putida KT2440
gcggcuguucgcagcacaa

SEQ ID NO: 3598877 - RNA, 13 nt, Pseudomonas putida KT2440
gcggcuucgaugc

SEQ ID NO: 3598878 - RNA, 20 nt, Pseudomonas putida KT2440
gcggcuucgaugcccggcag

SEQ ID NO: 3598879 - RNA, 22 nt, Pseudomonas putida KT2440
gcggcuucgaugcccggcaggu

SEQ ID NO: 3598880 - RNA, 13 nt, Pseudomonas putida KT2440
gcggcuugcucgc

SEQ ID NO: 3598881 - RNA, 14 nt, Pseudomonas putida KT2440
gcggcuuggcacga

SEQ ID NO: 3598882 - RNA, 16 nt, Pseudomonas putida KT2440
gcggcuuggccgcgaa

SEQ ID NO: 3598883 - RNA, 18 nt, Pseudomonas putida KT2440
gcggcuuucagcgccgcu

SEQ ID NO: 3598884 - RNA, 16 nt, Pseudomonas putida KT2440
gcgggaaggucggcca

SEQ ID NO: 3598885 - RNA, 22 nt, Pseudomonas putida KT2440
gcgggaaggucggccaguuggc

SEQ ID NO: 3598886 - RNA, 23 nt, Pseudomonas putida KT2440
gcgggacucgaucugugggagcg

SEQ ID NO: 3598887 - RNA, 13 nt, Pseudomonas putida KT2440
gcgggagcgggcg

SEQ ID NO: 3598888 - RNA, 20 nt, Pseudomonas putida KT2440
gcgggagcgggcgugcccgc

SEQ ID NO: 3598889 - RNA, 17 nt, Pseudomonas putida KT2440
gcgggagucgaaccugc

SEQ ID NO: 3598890 - RNA, 17 nt, Pseudomonas putida KT2440
gcgggaugcgguugacc

SEQ ID NO: 3598891 - RNA, 20 nt, Pseudomonas putida KT2440
gcgggauuguucccacaggg

SEQ ID NO: 3598892 - RNA, 20 nt, Pseudomonas putida KT2440
gcgggcaaacccgcgccuac

SEQ ID NO: 3598893 - RNA, 18 nt, Pseudomonas putida KT2440
gcgggcaaacuggcgccc

SEQ ID NO: 3598894 - RNA, 20 nt, Pseudomonas putida KT2440
gcgggcaaagaacaucacga

SEQ ID NO: 3598895 - RNA, 17 nt, Pseudomonas putida KT2440
gcgggcaacugcgccug

SEQ ID NO: 3598896 - RNA, 14 nt, Pseudomonas putida KT2440
gcgggcaagcccgc

SEQ ID NO: 3598897 - RNA, 16 nt, Pseudomonas putida KT2440
gcgggcaagcccgcga

SEQ ID NO: 3598898 - RNA, 17 nt, Pseudomonas putida KT2440
gcgggcaagcccgcgaa

SEQ ID NO: 3598899 - RNA, 18 nt, Pseudomonas putida KT2440
gcgggcaagcccgcgaag

SEQ ID NO: 3598900 - RNA, 15 nt, Pseudomonas putida KT2440
gcgggcaagcccgcu

SEQ ID NO: 3598901 - RNA, 16 nt, Pseudomonas putida KT2440
gcgggcaagcccgcuc

SEQ ID NO: 3598902 - RNA, 20 nt, Pseudomonas putida KT2440
gcgggcaagcccgcucccac

SEQ ID NO: 3598903 - RNA, 20 nt, Pseudomonas putida KT2440
gcgggcaagcccgcuccuac

SEQ ID NO: 3598904 - RNA, 22 nt, Pseudomonas putida KT2440
gcgggcaaggucgaugcugcug

SEQ ID NO: 3598905 - RNA, 20 nt, Pseudomonas putida KT2440
gcgggcaauguccaggugcu

SEQ ID NO: 3598906 - RNA, 22 nt, Pseudomonas putida KT2440
gcgggcacaggccgcgcaugau

SEQ ID NO: 3598907 - RNA, 20 nt, Pseudomonas putida KT2440
gcgggcacgcccgcucccac

SEQ ID NO: 3598908 - RNA, 16 nt, Pseudomonas putida KT2440
gcgggcacgggcagcg

SEQ ID NO: 3598909 - RNA, 15 nt, Pseudomonas putida KT2440
gcgggcagugcaaua

SEQ ID NO: 3598910 - RNA, 14 nt, Pseudomonas putida KT2440
gcgggcaugcccgc

SEQ ID NO: 3598911 - RNA, 21 nt, Pseudomonas putida KT2440
gcgggcaugcccgcucccaca

SEQ ID NO: 3598912 - RNA, 14 nt, Pseudomonas putida KT2440
gcgggccaagguca

SEQ ID NO: 3598913 - RNA, 16 nt, Pseudomonas putida KT2440
gcgggccaaggucagc

SEQ ID NO: 3598914 - RNA, 11 nt, Pseudomonas putida KT2440
gcgggccagcc

SEQ ID NO: 3598915 - RNA, 23 nt, Pseudomonas putida KT2440
gcgggccagcccauccagggcuu

SEQ ID NO: 3598916 - RNA, 15 nt, Pseudomonas putida KT2440
gcgggcccagcaggu

SEQ ID NO: 3598917 - RNA, 20 nt, Pseudomonas putida KT2440
gcgggcccagcaggugccca

SEQ ID NO: 3598918 - RNA, 12 nt, Pseudomonas putida KT2440
gcgggccgccga

SEQ ID NO: 3598919 - RNA, 19 nt, Pseudomonas putida KT2440
gcgggcgaagaugcguucg

SEQ ID NO: 3598920 - RNA, 23 nt, Pseudomonas putida KT2440
gcgggcgauugccagggugccag

SEQ ID NO: 3598921 - RNA, 22 nt, Pseudomonas putida KT2440
gcgggcgcgacaaucaggcguc

SEQ ID NO: 3598922 - RNA, 14 nt, Pseudomonas putida KT2440
gcgggcgcgcccgc

SEQ ID NO: 3598923 - RNA, 18 nt, Pseudomonas putida KT2440
gcgggcggcgcucgaucu

SEQ ID NO: 3598924 - RNA, 19 nt, Pseudomonas putida KT2440
gcgggcguaccuggcugcu

SEQ ID NO: 3598925 - RNA, 16 nt, Pseudomonas putida KT2440
gcgggcgucgcgauca

SEQ ID NO: 3598926 - RNA, 19 nt, Pseudomonas putida KT2440
gcgggcgucggucgccccc

SEQ ID NO: 3598927 - RNA, 14 nt, Pseudomonas putida KT2440
gcgggcgugcccgc

SEQ ID NO: 3598928 - RNA, 17 nt, Pseudomonas putida KT2440
gcgggcgugcccgcgaa

SEQ ID NO: 3598929 - RNA, 20 nt, Pseudomonas putida KT2440
gcgggcgugccugcgaaugg

SEQ ID NO: 3598930 - RNA, 22 nt, Pseudomonas putida KT2440
gcgggcguuguguugcugggcg

SEQ ID NO: 3598931 - RNA, 17 nt, Pseudomonas putida KT2440
gcgggcuacacgcgccc

SEQ ID NO: 3598932 - RNA, 22 nt, Pseudomonas putida KT2440
gcgggcuaugcgauugaucugc

SEQ ID NO: 3598933 - RNA, 14 nt, Pseudomonas putida KT2440
gcgggcucgcccac

SEQ ID NO: 3598934 - RNA, 20 nt, Pseudomonas putida KT2440
gcgggcucgcccacacggca

SEQ ID NO: 3598935 - RNA, 16 nt, Pseudomonas putida KT2440
gcgggcucgcccacuc

SEQ ID NO: 3598936 - RNA, 22 nt, Pseudomonas putida KT2440
gcgggcucguuauccgcgagua

SEQ ID NO: 3598937 - RNA, 19 nt, Pseudomonas putida KT2440
gcgggcuugcccgcgaagc

SEQ ID NO: 3598938 - RNA, 19 nt, Pseudomonas putida KT2440
gcgggcuugcccgcgaauc

SEQ ID NO: 3598939 - RNA, 23 nt, Pseudomonas putida KT2440
gcgggcuugcccgcgaaucgccu

SEQ ID NO: 3598940 - RNA, 18 nt, Pseudomonas putida KT2440
gcgggcuuguccgcgaag

SEQ ID NO: 3598941 - RNA, 14 nt, Pseudomonas putida KT2440
gcgggcuuucuggu

SEQ ID NO: 3598942 - RNA, 14 nt, Pseudomonas putida KT2440
gcggggagcgaacu

SEQ ID NO: 3598943 - RNA, 14 nt, Pseudomonas putida KT2440
gcggggcauucggc

SEQ ID NO: 3598944 - RNA, 22 nt, Pseudomonas putida KT2440
gcgguucaucggcaaacacauc

SEQ ID NO: 3598945 - RNA, 13 nt, Pseudomonas putida KT2440
gcgguucgaccga

SEQ ID NO: 3598946 - RNA, 17 nt, Pseudomonas putida KT2440
gcgguucuucgccugca

SEQ ID NO: 3598947 - RNA, 20 nt, Pseudomonas putida KT2440
gcgguucuucgccugcagca

SEQ ID NO: 3598948 - RNA, 20 nt, Pseudomonas putida KT2440
gcgguugaccagggcgucga

SEQ ID NO: 3598949 - RNA, 20 nt, Pseudomonas putida KT2440
gcgguugaccgccgccacca

SEQ ID NO: 3598950 - RNA, 13 nt, Pseudomonas putida KT2440
gcgguugcaccgu

SEQ ID NO: 3598951 - RNA, 21 nt, Pseudomonas putida KT2440
gcgguugcaccguggcagcaa

SEQ ID NO: 3598952 - RNA, 15 nt, Pseudomonas putida KT2440
gcgguugcaggacua

SEQ ID NO: 3598953 - RNA, 19 nt, Pseudomonas putida KT2440
gcgguugcaggacuacauc

SEQ ID NO: 3598954 - RNA, 20 nt, Pseudomonas putida KT2440
gcgguugccaagcacggcgc

SEQ ID NO: 3598955 - RNA, 19 nt, Pseudomonas putida KT2440
gcgguugcccguaggagcg

SEQ ID NO: 3598956 - RNA, 18 nt, Pseudomonas putida KT2440
gcgguugggcaagugcgu

SEQ ID NO: 3598957 - RNA, 20 nt, Pseudomonas putida KT2440
gcgguuguagaucgccggca

SEQ ID NO: 3598958 - RNA, 21 nt, Pseudomonas putida KT2440
gcgguuguagaucgccggcag

SEQ ID NO: 3598959 - RNA, 21 nt, Pseudomonas putida KT2440
gcgguugucgaccuggcucuu

SEQ ID NO: 3598960 - RNA, 20 nt, Pseudomonas putida KT2440
gcgguuucugcaaccacgac

SEQ ID NO: 3598961 - RNA, 17 nt, Pseudomonas putida KT2440
gcgguuuuuucauggau

SEQ ID NO: 3598962 - RNA, 13 nt, Pseudomonas putida KT2440
gcguaagcuggcu

SEQ ID NO: 3598963 - RNA, 13 nt, Pseudomonas putida KT2440
gcguacacugcag

SEQ ID NO: 3598964 - RNA, 14 nt, Pseudomonas putida KT2440
gcguacagcugcuc

SEQ ID NO: 3598965 - RNA, 15 nt, Pseudomonas putida KT2440
gcguacaucagccuc

SEQ ID NO: 3598966 - RNA, 14 nt, Pseudomonas putida KT2440
gcguaccagcaggg

SEQ ID NO: 3598967 - RNA, 20 nt, Pseudomonas putida KT2440
gcguacccagcucgaucagc

SEQ ID NO: 3598968 - RNA, 22 nt, Pseudomonas putida KT2440
gcguaccccuggcgcuuuccag

SEQ ID NO: 3598969 - RNA, 22 nt, Pseudomonas putida KT2440
gcguacccgucgcucuucaacc

SEQ ID NO: 3598970 - RNA, 13 nt, Pseudomonas putida KT2440
gcguaccggcaac

SEQ ID NO: 3598971 - RNA, 14 nt, Pseudomonas putida KT2440
gcguaccggcaacc

SEQ ID NO: 3598972 - RNA, 20 nt, Pseudomonas putida KT2440
gcguaccggcaacccggcag

SEQ ID NO: 3598973 - RNA, 14 nt, Pseudomonas putida KT2440
gcguaccuggcugc

SEQ ID NO: 3598974 - RNA, 15 nt, Pseudomonas putida KT2440
gcguacgcaugguca

SEQ ID NO: 3598975 - RNA, 19 nt, Pseudomonas putida KT2440
gcguacgccguugccgccc

SEQ ID NO: 3598976 - RNA, 14 nt, Pseudomonas putida KT2440
gcguacggccuugg

SEQ ID NO: 3598977 - RNA, 15 nt, Pseudomonas putida KT2440
gcguacggccuuggc

SEQ ID NO: 3598978 - RNA, 16 nt, Pseudomonas putida KT2440
gcguagcaggaucugc

SEQ ID NO: 3598979 - RNA, 21 nt, Pseudomonas putida KT2440
gcguagcaggaucugcugcag

SEQ ID NO: 3598980 - RNA, 19 nt, Pseudomonas putida KT2440
gcguagccuucagcggccg

SEQ ID NO: 3598981 - RNA, 22 nt, Pseudomonas putida KT2440
gcguaggccugcgaaaggcgcu

SEQ ID NO: 3598982 - RNA, 20 nt, Pseudomonas putida KT2440
gcguaggcgcaucgggccga

SEQ ID NO: 3598983 - RNA, 23 nt, Pseudomonas putida KT2440
gcguaggggcggauuugcccgcu

SEQ ID NO: 3598984 - RNA, 16 nt, Pseudomonas putida KT2440
gcguaggugcgcggcc

SEQ ID NO: 3598985 - RNA, 18 nt, Pseudomonas putida KT2440
gcguaguacuccagcagc

SEQ ID NO: 3598986 - RNA, 19 nt, Pseudomonas putida KT2440
gcguaguagauaucggccg

SEQ ID NO: 3598987 - RNA, 13 nt, Pseudomonas putida KT2440
gcguagugcaggc

SEQ ID NO: 3598988 - RNA, 17 nt, Pseudomonas putida KT2440
gcguagugcaggcgcag

SEQ ID NO: 3598989 - RNA, 14 nt, Pseudomonas putida KT2440
gcguauagccaccg

SEQ ID NO: 3598990 - RNA, 16 nt, Pseudomonas putida KT2440
gcguauccuugcccac

SEQ ID NO: 3598991 - RNA, 21 nt, Pseudomonas putida KT2440
gcguauguuuuguaggcgcgg

SEQ ID NO: 3598992 - RNA, 19 nt, Pseudomonas putida KT2440
gcguauucggccaccagcc

SEQ ID NO: 3598993 - RNA, 20 nt, Pseudomonas putida KT2440
gcguauugccagaaggcuca

SEQ ID NO: 3598994 - RNA, 20 nt, Pseudomonas putida KT2440
gcguauuuccugagcgguga

SEQ ID NO: 3598995 - RNA, 16 nt, Pseudomonas putida KT2440
gcguauuugaccagcc

SEQ ID NO: 3598996 - RNA, 21 nt, Pseudomonas putida KT2440
gcguauuugaccagcccgcug

SEQ ID NO: 3598997 - RNA, 22 nt, Pseudomonas putida KT2440
gcguauuuuugcgccaggcgca

SEQ ID NO: 3598998 - RNA, 14 nt, Pseudomonas putida KT2440
gcgucaaacagccg

SEQ ID NO: 3598999 - RNA, 20 nt, Pseudomonas putida KT2440
gcgucaaacagccgcccagu

SEQ ID NO: 3599000 - RNA, 22 nt, Pseudomonas putida KT2440
gcgucaacucaucacucuugcg

SEQ ID NO: 3599001 - RNA, 17 nt, Pseudomonas putida KT2440
gcgucacccgcgccacc

SEQ ID NO: 3599002 - RNA, 15 nt, Pseudomonas putida KT2440
gcgucaccuuccugg

SEQ ID NO: 3599003 - RNA, 16 nt, Pseudomonas putida KT2440
gcgucacugcaccucc

SEQ ID NO: 3599004 - RNA, 21 nt, Pseudomonas putida KT2440
gcgucacugcaccucccgcca

SEQ ID NO: 3599005 - RNA, 17 nt, Pseudomonas putida KT2440
gcgucagccguugacca

SEQ ID NO: 3599006 - RNA, 17 nt, Pseudomonas putida KT2440
gcgucagcguugcuggc

SEQ ID NO: 3599007 - RNA, 17 nt, Pseudomonas putida KT2440
gcgucagcucaagcgcu

SEQ ID NO: 3599008 - RNA, 18 nt, Pseudomonas putida KT2440
gcgucaggccaugcccuu

SEQ ID NO: 3599009 - RNA, 15 nt, Pseudomonas putida KT2440
gcgucagucgccaac

SEQ ID NO: 3599010 - RNA, 15 nt, Pseudomonas putida KT2440
gcgucauacucuucg

SEQ ID NO: 3599011 - RNA, 17 nt, Pseudomonas putida KT2440
gcgucauacucuucgcg

SEQ ID NO: 3599012 - RNA, 18 nt, Pseudomonas putida KT2440
gcgucaucaucagcaggc

SEQ ID NO: 3599013 - RNA, 13 nt, Pseudomonas putida KT2440
gcgucauccgcca

SEQ ID NO: 3599014 - RNA, 17 nt, Pseudomonas putida KT2440
gcgucauccugcgcggc

SEQ ID NO: 3599015 - RNA, 20 nt, Pseudomonas putida KT2440
gcguccacagccaugccggc

SEQ ID NO: 3599016 - RNA, 14 nt, Pseudomonas putida KT2440
gcguccagcaacag

SEQ ID NO: 3599017 - RNA, 16 nt, Pseudomonas putida KT2440
gcguccagcaacagcu

SEQ ID NO: 3599018 - RNA, 19 nt, Pseudomonas putida KT2440
gcguccagcaacagcugcc

SEQ ID NO: 3599019 - RNA, 22 nt, Pseudomonas putida KT2440
gcguccagcagugccaucgccu

SEQ ID NO: 3599020 - RNA, 23 nt, Pseudomonas putida KT2440
gcguccagcagugccaucgccuc

SEQ ID NO: 3599021 - RNA, 18 nt, Pseudomonas putida KT2440
gcguccaggcccgccaga

SEQ ID NO: 3599022 - RNA, 23 nt, Pseudomonas putida KT2440
gcguccaguucaaugccagcagu

SEQ ID NO: 3599023 - RNA, 18 nt, Pseudomonas putida KT2440
gcgucccccgguaccagc

SEQ ID NO: 3599024 - RNA, 17 nt, Pseudomonas putida KT2440
gcguccgagcggagcug

SEQ ID NO: 3599025 - RNA, 16 nt, Pseudomonas putida KT2440
gcguccggcuugagac

SEQ ID NO: 3599026 - RNA, 15 nt, Pseudomonas putida KT2440
gcguccgucgccggc

SEQ ID NO: 3599027 - RNA, 19 nt, Pseudomonas putida KT2440
gcguccgucgccggccggc

SEQ ID NO: 3599028 - RNA, 22 nt, Pseudomonas putida KT2440
gcguccucauaaugcuccgcca

SEQ ID NO: 3599029 - RNA, 16 nt, Pseudomonas putida KT2440
gcguccuggacccgca

SEQ ID NO: 3599030 - RNA, 19 nt, Pseudomonas putida KT2440
gcgucgccaaucucguugc

SEQ ID NO: 3599031 - RNA, 21 nt, Pseudomonas putida KT2440
gcgucgccaaucucguugcgc

SEQ ID NO: 3599032 - RNA, 13 nt, Pseudomonas putida KT2440
gcgucgcccagac

SEQ ID NO: 3599033 - RNA, 19 nt, Pseudomonas putida KT2440
gcgucgcgaugggcugcaa

SEQ ID NO: 3599034 - RNA, 21 nt, Pseudomonas putida KT2440
gcgucgcgcgcccaggcccaa

SEQ ID NO: 3599035 - RNA, 16 nt, Pseudomonas putida KT2440
gcgucgcggccccagg

SEQ ID NO: 3599036 - RNA, 22 nt, Pseudomonas putida KT2440
gcgucgcuucaucggcuggcag

SEQ ID NO: 3599037 - RNA, 17 nt, Pseudomonas putida KT2440
gcgucggcagagcgcca

SEQ ID NO: 3599038 - RNA, 18 nt, Pseudomonas putida KT2440
gcgucggcagagcgccag

SEQ ID NO: 3599039 - RNA, 19 nt, Pseudomonas putida KT2440
gcgucggccaccuggucga

SEQ ID NO: 3599040 - RNA, 19 nt, Pseudomonas putida KT2440
gcgucggccaugccacccc

SEQ ID NO: 3599041 - RNA, 16 nt, Pseudomonas putida KT2440
gcgucggccgaugucu

SEQ ID NO: 3599042 - RNA, 13 nt, Pseudomonas putida KT2440
gcgucggcgacgu

SEQ ID NO: 3599043 - RNA, 22 nt, Pseudomonas putida KT2440
gcgucggcgacguugguagaga

SEQ ID NO: 3599044 - RNA, 12 nt, Pseudomonas putida KT2440
gcgucggcgcgc

SEQ ID NO: 3599045 - RNA, 15 nt, Pseudomonas putida KT2440
gcgucggucagcgag

SEQ ID NO: 3599046 - RNA, 16 nt, Pseudomonas putida KT2440
gcgucguacaggccua

SEQ ID NO: 3599047 - RNA, 17 nt, Pseudomonas putida KT2440
gcgucguguucgccugu

SEQ ID NO: 3599048 - RNA, 20 nt, Pseudomonas putida KT2440
gcgucguuggggucgaccgg

SEQ ID NO: 3599049 - RNA, 17 nt, Pseudomonas putida KT2440
gcuacgaaaccgucaug

SEQ ID NO: 3599050 - RNA, 20 nt, Pseudomonas putida KT2440
gcuacgaaaccgucaugcag

SEQ ID NO: 3599051 - RNA, 15 nt, Pseudomonas putida KT2440
gcuacgaaccgagcg

SEQ ID NO: 3599052 - RNA, 19 nt, Pseudomonas putida KT2440
gcuacgacccugaagcccu

SEQ ID NO: 3599053 - RNA, 22 nt, Pseudomonas putida KT2440
gcuacgagacgguggcugccag

SEQ ID NO: 3599054 - RNA, 20 nt, Pseudomonas putida KT2440
gcuacgagagaucgcagcga

SEQ ID NO: 3599055 - RNA, 16 nt, Pseudomonas putida KT2440
gcuacgauccgauaau

SEQ ID NO: 3599056 - RNA, 16 nt, Pseudomonas putida KT2440
gcuacgcagcacccgg

SEQ ID NO: 3599057 - RNA, 12 nt, Pseudomonas putida KT2440
gcuacgccgccc

SEQ ID NO: 3599058 - RNA, 17 nt, Pseudomonas putida KT2440
gcuacgccgccccacuc

SEQ ID NO: 3599059 - RNA, 17 nt, Pseudomonas putida KT2440
gcuacgccgccgcuggc

SEQ ID NO: 3599060 - RNA, 23 nt, Pseudomonas putida KT2440
gcuacgcgcgggguugacagagg

SEQ ID NO: 3599061 - RNA, 19 nt, Pseudomonas putida KT2440
gcuacggccgugcagggcg

SEQ ID NO: 3599062 - RNA, 20 nt, Pseudomonas putida KT2440
gcuacugccgucguuguucu

SEQ ID NO: 3599063 - RNA, 20 nt, Pseudomonas putida KT2440
gcuaggcggccccauuucaa

SEQ ID NO: 3599064 - RNA, 15 nt, Pseudomonas putida KT2440
gcuauaucucuggua

SEQ ID NO: 3599065 - RNA, 16 nt, Pseudomonas putida KT2440
gcuaucgccagcaggc

SEQ ID NO: 3599066 - RNA, 18 nt, Pseudomonas putida KT2440
gcuaucgccagcaggccg

SEQ ID NO: 3599067 - RNA, 18 nt, Pseudomonas putida KT2440
gcuaugccggucagcagc

SEQ ID NO: 3599068 - RNA, 19 nt, Pseudomonas putida KT2440
gcuaugccggucagcagca

SEQ ID NO: 3599069 - RNA, 16 nt, Pseudomonas putida KT2440
gcuauugagagcagau

SEQ ID NO: 3599070 - RNA, 12 nt, Pseudomonas putida KT2440
gcucaaaaaaau

SEQ ID NO: 3599071 - RNA, 13 nt, Pseudomonas putida KT2440
gcucaaaaaaaua

SEQ ID NO: 3599072 - RNA, 18 nt, Pseudomonas putida KT2440
gcucaaaccccccaugcu

SEQ ID NO: 3599073 - RNA, 20 nt, Pseudomonas putida KT2440
gcucaaaccccccaugcuca

SEQ ID NO: 3599074 - RNA, 14 nt, Pseudomonas putida KT2440
gcucaaaugcuggc

SEQ ID NO: 3599075 - RNA, 22 nt, Pseudomonas putida KT2440
gcucaaaugcuggcaauccagc

SEQ ID NO: 3599076 - RNA, 14 nt, Pseudomonas putida KT2440
gcucaacagcaggu

SEQ ID NO: 3599077 - RNA, 14 nt, Pseudomonas putida KT2440
gcucaaccagccgc

SEQ ID NO: 3599078 - RNA, 22 nt, Pseudomonas putida KT2440
gcucaaccuuugcggcacaucu

SEQ ID NO: 3599079 - RNA, 20 nt, Pseudomonas putida KT2440
gcucaacgccagggcaaucg

SEQ ID NO: 3599080 - RNA, 15 nt, Pseudomonas putida KT2440
gcucaacuacccuga

SEQ ID NO: 3599081 - RNA, 15 nt, Pseudomonas putida KT2440
gcucaagcgccaggg

SEQ ID NO: 3599082 - RNA, 16 nt, Pseudomonas putida KT2440
gcucaagcgccagggc

SEQ ID NO: 3599083 - RNA, 19 nt, Pseudomonas putida KT2440
gcucaagcgccagggcauc

SEQ ID NO: 3599084 - RNA, 20 nt, Pseudomonas putida KT2440
gcucaagcgugacggccagc

SEQ ID NO: 3599085 - RNA, 16 nt, Pseudomonas putida KT2440
gcucaauagcggcggu

SEQ ID NO: 3599086 - RNA, 19 nt, Pseudomonas putida KT2440
gcucaaucaaccagcccgc

SEQ ID NO: 3599087 - RNA, 21 nt, Pseudomonas putida KT2440
gcucaauuggauagagcaucc

SEQ ID NO: 3599088 - RNA, 12 nt, Pseudomonas putida KT2440
gcucacagcacu

SEQ ID NO: 3599089 - RNA, 14 nt, Pseudomonas putida KT2440
gcucacagcacucg

SEQ ID NO: 3599090 - RNA, 15 nt, Pseudomonas putida KT2440
gcucacaggcucagu

SEQ ID NO: 3599091 - RNA, 13 nt, Pseudomonas putida KT2440
gcucacccaccag

SEQ ID NO: 3599092 - RNA, 21 nt, Pseudomonas putida KT2440
gcucacccgaccagaucaggc

SEQ ID NO: 3599093 - RNA, 17 nt, Pseudomonas putida KT2440
gcucacccuucucgaac

SEQ ID NO: 3599094 - RNA, 14 nt, Pseudomonas putida KT2440
gcucaccgcagccc

SEQ ID NO: 3599095 - RNA, 17 nt, Pseudomonas putida KT2440
gcucaccgcagcccagc

SEQ ID NO: 3599096 - RNA, 15 nt, Pseudomonas putida KT2440
gcucaccggccagcg

SEQ ID NO: 3599097 - RNA, 16 nt, Pseudomonas putida KT2440
gcucaccggccagcgc

SEQ ID NO: 3599098 - RNA, 18 nt, Pseudomonas putida KT2440
gcucaccggccagcgcgc

SEQ ID NO: 3599099 - RNA, 13 nt, Pseudomonas putida KT2440
gcucaccgugguc

SEQ ID NO: 3599100 - RNA, 13 nt, Pseudomonas putida KT2440
gcucaccugguac

SEQ ID NO: 3599101 - RNA, 18 nt, Pseudomonas putida KT2440
gcucaccugguaccccuc

SEQ ID NO: 3599102 - RNA, 13 nt, Pseudomonas putida KT2440
gcucacgcagcca

SEQ ID NO: 3599103 - RNA, 16 nt, Pseudomonas putida KT2440
gcucacgcagcccuuu

SEQ ID NO: 3599104 - RNA, 20 nt, Pseudomonas putida KT2440
gcucacgcagcccuuucagg

SEQ ID NO: 3599105 - RNA, 13 nt, Pseudomonas putida KT2440
gcucacgccccgu

SEQ ID NO: 3599106 - RNA, 13 nt, Pseudomonas putida KT2440
gcucacugaccac

SEQ ID NO: 3599107 - RNA, 16 nt, Pseudomonas putida KT2440
gcucacuggcauccag

SEQ ID NO: 3599108 - RNA, 24 nt, Pseudomonas putida KT2440
gcucacuggcauccagcgccacca

SEQ ID NO: 3599109 - RNA, 21 nt, Pseudomonas putida KT2440
gcucacuggccaacuccccac

SEQ ID NO: 3599110 - RNA, 18 nt, Pseudomonas putida KT2440
gcucagcaacugggcaau

SEQ ID NO: 3599111 - RNA, 23 nt, Pseudomonas putida KT2440
gcucagcagguugaacagcagcg

SEQ ID NO: 3599112 - RNA, 18 nt, Pseudomonas putida KT2440
gcucagccaaccgcccca

SEQ ID NO: 3599113 - RNA, 17 nt, Pseudomonas putida KT2440
gcucagccaccuguggg

SEQ ID NO: 3599114 - RNA, 17 nt, Pseudomonas putida KT2440
gcucagccacgcuggca

SEQ ID NO: 3599115 - RNA, 18 nt, Pseudomonas putida KT2440
gcucagccacgcuggcac

SEQ ID NO: 3599116 - RNA, 21 nt, Pseudomonas putida KT2440
gcucagccacgcuggcaccca

SEQ ID NO: 3599117 - RNA, 13 nt, Pseudomonas putida KT2440
gcucagccagcaa

SEQ ID NO: 3599118 - RNA, 15 nt, Pseudomonas putida KT2440
gcucagccagcaagc

SEQ ID NO: 3599119 - RNA, 22 nt, Pseudomonas putida KT2440
gcucagcgagcgguucagcgca

SEQ ID NO: 3599120 - RNA, 18 nt, Pseudomonas putida KT2440
gcucagcguacgcauggu

SEQ ID NO: 3599121 - RNA, 20 nt, Pseudomonas putida KT2440
gcucagcgugacgauggcca

SEQ ID NO: 3599122 - RNA, 13 nt, Pseudomonas putida KT2440
gcucagcuacgcu

SEQ ID NO: 3599123 - RNA, 15 nt, Pseudomonas putida KT2440
gcucagcuacgcugg

SEQ ID NO: 3599124 - RNA, 14 nt, Pseudomonas putida KT2440
gcucagcuggauag

SEQ ID NO: 3599125 - RNA, 19 nt, Pseudomonas putida KT2440
gcucagcuggauagaguac

SEQ ID NO: 3599126 - RNA, 22 nt, Pseudomonas putida KT2440
gcucagcugggcguuuccaggu

SEQ ID NO: 3599127 - RNA, 21 nt, Pseudomonas putida KT2440
gcucaggaucacgucacccag

SEQ ID NO: 3599128 - RNA, 22 nt, Pseudomonas putida KT2440
gcucaggaucacgucacccagg

SEQ ID NO: 3599129 - RNA, 13 nt, Pseudomonas putida KT2440
gcucaggccaugc

SEQ ID NO: 3599130 - RNA, 14 nt, Pseudomonas putida KT2440
gcucaggccaugcu

SEQ ID NO: 3599131 - RNA, 21 nt, Pseudomonas putida KT2440
gcucaggccaugcugcgccag

SEQ ID NO: 3599132 - RNA, 16 nt, Pseudomonas putida KT2440
gcucaggcgcuccagc

SEQ ID NO: 3599133 - RNA, 14 nt, Pseudomonas putida KT2440
gcucaggcucagcu

SEQ ID NO: 3599134 - RNA, 19 nt, Pseudomonas putida KT2440
gcucaggcucaguugcaag

SEQ ID NO: 3599135 - RNA, 21 nt, Pseudomonas putida KT2440
gcucaggcucuugaacugggc

SEQ ID NO: 3599136 - RNA, 16 nt, Pseudomonas putida KT2440
gcucagggcagcaacg

SEQ ID NO: 3599137 - RNA, 22 nt, Pseudomonas putida KT2440
gcucagggcagcaacgccgagc

SEQ ID NO: 3599138 - RNA, 21 nt, Pseudomonas putida KT2440
gcucaguaauaggugcguggc

SEQ ID NO: 3599139 - RNA, 18 nt, Pseudomonas putida KT2440
gcucagucgcaucgacag

SEQ ID NO: 3599140 - RNA, 16 nt, Pseudomonas putida KT2440
gcucagugucagcggc

SEQ ID NO: 3599141 - RNA, 20 nt, Pseudomonas putida KT2440
gcucagugucagcggcgcag

SEQ ID NO: 3599142 - RNA, 15 nt, Pseudomonas putida KT2440
gcucaguucggguga

SEQ ID NO: 3599143 - RNA, 17 nt, Pseudomonas putida KT2440
gcucaguugguagagca

SEQ ID NO: 3599144 - RNA, 20 nt, Pseudomonas putida KT2440
gcucauacugcugacccgga

SEQ ID NO: 3599145 - RNA, 16 nt, Pseudomonas putida KT2440
gcucaucaccggcguu

SEQ ID NO: 3599146 - RNA, 15 nt, Pseudomonas putida KT2440
gcucauccaucaccu

SEQ ID NO: 3599147 - RNA, 21 nt, Pseudomonas putida KT2440
gcucauccuuuuuugggcuga

SEQ ID NO: 3599148 - RNA, 16 nt, Pseudomonas putida KT2440
gcucaucgaggcguug

SEQ ID NO: 3599149 - RNA, 17 nt, Pseudomonas putida KT2440
gcucaucuaccagcuug

SEQ ID NO: 3599150 - RNA, 19 nt, Pseudomonas putida KT2440
gcucaucuaccugagccug

SEQ ID NO: 3599151 - RNA, 15 nt, Pseudomonas putida KT2440
gcucaugaacagcgc

SEQ ID NO: 3599152 - RNA, 16 nt, Pseudomonas putida KT2440
gcucaugaacagcgcc

SEQ ID NO: 3599153 - RNA, 16 nt, Pseudomonas putida KT2440
gcucauguccagguca

SEQ ID NO: 3599154 - RNA, 20 nt, Pseudomonas putida KT2440
gcucgacgcgggccaagguc

SEQ ID NO: 3599155 - RNA, 14 nt, Pseudomonas putida KT2440
gcucgacggcgcaa

SEQ ID NO: 3599156 - RNA, 18 nt, Pseudomonas putida KT2440
gcucgacguuuaccugca

SEQ ID NO: 3599157 - RNA, 20 nt, Pseudomonas putida KT2440
gcucgacguuuaccugcagc

SEQ ID NO: 3599158 - RNA, 19 nt, Pseudomonas putida KT2440
gcucgagaaacgccagcug

SEQ ID NO: 3599159 - RNA, 23 nt, Pseudomonas putida KT2440
gcucgagaaacucacgcauggcc

SEQ ID NO: 3599160 - RNA, 19 nt, Pseudomonas putida KT2440
gcucgagcccgccagcagg

SEQ ID NO: 3599161 - RNA, 17 nt, Pseudomonas putida KT2440
gcucgagugcgaaggca

SEQ ID NO: 3599162 - RNA, 15 nt, Pseudomonas putida KT2440
gcucgaucaggcucu

SEQ ID NO: 3599163 - RNA, 14 nt, Pseudomonas putida KT2440
gcucgaucggcaag

SEQ ID NO: 3599164 - RNA, 16 nt, Pseudomonas putida KT2440
gcucgaucggcaagcc

SEQ ID NO: 3599165 - RNA, 18 nt, Pseudomonas putida KT2440
gcucgaucuugccuucgg

SEQ ID NO: 3599166 - RNA, 22 nt, Pseudomonas putida KT2440
gcucgauuagcuccaccagcgg

SEQ ID NO: 3599167 - RNA, 16 nt, Pseudomonas putida KT2440
gcucgcagccaaugcu

SEQ ID NO: 3599168 - RNA, 18 nt, Pseudomonas putida KT2440
gcucgcagguauccgggu

SEQ ID NO: 3599169 - RNA, 19 nt, Pseudomonas putida KT2440
gcucgcaugagccggggcu

SEQ ID NO: 3599170 - RNA, 12 nt, Pseudomonas putida KT2440
gcucgcccacac

SEQ ID NO: 3599171 - RNA, 15 nt, Pseudomonas putida KT2440
gcucgcccagcagcc

SEQ ID NO: 3599172 - RNA, 18 nt, Pseudomonas putida KT2440
gcucgcccagcagccaac

SEQ ID NO: 3599173 - RNA, 13 nt, Pseudomonas putida KT2440
gcucgcccgcgaa

SEQ ID NO: 3599174 - RNA, 16 nt, Pseudomonas putida KT2440
gcucgcccggcacggc

SEQ ID NO: 3599175 - RNA, 16 nt, Pseudomonas putida KT2440
gcucgcccgggucagg

SEQ ID NO: 3599176 - RNA, 18 nt, Pseudomonas putida KT2440
gcucgcccgggucagguc

SEQ ID NO: 3599177 - RNA, 18 nt, Pseudomonas putida KT2440
gcucgccgcccaguggca

SEQ ID NO: 3599178 - RNA, 15 nt, Pseudomonas putida KT2440
gcucgccggguucca

SEQ ID NO: 3599179 - RNA, 18 nt, Pseudomonas putida KT2440
gcucgccucacagcgccg

SEQ ID NO: 3599180 - RNA, 11 nt, Pseudomonas putida KT2440
gcucgccugcu

SEQ ID NO: 3599181 - RNA, 12 nt, Pseudomonas putida KT2440
gcucgccugcuu

SEQ ID NO: 3599182 - RNA, 21 nt, Pseudomonas putida KT2440
gcucgcgauccaucuucaccu

SEQ ID NO: 3599183 - RNA, 21 nt, Pseudomonas putida KT2440
gcucgcgcaggaaccgcguca

SEQ ID NO: 3599184 - RNA, 15 nt, Pseudomonas putida KT2440
gcucgcgcagggcau

SEQ ID NO: 3599185 - RNA, 16 nt, Pseudomonas putida KT2440
gcucgcgcagggcauc

SEQ ID NO: 3599186 - RNA, 22 nt, Pseudomonas putida KT2440
gcucgcgcaggguuuucagcgc

SEQ ID NO: 3599187 - RNA, 15 nt, Pseudomonas putida KT2440
gcucgcgcaugaucg

SEQ ID NO: 3599188 - RNA, 17 nt, Pseudomonas putida KT2440
gcucgcgcugccaggcc

SEQ ID NO: 3599189 - RNA, 13 nt, Pseudomonas putida KT2440
gcucgcgcugcgc

SEQ ID NO: 3599190 - RNA, 14 nt, Pseudomonas putida KT2440
gcucgcgcugcgca

SEQ ID NO: 3599191 - RNA, 17 nt, Pseudomonas putida KT2440
gcucgcgcugcgcagcc

SEQ ID NO: 3599192 - RNA, 20 nt, Pseudomonas putida KT2440
gcucgcgcugcgcagccaac

SEQ ID NO: 3599193 - RNA, 13 nt, Pseudomonas putida KT2440
gcucgcggcgcag

SEQ ID NO: 3599194 - RNA, 15 nt, Pseudomonas putida KT2440
gcucgcucaggcucu

SEQ ID NO: 3599195 - RNA, 20 nt, Pseudomonas putida KT2440
gcucgcuggccaccagcaug

SEQ ID NO: 3599196 - RNA, 17 nt, Pseudomonas putida KT2440
gcucgcuuuccaaaccu

SEQ ID NO: 3599197 - RNA, 18 nt, Pseudomonas putida KT2440
gcucggaaaggucggcgg

SEQ ID NO: 3599198 - RNA, 21 nt, Pseudomonas putida KT2440
gcucggacaaauccaggucgg

SEQ ID NO: 3599199 - RNA, 16 nt, Pseudomonas putida KT2440
gcucggagaacgggcu

SEQ ID NO: 3599200 - RNA, 18 nt, Pseudomonas putida KT2440
gcucggcaaacagguucu

SEQ ID NO: 3599201 - RNA, 20 nt, Pseudomonas putida KT2440
gcucggcaaggcguaccggc

SEQ ID NO: 3599202 - RNA, 22 nt, Pseudomonas putida KT2440
gcucggcaaggcguaccggcaa

SEQ ID NO: 3599203 - RNA, 16 nt, Pseudomonas putida KT2440
gcucggcaguggcggu

SEQ ID NO: 3599204 - RNA, 17 nt, Pseudomonas putida KT2440
gcucggcaucuuuggcu

SEQ ID NO: 3599205 - RNA, 22 nt, Pseudomonas putida KT2440
gcucggcauguucaucaccggc

SEQ ID NO: 3599206 - RNA, 18 nt, Pseudomonas putida KT2440
gcucggccaccacccgcu

SEQ ID NO: 3599207 - RNA, 21 nt, Pseudomonas putida KT2440
gcucggccaccacccgcuggg

SEQ ID NO: 3599208 - RNA, 18 nt, Pseudomonas putida KT2440
gcucggccaccacuucug

SEQ ID NO: 3599209 - RNA, 12 nt, Pseudomonas putida KT2440
gcucggccagcc

SEQ ID NO: 3599210 - RNA, 19 nt, Pseudomonas putida KT2440
gcucggccaguaccagguc

SEQ ID NO: 3599211 - RNA, 19 nt, Pseudomonas putida KT2440
gcucggccgaugccaggua

SEQ ID NO: 3599212 - RNA, 19 nt, Pseudomonas putida KT2440
gcucggccggggcaaccug

SEQ ID NO: 3599213 - RNA, 14 nt, Pseudomonas putida KT2440
gcucggccugggca

SEQ ID NO: 3599214 - RNA, 12 nt, Pseudomonas putida KT2440
gcucggccuugc

SEQ ID NO: 3599215 - RNA, 19 nt, Pseudomonas putida KT2440
gcucggccuugcgagccug

SEQ ID NO: 3599216 - RNA, 17 nt, Pseudomonas putida KT2440
gcucggcgaugccgcgc

SEQ ID NO: 3599217 - RNA, 24 nt, Pseudomonas putida KT2440
gcucggcgaugccgcgcgcccgcu

SEQ ID NO: 3599218 - RNA, 17 nt, Pseudomonas putida KT2440
gcucggugugcaccugg

SEQ ID NO: 3599219 - RNA, 21 nt, Pseudomonas putida KT2440
gcucguacgaguugccuucga

SEQ ID NO: 3599220 - RNA, 14 nt, Pseudomonas putida KT2440
gcucgucaaccaca

SEQ ID NO: 3599221 - RNA, 16 nt, Pseudomonas putida KT2440
gcucgucaaccacagc

SEQ ID NO: 3599222 - RNA, 19 nt, Pseudomonas putida KT2440
gcucgucaaccacagcccg

SEQ ID NO: 3599223 - RNA, 13 nt, Pseudomonas putida KT2440
gcucgucacgggu

SEQ ID NO: 3599224 - RNA, 15 nt, Pseudomonas putida KT2440
gcucgucacggguau

SEQ ID NO: 3599225 - RNA, 20 nt, Pseudomonas putida KT2440
gcucguccaggcccugcagc

SEQ ID NO: 3599226 - RNA, 13 nt, Pseudomonas putida KT2440
gcucguccaucac

SEQ ID NO: 3599227 - RNA, 17 nt, Pseudomonas putida KT2440
gcucguccaucaccgcc

SEQ ID NO: 3599228 - RNA, 18 nt, Pseudomonas putida KT2440
gcucguccaucaccgcca

SEQ ID NO: 3599229 - RNA, 16 nt, Pseudomonas putida KT2440
gcucguccugcagggc

SEQ ID NO: 3599230 - RNA, 21 nt, Pseudomonas putida KT2440
gcucguccugcagggcgagca

SEQ ID NO: 3599231 - RNA, 22 nt, Pseudomonas putida KT2440
gcucgucgagcaacuugcgcag

SEQ ID NO: 3599232 - RNA, 19 nt, Pseudomonas putida KT2440
gcucgucgcacucugggcu

SEQ ID NO: 3599233 - RNA, 13 nt, Pseudomonas putida KT2440
gcucgucguccuc

SEQ ID NO: 3599234 - RNA, 17 nt, Pseudomonas putida KT2440
gcucgucucuggccgca

SEQ ID NO: 3599235 - RNA, 18 nt, Pseudomonas putida KT2440
gcucguguuagcugggcu

SEQ ID NO: 3599236 - RNA, 22 nt, Pseudomonas putida KT2440
gcucguugcugagcaagcgcgc

SEQ ID NO: 3599237 - RNA, 17 nt, Pseudomonas putida KT2440
gcucguuguccagcagc

SEQ ID NO: 3599238 - RNA, 18 nt, Pseudomonas putida KT2440
gcucguuguccagcagca

SEQ ID NO: 3599239 - RNA, 19 nt, Pseudomonas putida KT2440
gcucguuguccagcagcag

SEQ ID NO: 3599240 - RNA, 12 nt, Pseudomonas putida KT2440
gcucucagccca

SEQ ID NO: 3599241 - RNA, 20 nt, Pseudomonas putida KT2440
gcucuccagccgcugcugca

SEQ ID NO: 3599242 - RNA, 15 nt, Pseudomonas putida KT2440
gcucuccaggguucg

SEQ ID NO: 3599243 - RNA, 24 nt, Pseudomonas putida KT2440
gcucuccucucccaccagcauaug

SEQ ID NO: 3599244 - RNA, 18 nt, Pseudomonas putida KT2440
gcucucgaaguagcgcuc

SEQ ID NO: 3599245 - RNA, 19 nt, Pseudomonas putida KT2440
gcucucgucgguuuccucg

SEQ ID NO: 3599246 - RNA, 18 nt, Pseudomonas putida KT2440
gcucugaaugucagcgcu

SEQ ID NO: 3599247 - RNA, 15 nt, Pseudomonas putida KT2440
gcucugauagcgagc

SEQ ID NO: 3599248 - RNA, 15 nt, Pseudomonas putida KT2440
gcucugcaaugccgc

SEQ ID NO: 3599249 - RNA, 16 nt, Pseudomonas putida KT2440
gcucugcaggcacacc

SEQ ID NO: 3599250 - RNA, 20 nt, Pseudomonas putida KT2440
gcucugcccgcgccacccgc

SEQ ID NO: 3599251 - RNA, 24 nt, Pseudomonas putida KT2440
gcucugccgccgcagcaaucugcu

SEQ ID NO: 3599252 - RNA, 20 nt, Pseudomonas putida KT2440
gcucugccgguguucgcggg

SEQ ID NO: 3599253 - RNA, 17 nt, Pseudomonas putida KT2440
gcucugcgccagcaguu

SEQ ID NO: 3599254 - RNA, 19 nt, Pseudomonas putida KT2440
gcucugcgccugcgggugc

SEQ ID NO: 3599255 - RNA, 20 nt, Pseudomonas putida KT2440
gcucugcggcccauucgcgg

SEQ ID NO: 3599256 - RNA, 24 nt, Pseudomonas putida KT2440
gcucugcggcccauucgcgggcaa

SEQ ID NO: 3599257 - RNA, 14 nt, Pseudomonas putida KT2440
gcucugcuccagcu

SEQ ID NO: 3599258 - RNA, 15 nt, Pseudomonas putida KT2440
gcucugcuccagcug

SEQ ID NO: 3599259 - RNA, 16 nt, Pseudomonas putida KT2440
gcugcaccaccugcuc

SEQ ID NO: 3599260 - RNA, 16 nt, Pseudomonas putida KT2440
gcugcaccgcagcccc

SEQ ID NO: 3599261 - RNA, 17 nt, Pseudomonas putida KT2440
gcugcaccgccaccccg

SEQ ID NO: 3599262 - RNA, 22 nt, Pseudomonas putida KT2440
gcugcacgucgcgcagggccuu

SEQ ID NO: 3599263 - RNA, 16 nt, Pseudomonas putida KT2440
gcugcacuggcaugcg

SEQ ID NO: 3599264 - RNA, 20 nt, Pseudomonas putida KT2440
gcugcacuggcaugcggcau

SEQ ID NO: 3599265 - RNA, 13 nt, Pseudomonas putida KT2440
gcugcacuuccac

SEQ ID NO: 3599266 - RNA, 19 nt, Pseudomonas putida KT2440
gcugcacuucgauacccag

SEQ ID NO: 3599267 - RNA, 21 nt, Pseudomonas putida KT2440
gcugcacuucgauacccagcc

SEQ ID NO: 3599268 - RNA, 19 nt, Pseudomonas putida KT2440
gcugcagaaccgccagcac

SEQ ID NO: 3599269 - RNA, 20 nt, Pseudomonas putida KT2440
gcugcagaaccgccagcacc

SEQ ID NO: 3599270 - RNA, 15 nt, Pseudomonas putida KT2440
gcugcagauugcauc

SEQ ID NO: 3599271 - RNA, 16 nt, Pseudomonas putida KT2440
gcugcagauugcauca

SEQ ID NO: 3599272 - RNA, 19 nt, Pseudomonas putida KT2440
gcugcagauugcaucacug

SEQ ID NO: 3599273 - RNA, 15 nt, Pseudomonas putida KT2440
gcugcagcacugccu

SEQ ID NO: 3599274 - RNA, 16 nt, Pseudomonas putida KT2440
gcugcagcacugccug

SEQ ID NO: 3599275 - RNA, 17 nt, Pseudomonas putida KT2440
gcugcagcacugccugc

SEQ ID NO: 3599276 - RNA, 18 nt, Pseudomonas putida KT2440
gcugcagcacugccugca

SEQ ID NO: 3599277 - RNA, 18 nt, Pseudomonas putida KT2440
gcugcagcagcuuccugu

SEQ ID NO: 3599278 - RNA, 12 nt, Pseudomonas putida KT2440
gcugcagcaggc

SEQ ID NO: 3599279 - RNA, 17 nt, Pseudomonas putida KT2440
gcugcagcaggcuggcg

SEQ ID NO: 3599280 - RNA, 14 nt, Pseudomonas putida KT2440
gcugcagcauggcg

SEQ ID NO: 3599281 - RNA, 15 nt, Pseudomonas putida KT2440
gcugcagcauggcgu

SEQ ID NO: 3599282 - RNA, 19 nt, Pseudomonas putida KT2440
gcugcagccaaccuucagg

SEQ ID NO: 3599283 - RNA, 22 nt, Pseudomonas putida KT2440
gcugcagcuccuuguagauauu

SEQ ID NO: 3599284 - RNA, 16 nt, Pseudomonas putida KT2440
gcugcaggcucugaau

SEQ ID NO: 3599285 - RNA, 17 nt, Pseudomonas putida KT2440
gcugcagggcacgccaa

SEQ ID NO: 3599286 - RNA, 21 nt, Pseudomonas putida KT2440
gcugcagggcacgccaaucac

SEQ ID NO: 3599287 - RNA, 17 nt, Pseudomonas putida KT2440
gcugcagggcccagcca

SEQ ID NO: 3599288 - RNA, 19 nt, Pseudomonas putida KT2440
gcugcagggcccagccacc

SEQ ID NO: 3599289 - RNA, 15 nt, Pseudomonas putida KT2440
gcugcagggcgccga

SEQ ID NO: 3599290 - RNA, 16 nt, Pseudomonas putida KT2440
gcugcaguucagggcg

SEQ ID NO: 3599291 - RNA, 16 nt, Pseudomonas putida KT2440
gcugcaguucuuccag

SEQ ID NO: 3599292 - RNA, 20 nt, Pseudomonas putida KT2440
gcugcaguucuuccagcggc

SEQ ID NO: 3599293 - RNA, 21 nt, Pseudomonas putida KT2440
gcugcauacgcaccaacuggu

SEQ ID NO: 3599294 - RNA, 23 nt, Pseudomonas putida KT2440
gcugcaucagguagcugggcccg

SEQ ID NO: 3599295 - RNA, 13 nt, Pseudomonas putida KT2440
gcugcaugcucgg

SEQ ID NO: 3599296 - RNA, 14 nt, Pseudomonas putida KT2440
gcugcaugcucggc

SEQ ID NO: 3599297 - RNA, 15 nt, Pseudomonas putida KT2440
gcugcauugcagccc

SEQ ID NO: 3599298 - RNA, 16 nt, Pseudomonas putida KT2440
gcugcauugcagcccc

SEQ ID NO: 3599299 - RNA, 18 nt, Pseudomonas putida KT2440
gcugcauuggcggcaggc

SEQ ID NO: 3599300 - RNA, 22 nt, Pseudomonas putida KT2440
gcugcauuggcggcaggcgcag

SEQ ID NO: 3599301 - RNA, 19 nt, Pseudomonas putida KT2440
gcugccaaaguccggcgaa

SEQ ID NO: 3599302 - RNA, 21 nt, Pseudomonas putida KT2440
gcugccaaucaacccguucag

SEQ ID NO: 3599303 - RNA, 20 nt, Pseudomonas putida KT2440
gcugccacagguacugcgca

SEQ ID NO: 3599304 - RNA, 20 nt, Pseudomonas putida KT2440
gcugccacccacaggcacga

SEQ ID NO: 3599305 - RNA, 16 nt, Pseudomonas putida KT2440
gcugccacgcaugccu

SEQ ID NO: 3599306 - RNA, 16 nt, Pseudomonas putida KT2440
gcugccacggcggaag

SEQ ID NO: 3599307 - RNA, 13 nt, Pseudomonas putida KT2440
gcugccacgggca

SEQ ID NO: 3599308 - RNA, 20 nt, Pseudomonas putida KT2440
gcugccacguuuucgcggcc

SEQ ID NO: 3599309 - RNA, 16 nt, Pseudomonas putida KT2440
gcugccacucuucacc

SEQ ID NO: 3599310 - RNA, 18 nt, Pseudomonas putida KT2440
gcugccacucuucaccau

SEQ ID NO: 3599311 - RNA, 15 nt, Pseudomonas putida KT2440
gcugccagcagggca

SEQ ID NO: 3599312 - RNA, 14 nt, Pseudomonas putida KT2440
gcugccagcgcgcu

SEQ ID NO: 3599313 - RNA, 16 nt, Pseudomonas putida KT2440
gcugccagcgcgcugc

SEQ ID NO: 3599314 - RNA, 19 nt, Pseudomonas putida KT2440
gcugccagcguuuccgggu

SEQ ID NO: 3599315 - RNA, 18 nt, Pseudomonas putida KT2440
gcugccagcugcgcugcc

SEQ ID NO: 3599316 - RNA, 21 nt, Pseudomonas putida KT2440
gcugccaggaagcucgcacgc

SEQ ID NO: 3599317 - RNA, 13 nt, Pseudomonas putida KT2440
gcugccauacagc

SEQ ID NO: 3599318 - RNA, 16 nt, Pseudomonas putida KT2440
gcugccauacagccag

SEQ ID NO: 3599319 - RNA, 17 nt, Pseudomonas putida KT2440
gcugccauagcgcugca

SEQ ID NO: 3599320 - RNA, 14 nt, Pseudomonas putida KT2440
gcugccauccuuga

SEQ ID NO: 3599321 - RNA, 14 nt, Pseudomonas putida KT2440
gcugccaugcgcug

SEQ ID NO: 3599322 - RNA, 16 nt, Pseudomonas putida KT2440
gcugccaugcgcugca

SEQ ID NO: 3599323 - RNA, 20 nt, Pseudomonas putida KT2440
gcugccauuucuucagcagg

SEQ ID NO: 3599324 - RNA, 19 nt, Pseudomonas putida KT2440
gcugcccaggugccaggcu

SEQ ID NO: 3599325 - RNA, 14 nt, Pseudomonas putida KT2440
gcugccccaacugc

SEQ ID NO: 3599326 - RNA, 21 nt, Pseudomonas putida KT2440
gcugccccaagugccagaacc

SEQ ID NO: 3599327 - RNA, 13 nt, Pseudomonas putida KT2440
gcugcccucgggc

SEQ ID NO: 3599328 - RNA, 17 nt, Pseudomonas putida KT2440
gcugcccucgggcagcc

SEQ ID NO: 3599329 - RNA, 16 nt, Pseudomonas putida KT2440
gcugccgaggcgccga

SEQ ID NO: 3599330 - RNA, 11 nt, Pseudomonas putida KT2440
gcugccgauca

SEQ ID NO: 3599331 - RNA, 14 nt, Pseudomonas putida KT2440
gcugccgaucagca

SEQ ID NO: 3599332 - RNA, 20 nt, Pseudomonas putida KT2440
gcugccgaucagcacgccgc

SEQ ID NO: 3599333 - RNA, 17 nt, Pseudomonas putida KT2440
gcugccgccaaccagcu

SEQ ID NO: 3599334 - RNA, 18 nt, Pseudomonas putida KT2440
gcugccgcccucuugcug

SEQ ID NO: 3599335 - RNA, 21 nt, Pseudomonas putida KT2440
gcugccgcccucuugcugcaa

SEQ ID NO: 3599336 - RNA, 14 nt, Pseudomonas putida KT2440
gcugccgcuucgcg

SEQ ID NO: 3599337 - RNA, 15 nt, Pseudomonas putida KT2440
gcugccgcuucgcgg

SEQ ID NO: 3599338 - RNA, 23 nt, Pseudomonas putida KT2440
gcugccggaacguuuccagcaac

SEQ ID NO: 3599339 - RNA, 13 nt, Pseudomonas putida KT2440
gcugccggccagc

SEQ ID NO: 3599340 - RNA, 21 nt, Pseudomonas putida KT2440
gcugccggcguggcgagcuga

SEQ ID NO: 3599341 - RNA, 20 nt, Pseudomonas putida KT2440
gcugccgggcaaagcggguc

SEQ ID NO: 3599342 - RNA, 15 nt, Pseudomonas putida KT2440
gcugccggucggccu

SEQ ID NO: 3599343 - RNA, 18 nt, Pseudomonas putida KT2440
gcugccguccccaaccgg

SEQ ID NO: 3599344 - RNA, 13 nt, Pseudomonas putida KT2440
gcugccgugcagg

SEQ ID NO: 3599345 - RNA, 22 nt, Pseudomonas putida KT2440
gcugccuccacaccgacaucca

SEQ ID NO: 3599346 - RNA, 23 nt, Pseudomonas putida KT2440
gcugccuggcccgcuacgacccu

SEQ ID NO: 3599347 - RNA, 13 nt, Pseudomonas putida KT2440
gcugccugugccg

SEQ ID NO: 3599348 - RNA, 20 nt, Pseudomonas putida KT2440
gcugccuuccaaccagccag

SEQ ID NO: 3599349 - RNA, 13 nt, Pseudomonas putida KT2440
gcugccuucucug

SEQ ID NO: 3599350 - RNA, 17 nt, Pseudomonas putida KT2440
gcugccuugcccagcuc

SEQ ID NO: 3599351 - RNA, 16 nt, Pseudomonas putida KT2440
gcugccuuuggccgcc

SEQ ID NO: 3599352 - RNA, 23 nt, Pseudomonas putida KT2440
gcugccuuuuccugcugcaacaa

SEQ ID NO: 3599353 - RNA, 20 nt, Pseudomonas putida KT2440
gcugcgaaacgaaacccugc

SEQ ID NO: 3599354 - RNA, 20 nt, Pseudomonas putida KT2440
gcugcgaaccuguugaagcg

SEQ ID NO: 3599355 - RNA, 18 nt, Pseudomonas putida KT2440
gcugcgacacgcgaaucg

SEQ ID NO: 3599356 - RNA, 18 nt, Pseudomonas putida KT2440
gcugcgaggccccagacc

SEQ ID NO: 3599357 - RNA, 21 nt, Pseudomonas putida KT2440
gcugcgaguaacuguacuguu

SEQ ID NO: 3599358 - RNA, 22 nt, Pseudomonas putida KT2440
gcugcgauagaacuccaccagc

SEQ ID NO: 3599359 - RNA, 19 nt, Pseudomonas putida KT2440
gcugcgcaaggcauucagc

SEQ ID NO: 3599360 - RNA, 14 nt, Pseudomonas putida KT2440
gcugcgcaaggcga

SEQ ID NO: 3599361 - RNA, 21 nt, Pseudomonas putida KT2440
gcugcgcagcccauucgcggg

SEQ ID NO: 3599362 - RNA, 13 nt, Pseudomonas putida KT2440
gcugcgcagcccc

SEQ ID NO: 3599363 - RNA, 13 nt, Pseudomonas putida KT2440
gcugcgcagcccu

SEQ ID NO: 3599364 - RNA, 19 nt, Pseudomonas putida KT2440
gcuguaccggccucuucgc

SEQ ID NO: 3599365 - RNA, 18 nt, Pseudomonas putida KT2440
gcuguagcccaccagguc

SEQ ID NO: 3599366 - RNA, 19 nt, Pseudomonas putida KT2440
gcuguagcccaccagguca

SEQ ID NO: 3599367 - RNA, 17 nt, Pseudomonas putida KT2440
gcuguaggggcgggccu

SEQ ID NO: 3599368 - RNA, 21 nt, Pseudomonas putida KT2440
gcuguaggggcgggccugcug

SEQ ID NO: 3599369 - RNA, 17 nt, Pseudomonas putida KT2440
gcuguaguugaccguga

SEQ ID NO: 3599370 - RNA, 18 nt, Pseudomonas putida KT2440
gcuguauguguguguccg

SEQ ID NO: 3599371 - RNA, 14 nt, Pseudomonas putida KT2440
gcugucacccuugg

SEQ ID NO: 3599372 - RNA, 20 nt, Pseudomonas putida KT2440
gcugucacccuugggcacca

SEQ ID NO: 3599373 - RNA, 20 nt, Pseudomonas putida KT2440
gcugucauuacccggcagaa

SEQ ID NO: 3599374 - RNA, 14 nt, Pseudomonas putida KT2440
gcuguccagcgcau

SEQ ID NO: 3599375 - RNA, 13 nt, Pseudomonas putida KT2440
gcugucccaugcu

SEQ ID NO: 3599376 - RNA, 22 nt, Pseudomonas putida KT2440
gcuguccggcgugaaauccuca

SEQ ID NO: 3599377 - RNA, 23 nt, Pseudomonas putida KT2440
gcuguccugauguucggugcuca

SEQ ID NO: 3599378 - RNA, 22 nt, Pseudomonas putida KT2440
gcugucgagcagguucaggcgc

SEQ ID NO: 3599379 - RNA, 19 nt, Pseudomonas putida KT2440
gcugucggcaugcacuucc

SEQ ID NO: 3599380 - RNA, 13 nt, Pseudomonas putida KT2440
gcugucgggucga

SEQ ID NO: 3599381 - RNA, 21 nt, Pseudomonas putida KT2440
gcugucggucagcaucugggu

SEQ ID NO: 3599382 - RNA, 16 nt, Pseudomonas putida KT2440
gcugucggucagccag

SEQ ID NO: 3599383 - RNA, 14 nt, Pseudomonas putida KT2440
gcugucgucaagcu

SEQ ID NO: 3599384 - RNA, 16 nt, Pseudomonas putida KT2440
gcugucguccagcucg

SEQ ID NO: 3599385 - RNA, 18 nt, Pseudomonas putida KT2440
gcugucguccagcucgcg

SEQ ID NO: 3599386 - RNA, 21 nt, Pseudomonas putida KT2440
gcugucguccagcucgcgcag

SEQ ID NO: 3599387 - RNA, 13 nt, Pseudomonas putida KT2440
gcugucgugcuca

SEQ ID NO: 3599388 - RNA, 14 nt, Pseudomonas putida KT2440
gcugucuccauucc

SEQ ID NO: 3599389 - RNA, 18 nt, Pseudomonas putida KT2440
gcugucuuccagggcaau

SEQ ID NO: 3599390 - RNA, 14 nt, Pseudomonas putida KT2440
gcugucuucugcca

SEQ ID NO: 3599391 - RNA, 20 nt, Pseudomonas putida KT2440
gcugugauacagcacgcgca

SEQ ID NO: 3599392 - RNA, 20 nt, Pseudomonas putida KT2440
gcugugcaacagcgccuggc

SEQ ID NO: 3599393 - RNA, 24 nt, Pseudomonas putida KT2440
gcugugcacccgugccugccugca

SEQ ID NO: 3599394 - RNA, 22 nt, Pseudomonas putida KT2440
gcugugcacugcgaagcccagu

SEQ ID NO: 3599395 - RNA, 22 nt, Pseudomonas putida KT2440
gcugugcagcgcucgcugccgg

SEQ ID NO: 3599396 - RNA, 19 nt, Pseudomonas putida KT2440
gcugugcccugaucgccuc

SEQ ID NO: 3599397 - RNA, 16 nt, Pseudomonas putida KT2440
gcugugcggcaaccgg

SEQ ID NO: 3599398 - RNA, 21 nt, Pseudomonas putida KT2440
gcugugcggcguauacccggu

SEQ ID NO: 3599399 - RNA, 14 nt, Pseudomonas putida KT2440
gcugugcggcuggc

SEQ ID NO: 3599400 - RNA, 13 nt, Pseudomonas putida KT2440
gcugugcgugauu

SEQ ID NO: 3599401 - RNA, 21 nt, Pseudomonas putida KT2440
gcugugcucagcacauucagc

SEQ ID NO: 3599402 - RNA, 14 nt, Pseudomonas putida KT2440
gcugugcucuggcu

SEQ ID NO: 3599403 - RNA, 12 nt, Pseudomonas putida KT2440
gcugugcugcca

SEQ ID NO: 3599404 - RNA, 23 nt, Pseudomonas putida KT2440
gcuguggcaauuggcggaagccu

SEQ ID NO: 3599405 - RNA, 23 nt, Pseudomonas putida KT2440
gcuguguuaccaguccaaccgca

SEQ ID NO: 3599406 - RNA, 17 nt, Pseudomonas putida KT2440
gcuguuaggcuugacga

SEQ ID NO: 3599407 - RNA, 14 nt, Pseudomonas putida KT2440
gcuguucaggccgg

SEQ ID NO: 3599408 - RNA, 18 nt, Pseudomonas putida KT2440
gcuguuccagaagcggcu

SEQ ID NO: 3599409 - RNA, 19 nt, Pseudomonas putida KT2440
gcuguuccagaagcggcua

SEQ ID NO: 3599410 - RNA, 12 nt, Pseudomonas putida KT2440
gcuguuccagcc

SEQ ID NO: 3599411 - RNA, 14 nt, Pseudomonas putida KT2440
gcuguuccagcccg

SEQ ID NO: 3599412 - RNA, 18 nt, Pseudomonas putida KT2440
gcuguuccagcccggcaa

SEQ ID NO: 3599413 - RNA, 21 nt, Pseudomonas putida KT2440
gcuguuccauuucccuacagc

SEQ ID NO: 3599414 - RNA, 17 nt, Pseudomonas putida KT2440
gcuguuccucgccaugg

SEQ ID NO: 3599415 - RNA, 18 nt, Pseudomonas putida KT2440
gcuguuccucgccauggc

SEQ ID NO: 3599416 - RNA, 19 nt, Pseudomonas putida KT2440
gcuguuccucgccauggcc

SEQ ID NO: 3599417 - RNA, 21 nt, Pseudomonas putida KT2440
gcuguuccucgccauggccga

SEQ ID NO: 3599418 - RNA, 15 nt, Pseudomonas putida KT2440
gcuguucgcagcaca

SEQ ID NO: 3599419 - RNA, 15 nt, Pseudomonas putida KT2440
gcuguucgucggccu

SEQ ID NO: 3599420 - RNA, 18 nt, Pseudomonas putida KT2440
gcuguucgucggccuugu

SEQ ID NO: 3599421 - RNA, 12 nt, Pseudomonas putida KT2440
gcuguucuucgg

SEQ ID NO: 3599422 - RNA, 23 nt, Pseudomonas putida KT2440
gcuguugagcagcagcccuucgc

SEQ ID NO: 3599423 - RNA, 14 nt, Pseudomonas putida KT2440
gcuguugcgcuggg

SEQ ID NO: 3599424 - RNA, 19 nt, Pseudomonas putida KT2440
gcuguuggcacggcugaaa

SEQ ID NO: 3599425 - RNA, 18 nt, Pseudomonas putida KT2440
gcuguuuuagaaaucgcu

SEQ ID NO: 3599426 - RNA, 22 nt, Pseudomonas putida KT2440
gcuuaaucccgcaaguccgacu

SEQ ID NO: 3599427 - RNA, 14 nt, Pseudomonas putida KT2440
gcuuacaacugcuc

SEQ ID NO: 3599428 - RNA, 22 nt, Pseudomonas putida KT2440
gcuuacccgcgaagaggccggc

SEQ ID NO: 3599429 - RNA, 14 nt, Pseudomonas putida KT2440
gcuuacuuggucac

SEQ ID NO: 3599430 - RNA, 15 nt, Pseudomonas putida KT2440
gcuuagcgcgggccu

SEQ ID NO: 3599431 - RNA, 17 nt, Pseudomonas putida KT2440
gcuuauucuucuggcuu

SEQ ID NO: 3599432 - RNA, 18 nt, Pseudomonas putida KT2440
gcuuauugcgcagggugg

SEQ ID NO: 3599433 - RNA, 20 nt, Pseudomonas putida KT2440
gcuucaaaauagucgaaggc

SEQ ID NO: 3599434 - RNA, 14 nt, Pseudomonas putida KT2440
gcuucaaacccggu

SEQ ID NO: 3599435 - RNA, 14 nt, Pseudomonas putida KT2440
gcuucaacaagguc

SEQ ID NO: 3599436 - RNA, 12 nt, Pseudomonas putida KT2440
gcuucaacgcga

SEQ ID NO: 3599437 - RNA, 19 nt, Pseudomonas putida KT2440
gcuucaacgcgacgguuga

SEQ ID NO: 3599438 - RNA, 12 nt, Pseudomonas putida KT2440
gcuucaaggcca

SEQ ID NO: 3599439 - RNA, 18 nt, Pseudomonas putida KT2440
gcuucaaggccacgcggu

SEQ ID NO: 3599440 - RNA, 16 nt, Pseudomonas putida KT2440
gcuucaaggucgguga

SEQ ID NO: 3599441 - RNA, 17 nt, Pseudomonas putida KT2440
gcuucacauccaccgcu

SEQ ID NO: 3599442 - RNA, 20 nt, Pseudomonas putida KT2440
gcuucaccgcgcaccuccug

SEQ ID NO: 3599443 - RNA, 18 nt, Pseudomonas putida KT2440
gcuucacgucuggcacca

SEQ ID NO: 3599444 - RNA, 16 nt, Pseudomonas putida KT2440
gcuucacugccggcaa

SEQ ID NO: 3599445 - RNA, 14 nt, Pseudomonas putida KT2440
gcuucagccuucga

SEQ ID NO: 3599446 - RNA, 17 nt, Pseudomonas putida KT2440
gcuucagcgcgccaucu

SEQ ID NO: 3599447 - RNA, 12 nt, Pseudomonas putida KT2440
gcuucaggccgc

SEQ ID NO: 3599448 - RNA, 15 nt, Pseudomonas putida KT2440
gcuucaggccgccuu

SEQ ID NO: 3599449 - RNA, 15 nt, Pseudomonas putida KT2440
gcuucaggccuucga

SEQ ID NO: 3599450 - RNA, 20 nt, Pseudomonas putida KT2440
gcuucagggucgggcacagg

SEQ ID NO: 3599451 - RNA, 23 nt, Pseudomonas putida KT2440
gcuucagggucgggcacaggccc

SEQ ID NO: 3599452 - RNA, 18 nt, Pseudomonas putida KT2440
gcuucagguucacuucca

SEQ ID NO: 3599453 - RNA, 18 nt, Pseudomonas putida KT2440
gcuucauaucacaaacaa

SEQ ID NO: 3599454 - RNA, 14 nt, Pseudomonas putida KT2440
gcuucaucaacgca

SEQ ID NO: 3599455 - RNA, 21 nt, Pseudomonas putida KT2440
gcuucaucgcugacuuccagc

SEQ ID NO: 3599456 - RNA, 22 nt, Pseudomonas putida KT2440
gcuucaucgcugacuuccagca

SEQ ID NO: 3599457 - RNA, 15 nt, Pseudomonas putida KT2440
gcuucaucggcuggc

SEQ ID NO: 3599458 - RNA, 20 nt, Pseudomonas putida KT2440
gcuucaugaaaaacccggcc

SEQ ID NO: 3599459 - RNA, 13 nt, Pseudomonas putida KT2440
gcuucaugcacaa

SEQ ID NO: 3599460 - RNA, 18 nt, Pseudomonas putida KT2440
gcuucaugcugcugcagc

SEQ ID NO: 3599461 - RNA, 15 nt, Pseudomonas putida KT2440
gcuucauggcgccga

SEQ ID NO: 3599462 - RNA, 16 nt, Pseudomonas putida KT2440
gcuuccaagugcugua

SEQ ID NO: 3599463 - RNA, 14 nt, Pseudomonas putida KT2440
gcuuccaccauucc

SEQ ID NO: 3599464 - RNA, 16 nt, Pseudomonas putida KT2440
gcuuccaccauucccu

SEQ ID NO: 3599465 - RNA, 20 nt, Pseudomonas putida KT2440
gcuuccaccauucccugcac

SEQ ID NO: 3599466 - RNA, 20 nt, Pseudomonas putida KT2440
gcuuccaccucgggcuuggc

SEQ ID NO: 3599467 - RNA, 17 nt, Pseudomonas putida KT2440
gcuuccacggcgcgcuu

SEQ ID NO: 3599468 - RNA, 15 nt, Pseudomonas putida KT2440
gcuuccagcgauggc

SEQ ID NO: 3599469 - RNA, 23 nt, Pseudomonas putida KT2440
gcuuggccgacuggcgcaccagc

SEQ ID NO: 3599470 - RNA, 20 nt, Pseudomonas putida KT2440
gcuuggcggcccauucgcgg

SEQ ID NO: 3599471 - RNA, 17 nt, Pseudomonas putida KT2440
gcuuggcguaauccagc

SEQ ID NO: 3599472 - RNA, 16 nt, Pseudomonas putida KT2440
gcuuggcugccggccu

SEQ ID NO: 3599473 - RNA, 21 nt, Pseudomonas putida KT2440
gcuugguaccgucgaucagcu

SEQ ID NO: 3599474 - RNA, 21 nt, Pseudomonas putida KT2440
gcuuggucagcggaccaggug

SEQ ID NO: 3599475 - RNA, 22 nt, Pseudomonas putida KT2440
gcuuggucagggcaaagcccag

SEQ ID NO: 3599476 - RNA, 18 nt, Pseudomonas putida KT2440
gcuuggucccccacuucu

SEQ ID NO: 3599477 - RNA, 19 nt, Pseudomonas putida KT2440
gcuuggucggcgccccuuu

SEQ ID NO: 3599478 - RNA, 23 nt, Pseudomonas putida KT2440
gcuuguaaagaauucggacugug

SEQ ID NO: 3599479 - RNA, 14 nt, Pseudomonas putida KT2440
gcuuguacacgccu

SEQ ID NO: 3599480 - RNA, 17 nt, Pseudomonas putida KT2440
gcuuguagccggcaguc

SEQ ID NO: 3599481 - RNA, 13 nt, Pseudomonas putida KT2440
gcuuguagcgguc

SEQ ID NO: 3599482 - RNA, 15 nt, Pseudomonas putida KT2440
gcuuguagcggucga

SEQ ID NO: 3599483 - RNA, 18 nt, Pseudomonas putida KT2440
gcuuguagcucagguaga

SEQ ID NO: 3599484 - RNA, 19 nt, Pseudomonas putida KT2440
gcuugucaugccuuggcua

SEQ ID NO: 3599485 - RNA, 15 nt, Pseudomonas putida KT2440
gcuuguccagccacu

SEQ ID NO: 3599486 - RNA, 17 nt, Pseudomonas putida KT2440
gcuugucgagguugcgc

SEQ ID NO: 3599487 - RNA, 21 nt, Pseudomonas putida KT2440
gcuugucgagguugcgcucca

SEQ ID NO: 3599488 - RNA, 13 nt, Pseudomonas putida KT2440
gcuugucuuccag

SEQ ID NO: 3599489 - RNA, 14 nt, Pseudomonas putida KT2440
gcuugucuuccagc

SEQ ID NO: 3599490 - RNA, 15 nt, Pseudomonas putida KT2440
gcuugucuuccagcu

SEQ ID NO: 3599491 - RNA, 21 nt, Pseudomonas putida KT2440
gcuugucuuccggcaggucgg

SEQ ID NO: 3599492 - RNA, 15 nt, Pseudomonas putida KT2440
gcuugugcaucagcg

SEQ ID NO: 3599493 - RNA, 17 nt, Pseudomonas putida KT2440
gcuugugccgcugcgcg

SEQ ID NO: 3599494 - RNA, 20 nt, Pseudomonas putida KT2440
gcuuguggccauugcaggcu

SEQ ID NO: 3599495 - RNA, 15 nt, Pseudomonas putida KT2440
gcuuguuauggcacu

SEQ ID NO: 3599496 - RNA, 14 nt, Pseudomonas putida KT2440
gcuuguucagcugg

SEQ ID NO: 3599497 - RNA, 21 nt, Pseudomonas putida KT2440
gcuuguucagcuggugggcga

SEQ ID NO: 3599498 - RNA, 23 nt, Pseudomonas putida KT2440
gcuuguucagcuggugggcgaug

SEQ ID NO: 3599499 - RNA, 22 nt, Pseudomonas putida KT2440
gcuuguucuguuucaccagcag

SEQ ID NO: 3599500 - RNA, 22 nt, Pseudomonas putida KT2440
gcuuuaucgaugaucucgaugu

SEQ ID NO: 3599501 - RNA, 18 nt, Pseudomonas putida KT2440
gcuuucacuucauccagc

SEQ ID NO: 3599502 - RNA, 14 nt, Pseudomonas putida KT2440
gcuuucagcgccgc

SEQ ID NO: 3599503 - RNA, 18 nt, Pseudomonas putida KT2440
gcuuucaggcgcagcaca

SEQ ID NO: 3599504 - RNA, 18 nt, Pseudomonas putida KT2440
gcuuucaguugaggguga

SEQ ID NO: 3599505 - RNA, 19 nt, Pseudomonas putida KT2440
gcuuucaguugagggugac

SEQ ID NO: 3599506 - RNA, 16 nt, Pseudomonas putida KT2440
gcuuuccaaaccugcg

SEQ ID NO: 3599507 - RNA, 23 nt, Pseudomonas putida KT2440
gcuuuccaccuggccacccggcu

SEQ ID NO: 3599508 - RNA, 21 nt, Pseudomonas putida KT2440
gcuuuccagcuguacgcuggc

SEQ ID NO: 3599509 - RNA, 12 nt, Pseudomonas putida KT2440
gcuuuccagguc

SEQ ID NO: 3599510 - RNA, 17 nt, Pseudomonas putida KT2440
gcuuucggucagggcga

SEQ ID NO: 3599511 - RNA, 17 nt, Pseudomonas putida KT2440
gcuuucugcugugucgg

SEQ ID NO: 3599512 - RNA, 21 nt, Pseudomonas putida KT2440
gcuuucuggaggaguccagcu

SEQ ID NO: 3599513 - RNA, 23 nt, Pseudomonas putida KT2440
gcuuucuggaggaguccagcugc

SEQ ID NO: 3599514 - RNA, 15 nt, Pseudomonas putida KT2440
gcuuugaacagcucg

SEQ ID NO: 3599515 - RNA, 16 nt, Pseudomonas putida KT2440
gcuuugagcaggcgcu

SEQ ID NO: 3599516 - RNA, 19 nt, Pseudomonas putida KT2440
gcuuugcaccccuuuuucu

SEQ ID NO: 3599517 - RNA, 19 nt, Pseudomonas putida KT2440
gcuuugcacccgcgcgcug

SEQ ID NO: 3599518 - RNA, 22 nt, Pseudomonas putida KT2440
gcuuugcacccgcgcgcugaag

SEQ ID NO: 3599519 - RNA, 18 nt, Pseudomonas putida KT2440
gcuuugcagauuucgugg

SEQ ID NO: 3599520 - RNA, 19 nt, Pseudomonas putida KT2440
gcuuugcagauuucguggg

SEQ ID NO: 3599521 - RNA, 20 nt, Pseudomonas putida KT2440
gcuuugcagauuucgugggu

SEQ ID NO: 3599522 - RNA, 16 nt, Pseudomonas putida KT2440
gcuuugcagcccauuc

SEQ ID NO: 3599523 - RNA, 18 nt, Pseudomonas putida KT2440
gcuuugcagcccauucgc

SEQ ID NO: 3599524 - RNA, 20 nt, Pseudomonas putida KT2440
gcuuugcagcccauucgcgg

SEQ ID NO: 3599525 - RNA, 17 nt, Pseudomonas putida KT2440
gcuuugcagcccuucgc

SEQ ID NO: 3599526 - RNA, 20 nt, Pseudomonas putida KT2440
gcuuugcagcccuucgcggg

SEQ ID NO: 3599527 - RNA, 19 nt, Pseudomonas putida KT2440
gcuuugccauucucgccgc

SEQ ID NO: 3599528 - RNA, 22 nt, Pseudomonas putida KT2440
gcuuugccggccucuucgcggg

SEQ ID NO: 3599529 - RNA, 20 nt, Pseudomonas putida KT2440
gcuuugccgguguucgcggg

SEQ ID NO: 3599530 - RNA, 16 nt, Pseudomonas putida KT2440
gcuuugcggccccuuc

SEQ ID NO: 3599531 - RNA, 13 nt, Pseudomonas putida KT2440
gcuuugcgggcac

SEQ ID NO: 3599532 - RNA, 16 nt, Pseudomonas putida KT2440
gcuuugcgucaucauc

SEQ ID NO: 3599533 - RNA, 13 nt, Pseudomonas putida KT2440
gcuuuggcagcag

SEQ ID NO: 3599534 - RNA, 21 nt, Pseudomonas putida KT2440
gcuuuggccguagccaggcau

SEQ ID NO: 3599535 - RNA, 18 nt, Pseudomonas putida KT2440
gcuuuggcugcaggucgg

SEQ ID NO: 3599536 - RNA, 16 nt, Pseudomonas putida KT2440
gcuuuggucgcggcgc

SEQ ID NO: 3599537 - RNA, 14 nt, Pseudomonas putida KT2440
gcuuuguuugcugg

SEQ ID NO: 3599538 - RNA, 21 nt, Pseudomonas putida KT2440
gcuuuucaccuccaguugcca

SEQ ID NO: 3599539 - RNA, 22 nt, Pseudomonas putida KT2440
gcuuuucaccuccaguugccag

SEQ ID NO: 3599540 - RNA, 19 nt, Pseudomonas putida KT2440
gcuuuucaucuucaucgcg

SEQ ID NO: 3599541 - RNA, 20 nt, Pseudomonas putida KT2440
gcuuuuccaguuccuggcgg

SEQ ID NO: 3599542 - RNA, 18 nt, Pseudomonas putida KT2440
gcuuuucguuggccagcu

SEQ ID NO: 3599543 - RNA, 14 nt, Pseudomonas putida KT2440
gcuuuucuucgcug

SEQ ID NO: 3599544 - RNA, 13 nt, Pseudomonas putida KT2440
gcuuuugaugguc

SEQ ID NO: 3599545 - RNA, 18 nt, Pseudomonas putida KT2440
gcuuuuggcugugcaccc

SEQ ID NO: 3599546 - RNA, 22 nt, Pseudomonas putida KT2440
gcuuuuucguuauggaaggcaa

SEQ ID NO: 3599547 - RNA, 17 nt, Pseudomonas putida KT2440
gcuuuuuugugccuggu

SEQ ID NO: 3599548 - RNA, 12 nt, Pseudomonas putida KT2440
ggaaaaccgcuc

SEQ ID NO: 3599549 - RNA, 23 nt, Pseudomonas putida KT2440
ggaaaaugaugcagaugggggga

SEQ ID NO: 3599550 - RNA, 17 nt, Pseudomonas putida KT2440
ggaaacccgcgccuacg

SEQ ID NO: 3599551 - RNA, 13 nt, Pseudomonas putida KT2440
ggaaagcccccgc

SEQ ID NO: 3599552 - RNA, 20 nt, Pseudomonas putida KT2440
ggaaauaccagacgcaggca

SEQ ID NO: 3599553 - RNA, 14 nt, Pseudomonas putida KT2440
ggaaaucgccugcu

SEQ ID NO: 3599554 - RNA, 19 nt, Pseudomonas putida KT2440
ggaaauguucaacagccgc

SEQ ID NO: 3599555 - RNA, 12 nt, Pseudomonas putida KT2440
ggaaauuggcca

SEQ ID NO: 3599556 - RNA, 17 nt, Pseudomonas putida KT2440
ggaaauuggccagcagg

SEQ ID NO: 3599557 - RNA, 18 nt, Pseudomonas putida KT2440
ggaaauuggccagcaggc

SEQ ID NO: 3599558 - RNA, 12 nt, Pseudomonas putida KT2440
ggaacaaccuga

SEQ ID NO: 3599559 - RNA, 16 nt, Pseudomonas putida KT2440
ggaacacccagucgcc

SEQ ID NO: 3599560 - RNA, 21 nt, Pseudomonas putida KT2440
ggaacagccgcgcaugcugug

SEQ ID NO: 3599561 - RNA, 16 nt, Pseudomonas putida KT2440
ggaacagcggcagcaa

SEQ ID NO: 3599562 - RNA, 21 nt, Pseudomonas putida KT2440
ggaacagcucgauggccagga

SEQ ID NO: 3599563 - RNA, 22 nt, Pseudomonas putida KT2440
ggaacagcucuggcagcagugc

SEQ ID NO: 3599564 - RNA, 20 nt, Pseudomonas putida KT2440
ggaacauacgcaucagcgca

SEQ ID NO: 3599565 - RNA, 19 nt, Pseudomonas putida KT2440
ggaaccgaauaaccgcugu

SEQ ID NO: 3599566 - RNA, 18 nt, Pseudomonas putida KT2440
ggaaccuccguugcugcg

SEQ ID NO: 3599567 - RNA, 22 nt, Pseudomonas putida KT2440
ggaacgaaaaacuccuugagau

SEQ ID NO: 3599568 - RNA, 15 nt, Pseudomonas putida KT2440
ggaacggcccgcgga

SEQ ID NO: 3599569 - RNA, 18 nt, Pseudomonas putida KT2440
ggaacggugaacggcggg

SEQ ID NO: 3599570 - RNA, 17 nt, Pseudomonas putida KT2440
ggaacgucguugcaguu

SEQ ID NO: 3599571 - RNA, 17 nt, Pseudomonas putida KT2440
ggaacguuuccagcaac

SEQ ID NO: 3599572 - RNA, 23 nt, Pseudomonas putida KT2440
ggaacuccugcugcagcuccgga

SEQ ID NO: 3599573 - RNA, 19 nt, Pseudomonas putida KT2440
ggagcggguucacccgcga

SEQ ID NO: 3599574 - RNA, 21 nt, Pseudomonas putida KT2440
ggagcggguuuacccgcgaau

SEQ ID NO: 3599575 - RNA, 19 nt, Pseudomonas putida KT2440
ggagcggguuuucucgcga

SEQ ID NO: 3599576 - RNA, 17 nt, Pseudomonas putida KT2440
ggagcguccgagcggag

SEQ ID NO: 3599577 - RNA, 18 nt, Pseudomonas putida KT2440
ggagcguccgagcggagc

SEQ ID NO: 3599578 - RNA, 19 nt, Pseudomonas putida KT2440
ggagcguggaugaagcggu

SEQ ID NO: 3599579 - RNA, 14 nt, Pseudomonas putida KT2440
ggagcguugcaggc

SEQ ID NO: 3599580 - RNA, 22 nt, Pseudomonas putida KT2440
ggagcuccccucagacagagcu

SEQ ID NO: 3599581 - RNA, 15 nt, Pseudomonas putida KT2440
ggagcugauucagca

SEQ ID NO: 3599582 - RNA, 12 nt, Pseudomonas putida KT2440
ggagcuggagcc

SEQ ID NO: 3599583 - RNA, 16 nt, Pseudomonas putida KT2440
ggaggccgucaggccu

SEQ ID NO: 3599584 - RNA, 14 nt, Pseudomonas putida KT2440
ggagggggcuguuu

SEQ ID NO: 3599585 - RNA, 13 nt, Pseudomonas putida KT2440
ggagguagccacc

SEQ ID NO: 3599586 - RNA, 24 nt, Pseudomonas putida KT2440
ggaggucagcgguucgaucccgcu

SEQ ID NO: 3599587 - RNA, 15 nt, Pseudomonas putida KT2440
ggaguccccaccggc

SEQ ID NO: 3599588 - RNA, 18 nt, Pseudomonas putida KT2440
ggaguccccaccggcacc

SEQ ID NO: 3599589 - RNA, 18 nt, Pseudomonas putida KT2440
ggagucgaaccugcccgg

SEQ ID NO: 3599590 - RNA, 20 nt, Pseudomonas putida KT2440
ggagucggcucuggcaagau

SEQ ID NO: 3599591 - RNA, 18 nt, Pseudomonas putida KT2440
ggaguucugcacagcgcg

SEQ ID NO: 3599592 - RNA, 19 nt, Pseudomonas putida KT2440
ggaguugcucgagugcgaa

SEQ ID NO: 3599593 - RNA, 23 nt, Pseudomonas putida KT2440
ggauacaucgcauacagcgcacu

SEQ ID NO: 3599594 - RNA, 23 nt, Pseudomonas putida KT2440
ggauagaacaagccccuccuaag

SEQ ID NO: 3599595 - RNA, 19 nt, Pseudomonas putida KT2440
ggauagaacgggucauugc

SEQ ID NO: 3599596 - RNA, 23 nt, Pseudomonas putida KT2440
ggauagagcaucccccuccuaag

SEQ ID NO: 3599597 - RNA, 16 nt, Pseudomonas putida KT2440
ggauagcaaaggcgac

SEQ ID NO: 3599598 - RNA, 14 nt, Pseudomonas putida KT2440
ggauaucaaagcgg

SEQ ID NO: 3599599 - RNA, 14 nt, Pseudomonas putida KT2440
ggaucaacugccgc

SEQ ID NO: 3599600 - RNA, 18 nt, Pseudomonas putida KT2440
ggaucaccacgucuuccu

SEQ ID NO: 3599601 - RNA, 16 nt, Pseudomonas putida KT2440
ggaucaccgacgugca

SEQ ID NO: 3599602 - RNA, 19 nt, Pseudomonas putida KT2440
ggaucaccgacgugcagga

SEQ ID NO: 3599603 - RNA, 18 nt, Pseudomonas putida KT2440
ggaucaccgcaagcugca

SEQ ID NO: 3599604 - RNA, 15 nt, Pseudomonas putida KT2440
ggaucaccgccagca

SEQ ID NO: 3599605 - RNA, 15 nt, Pseudomonas putida KT2440
ggaucacugccagca

SEQ ID NO: 3599606 - RNA, 17 nt, Pseudomonas putida KT2440
ggaucacugccagcacc

SEQ ID NO: 3599607 - RNA, 18 nt, Pseudomonas putida KT2440
ggaucacugccagcaccu

SEQ ID NO: 3599608 - RNA, 21 nt, Pseudomonas putida KT2440
ggaucacugccagcaccuggc

SEQ ID NO: 3599609 - RNA, 12 nt, Pseudomonas putida KT2440
ggaucagccgcg

SEQ ID NO: 3599610 - RNA, 14 nt, Pseudomonas putida KT2440
ggaucagccgcgcc

SEQ ID NO: 3599611 - RNA, 18 nt, Pseudomonas putida KT2440
ggaucagcgcguccagca

SEQ ID NO: 3599612 - RNA, 14 nt, Pseudomonas putida KT2440
ggaucagcucggca

SEQ ID NO: 3599613 - RNA, 23 nt, Pseudomonas putida KT2440
ggaucaggaacaaucuucuucau

SEQ ID NO: 3599614 - RNA, 21 nt, Pseudomonas putida KT2440
ggaucagugucugcgccugcu

SEQ ID NO: 3599615 - RNA, 22 nt, Pseudomonas putida KT2440
ggaucaugguguucaugcccac

SEQ ID NO: 3599616 - RNA, 20 nt, Pseudomonas putida KT2440
ggaucgccgccgaugcgcuu

SEQ ID NO: 3599617 - RNA, 15 nt, Pseudomonas putida KT2440
ggaucgcgcaagccu

SEQ ID NO: 3599618 - RNA, 23 nt, Pseudomonas putida KT2440
ggaucgcgccuucauaggcggcc

SEQ ID NO: 3599619 - RNA, 13 nt, Pseudomonas putida KT2440
ggaucgcucucgc

SEQ ID NO: 3599620 - RNA, 18 nt, Pseudomonas putida KT2440
ggaucgggcacaacucca

SEQ ID NO: 3599621 - RNA, 21 nt, Pseudomonas putida KT2440
ggaucgggcacaacuccaccc

SEQ ID NO: 3599622 - RNA, 19 nt, Pseudomonas putida KT2440
ggaucggguuuacccgcga

SEQ ID NO: 3599623 - RNA, 22 nt, Pseudomonas putida KT2440
ggaucgugacggucugccggca

SEQ ID NO: 3599624 - RNA, 14 nt, Pseudomonas putida KT2440
ggaucuccucggcc

SEQ ID NO: 3599625 - RNA, 15 nt, Pseudomonas putida KT2440
ggaucuccucggcca

SEQ ID NO: 3599626 - RNA, 20 nt, Pseudomonas putida KT2440
ggaucuccucggccagcggc

SEQ ID NO: 3599627 - RNA, 16 nt, Pseudomonas putida KT2440
ggaucugacggcgcug

SEQ ID NO: 3599628 - RNA, 23 nt, Pseudomonas putida KT2440
ggaucugacggcgcugcuggccu

SEQ ID NO: 3599629 - RNA, 16 nt, Pseudomonas putida KT2440
ggaucugagcagcaga

SEQ ID NO: 3599630 - RNA, 19 nt, Pseudomonas putida KT2440
ggaucuuguauuggccaag

SEQ ID NO: 3599631 - RNA, 20 nt, Pseudomonas putida KT2440
ggaucuuuucgggcaaggca

SEQ ID NO: 3599632 - RNA, 21 nt, Pseudomonas putida KT2440
ggaugacguccggcugcgggu

SEQ ID NO: 3599633 - RNA, 18 nt, Pseudomonas putida KT2440
ggaugacuuucaugcccg

SEQ ID NO: 3599634 - RNA, 16 nt, Pseudomonas putida KT2440
ggaugagaaagcccgc

SEQ ID NO: 3599635 - RNA, 22 nt, Pseudomonas putida KT2440
ggaugagccuucacugugcagg

SEQ ID NO: 3599636 - RNA, 22 nt, Pseudomonas putida KT2440
ggaugauccagcccaccacgaa

SEQ ID NO: 3599637 - RNA, 14 nt, Pseudomonas putida KT2440
ggaugccaauuucc

SEQ ID NO: 3599638 - RNA, 12 nt, Pseudomonas putida KT2440
ggaugccacgcu

SEQ ID NO: 3599639 - RNA, 15 nt, Pseudomonas putida KT2440
ggaugccacgcugaa

SEQ ID NO: 3599640 - RNA, 19 nt, Pseudomonas putida KT2440
ggaugccacgcugaacacg

SEQ ID NO: 3599641 - RNA, 20 nt, Pseudomonas putida KT2440
ggaugccacgcugaacacgc

SEQ ID NO: 3599642 - RNA, 19 nt, Pseudomonas putida KT2440
ggaugccgugguaucgcuu

SEQ ID NO: 3599643 - RNA, 20 nt, Pseudomonas putida KT2440
ggaugcggcugaccccaccc

SEQ ID NO: 3599644 - RNA, 13 nt, Pseudomonas putida KT2440
ggaugcuccccuu

SEQ ID NO: 3599645 - RNA, 17 nt, Pseudomonas putida KT2440
ggaugcugaagcucucc

SEQ ID NO: 3599646 - RNA, 22 nt, Pseudomonas putida KT2440
ggaugcugaagcucuccagcag

SEQ ID NO: 3599647 - RNA, 15 nt, Pseudomonas putida KT2440
ggauggcaccggcuc

SEQ ID NO: 3599648 - RNA, 15 nt, Pseudomonas putida KT2440
ggauggccaugaucg

SEQ ID NO: 3599649 - RNA, 12 nt, Pseudomonas putida KT2440
ggauggccgcag

SEQ ID NO: 3599650 - RNA, 14 nt, Pseudomonas putida KT2440
ggauggucagcgcu

SEQ ID NO: 3599651 - RNA, 20 nt, Pseudomonas putida KT2440
ggauggugacugccagcacg

SEQ ID NO: 3599652 - RNA, 14 nt, Pseudomonas putida KT2440
ggauggugcgcucg

SEQ ID NO: 3599653 - RNA, 18 nt, Pseudomonas putida KT2440
ggaugugguggaacagga

SEQ ID NO: 3599654 - RNA, 22 nt, Pseudomonas putida KT2440
ggauguucccauugagcuguuu

SEQ ID NO: 3599655 - RNA, 23 nt, Pseudomonas putida KT2440
ggauucaacagcgcgacgcagca

SEQ ID NO: 3599656 - RNA, 20 nt, Pseudomonas putida KT2440
ggauucagcacgcuggccag

SEQ ID NO: 3599657 - RNA, 14 nt, Pseudomonas putida KT2440
ggauuccgacaagg

SEQ ID NO: 3599658 - RNA, 15 nt, Pseudomonas putida KT2440
ggauuccgacaaggg

SEQ ID NO: 3599659 - RNA, 16 nt, Pseudomonas putida KT2440
ggauuggcgcggcugg

SEQ ID NO: 3599660 - RNA, 17 nt, Pseudomonas putida KT2440
ggauuguucccacaggg

SEQ ID NO: 3599661 - RNA, 19 nt, Pseudomonas putida KT2440
ggauuuggggcgcccggca

SEQ ID NO: 3599662 - RNA, 14 nt, Pseudomonas putida KT2440
ggcaaacacaucca

SEQ ID NO: 3599663 - RNA, 21 nt, Pseudomonas putida KT2440
ggcaaacagacggugcgccug

SEQ ID NO: 3599664 - RNA, 17 nt, Pseudomonas putida KT2440
ggcaaacagcaccagcc

SEQ ID NO: 3599665 - RNA, 18 nt, Pseudomonas putida KT2440
ggcaaacccgcgccuaca

SEQ ID NO: 3599666 - RNA, 20 nt, Pseudomonas putida KT2440
ggcaaacccgcgccuacagg

SEQ ID NO: 3599667 - RNA, 21 nt, Pseudomonas putida KT2440
ggcaaacccgcgccuacaggc

SEQ ID NO: 3599668 - RNA, 17 nt, Pseudomonas putida KT2440
ggcaaacccggccagca

SEQ ID NO: 3599669 - RNA, 19 nt, Pseudomonas putida KT2440
ggcaaacccggccagcagg

SEQ ID NO: 3599670 - RNA, 20 nt, Pseudomonas putida KT2440
ggcaaacucgucgcuggucc

SEQ ID NO: 3599671 - RNA, 19 nt, Pseudomonas putida KT2440
ggcaaacuggcgcccggca

SEQ ID NO: 3599672 - RNA, 18 nt, Pseudomonas putida KT2440
ggcaaagaaacaccaggc

SEQ ID NO: 3599673 - RNA, 14 nt, Pseudomonas putida KT2440
ggcaaagaacggug

SEQ ID NO: 3599674 - RNA, 19 nt, Pseudomonas putida KT2440
ggcaaagaaugccgcccau

SEQ ID NO: 3599675 - RNA, 22 nt, Pseudomonas putida KT2440
ggcaaagaucgcccagcuggag

SEQ ID NO: 3599676 - RNA, 22 nt, Pseudomonas putida KT2440
ggcaacaccagcagccacgggu

SEQ ID NO: 3599677 - RNA, 17 nt, Pseudomonas putida KT2440
ggcaacagccgggcagc

SEQ ID NO: 3599678 - RNA, 21 nt, Pseudomonas putida KT2440
ggcacgcccggcaccugccgg

SEQ ID NO: 3599679 - RNA, 16 nt, Pseudomonas putida KT2440
ggcacgcgccagcagc

SEQ ID NO: 3599680 - RNA, 19 nt, Pseudomonas putida KT2440
ggcacgcgggccguagugg

SEQ ID NO: 3599681 - RNA, 19 nt, Pseudomonas putida KT2440
ggcacgcguaccccuggcg

SEQ ID NO: 3599682 - RNA, 16 nt, Pseudomonas putida KT2440
ggcacgcucgcgcagg

SEQ ID NO: 3599683 - RNA, 19 nt, Pseudomonas putida KT2440
ggcacgcucgcgcaggaac

SEQ ID NO: 3599684 - RNA, 12 nt, Pseudomonas putida KT2440
ggcacggccagc

SEQ ID NO: 3599685 - RNA, 12 nt, Pseudomonas putida KT2440
ggcacggccggu

SEQ ID NO: 3599686 - RNA, 22 nt, Pseudomonas putida KT2440
ggcacggcgcugucggucagca

SEQ ID NO: 3599687 - RNA, 22 nt, Pseudomonas putida KT2440
ggcacggcugaaaugcccgcaa

SEQ ID NO: 3599688 - RNA, 17 nt, Pseudomonas putida KT2440
ggcacggcugcccugca

SEQ ID NO: 3599689 - RNA, 21 nt, Pseudomonas putida KT2440
ggcacggcugcccugcauggc

SEQ ID NO: 3599690 - RNA, 23 nt, Pseudomonas putida KT2440
ggcacgggaucaaacggucccga

SEQ ID NO: 3599691 - RNA, 18 nt, Pseudomonas putida KT2440
ggcacgguugcgcccggc

SEQ ID NO: 3599692 - RNA, 14 nt, Pseudomonas putida KT2440
ggcacgugacugga

SEQ ID NO: 3599693 - RNA, 17 nt, Pseudomonas putida KT2440
ggcacguuggugccggu

SEQ ID NO: 3599694 - RNA, 16 nt, Pseudomonas putida KT2440
ggcacuaagcgaaaca

SEQ ID NO: 3599695 - RNA, 22 nt, Pseudomonas putida KT2440
ggcacuaagcgaaacaccagca

SEQ ID NO: 3599696 - RNA, 23 nt, Pseudomonas putida KT2440
ggcacuaccaggcccaacagcgc

SEQ ID NO: 3599697 - RNA, 14 nt, Pseudomonas putida KT2440
ggcacucgaagcac

SEQ ID NO: 3599698 - RNA, 16 nt, Pseudomonas putida KT2440
ggcacucgaagcacuc

SEQ ID NO: 3599699 - RNA, 23 nt, Pseudomonas putida KT2440
ggcacugaccacuucaagcacgc

SEQ ID NO: 3599700 - RNA, 17 nt, Pseudomonas putida KT2440
ggcacuggccagcggcg

SEQ ID NO: 3599701 - RNA, 23 nt, Pseudomonas putida KT2440
ggcacuggcgcgaugcgguugca

SEQ ID NO: 3599702 - RNA, 24 nt, Pseudomonas putida KT2440
ggcacuggcugauagccgccagca

SEQ ID NO: 3599703 - RNA, 14 nt, Pseudomonas putida KT2440
ggcacuguaggcaa

SEQ ID NO: 3599704 - RNA, 17 nt, Pseudomonas putida KT2440
ggcacuguaggcaaaca

SEQ ID NO: 3599705 - RNA, 18 nt, Pseudomonas putida KT2440
ggcacuugggaucgaugc

SEQ ID NO: 3599706 - RNA, 16 nt, Pseudomonas putida KT2440
ggcagaacaucgccca

SEQ ID NO: 3599707 - RNA, 15 nt, Pseudomonas putida KT2440
ggcagacaaguccuu

SEQ ID NO: 3599708 - RNA, 15 nt, Pseudomonas putida KT2440
ggcagacacaggcgc

SEQ ID NO: 3599709 - RNA, 22 nt, Pseudomonas putida KT2440
ggcagaccugcuggcacugcgg

SEQ ID NO: 3599710 - RNA, 21 nt, Pseudomonas putida KT2440
ggcagacuaccaacaccggcg

SEQ ID NO: 3599711 - RNA, 15 nt, Pseudomonas putida KT2440
ggcagacuucgcugu

SEQ ID NO: 3599712 - RNA, 19 nt, Pseudomonas putida KT2440
ggcagauacaaccccagau

SEQ ID NO: 3599713 - RNA, 13 nt, Pseudomonas putida KT2440
ggcagaucacgca

SEQ ID NO: 3599714 - RNA, 18 nt, Pseudomonas putida KT2440
ggcagaucacgcaaccuc

SEQ ID NO: 3599715 - RNA, 15 nt, Pseudomonas putida KT2440
ggcagaucaggcaau

SEQ ID NO: 3599716 - RNA, 19 nt, Pseudomonas putida KT2440
ggcagauccugcagccgca

SEQ ID NO: 3599717 - RNA, 19 nt, Pseudomonas putida KT2440
ggcagaugcuccaacccca

SEQ ID NO: 3599718 - RNA, 19 nt, Pseudomonas putida KT2440
ggcagcaacacgacgaugg

SEQ ID NO: 3599719 - RNA, 21 nt, Pseudomonas putida KT2440
ggcagcaacacgacgauggcc

SEQ ID NO: 3599720 - RNA, 22 nt, Pseudomonas putida KT2440
ggcagcaacacgacgauggcca

SEQ ID NO: 3599721 - RNA, 22 nt, Pseudomonas putida KT2440
ggcagcaacggugaacggcggg

SEQ ID NO: 3599722 - RNA, 20 nt, Pseudomonas putida KT2440
ggcagcaaggcauccagcgg

SEQ ID NO: 3599723 - RNA, 19 nt, Pseudomonas putida KT2440
ggcagcaaguugaagaaca

SEQ ID NO: 3599724 - RNA, 13 nt, Pseudomonas putida KT2440
ggcagcaccacga

SEQ ID NO: 3599725 - RNA, 14 nt, Pseudomonas putida KT2440
ggcagcacccgcuu

SEQ ID NO: 3599726 - RNA, 13 nt, Pseudomonas putida KT2440
ggcagcaccgcug

SEQ ID NO: 3599727 - RNA, 22 nt, Pseudomonas putida KT2440
ggcagcaccgcugccagcugcg

SEQ ID NO: 3599728 - RNA, 14 nt, Pseudomonas putida KT2440
ggcagcacgaucag

SEQ ID NO: 3599729 - RNA, 17 nt, Pseudomonas putida KT2440
ggcagcacgucggcgcc

SEQ ID NO: 3599730 - RNA, 22 nt, Pseudomonas putida KT2440
ggcagcacgucggcgccgaacg

SEQ ID NO: 3599731 - RNA, 20 nt, Pseudomonas putida KT2440
ggcagcagcaaugccgaaca

SEQ ID NO: 3599732 - RNA, 14 nt, Pseudomonas putida KT2440
ggcagcagcagccc

SEQ ID NO: 3599733 - RNA, 16 nt, Pseudomonas putida KT2440
ggcagcagcagcccca

SEQ ID NO: 3599734 - RNA, 14 nt, Pseudomonas putida KT2440
ggcagcagcucuuu

SEQ ID NO: 3599735 - RNA, 21 nt, Pseudomonas putida KT2440
ggcagcagcucuuuugccggg

SEQ ID NO: 3599736 - RNA, 12 nt, Pseudomonas putida KT2440
ggcagcaggcca

SEQ ID NO: 3599737 - RNA, 16 nt, Pseudomonas putida KT2440
ggcagcagugcaccca

SEQ ID NO: 3599738 - RNA, 15 nt, Pseudomonas putida KT2440
ggcagcaugaacagc

SEQ ID NO: 3599739 - RNA, 18 nt, Pseudomonas putida KT2440
ggcagcaugaacagcgcu

SEQ ID NO: 3599740 - RNA, 13 nt, Pseudomonas putida KT2440
ggcagccaccgcc

SEQ ID NO: 3599741 - RNA, 15 nt, Pseudomonas putida KT2440
ggcagccaccucgac

SEQ ID NO: 3599742 - RNA, 20 nt, Pseudomonas putida KT2440
ggcagccaccucgacccccu

SEQ ID NO: 3599743 - RNA, 16 nt, Pseudomonas putida KT2440
ggcagccacgauagcg

SEQ ID NO: 3599744 - RNA, 23 nt, Pseudomonas putida KT2440
ggcagccacgcuccagucguggc

SEQ ID NO: 3599745 - RNA, 19 nt, Pseudomonas putida KT2440
ggcagccagggccugaccg

SEQ ID NO: 3599746 - RNA, 15 nt, Pseudomonas putida KT2440
ggcagccccaaccuu

SEQ ID NO: 3599747 - RNA, 22 nt, Pseudomonas putida KT2440
ggcagccccaaccuuccagcaa

SEQ ID NO: 3599748 - RNA, 16 nt, Pseudomonas putida KT2440
ggcagcccuucgcggg

SEQ ID NO: 3599749 - RNA, 19 nt, Pseudomonas putida KT2440
ggcagccgaagcugucgaa

SEQ ID NO: 3599750 - RNA, 14 nt, Pseudomonas putida KT2440
ggcagccgcccuug

SEQ ID NO: 3599751 - RNA, 22 nt, Pseudomonas putida KT2440
ggcagccgucggcgucaacggu

SEQ ID NO: 3599752 - RNA, 18 nt, Pseudomonas putida KT2440
ggcagccguucccgggca

SEQ ID NO: 3599753 - RNA, 19 nt, Pseudomonas putida KT2440
ggcagcgacagcugcggca

SEQ ID NO: 3599754 - RNA, 18 nt, Pseudomonas putida KT2440
ggcagcgaucagugccuu

SEQ ID NO: 3599755 - RNA, 14 nt, Pseudomonas putida KT2440
ggcagcgauggccg

SEQ ID NO: 3599756 - RNA, 12 nt, Pseudomonas putida KT2440
ggcagcgcggcc

SEQ ID NO: 3599757 - RNA, 20 nt, Pseudomonas putida KT2440
ggcagcggcgaacggucggu

SEQ ID NO: 3599758 - RNA, 18 nt, Pseudomonas putida KT2440
ggcagcggcuuggccgcg

SEQ ID NO: 3599759 - RNA, 22 nt, Pseudomonas putida KT2440
ggcagcgggagucgaaccugcc

SEQ ID NO: 3599760 - RNA, 13 nt, Pseudomonas putida KT2440
ggcagcgggcucg

SEQ ID NO: 3599761 - RNA, 12 nt, Pseudomonas putida KT2440
ggcagcgggcug

SEQ ID NO: 3599762 - RNA, 22 nt, Pseudomonas putida KT2440
ggcagcuacgagacgguggcug

SEQ ID NO: 3599763 - RNA, 12 nt, Pseudomonas putida KT2440
ggcagcucaccg

SEQ ID NO: 3599764 - RNA, 14 nt, Pseudomonas putida KT2440
ggcagcuccagcca

SEQ ID NO: 3599765 - RNA, 21 nt, Pseudomonas putida KT2440
ggcagcucgagcaugcggaua

SEQ ID NO: 3599766 - RNA, 17 nt, Pseudomonas putida KT2440
ggcagcuugcccugcuu

SEQ ID NO: 3599767 - RNA, 16 nt, Pseudomonas putida KT2440
ggcaggaaacaccagg

SEQ ID NO: 3599768 - RNA, 13 nt, Pseudomonas putida KT2440
ggcaggaacuggc

SEQ ID NO: 3599769 - RNA, 14 nt, Pseudomonas putida KT2440
ggcaggaacuggcu

SEQ ID NO: 3599770 - RNA, 20 nt, Pseudomonas putida KT2440
ggcaggaacuggcugccgcu

SEQ ID NO: 3599771 - RNA, 13 nt, Pseudomonas putida KT2440
ggcaggccagcac

SEQ ID NO: 3599772 - RNA, 14 nt, Pseudomonas putida KT2440
ggcaggccagcacg

SEQ ID NO: 3599773 - RNA, 18 nt, Pseudomonas putida KT2440
ggcaggccaugcccgccc

SEQ ID NO: 3599774 - RNA, 14 nt, Pseudomonas putida KT2440
ggcaggcccaggua

SEQ ID NO: 3599775 - RNA, 19 nt, Pseudomonas putida KT2440
ggcaggccccugcaacagg

SEQ ID NO: 3599776 - RNA, 22 nt, Pseudomonas putida KT2440
ggcaggccccugcaacagggcg

SEQ ID NO: 3599777 - RNA, 17 nt, Pseudomonas putida KT2440
ggcaggcgguccagcaa

SEQ ID NO: 3599778 - RNA, 18 nt, Pseudomonas putida KT2440
ggcaggcucagggcagca

SEQ ID NO: 3599779 - RNA, 19 nt, Pseudomonas putida KT2440
ggcaggcugauggauuccu

SEQ ID NO: 3599780 - RNA, 11 nt, Pseudomonas putida KT2440
ggcaggcuggc

SEQ ID NO: 3599781 - RNA, 18 nt, Pseudomonas putida KT2440
ggcaggcugugcggcaac

SEQ ID NO: 3599782 - RNA, 13 nt, Pseudomonas putida KT2440
ggcagggcacacu

SEQ ID NO: 3599783 - RNA, 20 nt, Pseudomonas putida KT2440
ggccaccagcauggcgucgg

SEQ ID NO: 3599784 - RNA, 20 nt, Pseudomonas putida KT2440
ggccaccaggcgcggcagca

SEQ ID NO: 3599785 - RNA, 14 nt, Pseudomonas putida KT2440
ggccaccagggugg

SEQ ID NO: 3599786 - RNA, 22 nt, Pseudomonas putida KT2440
ggccaccaggguggcgauccac

SEQ ID NO: 3599787 - RNA, 20 nt, Pseudomonas putida KT2440
ggccaccauguacugcagac

SEQ ID NO: 3599788 - RNA, 20 nt, Pseudomonas putida KT2440
ggccacccggaccagcgccg

SEQ ID NO: 3599789 - RNA, 22 nt, Pseudomonas putida KT2440
ggccacccggaccagcgccgca

SEQ ID NO: 3599790 - RNA, 22 nt, Pseudomonas putida KT2440
ggccaccgccucggcuacgccg

SEQ ID NO: 3599791 - RNA, 14 nt, Pseudomonas putida KT2440
ggccaccggcagca

SEQ ID NO: 3599792 - RNA, 16 nt, Pseudomonas putida KT2440
ggccaccggcagcacc

SEQ ID NO: 3599793 - RNA, 16 nt, Pseudomonas putida KT2440
ggccaccuggucgaau

SEQ ID NO: 3599794 - RNA, 21 nt, Pseudomonas putida KT2440
ggccaccuugccaucggccau

SEQ ID NO: 3599795 - RNA, 16 nt, Pseudomonas putida KT2440
ggccacgaaggccggu

SEQ ID NO: 3599796 - RNA, 18 nt, Pseudomonas putida KT2440
ggccacggccgaguccuu

SEQ ID NO: 3599797 - RNA, 13 nt, Pseudomonas putida KT2440
ggccacgguccag

SEQ ID NO: 3599798 - RNA, 20 nt, Pseudomonas putida KT2440
ggccacgguguauccagccc

SEQ ID NO: 3599799 - RNA, 18 nt, Pseudomonas putida KT2440
ggccacggugucggacag

SEQ ID NO: 3599800 - RNA, 19 nt, Pseudomonas putida KT2440
ggccacggugucggacagg

SEQ ID NO: 3599801 - RNA, 20 nt, Pseudomonas putida KT2440
ggccacggugucggacaggu

SEQ ID NO: 3599802 - RNA, 12 nt, Pseudomonas putida KT2440
ggccacugguac

SEQ ID NO: 3599803 - RNA, 22 nt, Pseudomonas putida KT2440
ggccacugguacagcucacgca

SEQ ID NO: 3599804 - RNA, 24 nt, Pseudomonas putida KT2440
ggccacugguaguucaucgcccau

SEQ ID NO: 3599805 - RNA, 17 nt, Pseudomonas putida KT2440
ggccacuguugcagcgc

SEQ ID NO: 3599806 - RNA, 21 nt, Pseudomonas putida KT2440
ggccacuucgcgagcgagcgg

SEQ ID NO: 3599807 - RNA, 23 nt, Pseudomonas putida KT2440
ggccagaaacggcggcagauaca

SEQ ID NO: 3599808 - RNA, 17 nt, Pseudomonas putida KT2440
ggccagaucggccagcu

SEQ ID NO: 3599809 - RNA, 17 nt, Pseudomonas putida KT2440
ggccagcaaacccucgg

SEQ ID NO: 3599810 - RNA, 12 nt, Pseudomonas putida KT2440
ggccagcaaaga

SEQ ID NO: 3599811 - RNA, 13 nt, Pseudomonas putida KT2440
ggccagcaacagg

SEQ ID NO: 3599812 - RNA, 13 nt, Pseudomonas putida KT2440
ggccagcaaggca

SEQ ID NO: 3599813 - RNA, 12 nt, Pseudomonas putida KT2440
ggccagcaagug

SEQ ID NO: 3599814 - RNA, 18 nt, Pseudomonas putida KT2440
ggccagcacaaccacugc

SEQ ID NO: 3599815 - RNA, 14 nt, Pseudomonas putida KT2440
ggccagcacgaaca

SEQ ID NO: 3599816 - RNA, 16 nt, Pseudomonas putida KT2440
ggccagcacgaacagc

SEQ ID NO: 3599817 - RNA, 19 nt, Pseudomonas putida KT2440
ggccagcacuacgccggcc

SEQ ID NO: 3599818 - RNA, 20 nt, Pseudomonas putida KT2440
ggccagcagauggcucaucg

SEQ ID NO: 3599819 - RNA, 13 nt, Pseudomonas putida KT2440
ggccagcagcccc

SEQ ID NO: 3599820 - RNA, 11 nt, Pseudomonas putida KT2440
ggccagcaggc

SEQ ID NO: 3599821 - RNA, 13 nt, Pseudomonas putida KT2440
ggccagcaggccc

SEQ ID NO: 3599822 - RNA, 16 nt, Pseudomonas putida KT2440
ggccagcaggcccggc

SEQ ID NO: 3599823 - RNA, 14 nt, Pseudomonas putida KT2440
ggccagcagggccg

SEQ ID NO: 3599824 - RNA, 13 nt, Pseudomonas putida KT2440
ggccagcagguca

SEQ ID NO: 3599825 - RNA, 14 nt, Pseudomonas putida KT2440
ggccagcaggucag

SEQ ID NO: 3599826 - RNA, 18 nt, Pseudomonas putida KT2440
ggccagcaggucagcacg

SEQ ID NO: 3599827 - RNA, 22 nt, Pseudomonas putida KT2440
ggccagcaggucagcacgcgcu

SEQ ID NO: 3599828 - RNA, 16 nt, Pseudomonas putida KT2440
ggccagcaggucaggc

SEQ ID NO: 3599829 - RNA, 14 nt, Pseudomonas putida KT2440
ggccagccagcagc

SEQ ID NO: 3599830 - RNA, 12 nt, Pseudomonas putida KT2440
ggccagccaggu

SEQ ID NO: 3599831 - RNA, 21 nt, Pseudomonas putida KT2440
ggccagccagguauggccaga

SEQ ID NO: 3599832 - RNA, 17 nt, Pseudomonas putida KT2440
ggccagcccauggcgcu

SEQ ID NO: 3599833 - RNA, 13 nt, Pseudomonas putida KT2440
ggccagccccagc

SEQ ID NO: 3599834 - RNA, 13 nt, Pseudomonas putida KT2440
ggccagccgccgc

SEQ ID NO: 3599835 - RNA, 15 nt, Pseudomonas putida KT2440
ggccagccgccgccg

SEQ ID NO: 3599836 - RNA, 22 nt, Pseudomonas putida KT2440
ggccagccgcgccaggucggcg

SEQ ID NO: 3599837 - RNA, 21 nt, Pseudomonas putida KT2440
ggccagccgcuguucugcagu

SEQ ID NO: 3599838 - RNA, 22 nt, Pseudomonas putida KT2440
ggccagccgcuguucugcaguc

SEQ ID NO: 3599839 - RNA, 17 nt, Pseudomonas putida KT2440
ggccagccggcagcaag

SEQ ID NO: 3599840 - RNA, 21 nt, Pseudomonas putida KT2440
ggccagccggcagcaaggcau

SEQ ID NO: 3599841 - RNA, 17 nt, Pseudomonas putida KT2440
ggccagccggcgcugga

SEQ ID NO: 3599842 - RNA, 15 nt, Pseudomonas putida KT2440
ggccagcgcaucggc

SEQ ID NO: 3599843 - RNA, 21 nt, Pseudomonas putida KT2440
ggccagcgccugcaggcccag

SEQ ID NO: 3599844 - RNA, 15 nt, Pseudomonas putida KT2440
ggccagcgccugcug

SEQ ID NO: 3599845 - RNA, 16 nt, Pseudomonas putida KT2440
ggccagcgccugcugc

SEQ ID NO: 3599846 - RNA, 13 nt, Pseudomonas putida KT2440
ggccagcgcgcug

SEQ ID NO: 3599847 - RNA, 14 nt, Pseudomonas putida KT2440
ggccagcggccgcu

SEQ ID NO: 3599848 - RNA, 16 nt, Pseudomonas putida KT2440
ggccagcggcgcggcc

SEQ ID NO: 3599849 - RNA, 23 nt, Pseudomonas putida KT2440
ggccagcgucguguucgccuguc

SEQ ID NO: 3599850 - RNA, 22 nt, Pseudomonas putida KT2440
ggccagcguggccgccaacagc

SEQ ID NO: 3599851 - RNA, 13 nt, Pseudomonas putida KT2440
ggccagcuccuuc

SEQ ID NO: 3599852 - RNA, 15 nt, Pseudomonas putida KT2440
ggccagcuccuucgc

SEQ ID NO: 3599853 - RNA, 20 nt, Pseudomonas putida KT2440
ggccagcucgccaaacagga

SEQ ID NO: 3599854 - RNA, 14 nt, Pseudomonas putida KT2440
ggccagcucggcag

SEQ ID NO: 3599855 - RNA, 18 nt, Pseudomonas putida KT2440
ggccagcugcgcaccggc

SEQ ID NO: 3599856 - RNA, 16 nt, Pseudomonas putida KT2440
ggccagcugcugcggc

SEQ ID NO: 3599857 - RNA, 15 nt, Pseudomonas putida KT2440
ggccagcuucgacga

SEQ ID NO: 3599858 - RNA, 23 nt, Pseudomonas putida KT2440
ggccagcuugacggugcgcgcca

SEQ ID NO: 3599859 - RNA, 21 nt, Pseudomonas putida KT2440
ggccagcuuggcuuucggcgc

SEQ ID NO: 3599860 - RNA, 16 nt, Pseudomonas putida KT2440
ggccaggaacagcgca

SEQ ID NO: 3599861 - RNA, 14 nt, Pseudomonas putida KT2440
ggccaggcccacca

SEQ ID NO: 3599862 - RNA, 12 nt, Pseudomonas putida KT2440
ggccaggccccu

SEQ ID NO: 3599863 - RNA, 13 nt, Pseudomonas putida KT2440
ggccaggccggcg

SEQ ID NO: 3599864 - RNA, 17 nt, Pseudomonas putida KT2440
ggccagggcaucggaca

SEQ ID NO: 3599865 - RNA, 20 nt, Pseudomonas putida KT2440
ggccagggcaucggacaggu

SEQ ID NO: 3599866 - RNA, 11 nt, Pseudomonas putida KT2440
ggccagggccu

SEQ ID NO: 3599867 - RNA, 23 nt, Pseudomonas putida KT2440
ggccaggguaccgccguccacca

SEQ ID NO: 3599868 - RNA, 13 nt, Pseudomonas putida KT2440
ggccagggugcgg

SEQ ID NO: 3599869 - RNA, 19 nt, Pseudomonas putida KT2440
ggccagguagacgaucgag

SEQ ID NO: 3599870 - RNA, 22 nt, Pseudomonas putida KT2440
ggccagguagacgaucgagccg

SEQ ID NO: 3599871 - RNA, 15 nt, Pseudomonas putida KT2440
ggccaggucgaccga

SEQ ID NO: 3599872 - RNA, 15 nt, Pseudomonas putida KT2440
ggccaggucgauccg

SEQ ID NO: 3599873 - RNA, 14 nt, Pseudomonas putida KT2440
ggccagguggccuu

SEQ ID NO: 3599874 - RNA, 20 nt, Pseudomonas putida KT2440
ggccaguaaggaucgcgcag

SEQ ID NO: 3599875 - RNA, 16 nt, Pseudomonas putida KT2440
ggccaguaccagcagc

SEQ ID NO: 3599876 - RNA, 14 nt, Pseudomonas putida KT2440
ggccaguaccaggu

SEQ ID NO: 3599877 - RNA, 21 nt, Pseudomonas putida KT2440
ggccaguaccaggucgccagc

SEQ ID NO: 3599878 - RNA, 20 nt, Pseudomonas putida KT2440
ggccaguaccuucuggcugg

SEQ ID NO: 3599879 - RNA, 22 nt, Pseudomonas putida KT2440
ggccagugagccucacacagca

SEQ ID NO: 3599880 - RNA, 20 nt, Pseudomonas putida KT2440
ggccagugccaugaacacca

SEQ ID NO: 3599881 - RNA, 18 nt, Pseudomonas putida KT2440
ggccaguuguucgucgag

SEQ ID NO: 3599882 - RNA, 21 nt, Pseudomonas putida KT2440
ggccaguuguucgucgagcac

SEQ ID NO: 3599883 - RNA, 23 nt, Pseudomonas putida KT2440
ggccaguuguucgucgagcacca

SEQ ID NO: 3599884 - RNA, 16 nt, Pseudomonas putida KT2440
ggccaguuugugcucg

SEQ ID NO: 3599885 - RNA, 23 nt, Pseudomonas putida KT2440
ggccauauugcugagccaguuca

SEQ ID NO: 3599886 - RNA, 18 nt, Pseudomonas putida KT2440
ggccaucaauaccggcau

SEQ ID NO: 3599887 - RNA, 17 nt, Pseudomonas putida KT2440
ggccaucacuuccggcu

SEQ ID NO: 3599888 - RNA, 21 nt, Pseudomonas putida KT2440
ggcccuaucgcgacgcaaggc

SEQ ID NO: 3599889 - RNA, 21 nt, Pseudomonas putida KT2440
ggcccuauggggugagcggcu

SEQ ID NO: 3599890 - RNA, 18 nt, Pseudomonas putida KT2440
ggcccucaacccucgccc

SEQ ID NO: 3599891 - RNA, 13 nt, Pseudomonas putida KT2440
ggcccucaagggc

SEQ ID NO: 3599892 - RNA, 14 nt, Pseudomonas putida KT2440
ggcccucaagggcg

SEQ ID NO: 3599893 - RNA, 19 nt, Pseudomonas putida KT2440
ggcccucaagggcgcugau

SEQ ID NO: 3599894 - RNA, 21 nt, Pseudomonas putida KT2440
ggcccugaaggccgcuccugc

SEQ ID NO: 3599895 - RNA, 19 nt, Pseudomonas putida KT2440
ggcccugacaggcgaucag

SEQ ID NO: 3599896 - RNA, 22 nt, Pseudomonas putida KT2440
ggcccugacaggcgaucaguca

SEQ ID NO: 3599897 - RNA, 19 nt, Pseudomonas putida KT2440
ggcccugaccgcggugcug

SEQ ID NO: 3599898 - RNA, 21 nt, Pseudomonas putida KT2440
ggcccugacgccagcgcuggg

SEQ ID NO: 3599899 - RNA, 22 nt, Pseudomonas putida KT2440
ggcccugacgccagcgcugggc

SEQ ID NO: 3599900 - RNA, 13 nt, Pseudomonas putida KT2440
ggcccugacgcgu

SEQ ID NO: 3599901 - RNA, 13 nt, Pseudomonas putida KT2440
ggcccugagccuu

SEQ ID NO: 3599902 - RNA, 14 nt, Pseudomonas putida KT2440
ggcccugagccuug

SEQ ID NO: 3599903 - RNA, 12 nt, Pseudomonas putida KT2440
ggcccugcagcg

SEQ ID NO: 3599904 - RNA, 21 nt, Pseudomonas putida KT2440
ggcccugcauaugcagggccu

SEQ ID NO: 3599905 - RNA, 14 nt, Pseudomonas putida KT2440
ggcccugccuacca

SEQ ID NO: 3599906 - RNA, 17 nt, Pseudomonas putida KT2440
ggcccugcucacgcagc

SEQ ID NO: 3599907 - RNA, 20 nt, Pseudomonas putida KT2440
ggcccugggauuucggcggc

SEQ ID NO: 3599908 - RNA, 21 nt, Pseudomonas putida KT2440
ggcccugggauuucggcggcg

SEQ ID NO: 3599909 - RNA, 15 nt, Pseudomonas putida KT2440
ggcccugugccgggg

SEQ ID NO: 3599910 - RNA, 13 nt, Pseudomonas putida KT2440
ggcccugugggag

SEQ ID NO: 3599911 - RNA, 15 nt, Pseudomonas putida KT2440
ggcccugugggagcg

SEQ ID NO: 3599912 - RNA, 13 nt, Pseudomonas putida KT2440
ggcccuucgcggg

SEQ ID NO: 3599913 - RNA, 14 nt, Pseudomonas putida KT2440
ggcccuucgcgggc

SEQ ID NO: 3599914 - RNA, 15 nt, Pseudomonas putida KT2440
ggcccuucugcugcu

SEQ ID NO: 3599915 - RNA, 14 nt, Pseudomonas putida KT2440
ggcccuuggcagcg

SEQ ID NO: 3599916 - RNA, 16 nt, Pseudomonas putida KT2440
ggcccuuggcagcgcu

SEQ ID NO: 3599917 - RNA, 14 nt, Pseudomonas putida KT2440
ggcccuuucgcggg

SEQ ID NO: 3599918 - RNA, 15 nt, Pseudomonas putida KT2440
ggcccuuucgcgggu

SEQ ID NO: 3599919 - RNA, 17 nt, Pseudomonas putida KT2440
ggcccuuucgcggguaa

SEQ ID NO: 3599920 - RNA, 17 nt, Pseudomonas putida KT2440
ggccgaaaccagccccu

SEQ ID NO: 3599921 - RNA, 16 nt, Pseudomonas putida KT2440
ggccgaaaccgcccgg

SEQ ID NO: 3599922 - RNA, 18 nt, Pseudomonas putida KT2440
ggccgaaaccgcccggga

SEQ ID NO: 3599923 - RNA, 14 nt, Pseudomonas putida KT2440
ggccgaaaggugca

SEQ ID NO: 3599924 - RNA, 15 nt, Pseudomonas putida KT2440
ggccgaacaccgcca

SEQ ID NO: 3599925 - RNA, 21 nt, Pseudomonas putida KT2440
ggccgaacaccgccagcccgc

SEQ ID NO: 3599926 - RNA, 14 nt, Pseudomonas putida KT2440
ggccgaaggccagc

SEQ ID NO: 3599927 - RNA, 21 nt, Pseudomonas putida KT2440
ggccgaaggccguggcaaggc

SEQ ID NO: 3599928 - RNA, 14 nt, Pseudomonas putida KT2440
ggccgaaggcgcug

SEQ ID NO: 3599929 - RNA, 16 nt, Pseudomonas putida KT2440
ggccgaaggggcgggu

SEQ ID NO: 3599930 - RNA, 14 nt, Pseudomonas putida KT2440
ggccgacaacggug

SEQ ID NO: 3599931 - RNA, 21 nt, Pseudomonas putida KT2440
ggccgacacaccaauggccau

SEQ ID NO: 3599932 - RNA, 21 nt, Pseudomonas putida KT2440
ggccgacacgggguguugcuu

SEQ ID NO: 3599933 - RNA, 20 nt, Pseudomonas putida KT2440
ggccgacaguguugccggcg

SEQ ID NO: 3599934 - RNA, 13 nt, Pseudomonas putida KT2440
ggccgacauggcg

SEQ ID NO: 3599935 - RNA, 14 nt, Pseudomonas putida KT2440
ggccgacauggcgc

SEQ ID NO: 3599936 - RNA, 22 nt, Pseudomonas putida KT2440
ggccgacgucaguucggcggcc

SEQ ID NO: 3599937 - RNA, 19 nt, Pseudomonas putida KT2440
ggccgacucuucaccagcu

SEQ ID NO: 3599938 - RNA, 13 nt, Pseudomonas putida KT2440
ggccgacuggcgc

SEQ ID NO: 3599939 - RNA, 20 nt, Pseudomonas putida KT2440
ggccgagcaggagcugaacu

SEQ ID NO: 3599940 - RNA, 22 nt, Pseudomonas putida KT2440
ggccgagcugauccgccuggcc

SEQ ID NO: 3599941 - RNA, 21 nt, Pseudomonas putida KT2440
ggccgagcuuuguagcucccu

SEQ ID NO: 3599942 - RNA, 14 nt, Pseudomonas putida KT2440
ggccgaggccgggu

SEQ ID NO: 3599943 - RNA, 18 nt, Pseudomonas putida KT2440
ggccgaguaaccggcggc

SEQ ID NO: 3599944 - RNA, 13 nt, Pseudomonas putida KT2440
ggccgagucggug

SEQ ID NO: 3599945 - RNA, 17 nt, Pseudomonas putida KT2440
ggccgaucaccagcacc

SEQ ID NO: 3599946 - RNA, 18 nt, Pseudomonas putida KT2440
ggccgaucaccagcaccc

SEQ ID NO: 3599947 - RNA, 21 nt, Pseudomonas putida KT2440
ggccgaucaccagcaccccga

SEQ ID NO: 3599948 - RNA, 13 nt, Pseudomonas putida KT2440
ggccgaucacgaa

SEQ ID NO: 3599949 - RNA, 17 nt, Pseudomonas putida KT2440
ggccgaucacucggcag

SEQ ID NO: 3599950 - RNA, 22 nt, Pseudomonas putida KT2440
ggccgaucacucggcaggaaac

SEQ ID NO: 3599951 - RNA, 17 nt, Pseudomonas putida KT2440
ggccgaucuucaggcug

SEQ ID NO: 3599952 - RNA, 18 nt, Pseudomonas putida KT2440
ggccgaucuucaggcuga

SEQ ID NO: 3599953 - RNA, 22 nt, Pseudomonas putida KT2440
ggccgauggcgcaaacccucgg

SEQ ID NO: 3599954 - RNA, 15 nt, Pseudomonas putida KT2440
ggccgaugggcaggc

SEQ ID NO: 3599955 - RNA, 22 nt, Pseudomonas putida KT2440
ggccgaugggcuguuccagcag

SEQ ID NO: 3599956 - RNA, 22 nt, Pseudomonas putida KT2440
ggccgauugccugggcgagcca

SEQ ID NO: 3599957 - RNA, 15 nt, Pseudomonas putida KT2440
ggccgcaaagcggcc

SEQ ID NO: 3599958 - RNA, 16 nt, Pseudomonas putida KT2440
ggccgcaaagcggccc

SEQ ID NO: 3599959 - RNA, 22 nt, Pseudomonas putida KT2440
ggccgcaacacauuauccacca

SEQ ID NO: 3599960 - RNA, 13 nt, Pseudomonas putida KT2440
ggccgcaaggccg

SEQ ID NO: 3599961 - RNA, 15 nt, Pseudomonas putida KT2440
ggccgcaaggcggcc

SEQ ID NO: 3599962 - RNA, 17 nt, Pseudomonas putida KT2440
ggccgcacaaggccgcu

SEQ ID NO: 3599963 - RNA, 13 nt, Pseudomonas putida KT2440
ggccgcacccagc

SEQ ID NO: 3599964 - RNA, 16 nt, Pseudomonas putida KT2440
ggccgcacccagcagg

SEQ ID NO: 3599965 - RNA, 16 nt, Pseudomonas putida KT2440
ggccgcagagcggccc

SEQ ID NO: 3599966 - RNA, 13 nt, Pseudomonas putida KT2440
ggccgcagccaug

SEQ ID NO: 3599967 - RNA, 12 nt, Pseudomonas putida KT2440
ggccgcaggccc

SEQ ID NO: 3599968 - RNA, 18 nt, Pseudomonas putida KT2440
ggccgcauauacgccggc

SEQ ID NO: 3599969 - RNA, 16 nt, Pseudomonas putida KT2440
ggccgccaacagcgca

SEQ ID NO: 3599970 - RNA, 17 nt, Pseudomonas putida KT2440
ggccgccaauagcccgc

SEQ ID NO: 3599971 - RNA, 23 nt, Pseudomonas putida KT2440
ggccgccaauagcccgcuggccg

SEQ ID NO: 3599972 - RNA, 17 nt, Pseudomonas putida KT2440
ggccgccacggugccga

SEQ ID NO: 3599973 - RNA, 14 nt, Pseudomonas putida KT2440
ggccgccagcggcg

SEQ ID NO: 3599974 - RNA, 16 nt, Pseudomonas putida KT2440
ggccgcccacccacca

SEQ ID NO: 3599975 - RNA, 14 nt, Pseudomonas putida KT2440
ggccgccgaacagg

SEQ ID NO: 3599976 - RNA, 16 nt, Pseudomonas putida KT2440
ggccgccgaacaggcc

SEQ ID NO: 3599977 - RNA, 13 nt, Pseudomonas putida KT2440
ggccgccggcaac

SEQ ID NO: 3599978 - RNA, 14 nt, Pseudomonas putida KT2440
ggccgccucccagg

SEQ ID NO: 3599979 - RNA, 17 nt, Pseudomonas putida KT2440
ggccgccucccaggacu

SEQ ID NO: 3599980 - RNA, 20 nt, Pseudomonas putida KT2440
ggccgccuccugcugcugca

SEQ ID NO: 3599981 - RNA, 12 nt, Pseudomonas putida KT2440
ggccgccuugcg

SEQ ID NO: 3599982 - RNA, 20 nt, Pseudomonas putida KT2440
ggccgcgacgaugaucaggu

SEQ ID NO: 3599983 - RNA, 13 nt, Pseudomonas putida KT2440
ggccgcgacgcgg

SEQ ID NO: 3599984 - RNA, 14 nt, Pseudomonas putida KT2440
ggccgcgacgcggc

SEQ ID NO: 3599985 - RNA, 16 nt, Pseudomonas putida KT2440
ggccgcgacgcggccc

SEQ ID NO: 3599986 - RNA, 14 nt, Pseudomonas putida KT2440
ggccgcgcagccuu

SEQ ID NO: 3599987 - RNA, 14 nt, Pseudomonas putida KT2440
ggccgcgcaggaag

SEQ ID NO: 3599988 - RNA, 16 nt, Pseudomonas putida KT2440
ggccgcgcaggaagaa

SEQ ID NO: 3599989 - RNA, 12 nt, Pseudomonas putida KT2440
ggccgcgcaggc

SEQ ID NO: 3599990 - RNA, 14 nt, Pseudomonas putida KT2440
ggccgcgcaggcgg

SEQ ID NO: 3599991 - RNA, 17 nt, Pseudomonas putida KT2440
ggccgcgcaggcggcug

SEQ ID NO: 3599992 - RNA, 17 nt, Pseudomonas putida KT2440
ggccgcgcuuggcggcc

SEQ ID NO: 3599993 - RNA, 18 nt, Pseudomonas putida KT2440
ggccgcgcuuggcggccc

SEQ ID NO: 3599994 - RNA, 14 nt, Pseudomonas putida KT2440
ggccuguccaggca

SEQ ID NO: 3599995 - RNA, 18 nt, Pseudomonas putida KT2440
ggccugugcauguccagu

SEQ ID NO: 3599996 - RNA, 17 nt, Pseudomonas putida KT2440
ggccuguuuggccgcau

SEQ ID NO: 3599997 - RNA, 14 nt, Pseudomonas putida KT2440
ggccuucaaccuca

SEQ ID NO: 3599998 - RNA, 17 nt, Pseudomonas putida KT2440
ggccuucaagcucccca

SEQ ID NO: 3599999 - RNA, 20 nt, Pseudomonas putida KT2440
ggccuucaagcuccccagca

SEQ ID NO: 3600000 - RNA, 23 nt, Pseudomonas putida KT2440
ggccuucaagcuccccagcaacg

SEQ ID NO: 3600001 - RNA, 13 nt, Pseudomonas putida KT2440
ggccuucagcgcg

SEQ ID NO: 3600002 - RNA, 16 nt, Pseudomonas putida KT2440
ggccuucagcgcggca

SEQ ID NO: 3600003 - RNA, 18 nt, Pseudomonas putida KT2440
ggccuucgaacagcgaag

SEQ ID NO: 3600004 - RNA, 23 nt, Pseudomonas putida KT2440
ggccuucucuuccgccagccaac

SEQ ID NO: 3600005 - RNA, 13 nt, Pseudomonas putida KT2440
ggccuugaccagc

SEQ ID NO: 3600006 - RNA, 19 nt, Pseudomonas putida KT2440
ggccuugaccagcaacggc

SEQ ID NO: 3600007 - RNA, 13 nt, Pseudomonas putida KT2440
ggccuugccgcuc

SEQ ID NO: 3600008 - RNA, 17 nt, Pseudomonas putida KT2440
ggccuuggacaccaggc

SEQ ID NO: 3600009 - RNA, 16 nt, Pseudomonas putida KT2440
ggccuuggccgcuggc

SEQ ID NO: 3600010 - RNA, 12 nt, Pseudomonas putida KT2440
ggccuuggccug

SEQ ID NO: 3600011 - RNA, 23 nt, Pseudomonas putida KT2440
ggccuuggucucgaucagcgagu

SEQ ID NO: 3600012 - RNA, 17 nt, Pseudomonas putida KT2440
ggccuuguuauccaggc

SEQ ID NO: 3600013 - RNA, 20 nt, Pseudomonas putida KT2440
ggccuuguuauccaggcugg

SEQ ID NO: 3600014 - RNA, 13 nt, Pseudomonas putida KT2440
ggccuuucugcuu

SEQ ID NO: 3600015 - RNA, 16 nt, Pseudomonas putida KT2440
ggccuuucugcuucca

SEQ ID NO: 3600016 - RNA, 19 nt, Pseudomonas putida KT2440
ggccuuucugcuuccacuc

SEQ ID NO: 3600017 - RNA, 16 nt, Pseudomonas putida KT2440
ggccuuuucgcgggca

SEQ ID NO: 3600018 - RNA, 23 nt, Pseudomonas putida KT2440
ggcgaaauacccaacuccagcgc

SEQ ID NO: 3600019 - RNA, 15 nt, Pseudomonas putida KT2440
ggcgaaauggcgaau

SEQ ID NO: 3600020 - RNA, 14 nt, Pseudomonas putida KT2440
ggcgaacgauggug

SEQ ID NO: 3600021 - RNA, 22 nt, Pseudomonas putida KT2440
ggcgaacgccacggcggcaucc

SEQ ID NO: 3600022 - RNA, 17 nt, Pseudomonas putida KT2440
ggcgaacgccugcaggg

SEQ ID NO: 3600023 - RNA, 17 nt, Pseudomonas putida KT2440
ggcgaagaccgccgccc

SEQ ID NO: 3600024 - RNA, 23 nt, Pseudomonas putida KT2440
ggcgaagaccgccgcccagguca

SEQ ID NO: 3600025 - RNA, 22 nt, Pseudomonas putida KT2440
ggcgaagcacugucgauggcgg

SEQ ID NO: 3600026 - RNA, 14 nt, Pseudomonas putida KT2440
ggcgaagcccgugg

SEQ ID NO: 3600027 - RNA, 18 nt, Pseudomonas putida KT2440
ggcgaauacgcucagccg

SEQ ID NO: 3600028 - RNA, 23 nt, Pseudomonas putida KT2440
ggcgaauagcaucgcuagaaaac

SEQ ID NO: 3600029 - RNA, 13 nt, Pseudomonas putida KT2440
ggcgaauccagca

SEQ ID NO: 3600030 - RNA, 14 nt, Pseudomonas putida KT2440
ggcgaauccagcag

SEQ ID NO: 3600031 - RNA, 18 nt, Pseudomonas putida KT2440
ggcgaaugagaggcgggu

SEQ ID NO: 3600032 - RNA, 22 nt, Pseudomonas putida KT2440
ggcgaaugagaggcgggucagg

SEQ ID NO: 3600033 - RNA, 13 nt, Pseudomonas putida KT2440
ggcgaaugcgccc

SEQ ID NO: 3600034 - RNA, 22 nt, Pseudomonas putida KT2440
ggcgaaugcgcccggccagguc

SEQ ID NO: 3600035 - RNA, 21 nt, Pseudomonas putida KT2440
ggcgacaaccgaaaaggccaa

SEQ ID NO: 3600036 - RNA, 18 nt, Pseudomonas putida KT2440
ggcgacaggugccucugc

SEQ ID NO: 3600037 - RNA, 18 nt, Pseudomonas putida KT2440
ggcgaccaacacggugau

SEQ ID NO: 3600038 - RNA, 15 nt, Pseudomonas putida KT2440
ggcgaccaugcggcu

SEQ ID NO: 3600039 - RNA, 18 nt, Pseudomonas putida KT2440
ggcgacgaaggccuuggc

SEQ ID NO: 3600040 - RNA, 14 nt, Pseudomonas putida KT2440
ggcgacgcacuuca

SEQ ID NO: 3600041 - RNA, 22 nt, Pseudomonas putida KT2440
ggcgacgcaguuacucggcuac

SEQ ID NO: 3600042 - RNA, 14 nt, Pseudomonas putida KT2440
ggcgacgcggugcu

SEQ ID NO: 3600043 - RNA, 19 nt, Pseudomonas putida KT2440
ggcgacgcugcccagcaac

SEQ ID NO: 3600044 - RNA, 17 nt, Pseudomonas putida KT2440
ggcgacggaucggcaca

SEQ ID NO: 3600045 - RNA, 18 nt, Pseudomonas putida KT2440
ggcgacgugcccagauca

SEQ ID NO: 3600046 - RNA, 17 nt, Pseudomonas putida KT2440
ggcgacuucggucgccc

SEQ ID NO: 3600047 - RNA, 16 nt, Pseudomonas putida KT2440
ggcgacuucgugcgcu

SEQ ID NO: 3600048 - RNA, 13 nt, Pseudomonas putida KT2440
ggcgagcaggccc

SEQ ID NO: 3600049 - RNA, 15 nt, Pseudomonas putida KT2440
ggcgagcaggcccgc

SEQ ID NO: 3600050 - RNA, 14 nt, Pseudomonas putida KT2440
ggcgagcaggucau

SEQ ID NO: 3600051 - RNA, 19 nt, Pseudomonas putida KT2440
ggcgagcgcaggaacaggc

SEQ ID NO: 3600052 - RNA, 15 nt, Pseudomonas putida KT2440
ggcgagcgcgcaggc

SEQ ID NO: 3600053 - RNA, 22 nt, Pseudomonas putida KT2440
ggcgagcgcgugcggggcaucg

SEQ ID NO: 3600054 - RNA, 13 nt, Pseudomonas putida KT2440
ggcgagggcuucg

SEQ ID NO: 3600055 - RNA, 17 nt, Pseudomonas putida KT2440
ggcgagggcuucgcccu

SEQ ID NO: 3600056 - RNA, 15 nt, Pseudomonas putida KT2440
ggcgagguucagcgc

SEQ ID NO: 3600057 - RNA, 11 nt, Pseudomonas putida KT2440
ggcgagucagg

SEQ ID NO: 3600058 - RNA, 16 nt, Pseudomonas putida KT2440
ggcgauacuuggccau

SEQ ID NO: 3600059 - RNA, 18 nt, Pseudomonas putida KT2440
ggcgauauggcuccacca

SEQ ID NO: 3600060 - RNA, 15 nt, Pseudomonas putida KT2440
ggcgaucaggcaggc

SEQ ID NO: 3600061 - RNA, 21 nt, Pseudomonas putida KT2440
ggcgaucaggcaggccagcac

SEQ ID NO: 3600062 - RNA, 22 nt, Pseudomonas putida KT2440
ggcgaucaggcaggccagcacg

SEQ ID NO: 3600063 - RNA, 11 nt, Pseudomonas putida KT2440
ggcgaucaggg

SEQ ID NO: 3600064 - RNA, 14 nt, Pseudomonas putida KT2440
ggcgaucagggugu

SEQ ID NO: 3600065 - RNA, 21 nt, Pseudomonas putida KT2440
ggcgauccggauggaucgccu

SEQ ID NO: 3600066 - RNA, 20 nt, Pseudomonas putida KT2440
ggcgaucgccagguggaagc

SEQ ID NO: 3600067 - RNA, 21 nt, Pseudomonas putida KT2440
ggcgaucgccagguggaagcg

SEQ ID NO: 3600068 - RNA, 23 nt, Pseudomonas putida KT2440
ggcgaucgccagguggaagcgcg

SEQ ID NO: 3600069 - RNA, 17 nt, Pseudomonas putida KT2440
ggcgaucuggucgaagc

SEQ ID NO: 3600070 - RNA, 22 nt, Pseudomonas putida KT2440
ggcgaugaacacgccgucgacc

SEQ ID NO: 3600071 - RNA, 23 nt, Pseudomonas putida KT2440
ggcgaugaucgagccgaucagga

SEQ ID NO: 3600072 - RNA, 14 nt, Pseudomonas putida KT2440
ggcgaugaucgccu

SEQ ID NO: 3600073 - RNA, 16 nt, Pseudomonas putida KT2440
ggcgaugaucgccugg

SEQ ID NO: 3600074 - RNA, 16 nt, Pseudomonas putida KT2440
ggcgaugaucgcggcg

SEQ ID NO: 3600075 - RNA, 20 nt, Pseudomonas putida KT2440
ggcgaugcagggcugcgguc

SEQ ID NO: 3600076 - RNA, 13 nt, Pseudomonas putida KT2440
ggcgaugcgcaca

SEQ ID NO: 3600077 - RNA, 18 nt, Pseudomonas putida KT2440
ggcgaugcgcacaccgcu

SEQ ID NO: 3600078 - RNA, 16 nt, Pseudomonas putida KT2440
ggcgaugcgcccccca

SEQ ID NO: 3600079 - RNA, 21 nt, Pseudomonas putida KT2440
ggcgaugcgccccccaggcgg

SEQ ID NO: 3600080 - RNA, 23 nt, Pseudomonas putida KT2440
ggcgauggcauccacacgcugcu

SEQ ID NO: 3600081 - RNA, 15 nt, Pseudomonas putida KT2440
ggcgauucaggcuuu

SEQ ID NO: 3600082 - RNA, 18 nt, Pseudomonas putida KT2440
ggcgcaaauugcccggcc

SEQ ID NO: 3600083 - RNA, 22 nt, Pseudomonas putida KT2440
ggcgcaaauugcccggccagcg

SEQ ID NO: 3600084 - RNA, 23 nt, Pseudomonas putida KT2440
ggcgcaaauugcccggccagcga

SEQ ID NO: 3600085 - RNA, 20 nt, Pseudomonas putida KT2440
ggcgcaacaucgaucuggug

SEQ ID NO: 3600086 - RNA, 16 nt, Pseudomonas putida KT2440
ggcgcaacucagcgca

SEQ ID NO: 3600087 - RNA, 18 nt, Pseudomonas putida KT2440
ggcgcaacucagcgcagc

SEQ ID NO: 3600088 - RNA, 22 nt, Pseudomonas putida KT2440
ggcgcaacucagcgcagcuucu

SEQ ID NO: 3600089 - RNA, 13 nt, Pseudomonas putida KT2440
ggcgcaacucgcg

SEQ ID NO: 3600090 - RNA, 21 nt, Pseudomonas putida KT2440
ggcgcaaguagaaccacacag

SEQ ID NO: 3600091 - RNA, 20 nt, Pseudomonas putida KT2440
ggcgcaauccgugagccagg

SEQ ID NO: 3600092 - RNA, 21 nt, Pseudomonas putida KT2440
ggcgcaaugaaaaagccccug

SEQ ID NO: 3600093 - RNA, 20 nt, Pseudomonas putida KT2440
ggcgcacagggcgaugcccu

SEQ ID NO: 3600094 - RNA, 12 nt, Pseudomonas putida KT2440
ggcgcaccacga

SEQ ID NO: 3600095 - RNA, 15 nt, Pseudomonas putida KT2440
ggcgcaccagcggcu

SEQ ID NO: 3600096 - RNA, 22 nt, Pseudomonas putida KT2440
ggcgcaccgagcgcucgcgaau

SEQ ID NO: 3600097 - RNA, 22 nt, Pseudomonas putida KT2440
ggcgcacucucgucaccugaca

SEQ ID NO: 3600098 - RNA, 18 nt, Pseudomonas putida KT2440
ggcgcagagcgccccggc

SEQ ID NO: 3600099 - RNA, 20 nt, Pseudomonas putida KT2440
ggcgcugaugcggacccagc

SEQ ID NO: 3600100 - RNA, 17 nt, Pseudomonas putida KT2440
ggcgcugcguuggccau

SEQ ID NO: 3600101 - RNA, 17 nt, Pseudomonas putida KT2440
ggcgcuggacagcggca

SEQ ID NO: 3600102 - RNA, 13 nt, Pseudomonas putida KT2440
ggcgcuggccagg

SEQ ID NO: 3600103 - RNA, 15 nt, Pseudomonas putida KT2440
ggcgcuggccaggcu

SEQ ID NO: 3600104 - RNA, 18 nt, Pseudomonas putida KT2440
ggcgcugguaggcgagua

SEQ ID NO: 3600105 - RNA, 16 nt, Pseudomonas putida KT2440
ggcgcuguccagcgca

SEQ ID NO: 3600106 - RNA, 16 nt, Pseudomonas putida KT2440
ggcgcuuccuggccuu

SEQ ID NO: 3600107 - RNA, 18 nt, Pseudomonas putida KT2440
ggcgcuugaucugccagg

SEQ ID NO: 3600108 - RNA, 21 nt, Pseudomonas putida KT2440
ggcgcuuggaaauguucaaca

SEQ ID NO: 3600109 - RNA, 17 nt, Pseudomonas putida KT2440
ggcgcuuugcacccgcg

SEQ ID NO: 3600110 - RNA, 18 nt, Pseudomonas putida KT2440
ggcgcuuugcacccgcgc

SEQ ID NO: 3600111 - RNA, 22 nt, Pseudomonas putida KT2440
ggcgcuuugcacccgcgcgcug

SEQ ID NO: 3600112 - RNA, 17 nt, Pseudomonas putida KT2440
ggcgcuuugcgcaaccg

SEQ ID NO: 3600113 - RNA, 17 nt, Pseudomonas putida KT2440
ggcggagauuggccagc

SEQ ID NO: 3600114 - RNA, 16 nt, Pseudomonas putida KT2440
ggcggauagccccgcc

SEQ ID NO: 3600115 - RNA, 18 nt, Pseudomonas putida KT2440
ggcggaucugacggcgcu

SEQ ID NO: 3600116 - RNA, 22 nt, Pseudomonas putida KT2440
ggcggaucugacggcgcugcug

SEQ ID NO: 3600117 - RNA, 20 nt, Pseudomonas putida KT2440
ggcggauguuggccacgaaa

SEQ ID NO: 3600118 - RNA, 16 nt, Pseudomonas putida KT2440
ggcggauuugcccgcu

SEQ ID NO: 3600119 - RNA, 17 nt, Pseudomonas putida KT2440
ggcggauuugcccgcua

SEQ ID NO: 3600120 - RNA, 12 nt, Pseudomonas putida KT2440
ggcggcaacggu

SEQ ID NO: 3600121 - RNA, 12 nt, Pseudomonas putida KT2440
ggcggcagcggc

SEQ ID NO: 3600122 - RNA, 15 nt, Pseudomonas putida KT2440
ggcggcaggcgcagc

SEQ ID NO: 3600123 - RNA, 15 nt, Pseudomonas putida KT2440
ggcggcauccaggcg

SEQ ID NO: 3600124 - RNA, 15 nt, Pseudomonas putida KT2440
ggcggcaucucgcac

SEQ ID NO: 3600125 - RNA, 15 nt, Pseudomonas putida KT2440
ggcggccaaacugga

SEQ ID NO: 3600126 - RNA, 23 nt, Pseudomonas putida KT2440
ggcggccaaacuggaugauggua

SEQ ID NO: 3600127 - RNA, 12 nt, Pseudomonas putida KT2440
ggcggccagcac

SEQ ID NO: 3600128 - RNA, 18 nt, Pseudomonas putida KT2440
ggcggccagcacgaacag

SEQ ID NO: 3600129 - RNA, 14 nt, Pseudomonas putida KT2440
ggcggccagccaac

SEQ ID NO: 3600130 - RNA, 15 nt, Pseudomonas putida KT2440
ggcggccaucgcuuc

SEQ ID NO: 3600131 - RNA, 22 nt, Pseudomonas putida KT2440
ggcggcccagccagucgcgcaa

SEQ ID NO: 3600132 - RNA, 23 nt, Pseudomonas putida KT2440
ggcggcccagccagucgcgcaac

SEQ ID NO: 3600133 - RNA, 16 nt, Pseudomonas putida KT2440
ggcggcccgccggcaa

SEQ ID NO: 3600134 - RNA, 18 nt, Pseudomonas putida KT2440
ggcggcccgccggcaacu

SEQ ID NO: 3600135 - RNA, 14 nt, Pseudomonas putida KT2440
ggcggcccggcaca

SEQ ID NO: 3600136 - RNA, 22 nt, Pseudomonas putida KT2440
ggcggccuuggcucgacacgcu

SEQ ID NO: 3600137 - RNA, 17 nt, Pseudomonas putida KT2440
ggcggcgaacaucugcu

SEQ ID NO: 3600138 - RNA, 15 nt, Pseudomonas putida KT2440
ggcggcgaucagcgc

SEQ ID NO: 3600139 - RNA, 18 nt, Pseudomonas putida KT2440
ggcggcgcgaaucagcgc

SEQ ID NO: 3600140 - RNA, 22 nt, Pseudomonas putida KT2440
ggcggcgcucgaucucacaggc

SEQ ID NO: 3600141 - RNA, 23 nt, Pseudomonas putida KT2440
ggcggcgcucgaucucacaggcg

SEQ ID NO: 3600142 - RNA, 18 nt, Pseudomonas putida KT2440
ggcggcggaucggcgugg

SEQ ID NO: 3600143 - RNA, 13 nt, Pseudomonas putida KT2440
ggcggcggcguga

SEQ ID NO: 3600144 - RNA, 13 nt, Pseudomonas putida KT2440
ggcggcgguaccc

SEQ ID NO: 3600145 - RNA, 20 nt, Pseudomonas putida KT2440
ggcggcgugaccagcccggc

SEQ ID NO: 3600146 - RNA, 12 nt, Pseudomonas putida KT2440
ggcggcgugagc

SEQ ID NO: 3600147 - RNA, 18 nt, Pseudomonas putida KT2440
ggcggcucgcugaacacg

SEQ ID NO: 3600148 - RNA, 19 nt, Pseudomonas putida KT2440
ggcggcucgcugaacacgc

SEQ ID NO: 3600149 - RNA, 17 nt, Pseudomonas putida KT2440
ggcggcucuugcagcga

SEQ ID NO: 3600150 - RNA, 16 nt, Pseudomonas putida KT2440
ggcggcugagccggcu

SEQ ID NO: 3600151 - RNA, 17 nt, Pseudomonas putida KT2440
ggcggcuuccagggcug

SEQ ID NO: 3600152 - RNA, 18 nt, Pseudomonas putida KT2440
ggcggcuuccagggcugg

SEQ ID NO: 3600153 - RNA, 17 nt, Pseudomonas putida KT2440
ggcggcuuucagcgccg

SEQ ID NO: 3600154 - RNA, 18 nt, Pseudomonas putida KT2440
ggcggcuuucagcgccgc

SEQ ID NO: 3600155 - RNA, 15 nt, Pseudomonas putida KT2440
ggcgggccaucugcu

SEQ ID NO: 3600156 - RNA, 18 nt, Pseudomonas putida KT2440
ggcgggccaucugcuugg

SEQ ID NO: 3600157 - RNA, 22 nt, Pseudomonas putida KT2440
ggcgggcggagauuggccagca

SEQ ID NO: 3600158 - RNA, 17 nt, Pseudomonas putida KT2440
ggcgggguuuuuucuau

SEQ ID NO: 3600159 - RNA, 15 nt, Pseudomonas putida KT2440
ggcggguagaggaag

SEQ ID NO: 3600160 - RNA, 22 nt, Pseudomonas putida KT2440
ggcggguggagauuggccagca

SEQ ID NO: 3600161 - RNA, 19 nt, Pseudomonas putida KT2440
ggcgguaacagggguucga

SEQ ID NO: 3600162 - RNA, 20 nt, Pseudomonas putida KT2440
ggcgguacuggaagagcagg

SEQ ID NO: 3600163 - RNA, 17 nt, Pseudomonas putida KT2440
ggcgguauucacaccug

SEQ ID NO: 3600164 - RNA, 13 nt, Pseudomonas putida KT2440
ggcgguccagcaa

SEQ ID NO: 3600165 - RNA, 21 nt, Pseudomonas putida KT2440
ggcgguccagcaagcucauca

SEQ ID NO: 3600166 - RNA, 15 nt, Pseudomonas putida KT2440
ggcgguccuucaugc

SEQ ID NO: 3600167 - RNA, 17 nt, Pseudomonas putida KT2440
ggcggucguagcccucg

SEQ ID NO: 3600168 - RNA, 20 nt, Pseudomonas putida KT2440
ggcgguguaucuccaugcug

SEQ ID NO: 3600169 - RNA, 15 nt, Pseudomonas putida KT2440
ggcgguuaagaaggc

SEQ ID NO: 3600170 - RNA, 14 nt, Pseudomonas putida KT2440
ggcgguugaccagg

SEQ ID NO: 3600171 - RNA, 21 nt, Pseudomonas putida KT2440
ggcgguugucgaccuggcucu

SEQ ID NO: 3600172 - RNA, 21 nt, Pseudomonas putida KT2440
ggcgguuuuuugccugaucag

SEQ ID NO: 3600173 - RNA, 17 nt, Pseudomonas putida KT2440
ggcguaacucagcaacg

SEQ ID NO: 3600174 - RNA, 18 nt, Pseudomonas putida KT2440
ggcguaauacugcuucca

SEQ ID NO: 3600175 - RNA, 15 nt, Pseudomonas putida KT2440
ggcguacaucagccu

SEQ ID NO: 3600176 - RNA, 20 nt, Pseudomonas putida KT2440
ggcguacaucagccucgguc

SEQ ID NO: 3600177 - RNA, 17 nt, Pseudomonas putida KT2440
ggcguacuggacguggu

SEQ ID NO: 3600178 - RNA, 14 nt, Pseudomonas putida KT2440
ggcguaggcacacc

SEQ ID NO: 3600179 - RNA, 20 nt, Pseudomonas putida KT2440
ggcguaguaauguucggagu

SEQ ID NO: 3600180 - RNA, 19 nt, Pseudomonas putida KT2440
ggcguauggcuucacggcc

SEQ ID NO: 3600181 - RNA, 23 nt, Pseudomonas putida KT2440
ggcgucaaccgaacccgcuggcg

SEQ ID NO: 3600182 - RNA, 23 nt, Pseudomonas putida KT2440
ggcgucacccgcgccaccagccc

SEQ ID NO: 3600183 - RNA, 13 nt, Pseudomonas putida KT2440
ggcgucacgcagg

SEQ ID NO: 3600184 - RNA, 15 nt, Pseudomonas putida KT2440
ggcgucacgcagggc

SEQ ID NO: 3600185 - RNA, 17 nt, Pseudomonas putida KT2440
ggcgucacgcagggcca

SEQ ID NO: 3600186 - RNA, 18 nt, Pseudomonas putida KT2440
ggcgucacgcagggccag

SEQ ID NO: 3600187 - RNA, 14 nt, Pseudomonas putida KT2440
ggcgucagccgcgg

SEQ ID NO: 3600188 - RNA, 21 nt, Pseudomonas putida KT2440
ggcgucagcguugcuggcgau

SEQ ID NO: 3600189 - RNA, 24 nt, Pseudomonas putida KT2440
ggcgucagucgccaaccgccagca

SEQ ID NO: 3600190 - RNA, 20 nt, Pseudomonas putida KT2440
ggcgucaguucgacgcggac

SEQ ID NO: 3600191 - RNA, 13 nt, Pseudomonas putida KT2440
ggcgucaucaccc

SEQ ID NO: 3600192 - RNA, 14 nt, Pseudomonas putida KT2440
ggcgucaucacccg

SEQ ID NO: 3600193 - RNA, 13 nt, Pseudomonas putida KT2440
ggcguccacugca

SEQ ID NO: 3600194 - RNA, 16 nt, Pseudomonas putida KT2440
ggcgucgaacaacggc

SEQ ID NO: 3600195 - RNA, 19 nt, Pseudomonas putida KT2440
ggcgucgacgaugaugcgg

SEQ ID NO: 3600196 - RNA, 18 nt, Pseudomonas putida KT2440
ggcgucgaugaucaccug

SEQ ID NO: 3600197 - RNA, 15 nt, Pseudomonas putida KT2440
ggcgucgccugcaug

SEQ ID NO: 3600198 - RNA, 18 nt, Pseudomonas putida KT2440
ggcgucgcgaucacgcag

SEQ ID NO: 3600199 - RNA, 22 nt, Pseudomonas putida KT2440
ggcgucgcgaucacgcaggccc

SEQ ID NO: 3600200 - RNA, 21 nt, Pseudomonas putida KT2440
ggcgucggccaugccaccccc

SEQ ID NO: 3600201 - RNA, 16 nt, Pseudomonas putida KT2440
ggcgucggcgcgcaac

SEQ ID NO: 3600202 - RNA, 19 nt, Pseudomonas putida KT2440
ggcgucggcgcgcaacagc

SEQ ID NO: 3600203 - RNA, 16 nt, Pseudomonas putida KT2440
ggcgucggggccggag

SEQ ID NO: 3600204 - RNA, 22 nt, Pseudomonas putida KT2440
ggcugaaauggcggcccagcca

SEQ ID NO: 3600205 - RNA, 21 nt, Pseudomonas putida KT2440
ggcugaacacgcucaugaaca

SEQ ID NO: 3600206 - RNA, 22 nt, Pseudomonas putida KT2440
ggcugaccccacccuugaagac

SEQ ID NO: 3600207 - RNA, 22 nt, Pseudomonas putida KT2440
ggcugaccugauacacccgcuc

SEQ ID NO: 3600208 - RNA, 17 nt, Pseudomonas putida KT2440
ggcugagcagaccagcc

SEQ ID NO: 3600209 - RNA, 12 nt, Pseudomonas putida KT2440
ggcugagcccgg

SEQ ID NO: 3600210 - RNA, 13 nt, Pseudomonas putida KT2440
ggcugagcccggc

SEQ ID NO: 3600211 - RNA, 12 nt, Pseudomonas putida KT2440
ggcugagccggc

SEQ ID NO: 3600212 - RNA, 13 nt, Pseudomonas putida KT2440
ggcugagccggcu

SEQ ID NO: 3600213 - RNA, 21 nt, Pseudomonas putida KT2440
ggcugaggaaguuguccgggu

SEQ ID NO: 3600214 - RNA, 13 nt, Pseudomonas putida KT2440
ggcugaucaccgc

SEQ ID NO: 3600215 - RNA, 22 nt, Pseudomonas putida KT2440
ggcugaucagcaugucccgggu

SEQ ID NO: 3600216 - RNA, 23 nt, Pseudomonas putida KT2440
ggcugaucucacggccauccugc

SEQ ID NO: 3600217 - RNA, 17 nt, Pseudomonas putida KT2440
ggcugaugcgcuggccc

SEQ ID NO: 3600218 - RNA, 22 nt, Pseudomonas putida KT2440
ggcugaugcgcuggcccuugcc

SEQ ID NO: 3600219 - RNA, 21 nt, Pseudomonas putida KT2440
ggcugaugguggucggcagcu

SEQ ID NO: 3600220 - RNA, 19 nt, Pseudomonas putida KT2440
ggcugauugagcagcuggg

SEQ ID NO: 3600221 - RNA, 21 nt, Pseudomonas putida KT2440
ggcugcaaagcagacccagaa

SEQ ID NO: 3600222 - RNA, 16 nt, Pseudomonas putida KT2440
ggcugcaaagcagccc

SEQ ID NO: 3600223 - RNA, 20 nt, Pseudomonas putida KT2440
ggcugcaaagcgggcaacug

SEQ ID NO: 3600224 - RNA, 23 nt, Pseudomonas putida KT2440
ggcugcaagguguuggucagggc

SEQ ID NO: 3600225 - RNA, 13 nt, Pseudomonas putida KT2440
ggcugcacugggc

SEQ ID NO: 3600226 - RNA, 16 nt, Pseudomonas putida KT2440
ggcugcacuucgauac

SEQ ID NO: 3600227 - RNA, 23 nt, Pseudomonas putida KT2440
ggcugcaggucggccagcucggc

SEQ ID NO: 3600228 - RNA, 20 nt, Pseudomonas putida KT2440
ggcugcaguagucgccaggc

SEQ ID NO: 3600229 - RNA, 18 nt, Pseudomonas putida KT2440
ggcugcauugcagcccca

SEQ ID NO: 3600230 - RNA, 21 nt, Pseudomonas putida KT2440
ggcugccaaaccgccccacca

SEQ ID NO: 3600231 - RNA, 16 nt, Pseudomonas putida KT2440
ggcugccaaucaaccc

SEQ ID NO: 3600232 - RNA, 17 nt, Pseudomonas putida KT2440
ggcugccagcgcgcugc

SEQ ID NO: 3600233 - RNA, 20 nt, Pseudomonas putida KT2440
ggcugccagcgcgcugcgca

SEQ ID NO: 3600234 - RNA, 20 nt, Pseudomonas putida KT2440
ggcugcccucgggcagccuu

SEQ ID NO: 3600235 - RNA, 21 nt, Pseudomonas putida KT2440
ggcugcccucgggcagccuuu

SEQ ID NO: 3600236 - RNA, 14 nt, Pseudomonas putida KT2440
ggcugcccugcaug

SEQ ID NO: 3600237 - RNA, 17 nt, Pseudomonas putida KT2440
ggcugccgccgaacaug

SEQ ID NO: 3600238 - RNA, 16 nt, Pseudomonas putida KT2440
ggcugccgcgcagccc

SEQ ID NO: 3600239 - RNA, 21 nt, Pseudomonas putida KT2440
ggcugccgcgcagcccaaaca

SEQ ID NO: 3600240 - RNA, 22 nt, Pseudomonas putida KT2440
ggcugccguccccaaccggguu

SEQ ID NO: 3600241 - RNA, 15 nt, Pseudomonas putida KT2440
ggcugccuacccagg

SEQ ID NO: 3600242 - RNA, 17 nt, Pseudomonas putida KT2440
ggcugccuucgcucagg

SEQ ID NO: 3600243 - RNA, 21 nt, Pseudomonas putida KT2440
ggcugccuucgcucaggugca

SEQ ID NO: 3600244 - RNA, 21 nt, Pseudomonas putida KT2440
ggcugcgauagaacuccacca

SEQ ID NO: 3600245 - RNA, 18 nt, Pseudomonas putida KT2440
ggcugcgcaucaggcugc

SEQ ID NO: 3600246 - RNA, 13 nt, Pseudomonas putida KT2440
ggcugcgccgauc

SEQ ID NO: 3600247 - RNA, 23 nt, Pseudomonas putida KT2440
ggcugcgccgaucaggaaggccu

SEQ ID NO: 3600248 - RNA, 12 nt, Pseudomonas putida KT2440
ggcugcgcgcca

SEQ ID NO: 3600249 - RNA, 17 nt, Pseudomonas putida KT2440
ggcugcgcuugagccuu

SEQ ID NO: 3600250 - RNA, 22 nt, Pseudomonas putida KT2440
ggcugcggcagguaggcccagc

SEQ ID NO: 3600251 - RNA, 19 nt, Pseudomonas putida KT2440
ggcugcgguagcgcagccu

SEQ ID NO: 3600252 - RNA, 18 nt, Pseudomonas putida KT2440
ggcugcgugccugcugcu

SEQ ID NO: 3600253 - RNA, 15 nt, Pseudomonas putida KT2440
ggcugcguugcgguc

SEQ ID NO: 3600254 - RNA, 21 nt, Pseudomonas putida KT2440
ggcugcguugcggucagcgcu

SEQ ID NO: 3600255 - RNA, 20 nt, Pseudomonas putida KT2440
ggcugcguuuaccggcaccg

SEQ ID NO: 3600256 - RNA, 22 nt, Pseudomonas putida KT2440
ggcugcguuuaccggcaccgcc

SEQ ID NO: 3600257 - RNA, 14 nt, Pseudomonas putida KT2440
ggcugcugccgccc

SEQ ID NO: 3600258 - RNA, 17 nt, Pseudomonas putida KT2440
ggcugcugccgccccaa

SEQ ID NO: 3600259 - RNA, 12 nt, Pseudomonas putida KT2440
ggcugcugcgca

SEQ ID NO: 3600260 - RNA, 16 nt, Pseudomonas putida KT2440
ggcugcugcgcagccc

SEQ ID NO: 3600261 - RNA, 21 nt, Pseudomonas putida KT2440
ggcugcugcgguuugcucuga

SEQ ID NO: 3600262 - RNA, 15 nt, Pseudomonas putida KT2440
ggcugcugugguuug

SEQ ID NO: 3600263 - RNA, 17 nt, Pseudomonas putida KT2440
ggcugcuuugcagccca

SEQ ID NO: 3600264 - RNA, 21 nt, Pseudomonas putida KT2440
ggcugcuuugcagcccauucg

SEQ ID NO: 3600265 - RNA, 18 nt, Pseudomonas putida KT2440
ggcuggacaagccaacca

SEQ ID NO: 3600266 - RNA, 14 nt, Pseudomonas putida KT2440
ggcuggcagcgggc

SEQ ID NO: 3600267 - RNA, 14 nt, Pseudomonas putida KT2440
ggcuggcagcuugc

SEQ ID NO: 3600268 - RNA, 21 nt, Pseudomonas putida KT2440
ggcuggcauaguccaggaagc

SEQ ID NO: 3600269 - RNA, 15 nt, Pseudomonas putida KT2440
ggcuggcaucgccuc

SEQ ID NO: 3600270 - RNA, 20 nt, Pseudomonas putida KT2440
ggcuggcauucaacgcccgc

SEQ ID NO: 3600271 - RNA, 21 nt, Pseudomonas putida KT2440
ggcuggccaccaugaacagca

SEQ ID NO: 3600272 - RNA, 11 nt, Pseudomonas putida KT2440
ggcuggccaga

SEQ ID NO: 3600273 - RNA, 12 nt, Pseudomonas putida KT2440
ggcuggccagac

SEQ ID NO: 3600274 - RNA, 14 nt, Pseudomonas putida KT2440
ggcuggccagcaag

SEQ ID NO: 3600275 - RNA, 21 nt, Pseudomonas putida KT2440
ggcuggccagcaagugccccu

SEQ ID NO: 3600276 - RNA, 13 nt, Pseudomonas putida KT2440
ggcuggcccugua

SEQ ID NO: 3600277 - RNA, 12 nt, Pseudomonas putida KT2440
ggcuggcgacgc

SEQ ID NO: 3600278 - RNA, 18 nt, Pseudomonas putida KT2440
ggcuggcgggguggccgg

SEQ ID NO: 3600279 - RNA, 20 nt, Pseudomonas putida KT2440
ggcuggcuuacaucaugccg

SEQ ID NO: 3600280 - RNA, 14 nt, Pseudomonas putida KT2440
ggcugggccccagg

SEQ ID NO: 3600281 - RNA, 17 nt, Pseudomonas putida KT2440
ggcugggccccaggcgg

SEQ ID NO: 3600282 - RNA, 19 nt, Pseudomonas putida KT2440
ggcugggccccaggcggug

SEQ ID NO: 3600283 - RNA, 16 nt, Pseudomonas putida KT2440
ggcugggucacccagg

SEQ ID NO: 3600284 - RNA, 20 nt, Pseudomonas putida KT2440
ggcugggucacccaggugag

SEQ ID NO: 3600285 - RNA, 22 nt, Pseudomonas putida KT2440
ggcugggucacccaggugagga

SEQ ID NO: 3600286 - RNA, 16 nt, Pseudomonas putida KT2440
ggcuggucuccagcag

SEQ ID NO: 3600287 - RNA, 17 nt, Pseudomonas putida KT2440
ggcuggugaagcccuuc

SEQ ID NO: 3600288 - RNA, 22 nt, Pseudomonas putida KT2440
ggcuggugaagcccuucgaugc

SEQ ID NO: 3600289 - RNA, 14 nt, Pseudomonas putida KT2440
ggcuggugaaggca

SEQ ID NO: 3600290 - RNA, 20 nt, Pseudomonas putida KT2440
ggcuggugaaggcaggucag

SEQ ID NO: 3600291 - RNA, 21 nt, Pseudomonas putida KT2440
ggcuggugaaggcaggucagc

SEQ ID NO: 3600292 - RNA, 19 nt, Pseudomonas putida KT2440
ggcuggugacaacgcccgc

SEQ ID NO: 3600293 - RNA, 19 nt, Pseudomonas putida KT2440
ggcugguuccugggaagcu

SEQ ID NO: 3600294 - RNA, 22 nt, Pseudomonas putida KT2440
ggcugguuccugggaagcugca

SEQ ID NO: 3600295 - RNA, 16 nt, Pseudomonas putida KT2440
ggcuguauagcccugc

SEQ ID NO: 3600296 - RNA, 12 nt, Pseudomonas putida KT2440
ggcugucacgau

SEQ ID NO: 3600297 - RNA, 15 nt, Pseudomonas putida KT2440
ggcugucacgaugau

SEQ ID NO: 3600298 - RNA, 17 nt, Pseudomonas putida KT2440
ggcuguccagcaagggc

SEQ ID NO: 3600299 - RNA, 22 nt, Pseudomonas putida KT2440
ggcugucgaacaggcugccgcg

SEQ ID NO: 3600300 - RNA, 14 nt, Pseudomonas putida KT2440
ggcugucgagcagg

SEQ ID NO: 3600301 - RNA, 22 nt, Pseudomonas putida KT2440
ggcugucggcgucggccaugcc

SEQ ID NO: 3600302 - RNA, 14 nt, Pseudomonas putida KT2440
ggcugucgugcuca

SEQ ID NO: 3600303 - RNA, 23 nt, Pseudomonas putida KT2440
ggcugugaacccccguaggagcg

SEQ ID NO: 3600304 - RNA, 15 nt, Pseudomonas putida KT2440
ggcugugccgaacca

SEQ ID NO: 3600305 - RNA, 16 nt, Pseudomonas putida KT2440
ggcugugguucaccgu

SEQ ID NO: 3600306 - RNA, 15 nt, Pseudomonas putida KT2440
ggcuguuccauuucc

SEQ ID NO: 3600307 - RNA, 18 nt, Pseudomonas putida KT2440
ggcuguuccauuucccua

SEQ ID NO: 3600308 - RNA, 17 nt, Pseudomonas putida KT2440
ggcuguuccucgccaug

SEQ ID NO: 3600309 - RNA, 21 nt, Pseudomonas putida KT2440
gggcaauagccacaauggcgc

SEQ ID NO: 3600310 - RNA, 18 nt, Pseudomonas putida KT2440
gggcaauggcgcgaacag

SEQ ID NO: 3600311 - RNA, 18 nt, Pseudomonas putida KT2440
gggcaauguucgcugcca

SEQ ID NO: 3600312 - RNA, 22 nt, Pseudomonas putida KT2440
gggcacaccuggugcgccuuuu

SEQ ID NO: 3600313 - RNA, 15 nt, Pseudomonas putida KT2440
gggcacaggcccagc

SEQ ID NO: 3600314 - RNA, 19 nt, Pseudomonas putida KT2440
gggcacaggccgcgcauga

SEQ ID NO: 3600315 - RNA, 16 nt, Pseudomonas putida KT2440
gggcacaucaccagca

SEQ ID NO: 3600316 - RNA, 17 nt, Pseudomonas putida KT2440
gggcaccggccaccagg

SEQ ID NO: 3600317 - RNA, 19 nt, Pseudomonas putida KT2440
gggcacgcccgcucccaca

SEQ ID NO: 3600318 - RNA, 22 nt, Pseudomonas putida KT2440
gggcacgcccgcucccacagga

SEQ ID NO: 3600319 - RNA, 14 nt, Pseudomonas putida KT2440
gggcacgggcagcg

SEQ ID NO: 3600320 - RNA, 13 nt, Pseudomonas putida KT2440
gggcacugcccgg

SEQ ID NO: 3600321 - RNA, 23 nt, Pseudomonas putida KT2440
gggcagaguaaccgcggcugacg

SEQ ID NO: 3600322 - RNA, 12 nt, Pseudomonas putida KT2440
gggcagaugagg

SEQ ID NO: 3600323 - RNA, 15 nt, Pseudomonas putida KT2440
gggcagccgucggcg

SEQ ID NO: 3600324 - RNA, 23 nt, Pseudomonas putida KT2440
gggcaggccaugcccgcccgggc

SEQ ID NO: 3600325 - RNA, 13 nt, Pseudomonas putida KT2440
gggcaggcccggc

SEQ ID NO: 3600326 - RNA, 15 nt, Pseudomonas putida KT2440
gggcaggcccggcag

SEQ ID NO: 3600327 - RNA, 14 nt, Pseudomonas putida KT2440
gggcaggucguuga

SEQ ID NO: 3600328 - RNA, 22 nt, Pseudomonas putida KT2440
gggcagugcaauaccagccugg

SEQ ID NO: 3600329 - RNA, 18 nt, Pseudomonas putida KT2440
gggcauaacgccccagca

SEQ ID NO: 3600330 - RNA, 17 nt, Pseudomonas putida KT2440
gggcauccagcuugcca

SEQ ID NO: 3600331 - RNA, 18 nt, Pseudomonas putida KT2440
gggcaucgaucacuacau

SEQ ID NO: 3600332 - RNA, 20 nt, Pseudomonas putida KT2440
gggcaucgaucccuggggcc

SEQ ID NO: 3600333 - RNA, 20 nt, Pseudomonas putida KT2440
gggcaugagccuggccggug

SEQ ID NO: 3600334 - RNA, 17 nt, Pseudomonas putida KT2440
gggcaugcccgcuccca

SEQ ID NO: 3600335 - RNA, 19 nt, Pseudomonas putida KT2440
gggcaugcccgcucccaca

SEQ ID NO: 3600336 - RNA, 15 nt, Pseudomonas putida KT2440
gggcauugcgcuggu

SEQ ID NO: 3600337 - RNA, 17 nt, Pseudomonas putida KT2440
gggcauuuuuugagcaa

SEQ ID NO: 3600338 - RNA, 15 nt, Pseudomonas putida KT2440
gggccaaguggcugg

SEQ ID NO: 3600339 - RNA, 20 nt, Pseudomonas putida KT2440
gggccagcacaaccacugca

SEQ ID NO: 3600340 - RNA, 12 nt, Pseudomonas putida KT2440
gggccagccgcg

SEQ ID NO: 3600341 - RNA, 19 nt, Pseudomonas putida KT2440
gggccagccgcgccagguc

SEQ ID NO: 3600342 - RNA, 21 nt, Pseudomonas putida KT2440
gggccagcggcuuuucuuuac

SEQ ID NO: 3600343 - RNA, 12 nt, Pseudomonas putida KT2440
gggccaggcccc

SEQ ID NO: 3600344 - RNA, 21 nt, Pseudomonas putida KT2440
gggccaggcuuuccagguccu

SEQ ID NO: 3600345 - RNA, 15 nt, Pseudomonas putida KT2440
gggccagguggccuu

SEQ ID NO: 3600346 - RNA, 15 nt, Pseudomonas putida KT2440
gggccaucaucugcu

SEQ ID NO: 3600347 - RNA, 17 nt, Pseudomonas putida KT2440
gggccaugcccaccgca

SEQ ID NO: 3600348 - RNA, 22 nt, Pseudomonas putida KT2440
gggcccagcaggugcccaagcg

SEQ ID NO: 3600349 - RNA, 14 nt, Pseudomonas putida KT2440
gggccccaccaggc

SEQ ID NO: 3600350 - RNA, 17 nt, Pseudomonas putida KT2440
gggcccgcccagcuggc

SEQ ID NO: 3600351 - RNA, 23 nt, Pseudomonas putida KT2440
gggcccggacaggggaugcgcga

SEQ ID NO: 3600352 - RNA, 14 nt, Pseudomonas putida KT2440
gggcccucaacccu

SEQ ID NO: 3600353 - RNA, 13 nt, Pseudomonas putida KT2440
gggcccuguggga

SEQ ID NO: 3600354 - RNA, 17 nt, Pseudomonas putida KT2440
gggccgaaaggugcagc

SEQ ID NO: 3600355 - RNA, 20 nt, Pseudomonas putida KT2440
gggccgcaaagcggccccag

SEQ ID NO: 3600356 - RNA, 20 nt, Pseudomonas putida KT2440
gggccgcaaagcggccccuu

SEQ ID NO: 3600357 - RNA, 13 nt, Pseudomonas putida KT2440
gggccgccuugcg

SEQ ID NO: 3600358 - RNA, 20 nt, Pseudomonas putida KT2440
gggccgcgacgcggccccag

SEQ ID NO: 3600359 - RNA, 20 nt, Pseudomonas putida KT2440
gggccgcgcagcggccccuu

SEQ ID NO: 3600360 - RNA, 12 nt, Pseudomonas putida KT2440
gggccgcgcagg

SEQ ID NO: 3600361 - RNA, 15 nt, Pseudomonas putida KT2440
gggccgcgcaggcgg

SEQ ID NO: 3600362 - RNA, 20 nt, Pseudomonas putida KT2440
gggccgcgcuuggcggcccu

SEQ ID NO: 3600363 - RNA, 20 nt, Pseudomonas putida KT2440
gggccgcgucgcggccccag

SEQ ID NO: 3600364 - RNA, 18 nt, Pseudomonas putida KT2440
gggccgcguugcggcccu

SEQ ID NO: 3600365 - RNA, 20 nt, Pseudomonas putida KT2440
gggccgcucugcggcccauu

SEQ ID NO: 3600366 - RNA, 14 nt, Pseudomonas putida KT2440
gggccgcuucgcga

SEQ ID NO: 3600367 - RNA, 15 nt, Pseudomonas putida KT2440
gggccgcuucgcgac

SEQ ID NO: 3600368 - RNA, 17 nt, Pseudomonas putida KT2440
gggccgcuugcucaggc

SEQ ID NO: 3600369 - RNA, 17 nt, Pseudomonas putida KT2440
gggccgcuuggcggccc

SEQ ID NO: 3600370 - RNA, 18 nt, Pseudomonas putida KT2440
gggccgcuuggcggcccu

SEQ ID NO: 3600371 - RNA, 20 nt, Pseudomonas putida KT2440
gggccgcuuggcggcccuau

SEQ ID NO: 3600372 - RNA, 14 nt, Pseudomonas putida KT2440
gggccggcacaggc

SEQ ID NO: 3600373 - RNA, 14 nt, Pseudomonas putida KT2440
gggccggcccugcu

SEQ ID NO: 3600374 - RNA, 13 nt, Pseudomonas putida KT2440
gggccggcccuuu

SEQ ID NO: 3600375 - RNA, 16 nt, Pseudomonas putida KT2440
gggccggcgcccugca

SEQ ID NO: 3600376 - RNA, 22 nt, Pseudomonas putida KT2440
gggccgggcacgacacuccgcu

SEQ ID NO: 3600377 - RNA, 19 nt, Pseudomonas putida KT2440
gggccguaguggcgccgga

SEQ ID NO: 3600378 - RNA, 19 nt, Pseudomonas putida KT2440
gggccgucaccgcugccga

SEQ ID NO: 3600379 - RNA, 14 nt, Pseudomonas putida KT2440
gggccgugcaggcg

SEQ ID NO: 3600380 - RNA, 21 nt, Pseudomonas putida KT2440
gggccgugcaggcggcgacaa

SEQ ID NO: 3600381 - RNA, 19 nt, Pseudomonas putida KT2440
gggccguuacucccacagc

SEQ ID NO: 3600382 - RNA, 22 nt, Pseudomonas putida KT2440
gggccguuacucccacagcggc

SEQ ID NO: 3600383 - RNA, 22 nt, Pseudomonas putida KT2440
gggccuggacgcgugcaaggga

SEQ ID NO: 3600384 - RNA, 15 nt, Pseudomonas putida KT2440
gggccuggagcaagg

SEQ ID NO: 3600385 - RNA, 16 nt, Pseudomonas putida KT2440
gggccuggagcaaggc

SEQ ID NO: 3600386 - RNA, 12 nt, Pseudomonas putida KT2440
gggccugugccg

SEQ ID NO: 3600387 - RNA, 17 nt, Pseudomonas putida KT2440
gggccuucgcccgccgc

SEQ ID NO: 3600388 - RNA, 14 nt, Pseudomonas putida KT2440
gggccuugaccagc

SEQ ID NO: 3600389 - RNA, 16 nt, Pseudomonas putida KT2440
gggccuugaccagcaa

SEQ ID NO: 3600390 - RNA, 18 nt, Pseudomonas putida KT2440
gggccuugaucugcugcg

SEQ ID NO: 3600391 - RNA, 17 nt, Pseudomonas putida KT2440
gggccuuggccuggggc

SEQ ID NO: 3600392 - RNA, 21 nt, Pseudomonas putida KT2440
gggccuuguuauccaggcugg

SEQ ID NO: 3600393 - RNA, 21 nt, Pseudomonas putida KT2440
gggccuuuccgcacucaggug

SEQ ID NO: 3600394 - RNA, 17 nt, Pseudomonas putida KT2440
gggcgaagucccgacag

SEQ ID NO: 3600395 - RNA, 21 nt, Pseudomonas putida KT2440
gggcgaauucgagcuggucau

SEQ ID NO: 3600396 - RNA, 13 nt, Pseudomonas putida KT2440
gggcgacaccggu

SEQ ID NO: 3600397 - RNA, 23 nt, Pseudomonas putida KT2440
gggcgaccgaagucgcccuuugu

SEQ ID NO: 3600398 - RNA, 16 nt, Pseudomonas putida KT2440
gggcgagcgcgcaggc

SEQ ID NO: 3600399 - RNA, 21 nt, Pseudomonas putida KT2440
gggcgaggacagcaucucggu

SEQ ID NO: 3600400 - RNA, 17 nt, Pseudomonas putida KT2440
gggcgaucuccugcagg

SEQ ID NO: 3600401 - RNA, 21 nt, Pseudomonas putida KT2440
gggcgaugaucgccuggccgg

SEQ ID NO: 3600402 - RNA, 23 nt, Pseudomonas putida KT2440
gggcgaugcccuucaggccccag

SEQ ID NO: 3600403 - RNA, 19 nt, Pseudomonas putida KT2440
gggcgcagagcgccccggc

SEQ ID NO: 3600404 - RNA, 22 nt, Pseudomonas putida KT2440
gggcgcauuuuucgaggcaaaa

SEQ ID NO: 3600405 - RNA, 16 nt, Pseudomonas putida KT2440
gggcgcgcccgcgaag

SEQ ID NO: 3600406 - RNA, 18 nt, Pseudomonas putida KT2440
gggcgcguguagcccgcu

SEQ ID NO: 3600407 - RNA, 14 nt, Pseudomonas putida KT2440
gggcgcuaccgagg

SEQ ID NO: 3600408 - RNA, 22 nt, Pseudomonas putida KT2440
gggcgcuaccgaggucugcgcg

SEQ ID NO: 3600409 - RNA, 13 nt, Pseudomonas putida KT2440
gggcgcuccagca

SEQ ID NO: 3600410 - RNA, 19 nt, Pseudomonas putida KT2440
gggcgcugaucaagcccgc

SEQ ID NO: 3600411 - RNA, 20 nt, Pseudomonas putida KT2440
gggcgcuggaagugcugaga

SEQ ID NO: 3600412 - RNA, 22 nt, Pseudomonas putida KT2440
gggcgcuggaagugcugagagg

SEQ ID NO: 3600413 - RNA, 12 nt, Pseudomonas putida KT2440
gggcgcugucgg

SEQ ID NO: 3600414 - RNA, 12 nt, Pseudomonas putida KT2440
ggggugcucugc

SEQ ID NO: 3600415 - RNA, 16 nt, Pseudomonas putida KT2440
ggggugcugagcuuga

SEQ ID NO: 3600416 - RNA, 16 nt, Pseudomonas putida KT2440
ggguaaacccauuccu

SEQ ID NO: 3600417 - RNA, 14 nt, Pseudomonas putida KT2440
ggguaaacccgcgc

SEQ ID NO: 3600418 - RNA, 20 nt, Pseudomonas putida KT2440
ggguaaacccgcgccuacaa

SEQ ID NO: 3600419 - RNA, 20 nt, Pseudomonas putida KT2440
ggguaaacccgcgccuacga

SEQ ID NO: 3600420 - RNA, 20 nt, Pseudomonas putida KT2440
ggguaaacccgcucccacaa

SEQ ID NO: 3600421 - RNA, 20 nt, Pseudomonas putida KT2440
ggguaaacccgcuccuacac

SEQ ID NO: 3600422 - RNA, 19 nt, Pseudomonas putida KT2440
ggguaaacccgcuccuacg

SEQ ID NO: 3600423 - RNA, 21 nt, Pseudomonas putida KT2440
ggguaaacccgcuccuacgac

SEQ ID NO: 3600424 - RNA, 20 nt, Pseudomonas putida KT2440
ggguaaacccgcuccuacgc

SEQ ID NO: 3600425 - RNA, 20 nt, Pseudomonas putida KT2440
ggguaaacccgcuccuacua

SEQ ID NO: 3600426 - RNA, 21 nt, Pseudomonas putida KT2440
ggguaaacccgcuccuacuac

SEQ ID NO: 3600427 - RNA, 13 nt, Pseudomonas putida KT2440
ggguaagccaugc

SEQ ID NO: 3600428 - RNA, 12 nt, Pseudomonas putida KT2440
ggguaagccggc

SEQ ID NO: 3600429 - RNA, 15 nt, Pseudomonas putida KT2440
ggguaaucgccaggc

SEQ ID NO: 3600430 - RNA, 21 nt, Pseudomonas putida KT2440
ggguaaucgccaggcccagcc

SEQ ID NO: 3600431 - RNA, 20 nt, Pseudomonas putida KT2440
ggguaaugccccagccgaac

SEQ ID NO: 3600432 - RNA, 15 nt, Pseudomonas putida KT2440
ggguacagucuccua

SEQ ID NO: 3600433 - RNA, 18 nt, Pseudomonas putida KT2440
ggguaccgccguccacca

SEQ ID NO: 3600434 - RNA, 13 nt, Pseudomonas putida KT2440
ggguacuccacca

SEQ ID NO: 3600435 - RNA, 22 nt, Pseudomonas putida KT2440
ggguacuucucgaccagcgcca

SEQ ID NO: 3600436 - RNA, 17 nt, Pseudomonas putida KT2440
ggguagccccgaggaag

SEQ ID NO: 3600437 - RNA, 14 nt, Pseudomonas putida KT2440
ggguaguccuccaa

SEQ ID NO: 3600438 - RNA, 14 nt, Pseudomonas putida KT2440
ggguauagccaugc

SEQ ID NO: 3600439 - RNA, 13 nt, Pseudomonas putida KT2440
ggguaucgaauag

SEQ ID NO: 3600440 - RNA, 21 nt, Pseudomonas putida KT2440
ggguauugucggucagguagc

SEQ ID NO: 3600441 - RNA, 17 nt, Pseudomonas putida KT2440
gggucaaggccagcgcc

SEQ ID NO: 3600442 - RNA, 19 nt, Pseudomonas putida KT2440
gggucacggucaguaccug

SEQ ID NO: 3600443 - RNA, 23 nt, Pseudomonas putida KT2440
gggucacucccgggaucaccgca

SEQ ID NO: 3600444 - RNA, 20 nt, Pseudomonas putida KT2440
gggucagcgcugacucagcg

SEQ ID NO: 3600445 - RNA, 15 nt, Pseudomonas putida KT2440
gggucaggaugccgu

SEQ ID NO: 3600446 - RNA, 17 nt, Pseudomonas putida KT2440
gggucaguucagccagg

SEQ ID NO: 3600447 - RNA, 17 nt, Pseudomonas putida KT2440
gggucauccggccgacu

SEQ ID NO: 3600448 - RNA, 22 nt, Pseudomonas putida KT2440
gggucaugucggcagccagggu

SEQ ID NO: 3600449 - RNA, 22 nt, Pseudomonas putida KT2440
gggucauugcugaucccugccc

SEQ ID NO: 3600450 - RNA, 18 nt, Pseudomonas putida KT2440
ggguccagcgcggccacg

SEQ ID NO: 3600451 - RNA, 21 nt, Pseudomonas putida KT2440
ggguccaggauacccaucucg

SEQ ID NO: 3600452 - RNA, 16 nt, Pseudomonas putida KT2440
ggguccugcgccaggc

SEQ ID NO: 3600453 - RNA, 18 nt, Pseudomonas putida KT2440
gggucgaccugggccagg

SEQ ID NO: 3600454 - RNA, 13 nt, Pseudomonas putida KT2440
gggucgacgcgca

SEQ ID NO: 3600455 - RNA, 19 nt, Pseudomonas putida KT2440
gggucgacgcgcaagcuga

SEQ ID NO: 3600456 - RNA, 13 nt, Pseudomonas putida KT2440
gggucgagccagg

SEQ ID NO: 3600457 - RNA, 15 nt, Pseudomonas putida KT2440
gggucgagccaggcg

SEQ ID NO: 3600458 - RNA, 15 nt, Pseudomonas putida KT2440
gggucgcccgcaaca

SEQ ID NO: 3600459 - RNA, 13 nt, Pseudomonas putida KT2440
gggucggccugcu

SEQ ID NO: 3600460 - RNA, 15 nt, Pseudomonas putida KT2440
gggucggcgccaggc

SEQ ID NO: 3600461 - RNA, 16 nt, Pseudomonas putida KT2440
gggucggcgccaggcc

SEQ ID NO: 3600462 - RNA, 17 nt, Pseudomonas putida KT2440
gggucggcgggcggauc

SEQ ID NO: 3600463 - RNA, 13 nt, Pseudomonas putida KT2440
gggucugcccggc

SEQ ID NO: 3600464 - RNA, 19 nt, Pseudomonas putida KT2440
gggucugcccggccagcag

SEQ ID NO: 3600465 - RNA, 22 nt, Pseudomonas putida KT2440
gggucugcgcuucaagcaggua

SEQ ID NO: 3600466 - RNA, 19 nt, Pseudomonas putida KT2440
gggucugcuuugcagcccu

SEQ ID NO: 3600467 - RNA, 18 nt, Pseudomonas putida KT2440
gggucugguucuggucga

SEQ ID NO: 3600468 - RNA, 15 nt, Pseudomonas putida KT2440
gggucugugcagcga

SEQ ID NO: 3600469 - RNA, 17 nt, Pseudomonas putida KT2440
gggucuuccggcagggu

SEQ ID NO: 3600470 - RNA, 20 nt, Pseudomonas putida KT2440
gggugaacccgcuccuacca

SEQ ID NO: 3600471 - RNA, 20 nt, Pseudomonas putida KT2440
gggugaacccgcuccuaccg

SEQ ID NO: 3600472 - RNA, 19 nt, Pseudomonas putida KT2440
gggugaacccgcuccugca

SEQ ID NO: 3600473 - RNA, 14 nt, Pseudomonas putida KT2440
gggugacaaagcgg

SEQ ID NO: 3600474 - RNA, 14 nt, Pseudomonas putida KT2440
gggugaccaccagc

SEQ ID NO: 3600475 - RNA, 23 nt, Pseudomonas putida KT2440
gggugaccaggcccagcagguag

SEQ ID NO: 3600476 - RNA, 20 nt, Pseudomonas putida KT2440
gggugaucgccucgugcagc

SEQ ID NO: 3600477 - RNA, 13 nt, Pseudomonas putida KT2440
gggugaugcccgc

SEQ ID NO: 3600478 - RNA, 17 nt, Pseudomonas putida KT2440
gggugaugcgcuugcca

SEQ ID NO: 3600479 - RNA, 15 nt, Pseudomonas putida KT2440
gggugauugcaguca

SEQ ID NO: 3600480 - RNA, 19 nt, Pseudomonas putida KT2440
gggugcacacgucgccugg

SEQ ID NO: 3600481 - RNA, 12 nt, Pseudomonas putida KT2440
gggugcauggcu

SEQ ID NO: 3600482 - RNA, 14 nt, Pseudomonas putida KT2440
gggugccaucaggg

SEQ ID NO: 3600483 - RNA, 17 nt, Pseudomonas putida KT2440
gggugcuccaggccugc

SEQ ID NO: 3600484 - RNA, 13 nt, Pseudomonas putida KT2440
gggugcucugccg

SEQ ID NO: 3600485 - RNA, 19 nt, Pseudomonas putida KT2440
ggguggaaauuggccagca

SEQ ID NO: 3600486 - RNA, 22 nt, Pseudomonas putida KT2440
ggguggaaguuccugcucucgg

SEQ ID NO: 3600487 - RNA, 17 nt, Pseudomonas putida KT2440
ggguggcgcggugcggc

SEQ ID NO: 3600488 - RNA, 20 nt, Pseudomonas putida KT2440
ggguguauugccgccgggcc

SEQ ID NO: 3600489 - RNA, 13 nt, Pseudomonas putida KT2440
ggguguccugcaa

SEQ ID NO: 3600490 - RNA, 23 nt, Pseudomonas putida KT2440
gggugucgguggcggccagcgca

SEQ ID NO: 3600491 - RNA, 17 nt, Pseudomonas putida KT2440
ggguguuggcugugaga

SEQ ID NO: 3600492 - RNA, 18 nt, Pseudomonas putida KT2440
ggguguuuccaccccggc

SEQ ID NO: 3600493 - RNA, 21 nt, Pseudomonas putida KT2440
ggguuaccugcgcgagaaugc

SEQ ID NO: 3600494 - RNA, 15 nt, Pseudomonas putida KT2440
ggguucacagccggc

SEQ ID NO: 3600495 - RNA, 16 nt, Pseudomonas putida KT2440
ggguucacagccggca

SEQ ID NO: 3600496 - RNA, 13 nt, Pseudomonas putida KT2440
ggguucagcguca

SEQ ID NO: 3600497 - RNA, 12 nt, Pseudomonas putida KT2440
ggguuccagccg

SEQ ID NO: 3600498 - RNA, 18 nt, Pseudomonas putida KT2440
ggguucgccgucagccuu

SEQ ID NO: 3600499 - RNA, 20 nt, Pseudomonas putida KT2440
ggguugaccuuguccugccc

SEQ ID NO: 3600500 - RNA, 12 nt, Pseudomonas putida KT2440
ggguugacgcug

SEQ ID NO: 3600501 - RNA, 15 nt, Pseudomonas putida KT2440
ggguuggacccaggc

SEQ ID NO: 3600502 - RNA, 18 nt, Pseudomonas putida KT2440
ggguuuaccugcgaauac

SEQ ID NO: 3600503 - RNA, 18 nt, Pseudomonas putida KT2440
ggguuuaccugugaaugc

SEQ ID NO: 3600504 - RNA, 15 nt, Pseudomonas putida KT2440
ggguuucagugaccg

SEQ ID NO: 3600505 - RNA, 13 nt, Pseudomonas putida KT2440
ggguuugaagccc

SEQ ID NO: 3600506 - RNA, 23 nt, Pseudomonas putida KT2440
ggguuuucaaaaguuggcacgca

SEQ ID NO: 3600507 - RNA, 18 nt, Pseudomonas putida KT2440
ggguuuucucgcgaaugc

SEQ ID NO: 3600508 - RNA, 23 nt, Pseudomonas putida KT2440
gguaaacaauucccagccuuucu

SEQ ID NO: 3600509 - RNA, 17 nt, Pseudomonas putida KT2440
gguaaacccgcgccugc

SEQ ID NO: 3600510 - RNA, 18 nt, Pseudomonas putida KT2440
gguaaacccgcuccuaca

SEQ ID NO: 3600511 - RNA, 21 nt, Pseudomonas putida KT2440
gguaaacccgcuccuacaaug

SEQ ID NO: 3600512 - RNA, 20 nt, Pseudomonas putida KT2440
gguaaacccgcuccuacaug

SEQ ID NO: 3600513 - RNA, 21 nt, Pseudomonas putida KT2440
gguaaacccgggucaggcgca

SEQ ID NO: 3600514 - RNA, 21 nt, Pseudomonas putida KT2440
gguaaacgucggcagccaugc

SEQ ID NO: 3600515 - RNA, 17 nt, Pseudomonas putida KT2440
gguaaacguggucagcc

SEQ ID NO: 3600516 - RNA, 16 nt, Pseudomonas putida KT2440
gguaaaggucacaggu

SEQ ID NO: 3600517 - RNA, 17 nt, Pseudomonas putida KT2440
gguaaaggugcccugcu

SEQ ID NO: 3600518 - RNA, 19 nt, Pseudomonas putida KT2440
gguaacacggugaucgcau

SEQ ID NO: 3600519 - RNA, 18 nt, Pseudomonas putida KT2440
gguaacagggaaacaaau

SEQ ID NO: 3600520 - RNA, 18 nt, Pseudomonas putida KT2440
gguaaccugguucuucgc

SEQ ID NO: 3600521 - RNA, 20 nt, Pseudomonas putida KT2440
gguaacgggcaaggcuggca

SEQ ID NO: 3600522 - RNA, 18 nt, Pseudomonas putida KT2440
gguaacgguaauggccgg

SEQ ID NO: 3600523 - RNA, 17 nt, Pseudomonas putida KT2440
gguaacguuggccgggg

SEQ ID NO: 3600524 - RNA, 20 nt, Pseudomonas putida KT2440
gguaagccaugcgcaggcag

SEQ ID NO: 3600525 - RNA, 15 nt, Pseudomonas putida KT2440
gguaagccggcggcc

SEQ ID NO: 3600526 - RNA, 13 nt, Pseudomonas putida KT2440
gguaagucagcga

SEQ ID NO: 3600527 - RNA, 17 nt, Pseudomonas putida KT2440
gguaauaccacaucccc

SEQ ID NO: 3600528 - RNA, 15 nt, Pseudomonas putida KT2440
gguaauccaccagcc

SEQ ID NO: 3600529 - RNA, 17 nt, Pseudomonas putida KT2440
gguaauggccggcugug

SEQ ID NO: 3600530 - RNA, 19 nt, Pseudomonas putida KT2440
gguacaacaacaaaaaaaa

SEQ ID NO: 3600531 - RNA, 15 nt, Pseudomonas putida KT2440
gguacagauggcacc

SEQ ID NO: 3600532 - RNA, 14 nt, Pseudomonas putida KT2440
gguacagcacugca

SEQ ID NO: 3600533 - RNA, 15 nt, Pseudomonas putida KT2440
gguacagcagcugca

SEQ ID NO: 3600534 - RNA, 14 nt, Pseudomonas putida KT2440
gguacagcagcuug

SEQ ID NO: 3600535 - RNA, 20 nt, Pseudomonas putida KT2440
gguacagcucacuggccaac

SEQ ID NO: 3600536 - RNA, 22 nt, Pseudomonas putida KT2440
gguacagcucacuggccaacuc

SEQ ID NO: 3600537 - RNA, 15 nt, Pseudomonas putida KT2440
gguacagggucagga

SEQ ID NO: 3600538 - RNA, 16 nt, Pseudomonas putida KT2440
gguacccgccagcaau

SEQ ID NO: 3600539 - RNA, 20 nt, Pseudomonas putida KT2440
gguacccgcguuggcagcac

SEQ ID NO: 3600540 - RNA, 15 nt, Pseudomonas putida KT2440
gguaccgccguccac

SEQ ID NO: 3600541 - RNA, 19 nt, Pseudomonas putida KT2440
gguaccggccagcugcgca

SEQ ID NO: 3600542 - RNA, 19 nt, Pseudomonas putida KT2440
gguaccgucgaucagcuuc

SEQ ID NO: 3600543 - RNA, 12 nt, Pseudomonas putida KT2440
gguaccgugcug

SEQ ID NO: 3600544 - RNA, 22 nt, Pseudomonas putida KT2440
gguaccgugcugcaggcuggca

SEQ ID NO: 3600545 - RNA, 15 nt, Pseudomonas putida KT2440
gguaccuguggggca

SEQ ID NO: 3600546 - RNA, 21 nt, Pseudomonas putida KT2440
gguaccuguggggcaacugcg

SEQ ID NO: 3600547 - RNA, 14 nt, Pseudomonas putida KT2440
gguacgagucagcg

SEQ ID NO: 3600548 - RNA, 16 nt, Pseudomonas putida KT2440
gguacgcacuguagcg

SEQ ID NO: 3600549 - RNA, 22 nt, Pseudomonas putida KT2440
gguacgcagaaugugcucggcc

SEQ ID NO: 3600550 - RNA, 15 nt, Pseudomonas putida KT2440
gguacgcgcaggcag

SEQ ID NO: 3600551 - RNA, 21 nt, Pseudomonas putida KT2440
gguacggguucaagggcaggg

SEQ ID NO: 3600552 - RNA, 21 nt, Pseudomonas putida KT2440
gguacucugucacccgcugca

SEQ ID NO: 3600553 - RNA, 21 nt, Pseudomonas putida KT2440
gguacugcuucaugaagucag

SEQ ID NO: 3600554 - RNA, 16 nt, Pseudomonas putida KT2440
gguagaacaagucgcg

SEQ ID NO: 3600555 - RNA, 13 nt, Pseudomonas putida KT2440
gguagacuucugc

SEQ ID NO: 3600556 - RNA, 20 nt, Pseudomonas putida KT2440
gguagaucacaccggccgcc

SEQ ID NO: 3600557 - RNA, 22 nt, Pseudomonas putida KT2440
gguagaucugcucuucgccgcc

SEQ ID NO: 3600558 - RNA, 23 nt, Pseudomonas putida KT2440
gguagccacgugaauaugcucuu

SEQ ID NO: 3600559 - RNA, 14 nt, Pseudomonas putida KT2440
gguagccguggcug

SEQ ID NO: 3600560 - RNA, 17 nt, Pseudomonas putida KT2440
gguagccucgacccgcu

SEQ ID NO: 3600561 - RNA, 18 nt, Pseudomonas putida KT2440
gguagcgcccgggcauca

SEQ ID NO: 3600562 - RNA, 14 nt, Pseudomonas putida KT2440
gguagcggcagcaa

SEQ ID NO: 3600563 - RNA, 17 nt, Pseudomonas putida KT2440
gguagcggccagcccgc

SEQ ID NO: 3600564 - RNA, 17 nt, Pseudomonas putida KT2440
gguagcggcugggcgcg

SEQ ID NO: 3600565 - RNA, 12 nt, Pseudomonas putida KT2440
gguagcggggcc

SEQ ID NO: 3600566 - RNA, 20 nt, Pseudomonas putida KT2440
gguagcucgcuuuccaaacc

SEQ ID NO: 3600567 - RNA, 21 nt, Pseudomonas putida KT2440
gguagcugggcccgcccagcu

SEQ ID NO: 3600568 - RNA, 19 nt, Pseudomonas putida KT2440
gguagcugucggucagcca

SEQ ID NO: 3600569 - RNA, 20 nt, Pseudomonas putida KT2440
gguaggcaccccggccgcuu

SEQ ID NO: 3600570 - RNA, 16 nt, Pseudomonas putida KT2440
gguaggcacggucggu

SEQ ID NO: 3600571 - RNA, 15 nt, Pseudomonas putida KT2440
gguaggcccagccca

SEQ ID NO: 3600572 - RNA, 16 nt, Pseudomonas putida KT2440
gguaggcccagcccag

SEQ ID NO: 3600573 - RNA, 17 nt, Pseudomonas putida KT2440
gguaggccgucagcagc

SEQ ID NO: 3600574 - RNA, 17 nt, Pseudomonas putida KT2440
gguaggccuugaccagc

SEQ ID NO: 3600575 - RNA, 15 nt, Pseudomonas putida KT2440
gguagggaaauccuc

SEQ ID NO: 3600576 - RNA, 16 nt, Pseudomonas putida KT2440
gguagggaaauccucg

SEQ ID NO: 3600577 - RNA, 17 nt, Pseudomonas putida KT2440
gguagggaaauccucgg

SEQ ID NO: 3600578 - RNA, 19 nt, Pseudomonas putida KT2440
gguaggucaccaucagccg

SEQ ID NO: 3600579 - RNA, 21 nt, Pseudomonas putida KT2440
gguaggucuaaccgcgcuggu

SEQ ID NO: 3600580 - RNA, 16 nt, Pseudomonas putida KT2440
gguaguccaugaugaa

SEQ ID NO: 3600581 - RNA, 16 nt, Pseudomonas putida KT2440
gguaguccggcacguu

SEQ ID NO: 3600582 - RNA, 13 nt, Pseudomonas putida KT2440
gguaguccuccaa

SEQ ID NO: 3600583 - RNA, 14 nt, Pseudomonas putida KT2440
gguaguccuugccg

SEQ ID NO: 3600584 - RNA, 21 nt, Pseudomonas putida KT2440
gguagucgcucaggcggcgca

SEQ ID NO: 3600585 - RNA, 13 nt, Pseudomonas putida KT2440
gguaguggcggca

SEQ ID NO: 3600586 - RNA, 21 nt, Pseudomonas putida KT2440
gguaguucacuggccagcagg

SEQ ID NO: 3600587 - RNA, 22 nt, Pseudomonas putida KT2440
gguaguucacuggccagcaggg

SEQ ID NO: 3600588 - RNA, 14 nt, Pseudomonas putida KT2440
gguaguuggccggg

SEQ ID NO: 3600589 - RNA, 21 nt, Pseudomonas putida KT2440
gguauaggccccgaaugcacg

SEQ ID NO: 3600590 - RNA, 17 nt, Pseudomonas putida KT2440
gguaucacgcuccugca

SEQ ID NO: 3600591 - RNA, 14 nt, Pseudomonas putida KT2440
gguaucgagcacuu

SEQ ID NO: 3600592 - RNA, 14 nt, Pseudomonas putida KT2440
gguaucgaucagga

SEQ ID NO: 3600593 - RNA, 23 nt, Pseudomonas putida KT2440
gguaucgaugcacagcucgcgcu

SEQ ID NO: 3600594 - RNA, 22 nt, Pseudomonas putida KT2440
gguaugcauggguuguggcuug

SEQ ID NO: 3600595 - RNA, 20 nt, Pseudomonas putida KT2440
gguauggcaggcugacccgc

SEQ ID NO: 3600596 - RNA, 16 nt, Pseudomonas putida KT2440
gguauucacaccugcc

SEQ ID NO: 3600597 - RNA, 21 nt, Pseudomonas putida KT2440
gguauucggguguccacaaac

SEQ ID NO: 3600598 - RNA, 17 nt, Pseudomonas putida KT2440
ggucaaaaaauccucaa

SEQ ID NO: 3600599 - RNA, 20 nt, Pseudomonas putida KT2440
ggucaaacguauccgccgca

SEQ ID NO: 3600600 - RNA, 21 nt, Pseudomonas putida KT2440
ggucaacggcaacgccagcaa

SEQ ID NO: 3600601 - RNA, 22 nt, Pseudomonas putida KT2440
ggucaagcucguccugcagggc

SEQ ID NO: 3600602 - RNA, 16 nt, Pseudomonas putida KT2440
ggucaaggccagcgcc

SEQ ID NO: 3600603 - RNA, 17 nt, Pseudomonas putida KT2440
ggucaaggccagcgccu

SEQ ID NO: 3600604 - RNA, 22 nt, Pseudomonas putida KT2440
ggucaaucagggauacugcuga

SEQ ID NO: 3600605 - RNA, 18 nt, Pseudomonas putida KT2440
ggucaccagcacgucacc

SEQ ID NO: 3600606 - RNA, 16 nt, Pseudomonas putida KT2440
ggucaccaucaagccc

SEQ ID NO: 3600607 - RNA, 21 nt, Pseudomonas putida KT2440
ggucacccgugcugcucgccu

SEQ ID NO: 3600608 - RNA, 17 nt, Pseudomonas putida KT2440
ggucacccugacgcugc

SEQ ID NO: 3600609 - RNA, 19 nt, Pseudomonas putida KT2440
ggucacccuggucacgcag

SEQ ID NO: 3600610 - RNA, 22 nt, Pseudomonas putida KT2440
ggucaccuuguccagcaggcca

SEQ ID NO: 3600611 - RNA, 15 nt, Pseudomonas putida KT2440
ggucacgccaucccc

SEQ ID NO: 3600612 - RNA, 15 nt, Pseudomonas putida KT2440
ggucacgcccaucag

SEQ ID NO: 3600613 - RNA, 19 nt, Pseudomonas putida KT2440
ggucacgcccaucaggaac

SEQ ID NO: 3600614 - RNA, 16 nt, Pseudomonas putida KT2440
ggucacgcucggccag

SEQ ID NO: 3600615 - RNA, 17 nt, Pseudomonas putida KT2440
ggucacgcucggccagu

SEQ ID NO: 3600616 - RNA, 13 nt, Pseudomonas putida KT2440
ggucacggcugaa

SEQ ID NO: 3600617 - RNA, 23 nt, Pseudomonas putida KT2440
ggucacucugccgccccuccacc

SEQ ID NO: 3600618 - RNA, 17 nt, Pseudomonas putida KT2440
ggucagcaagccgccga

SEQ ID NO: 3600619 - RNA, 15 nt, Pseudomonas putida KT2440
ggucagcaguggcuc

SEQ ID NO: 3600620 - RNA, 16 nt, Pseudomonas putida KT2440
ggucagcaucaccgcg

SEQ ID NO: 3600621 - RNA, 11 nt, Pseudomonas putida KT2440
ggucagcaucc

SEQ ID NO: 3600622 - RNA, 18 nt, Pseudomonas putida KT2440
ggucagcaucuucuuccc

SEQ ID NO: 3600623 - RNA, 19 nt, Pseudomonas putida KT2440
ggucagcauggccaguucc

SEQ ID NO: 3600624 - RNA, 15 nt, Pseudomonas putida KT2440
ggucucgaucagcga

SEQ ID NO: 3600625 - RNA, 12 nt, Pseudomonas putida KT2440
ggucucgcggcu

SEQ ID NO: 3600626 - RNA, 14 nt, Pseudomonas putida KT2440
ggucucguugcuuu

SEQ ID NO: 3600627 - RNA, 22 nt, Pseudomonas putida KT2440
ggucugcuccaguugcaagccu

SEQ ID NO: 3600628 - RNA, 14 nt, Pseudomonas putida KT2440
ggucugcugcggcc

SEQ ID NO: 3600629 - RNA, 15 nt, Pseudomonas putida KT2440
ggucugcugcggccg

SEQ ID NO: 3600630 - RNA, 18 nt, Pseudomonas putida KT2440
ggucuucaaaucgcugcg

SEQ ID NO: 3600631 - RNA, 15 nt, Pseudomonas putida KT2440
ggucuuccagcggug

SEQ ID NO: 3600632 - RNA, 17 nt, Pseudomonas putida KT2440
ggucuuccaggaucagc

SEQ ID NO: 3600633 - RNA, 18 nt, Pseudomonas putida KT2440
ggucuucucaggcaccag

SEQ ID NO: 3600634 - RNA, 20 nt, Pseudomonas putida KT2440
ggucuucucaggcaccagcg

SEQ ID NO: 3600635 - RNA, 13 nt, Pseudomonas putida KT2440
ggucuugccgaua

SEQ ID NO: 3600636 - RNA, 17 nt, Pseudomonas putida KT2440
ggucuugucugacagca

SEQ ID NO: 3600637 - RNA, 18 nt, Pseudomonas putida KT2440
ggucuuuucgccacuggc

SEQ ID NO: 3600638 - RNA, 18 nt, Pseudomonas putida KT2440
ggucuuuuggcucaggug

SEQ ID NO: 3600639 - RNA, 23 nt, Pseudomonas putida KT2440
ggugaaacccucuggguagccac

SEQ ID NO: 3600640 - RNA, 22 nt, Pseudomonas putida KT2440
ggugaaagcgcaaucaaagcag

SEQ ID NO: 3600641 - RNA, 13 nt, Pseudomonas putida KT2440
ggugaacccgcuc

SEQ ID NO: 3600642 - RNA, 18 nt, Pseudomonas putida KT2440
ggugaacccgcuccugca

SEQ ID NO: 3600643 - RNA, 14 nt, Pseudomonas putida KT2440
ggugaagaucgccg

SEQ ID NO: 3600644 - RNA, 14 nt, Pseudomonas putida KT2440
ggugaagcccugcu

SEQ ID NO: 3600645 - RNA, 17 nt, Pseudomonas putida KT2440
ggugaaggcaggucagc

SEQ ID NO: 3600646 - RNA, 18 nt, Pseudomonas putida KT2440
ggugaaucagcggcaggc

SEQ ID NO: 3600647 - RNA, 17 nt, Pseudomonas putida KT2440
ggugaauggcgagcccg

SEQ ID NO: 3600648 - RNA, 14 nt, Pseudomonas putida KT2440
ggugaccaccagca

SEQ ID NO: 3600649 - RNA, 16 nt, Pseudomonas putida KT2440
ggugaccagcggcagc

SEQ ID NO: 3600650 - RNA, 16 nt, Pseudomonas putida KT2440
ggugaccuuuucuaag

SEQ ID NO: 3600651 - RNA, 20 nt, Pseudomonas putida KT2440
ggugacgggcccaaggugca

SEQ ID NO: 3600652 - RNA, 15 nt, Pseudomonas putida KT2440
ggugagcaugccgau

SEQ ID NO: 3600653 - RNA, 16 nt, Pseudomonas putida KT2440
ggugagcgaaucccgc

SEQ ID NO: 3600654 - RNA, 12 nt, Pseudomonas putida KT2440
ggugagcgcgau

SEQ ID NO: 3600655 - RNA, 20 nt, Pseudomonas putida KT2440
ggugauaccgaggaggaggc

SEQ ID NO: 3600656 - RNA, 22 nt, Pseudomonas putida KT2440
ggugaucgccucgugcagcugc

SEQ ID NO: 3600657 - RNA, 17 nt, Pseudomonas putida KT2440
ggugaugaucagggaca

SEQ ID NO: 3600658 - RNA, 21 nt, Pseudomonas putida KT2440
ggugaugcgcuugccagcgug

SEQ ID NO: 3600659 - RNA, 15 nt, Pseudomonas putida KT2440
ggugaugcggcccuu

SEQ ID NO: 3600660 - RNA, 21 nt, Pseudomonas putida KT2440
ggugaugguugaagaugcgcg

SEQ ID NO: 3600661 - RNA, 22 nt, Pseudomonas putida KT2440
ggugauugaaggcauugcggcc

SEQ ID NO: 3600662 - RNA, 19 nt, Pseudomonas putida KT2440
ggugcacagggcggccaag

SEQ ID NO: 3600663 - RNA, 18 nt, Pseudomonas putida KT2440
ggugcaccaacacuucca

SEQ ID NO: 3600664 - RNA, 23 nt, Pseudomonas putida KT2440
ggugcacggccguuggccagcau

SEQ ID NO: 3600665 - RNA, 11 nt, Pseudomonas putida KT2440
ggugcagaacg

SEQ ID NO: 3600666 - RNA, 21 nt, Pseudomonas putida KT2440
ggugcagacgaucagguuugc

SEQ ID NO: 3600667 - RNA, 14 nt, Pseudomonas putida KT2440
ggugcagauccagg

SEQ ID NO: 3600668 - RNA, 18 nt, Pseudomonas putida KT2440
ggugcagcaacagguaca

SEQ ID NO: 3600669 - RNA, 13 nt, Pseudomonas putida KT2440
ggugcagcggcag

SEQ ID NO: 3600670 - RNA, 15 nt, Pseudomonas putida KT2440
ggugcagcgggaugu

SEQ ID NO: 3600671 - RNA, 21 nt, Pseudomonas putida KT2440
ggugcagcugaugagguuugc

SEQ ID NO: 3600672 - RNA, 23 nt, Pseudomonas putida KT2440
ggugcagguugauccagcccuuc

SEQ ID NO: 3600673 - RNA, 17 nt, Pseudomonas putida KT2440
ggugcauccaacgcugc

SEQ ID NO: 3600674 - RNA, 23 nt, Pseudomonas putida KT2440
ggugcaucgucacauccugcucg

SEQ ID NO: 3600675 - RNA, 22 nt, Pseudomonas putida KT2440
ggugcaugcaagcagccacccu

SEQ ID NO: 3600676 - RNA, 21 nt, Pseudomonas putida KT2440
ggugcauucugccaugauccg

SEQ ID NO: 3600677 - RNA, 16 nt, Pseudomonas putida KT2440
ggugccaacaggcagc

SEQ ID NO: 3600678 - RNA, 23 nt, Pseudomonas putida KT2440
ggugccaauaaccggcacaagcg

SEQ ID NO: 3600679 - RNA, 14 nt, Pseudomonas putida KT2440
ggugccaccgaugg

SEQ ID NO: 3600680 - RNA, 15 nt, Pseudomonas putida KT2440
ggugccaggcucagg

SEQ ID NO: 3600681 - RNA, 15 nt, Pseudomonas putida KT2440
ggugccauagcacca

SEQ ID NO: 3600682 - RNA, 18 nt, Pseudomonas putida KT2440
ggugccauagcaccagcg

SEQ ID NO: 3600683 - RNA, 13 nt, Pseudomonas putida KT2440
ggugccaucaccg

SEQ ID NO: 3600684 - RNA, 18 nt, Pseudomonas putida KT2440
ggugccaucaccgcccgc

SEQ ID NO: 3600685 - RNA, 18 nt, Pseudomonas putida KT2440
ggugccauccaccgcgcc

SEQ ID NO: 3600686 - RNA, 13 nt, Pseudomonas putida KT2440
ggugcccaagcgg

SEQ ID NO: 3600687 - RNA, 13 nt, Pseudomonas putida KT2440
ggugcccacugca

SEQ ID NO: 3600688 - RNA, 19 nt, Pseudomonas putida KT2440
ggugccccgguccagcaca

SEQ ID NO: 3600689 - RNA, 13 nt, Pseudomonas putida KT2440
ggugccgaacagc

SEQ ID NO: 3600690 - RNA, 11 nt, Pseudomonas putida KT2440
ggugccggccu

SEQ ID NO: 3600691 - RNA, 20 nt, Pseudomonas putida KT2440
ggugccguacauagcaggau

SEQ ID NO: 3600692 - RNA, 16 nt, Pseudomonas putida KT2440
ggugccgugcaggggc

SEQ ID NO: 3600693 - RNA, 19 nt, Pseudomonas putida KT2440
ggugccguuggacgccgca

SEQ ID NO: 3600694 - RNA, 23 nt, Pseudomonas putida KT2440
ggugccuaucgcucuggcacuca

SEQ ID NO: 3600695 - RNA, 18 nt, Pseudomonas putida KT2440
ggugccugcagcccggca

SEQ ID NO: 3600696 - RNA, 16 nt, Pseudomonas putida KT2440
ggugcgagaggcgcuu

SEQ ID NO: 3600697 - RNA, 17 nt, Pseudomonas putida KT2440
ggugcgccuccagcagc

SEQ ID NO: 3600698 - RNA, 17 nt, Pseudomonas putida KT2440
ggugcgcggccgucaug

SEQ ID NO: 3600699 - RNA, 23 nt, Pseudomonas putida KT2440
ggugcgcucguaggcugcagcga

SEQ ID NO: 3600700 - RNA, 20 nt, Pseudomonas putida KT2440
ggugcggcuuuagccgugaa

SEQ ID NO: 3600701 - RNA, 16 nt, Pseudomonas putida KT2440
ggugcguacucgacca

SEQ ID NO: 3600702 - RNA, 15 nt, Pseudomonas putida KT2440
ggugcucagcggcac

SEQ ID NO: 3600703 - RNA, 20 nt, Pseudomonas putida KT2440
ggugcuccaggccugcggca

SEQ ID NO: 3600704 - RNA, 19 nt, Pseudomonas putida KT2440
ggugcucugccgcaccagg

SEQ ID NO: 3600705 - RNA, 14 nt, Pseudomonas putida KT2440
ggugcugcagaccc

SEQ ID NO: 3600706 - RNA, 16 nt, Pseudomonas putida KT2440
ggugcugcagacccgc

SEQ ID NO: 3600707 - RNA, 19 nt, Pseudomonas putida KT2440
ggugcugccgaggcgccga

SEQ ID NO: 3600708 - RNA, 13 nt, Pseudomonas putida KT2440
ggugcugcgagua

SEQ ID NO: 3600709 - RNA, 16 nt, Pseudomonas putida KT2440
ggugcuggcucgcugc

SEQ ID NO: 3600710 - RNA, 14 nt, Pseudomonas putida KT2440
ggugcugggcauga

SEQ ID NO: 3600711 - RNA, 18 nt, Pseudomonas putida KT2440
gguggaaauuggccagca

SEQ ID NO: 3600712 - RNA, 18 nt, Pseudomonas putida KT2440
gguggaacaggauggcaa

SEQ ID NO: 3600713 - RNA, 17 nt, Pseudomonas putida KT2440
gguggauggcaccggcu

SEQ ID NO: 3600714 - RNA, 23 nt, Pseudomonas putida KT2440
gguggauguugaugccacgggca

SEQ ID NO: 3600715 - RNA, 14 nt, Pseudomonas putida KT2440
gguggcaaugccau

SEQ ID NO: 3600716 - RNA, 19 nt, Pseudomonas putida KT2440
gguggcaauggccugcaug

SEQ ID NO: 3600717 - RNA, 16 nt, Pseudomonas putida KT2440
gguggcaccggcaccg

SEQ ID NO: 3600718 - RNA, 15 nt, Pseudomonas putida KT2440
gguggcagaacaucg

SEQ ID NO: 3600719 - RNA, 14 nt, Pseudomonas putida KT2440
gguggcaugcucca

SEQ ID NO: 3600720 - RNA, 19 nt, Pseudomonas putida KT2440
gguggcauuggcgugcucg

SEQ ID NO: 3600721 - RNA, 15 nt, Pseudomonas putida KT2440
gguggcccugaccgc

SEQ ID NO: 3600722 - RNA, 21 nt, Pseudomonas putida KT2440
gguggcccugaccgcggugcu

SEQ ID NO: 3600723 - RNA, 20 nt, Pseudomonas putida KT2440
gguggccuugcccgaagcca

SEQ ID NO: 3600724 - RNA, 21 nt, Pseudomonas putida KT2440
gguggcgauccacagcggguc

SEQ ID NO: 3600725 - RNA, 19 nt, Pseudomonas putida KT2440
gguggcgcugaccaacagg

SEQ ID NO: 3600726 - RNA, 14 nt, Pseudomonas putida KT2440
gguggcggccagcg

SEQ ID NO: 3600727 - RNA, 14 nt, Pseudomonas putida KT2440
gguggcguccacga

SEQ ID NO: 3600728 - RNA, 22 nt, Pseudomonas putida KT2440
gguggcucugcuugagcgcagc

SEQ ID NO: 3600729 - RNA, 18 nt, Pseudomonas putida KT2440
gguuuuuugccugaucag

SEQ ID NO: 3600730 - RNA, 16 nt, Pseudomonas putida KT2440
guaaaaacuggccagc

SEQ ID NO: 3600731 - RNA, 16 nt, Pseudomonas putida KT2440
guaaaaaucaugcagu

SEQ ID NO: 3600732 - RNA, 17 nt, Pseudomonas putida KT2440
guaaaaaucaugcaguu

SEQ ID NO: 3600733 - RNA, 14 nt, Pseudomonas putida KT2440
guaaaacagccuug

SEQ ID NO: 3600734 - RNA, 23 nt, Pseudomonas putida KT2440
guaaacaaagccccggcagcgau

SEQ ID NO: 3600735 - RNA, 19 nt, Pseudomonas putida KT2440
guaaacccauuccuacaga

SEQ ID NO: 3600736 - RNA, 19 nt, Pseudomonas putida KT2440
guaaacccgcuccuacaag

SEQ ID NO: 3600737 - RNA, 16 nt, Pseudomonas putida KT2440
guaaacguggucagcc

SEQ ID NO: 3600738 - RNA, 17 nt, Pseudomonas putida KT2440
guaaagaaaagccgcug

SEQ ID NO: 3600739 - RNA, 21 nt, Pseudomonas putida KT2440
guaaagaaaagccgcuggccc

SEQ ID NO: 3600740 - RNA, 20 nt, Pseudomonas putida KT2440
guaaagaacaugaucaagcu

SEQ ID NO: 3600741 - RNA, 17 nt, Pseudomonas putida KT2440
guaaagcacacaacugu

SEQ ID NO: 3600742 - RNA, 14 nt, Pseudomonas putida KT2440
guaaagccagcagc

SEQ ID NO: 3600743 - RNA, 16 nt, Pseudomonas putida KT2440
guaaagccgaucgacg

SEQ ID NO: 3600744 - RNA, 18 nt, Pseudomonas putida KT2440
guaacagggaaacaaauc

SEQ ID NO: 3600745 - RNA, 11 nt, Pseudomonas putida KT2440
guaacccugcu

SEQ ID NO: 3600746 - RNA, 16 nt, Pseudomonas putida KT2440
guaacccugcucgcca

SEQ ID NO: 3600747 - RNA, 21 nt, Pseudomonas putida KT2440
guaacccugcucgccaucgcc

SEQ ID NO: 3600748 - RNA, 16 nt, Pseudomonas putida KT2440
guaaccgcccgccaua

SEQ ID NO: 3600749 - RNA, 23 nt, Pseudomonas putida KT2440
guaaccgcugccauagcgcugca

SEQ ID NO: 3600750 - RNA, 19 nt, Pseudomonas putida KT2440
guaacggcucugacauaac

SEQ ID NO: 3600751 - RNA, 15 nt, Pseudomonas putida KT2440
guaacgggcaaggcu

SEQ ID NO: 3600752 - RNA, 22 nt, Pseudomonas putida KT2440
guaacgggcaaggcuggcaacc

SEQ ID NO: 3600753 - RNA, 22 nt, Pseudomonas putida KT2440
guaacggucacugagccaggcc

SEQ ID NO: 3600754 - RNA, 15 nt, Pseudomonas putida KT2440
guaacucaccacauc

SEQ ID NO: 3600755 - RNA, 22 nt, Pseudomonas putida KT2440
guaagcccgcuccuacagggga

SEQ ID NO: 3600756 - RNA, 20 nt, Pseudomonas putida KT2440
guaagccggcggccaucgcu

SEQ ID NO: 3600757 - RNA, 13 nt, Pseudomonas putida KT2440
guaaggcuggucg

SEQ ID NO: 3600758 - RNA, 13 nt, Pseudomonas putida KT2440
guaagguaguaaa

SEQ ID NO: 3600759 - RNA, 15 nt, Pseudomonas putida KT2440
guaauacugcuucca

SEQ ID NO: 3600760 - RNA, 17 nt, Pseudomonas putida KT2440
guaaucagcuugaacac

SEQ ID NO: 3600761 - RNA, 17 nt, Pseudomonas putida KT2440
guaauccaucaccacaa

SEQ ID NO: 3600762 - RNA, 23 nt, Pseudomonas putida KT2440
guaaucgaugaaauucaccugcc

SEQ ID NO: 3600763 - RNA, 20 nt, Pseudomonas putida KT2440
guaaucuggcugucgugcuc

SEQ ID NO: 3600764 - RNA, 22 nt, Pseudomonas putida KT2440
guaaugaccuggaucgccaggc

SEQ ID NO: 3600765 - RNA, 14 nt, Pseudomonas putida KT2440
guaaugcgcacggc

SEQ ID NO: 3600766 - RNA, 20 nt, Pseudomonas putida KT2440
guaauggccuacgcacuggg

SEQ ID NO: 3600767 - RNA, 16 nt, Pseudomonas putida KT2440
guacaacaacaaaaaa

SEQ ID NO: 3600768 - RNA, 15 nt, Pseudomonas putida KT2440
guacaagcuggcacg

SEQ ID NO: 3600769 - RNA, 13 nt, Pseudomonas putida KT2440
guacaaugcacuu

SEQ ID NO: 3600770 - RNA, 23 nt, Pseudomonas putida KT2440
guacacagcccaaggcuggccag

SEQ ID NO: 3600771 - RNA, 15 nt, Pseudomonas putida KT2440
guacaccgacgccga

SEQ ID NO: 3600772 - RNA, 13 nt, Pseudomonas putida KT2440
guacaccggcagc

SEQ ID NO: 3600773 - RNA, 17 nt, Pseudomonas putida KT2440
guacacgccacggaaca

SEQ ID NO: 3600774 - RNA, 16 nt, Pseudomonas putida KT2440
guacacugcaggagcg

SEQ ID NO: 3600775 - RNA, 19 nt, Pseudomonas putida KT2440
guacacugcaggagcgggc

SEQ ID NO: 3600776 - RNA, 21 nt, Pseudomonas putida KT2440
guacagaucgauccccugcaa

SEQ ID NO: 3600777 - RNA, 11 nt, Pseudomonas putida KT2440
guacagcagcu

SEQ ID NO: 3600778 - RNA, 19 nt, Pseudomonas putida KT2440
guacagcgacaugccggcc

SEQ ID NO: 3600779 - RNA, 18 nt, Pseudomonas putida KT2440
guacagcgugcgcucagg

SEQ ID NO: 3600780 - RNA, 22 nt, Pseudomonas putida KT2440
guacagcucacgcagccaguuc

SEQ ID NO: 3600781 - RNA, 18 nt, Pseudomonas putida KT2440
guacagcucacuggccaa

SEQ ID NO: 3600782 - RNA, 18 nt, Pseudomonas putida KT2440
guacaggcaauacaaggc

SEQ ID NO: 3600783 - RNA, 15 nt, Pseudomonas putida KT2440
guacaggcugccgcc

SEQ ID NO: 3600784 - RNA, 19 nt, Pseudomonas putida KT2440
guacagguugcggccaucg

SEQ ID NO: 3600785 - RNA, 19 nt, Pseudomonas putida KT2440
guacaguggcacuggcgcg

SEQ ID NO: 3600786 - RNA, 18 nt, Pseudomonas putida KT2440
guacauagaacagcauca

SEQ ID NO: 3600787 - RNA, 21 nt, Pseudomonas putida KT2440
guacauccagcuccagcacca

SEQ ID NO: 3600788 - RNA, 19 nt, Pseudomonas putida KT2440
guacaugcgaacgcaggcg

SEQ ID NO: 3600789 - RNA, 14 nt, Pseudomonas putida KT2440
guaccagaaccccg

SEQ ID NO: 3600790 - RNA, 14 nt, Pseudomonas putida KT2440
guaccagcagcaca

SEQ ID NO: 3600791 - RNA, 11 nt, Pseudomonas putida KT2440
guaccagcagg

SEQ ID NO: 3600792 - RNA, 12 nt, Pseudomonas putida KT2440
guaccagcaggc

SEQ ID NO: 3600793 - RNA, 16 nt, Pseudomonas putida KT2440
guaccaggucgccagc

SEQ ID NO: 3600794 - RNA, 17 nt, Pseudomonas putida KT2440
guaccaggucgccagca

SEQ ID NO: 3600795 - RNA, 22 nt, Pseudomonas putida KT2440
guaccauccaguaccagugcau

SEQ ID NO: 3600796 - RNA, 13 nt, Pseudomonas putida KT2440
guacccagccccc

SEQ ID NO: 3600797 - RNA, 20 nt, Pseudomonas putida KT2440
guacccagcucgaucagcug

SEQ ID NO: 3600798 - RNA, 18 nt, Pseudomonas putida KT2440
guaccccucgacgccuug

SEQ ID NO: 3600799 - RNA, 18 nt, Pseudomonas putida KT2440
guaccccuggcgcuuucc

SEQ ID NO: 3600800 - RNA, 14 nt, Pseudomonas putida KT2440
guacccgccagcaa

SEQ ID NO: 3600801 - RNA, 15 nt, Pseudomonas putida KT2440
guacccgccagcaau

SEQ ID NO: 3600802 - RNA, 20 nt, Pseudomonas putida KT2440
guacccgcguuggcagcacc

SEQ ID NO: 3600803 - RNA, 14 nt, Pseudomonas putida KT2440
guaccgaccucuuc

SEQ ID NO: 3600804 - RNA, 20 nt, Pseudomonas putida KT2440
guaccgaccucuucgcgggu

SEQ ID NO: 3600805 - RNA, 22 nt, Pseudomonas putida KT2440
guaccgcccucuucgcgggcau

SEQ ID NO: 3600806 - RNA, 19 nt, Pseudomonas putida KT2440
guaccgccguccaccaucu

SEQ ID NO: 3600807 - RNA, 16 nt, Pseudomonas putida KT2440
guaccgccucgggggc

SEQ ID NO: 3600808 - RNA, 22 nt, Pseudomonas putida KT2440
guaccgccucgggggcaucauu

SEQ ID NO: 3600809 - RNA, 12 nt, Pseudomonas putida KT2440
guaccggcaacc

SEQ ID NO: 3600810 - RNA, 22 nt, Pseudomonas putida KT2440
guaccggccucuucgcgggcaa

SEQ ID NO: 3600811 - RNA, 15 nt, Pseudomonas putida KT2440
guaccgggcggccac

SEQ ID NO: 3600812 - RNA, 16 nt, Pseudomonas putida KT2440
guaccgggcggccacc

SEQ ID NO: 3600813 - RNA, 23 nt, Pseudomonas putida KT2440
guaccgggcggccaccggccacg

SEQ ID NO: 3600814 - RNA, 12 nt, Pseudomonas putida KT2440
guaccgugcugc

SEQ ID NO: 3600815 - RNA, 19 nt, Pseudomonas putida KT2440
guaccugcacacugcccag

SEQ ID NO: 3600816 - RNA, 21 nt, Pseudomonas putida KT2440
guaccuggaauaccaccucac

SEQ ID NO: 3600817 - RNA, 13 nt, Pseudomonas putida KT2440
guaccuggccgcg

SEQ ID NO: 3600818 - RNA, 15 nt, Pseudomonas putida KT2440
guaccuggccgugcc

SEQ ID NO: 3600819 - RNA, 19 nt, Pseudomonas putida KT2440
guaccugugggagcgggcu

SEQ ID NO: 3600820 - RNA, 20 nt, Pseudomonas putida KT2440
guaccugugggagcgggcuu

SEQ ID NO: 3600821 - RNA, 15 nt, Pseudomonas putida KT2440
guaccuguggggcaa

SEQ ID NO: 3600822 - RNA, 22 nt, Pseudomonas putida KT2440
guaccuuccauuucgaagcugu

SEQ ID NO: 3600823 - RNA, 14 nt, Pseudomonas putida KT2440
guaccuuucaugcc

SEQ ID NO: 3600824 - RNA, 12 nt, Pseudomonas putida KT2440
guacgaagccau

SEQ ID NO: 3600825 - RNA, 14 nt, Pseudomonas putida KT2440
guacgaagcucugg

SEQ ID NO: 3600826 - RNA, 17 nt, Pseudomonas putida KT2440
guacgagucagcgugcc

SEQ ID NO: 3600827 - RNA, 18 nt, Pseudomonas putida KT2440
guacgaugcugcgggcgu

SEQ ID NO: 3600828 - RNA, 14 nt, Pseudomonas putida KT2440
guacgccagcagcg

SEQ ID NO: 3600829 - RNA, 16 nt, Pseudomonas putida KT2440
guacgccagcagcgca

SEQ ID NO: 3600830 - RNA, 18 nt, Pseudomonas putida KT2440
guacgccgcaaacgcuga

SEQ ID NO: 3600831 - RNA, 22 nt, Pseudomonas putida KT2440
guacgccggcgcacgcaugcgc

SEQ ID NO: 3600832 - RNA, 21 nt, Pseudomonas putida KT2440
guacgcguggucgccggcgaa

SEQ ID NO: 3600833 - RNA, 13 nt, Pseudomonas putida KT2440
guacgcuggccaa

SEQ ID NO: 3600834 - RNA, 14 nt, Pseudomonas putida KT2440
guauacccaucggu

SEQ ID NO: 3600835 - RNA, 20 nt, Pseudomonas putida KT2440
guauagccaugcaccgucug

SEQ ID NO: 3600836 - RNA, 14 nt, Pseudomonas putida KT2440
guauccaucaccau

SEQ ID NO: 3600837 - RNA, 22 nt, Pseudomonas putida KT2440
guauccccgaguauccccacca

SEQ ID NO: 3600838 - RNA, 12 nt, Pseudomonas putida KT2440
guaucgaacagg

SEQ ID NO: 3600839 - RNA, 19 nt, Pseudomonas putida KT2440
guaucgaacaggcagacca

SEQ ID NO: 3600840 - RNA, 18 nt, Pseudomonas putida KT2440
guaucgaucaggaaggca

SEQ ID NO: 3600841 - RNA, 15 nt, Pseudomonas putida KT2440
guaucggccauggcc

SEQ ID NO: 3600842 - RNA, 14 nt, Pseudomonas putida KT2440
guaucguucuccag

SEQ ID NO: 3600843 - RNA, 14 nt, Pseudomonas putida KT2440
guaucugccagcac

SEQ ID NO: 3600844 - RNA, 18 nt, Pseudomonas putida KT2440
guaucugccggcagggcu

SEQ ID NO: 3600845 - RNA, 13 nt, Pseudomonas putida KT2440
guaugauuucagg

SEQ ID NO: 3600846 - RNA, 13 nt, Pseudomonas putida KT2440
guaugcagguacc

SEQ ID NO: 3600847 - RNA, 19 nt, Pseudomonas putida KT2440
guauggcaggcugacccgc

SEQ ID NO: 3600848 - RNA, 15 nt, Pseudomonas putida KT2440
guauggcguugcuca

SEQ ID NO: 3600849 - RNA, 21 nt, Pseudomonas putida KT2440
guauggcucagugucagcggc

SEQ ID NO: 3600850 - RNA, 14 nt, Pseudomonas putida KT2440
guauggcuucacgg

SEQ ID NO: 3600851 - RNA, 15 nt, Pseudomonas putida KT2440
guauggcuucacggc

SEQ ID NO: 3600852 - RNA, 16 nt, Pseudomonas putida KT2440
guaugggcgacgaagg

SEQ ID NO: 3600853 - RNA, 19 nt, Pseudomonas putida KT2440
guaugugcacauucuccag

SEQ ID NO: 3600854 - RNA, 20 nt, Pseudomonas putida KT2440
guauuaagggcauggccgcc

SEQ ID NO: 3600855 - RNA, 14 nt, Pseudomonas putida KT2440
guauucgagcuuga

SEQ ID NO: 3600856 - RNA, 22 nt, Pseudomonas putida KT2440
guauucgcuaaccucugcaugc

SEQ ID NO: 3600857 - RNA, 13 nt, Pseudomonas putida KT2440
guauuggccaaga

SEQ ID NO: 3600858 - RNA, 20 nt, Pseudomonas putida KT2440
gucaaacaaugcacagcgcu

SEQ ID NO: 3600859 - RNA, 18 nt, Pseudomonas putida KT2440
gucaaagaaccugggacu

SEQ ID NO: 3600860 - RNA, 22 nt, Pseudomonas putida KT2440
gucaaccccaggugcugaugcc

SEQ ID NO: 3600861 - RNA, 18 nt, Pseudomonas putida KT2440
gucaaccccuugcgggaa

SEQ ID NO: 3600862 - RNA, 19 nt, Pseudomonas putida KT2440
gucaaccgaacccgcuggc

SEQ ID NO: 3600863 - RNA, 17 nt, Pseudomonas putida KT2440
gucaaccucaacgccau

SEQ ID NO: 3600864 - RNA, 22 nt, Pseudomonas putida KT2440
gucaacgguaacguuggccggg

SEQ ID NO: 3600865 - RNA, 11 nt, Pseudomonas putida KT2440
gucaacucauc

SEQ ID NO: 3600866 - RNA, 18 nt, Pseudomonas putida KT2440
gucaacucgccaaaccau

SEQ ID NO: 3600867 - RNA, 22 nt, Pseudomonas putida KT2440
gucaacucgccaaaccauggcg

SEQ ID NO: 3600868 - RNA, 23 nt, Pseudomonas putida KT2440
gucaaggccagcgccugcugcca

SEQ ID NO: 3600869 - RNA, 20 nt, Pseudomonas putida KT2440
gucaaguacuugcaggugca

SEQ ID NO: 3600870 - RNA, 15 nt, Pseudomonas putida KT2440
gucaauaccggugcc

SEQ ID NO: 3600871 - RNA, 20 nt, Pseudomonas putida KT2440
gucaaucuaaaaucaucggc

SEQ ID NO: 3600872 - RNA, 22 nt, Pseudomonas putida KT2440
gucaaucuaaaaucaucggcaa

SEQ ID NO: 3600873 - RNA, 19 nt, Pseudomonas putida KT2440
gucacaccaucggccggcu

SEQ ID NO: 3600874 - RNA, 12 nt, Pseudomonas putida KT2440
gucaccagcguc

SEQ ID NO: 3600875 - RNA, 14 nt, Pseudomonas putida KT2440
gucacccgcgacca

SEQ ID NO: 3600876 - RNA, 11 nt, Pseudomonas putida KT2440
gucacccgcgc

SEQ ID NO: 3600877 - RNA, 17 nt, Pseudomonas putida KT2440
gucacccguggcagccc

SEQ ID NO: 3600878 - RNA, 18 nt, Pseudomonas putida KT2440
gucacccguggcagcccc

SEQ ID NO: 3600879 - RNA, 21 nt, Pseudomonas putida KT2440
gucacccuuggucaggaucac

SEQ ID NO: 3600880 - RNA, 18 nt, Pseudomonas putida KT2440
gucaccgagacgaucacc

SEQ ID NO: 3600881 - RNA, 23 nt, Pseudomonas putida KT2440
gucaccgcccagcuucuccagca

SEQ ID NO: 3600882 - RNA, 17 nt, Pseudomonas putida KT2440
gucaccgccccagcgcg

SEQ ID NO: 3600883 - RNA, 18 nt, Pseudomonas putida KT2440
gucaccgucaccuugcug

SEQ ID NO: 3600884 - RNA, 16 nt, Pseudomonas putida KT2440
gucaccugacacauag

SEQ ID NO: 3600885 - RNA, 16 nt, Pseudomonas putida KT2440
gucaccuuguccagca

SEQ ID NO: 3600886 - RNA, 20 nt, Pseudomonas putida KT2440
gucaccuuguccagcaggcc

SEQ ID NO: 3600887 - RNA, 20 nt, Pseudomonas putida KT2440
gucacgacaggggcgcagag

SEQ ID NO: 3600888 - RNA, 14 nt, Pseudomonas putida KT2440
gucacgcaccaugu

SEQ ID NO: 3600889 - RNA, 14 nt, Pseudomonas putida KT2440
gucacgcggccguc

SEQ ID NO: 3600890 - RNA, 22 nt, Pseudomonas putida KT2440
gucacgcuccuucgccacgaac

SEQ ID NO: 3600891 - RNA, 14 nt, Pseudomonas putida KT2440
gucacgcucggcca

SEQ ID NO: 3600892 - RNA, 21 nt, Pseudomonas putida KT2440
gucacggccacccauggcggu

SEQ ID NO: 3600893 - RNA, 14 nt, Pseudomonas putida KT2440
gucacggcugaaga

SEQ ID NO: 3600894 - RNA, 18 nt, Pseudomonas putida KT2440
gucacggcugaagaagcu

SEQ ID NO: 3600895 - RNA, 15 nt, Pseudomonas putida KT2440
gucacguagaacagg

SEQ ID NO: 3600896 - RNA, 17 nt, Pseudomonas putida KT2440
gucacguagaacaggcc

SEQ ID NO: 3600897 - RNA, 14 nt, Pseudomonas putida KT2440
gucacguugcccga

SEQ ID NO: 3600898 - RNA, 20 nt, Pseudomonas putida KT2440
gucacguuguagcccaccac

SEQ ID NO: 3600899 - RNA, 19 nt, Pseudomonas putida KT2440
gucacucaggugcacgacg

SEQ ID NO: 3600900 - RNA, 15 nt, Pseudomonas putida KT2440
gucacugagccaggc

SEQ ID NO: 3600901 - RNA, 18 nt, Pseudomonas putida KT2440
gucacugagccaggccga

SEQ ID NO: 3600902 - RNA, 11 nt, Pseudomonas putida KT2440
gucacugccgu

SEQ ID NO: 3600903 - RNA, 16 nt, Pseudomonas putida KT2440
gucacuggcgacagcc

SEQ ID NO: 3600904 - RNA, 14 nt, Pseudomonas putida KT2440
gucacuggcugcug

SEQ ID NO: 3600905 - RNA, 18 nt, Pseudomonas putida KT2440
gucacuggcugcugcggu

SEQ ID NO: 3600906 - RNA, 18 nt, Pseudomonas putida KT2440
gucagaaaaaacagugcc

SEQ ID NO: 3600907 - RNA, 14 nt, Pseudomonas putida KT2440
gucagcaccggcag

SEQ ID NO: 3600908 - RNA, 13 nt, Pseudomonas putida KT2440
gucagcagcaccg

SEQ ID NO: 3600909 - RNA, 14 nt, Pseudomonas putida KT2440
gucagcagcaggcg

SEQ ID NO: 3600910 - RNA, 20 nt, Pseudomonas putida KT2440
gucagcagcuucagccaggg

SEQ ID NO: 3600911 - RNA, 13 nt, Pseudomonas putida KT2440
gucagcaguggcu

SEQ ID NO: 3600912 - RNA, 16 nt, Pseudomonas putida KT2440
gucagcaguggcucca

SEQ ID NO: 3600913 - RNA, 13 nt, Pseudomonas putida KT2440
gucagcaucaccg

SEQ ID NO: 3600914 - RNA, 14 nt, Pseudomonas putida KT2440
gucagcauccagcc

SEQ ID NO: 3600915 - RNA, 21 nt, Pseudomonas putida KT2440
gucagccacauccucugcccg

SEQ ID NO: 3600916 - RNA, 16 nt, Pseudomonas putida KT2440
gucagccaccaccagc

SEQ ID NO: 3600917 - RNA, 17 nt, Pseudomonas putida KT2440
gucagccaccaccagcu

SEQ ID NO: 3600918 - RNA, 15 nt, Pseudomonas putida KT2440
gucagccagaugcgc

SEQ ID NO: 3600919 - RNA, 19 nt, Pseudomonas putida KT2440
gucagccagcgguccggcc

SEQ ID NO: 3600920 - RNA, 13 nt, Pseudomonas putida KT2440
gucagccaggcgu

SEQ ID NO: 3600921 - RNA, 20 nt, Pseudomonas putida KT2440
gucagccccuagcgcauccu

SEQ ID NO: 3600922 - RNA, 15 nt, Pseudomonas putida KT2440
gucagccgacagaua

SEQ ID NO: 3600923 - RNA, 22 nt, Pseudomonas putida KT2440
gucagccgcggugaagaccacu

SEQ ID NO: 3600924 - RNA, 12 nt, Pseudomonas putida KT2440
gucagccugcca

SEQ ID NO: 3600925 - RNA, 20 nt, Pseudomonas putida KT2440
gucagccuuucgagagccgg

SEQ ID NO: 3600926 - RNA, 21 nt, Pseudomonas putida KT2440
gucagccuuucgagagccggg

SEQ ID NO: 3600927 - RNA, 22 nt, Pseudomonas putida KT2440
gucagcgaauaguagaagcaga

SEQ ID NO: 3600928 - RNA, 22 nt, Pseudomonas putida KT2440
gucagcgaguugaacuuggcga

SEQ ID NO: 3600929 - RNA, 17 nt, Pseudomonas putida KT2440
gucagcgccagcggcuc

SEQ ID NO: 3600930 - RNA, 14 nt, Pseudomonas putida KT2440
gucagcggaccagg

SEQ ID NO: 3600931 - RNA, 15 nt, Pseudomonas putida KT2440
gucagcggaccaggu

SEQ ID NO: 3600932 - RNA, 21 nt, Pseudomonas putida KT2440
gucagcggcaguugccugccu

SEQ ID NO: 3600933 - RNA, 17 nt, Pseudomonas putida KT2440
gucagcguacacugcag

SEQ ID NO: 3600934 - RNA, 22 nt, Pseudomonas putida KT2440
gucagcguacacugcaggagcg

SEQ ID NO: 3600935 - RNA, 23 nt, Pseudomonas putida KT2440
gucagcgugguaguuguccaccu

SEQ ID NO: 3600936 - RNA, 13 nt, Pseudomonas putida KT2440
gucagcucaagcg

SEQ ID NO: 3600937 - RNA, 21 nt, Pseudomonas putida KT2440
gucagcuggccuucgaacagc

SEQ ID NO: 3600938 - RNA, 22 nt, Pseudomonas putida KT2440
gucagcuugccuuccgggaaga

SEQ ID NO: 3600939 - RNA, 21 nt, Pseudomonas putida KT2440
gucaggccgaugggcaggcca

SEQ ID NO: 3600940 - RNA, 19 nt, Pseudomonas putida KT2440
guccaguucaaugccagca

SEQ ID NO: 3600941 - RNA, 19 nt, Pseudomonas putida KT2440
guccaguuggcggcgcagc

SEQ ID NO: 3600942 - RNA, 12 nt, Pseudomonas putida KT2440
guccaucugcuu

SEQ ID NO: 3600943 - RNA, 15 nt, Pseudomonas putida KT2440
guccaucuugcugcu

SEQ ID NO: 3600944 - RNA, 16 nt, Pseudomonas putida KT2440
guccaugaucuccacg

SEQ ID NO: 3600945 - RNA, 23 nt, Pseudomonas putida KT2440
guccaugaucuccacggcaaucg

SEQ ID NO: 3600946 - RNA, 17 nt, Pseudomonas putida KT2440
guccauguuacggccca

SEQ ID NO: 3600947 - RNA, 15 nt, Pseudomonas putida KT2440
gucccagcaggcaca

SEQ ID NO: 3600948 - RNA, 13 nt, Pseudomonas putida KT2440
gucccagcuggca

SEQ ID NO: 3600949 - RNA, 21 nt, Pseudomonas putida KT2440
gucccagcuggcaaugcaacu

SEQ ID NO: 3600950 - RNA, 14 nt, Pseudomonas putida KT2440
guccccaccggcac

SEQ ID NO: 3600951 - RNA, 22 nt, Pseudomonas putida KT2440
guccccgcgcuuugugcacaag

SEQ ID NO: 3600952 - RNA, 18 nt, Pseudomonas putida KT2440
guccccuucgucuagugg

SEQ ID NO: 3600953 - RNA, 18 nt, Pseudomonas putida KT2440
gucccgaucagguucacc

SEQ ID NO: 3600954 - RNA, 15 nt, Pseudomonas putida KT2440
gucccgaucucccca

SEQ ID NO: 3600955 - RNA, 11 nt, Pseudomonas putida KT2440
gucccgcccgg

SEQ ID NO: 3600956 - RNA, 22 nt, Pseudomonas putida KT2440
gucccgcccuccagccgcgaac

SEQ ID NO: 3600957 - RNA, 15 nt, Pseudomonas putida KT2440
gucccgcccugagcc

SEQ ID NO: 3600958 - RNA, 20 nt, Pseudomonas putida KT2440
gucccgcccugagccaaggc

SEQ ID NO: 3600959 - RNA, 17 nt, Pseudomonas putida KT2440
gucccgcugccguagca

SEQ ID NO: 3600960 - RNA, 13 nt, Pseudomonas putida KT2440
gucccggccagcg

SEQ ID NO: 3600961 - RNA, 14 nt, Pseudomonas putida KT2440
gucccggccagggc

SEQ ID NO: 3600962 - RNA, 23 nt, Pseudomonas putida KT2440
gucccggcccagccgcgacugga

SEQ ID NO: 3600963 - RNA, 17 nt, Pseudomonas putida KT2440
gucccuguaggcgcaac

SEQ ID NO: 3600964 - RNA, 14 nt, Pseudomonas putida KT2440
guccgaagcgaaca

SEQ ID NO: 3600965 - RNA, 16 nt, Pseudomonas putida KT2440
guccgacaaugccagc

SEQ ID NO: 3600966 - RNA, 15 nt, Pseudomonas putida KT2440
guccgagcggagcug

SEQ ID NO: 3600967 - RNA, 17 nt, Pseudomonas putida KT2440
guccgaggucagcacca

SEQ ID NO: 3600968 - RNA, 21 nt, Pseudomonas putida KT2440
guccgccaagauccgcggcau

SEQ ID NO: 3600969 - RNA, 20 nt, Pseudomonas putida KT2440
guccgccaagguaaucuggc

SEQ ID NO: 3600970 - RNA, 19 nt, Pseudomonas putida KT2440
guccgcccuugccaccagu

SEQ ID NO: 3600971 - RNA, 23 nt, Pseudomonas putida KT2440
guccgcccuugccaccagugccg

SEQ ID NO: 3600972 - RNA, 15 nt, Pseudomonas putida KT2440
guccgccgcgcugac

SEQ ID NO: 3600973 - RNA, 18 nt, Pseudomonas putida KT2440
guccgccuugagguugcc

SEQ ID NO: 3600974 - RNA, 18 nt, Pseudomonas putida KT2440
guccgcgaagcagacaac

SEQ ID NO: 3600975 - RNA, 21 nt, Pseudomonas putida KT2440
guccgcucuucucgucguagc

SEQ ID NO: 3600976 - RNA, 17 nt, Pseudomonas putida KT2440
guccgcugccuuccaac

SEQ ID NO: 3600977 - RNA, 21 nt, Pseudomonas putida KT2440
guccggcaugugcacuggcag

SEQ ID NO: 3600978 - RNA, 14 nt, Pseudomonas putida KT2440
guccggccagcaac

SEQ ID NO: 3600979 - RNA, 14 nt, Pseudomonas putida KT2440
guccggcugcgggu

SEQ ID NO: 3600980 - RNA, 14 nt, Pseudomonas putida KT2440
guccgguaacuggc

SEQ ID NO: 3600981 - RNA, 12 nt, Pseudomonas putida KT2440
guccgugagaaa

SEQ ID NO: 3600982 - RNA, 18 nt, Pseudomonas putida KT2440
guccucaaucacauccac

SEQ ID NO: 3600983 - RNA, 23 nt, Pseudomonas putida KT2440
guccucauaaugcuccgccacca

SEQ ID NO: 3600984 - RNA, 20 nt, Pseudomonas putida KT2440
guccucccaguacaugaucg

SEQ ID NO: 3600985 - RNA, 20 nt, Pseudomonas putida KT2440
guccuccccuucccgccauu

SEQ ID NO: 3600986 - RNA, 19 nt, Pseudomonas putida KT2440
guccucgaaacgcaggcuc

SEQ ID NO: 3600987 - RNA, 19 nt, Pseudomonas putida KT2440
guccucgacgggcaggcgg

SEQ ID NO: 3600988 - RNA, 22 nt, Pseudomonas putida KT2440
guccucgacgggcaggcgguug

SEQ ID NO: 3600989 - RNA, 15 nt, Pseudomonas putida KT2440
guccugcaaaggccc

SEQ ID NO: 3600990 - RNA, 15 nt, Pseudomonas putida KT2440
guccugcaacucggc

SEQ ID NO: 3600991 - RNA, 16 nt, Pseudomonas putida KT2440
guccugcaccacaugc

SEQ ID NO: 3600992 - RNA, 14 nt, Pseudomonas putida KT2440
guccugcagcggca

SEQ ID NO: 3600993 - RNA, 23 nt, Pseudomonas putida KT2440
guccugcccccaaugggcaccgg

SEQ ID NO: 3600994 - RNA, 20 nt, Pseudomonas putida KT2440
guccugcgauagaucagcga

SEQ ID NO: 3600995 - RNA, 14 nt, Pseudomonas putida KT2440
guccugcgccaggc

SEQ ID NO: 3600996 - RNA, 16 nt, Pseudomonas putida KT2440
guccugcgccaggcau

SEQ ID NO: 3600997 - RNA, 15 nt, Pseudomonas putida KT2440
guccugcgcgcuuga

SEQ ID NO: 3600998 - RNA, 22 nt, Pseudomonas putida KT2440
guccugcgcgucgacaaaccgc

SEQ ID NO: 3600999 - RNA, 22 nt, Pseudomonas putida KT2440
guccugcuccacccgugcaggg

SEQ ID NO: 3601000 - RNA, 14 nt, Pseudomonas putida KT2440
guccugcugcaggc

SEQ ID NO: 3601001 - RNA, 16 nt, Pseudomonas putida KT2440
guccugcugcaggcuc

SEQ ID NO: 3601002 - RNA, 22 nt, Pseudomonas putida KT2440
guccuggaaaagcaaggcucag

SEQ ID NO: 3601003 - RNA, 24 nt, Pseudomonas putida KT2440
guccuggaaaagcaaggcucaggc

SEQ ID NO: 3601004 - RNA, 20 nt, Pseudomonas putida KT2440
guccugguaacccgguugcc

SEQ ID NO: 3601005 - RNA, 21 nt, Pseudomonas putida KT2440
guccugguccgaggucagcac

SEQ ID NO: 3601006 - RNA, 19 nt, Pseudomonas putida KT2440
guccuuauccagacccuga

SEQ ID NO: 3601007 - RNA, 13 nt, Pseudomonas putida KT2440
guccuugcacagu

SEQ ID NO: 3601008 - RNA, 13 nt, Pseudomonas putida KT2440
guccuugcacucc

SEQ ID NO: 3601009 - RNA, 15 nt, Pseudomonas putida KT2440
guccuugcagggcac

SEQ ID NO: 3601010 - RNA, 16 nt, Pseudomonas putida KT2440
guccuugcagggcacc

SEQ ID NO: 3601011 - RNA, 20 nt, Pseudomonas putida KT2440
guccuuguaagagcggccuu

SEQ ID NO: 3601012 - RNA, 23 nt, Pseudomonas putida KT2440
guccuuucgcgacacaaggccgc

SEQ ID NO: 3601013 - RNA, 16 nt, Pseudomonas putida KT2440
gucgaacaacuugugc

SEQ ID NO: 3601014 - RNA, 18 nt, Pseudomonas putida KT2440
gucgaacagcugaucgcc

SEQ ID NO: 3601015 - RNA, 16 nt, Pseudomonas putida KT2440
gucgaaccacugaugc

SEQ ID NO: 3601016 - RNA, 16 nt, Pseudomonas putida KT2440
gucgaaccgcaacugg

SEQ ID NO: 3601017 - RNA, 17 nt, Pseudomonas putida KT2440
gucgaaccgcaacuggc

SEQ ID NO: 3601018 - RNA, 12 nt, Pseudomonas putida KT2440
gucgaaccugcc

SEQ ID NO: 3601019 - RNA, 14 nt, Pseudomonas putida KT2440
gucgaaccugcccg

SEQ ID NO: 3601020 - RNA, 23 nt, Pseudomonas putida KT2440
gucgaacucgcgcccacgcgggu

SEQ ID NO: 3601021 - RNA, 12 nt, Pseudomonas putida KT2440
gucgaagcgcac

SEQ ID NO: 3601022 - RNA, 21 nt, Pseudomonas putida KT2440
gucgaagcgcucccaggccuc

SEQ ID NO: 3601023 - RNA, 17 nt, Pseudomonas putida KT2440
gucgaaggucaggcgcg

SEQ ID NO: 3601024 - RNA, 23 nt, Pseudomonas putida KT2440
gucgaaguauuccagaaucugca

SEQ ID NO: 3601025 - RNA, 17 nt, Pseudomonas putida KT2440
gucgaaguggaucacgg

SEQ ID NO: 3601026 - RNA, 19 nt, Pseudomonas putida KT2440
gucgaaugcgugcaacgcc

SEQ ID NO: 3601027 - RNA, 15 nt, Pseudomonas putida KT2440
gucgacaaaugccgg

SEQ ID NO: 3601028 - RNA, 14 nt, Pseudomonas putida KT2440
gucgacaccaggau

SEQ ID NO: 3601029 - RNA, 13 nt, Pseudomonas putida KT2440
gucgaccaaaaau

SEQ ID NO: 3601030 - RNA, 19 nt, Pseudomonas putida KT2440
gucgaccaaaaaucuuaac

SEQ ID NO: 3601031 - RNA, 15 nt, Pseudomonas putida KT2440
gucgaccagaagggc

SEQ ID NO: 3601032 - RNA, 11 nt, Pseudomonas putida KT2440
gucgaccagca

SEQ ID NO: 3601033 - RNA, 13 nt, Pseudomonas putida KT2440
gucgaccagcagc

SEQ ID NO: 3601034 - RNA, 14 nt, Pseudomonas putida KT2440
gucgaccgcgacca

SEQ ID NO: 3601035 - RNA, 16 nt, Pseudomonas putida KT2440
gucgaccgcuauggcg

SEQ ID NO: 3601036 - RNA, 12 nt, Pseudomonas putida KT2440
gucgaccggagc

SEQ ID NO: 3601037 - RNA, 17 nt, Pseudomonas putida KT2440
gucgaccugggccaggu

SEQ ID NO: 3601038 - RNA, 17 nt, Pseudomonas putida KT2440
gucgaccugguccagcu

SEQ ID NO: 3601039 - RNA, 11 nt, Pseudomonas putida KT2440
gucgacgaaca

SEQ ID NO: 3601040 - RNA, 15 nt, Pseudomonas putida KT2440
gucgacgaucgccgc

SEQ ID NO: 3601041 - RNA, 14 nt, Pseudomonas putida KT2440
gucgacguacagca

SEQ ID NO: 3601042 - RNA, 17 nt, Pseudomonas putida KT2440
gucgacguacagcagcu

SEQ ID NO: 3601043 - RNA, 14 nt, Pseudomonas putida KT2440
gucgacucgaugcc

SEQ ID NO: 3601044 - RNA, 16 nt, Pseudomonas putida KT2440
gucgagcaccacggcg

SEQ ID NO: 3601045 - RNA, 19 nt, Pseudomonas putida KT2440
gucgagcaccacggcggcg

SEQ ID NO: 3601046 - RNA, 22 nt, Pseudomonas putida KT2440
gucggcgcgcaacagcaaggca

SEQ ID NO: 3601047 - RNA, 18 nt, Pseudomonas putida KT2440
gucggcgcgcgcauccac

SEQ ID NO: 3601048 - RNA, 12 nt, Pseudomonas putida KT2440
gucggcgcugga

SEQ ID NO: 3601049 - RNA, 16 nt, Pseudomonas putida KT2440
gucggcgcuggacagg

SEQ ID NO: 3601050 - RNA, 15 nt, Pseudomonas putida KT2440
gucggcguccacugc

SEQ ID NO: 3601051 - RNA, 16 nt, Pseudomonas putida KT2440
gucggcguccacugca

SEQ ID NO: 3601052 - RNA, 15 nt, Pseudomonas putida KT2440
gucggcguccuucag

SEQ ID NO: 3601053 - RNA, 20 nt, Pseudomonas putida KT2440
gucggcguggaacaacggcu

SEQ ID NO: 3601054 - RNA, 23 nt, Pseudomonas putida KT2440
gucggcguuaccccguugcgcag

SEQ ID NO: 3601055 - RNA, 14 nt, Pseudomonas putida KT2440
gucggcuggcagcu

SEQ ID NO: 3601056 - RNA, 17 nt, Pseudomonas putida KT2440
gucgggaauugcagccc

SEQ ID NO: 3601057 - RNA, 21 nt, Pseudomonas putida KT2440
gucgggcacaggcccagcaug

SEQ ID NO: 3601058 - RNA, 13 nt, Pseudomonas putida KT2440
gucgggcuggcug

SEQ ID NO: 3601059 - RNA, 14 nt, Pseudomonas putida KT2440
gucgggcuggcugc

SEQ ID NO: 3601060 - RNA, 15 nt, Pseudomonas putida KT2440
gucggggccggagaa

SEQ ID NO: 3601061 - RNA, 18 nt, Pseudomonas putida KT2440
gucggggugaggggauuc

SEQ ID NO: 3601062 - RNA, 17 nt, Pseudomonas putida KT2440
gucggggugcugcgcac

SEQ ID NO: 3601063 - RNA, 15 nt, Pseudomonas putida KT2440
gucgguagagcaaau

SEQ ID NO: 3601064 - RNA, 19 nt, Pseudomonas putida KT2440
gucggucagcaccuggcag

SEQ ID NO: 3601065 - RNA, 12 nt, Pseudomonas putida KT2440
gucggucaggua

SEQ ID NO: 3601066 - RNA, 21 nt, Pseudomonas putida KT2440
gucggucagguagccuuccag

SEQ ID NO: 3601067 - RNA, 22 nt, Pseudomonas putida KT2440
gucggucgcccccaugaugacc

SEQ ID NO: 3601068 - RNA, 19 nt, Pseudomonas putida KT2440
gucggucucgguaccacgc

SEQ ID NO: 3601069 - RNA, 23 nt, Pseudomonas putida KT2440
gucggugaagccgaccacuucga

SEQ ID NO: 3601070 - RNA, 15 nt, Pseudomonas putida KT2440
gucgguggcgaaggu

SEQ ID NO: 3601071 - RNA, 13 nt, Pseudomonas putida KT2440
gucgguggcggcc

SEQ ID NO: 3601072 - RNA, 20 nt, Pseudomonas putida KT2440
gucguaaucgcccgcugcuu

SEQ ID NO: 3601073 - RNA, 23 nt, Pseudomonas putida KT2440
gucguacggcgucaguucgacgc

SEQ ID NO: 3601074 - RNA, 16 nt, Pseudomonas putida KT2440
gucguaggcgcggguu

SEQ ID NO: 3601075 - RNA, 14 nt, Pseudomonas putida KT2440
gucgucagcuuccg

SEQ ID NO: 3601076 - RNA, 15 nt, Pseudomonas putida KT2440
gucguccgcaguccc

SEQ ID NO: 3601077 - RNA, 16 nt, Pseudomonas putida KT2440
gucguccugcccccaa

SEQ ID NO: 3601078 - RNA, 14 nt, Pseudomonas putida KT2440
gucgugagccugca

SEQ ID NO: 3601079 - RNA, 17 nt, Pseudomonas putida KT2440
gucgugaggugcgcuuc

SEQ ID NO: 3601080 - RNA, 18 nt, Pseudomonas putida KT2440
gucgugcucacgccccuu

SEQ ID NO: 3601081 - RNA, 16 nt, Pseudomonas putida KT2440
gucgugcugccggucg

SEQ ID NO: 3601082 - RNA, 14 nt, Pseudomonas putida KT2440
gucguggcgcuggc

SEQ ID NO: 3601083 - RNA, 17 nt, Pseudomonas putida KT2440
gucguggucgccgucgc

SEQ ID NO: 3601084 - RNA, 18 nt, Pseudomonas putida KT2440
gucguguaggauucgaac

SEQ ID NO: 3601085 - RNA, 17 nt, Pseudomonas putida KT2440
gucuaaccgcgcuggua

SEQ ID NO: 3601086 - RNA, 13 nt, Pseudomonas putida KT2440
gucuacaaaacuu

SEQ ID NO: 3601087 - RNA, 14 nt, Pseudomonas putida KT2440
gucuagagaucugc

SEQ ID NO: 3601088 - RNA, 16 nt, Pseudomonas putida KT2440
gucuagccgccugccg

SEQ ID NO: 3601089 - RNA, 19 nt, Pseudomonas putida KT2440
gucuauggaugccagcggu

SEQ ID NO: 3601090 - RNA, 20 nt, Pseudomonas putida KT2440
gucucacaggcgcugaaacu

SEQ ID NO: 3601091 - RNA, 20 nt, Pseudomonas putida KT2440
gucuccgcgcuugcucaacu

SEQ ID NO: 3601092 - RNA, 14 nt, Pseudomonas putida KT2440
gucuccgggcgccc

SEQ ID NO: 3601093 - RNA, 23 nt, Pseudomonas putida KT2440
gucuccuaugagacuagcagucc

SEQ ID NO: 3601094 - RNA, 19 nt, Pseudomonas putida KT2440
gucucgaaccacagcacgc

SEQ ID NO: 3601095 - RNA, 16 nt, Pseudomonas putida KT2440
gucucgaaccaguucg

SEQ ID NO: 3601096 - RNA, 17 nt, Pseudomonas putida KT2440
gucucgaacgcugugcc

SEQ ID NO: 3601097 - RNA, 16 nt, Pseudomonas putida KT2440
gucucgaccacuuccc

SEQ ID NO: 3601098 - RNA, 22 nt, Pseudomonas putida KT2440
gucucgaucuaugcccggcuca

SEQ ID NO: 3601099 - RNA, 20 nt, Pseudomonas putida KT2440
gucucgccgcuguacaccag

SEQ ID NO: 3601100 - RNA, 16 nt, Pseudomonas putida KT2440
gucucgcggcuggugu

SEQ ID NO: 3601101 - RNA, 14 nt, Pseudomonas putida KT2440
gucucguacgggug

SEQ ID NO: 3601102 - RNA, 17 nt, Pseudomonas putida KT2440
gucucgucacuggcugc

SEQ ID NO: 3601103 - RNA, 17 nt, Pseudomonas putida KT2440
gucucuacgcccauggc

SEQ ID NO: 3601104 - RNA, 20 nt, Pseudomonas putida KT2440
gucucuuucaacagcuggcu

SEQ ID NO: 3601105 - RNA, 23 nt, Pseudomonas putida KT2440
gucucuuucaacagcuggcuggu

SEQ ID NO: 3601106 - RNA, 16 nt, Pseudomonas putida KT2440
gucucuuucaggcaca

SEQ ID NO: 3601107 - RNA, 15 nt, Pseudomonas putida KT2440
gucugacagcaggaa

SEQ ID NO: 3601108 - RNA, 18 nt, Pseudomonas putida KT2440
gucugacagcaggaacag

SEQ ID NO: 3601109 - RNA, 19 nt, Pseudomonas putida KT2440
gucugacagcaggaacagc

SEQ ID NO: 3601110 - RNA, 15 nt, Pseudomonas putida KT2440
gucugauagccaggg

SEQ ID NO: 3601111 - RNA, 21 nt, Pseudomonas putida KT2440
gucugcacgcgugccugguug

SEQ ID NO: 3601112 - RNA, 22 nt, Pseudomonas putida KT2440
gucugcacgcgugccugguugc

SEQ ID NO: 3601113 - RNA, 16 nt, Pseudomonas putida KT2440
gucugcauaggcgcug

SEQ ID NO: 3601114 - RNA, 12 nt, Pseudomonas putida KT2440
gucugcaucauu

SEQ ID NO: 3601115 - RNA, 20 nt, Pseudomonas putida KT2440
gucugccaguucaugcagcg

SEQ ID NO: 3601116 - RNA, 16 nt, Pseudomonas putida KT2440
gucugcccggccagca

SEQ ID NO: 3601117 - RNA, 18 nt, Pseudomonas putida KT2440
gucugcccggccagcagg

SEQ ID NO: 3601118 - RNA, 15 nt, Pseudomonas putida KT2440
gucugccgaagaacg

SEQ ID NO: 3601119 - RNA, 17 nt, Pseudomonas putida KT2440
gucugccgcuucgucca

SEQ ID NO: 3601120 - RNA, 15 nt, Pseudomonas putida KT2440
gucugccggcaccgu

SEQ ID NO: 3601121 - RNA, 18 nt, Pseudomonas putida KT2440
gucugccgguaccacugc

SEQ ID NO: 3601122 - RNA, 14 nt, Pseudomonas putida KT2440
gucugcgccugcug

SEQ ID NO: 3601123 - RNA, 19 nt, Pseudomonas putida KT2440
gucugcgcgggaagcccgu

SEQ ID NO: 3601124 - RNA, 18 nt, Pseudomonas putida KT2440
gucugcgcuucaagcagg

SEQ ID NO: 3601125 - RNA, 18 nt, Pseudomonas putida KT2440
gucugcgugauggcagcu

SEQ ID NO: 3601126 - RNA, 21 nt, Pseudomonas putida KT2440
gucugcgugcacccaaccugc

SEQ ID NO: 3601127 - RNA, 20 nt, Pseudomonas putida KT2440
gucugcucagccaaccgccc

SEQ ID NO: 3601128 - RNA, 14 nt, Pseudomonas putida KT2440
gucugcugcggccg

SEQ ID NO: 3601129 - RNA, 16 nt, Pseudomonas putida KT2440
gucugcugcggccgcg

SEQ ID NO: 3601130 - RNA, 16 nt, Pseudomonas putida KT2440
gucugcuuugcagccc

SEQ ID NO: 3601131 - RNA, 13 nt, Pseudomonas putida KT2440
gucuggcaccagu

SEQ ID NO: 3601132 - RNA, 14 nt, Pseudomonas putida KT2440
gucuggcggcccug

SEQ ID NO: 3601133 - RNA, 15 nt, Pseudomonas putida KT2440
gucugguuaccagag

SEQ ID NO: 3601134 - RNA, 13 nt, Pseudomonas putida KT2440
gucuguaagucgu

SEQ ID NO: 3601135 - RNA, 23 nt, Pseudomonas putida KT2440
gucuguggauaacuuacaucugc

SEQ ID NO: 3601136 - RNA, 17 nt, Pseudomonas putida KT2440
gucuucaaaucgcugcg

SEQ ID NO: 3601137 - RNA, 18 nt, Pseudomonas putida KT2440
gucuucaagcucgaagcg

SEQ ID NO: 3601138 - RNA, 17 nt, Pseudomonas putida KT2440
gucuucaaggccaccac

SEQ ID NO: 3601139 - RNA, 23 nt, Pseudomonas putida KT2440
gucuucaaucgucaugaucgcua

SEQ ID NO: 3601140 - RNA, 17 nt, Pseudomonas putida KT2440
gucuucagccaaggcgc

SEQ ID NO: 3601141 - RNA, 12 nt, Pseudomonas putida KT2440
gucuuccagcug

SEQ ID NO: 3601142 - RNA, 20 nt, Pseudomonas putida KT2440
gucuuccagcugcgccugca

SEQ ID NO: 3601143 - RNA, 11 nt, Pseudomonas putida KT2440
gucuuccaggu

SEQ ID NO: 3601144 - RNA, 18 nt, Pseudomonas putida KT2440
gucuuccagguggccgcc

SEQ ID NO: 3601145 - RNA, 14 nt, Pseudomonas putida KT2440
gucuucccauccac

SEQ ID NO: 3601146 - RNA, 23 nt, Pseudomonas putida KT2440
gucuuccggcagggugaaguuga

SEQ ID NO: 3601147 - RNA, 18 nt, Pseudomonas putida KT2440
gucuuccuccgacagcgc

SEQ ID NO: 3601148 - RNA, 22 nt, Pseudomonas putida KT2440
gucuuccucgacccagccaccc

SEQ ID NO: 3601149 - RNA, 17 nt, Pseudomonas putida KT2440
gucuuccuggcggaacg

SEQ ID NO: 3601150 - RNA, 18 nt, Pseudomonas putida KT2440
gucuuccugguuuucgcg

SEQ ID NO: 3601151 - RNA, 23 nt, Pseudomonas putida KT2440
gucuucgaucuggaucacugcca

SEQ ID NO: 3601152 - RNA, 17 nt, Pseudomonas putida KT2440
gugcauccaacgcugcc

SEQ ID NO: 3601153 - RNA, 12 nt, Pseudomonas putida KT2440
gugcauccugca

SEQ ID NO: 3601154 - RNA, 18 nt, Pseudomonas putida KT2440
gugcaucgaagcaggccg

SEQ ID NO: 3601155 - RNA, 17 nt, Pseudomonas putida KT2440
gugcaucugcuccccca

SEQ ID NO: 3601156 - RNA, 17 nt, Pseudomonas putida KT2440
gugcauguagccaauca

SEQ ID NO: 3601157 - RNA, 13 nt, Pseudomonas putida KT2440
gugcauguccagu

SEQ ID NO: 3601158 - RNA, 17 nt, Pseudomonas putida KT2440
gugcauucugccaugau

SEQ ID NO: 3601159 - RNA, 17 nt, Pseudomonas putida KT2440
gugccaccuucagcggg

SEQ ID NO: 3601160 - RNA, 18 nt, Pseudomonas putida KT2440
gugccaccuucagcgggu

SEQ ID NO: 3601161 - RNA, 14 nt, Pseudomonas putida KT2440
gugccagaccacgg

SEQ ID NO: 3601162 - RNA, 13 nt, Pseudomonas putida KT2440
gugccagagaauu

SEQ ID NO: 3601163 - RNA, 18 nt, Pseudomonas putida KT2440
gugccagagaauuucucc

SEQ ID NO: 3601164 - RNA, 17 nt, Pseudomonas putida KT2440
gugccagcaacaagcug

SEQ ID NO: 3601165 - RNA, 14 nt, Pseudomonas putida KT2440
gugccagcggccac

SEQ ID NO: 3601166 - RNA, 17 nt, Pseudomonas putida KT2440
gugccauccaccgcgcc

SEQ ID NO: 3601167 - RNA, 22 nt, Pseudomonas putida KT2440
gugccaucgccucggcacugca

SEQ ID NO: 3601168 - RNA, 15 nt, Pseudomonas putida KT2440
gugcccacugcagcc

SEQ ID NO: 3601169 - RNA, 20 nt, Pseudomonas putida KT2440
gugcccacugcagccauuca

SEQ ID NO: 3601170 - RNA, 12 nt, Pseudomonas putida KT2440
gugccccaaacg

SEQ ID NO: 3601171 - RNA, 18 nt, Pseudomonas putida KT2440
gugcccccccaacaacag

SEQ ID NO: 3601172 - RNA, 18 nt, Pseudomonas putida KT2440
gugccccgguccagcaca

SEQ ID NO: 3601173 - RNA, 19 nt, Pseudomonas putida KT2440
gugcccgcgaacaaggcuc

SEQ ID NO: 3601174 - RNA, 21 nt, Pseudomonas putida KT2440
gugcccgcgaagggcugccgc

SEQ ID NO: 3601175 - RNA, 18 nt, Pseudomonas putida KT2440
gugcccggcaaucgccag

SEQ ID NO: 3601176 - RNA, 21 nt, Pseudomonas putida KT2440
gugcccggcaaucgccaggcg

SEQ ID NO: 3601177 - RNA, 22 nt, Pseudomonas putida KT2440
gugcccggcauccgccucaucc

SEQ ID NO: 3601178 - RNA, 17 nt, Pseudomonas putida KT2440
gugcccguagcggauaa

SEQ ID NO: 3601179 - RNA, 20 nt, Pseudomonas putida KT2440
gugcccgugguacacggcau

SEQ ID NO: 3601180 - RNA, 17 nt, Pseudomonas putida KT2440
gugcccugaucgccucc

SEQ ID NO: 3601181 - RNA, 16 nt, Pseudomonas putida KT2440
gugccgaagucaucca

SEQ ID NO: 3601182 - RNA, 20 nt, Pseudomonas putida KT2440
gugccgaagucauccauggc

SEQ ID NO: 3601183 - RNA, 21 nt, Pseudomonas putida KT2440
gugccgaagucauccauggca

SEQ ID NO: 3601184 - RNA, 22 nt, Pseudomonas putida KT2440
gugccgaauugacccagucagc

SEQ ID NO: 3601185 - RNA, 14 nt, Pseudomonas putida KT2440
gugccgaggacaac

SEQ ID NO: 3601186 - RNA, 15 nt, Pseudomonas putida KT2440
gugccgagugccaac

SEQ ID NO: 3601187 - RNA, 18 nt, Pseudomonas putida KT2440
gugccgagugccaacaau

SEQ ID NO: 3601188 - RNA, 21 nt, Pseudomonas putida KT2440
gugccgcaagcagucccagca

SEQ ID NO: 3601189 - RNA, 23 nt, Pseudomonas putida KT2440
gugccgcaagcagucccagcacc

SEQ ID NO: 3601190 - RNA, 14 nt, Pseudomonas putida KT2440
gugccgcaucagcc

SEQ ID NO: 3601191 - RNA, 21 nt, Pseudomonas putida KT2440
gugccgcaucagccggcuucc

SEQ ID NO: 3601192 - RNA, 17 nt, Pseudomonas putida KT2440
gugccgcaugugccagg

SEQ ID NO: 3601193 - RNA, 14 nt, Pseudomonas putida KT2440
gugccggcagcgag

SEQ ID NO: 3601194 - RNA, 22 nt, Pseudomonas putida KT2440
gugccggccaaucgaucugcuc

SEQ ID NO: 3601195 - RNA, 16 nt, Pseudomonas putida KT2440
gugccggccagcggca

SEQ ID NO: 3601196 - RNA, 12 nt, Pseudomonas putida KT2440
gugccggccucu

SEQ ID NO: 3601197 - RNA, 22 nt, Pseudomonas putida KT2440
gugccggccucuucgcggccuu

SEQ ID NO: 3601198 - RNA, 11 nt, Pseudomonas putida KT2440
gugccggcgag

SEQ ID NO: 3601199 - RNA, 19 nt, Pseudomonas putida KT2440
gugccggcuggacaccucc

SEQ ID NO: 3601200 - RNA, 19 nt, Pseudomonas putida KT2440
gugccgggccgucgaugcc

SEQ ID NO: 3601201 - RNA, 18 nt, Pseudomonas putida KT2440
gugccggguccaguuccu

SEQ ID NO: 3601202 - RNA, 16 nt, Pseudomonas putida KT2440
gugccggucacuggca

SEQ ID NO: 3601203 - RNA, 21 nt, Pseudomonas putida KT2440
gugccggucacuggcaacggg

SEQ ID NO: 3601204 - RNA, 21 nt, Pseudomonas putida KT2440
gugccguacauagcaggaucu

SEQ ID NO: 3601205 - RNA, 20 nt, Pseudomonas putida KT2440
gugccguaccugugggagcg

SEQ ID NO: 3601206 - RNA, 18 nt, Pseudomonas putida KT2440
gugccguauggcguugcu

SEQ ID NO: 3601207 - RNA, 23 nt, Pseudomonas putida KT2440
gugccguauggcguugcucaaca

SEQ ID NO: 3601208 - RNA, 17 nt, Pseudomonas putida KT2440
gugccgucagaaagaau

SEQ ID NO: 3601209 - RNA, 16 nt, Pseudomonas putida KT2440
gugccguccaauagcc

SEQ ID NO: 3601210 - RNA, 20 nt, Pseudomonas putida KT2440
gugccguccgcugccuucca

SEQ ID NO: 3601211 - RNA, 15 nt, Pseudomonas putida KT2440
gugccgucgagcagg

SEQ ID NO: 3601212 - RNA, 16 nt, Pseudomonas putida KT2440
gugccgucgagcaggu

SEQ ID NO: 3601213 - RNA, 16 nt, Pseudomonas putida KT2440
gugccucagccaggcu

SEQ ID NO: 3601214 - RNA, 13 nt, Pseudomonas putida KT2440
gugccugcagccc

SEQ ID NO: 3601215 - RNA, 14 nt, Pseudomonas putida KT2440
gugccugcagcccg

SEQ ID NO: 3601216 - RNA, 17 nt, Pseudomonas putida KT2440
gugccugcagcccggca

SEQ ID NO: 3601217 - RNA, 15 nt, Pseudomonas putida KT2440
gugccuggcgcuuga

SEQ ID NO: 3601218 - RNA, 22 nt, Pseudomonas putida KT2440
gugccugggucagcuccucugc

SEQ ID NO: 3601219 - RNA, 23 nt, Pseudomonas putida KT2440
gugccugguugcccaugcacagc

SEQ ID NO: 3601220 - RNA, 15 nt, Pseudomonas putida KT2440
gugccuguaggagcg

SEQ ID NO: 3601221 - RNA, 16 nt, Pseudomonas putida KT2440
gugccuucaggcgcug

SEQ ID NO: 3601222 - RNA, 12 nt, Pseudomonas putida KT2440
gugccuugucga

SEQ ID NO: 3601223 - RNA, 19 nt, Pseudomonas putida KT2440
gugcgacccgcuggccgga

SEQ ID NO: 3601224 - RNA, 20 nt, Pseudomonas putida KT2440
gugcgagcccuuguccaggu

SEQ ID NO: 3601225 - RNA, 20 nt, Pseudomonas putida KT2440
gugcgaguauccuccagccc

SEQ ID NO: 3601226 - RNA, 15 nt, Pseudomonas putida KT2440
gugcgcaccuuggcg

SEQ ID NO: 3601227 - RNA, 23 nt, Pseudomonas putida KT2440
gugcgcacgaagaucaccgacaa

SEQ ID NO: 3601228 - RNA, 14 nt, Pseudomonas putida KT2440
gugcgcacgcugcc

SEQ ID NO: 3601229 - RNA, 20 nt, Pseudomonas putida KT2440
gugcgcaggcuuucggccac

SEQ ID NO: 3601230 - RNA, 15 nt, Pseudomonas putida KT2440
gugcgcagguacgcc

SEQ ID NO: 3601231 - RNA, 22 nt, Pseudomonas putida KT2440
gugcgcauuucacgcacggccu

SEQ ID NO: 3601232 - RNA, 20 nt, Pseudomonas putida KT2440
gugcgccaccgacuccggca

SEQ ID NO: 3601233 - RNA, 21 nt, Pseudomonas putida KT2440
gugcgccaccgacuccggcaa

SEQ ID NO: 3601234 - RNA, 14 nt, Pseudomonas putida KT2440
gugcgcccggcaaa

SEQ ID NO: 3601235 - RNA, 16 nt, Pseudomonas putida KT2440
gugcgcccggcaaaca

SEQ ID NO: 3601236 - RNA, 17 nt, Pseudomonas putida KT2440
gugcgcccggcgcugau

SEQ ID NO: 3601237 - RNA, 21 nt, Pseudomonas putida KT2440
gugcgcccggcgcugaucagc

SEQ ID NO: 3601238 - RNA, 19 nt, Pseudomonas putida KT2440
gugcgccggcuugccuuca

SEQ ID NO: 3601239 - RNA, 22 nt, Pseudomonas putida KT2440
gugcgccucaugcagcaccucc

SEQ ID NO: 3601240 - RNA, 15 nt, Pseudomonas putida KT2440
gugcgccuccagcag

SEQ ID NO: 3601241 - RNA, 20 nt, Pseudomonas putida KT2440
gugcgccuccagcagcgaca

SEQ ID NO: 3601242 - RNA, 13 nt, Pseudomonas putida KT2440
gugcgcgcaacag

SEQ ID NO: 3601243 - RNA, 16 nt, Pseudomonas putida KT2440
gugcgcggcaggucga

SEQ ID NO: 3601244 - RNA, 15 nt, Pseudomonas putida KT2440
gugcgcggccgucau

SEQ ID NO: 3601245 - RNA, 18 nt, Pseudomonas putida KT2440
gugcgcucguaggcugca

SEQ ID NO: 3601246 - RNA, 18 nt, Pseudomonas putida KT2440
gugcgcugaucgaaagcu

SEQ ID NO: 3601247 - RNA, 20 nt, Pseudomonas putida KT2440
gugcggaucgccgccgaugc

SEQ ID NO: 3601248 - RNA, 16 nt, Pseudomonas putida KT2440
gugcggcaaucgggau

SEQ ID NO: 3601249 - RNA, 13 nt, Pseudomonas putida KT2440
gugcggcaucaug

SEQ ID NO: 3601250 - RNA, 16 nt, Pseudomonas putida KT2440
gugcgggccaccaggc

SEQ ID NO: 3601251 - RNA, 18 nt, Pseudomonas putida KT2440
gugcgggcuccacugcaa

SEQ ID NO: 3601252 - RNA, 20 nt, Pseudomonas putida KT2440
gugcgggcuuguccgcgaag

SEQ ID NO: 3601253 - RNA, 23 nt, Pseudomonas putida KT2440
gugcggggcaaacuucucgauga

SEQ ID NO: 3601254 - RNA, 15 nt, Pseudomonas putida KT2440
gugcggugaccgagg

SEQ ID NO: 3601255 - RNA, 21 nt, Pseudomonas putida KT2440
gugcguagccuucagcggccg

SEQ ID NO: 3601256 - RNA, 19 nt, Pseudomonas putida KT2440
gugcuacggccgugcaggg

SEQ ID NO: 3601257 - RNA, 15 nt, Pseudomonas putida KT2440
gugguaaugcgcuga

SEQ ID NO: 3601258 - RNA, 19 nt, Pseudomonas putida KT2440
gugguaaugcgcugauuca

SEQ ID NO: 3601259 - RNA, 20 nt, Pseudomonas putida KT2440
gugguaggagcggguucacc

SEQ ID NO: 3601260 - RNA, 17 nt, Pseudomonas putida KT2440
gugguaguccuugccgc

SEQ ID NO: 3601261 - RNA, 23 nt, Pseudomonas putida KT2440
guggucauccaggcuggccagca

SEQ ID NO: 3601262 - RNA, 22 nt, Pseudomonas putida KT2440
guggucgaauagcgcgagcugg

SEQ ID NO: 3601263 - RNA, 14 nt, Pseudomonas putida KT2440
guggucuucaaggc

SEQ ID NO: 3601264 - RNA, 14 nt, Pseudomonas putida KT2440
guggugaccucgau

SEQ ID NO: 3601265 - RNA, 16 nt, Pseudomonas putida KT2440
guggugaccucgaugc

SEQ ID NO: 3601266 - RNA, 15 nt, Pseudomonas putida KT2440
guggugaucacgggu

SEQ ID NO: 3601267 - RNA, 22 nt, Pseudomonas putida KT2440
guggugcgggccaccaggccuu

SEQ ID NO: 3601268 - RNA, 19 nt, Pseudomonas putida KT2440
gugguucaucaccagcccc

SEQ ID NO: 3601269 - RNA, 20 nt, Pseudomonas putida KT2440
gugguugacguuggccgcca

SEQ ID NO: 3601270 - RNA, 16 nt, Pseudomonas putida KT2440
gugguugucggucagg

SEQ ID NO: 3601271 - RNA, 15 nt, Pseudomonas putida KT2440
guguaccauccagua

SEQ ID NO: 3601272 - RNA, 21 nt, Pseudomonas putida KT2440
guguagaacggcagcaggcca

SEQ ID NO: 3601273 - RNA, 20 nt, Pseudomonas putida KT2440
guguagcccgcugaagguca

SEQ ID NO: 3601274 - RNA, 18 nt, Pseudomonas putida KT2440
guguagcgcaguccggua

SEQ ID NO: 3601275 - RNA, 13 nt, Pseudomonas putida KT2440
guguaggaucugc

SEQ ID NO: 3601276 - RNA, 16 nt, Pseudomonas putida KT2440
guguagguucacagaa

SEQ ID NO: 3601277 - RNA, 12 nt, Pseudomonas putida KT2440
guguaucggcca

SEQ ID NO: 3601278 - RNA, 14 nt, Pseudomonas putida KT2440
gugucaacaggcug

SEQ ID NO: 3601279 - RNA, 23 nt, Pseudomonas putida KT2440
gugucaacaggcuggccgacguc

SEQ ID NO: 3601280 - RNA, 17 nt, Pseudomonas putida KT2440
gugucagcguacacugc

SEQ ID NO: 3601281 - RNA, 18 nt, Pseudomonas putida KT2440
gugucaggugguaguccu

SEQ ID NO: 3601282 - RNA, 20 nt, Pseudomonas putida KT2440
guguccacccccgcuccuac

SEQ ID NO: 3601283 - RNA, 21 nt, Pseudomonas putida KT2440
guguccacccccgcuccuacg

SEQ ID NO: 3601284 - RNA, 22 nt, Pseudomonas putida KT2440
guguccacccccgcuccuacgg

SEQ ID NO: 3601285 - RNA, 14 nt, Pseudomonas putida KT2440
gugucccggccagg

SEQ ID NO: 3601286 - RNA, 22 nt, Pseudomonas putida KT2440
guguccgccacaacccuugcag

SEQ ID NO: 3601287 - RNA, 14 nt, Pseudomonas putida KT2440
guguccgccgccgu

SEQ ID NO: 3601288 - RNA, 19 nt, Pseudomonas putida KT2440
gugucgauacucacccgcu

SEQ ID NO: 3601289 - RNA, 18 nt, Pseudomonas putida KT2440
gugucggcauacagcucc

SEQ ID NO: 3601290 - RNA, 21 nt, Pseudomonas putida KT2440
gugucgguggcggccagcgca

SEQ ID NO: 3601291 - RNA, 15 nt, Pseudomonas putida KT2440
gugucgucacggcgc

SEQ ID NO: 3601292 - RNA, 13 nt, Pseudomonas putida KT2440
gugucugcgccug

SEQ ID NO: 3601293 - RNA, 14 nt, Pseudomonas putida KT2440
gugucugcgccugc

SEQ ID NO: 3601294 - RNA, 15 nt, Pseudomonas putida KT2440
gugucugcgccugcu

SEQ ID NO: 3601295 - RNA, 15 nt, Pseudomonas putida KT2440
gugucuucuguuguu

SEQ ID NO: 3601296 - RNA, 17 nt, Pseudomonas putida KT2440
gugugaaauagccacgc

SEQ ID NO: 3601297 - RNA, 15 nt, Pseudomonas putida KT2440
gugugaucuucuucg

SEQ ID NO: 3601298 - RNA, 20 nt, Pseudomonas putida KT2440
gugugaugcagccagccucu

SEQ ID NO: 3601299 - RNA, 13 nt, Pseudomonas putida KT2440
gugugcaccuggu

SEQ ID NO: 3601300 - RNA, 13 nt, Pseudomonas putida KT2440
gugugccacuuca

SEQ ID NO: 3601301 - RNA, 20 nt, Pseudomonas putida KT2440
gugugccacuucaugggcca

SEQ ID NO: 3601302 - RNA, 16 nt, Pseudomonas putida KT2440
gugugcccaccaguga

SEQ ID NO: 3601303 - RNA, 15 nt, Pseudomonas putida KT2440
gugugcccaccgcag

SEQ ID NO: 3601304 - RNA, 15 nt, Pseudomonas putida KT2440
gugugcucacgguga

SEQ ID NO: 3601305 - RNA, 14 nt, Pseudomonas putida KT2440
gugugcuccagcuc

SEQ ID NO: 3601306 - RNA, 16 nt, Pseudomonas putida KT2440
gugugcucgaggaagc

SEQ ID NO: 3601307 - RNA, 16 nt, Pseudomonas putida KT2440
gugugcucggcgaugc

SEQ ID NO: 3601308 - RNA, 18 nt, Pseudomonas putida KT2440
guguggccaaggcggcga

SEQ ID NO: 3601309 - RNA, 20 nt, Pseudomonas putida KT2440
guguggccacacugcucagu

SEQ ID NO: 3601310 - RNA, 15 nt, Pseudomonas putida KT2440
guguggccagugcca

SEQ ID NO: 3601311 - RNA, 13 nt, Pseudomonas putida KT2440
gugugggccuugc

SEQ ID NO: 3601312 - RNA, 16 nt, Pseudomonas putida KT2440
gugugggggcggccuc

SEQ ID NO: 3601313 - RNA, 14 nt, Pseudomonas putida KT2440
guguggugcggcug

SEQ ID NO: 3601314 - RNA, 15 nt, Pseudomonas putida KT2440
guguggugcggcugg

SEQ ID NO: 3601315 - RNA, 12 nt, Pseudomonas putida KT2440
guguuccagcac

SEQ ID NO: 3601316 - RNA, 21 nt, Pseudomonas putida KT2440
guguucccagcaccccagcac

SEQ ID NO: 3601317 - RNA, 14 nt, Pseudomonas putida KT2440
guguucgcgggcau

SEQ ID NO: 3601318 - RNA, 18 nt, Pseudomonas putida KT2440
guguucgggguguggcca

SEQ ID NO: 3601319 - RNA, 19 nt, Pseudomonas putida KT2440
guguucuaccgcguuggac

SEQ ID NO: 3601320 - RNA, 21 nt, Pseudomonas putida KT2440
guguucuaccgcguuggacac

SEQ ID NO: 3601321 - RNA, 22 nt, Pseudomonas putida KT2440
guguucuucauauccgcuuugc

SEQ ID NO: 3601322 - RNA, 14 nt, Pseudomonas putida KT2440
guguugcugggcga

SEQ ID NO: 3601323 - RNA, 19 nt, Pseudomonas putida KT2440
guguuggaugcuucgcggg

SEQ ID NO: 3601324 - RNA, 16 nt, Pseudomonas putida KT2440
guguugucugugcccg

SEQ ID NO: 3601325 - RNA, 13 nt, Pseudomonas putida KT2440
guguuugaagcua

SEQ ID NO: 3601326 - RNA, 22 nt, Pseudomonas putida KT2440
guguuugaccaccagacgggca

SEQ ID NO: 3601327 - RNA, 18 nt, Pseudomonas putida KT2440
guguuuugccuccagcuu

SEQ ID NO: 3601328 - RNA, 22 nt, Pseudomonas putida KT2440
guuacacccauguugucaccca

SEQ ID NO: 3601329 - RNA, 15 nt, Pseudomonas putida KT2440
guuacccagguagau

SEQ ID NO: 3601330 - RNA, 15 nt, Pseudomonas putida KT2440
guuacccaucugcuc

SEQ ID NO: 3601331 - RNA, 22 nt, Pseudomonas putida KT2440
guuacccucggcaucgaacagc

SEQ ID NO: 3601332 - RNA, 15 nt, Pseudomonas putida KT2440
guuaccucccgcaca

SEQ ID NO: 3601333 - RNA, 16 nt, Pseudomonas putida KT2440
guuacgcaacuccacg

SEQ ID NO: 3601334 - RNA, 14 nt, Pseudomonas putida KT2440
guuacgccaggcgu

SEQ ID NO: 3601335 - RNA, 14 nt, Pseudomonas putida KT2440
guuacgcccggcaa

SEQ ID NO: 3601336 - RNA, 15 nt, Pseudomonas putida KT2440
guuacgcccggcaau

SEQ ID NO: 3601337 - RNA, 23 nt, Pseudomonas putida KT2440
guuacgccguugucacgcgccag

SEQ ID NO: 3601338 - RNA, 18 nt, Pseudomonas putida KT2440
guuacggcggccugcugc

SEQ ID NO: 3601339 - RNA, 17 nt, Pseudomonas putida KT2440
guuacguaagucaggcc

SEQ ID NO: 3601340 - RNA, 17 nt, Pseudomonas putida KT2440
guuacuauuaaccgcuu

SEQ ID NO: 3601341 - RNA, 23 nt, Pseudomonas putida KT2440
guuacuggccaauugcgccauca

SEQ ID NO: 3601342 - RNA, 16 nt, Pseudomonas putida KT2440
guuagcucaguuggua

SEQ ID NO: 3601343 - RNA, 16 nt, Pseudomonas putida KT2440
guuaguucgugcaccc

SEQ ID NO: 3601344 - RNA, 18 nt, Pseudomonas putida KT2440
guuauacgccgccgaggc

SEQ ID NO: 3601345 - RNA, 12 nt, Pseudomonas putida KT2440
guuauccagcac

SEQ ID NO: 3601346 - RNA, 16 nt, Pseudomonas putida KT2440
guuauccagcugcaac

SEQ ID NO: 3601347 - RNA, 17 nt, Pseudomonas putida KT2440
guuauccagcugcaaca

SEQ ID NO: 3601348 - RNA, 18 nt, Pseudomonas putida KT2440
guuauccagcugcaacag

SEQ ID NO: 3601349 - RNA, 16 nt, Pseudomonas putida KT2440
guuauccugcagcacc

SEQ ID NO: 3601350 - RNA, 16 nt, Pseudomonas putida KT2440
guuaugacuggccucg

SEQ ID NO: 3601351 - RNA, 18 nt, Pseudomonas putida KT2440
guuauuugugaaacacca

SEQ ID NO: 3601352 - RNA, 15 nt, Pseudomonas putida KT2440
guucaacacuguccc

SEQ ID NO: 3601353 - RNA, 14 nt, Pseudomonas putida KT2440
guucaacagccgcg

SEQ ID NO: 3601354 - RNA, 16 nt, Pseudomonas putida KT2440
guucaacuucgguggc

SEQ ID NO: 3601355 - RNA, 13 nt, Pseudomonas putida KT2440
guucaagggcagg

SEQ ID NO: 3601356 - RNA, 13 nt, Pseudomonas putida KT2440
guucacaucgccc

SEQ ID NO: 3601357 - RNA, 20 nt, Pseudomonas putida KT2440
guucacccgcgaaagggcca

SEQ ID NO: 3601358 - RNA, 18 nt, Pseudomonas putida KT2440
guucaccguacccaggug

SEQ ID NO: 3601359 - RNA, 15 nt, Pseudomonas putida KT2440
guucaccuugggcga

SEQ ID NO: 3601360 - RNA, 15 nt, Pseudomonas putida KT2440
guucacgcaggcgca

SEQ ID NO: 3601361 - RNA, 14 nt, Pseudomonas putida KT2440
guucacggucaggc

SEQ ID NO: 3601362 - RNA, 11 nt, Pseudomonas putida KT2440
guucagcagcg

SEQ ID NO: 3601363 - RNA, 18 nt, Pseudomonas putida KT2440
guugaccguccacaccga

SEQ ID NO: 3601364 - RNA, 18 nt, Pseudomonas putida KT2440
guugaccguguugcagcg

SEQ ID NO: 3601365 - RNA, 20 nt, Pseudomonas putida KT2440
guugacggugaagaguggau

SEQ ID NO: 3601366 - RNA, 24 nt, Pseudomonas putida KT2440
guugacguuguagcggccaucgca

SEQ ID NO: 3601367 - RNA, 22 nt, Pseudomonas putida KT2440
guugagcacacgguaguccugc

SEQ ID NO: 3601368 - RNA, 19 nt, Pseudomonas putida KT2440
guugagcacgaaacugcgc

SEQ ID NO: 3601369 - RNA, 23 nt, Pseudomonas putida KT2440
guugagugggguggaaguuccug

SEQ ID NO: 3601370 - RNA, 24 nt, Pseudomonas putida KT2440
guugagugggguggaaguuccugc

SEQ ID NO: 3601371 - RNA, 20 nt, Pseudomonas putida KT2440
guugaucagcgacaccgcca

SEQ ID NO: 3601372 - RNA, 18 nt, Pseudomonas putida KT2440
guugauccaggcuuggcg

SEQ ID NO: 3601373 - RNA, 23 nt, Pseudomonas putida KT2440
guugauccggcacuccagcgagu

SEQ ID NO: 3601374 - RNA, 22 nt, Pseudomonas putida KT2440
guugaucgcuugucuccauguc

SEQ ID NO: 3601375 - RNA, 17 nt, Pseudomonas putida KT2440
guugaugccacgggcaa

SEQ ID NO: 3601376 - RNA, 19 nt, Pseudomonas putida KT2440
guugaugcgcuugaaguga

SEQ ID NO: 3601377 - RNA, 24 nt, Pseudomonas putida KT2440
guugcacgucauaguuguggcaac

SEQ ID NO: 3601378 - RNA, 19 nt, Pseudomonas putida KT2440
guugcagcacacuccacga

SEQ ID NO: 3601379 - RNA, 15 nt, Pseudomonas putida KT2440
guugcagccauagcc

SEQ ID NO: 3601380 - RNA, 14 nt, Pseudomonas putida KT2440
guugcaggucggca

SEQ ID NO: 3601381 - RNA, 12 nt, Pseudomonas putida KT2440
guugcaucgcgc

SEQ ID NO: 3601382 - RNA, 13 nt, Pseudomonas putida KT2440
guugccaccagca

SEQ ID NO: 3601383 - RNA, 24 nt, Pseudomonas putida KT2440
guugccacccagaucaucaucggc

SEQ ID NO: 3601384 - RNA, 21 nt, Pseudomonas putida KT2440
guugccauugaggcuguggcc

SEQ ID NO: 3601385 - RNA, 16 nt, Pseudomonas putida KT2440
guugcccgacaccuca

SEQ ID NO: 3601386 - RNA, 14 nt, Pseudomonas putida KT2440
guugcccggcauga

SEQ ID NO: 3601387 - RNA, 13 nt, Pseudomonas putida KT2440
guugcccggcgag

SEQ ID NO: 3601388 - RNA, 19 nt, Pseudomonas putida KT2440
guugcccucggccaccugg

SEQ ID NO: 3601389 - RNA, 20 nt, Pseudomonas putida KT2440
guugccgaugaugcgggcaa

SEQ ID NO: 3601390 - RNA, 13 nt, Pseudomonas putida KT2440
guugccgccagcc

SEQ ID NO: 3601391 - RNA, 19 nt, Pseudomonas putida KT2440
guugccggcgagcgcgugc

SEQ ID NO: 3601392 - RNA, 16 nt, Pseudomonas putida KT2440
guugccugugcuggcc

SEQ ID NO: 3601393 - RNA, 17 nt, Pseudomonas putida KT2440
guugcgaagcggccuga

SEQ ID NO: 3601394 - RNA, 16 nt, Pseudomonas putida KT2440
guugcgagcgaacagc

SEQ ID NO: 3601395 - RNA, 19 nt, Pseudomonas putida KT2440
guugcgaugggcugcaaag

SEQ ID NO: 3601396 - RNA, 20 nt, Pseudomonas putida KT2440
guugcgcagccggccuugcu

SEQ ID NO: 3601397 - RNA, 20 nt, Pseudomonas putida KT2440
guugcgcucaaccgaccugc

SEQ ID NO: 3601398 - RNA, 16 nt, Pseudomonas putida KT2440
guugcgcucgucgaac

SEQ ID NO: 3601399 - RNA, 14 nt, Pseudomonas putida KT2440
guugcgcugggcgu

SEQ ID NO: 3601400 - RNA, 20 nt, Pseudomonas putida KT2440
guugcggaacauacgcauca

SEQ ID NO: 3601401 - RNA, 17 nt, Pseudomonas putida KT2440
guugcggcccuucgcgg

SEQ ID NO: 3601402 - RNA, 21 nt, Pseudomonas putida KT2440
guugcggcccuucgcgggcac

SEQ ID NO: 3601403 - RNA, 20 nt, Pseudomonas putida KT2440
guugcggucgguggucagcu

SEQ ID NO: 3601404 - RNA, 14 nt, Pseudomonas putida KT2440
guugcggugaggug

SEQ ID NO: 3601405 - RNA, 15 nt, Pseudomonas putida KT2440
guugcguugcagcuu

SEQ ID NO: 3601406 - RNA, 16 nt, Pseudomonas putida KT2440
guugcugauguuggcc

SEQ ID NO: 3601407 - RNA, 17 nt, Pseudomonas putida KT2440
guugcugccgaucaccg

SEQ ID NO: 3601408 - RNA, 18 nt, Pseudomonas putida KT2440
guugcuggcgacgcugcc

SEQ ID NO: 3601409 - RNA, 21 nt, Pseudomonas putida KT2440
guugcuguuguagggggaggg

SEQ ID NO: 3601410 - RNA, 17 nt, Pseudomonas putida KT2440
guugcuugucccaggcc

SEQ ID NO: 3601411 - RNA, 14 nt, Pseudomonas putida KT2440
guugcuuucagcuc

SEQ ID NO: 3601412 - RNA, 23 nt, Pseudomonas putida KT2440
guuggacagcgcccggcgcagca

SEQ ID NO: 3601413 - RNA, 14 nt, Pseudomonas putida KT2440
guuggcacguugcu

SEQ ID NO: 3601414 - RNA, 19 nt, Pseudomonas putida KT2440
guuggcacguugcugccug

SEQ ID NO: 3601415 - RNA, 21 nt, Pseudomonas putida KT2440
guuggccaaaccguccaggua

SEQ ID NO: 3601416 - RNA, 16 nt, Pseudomonas putida KT2440
guuggccagcaugaca

SEQ ID NO: 3601417 - RNA, 17 nt, Pseudomonas putida KT2440
guuggccagcaugacag

SEQ ID NO: 3601418 - RNA, 19 nt, Pseudomonas putida KT2440
guuggccaucugguugcug

SEQ ID NO: 3601419 - RNA, 23 nt, Pseudomonas putida KT2440
guuggcccgccaauacccacguc

SEQ ID NO: 3601420 - RNA, 22 nt, Pseudomonas putida KT2440
guuggcccugaacuuggccucc

SEQ ID NO: 3601421 - RNA, 14 nt, Pseudomonas putida KT2440
guuggccggcaugg

SEQ ID NO: 3601422 - RNA, 19 nt, Pseudomonas putida KT2440
guuggcgcgaauuuccggg

SEQ ID NO: 3601423 - RNA, 13 nt, Pseudomonas putida KT2440
guuggcggagcca

SEQ ID NO: 3601424 - RNA, 21 nt, Pseudomonas putida KT2440
guuggcggagccagccacaga

SEQ ID NO: 3601425 - RNA, 16 nt, Pseudomonas putida KT2440
guuggcggucgagcuu

SEQ ID NO: 3601426 - RNA, 14 nt, Pseudomonas putida KT2440
guuggcucugugga

SEQ ID NO: 3601427 - RNA, 17 nt, Pseudomonas putida KT2440
guuggcuuguccagcca

SEQ ID NO: 3601428 - RNA, 16 nt, Pseudomonas putida KT2440
guugggcaagugcgug

SEQ ID NO: 3601429 - RNA, 12 nt, Pseudomonas putida KT2440
guugggcacgaa

SEQ ID NO: 3601430 - RNA, 14 nt, Pseudomonas putida KT2440
guugggcagggugu

SEQ ID NO: 3601431 - RNA, 22 nt, Pseudomonas putida KT2440
guuggucaccacguugcgcuug

SEQ ID NO: 3601432 - RNA, 19 nt, Pseudomonas putida KT2440
guuggucagcgacugccaa

SEQ ID NO: 3601433 - RNA, 22 nt, Pseudomonas putida KT2440
guuggugccggucggcguccac

SEQ ID NO: 3601434 - RNA, 21 nt, Pseudomonas putida KT2440
guuggugcgccuccagcagcg

SEQ ID NO: 3601435 - RNA, 16 nt, Pseudomonas putida KT2440
guuggugggcaaccag

SEQ ID NO: 3601436 - RNA, 13 nt, Pseudomonas putida KT2440
guugguguccuug

SEQ ID NO: 3601437 - RNA, 14 nt, Pseudomonas putida KT2440
guugguguccuugu

SEQ ID NO: 3601438 - RNA, 16 nt, Pseudomonas putida KT2440
guuguaccgaaguuca

SEQ ID NO: 3601439 - RNA, 15 nt, Pseudomonas putida KT2440
guuguagaucgccgg

SEQ ID NO: 3601440 - RNA, 19 nt, Pseudomonas putida KT2440
guuguaguccaugaucucc

SEQ ID NO: 3601441 - RNA, 21 nt, Pseudomonas putida KT2440
guuguauugccggggcugcuu

SEQ ID NO: 3601442 - RNA, 15 nt, Pseudomonas putida KT2440
guugucacccagcac

SEQ ID NO: 3601443 - RNA, 18 nt, Pseudomonas putida KT2440
guuguccaccccacccuc

SEQ ID NO: 3601444 - RNA, 13 nt, Pseudomonas putida KT2440
guuguccaccuga

SEQ ID NO: 3601445 - RNA, 12 nt, Pseudomonas putida KT2440
guuguccagcag

SEQ ID NO: 3601446 - RNA, 14 nt, Pseudomonas putida KT2440
guuguccagcagca

SEQ ID NO: 3601447 - RNA, 15 nt, Pseudomonas putida KT2440
guuguccagcagcag

SEQ ID NO: 3601448 - RNA, 19 nt, Pseudomonas putida KT2440
guuguccagcagcagcgca

SEQ ID NO: 3601449 - RNA, 21 nt, Pseudomonas putida KT2440
guuguccagcagcagcgcacc

SEQ ID NO: 3601450 - RNA, 13 nt, Pseudomonas putida KT2440
guuguccagcagg

SEQ ID NO: 3601451 - RNA, 20 nt, Pseudomonas putida KT2440
guugucgaacagcauccagc

SEQ ID NO: 3601452 - RNA, 20 nt, Pseudomonas putida KT2440
guugucgccuuucaggucga

SEQ ID NO: 3601453 - RNA, 13 nt, Pseudomonas putida KT2440
guugucgcgagug

SEQ ID NO: 3601454 - RNA, 14 nt, Pseudomonas putida KT2440
guuguggugagccc

SEQ ID NO: 3601455 - RNA, 22 nt, Pseudomonas putida KT2440
guuguucggcaggcucugcucc

SEQ ID NO: 3601456 - RNA, 21 nt, Pseudomonas putida KT2440
guuguuugucaccccguucgc

SEQ ID NO: 3601457 - RNA, 14 nt, Pseudomonas putida KT2440
guuuacccgcgaac

SEQ ID NO: 3601458 - RNA, 17 nt, Pseudomonas putida KT2440
guuuacccgcgaacagg

SEQ ID NO: 3601459 - RNA, 20 nt, Pseudomonas putida KT2440
guuuacccgcgaagaagcca

SEQ ID NO: 3601460 - RNA, 20 nt, Pseudomonas putida KT2440
guuuacccgcgaagaggccg

SEQ ID NO: 3601461 - RNA, 20 nt, Pseudomonas putida KT2440
guuuacccgcgaaugggccg

SEQ ID NO: 3601462 - RNA, 16 nt, Pseudomonas putida KT2440
guuuaccuccaucacc

SEQ ID NO: 3601463 - RNA, 18 nt, Pseudomonas putida KT2440
guuuagaucgcuaucuga

SEQ ID NO: 3601464 - RNA, 19 nt, Pseudomonas putida KT2440
guuuaguccugcagcggca

SEQ ID NO: 3601465 - RNA, 17 nt, Pseudomonas putida KT2440
guuucaaaaacggugca

SEQ ID NO: 3601466 - RNA, 23 nt, Pseudomonas putida KT2440
guuucaacggguaguugcccggg

SEQ ID NO: 3601467 - RNA, 22 nt, Pseudomonas putida KT2440
guuucacccuugggcucagccg

SEQ ID NO: 3601468 - RNA, 14 nt, Pseudomonas putida KT2440
uaagcccgcuccua

SEQ ID NO: 3601469 - RNA, 19 nt, Pseudomonas putida KT2440
uaagccggcggccaucgcu

SEQ ID NO: 3601470 - RNA, 17 nt, Pseudomonas putida KT2440
uaagcgaaacaccagca

SEQ ID NO: 3601471 - RNA, 19 nt, Pseudomonas putida KT2440
uaagcgccaccaccgcuga

SEQ ID NO: 3601472 - RNA, 15 nt, Pseudomonas putida KT2440
uaagcgcugcgcagg

SEQ ID NO: 3601473 - RNA, 15 nt, Pseudomonas putida KT2440
uaaggaaaaucagcu

SEQ ID NO: 3601474 - RNA, 19 nt, Pseudomonas putida KT2440
uaaggaucaugaacgagga

SEQ ID NO: 3601475 - RNA, 16 nt, Pseudomonas putida KT2440
uaaggaucgcgcagca

SEQ ID NO: 3601476 - RNA, 13 nt, Pseudomonas putida KT2440
uaaggcagcagcu

SEQ ID NO: 3601477 - RNA, 19 nt, Pseudomonas putida KT2440
uaagguugcuccugcaggu

SEQ ID NO: 3601478 - RNA, 15 nt, Pseudomonas putida KT2440
uaaguuugcccagcg

SEQ ID NO: 3601479 - RNA, 14 nt, Pseudomonas putida KT2440
uaauaaaaaaagag

SEQ ID NO: 3601480 - RNA, 12 nt, Pseudomonas putida KT2440
uaauacgcugug

SEQ ID NO: 3601481 - RNA, 16 nt, Pseudomonas putida KT2440
uaauacugcuuccagg

SEQ ID NO: 3601482 - RNA, 15 nt, Pseudomonas putida KT2440
uaaucagcaacgccc

SEQ ID NO: 3601483 - RNA, 13 nt, Pseudomonas putida KT2440
uaauccagcugcu

SEQ ID NO: 3601484 - RNA, 13 nt, Pseudomonas putida KT2440
uaauccaucacca

SEQ ID NO: 3601485 - RNA, 16 nt, Pseudomonas putida KT2440
uaauccaucaccacaa

SEQ ID NO: 3601486 - RNA, 23 nt, Pseudomonas putida KT2440
uaauccaucaccacaaaaccuuc

SEQ ID NO: 3601487 - RNA, 18 nt, Pseudomonas putida KT2440
uaauccucguccagcucg

SEQ ID NO: 3601488 - RNA, 15 nt, Pseudomonas putida KT2440
uaaucgacaaagcuc

SEQ ID NO: 3601489 - RNA, 20 nt, Pseudomonas putida KT2440
uaaucgccaggcccagcccc

SEQ ID NO: 3601490 - RNA, 16 nt, Pseudomonas putida KT2440
uaaucugccggcgccu

SEQ ID NO: 3601491 - RNA, 22 nt, Pseudomonas putida KT2440
uaaucugccggcgccuccagca

SEQ ID NO: 3601492 - RNA, 20 nt, Pseudomonas putida KT2440
uaaugaccuggaucgccagg

SEQ ID NO: 3601493 - RNA, 16 nt, Pseudomonas putida KT2440
uaaugcgcacggcuuc

SEQ ID NO: 3601494 - RNA, 12 nt, Pseudomonas putida KT2440
uaauggccggcu

SEQ ID NO: 3601495 - RNA, 16 nt, Pseudomonas putida KT2440
uaauuccugugggagc

SEQ ID NO: 3601496 - RNA, 18 nt, Pseudomonas putida KT2440
uaauugugcccuugaacg

SEQ ID NO: 3601497 - RNA, 14 nt, Pseudomonas putida KT2440
uacaaagcggcgcg

SEQ ID NO: 3601498 - RNA, 14 nt, Pseudomonas putida KT2440
uacaacaacaaaaa

SEQ ID NO: 3601499 - RNA, 16 nt, Pseudomonas putida KT2440
uacaacaacaaaaaaa

SEQ ID NO: 3601500 - RNA, 18 nt, Pseudomonas putida KT2440
uacaacaacaaaaaaaac

SEQ ID NO: 3601501 - RNA, 19 nt, Pseudomonas putida KT2440
uacaacaacaaaaaaaacg

SEQ ID NO: 3601502 - RNA, 14 nt, Pseudomonas putida KT2440
uacaacgucacaug

SEQ ID NO: 3601503 - RNA, 17 nt, Pseudomonas putida KT2440
uacaacugccacccucc

SEQ ID NO: 3601504 - RNA, 20 nt, Pseudomonas putida KT2440
uacaagcuggcacgugcagg

SEQ ID NO: 3601505 - RNA, 14 nt, Pseudomonas putida KT2440
uacaaggaccucaa

SEQ ID NO: 3601506 - RNA, 15 nt, Pseudomonas putida KT2440
uacaaggcucaacua

SEQ ID NO: 3601507 - RNA, 21 nt, Pseudomonas putida KT2440
uacaagggccugugccgggcc

SEQ ID NO: 3601508 - RNA, 16 nt, Pseudomonas putida KT2440
uacaagugguuaaccu

SEQ ID NO: 3601509 - RNA, 14 nt, Pseudomonas putida KT2440
uacaaugcacuucu

SEQ ID NO: 3601510 - RNA, 13 nt, Pseudomonas putida KT2440
uacacagcccaag

SEQ ID NO: 3601511 - RNA, 22 nt, Pseudomonas putida KT2440
uacaccggccuggauaaucgcc

SEQ ID NO: 3601512 - RNA, 17 nt, Pseudomonas putida KT2440
uacacgguaugcaggua

SEQ ID NO: 3601513 - RNA, 22 nt, Pseudomonas putida KT2440
uacacuggcuuucccccagcca

SEQ ID NO: 3601514 - RNA, 13 nt, Pseudomonas putida KT2440
uacagaucagcca

SEQ ID NO: 3601515 - RNA, 16 nt, Pseudomonas putida KT2440
uacagaugcugcugca

SEQ ID NO: 3601516 - RNA, 13 nt, Pseudomonas putida KT2440
uacagcacgcgca

SEQ ID NO: 3601517 - RNA, 18 nt, Pseudomonas putida KT2440
uacagccccuuccccagg

SEQ ID NO: 3601518 - RNA, 20 nt, Pseudomonas putida KT2440
uacagccccuuccccaggcc

SEQ ID NO: 3601519 - RNA, 22 nt, Pseudomonas putida KT2440
uacagccccuuccccaggccgc

SEQ ID NO: 3601520 - RNA, 13 nt, Pseudomonas putida KT2440
uacagcgccucca

SEQ ID NO: 3601521 - RNA, 22 nt, Pseudomonas putida KT2440
uacagcgccuccagcaggggca

SEQ ID NO: 3601522 - RNA, 19 nt, Pseudomonas putida KT2440
uacagcgugguauugcgcg

SEQ ID NO: 3601523 - RNA, 19 nt, Pseudomonas putida KT2440
uacagcucccgcgcaugcu

SEQ ID NO: 3601524 - RNA, 23 nt, Pseudomonas putida KT2440
uacagcugcucaccauguuccag

SEQ ID NO: 3601525 - RNA, 17 nt, Pseudomonas putida KT2440
uacagcuugcccaucac

SEQ ID NO: 3601526 - RNA, 21 nt, Pseudomonas putida KT2440
uacagcuugcccaucaccucg

SEQ ID NO: 3601527 - RNA, 13 nt, Pseudomonas putida KT2440
uacaggaccaggc

SEQ ID NO: 3601528 - RNA, 14 nt, Pseudomonas putida KT2440
uacaggaccaggcc

SEQ ID NO: 3601529 - RNA, 17 nt, Pseudomonas putida KT2440
uacaggcaaccgcaucc

SEQ ID NO: 3601530 - RNA, 19 nt, Pseudomonas putida KT2440
uacaggcugccgccgaaca

SEQ ID NO: 3601531 - RNA, 19 nt, Pseudomonas putida KT2440
uacagguagugcgcggccg

SEQ ID NO: 3601532 - RNA, 15 nt, Pseudomonas putida KT2440
uacagguuguaaaca

SEQ ID NO: 3601533 - RNA, 22 nt, Pseudomonas putida KT2440
uacauagcaggaucuagcccaa

SEQ ID NO: 3601534 - RNA, 17 nt, Pseudomonas putida KT2440
uacauccagcuccagca

SEQ ID NO: 3601535 - RNA, 15 nt, Pseudomonas putida KT2440
uacauccaugccuag

SEQ ID NO: 3601536 - RNA, 19 nt, Pseudomonas putida KT2440
uacauccgcguccccuuca

SEQ ID NO: 3601537 - RNA, 15 nt, Pseudomonas putida KT2440
uaccaacaccggcga

SEQ ID NO: 3601538 - RNA, 17 nt, Pseudomonas putida KT2440
uaccaacaccggcgaug

SEQ ID NO: 3601539 - RNA, 17 nt, Pseudomonas putida KT2440
uaccaaggcgguggagu

SEQ ID NO: 3601540 - RNA, 22 nt, Pseudomonas putida KT2440
uaccaaggcgguggaguaccug

SEQ ID NO: 3601541 - RNA, 15 nt, Pseudomonas putida KT2440
uaccacacaccccag

SEQ ID NO: 3601542 - RNA, 19 nt, Pseudomonas putida KT2440
uaccacacaccccagaacg

SEQ ID NO: 3601543 - RNA, 22 nt, Pseudomonas putida KT2440
uaccacacgaauggguggcagc

SEQ ID NO: 3601544 - RNA, 22 nt, Pseudomonas putida KT2440
uaccacacguuguccgacagcu

SEQ ID NO: 3601545 - RNA, 20 nt, Pseudomonas putida KT2440
uaccaccugggcgcuuugca

SEQ ID NO: 3601546 - RNA, 15 nt, Pseudomonas putida KT2440
uaccacguuauccag

SEQ ID NO: 3601547 - RNA, 19 nt, Pseudomonas putida KT2440
uaccacuuccaacacccgg

SEQ ID NO: 3601548 - RNA, 13 nt, Pseudomonas putida KT2440
uaccagacgcagg

SEQ ID NO: 3601549 - RNA, 17 nt, Pseudomonas putida KT2440
uaccagacgcaggcaaa

SEQ ID NO: 3601550 - RNA, 13 nt, Pseudomonas putida KT2440
uaccagcaccauc

SEQ ID NO: 3601551 - RNA, 12 nt, Pseudomonas putida KT2440
uaccagcagcac

SEQ ID NO: 3601552 - RNA, 20 nt, Pseudomonas putida KT2440
uaccagcaguuggcugccgg

SEQ ID NO: 3601553 - RNA, 16 nt, Pseudomonas putida KT2440
uaccagcuugccgcgu

SEQ ID NO: 3601554 - RNA, 15 nt, Pseudomonas putida KT2440
uaccaggcccaacag

SEQ ID NO: 3601555 - RNA, 21 nt, Pseudomonas putida KT2440
uaccaggcccgcuauccucga

SEQ ID NO: 3601556 - RNA, 19 nt, Pseudomonas putida KT2440
uaccaggccuuucugcucg

SEQ ID NO: 3601557 - RNA, 16 nt, Pseudomonas putida KT2440
uaccaggucgccagca

SEQ ID NO: 3601558 - RNA, 17 nt, Pseudomonas putida KT2440
uaccaggucgccagcac

SEQ ID NO: 3601559 - RNA, 19 nt, Pseudomonas putida KT2440
uaccaggucgccagcacca

SEQ ID NO: 3601560 - RNA, 13 nt, Pseudomonas putida KT2440
uaccaugaaaaac

SEQ ID NO: 3601561 - RNA, 16 nt, Pseudomonas putida KT2440
uacccaaacucuugag

SEQ ID NO: 3601562 - RNA, 18 nt, Pseudomonas putida KT2440
uacccaacuccagcgcgg

SEQ ID NO: 3601563 - RNA, 20 nt, Pseudomonas putida KT2440
uacccaaggccagcccaugg

SEQ ID NO: 3601564 - RNA, 14 nt, Pseudomonas putida KT2440
uacccaauaaaaac

SEQ ID NO: 3601565 - RNA, 16 nt, Pseudomonas putida KT2440
uacccaauaaaaacaa

SEQ ID NO: 3601566 - RNA, 18 nt, Pseudomonas putida KT2440
uacccaauaaaaacaaca

SEQ ID NO: 3601567 - RNA, 14 nt, Pseudomonas putida KT2440
uacccaccagcucc

SEQ ID NO: 3601568 - RNA, 17 nt, Pseudomonas putida KT2440
uacccagcgcgcgcaga

SEQ ID NO: 3601569 - RNA, 19 nt, Pseudomonas putida KT2440
uacccagcucgaucagcug

SEQ ID NO: 3601570 - RNA, 21 nt, Pseudomonas putida KT2440
uacccaggccaacgauuggca

SEQ ID NO: 3601571 - RNA, 16 nt, Pseudomonas putida KT2440
uacccaggcgcgccug

SEQ ID NO: 3601572 - RNA, 21 nt, Pseudomonas putida KT2440
uacccaggcgcgccugcaccu

SEQ ID NO: 3601573 - RNA, 21 nt, Pseudomonas putida KT2440
uacccaggugaugcaggcaau

SEQ ID NO: 3601574 - RNA, 14 nt, Pseudomonas putida KT2440
uacuccaccgccag

SEQ ID NO: 3601575 - RNA, 13 nt, Pseudomonas putida KT2440
uacuccacuucca

SEQ ID NO: 3601576 - RNA, 21 nt, Pseudomonas putida KT2440
uacuccugcaccaugauguuc

SEQ ID NO: 3601577 - RNA, 18 nt, Pseudomonas putida KT2440
uacucgcccgccagguag

SEQ ID NO: 3601578 - RNA, 24 nt, Pseudomonas putida KT2440
uacucggcacgcgcccggugcaag

SEQ ID NO: 3601579 - RNA, 13 nt, Pseudomonas putida KT2440
uacugacugacgu

SEQ ID NO: 3601580 - RNA, 21 nt, Pseudomonas putida KT2440
uacugcgccggccaaguggcc

SEQ ID NO: 3601581 - RNA, 16 nt, Pseudomonas putida KT2440
uacugcgucuuguagu

SEQ ID NO: 3601582 - RNA, 16 nt, Pseudomonas putida KT2440
uacugcugggucagca

SEQ ID NO: 3601583 - RNA, 12 nt, Pseudomonas putida KT2440
uacugcuuccag

SEQ ID NO: 3601584 - RNA, 19 nt, Pseudomonas putida KT2440
uacuggaagagcaggaaga

SEQ ID NO: 3601585 - RNA, 20 nt, Pseudomonas putida KT2440
uacuggaagagcaggaagau

SEQ ID NO: 3601586 - RNA, 14 nt, Pseudomonas putida KT2440
uacuggccauccag

SEQ ID NO: 3601587 - RNA, 12 nt, Pseudomonas putida KT2440
uacuggccgcug

SEQ ID NO: 3601588 - RNA, 23 nt, Pseudomonas putida KT2440
uacuggccgcugaaccucaccgc

SEQ ID NO: 3601589 - RNA, 21 nt, Pseudomonas putida KT2440
uacuggcuucgaugaaggcug

SEQ ID NO: 3601590 - RNA, 16 nt, Pseudomonas putida KT2440
uacuugcaggugcagg

SEQ ID NO: 3601591 - RNA, 16 nt, Pseudomonas putida KT2440
uacuugcugcagggca

SEQ ID NO: 3601592 - RNA, 16 nt, Pseudomonas putida KT2440
uacuuggccaucagcu

SEQ ID NO: 3601593 - RNA, 22 nt, Pseudomonas putida KT2440
uacuuggcgccgcccuggaugc

SEQ ID NO: 3601594 - RNA, 18 nt, Pseudomonas putida KT2440
uacuugugugccugcucc

SEQ ID NO: 3601595 - RNA, 17 nt, Pseudomonas putida KT2440
uagaacaagccccuccu

SEQ ID NO: 3601596 - RNA, 20 nt, Pseudomonas putida KT2440
uagaacaagccccuccuaag

SEQ ID NO: 3601597 - RNA, 12 nt, Pseudomonas putida KT2440
uagaacacccgc

SEQ ID NO: 3601598 - RNA, 13 nt, Pseudomonas putida KT2440
uagaacggcagca

SEQ ID NO: 3601599 - RNA, 18 nt, Pseudomonas putida KT2440
uagaacggcagcaggcca

SEQ ID NO: 3601600 - RNA, 14 nt, Pseudomonas putida KT2440
uagaacuggcgcag

SEQ ID NO: 3601601 - RNA, 15 nt, Pseudomonas putida KT2440
uagaacuggcgcagc

SEQ ID NO: 3601602 - RNA, 18 nt, Pseudomonas putida KT2440
uagaagcagaucaucaug

SEQ ID NO: 3601603 - RNA, 19 nt, Pseudomonas putida KT2440
uagaagcuuggggcgaugu

SEQ ID NO: 3601604 - RNA, 21 nt, Pseudomonas putida KT2440
uagaauagccggccucagcag

SEQ ID NO: 3601605 - RNA, 19 nt, Pseudomonas putida KT2440
uagacaugaggcccucccc

SEQ ID NO: 3601606 - RNA, 13 nt, Pseudomonas putida KT2440
uagaccaccagcg

SEQ ID NO: 3601607 - RNA, 22 nt, Pseudomonas putida KT2440
uagaccugcguugcccccagcc

SEQ ID NO: 3601608 - RNA, 13 nt, Pseudomonas putida KT2440
uagauaucaagca

SEQ ID NO: 3601609 - RNA, 13 nt, Pseudomonas putida KT2440
uagaucacaccgg

SEQ ID NO: 3601610 - RNA, 15 nt, Pseudomonas putida KT2440
uagaucacaccggcc

SEQ ID NO: 3601611 - RNA, 23 nt, Pseudomonas putida KT2440
uagaucacaccggccgccaggau

SEQ ID NO: 3601612 - RNA, 15 nt, Pseudomonas putida KT2440
uagaucagcgaugcc

SEQ ID NO: 3601613 - RNA, 18 nt, Pseudomonas putida KT2440
uagaucgccggcagcacg

SEQ ID NO: 3601614 - RNA, 13 nt, Pseudomonas putida KT2440
uagaucugcucuu

SEQ ID NO: 3601615 - RNA, 13 nt, Pseudomonas putida KT2440
uagauggcugucu

SEQ ID NO: 3601616 - RNA, 23 nt, Pseudomonas putida KT2440
uagauguccagcgucugcuugcc

SEQ ID NO: 3601617 - RNA, 17 nt, Pseudomonas putida KT2440
uagcacaagggccaggu

SEQ ID NO: 3601618 - RNA, 22 nt, Pseudomonas putida KT2440
uagcaccagcgggcccagcagg

SEQ ID NO: 3601619 - RNA, 20 nt, Pseudomonas putida KT2440
uagcaccgguaccgcucugc

SEQ ID NO: 3601620 - RNA, 15 nt, Pseudomonas putida KT2440
uagcagaacagaaac

SEQ ID NO: 3601621 - RNA, 14 nt, Pseudomonas putida KT2440
uagcagcaccgauc

SEQ ID NO: 3601622 - RNA, 17 nt, Pseudomonas putida KT2440
uagcagcgcuaugccuu

SEQ ID NO: 3601623 - RNA, 16 nt, Pseudomonas putida KT2440
uagcaggcaagcccgc

SEQ ID NO: 3601624 - RNA, 21 nt, Pseudomonas putida KT2440
uagcagguaaacccgcgccug

SEQ ID NO: 3601625 - RNA, 17 nt, Pseudomonas putida KT2440
uagccaaucaucuugcc

SEQ ID NO: 3601626 - RNA, 13 nt, Pseudomonas putida KT2440
uagccacgcugcc

SEQ ID NO: 3601627 - RNA, 18 nt, Pseudomonas putida KT2440
uagccacgcugccaggac

SEQ ID NO: 3601628 - RNA, 17 nt, Pseudomonas putida KT2440
uagccagcuggccaccu

SEQ ID NO: 3601629 - RNA, 19 nt, Pseudomonas putida KT2440
uagccauuccggcugcagc

SEQ ID NO: 3601630 - RNA, 16 nt, Pseudomonas putida KT2440
uagcccaccaccuucu

SEQ ID NO: 3601631 - RNA, 16 nt, Pseudomonas putida KT2440
uagcccaccaggucau

SEQ ID NO: 3601632 - RNA, 13 nt, Pseudomonas putida KT2440
uagcccaccuuca

SEQ ID NO: 3601633 - RNA, 13 nt, Pseudomonas putida KT2440
uagccccgaggaa

SEQ ID NO: 3601634 - RNA, 13 nt, Pseudomonas putida KT2440
uagccgccagcau

SEQ ID NO: 3601635 - RNA, 19 nt, Pseudomonas putida KT2440
uagccgcuuucggucaggg

SEQ ID NO: 3601636 - RNA, 15 nt, Pseudomonas putida KT2440
uagccguacuugguc

SEQ ID NO: 3601637 - RNA, 22 nt, Pseudomonas putida KT2440
uagccguggggcucgcgcaaca

SEQ ID NO: 3601638 - RNA, 20 nt, Pseudomonas putida KT2440
uagccguuugaagccaaccc

SEQ ID NO: 3601639 - RNA, 13 nt, Pseudomonas putida KT2440
uagccucaucaga

SEQ ID NO: 3601640 - RNA, 14 nt, Pseudomonas putida KT2440
uagccucaucagag

SEQ ID NO: 3601641 - RNA, 21 nt, Pseudomonas putida KT2440
uagccugcaaacgccgcucga

SEQ ID NO: 3601642 - RNA, 16 nt, Pseudomonas putida KT2440
uagccugcacuggccu

SEQ ID NO: 3601643 - RNA, 17 nt, Pseudomonas putida KT2440
uagccugcugacgcagg

SEQ ID NO: 3601644 - RNA, 15 nt, Pseudomonas putida KT2440
uagccuguggggcaa

SEQ ID NO: 3601645 - RNA, 20 nt, Pseudomonas putida KT2440
uagccuguggggcaacugcg

SEQ ID NO: 3601646 - RNA, 21 nt, Pseudomonas putida KT2440
uagccuucagcggccgcgcaa

SEQ ID NO: 3601647 - RNA, 16 nt, Pseudomonas putida KT2440
uagcgagcaccggcag

SEQ ID NO: 3601648 - RNA, 16 nt, Pseudomonas putida KT2440
uagcgauugcggccua

SEQ ID NO: 3601649 - RNA, 17 nt, Pseudomonas putida KT2440
uagcgcaacaccgccau

SEQ ID NO: 3601650 - RNA, 15 nt, Pseudomonas putida KT2440
uagcgcacugagcaa

SEQ ID NO: 3601651 - RNA, 16 nt, Pseudomonas putida KT2440
uagcgcacuugcacuu

SEQ ID NO: 3601652 - RNA, 15 nt, Pseudomonas putida KT2440
uagcgcucgcgcagg

SEQ ID NO: 3601653 - RNA, 19 nt, Pseudomonas putida KT2440
uagcgcucuuugccacuca

SEQ ID NO: 3601654 - RNA, 14 nt, Pseudomonas putida KT2440
uagcgcuugaaguu

SEQ ID NO: 3601655 - RNA, 15 nt, Pseudomonas putida KT2440
uagcgcuuuuccagu

SEQ ID NO: 3601656 - RNA, 23 nt, Pseudomonas putida KT2440
uagcggcagcgacgauaccggcg

SEQ ID NO: 3601657 - RNA, 16 nt, Pseudomonas putida KT2440
uagcggccaacgcugc

SEQ ID NO: 3601658 - RNA, 17 nt, Pseudomonas putida KT2440
uagcggcggcaauggcg

SEQ ID NO: 3601659 - RNA, 12 nt, Pseudomonas putida KT2440
uagcggcugggc

SEQ ID NO: 3601660 - RNA, 19 nt, Pseudomonas putida KT2440
uagcgucgaugcggccaca

SEQ ID NO: 3601661 - RNA, 22 nt, Pseudomonas putida KT2440
uagcgugaagcggccaccugcc

SEQ ID NO: 3601662 - RNA, 17 nt, Pseudomonas putida KT2440
uagcucagguagaccug

SEQ ID NO: 3601663 - RNA, 21 nt, Pseudomonas putida KT2440
uagcucagucgguagagcaaa

SEQ ID NO: 3601664 - RNA, 15 nt, Pseudomonas putida KT2440
uagcugaccuuggac

SEQ ID NO: 3601665 - RNA, 21 nt, Pseudomonas putida KT2440
uagcugggcccgcccagcugg

SEQ ID NO: 3601666 - RNA, 16 nt, Pseudomonas putida KT2440
uagcuuggucucguug

SEQ ID NO: 3601667 - RNA, 13 nt, Pseudomonas putida KT2440
uaggacaccgccc

SEQ ID NO: 3601668 - RNA, 12 nt, Pseudomonas putida KT2440
uaggagcgggcu

SEQ ID NO: 3601669 - RNA, 21 nt, Pseudomonas putida KT2440
uaggagcgggcuuacccgcga

SEQ ID NO: 3601670 - RNA, 20 nt, Pseudomonas putida KT2440
uaggagcgggcuugcccgcg

SEQ ID NO: 3601671 - RNA, 21 nt, Pseudomonas putida KT2440
uaggagcgggcuugcccgcga

SEQ ID NO: 3601672 - RNA, 22 nt, Pseudomonas putida KT2440
uaggagcgggcuugcccgcgaa

SEQ ID NO: 3601673 - RNA, 20 nt, Pseudomonas putida KT2440
uaggagcgggucuacccgcg

SEQ ID NO: 3601674 - RNA, 22 nt, Pseudomonas putida KT2440
uaggagcggguucacccgcgaa

SEQ ID NO: 3601675 - RNA, 22 nt, Pseudomonas putida KT2440
uaggagcggguuuacccgcgaa

SEQ ID NO: 3601676 - RNA, 22 nt, Pseudomonas putida KT2440
uaggagcugauucagcacaccg

SEQ ID NO: 3601677 - RNA, 19 nt, Pseudomonas putida KT2440
uaggcaaacagcucgacaa

SEQ ID NO: 3601678 - RNA, 23 nt, Pseudomonas putida KT2440
uaggcacucggucggcuggcacu

SEQ ID NO: 3601679 - RNA, 16 nt, Pseudomonas putida KT2440
ucaaagaaccugggac

SEQ ID NO: 3601680 - RNA, 14 nt, Pseudomonas putida KT2440
ucaaagcagacagc

SEQ ID NO: 3601681 - RNA, 18 nt, Pseudomonas putida KT2440
ucaaagccugcuccagca

SEQ ID NO: 3601682 - RNA, 19 nt, Pseudomonas putida KT2440
ucaaagccugcuccagcac

SEQ ID NO: 3601683 - RNA, 14 nt, Pseudomonas putida KT2440
ucaaaggcagccuc

SEQ ID NO: 3601684 - RNA, 20 nt, Pseudomonas putida KT2440
ucaaagucgccuacaagggu

SEQ ID NO: 3601685 - RNA, 20 nt, Pseudomonas putida KT2440
ucaaauacucagaccaacaa

SEQ ID NO: 3601686 - RNA, 23 nt, Pseudomonas putida KT2440
ucaaauagaccucgagaauccgu

SEQ ID NO: 3601687 - RNA, 15 nt, Pseudomonas putida KT2440
ucaacaaaccgaccc

SEQ ID NO: 3601688 - RNA, 21 nt, Pseudomonas putida KT2440
ucaacaaaccgacccugcugc

SEQ ID NO: 3601689 - RNA, 13 nt, Pseudomonas putida KT2440
ucaacaaaucggc

SEQ ID NO: 3601690 - RNA, 21 nt, Pseudomonas putida KT2440
ucaacaauuuucgaccaaggc

SEQ ID NO: 3601691 - RNA, 22 nt, Pseudomonas putida KT2440
ucaacaauuuucgaccaaggcu

SEQ ID NO: 3601692 - RNA, 17 nt, Pseudomonas putida KT2440
ucaacaccagacucagc

SEQ ID NO: 3601693 - RNA, 12 nt, Pseudomonas putida KT2440
ucaacaccagca

SEQ ID NO: 3601694 - RNA, 21 nt, Pseudomonas putida KT2440
ucaacaccagcauguccugcu

SEQ ID NO: 3601695 - RNA, 23 nt, Pseudomonas putida KT2440
ucaacaccagcauguccugcugc

SEQ ID NO: 3601696 - RNA, 15 nt, Pseudomonas putida KT2440
ucaacagccacgccc

SEQ ID NO: 3601697 - RNA, 15 nt, Pseudomonas putida KT2440
ucaacagccgcggca

SEQ ID NO: 3601698 - RNA, 20 nt, Pseudomonas putida KT2440
ucaacagccgcggcacccaa

SEQ ID NO: 3601699 - RNA, 21 nt, Pseudomonas putida KT2440
ucaacagcgcgacgcagcagc

SEQ ID NO: 3601700 - RNA, 14 nt, Pseudomonas putida KT2440
ucaacagcuggcug

SEQ ID NO: 3601701 - RNA, 14 nt, Pseudomonas putida KT2440
ucaacaggcuggcc

SEQ ID NO: 3601702 - RNA, 13 nt, Pseudomonas putida KT2440
ucaaccaacuccu

SEQ ID NO: 3601703 - RNA, 14 nt, Pseudomonas putida KT2440
ucaaccacagcccg

SEQ ID NO: 3601704 - RNA, 14 nt, Pseudomonas putida KT2440
ucaaccagccgccu

SEQ ID NO: 3601705 - RNA, 23 nt, Pseudomonas putida KT2440
ucaaccccaggugcugaugccca

SEQ ID NO: 3601706 - RNA, 13 nt, Pseudomonas putida KT2440
ucaaccccaucac

SEQ ID NO: 3601707 - RNA, 20 nt, Pseudomonas putida KT2440
ucaacccucgcccagaaucu

SEQ ID NO: 3601708 - RNA, 19 nt, Pseudomonas putida KT2440
ucaaccgugguucuugccg

SEQ ID NO: 3601709 - RNA, 13 nt, Pseudomonas putida KT2440
ucaacgccgccag

SEQ ID NO: 3601710 - RNA, 19 nt, Pseudomonas putida KT2440
ucaacgccucccccacccc

SEQ ID NO: 3601711 - RNA, 20 nt, Pseudomonas putida KT2440
ucaacggcgcccgggccaug

SEQ ID NO: 3601712 - RNA, 17 nt, Pseudomonas putida KT2440
ucaacguucccaauguc

SEQ ID NO: 3601713 - RNA, 18 nt, Pseudomonas putida KT2440
ucaacguucccaauguca

SEQ ID NO: 3601714 - RNA, 14 nt, Pseudomonas putida KT2440
ucaacucggcagug

SEQ ID NO: 3601715 - RNA, 15 nt, Pseudomonas putida KT2440
ucaacucggcaguga

SEQ ID NO: 3601716 - RNA, 17 nt, Pseudomonas putida KT2440
ucaacucggcagugaac

SEQ ID NO: 3601717 - RNA, 12 nt, Pseudomonas putida KT2440
ucaacuggcagg

SEQ ID NO: 3601718 - RNA, 14 nt, Pseudomonas putida KT2440
ucaacuucccucug

SEQ ID NO: 3601719 - RNA, 22 nt, Pseudomonas putida KT2440
ucaacuucccucugccugccca

SEQ ID NO: 3601720 - RNA, 21 nt, Pseudomonas putida KT2440
ucaagaaaucgggucaucccc

SEQ ID NO: 3601721 - RNA, 17 nt, Pseudomonas putida KT2440
ucaagaauuucuaccaa

SEQ ID NO: 3601722 - RNA, 22 nt, Pseudomonas putida KT2440
ucaagaggagugcuucauagcc

SEQ ID NO: 3601723 - RNA, 19 nt, Pseudomonas putida KT2440
ucaagauagaccuugccag

SEQ ID NO: 3601724 - RNA, 20 nt, Pseudomonas putida KT2440
ucaagcagguaaccgcugcc

SEQ ID NO: 3601725 - RNA, 17 nt, Pseudomonas putida KT2440
ucaagcccugccgccuu

SEQ ID NO: 3601726 - RNA, 19 nt, Pseudomonas putida KT2440
ucaagccugcgcaggcgcc

SEQ ID NO: 3601727 - RNA, 15 nt, Pseudomonas putida KT2440
ucaagcuccccagca

SEQ ID NO: 3601728 - RNA, 17 nt, Pseudomonas putida KT2440
ucaagcuccccagcaac

SEQ ID NO: 3601729 - RNA, 18 nt, Pseudomonas putida KT2440
ucaagcuccccagcaacg

SEQ ID NO: 3601730 - RNA, 21 nt, Pseudomonas putida KT2440
ucaagcuccccagcaacggau

SEQ ID NO: 3601731 - RNA, 18 nt, Pseudomonas putida KT2440
ucaagcucgaagcgcuca

SEQ ID NO: 3601732 - RNA, 22 nt, Pseudomonas putida KT2440
ucaagcucgaagcgcucaugca

SEQ ID NO: 3601733 - RNA, 13 nt, Pseudomonas putida KT2440
ucaagcucuuccu

SEQ ID NO: 3601734 - RNA, 12 nt, Pseudomonas putida KT2440
ucaagcuggaug

SEQ ID NO: 3601735 - RNA, 21 nt, Pseudomonas putida KT2440
ucaagcuggcgcaaucuugcc

SEQ ID NO: 3601736 - RNA, 15 nt, Pseudomonas putida KT2440
ucaaggccagcgccu

SEQ ID NO: 3601737 - RNA, 13 nt, Pseudomonas putida KT2440
ucaaggccgccac

SEQ ID NO: 3601738 - RNA, 15 nt, Pseudomonas putida KT2440
ucaagggcaaacugg

SEQ ID NO: 3601739 - RNA, 15 nt, Pseudomonas putida KT2440
ucaagggcaggguga

SEQ ID NO: 3601740 - RNA, 12 nt, Pseudomonas putida KT2440
ucaaggucacgg

SEQ ID NO: 3601741 - RNA, 18 nt, Pseudomonas putida KT2440
ucaaggucacggcuguca

SEQ ID NO: 3601742 - RNA, 22 nt, Pseudomonas putida KT2440
ucaaggucacggcugucaccau

SEQ ID NO: 3601743 - RNA, 21 nt, Pseudomonas putida KT2440
ucaaggucagcuucuggguau

SEQ ID NO: 3601744 - RNA, 15 nt, Pseudomonas putida KT2440
ucaagguuucacgcc

SEQ ID NO: 3601745 - RNA, 22 nt, Pseudomonas putida KT2440
ucaaucaaccagcccgccgcca

SEQ ID NO: 3601746 - RNA, 23 nt, Pseudomonas putida KT2440
ucaaucaaccagcccgccgccag

SEQ ID NO: 3601747 - RNA, 20 nt, Pseudomonas putida KT2440
ucaaucaacucggcagugaa

SEQ ID NO: 3601748 - RNA, 20 nt, Pseudomonas putida KT2440
ucaaucagggauacugcuga

SEQ ID NO: 3601749 - RNA, 23 nt, Pseudomonas putida KT2440
ucaaugaugcguacggccuuggc

SEQ ID NO: 3601750 - RNA, 22 nt, Pseudomonas putida KT2440
ucaaugcccagguaucgcaccg

SEQ ID NO: 3601751 - RNA, 22 nt, Pseudomonas putida KT2440
ucaaugccccgaccaccgccuc

SEQ ID NO: 3601752 - RNA, 19 nt, Pseudomonas putida KT2440
ucaaugucgagcaugauca

SEQ ID NO: 3601753 - RNA, 22 nt, Pseudomonas putida KT2440
ucaauuucuuucagcucggcac

SEQ ID NO: 3601754 - RNA, 20 nt, Pseudomonas putida KT2440
ucacacaggcugucggcaug

SEQ ID NO: 3601755 - RNA, 15 nt, Pseudomonas putida KT2440
ucacacgccacuaag

SEQ ID NO: 3601756 - RNA, 15 nt, Pseudomonas putida KT2440
ucacacucagccgcu

SEQ ID NO: 3601757 - RNA, 14 nt, Pseudomonas putida KT2440
ucacagaaaagcug

SEQ ID NO: 3601758 - RNA, 16 nt, Pseudomonas putida KT2440
ucacagcacaaggcuc

SEQ ID NO: 3601759 - RNA, 16 nt, Pseudomonas putida KT2440
ucacagcgccgcggcc

SEQ ID NO: 3601760 - RNA, 22 nt, Pseudomonas putida KT2440
ucacagcgggggcagugcccag

SEQ ID NO: 3601761 - RNA, 15 nt, Pseudomonas putida KT2440
ucacaggccauagcc

SEQ ID NO: 3601762 - RNA, 20 nt, Pseudomonas putida KT2440
ucacaggcuucagccuucga

SEQ ID NO: 3601763 - RNA, 16 nt, Pseudomonas putida KT2440
ucacagggaccgugca

SEQ ID NO: 3601764 - RNA, 18 nt, Pseudomonas putida KT2440
ucacauaaggcagcagcu

SEQ ID NO: 3601765 - RNA, 16 nt, Pseudomonas putida KT2440
ucacauaguugggcug

SEQ ID NO: 3601766 - RNA, 16 nt, Pseudomonas putida KT2440
ucacaucaacuguuca

SEQ ID NO: 3601767 - RNA, 13 nt, Pseudomonas putida KT2440
ucacauccacagc

SEQ ID NO: 3601768 - RNA, 23 nt, Pseudomonas putida KT2440
ucacauccaccgcucgcgccgcc

SEQ ID NO: 3601769 - RNA, 21 nt, Pseudomonas putida KT2440
ucacauccuuggucauggcac

SEQ ID NO: 3601770 - RNA, 16 nt, Pseudomonas putida KT2440
ucaccacaaaaccuuc

SEQ ID NO: 3601771 - RNA, 13 nt, Pseudomonas putida KT2440
ucaccacaucggc

SEQ ID NO: 3601772 - RNA, 15 nt, Pseudomonas putida KT2440
ucaccaccaggugcu

SEQ ID NO: 3601773 - RNA, 20 nt, Pseudomonas putida KT2440
ucaccaccggcuuccagcuu

SEQ ID NO: 3601774 - RNA, 19 nt, Pseudomonas putida KT2440
ucaccaccgucgaagcccg

SEQ ID NO: 3601775 - RNA, 18 nt, Pseudomonas putida KT2440
ucaccacgcccgccggca

SEQ ID NO: 3601776 - RNA, 18 nt, Pseudomonas putida KT2440
ucaccacgcccuggcccg

SEQ ID NO: 3601777 - RNA, 20 nt, Pseudomonas putida KT2440
ucaccacgggaaugaacugc

SEQ ID NO: 3601778 - RNA, 13 nt, Pseudomonas putida KT2440
ucaccagcacguc

SEQ ID NO: 3601779 - RNA, 12 nt, Pseudomonas putida KT2440
ucaccagcagcu

SEQ ID NO: 3601780 - RNA, 15 nt, Pseudomonas putida KT2440
ucaccagcagcuucu

SEQ ID NO: 3601781 - RNA, 22 nt, Pseudomonas putida KT2440
ucaccagcaggucggcacgcac

SEQ ID NO: 3601782 - RNA, 12 nt, Pseudomonas putida KT2440
ucaccagccagg

SEQ ID NO: 3601783 - RNA, 14 nt, Pseudomonas putida KT2440
ucaccagccccuca

SEQ ID NO: 3601784 - RNA, 13 nt, Pseudomonas putida KT2440
ucacgucggccug

SEQ ID NO: 3601785 - RNA, 17 nt, Pseudomonas putida KT2440
ucacgucguacucggcc

SEQ ID NO: 3601786 - RNA, 20 nt, Pseudomonas putida KT2440
ucacgucuggcaccaguucc

SEQ ID NO: 3601787 - RNA, 19 nt, Pseudomonas putida KT2440
ucacgugccuucaccagcu

SEQ ID NO: 3601788 - RNA, 12 nt, Pseudomonas putida KT2440
ucacguggcuga

SEQ ID NO: 3601789 - RNA, 16 nt, Pseudomonas putida KT2440
ucacguggcugaugcc

SEQ ID NO: 3601790 - RNA, 18 nt, Pseudomonas putida KT2440
ucacguuguagcccacca

SEQ ID NO: 3601791 - RNA, 23 nt, Pseudomonas putida KT2440
ucacguuguagcccaccaccuuc

SEQ ID NO: 3601792 - RNA, 16 nt, Pseudomonas putida KT2440
ucacucaaccaccgcu

SEQ ID NO: 3601793 - RNA, 18 nt, Pseudomonas putida KT2440
ucacuccugguuggccag

SEQ ID NO: 3601794 - RNA, 11 nt, Pseudomonas putida KT2440
ucacucggcag

SEQ ID NO: 3601795 - RNA, 19 nt, Pseudomonas putida KT2440
ucacucugccgccccucca

SEQ ID NO: 3601796 - RNA, 16 nt, Pseudomonas putida KT2440
ucacugacagcaugcc

SEQ ID NO: 3601797 - RNA, 14 nt, Pseudomonas putida KT2440
ucacugagccaggc

SEQ ID NO: 3601798 - RNA, 19 nt, Pseudomonas putida KT2440
ucacugagccaggccgaca

SEQ ID NO: 3601799 - RNA, 17 nt, Pseudomonas putida KT2440
ucacugaucgggauuac

SEQ ID NO: 3601800 - RNA, 22 nt, Pseudomonas putida KT2440
ucacugccaccgugagcauggc

SEQ ID NO: 3601801 - RNA, 19 nt, Pseudomonas putida KT2440
ucacugccagcaccuggcg

SEQ ID NO: 3601802 - RNA, 17 nt, Pseudomonas putida KT2440
ucacugcuguaaucggc

SEQ ID NO: 3601803 - RNA, 14 nt, Pseudomonas putida KT2440
ucacuggccaacuc

SEQ ID NO: 3601804 - RNA, 14 nt, Pseudomonas putida KT2440
ucacuggccagcag

SEQ ID NO: 3601805 - RNA, 19 nt, Pseudomonas putida KT2440
ucacuguggucauccaggc

SEQ ID NO: 3601806 - RNA, 20 nt, Pseudomonas putida KT2440
ucacuguggucauccaggcu

SEQ ID NO: 3601807 - RNA, 17 nt, Pseudomonas putida KT2440
ucacuucauccagccgg

SEQ ID NO: 3601808 - RNA, 13 nt, Pseudomonas putida KT2440
ucacuuccacacg

SEQ ID NO: 3601809 - RNA, 17 nt, Pseudomonas putida KT2440
ucacuucuuucagcuca

SEQ ID NO: 3601810 - RNA, 18 nt, Pseudomonas putida KT2440
ucacuuucuugaaauuaa

SEQ ID NO: 3601811 - RNA, 21 nt, Pseudomonas putida KT2440
ucagaacgaggcguuggccaa

SEQ ID NO: 3601812 - RNA, 18 nt, Pseudomonas putida KT2440
ucagaauuugccccuucc

SEQ ID NO: 3601813 - RNA, 19 nt, Pseudomonas putida KT2440
ucagacgcggaacuggcug

SEQ ID NO: 3601814 - RNA, 17 nt, Pseudomonas putida KT2440
ucagacuuugcggacga

SEQ ID NO: 3601815 - RNA, 14 nt, Pseudomonas putida KT2440
ucagagcgccagca

SEQ ID NO: 3601816 - RNA, 16 nt, Pseudomonas putida KT2440
ucagagcgccagcaag

SEQ ID NO: 3601817 - RNA, 15 nt, Pseudomonas putida KT2440
ucagauacugcaccc

SEQ ID NO: 3601818 - RNA, 18 nt, Pseudomonas putida KT2440
ucagauaggcgccgugcu

SEQ ID NO: 3601819 - RNA, 13 nt, Pseudomonas putida KT2440
ucagaucacccuu

SEQ ID NO: 3601820 - RNA, 20 nt, Pseudomonas putida KT2440
ucagaucacccuuggccacc

SEQ ID NO: 3601821 - RNA, 15 nt, Pseudomonas putida KT2440
ucagauggcccgguc

SEQ ID NO: 3601822 - RNA, 20 nt, Pseudomonas putida KT2440
ucagcaaaccgaccaggcag

SEQ ID NO: 3601823 - RNA, 18 nt, Pseudomonas putida KT2440
ucagcaacccggccaggc

SEQ ID NO: 3601824 - RNA, 17 nt, Pseudomonas putida KT2440
ucagcaacgccaccagu

SEQ ID NO: 3601825 - RNA, 18 nt, Pseudomonas putida KT2440
ucagcaacgccaccaguu

SEQ ID NO: 3601826 - RNA, 21 nt, Pseudomonas putida KT2440
ucagcaagaccagaaacccag

SEQ ID NO: 3601827 - RNA, 16 nt, Pseudomonas putida KT2440
ucagcaagccgccgau

SEQ ID NO: 3601828 - RNA, 14 nt, Pseudomonas putida KT2440
ucagcaaucccgcc

SEQ ID NO: 3601829 - RNA, 22 nt, Pseudomonas putida KT2440
ucagcaaugccaguugaucacc

SEQ ID NO: 3601830 - RNA, 23 nt, Pseudomonas putida KT2440
ucagcacacccagcacgaaggcc

SEQ ID NO: 3601831 - RNA, 18 nt, Pseudomonas putida KT2440
ucagcacauucagcagcg

SEQ ID NO: 3601832 - RNA, 12 nt, Pseudomonas putida KT2440
ucagcaccuggc

SEQ ID NO: 3601833 - RNA, 17 nt, Pseudomonas putida KT2440
ucagcaccuucuugccc

SEQ ID NO: 3601834 - RNA, 21 nt, Pseudomonas putida KT2440
ucagcaggaagcuguacagcg

SEQ ID NO: 3601835 - RNA, 16 nt, Pseudomonas putida KT2440
ucagcaggcgcggcgu

SEQ ID NO: 3601836 - RNA, 21 nt, Pseudomonas putida KT2440
ucagcagguugaacagcagcg

SEQ ID NO: 3601837 - RNA, 14 nt, Pseudomonas putida KT2440
ucagcaguggcucc

SEQ ID NO: 3601838 - RNA, 14 nt, Pseudomonas putida KT2440
ucagcaugcccagc

SEQ ID NO: 3601839 - RNA, 20 nt, Pseudomonas putida KT2440
ucagcaugcccagcgccacc

SEQ ID NO: 3601840 - RNA, 14 nt, Pseudomonas putida KT2440
ucagcauggccagu

SEQ ID NO: 3601841 - RNA, 15 nt, Pseudomonas putida KT2440
ucagcauggccaguu

SEQ ID NO: 3601842 - RNA, 18 nt, Pseudomonas putida KT2440
ucagcauggccaguuccu

SEQ ID NO: 3601843 - RNA, 15 nt, Pseudomonas putida KT2440
ucagcaugucccggg

SEQ ID NO: 3601844 - RNA, 15 nt, Pseudomonas putida KT2440
ucagccaaaucagcu

SEQ ID NO: 3601845 - RNA, 18 nt, Pseudomonas putida KT2440
ucagccaaccgccccacc

SEQ ID NO: 3601846 - RNA, 20 nt, Pseudomonas putida KT2440
ucagccaaccgccccaccca

SEQ ID NO: 3601847 - RNA, 16 nt, Pseudomonas putida KT2440
ucagccaacggcguga

SEQ ID NO: 3601848 - RNA, 12 nt, Pseudomonas putida KT2440
ucagccacaucc

SEQ ID NO: 3601849 - RNA, 17 nt, Pseudomonas putida KT2440
ucagccacauccucugc

SEQ ID NO: 3601850 - RNA, 20 nt, Pseudomonas putida KT2440
ucagccaccgcacucugcug

SEQ ID NO: 3601851 - RNA, 21 nt, Pseudomonas putida KT2440
ucagccaccgcacucugcugc

SEQ ID NO: 3601852 - RNA, 20 nt, Pseudomonas putida KT2440
ucagccacgcuggcacccac

SEQ ID NO: 3601853 - RNA, 14 nt, Pseudomonas putida KT2440
ucagccacgggcuu

SEQ ID NO: 3601854 - RNA, 23 nt, Pseudomonas putida KT2440
ucagccagccuucgccaacugca

SEQ ID NO: 3601855 - RNA, 14 nt, Pseudomonas putida KT2440
ucagccaggguuuc

SEQ ID NO: 3601856 - RNA, 22 nt, Pseudomonas putida KT2440
ucagccagugcugccugcugca

SEQ ID NO: 3601857 - RNA, 19 nt, Pseudomonas putida KT2440
ucagcccauuucaccugcu

SEQ ID NO: 3601858 - RNA, 20 nt, Pseudomonas putida KT2440
ucagcccuugccagugaucc

SEQ ID NO: 3601859 - RNA, 18 nt, Pseudomonas putida KT2440
ucagcccuugcugcagca

SEQ ID NO: 3601860 - RNA, 20 nt, Pseudomonas putida KT2440
ucagccgagccaaccgcuuc

SEQ ID NO: 3601861 - RNA, 15 nt, Pseudomonas putida KT2440
ucagccgauacgcug

SEQ ID NO: 3601862 - RNA, 16 nt, Pseudomonas putida KT2440
ucagccgccgcugcga

SEQ ID NO: 3601863 - RNA, 16 nt, Pseudomonas putida KT2440
ucagccgcugcgccug

SEQ ID NO: 3601864 - RNA, 23 nt, Pseudomonas putida KT2440
ucagccgucgccgcuucggcaug

SEQ ID NO: 3601865 - RNA, 17 nt, Pseudomonas putida KT2440
ucagccucggucaggua

SEQ ID NO: 3601866 - RNA, 12 nt, Pseudomonas putida KT2440
ucagccugccau

SEQ ID NO: 3601867 - RNA, 18 nt, Pseudomonas putida KT2440
ucagccuguaccgcccuc

SEQ ID NO: 3601868 - RNA, 11 nt, Pseudomonas putida KT2440
ucagccuucag

SEQ ID NO: 3601869 - RNA, 17 nt, Pseudomonas putida KT2440
ucagccuucagugcuuc

SEQ ID NO: 3601870 - RNA, 13 nt, Pseudomonas putida KT2440
ucagccuuuucca

SEQ ID NO: 3601871 - RNA, 16 nt, Pseudomonas putida KT2440
ucagccuuuuccagcu

SEQ ID NO: 3601872 - RNA, 15 nt, Pseudomonas putida KT2440
ucagcgacaacggcu

SEQ ID NO: 3601873 - RNA, 15 nt, Pseudomonas putida KT2440
ucagcgacaccgcca

SEQ ID NO: 3601874 - RNA, 14 nt, Pseudomonas putida KT2440
ucagcgacugccaa

SEQ ID NO: 3601875 - RNA, 22 nt, Pseudomonas putida KT2440
ucagcgagcgggugccgcagca

SEQ ID NO: 3601876 - RNA, 22 nt, Pseudomonas putida KT2440
ucagcgaggaauagccggugcc

SEQ ID NO: 3601877 - RNA, 15 nt, Pseudomonas putida KT2440
ucagcgccagcggcu

SEQ ID NO: 3601878 - RNA, 13 nt, Pseudomonas putida KT2440
ucagcgccccauc

SEQ ID NO: 3601879 - RNA, 17 nt, Pseudomonas putida KT2440
ucagcgccgcaacggcc

SEQ ID NO: 3601880 - RNA, 17 nt, Pseudomonas putida KT2440
ucagcgccgguagcggc

SEQ ID NO: 3601881 - RNA, 21 nt, Pseudomonas putida KT2440
ucagcgccgguagcggcuggg

SEQ ID NO: 3601882 - RNA, 13 nt, Pseudomonas putida KT2440
ucagcgccuccag

SEQ ID NO: 3601883 - RNA, 19 nt, Pseudomonas putida KT2440
ucagcgccuccagggcggc

SEQ ID NO: 3601884 - RNA, 14 nt, Pseudomonas putida KT2440
ucagcgccugcuca

SEQ ID NO: 3601885 - RNA, 19 nt, Pseudomonas putida KT2440
ucagcgcggcaaagguggc

SEQ ID NO: 3601886 - RNA, 22 nt, Pseudomonas putida KT2440
ucagcgcggcaaagguggcacc

SEQ ID NO: 3601887 - RNA, 17 nt, Pseudomonas putida KT2440
ucagcgcggugaccagc

SEQ ID NO: 3601888 - RNA, 22 nt, Pseudomonas putida KT2440
ucagcgcggugaccagcggcag

SEQ ID NO: 3601889 - RNA, 15 nt, Pseudomonas putida KT2440
ucagcgcguccagca

SEQ ID NO: 3601890 - RNA, 15 nt, Pseudomonas putida KT2440
ucagggcuuuuucca

SEQ ID NO: 3601891 - RNA, 20 nt, Pseudomonas putida KT2440
ucaggggugccuucgagcau

SEQ ID NO: 3601892 - RNA, 24 nt, Pseudomonas putida KT2440
ucaggguauugaacggcgcaucca

SEQ ID NO: 3601893 - RNA, 23 nt, Pseudomonas putida KT2440
ucagggucgggcacaggcccagc

SEQ ID NO: 3601894 - RNA, 15 nt, Pseudomonas putida KT2440
ucagggucucgcggc

SEQ ID NO: 3601895 - RNA, 17 nt, Pseudomonas putida KT2440
ucagggucucgcggcug

SEQ ID NO: 3601896 - RNA, 14 nt, Pseudomonas putida KT2440
ucagguacagcagc

SEQ ID NO: 3601897 - RNA, 16 nt, Pseudomonas putida KT2440
ucagguagaccugcgu

SEQ ID NO: 3601898 - RNA, 15 nt, Pseudomonas putida KT2440
ucagguagcugggcc

SEQ ID NO: 3601899 - RNA, 17 nt, Pseudomonas putida KT2440
ucagguaggccgcagcc

SEQ ID NO: 3601900 - RNA, 21 nt, Pseudomonas putida KT2440
ucagguauugcgcaaggccgc

SEQ ID NO: 3601901 - RNA, 18 nt, Pseudomonas putida KT2440
ucaggucgacacccagca

SEQ ID NO: 3601902 - RNA, 20 nt, Pseudomonas putida KT2440
ucaggucgacacccagcacc

SEQ ID NO: 3601903 - RNA, 13 nt, Pseudomonas putida KT2440
ucaggucgccagg

SEQ ID NO: 3601904 - RNA, 13 nt, Pseudomonas putida KT2440
ucaggucguacgg

SEQ ID NO: 3601905 - RNA, 16 nt, Pseudomonas putida KT2440
ucaggugagccaugcc

SEQ ID NO: 3601906 - RNA, 17 nt, Pseudomonas putida KT2440
ucagguggaucagccgc

SEQ ID NO: 3601907 - RNA, 17 nt, Pseudomonas putida KT2440
ucagguggaucaggguc

SEQ ID NO: 3601908 - RNA, 20 nt, Pseudomonas putida KT2440
ucaggugguaguccuugccg

SEQ ID NO: 3601909 - RNA, 15 nt, Pseudomonas putida KT2440
ucagguguuccagca

SEQ ID NO: 3601910 - RNA, 16 nt, Pseudomonas putida KT2440
ucagguguuccagcac

SEQ ID NO: 3601911 - RNA, 17 nt, Pseudomonas putida KT2440
ucagguguuccagcacg

SEQ ID NO: 3601912 - RNA, 13 nt, Pseudomonas putida KT2440
ucagguucagggc

SEQ ID NO: 3601913 - RNA, 15 nt, Pseudomonas putida KT2440
ucagguucagggcaa

SEQ ID NO: 3601914 - RNA, 21 nt, Pseudomonas putida KT2440
ucagguucugccggacaagaa

SEQ ID NO: 3601915 - RNA, 18 nt, Pseudomonas putida KT2440
ucagguugagcaccgggc

SEQ ID NO: 3601916 - RNA, 15 nt, Pseudomonas putida KT2440
ucagguugcccagca

SEQ ID NO: 3601917 - RNA, 18 nt, Pseudomonas putida KT2440
ucagguugcccgcaugca

SEQ ID NO: 3601918 - RNA, 13 nt, Pseudomonas putida KT2440
ucaguaccaggcc

SEQ ID NO: 3601919 - RNA, 23 nt, Pseudomonas putida KT2440
ucaguaccggucauggcgcgcca

SEQ ID NO: 3601920 - RNA, 16 nt, Pseudomonas putida KT2440
ucaguaccuggccgcg

SEQ ID NO: 3601921 - RNA, 13 nt, Pseudomonas putida KT2440
ucagucagccagu

SEQ ID NO: 3601922 - RNA, 17 nt, Pseudomonas putida KT2440
ucaguccaucaccacca

SEQ ID NO: 3601923 - RNA, 19 nt, Pseudomonas putida KT2440
ucagucgagucgacaguga

SEQ ID NO: 3601924 - RNA, 20 nt, Pseudomonas putida KT2440
ucagucgcaucgacaggucc

SEQ ID NO: 3601925 - RNA, 19 nt, Pseudomonas putida KT2440
ucagucucuuucaacagcu

SEQ ID NO: 3601926 - RNA, 17 nt, Pseudomonas putida KT2440
ucagugacaggcaguca

SEQ ID NO: 3601927 - RNA, 21 nt, Pseudomonas putida KT2440
ucagugaugcuugcgcggcac

SEQ ID NO: 3601928 - RNA, 17 nt, Pseudomonas putida KT2440
ucagugcccccgccaca

SEQ ID NO: 3601929 - RNA, 22 nt, Pseudomonas putida KT2440
ucagugccgggggugcuuaagu

SEQ ID NO: 3601930 - RNA, 23 nt, Pseudomonas putida KT2440
ucagugccugcuccaugggcagg

SEQ ID NO: 3601931 - RNA, 17 nt, Pseudomonas putida KT2440
ucagugccugggucagc

SEQ ID NO: 3601932 - RNA, 17 nt, Pseudomonas putida KT2440
ucagugcggucaggcca

SEQ ID NO: 3601933 - RNA, 16 nt, Pseudomonas putida KT2440
ucagugcgucggccac

SEQ ID NO: 3601934 - RNA, 18 nt, Pseudomonas putida KT2440
ucagugcuucacagcguu

SEQ ID NO: 3601935 - RNA, 16 nt, Pseudomonas putida KT2440
ucagugucugcgccug

SEQ ID NO: 3601936 - RNA, 20 nt, Pseudomonas putida KT2440
ucagugugggggcggccucg

SEQ ID NO: 3601937 - RNA, 15 nt, Pseudomonas putida KT2440
ucaguuaaucagcaa

SEQ ID NO: 3601938 - RNA, 14 nt, Pseudomonas putida KT2440
ucaguucagccagg

SEQ ID NO: 3601939 - RNA, 16 nt, Pseudomonas putida KT2440
ucaguucgacgcggac

SEQ ID NO: 3601940 - RNA, 22 nt, Pseudomonas putida KT2440
ucaguugcaagucucgcgccuu

SEQ ID NO: 3601941 - RNA, 18 nt, Pseudomonas putida KT2440
ucaguugcagcaacgccu

SEQ ID NO: 3601942 - RNA, 15 nt, Pseudomonas putida KT2440
ucaguugcucgcccg

SEQ ID NO: 3601943 - RNA, 17 nt, Pseudomonas putida KT2440
ucaguugguagagcacg

SEQ ID NO: 3601944 - RNA, 19 nt, Pseudomonas putida KT2440
ucaguuugggcgggcugcg

SEQ ID NO: 3601945 - RNA, 16 nt, Pseudomonas putida KT2440
ucauaaggaucaugaa

SEQ ID NO: 3601946 - RNA, 14 nt, Pseudomonas putida KT2440
ucauacagcgccuc

SEQ ID NO: 3601947 - RNA, 20 nt, Pseudomonas putida KT2440
ucauacccuuugccauccac

SEQ ID NO: 3601948 - RNA, 14 nt, Pseudomonas putida KT2440
ucauacgcaaucuc

SEQ ID NO: 3601949 - RNA, 16 nt, Pseudomonas putida KT2440
ucauagcucagcugga

SEQ ID NO: 3601950 - RNA, 20 nt, Pseudomonas putida KT2440
ucauagcucagcuggauaga

SEQ ID NO: 3601951 - RNA, 16 nt, Pseudomonas putida KT2440
ucauaguuguggcaac

SEQ ID NO: 3601952 - RNA, 22 nt, Pseudomonas putida KT2440
ucauauccgcuuugcuugaguu

SEQ ID NO: 3601953 - RNA, 21 nt, Pseudomonas putida KT2440
ucaucaaagacuccgcuucau

SEQ ID NO: 3601954 - RNA, 16 nt, Pseudomonas putida KT2440
ucaucacacucgcccc

SEQ ID NO: 3601955 - RNA, 18 nt, Pseudomonas putida KT2440
ucaucacacucgccccca

SEQ ID NO: 3601956 - RNA, 13 nt, Pseudomonas putida KT2440
ucaucaccacccc

SEQ ID NO: 3601957 - RNA, 12 nt, Pseudomonas putida KT2440
ucaucaccagcc

SEQ ID NO: 3601958 - RNA, 22 nt, Pseudomonas putida KT2440
ucaucacccgggaacagcagca

SEQ ID NO: 3601959 - RNA, 23 nt, Pseudomonas putida KT2440
ucaucacccgggaacagcagcac

SEQ ID NO: 3601960 - RNA, 12 nt, Pseudomonas putida KT2440
ucaucaccggcc

SEQ ID NO: 3601961 - RNA, 16 nt, Pseudomonas putida KT2440
ucaucaccggccagca

SEQ ID NO: 3601962 - RNA, 16 nt, Pseudomonas putida KT2440
ucaucagaccgccgau

SEQ ID NO: 3601963 - RNA, 21 nt, Pseudomonas putida KT2440
ucaucagcaacccggccaggc

SEQ ID NO: 3601964 - RNA, 14 nt, Pseudomonas putida KT2440
ucaucagcaggcag

SEQ ID NO: 3601965 - RNA, 15 nt, Pseudomonas putida KT2440
ucaucaggacgguca

SEQ ID NO: 3601966 - RNA, 20 nt, Pseudomonas putida KT2440
ucaucaggccgaugccaagc

SEQ ID NO: 3601967 - RNA, 23 nt, Pseudomonas putida KT2440
ucaucaggccgaugccaagcacc

SEQ ID NO: 3601968 - RNA, 20 nt, Pseudomonas putida KT2440
ucaucaggcgauucaggcuu

SEQ ID NO: 3601969 - RNA, 23 nt, Pseudomonas putida KT2440
ucaucagguacggguuggcgucg

SEQ ID NO: 3601970 - RNA, 13 nt, Pseudomonas putida KT2440
ucaucaggucgcc

SEQ ID NO: 3601971 - RNA, 14 nt, Pseudomonas putida KT2440
ucaucaucagcagg

SEQ ID NO: 3601972 - RNA, 15 nt, Pseudomonas putida KT2440
ucaucaucagcaggc

SEQ ID NO: 3601973 - RNA, 21 nt, Pseudomonas putida KT2440
ucaucaucgagauguggcccg

SEQ ID NO: 3601974 - RNA, 16 nt, Pseudomonas putida KT2440
ucaucaucggcaugca

SEQ ID NO: 3601975 - RNA, 13 nt, Pseudomonas putida KT2440
ucaucaucgguaa

SEQ ID NO: 3601976 - RNA, 17 nt, Pseudomonas putida KT2440
ucaucaucucgcgaugc

SEQ ID NO: 3601977 - RNA, 22 nt, Pseudomonas putida KT2440
ucauccaccacccuggcaugcc

SEQ ID NO: 3601978 - RNA, 21 nt, Pseudomonas putida KT2440
ucauccaccgccccaagcgcc

SEQ ID NO: 3601979 - RNA, 11 nt, Pseudomonas putida KT2440
ucauccagcag

SEQ ID NO: 3601980 - RNA, 14 nt, Pseudomonas putida KT2440
ucauccagcagcuc

SEQ ID NO: 3601981 - RNA, 22 nt, Pseudomonas putida KT2440
ucauccagcgggaugcagucga

SEQ ID NO: 3601982 - RNA, 19 nt, Pseudomonas putida KT2440
ucauccagcguggccugca

SEQ ID NO: 3601983 - RNA, 17 nt, Pseudomonas putida KT2440
ucauccaggcugcacug

SEQ ID NO: 3601984 - RNA, 15 nt, Pseudomonas putida KT2440
ucauccaggcuggcc

SEQ ID NO: 3601985 - RNA, 14 nt, Pseudomonas putida KT2440
ucauccaucaccug

SEQ ID NO: 3601986 - RNA, 16 nt, Pseudomonas putida KT2440
ucauccauggcaaaac

SEQ ID NO: 3601987 - RNA, 16 nt, Pseudomonas putida KT2440
ucaucccuguacagau

SEQ ID NO: 3601988 - RNA, 17 nt, Pseudomonas putida KT2440
ucauccgagcugagcag

SEQ ID NO: 3601989 - RNA, 19 nt, Pseudomonas putida KT2440
ucauccgagcugagcagcg

SEQ ID NO: 3601990 - RNA, 20 nt, Pseudomonas putida KT2440
ucauccgccaacaccaccuc

SEQ ID NO: 3601991 - RNA, 15 nt, Pseudomonas putida KT2440
ucauccgccaggcuc

SEQ ID NO: 3601992 - RNA, 16 nt, Pseudomonas putida KT2440
ucauccgccaggcucu

SEQ ID NO: 3601993 - RNA, 19 nt, Pseudomonas putida KT2440
ucauccgccaggcucucca

SEQ ID NO: 3601994 - RNA, 20 nt, Pseudomonas putida KT2440
ucauccggcgcaucgacggg

SEQ ID NO: 3601995 - RNA, 12 nt, Pseudomonas putida KT2440
uccaccgcccca

SEQ ID NO: 3601996 - RNA, 14 nt, Pseudomonas putida KT2440
uccaccgccccaag

SEQ ID NO: 3601997 - RNA, 15 nt, Pseudomonas putida KT2440
uccaccgccccaagc

SEQ ID NO: 3601998 - RNA, 20 nt, Pseudomonas putida KT2440
uccaccgccccaagcgccug

SEQ ID NO: 3601999 - RNA, 21 nt, Pseudomonas putida KT2440
uccaccgccccaagcgccuga

SEQ ID NO: 3602000 - RNA, 19 nt, Pseudomonas putida KT2440
uccaccgccucgaccuggc

SEQ ID NO: 3602001 - RNA, 18 nt, Pseudomonas putida KT2440
uccaccgcgcaacgcgcc

SEQ ID NO: 3602002 - RNA, 12 nt, Pseudomonas putida KT2440
uccaccgcgcca

SEQ ID NO: 3602003 - RNA, 16 nt, Pseudomonas putida KT2440
uccaccgcucgcgccg

SEQ ID NO: 3602004 - RNA, 19 nt, Pseudomonas putida KT2440
uccaccgcucgcgccgccg

SEQ ID NO: 3602005 - RNA, 17 nt, Pseudomonas putida KT2440
uccaccgguacauugcg

SEQ ID NO: 3602006 - RNA, 16 nt, Pseudomonas putida KT2440
uccaccuaucaggagc

SEQ ID NO: 3602007 - RNA, 20 nt, Pseudomonas putida KT2440
uccaccugacgcgccagguc

SEQ ID NO: 3602008 - RNA, 14 nt, Pseudomonas putida KT2440
uccaccuggccacc

SEQ ID NO: 3602009 - RNA, 22 nt, Pseudomonas putida KT2440
uccaccuggccacccggcugcu

SEQ ID NO: 3602010 - RNA, 16 nt, Pseudomonas putida KT2440
uccacgaaccugugca

SEQ ID NO: 3602011 - RNA, 13 nt, Pseudomonas putida KT2440
uccacgaccguga

SEQ ID NO: 3602012 - RNA, 14 nt, Pseudomonas putida KT2440
uccacgccucgaug

SEQ ID NO: 3602013 - RNA, 20 nt, Pseudomonas putida KT2440
uccacgccucgaugugcgug

SEQ ID NO: 3602014 - RNA, 14 nt, Pseudomonas putida KT2440
uccacgcgcaggcc

SEQ ID NO: 3602015 - RNA, 16 nt, Pseudomonas putida KT2440
uccacgcgcaggccac

SEQ ID NO: 3602016 - RNA, 20 nt, Pseudomonas putida KT2440
uccacgcgcaggccacggua

SEQ ID NO: 3602017 - RNA, 19 nt, Pseudomonas putida KT2440
uccacggcaaucggcaggc

SEQ ID NO: 3602018 - RNA, 20 nt, Pseudomonas putida KT2440
uccacggcaaucggcaggcc

SEQ ID NO: 3602019 - RNA, 16 nt, Pseudomonas putida KT2440
uccacggucagcaucc

SEQ ID NO: 3602020 - RNA, 16 nt, Pseudomonas putida KT2440
uccacuaccuccagcc

SEQ ID NO: 3602021 - RNA, 21 nt, Pseudomonas putida KT2440
uccacucgucgaucuggauga

SEQ ID NO: 3602022 - RNA, 21 nt, Pseudomonas putida KT2440
uccacugcacccgugcagggc

SEQ ID NO: 3602023 - RNA, 22 nt, Pseudomonas putida KT2440
uccacuggaacucgaucggcac

SEQ ID NO: 3602024 - RNA, 14 nt, Pseudomonas putida KT2440
uccagaaauccauc

SEQ ID NO: 3602025 - RNA, 16 nt, Pseudomonas putida KT2440
uccagagggccugcau

SEQ ID NO: 3602026 - RNA, 15 nt, Pseudomonas putida KT2440
uccagaucggcagug

SEQ ID NO: 3602027 - RNA, 17 nt, Pseudomonas putida KT2440
uccagcaacaacgccuu

SEQ ID NO: 3602028 - RNA, 13 nt, Pseudomonas putida KT2440
uccagcaacagcu

SEQ ID NO: 3602029 - RNA, 22 nt, Pseudomonas putida KT2440
uccagcaacagcugccgggccg

SEQ ID NO: 3602030 - RNA, 15 nt, Pseudomonas putida KT2440
uccagcaacggacgu

SEQ ID NO: 3602031 - RNA, 13 nt, Pseudomonas putida KT2440
uccagcaagcgcu

SEQ ID NO: 3602032 - RNA, 14 nt, Pseudomonas putida KT2440
uccagcaagcgcuc

SEQ ID NO: 3602033 - RNA, 13 nt, Pseudomonas putida KT2440
uccagcaccaacc

SEQ ID NO: 3602034 - RNA, 21 nt, Pseudomonas putida KT2440
uccagcaccgccccggccagu

SEQ ID NO: 3602035 - RNA, 13 nt, Pseudomonas putida KT2440
uccagcaccucgc

SEQ ID NO: 3602036 - RNA, 17 nt, Pseudomonas putida KT2440
uccagcaccucgcucag

SEQ ID NO: 3602037 - RNA, 18 nt, Pseudomonas putida KT2440
uccagcacugccuggcca

SEQ ID NO: 3602038 - RNA, 21 nt, Pseudomonas putida KT2440
uccagcacuuuugccaccacc

SEQ ID NO: 3602039 - RNA, 11 nt, Pseudomonas putida KT2440
uccagcagcag

SEQ ID NO: 3602040 - RNA, 16 nt, Pseudomonas putida KT2440
uccagcagcgcaucca

SEQ ID NO: 3602041 - RNA, 21 nt, Pseudomonas putida KT2440
uccagcagcgcauccaccucg

SEQ ID NO: 3602042 - RNA, 23 nt, Pseudomonas putida KT2440
uccagcaggguggccagcaaggc

SEQ ID NO: 3602043 - RNA, 17 nt, Pseudomonas putida KT2440
uccagcaucagcacacc

SEQ ID NO: 3602044 - RNA, 20 nt, Pseudomonas putida KT2440
uccagcaucagcacacccag

SEQ ID NO: 3602045 - RNA, 21 nt, Pseudomonas putida KT2440
uccagccagauugcaggaaca

SEQ ID NO: 3602046 - RNA, 14 nt, Pseudomonas putida KT2440
uccagccccgcacc

SEQ ID NO: 3602047 - RNA, 23 nt, Pseudomonas putida KT2440
uccagccccucauucaaagccug

SEQ ID NO: 3602048 - RNA, 11 nt, Pseudomonas putida KT2440
uccagcccgaa

SEQ ID NO: 3602049 - RNA, 15 nt, Pseudomonas putida KT2440
uccagcccgauggcc

SEQ ID NO: 3602050 - RNA, 17 nt, Pseudomonas putida KT2440
uccagcccgccugcuca

SEQ ID NO: 3602051 - RNA, 14 nt, Pseudomonas putida KT2440
uccagcccggcguu

SEQ ID NO: 3602052 - RNA, 20 nt, Pseudomonas putida KT2440
uccagcccgucacgugccuu

SEQ ID NO: 3602053 - RNA, 22 nt, Pseudomonas putida KT2440
uccagcccucaagggauuggca

SEQ ID NO: 3602054 - RNA, 18 nt, Pseudomonas putida KT2440
uccagcccugcucgccaa

SEQ ID NO: 3602055 - RNA, 15 nt, Pseudomonas putida KT2440
uccagcccuggcgac

SEQ ID NO: 3602056 - RNA, 16 nt, Pseudomonas putida KT2440
uccagccgcugcugca

SEQ ID NO: 3602057 - RNA, 15 nt, Pseudomonas putida KT2440
uccagccugcagcac

SEQ ID NO: 3602058 - RNA, 17 nt, Pseudomonas putida KT2440
uccagccugcagcaccc

SEQ ID NO: 3602059 - RNA, 18 nt, Pseudomonas putida KT2440
uccagccugcagcacccu

SEQ ID NO: 3602060 - RNA, 17 nt, Pseudomonas putida KT2440
uccagcgaggcgggccg

SEQ ID NO: 3602061 - RNA, 20 nt, Pseudomonas putida KT2440
uccagcgaggguuccaggcc

SEQ ID NO: 3602062 - RNA, 20 nt, Pseudomonas putida KT2440
uccagcgaugacccggccuu

SEQ ID NO: 3602063 - RNA, 24 nt, Pseudomonas putida KT2440
uccagcgaugacccggccuuucgc

SEQ ID NO: 3602064 - RNA, 14 nt, Pseudomonas putida KT2440
uccagcgcaggcuu

SEQ ID NO: 3602065 - RNA, 16 nt, Pseudomonas putida KT2440
uccagcgccagcagcc

SEQ ID NO: 3602066 - RNA, 21 nt, Pseudomonas putida KT2440
uccagcgccagcagccgggcc

SEQ ID NO: 3602067 - RNA, 13 nt, Pseudomonas putida KT2440
uccagcgccgcca

SEQ ID NO: 3602068 - RNA, 13 nt, Pseudomonas putida KT2440
uccagcgccuccc

SEQ ID NO: 3602069 - RNA, 15 nt, Pseudomonas putida KT2440
uccagcgccuccccc

SEQ ID NO: 3602070 - RNA, 17 nt, Pseudomonas putida KT2440
uccagcgccucccccag

SEQ ID NO: 3602071 - RNA, 13 nt, Pseudomonas putida KT2440
uccagcgcggcca

SEQ ID NO: 3602072 - RNA, 19 nt, Pseudomonas putida KT2440
uccagcgcggccacgcccu

SEQ ID NO: 3602073 - RNA, 21 nt, Pseudomonas putida KT2440
uccagcgcggccacgcccuuu

SEQ ID NO: 3602074 - RNA, 22 nt, Pseudomonas putida KT2440
uccagcggcaaggucaacggca

SEQ ID NO: 3602075 - RNA, 22 nt, Pseudomonas putida KT2440
uccagcgguggguggcucauca

SEQ ID NO: 3602076 - RNA, 12 nt, Pseudomonas putida KT2440
uccagcguagcc

SEQ ID NO: 3602077 - RNA, 15 nt, Pseudomonas putida KT2440
uccagcgucaccacc

SEQ ID NO: 3602078 - RNA, 17 nt, Pseudomonas putida KT2440
uccagcgucucgaugca

SEQ ID NO: 3602079 - RNA, 14 nt, Pseudomonas putida KT2440
uccagcgucugcuu

SEQ ID NO: 3602080 - RNA, 17 nt, Pseudomonas putida KT2440
uccagcguucggccagc

SEQ ID NO: 3602081 - RNA, 18 nt, Pseudomonas putida KT2440
uccagcguucggccagca

SEQ ID NO: 3602082 - RNA, 20 nt, Pseudomonas putida KT2440
uccagcguucggccagcacu

SEQ ID NO: 3602083 - RNA, 14 nt, Pseudomonas putida KT2440
uccagcucacagca

SEQ ID NO: 3602084 - RNA, 16 nt, Pseudomonas putida KT2440
uccagcucacagcacu

SEQ ID NO: 3602085 - RNA, 15 nt, Pseudomonas putida KT2440
uccagcucgccgccc

SEQ ID NO: 3602086 - RNA, 19 nt, Pseudomonas putida KT2440
uccagcucgcgcagggcau

SEQ ID NO: 3602087 - RNA, 15 nt, Pseudomonas putida KT2440
uccagcucuggucac

SEQ ID NO: 3602088 - RNA, 20 nt, Pseudomonas putida KT2440
uccagcucuggucaccuucg

SEQ ID NO: 3602089 - RNA, 15 nt, Pseudomonas putida KT2440
uccagcucuugcuug

SEQ ID NO: 3602090 - RNA, 13 nt, Pseudomonas putida KT2440
uccagcugaaagu

SEQ ID NO: 3602091 - RNA, 20 nt, Pseudomonas putida KT2440
uccagcugagcgccauccac

SEQ ID NO: 3602092 - RNA, 16 nt, Pseudomonas putida KT2440
uccagcugcaacagcg

SEQ ID NO: 3602093 - RNA, 19 nt, Pseudomonas putida KT2440
uccagcugcaacagcggcg

SEQ ID NO: 3602094 - RNA, 14 nt, Pseudomonas putida KT2440
uccagcugcgccug

SEQ ID NO: 3602095 - RNA, 20 nt, Pseudomonas putida KT2440
uccagcugcggcugggucac

SEQ ID NO: 3602096 - RNA, 19 nt, Pseudomonas putida KT2440
uccagcugcuggauugccu

SEQ ID NO: 3602097 - RNA, 15 nt, Pseudomonas putida KT2440
uccagcuguacgcug

SEQ ID NO: 3602098 - RNA, 17 nt, Pseudomonas putida KT2440
uccagcuucaccucauc

SEQ ID NO: 3602099 - RNA, 17 nt, Pseudomonas putida KT2440
uccagcuugccaccauc

SEQ ID NO: 3602100 - RNA, 16 nt, Pseudomonas putida KT2440
uccagcuuuggcugca

SEQ ID NO: 3602101 - RNA, 15 nt, Pseudomonas putida KT2440
uccccgcgccgccga

SEQ ID NO: 3602102 - RNA, 23 nt, Pseudomonas putida KT2440
uccccgcgcuuugugcacaagcu

SEQ ID NO: 3602103 - RNA, 16 nt, Pseudomonas putida KT2440
uccccgcuucauccau

SEQ ID NO: 3602104 - RNA, 22 nt, Pseudomonas putida KT2440
uccccggccuccucgcgggcaa

SEQ ID NO: 3602105 - RNA, 15 nt, Pseudomonas putida KT2440
uccccggcgccgccg

SEQ ID NO: 3602106 - RNA, 23 nt, Pseudomonas putida KT2440
uccccggcgccgccgaacucugg

SEQ ID NO: 3602107 - RNA, 16 nt, Pseudomonas putida KT2440
uccccggguccaccuc

SEQ ID NO: 3602108 - RNA, 15 nt, Pseudomonas putida KT2440
uccccggucagcaug

SEQ ID NO: 3602109 - RNA, 17 nt, Pseudomonas putida KT2440
uccccggucagcauggc

SEQ ID NO: 3602110 - RNA, 21 nt, Pseudomonas putida KT2440
uccccuggaaauucucggcug

SEQ ID NO: 3602111 - RNA, 15 nt, Pseudomonas putida KT2440
uccccuuccaugccc

SEQ ID NO: 3602112 - RNA, 18 nt, Pseudomonas putida KT2440
uccccuuggcgacgugcc

SEQ ID NO: 3602113 - RNA, 13 nt, Pseudomonas putida KT2440
ucccgagccagga

SEQ ID NO: 3602114 - RNA, 17 nt, Pseudomonas putida KT2440
ucccgaggucagcagug

SEQ ID NO: 3602115 - RNA, 20 nt, Pseudomonas putida KT2440
ucccgaucuccccaccauca

SEQ ID NO: 3602116 - RNA, 20 nt, Pseudomonas putida KT2440
ucccgaugcgcuugaggcuu

SEQ ID NO: 3602117 - RNA, 13 nt, Pseudomonas putida KT2440
ucccgcaaguccg

SEQ ID NO: 3602118 - RNA, 20 nt, Pseudomonas putida KT2440
ucccgcacauuucacagcaa

SEQ ID NO: 3602119 - RNA, 20 nt, Pseudomonas putida KT2440
ucccgcacgauccccggccg

SEQ ID NO: 3602120 - RNA, 14 nt, Pseudomonas putida KT2440
ucccgcacugcugc

SEQ ID NO: 3602121 - RNA, 15 nt, Pseudomonas putida KT2440
ucccgcacugcugcc

SEQ ID NO: 3602122 - RNA, 16 nt, Pseudomonas putida KT2440
ucccgcacugcugccg

SEQ ID NO: 3602123 - RNA, 18 nt, Pseudomonas putida KT2440
ucccgccauauucgcggc

SEQ ID NO: 3602124 - RNA, 19 nt, Pseudomonas putida KT2440
ucccgccauauucgcggcg

SEQ ID NO: 3602125 - RNA, 21 nt, Pseudomonas putida KT2440
ucccgccccaaaggaagucaa

SEQ ID NO: 3602126 - RNA, 23 nt, Pseudomonas putida KT2440
ucccgcccugagccaaggccgcc

SEQ ID NO: 3602127 - RNA, 19 nt, Pseudomonas putida KT2440
ucccgcgcauccuccgccc

SEQ ID NO: 3602128 - RNA, 15 nt, Pseudomonas putida KT2440
ucccgcgcaugcugc

SEQ ID NO: 3602129 - RNA, 20 nt, Pseudomonas putida KT2440
ucccgcgcaugcugccaggc

SEQ ID NO: 3602130 - RNA, 22 nt, Pseudomonas putida KT2440
ucccgcgcaugcugccaggcaa

SEQ ID NO: 3602131 - RNA, 21 nt, Pseudomonas putida KT2440
ucccgcguaggugcgcggccg

SEQ ID NO: 3602132 - RNA, 11 nt, Pseudomonas putida KT2440
ucccgcuccuc

SEQ ID NO: 3602133 - RNA, 21 nt, Pseudomonas putida KT2440
ucccgcucgguaucggccagc

SEQ ID NO: 3602134 - RNA, 16 nt, Pseudomonas putida KT2440
ucccgcugccguagca

SEQ ID NO: 3602135 - RNA, 16 nt, Pseudomonas putida KT2440
ucccgcuucgccagcg

SEQ ID NO: 3602136 - RNA, 15 nt, Pseudomonas putida KT2440
ucccggacagcagca

SEQ ID NO: 3602137 - RNA, 14 nt, Pseudomonas putida KT2440
ucccggcacaaccg

SEQ ID NO: 3602138 - RNA, 23 nt, Pseudomonas putida KT2440
ucccggcacaaccgaacccgcug

SEQ ID NO: 3602139 - RNA, 13 nt, Pseudomonas putida KT2440
ucccggcaccgcu

SEQ ID NO: 3602140 - RNA, 21 nt, Pseudomonas putida KT2440
ucccggccacugguaguucau

SEQ ID NO: 3602141 - RNA, 14 nt, Pseudomonas putida KT2440
ucccggccagggcu

SEQ ID NO: 3602142 - RNA, 15 nt, Pseudomonas putida KT2440
ucccggccagggcug

SEQ ID NO: 3602143 - RNA, 19 nt, Pseudomonas putida KT2440
ucccggcuacgcacccgca

SEQ ID NO: 3602144 - RNA, 16 nt, Pseudomonas putida KT2440
ucccggcucaucaggc

SEQ ID NO: 3602145 - RNA, 16 nt, Pseudomonas putida KT2440
ucccgggaaaagccug

SEQ ID NO: 3602146 - RNA, 16 nt, Pseudomonas putida KT2440
ucccgggaucaccgca

SEQ ID NO: 3602147 - RNA, 13 nt, Pseudomonas putida KT2440
ucccgggccaugu

SEQ ID NO: 3602148 - RNA, 23 nt, Pseudomonas putida KT2440
ucccggucaacgcuucggccaug

SEQ ID NO: 3602149 - RNA, 16 nt, Pseudomonas putida KT2440
ucccgucgagccgggu

SEQ ID NO: 3602150 - RNA, 23 nt, Pseudomonas putida KT2440
ucccgucggccucuccgaggccg

SEQ ID NO: 3602151 - RNA, 13 nt, Pseudomonas putida KT2440
ucccgugcgccua

SEQ ID NO: 3602152 - RNA, 19 nt, Pseudomonas putida KT2440
ucccgugcgccuaucaggc

SEQ ID NO: 3602153 - RNA, 16 nt, Pseudomonas putida KT2440
ucccucauuucaggcu

SEQ ID NO: 3602154 - RNA, 19 nt, Pseudomonas putida KT2440
ucccucgguuucucacccc

SEQ ID NO: 3602155 - RNA, 16 nt, Pseudomonas putida KT2440
ucccucguaggagcgg

SEQ ID NO: 3602156 - RNA, 18 nt, Pseudomonas putida KT2440
ucccucguaggagcgggu

SEQ ID NO: 3602157 - RNA, 15 nt, Pseudomonas putida KT2440
ucccucugccugccc

SEQ ID NO: 3602158 - RNA, 21 nt, Pseudomonas putida KT2440
ucccugacucgaccgccgcac

SEQ ID NO: 3602159 - RNA, 13 nt, Pseudomonas putida KT2440
ucccugaucauac

SEQ ID NO: 3602160 - RNA, 20 nt, Pseudomonas putida KT2440
ucccugcccccaaagccgcc

SEQ ID NO: 3602161 - RNA, 18 nt, Pseudomonas putida KT2440
ucccuggcacgcccggca

SEQ ID NO: 3602162 - RNA, 16 nt, Pseudomonas putida KT2440
ucccuguaggugcggc

SEQ ID NO: 3602163 - RNA, 13 nt, Pseudomonas putida KT2440
uccgaagcgaaca

SEQ ID NO: 3602164 - RNA, 15 nt, Pseudomonas putida KT2440
uccgacaaaugcacc

SEQ ID NO: 3602165 - RNA, 15 nt, Pseudomonas putida KT2440
uccgacaagggcuac

SEQ ID NO: 3602166 - RNA, 18 nt, Pseudomonas putida KT2440
uccgacaaugccagcaaa

SEQ ID NO: 3602167 - RNA, 13 nt, Pseudomonas putida KT2440
uccgacaggcugu

SEQ ID NO: 3602168 - RNA, 13 nt, Pseudomonas putida KT2440
uccgaccccagca

SEQ ID NO: 3602169 - RNA, 15 nt, Pseudomonas putida KT2440
uccgaccccagcaug

SEQ ID NO: 3602170 - RNA, 23 nt, Pseudomonas putida KT2440
uccgaccggucauacauccagcu

SEQ ID NO: 3602171 - RNA, 13 nt, Pseudomonas putida KT2440
uccgacggauugg

SEQ ID NO: 3602172 - RNA, 14 nt, Pseudomonas putida KT2440
uccgagaagguggc

SEQ ID NO: 3602173 - RNA, 20 nt, Pseudomonas putida KT2440
uccgagagugcuggggccgc

SEQ ID NO: 3602174 - RNA, 20 nt, Pseudomonas putida KT2440
uccgaggucagcaccagcuc

SEQ ID NO: 3602175 - RNA, 21 nt, Pseudomonas putida KT2440
uccgaggucagcaccagcuca

SEQ ID NO: 3602176 - RNA, 19 nt, Pseudomonas putida KT2440
uccgcaacaugaagccaug

SEQ ID NO: 3602177 - RNA, 22 nt, Pseudomonas putida KT2440
uccgcacaggcuggccaccaug

SEQ ID NO: 3602178 - RNA, 19 nt, Pseudomonas putida KT2440
uccgcaccccaaggcugcc

SEQ ID NO: 3602179 - RNA, 16 nt, Pseudomonas putida KT2440
uccgcaccgggcaaaa

SEQ ID NO: 3602180 - RNA, 12 nt, Pseudomonas putida KT2440
uccgcagccccg

SEQ ID NO: 3602181 - RNA, 23 nt, Pseudomonas putida KT2440
uccgcauaucauagaucucgaca

SEQ ID NO: 3602182 - RNA, 15 nt, Pseudomonas putida KT2440
uccgccaaaccccag

SEQ ID NO: 3602183 - RNA, 17 nt, Pseudomonas putida KT2440
uccgccaaaccccagca

SEQ ID NO: 3602184 - RNA, 20 nt, Pseudomonas putida KT2440
uccgccaaaccccagcaagg

SEQ ID NO: 3602185 - RNA, 21 nt, Pseudomonas putida KT2440
uccgccaaaccccagcaaggc

SEQ ID NO: 3602186 - RNA, 18 nt, Pseudomonas putida KT2440
uccgccaagauccgcggc

SEQ ID NO: 3602187 - RNA, 19 nt, Pseudomonas putida KT2440
uccgccaauugcgccagcc

SEQ ID NO: 3602188 - RNA, 22 nt, Pseudomonas putida KT2440
uccgccaauugcgccagccgcu

SEQ ID NO: 3602189 - RNA, 24 nt, Pseudomonas putida KT2440
uccgccaccaaccggccaguggcc

SEQ ID NO: 3602190 - RNA, 18 nt, Pseudomonas putida KT2440
uccgccaccacgaacagu

SEQ ID NO: 3602191 - RNA, 19 nt, Pseudomonas putida KT2440
uccgccccauagccugcug

SEQ ID NO: 3602192 - RNA, 13 nt, Pseudomonas putida KT2440
uccgcccuugcca

SEQ ID NO: 3602193 - RNA, 20 nt, Pseudomonas putida KT2440
uccgccgcgcugaccaaggc

SEQ ID NO: 3602194 - RNA, 14 nt, Pseudomonas putida KT2440
uccgccgcuuuguu

SEQ ID NO: 3602195 - RNA, 20 nt, Pseudomonas putida KT2440
uccgccucauccucgcccac

SEQ ID NO: 3602196 - RNA, 16 nt, Pseudomonas putida KT2440
uccgccucgaucauuu

SEQ ID NO: 3602197 - RNA, 21 nt, Pseudomonas putida KT2440
uccgcgagggcaucagcgcac

SEQ ID NO: 3602198 - RNA, 22 nt, Pseudomonas putida KT2440
uccgcgaguaaagccagcagcc

SEQ ID NO: 3602199 - RNA, 23 nt, Pseudomonas putida KT2440
uccgcgaguaaagccagcagccu

SEQ ID NO: 3602200 - RNA, 23 nt, Pseudomonas putida KT2440
uccgcgauuuuuuuguccacgcu

SEQ ID NO: 3602201 - RNA, 20 nt, Pseudomonas putida KT2440
uccgcgcauaaaacucgcuu

SEQ ID NO: 3602202 - RNA, 15 nt, Pseudomonas putida KT2440
uccgcgccaucagcu

SEQ ID NO: 3602203 - RNA, 17 nt, Pseudomonas putida KT2440
uccgcgcccagucaccg

SEQ ID NO: 3602204 - RNA, 20 nt, Pseudomonas putida KT2440
uccgcucuucucgucguagc

SEQ ID NO: 3602205 - RNA, 16 nt, Pseudomonas putida KT2440
uccgcuggcuuguccu

SEQ ID NO: 3602206 - RNA, 19 nt, Pseudomonas putida KT2440
uccugccgacgccgcuucu

SEQ ID NO: 3602207 - RNA, 21 nt, Pseudomonas putida KT2440
uccugccuuccacccgccugc

SEQ ID NO: 3602208 - RNA, 20 nt, Pseudomonas putida KT2440
uccugcgcaugcaacggcac

SEQ ID NO: 3602209 - RNA, 18 nt, Pseudomonas putida KT2440
uccugcguacccagcccc

SEQ ID NO: 3602210 - RNA, 17 nt, Pseudomonas putida KT2440
uccugcgugcugugcac

SEQ ID NO: 3602211 - RNA, 11 nt, Pseudomonas putida KT2440
uccugcucgac

SEQ ID NO: 3602212 - RNA, 11 nt, Pseudomonas putida KT2440
uccugcugcug

SEQ ID NO: 3602213 - RNA, 12 nt, Pseudomonas putida KT2440
uccugcuugccg

SEQ ID NO: 3602214 - RNA, 14 nt, Pseudomonas putida KT2440
uccugcuugccggg

SEQ ID NO: 3602215 - RNA, 17 nt, Pseudomonas putida KT2440
uccugcuugccgggugc

SEQ ID NO: 3602216 - RNA, 21 nt, Pseudomonas putida KT2440
uccugcuugccgggugcaucg

SEQ ID NO: 3602217 - RNA, 17 nt, Pseudomonas putida KT2440
uccuggaaaagcaaggc

SEQ ID NO: 3602218 - RNA, 14 nt, Pseudomonas putida KT2440
uccuggaucagccg

SEQ ID NO: 3602219 - RNA, 13 nt, Pseudomonas putida KT2440
uccuggcuggcag

SEQ ID NO: 3602220 - RNA, 20 nt, Pseudomonas putida KT2440
uccugggaagcugcagcagc

SEQ ID NO: 3602221 - RNA, 21 nt, Pseudomonas putida KT2440
uccugggaagcugcagcagcu

SEQ ID NO: 3602222 - RNA, 15 nt, Pseudomonas putida KT2440
uccugggcuggccuu

SEQ ID NO: 3602223 - RNA, 22 nt, Pseudomonas putida KT2440
uccugguaaggcucgcccucgc

SEQ ID NO: 3602224 - RNA, 15 nt, Pseudomonas putida KT2440
uccuggucgcgggcc

SEQ ID NO: 3602225 - RNA, 18 nt, Pseudomonas putida KT2440
uccuggucgcgggccagc

SEQ ID NO: 3602226 - RNA, 22 nt, Pseudomonas putida KT2440
uccuggugaucaacaaaccgac

SEQ ID NO: 3602227 - RNA, 17 nt, Pseudomonas putida KT2440
uccugguuuucgcggua

SEQ ID NO: 3602228 - RNA, 20 nt, Pseudomonas putida KT2440
uccugugccgcuuuggcagc

SEQ ID NO: 3602229 - RNA, 23 nt, Pseudomonas putida KT2440
uccugugccgcuuuggcagcagc

SEQ ID NO: 3602230 - RNA, 18 nt, Pseudomonas putida KT2440
uccuguggaagcgggcgu

SEQ ID NO: 3602231 - RNA, 17 nt, Pseudomonas putida KT2440
uccugugggagcgggcg

SEQ ID NO: 3602232 - RNA, 14 nt, Pseudomonas putida KT2440
uccuucaucuguca

SEQ ID NO: 3602233 - RNA, 21 nt, Pseudomonas putida KT2440
uccuucgaccagaacagcucg

SEQ ID NO: 3602234 - RNA, 16 nt, Pseudomonas putida KT2440
uccuucgccacgaaca

SEQ ID NO: 3602235 - RNA, 21 nt, Pseudomonas putida KT2440
uccuucuccggauucaacuug

SEQ ID NO: 3602236 - RNA, 24 nt, Pseudomonas putida KT2440
uccuucugccguuugcuggccugc

SEQ ID NO: 3602237 - RNA, 19 nt, Pseudomonas putida KT2440
uccuucuugugcacaaagc

SEQ ID NO: 3602238 - RNA, 12 nt, Pseudomonas putida KT2440
uccuugaaauuc

SEQ ID NO: 3602239 - RNA, 14 nt, Pseudomonas putida KT2440
uccuugaaauucaa

SEQ ID NO: 3602240 - RNA, 13 nt, Pseudomonas putida KT2440
uccuugaucagga

SEQ ID NO: 3602241 - RNA, 13 nt, Pseudomonas putida KT2440
uccuugaucaggg

SEQ ID NO: 3602242 - RNA, 23 nt, Pseudomonas putida KT2440
uccuugcacaguucgaaaaccug

SEQ ID NO: 3602243 - RNA, 12 nt, Pseudomonas putida KT2440
uccuugcagcgc

SEQ ID NO: 3602244 - RNA, 14 nt, Pseudomonas putida KT2440
uccuugcagcgccg

SEQ ID NO: 3602245 - RNA, 23 nt, Pseudomonas putida KT2440
uccuugcagcgccgcauccagca

SEQ ID NO: 3602246 - RNA, 21 nt, Pseudomonas putida KT2440
uccuugcagcucuugucgaca

SEQ ID NO: 3602247 - RNA, 13 nt, Pseudomonas putida KT2440
uccuugcagggca

SEQ ID NO: 3602248 - RNA, 16 nt, Pseudomonas putida KT2440
uccuugcccaccagga

SEQ ID NO: 3602249 - RNA, 16 nt, Pseudomonas putida KT2440
uccuugcccucgccca

SEQ ID NO: 3602250 - RNA, 19 nt, Pseudomonas putida KT2440
uccuugcgcacgcgcucug

SEQ ID NO: 3602251 - RNA, 20 nt, Pseudomonas putida KT2440
uccuugcgcaucaagcggcu

SEQ ID NO: 3602252 - RNA, 19 nt, Pseudomonas putida KT2440
uccuuggacagcaauucca

SEQ ID NO: 3602253 - RNA, 16 nt, Pseudomonas putida KT2440
uccuuggccaaugcca

SEQ ID NO: 3602254 - RNA, 19 nt, Pseudomonas putida KT2440
uccuuggccaaugccagga

SEQ ID NO: 3602255 - RNA, 23 nt, Pseudomonas putida KT2440
uccuuggccgguuucagucagcc

SEQ ID NO: 3602256 - RNA, 19 nt, Pseudomonas putida KT2440
uccuuggggauguugcggc

SEQ ID NO: 3602257 - RNA, 23 nt, Pseudomonas putida KT2440
uccuugggggugaagcccugcug

SEQ ID NO: 3602258 - RNA, 13 nt, Pseudomonas putida KT2440
uccuuggucaggu

SEQ ID NO: 3602259 - RNA, 23 nt, Pseudomonas putida KT2440
uccuuggucaggucgaucccgcc

SEQ ID NO: 3602260 - RNA, 21 nt, Pseudomonas putida KT2440
uccuuggugcaugcaagcagc

SEQ ID NO: 3602261 - RNA, 20 nt, Pseudomonas putida KT2440
uccuuguaagagcggccuug

SEQ ID NO: 3602262 - RNA, 22 nt, Pseudomonas putida KT2440
uccuuguagauauugaccagcg

SEQ ID NO: 3602263 - RNA, 16 nt, Pseudomonas putida KT2440
uccuuguaggccauuu

SEQ ID NO: 3602264 - RNA, 22 nt, Pseudomonas putida KT2440
uccuuguaggccauuucccaaa

SEQ ID NO: 3602265 - RNA, 21 nt, Pseudomonas putida KT2440
uccuugucgcaauggaaacau

SEQ ID NO: 3602266 - RNA, 19 nt, Pseudomonas putida KT2440
uccuuuguaggagcgggcu

SEQ ID NO: 3602267 - RNA, 18 nt, Pseudomonas putida KT2440
uccuuuguuuucaucugc

SEQ ID NO: 3602268 - RNA, 23 nt, Pseudomonas putida KT2440
uccuuuguuuucaucugcccgcg

SEQ ID NO: 3602269 - RNA, 18 nt, Pseudomonas putida KT2440
ucgaaaaccugcugacac

SEQ ID NO: 3602270 - RNA, 21 nt, Pseudomonas putida KT2440
ucgaaaaccugcugacaccgc

SEQ ID NO: 3602271 - RNA, 21 nt, Pseudomonas putida KT2440
ucgaaaaucucguucaugccc

SEQ ID NO: 3602272 - RNA, 18 nt, Pseudomonas putida KT2440
ucgaaaccaucaaucaac

SEQ ID NO: 3602273 - RNA, 18 nt, Pseudomonas putida KT2440
ucgaaacgccgggucagc

SEQ ID NO: 3602274 - RNA, 22 nt, Pseudomonas putida KT2440
ucgaaagcccauaaaccccagc

SEQ ID NO: 3602275 - RNA, 19 nt, Pseudomonas putida KT2440
ucgaaauacaggcgcgugu

SEQ ID NO: 3602276 - RNA, 21 nt, Pseudomonas putida KT2440
ucgaacaacgccucgggcgcu

SEQ ID NO: 3602277 - RNA, 22 nt, Pseudomonas putida KT2440
ucgaacaacuguccugugcgca

SEQ ID NO: 3602278 - RNA, 19 nt, Pseudomonas putida KT2440
ucgaacaacuugugcauca

SEQ ID NO: 3602279 - RNA, 23 nt, Pseudomonas putida KT2440
ucgaacaacuugugcaucaaguc

SEQ ID NO: 3602280 - RNA, 16 nt, Pseudomonas putida KT2440
ucgaacaccacccggu

SEQ ID NO: 3602281 - RNA, 22 nt, Pseudomonas putida KT2440
ucgaacaccagggugggaaugc

SEQ ID NO: 3602282 - RNA, 14 nt, Pseudomonas putida KT2440
ucgaacacggcgug

SEQ ID NO: 3602283 - RNA, 18 nt, Pseudomonas putida KT2440
ucgaacacuucacgcaca

SEQ ID NO: 3602284 - RNA, 19 nt, Pseudomonas putida KT2440
ucgaacagcauccagcgcc

SEQ ID NO: 3602285 - RNA, 18 nt, Pseudomonas putida KT2440
ucgaacagcgccggcagu

SEQ ID NO: 3602286 - RNA, 17 nt, Pseudomonas putida KT2440
ucgaacagcucuuccag

SEQ ID NO: 3602287 - RNA, 19 nt, Pseudomonas putida KT2440
ucgaacagcucuuccaguu

SEQ ID NO: 3602288 - RNA, 22 nt, Pseudomonas putida KT2440
ucgaacagcuugccauccuuga

SEQ ID NO: 3602289 - RNA, 20 nt, Pseudomonas putida KT2440
ucgaaccccugauguggcug

SEQ ID NO: 3602290 - RNA, 17 nt, Pseudomonas putida KT2440
ucgaaccgcaacuggcc

SEQ ID NO: 3602291 - RNA, 19 nt, Pseudomonas putida KT2440
ucgaacgcugccugcaggc

SEQ ID NO: 3602292 - RNA, 17 nt, Pseudomonas putida KT2440
ucgaacggcgccagcag

SEQ ID NO: 3602293 - RNA, 18 nt, Pseudomonas putida KT2440
ucgaacggcgccagcagu

SEQ ID NO: 3602294 - RNA, 23 nt, Pseudomonas putida KT2440
ucgaacuccuugucgcaauggaa

SEQ ID NO: 3602295 - RNA, 20 nt, Pseudomonas putida KT2440
ucgaacucuuccagcucgcu

SEQ ID NO: 3602296 - RNA, 18 nt, Pseudomonas putida KT2440
ucgaacuucacuucgguu

SEQ ID NO: 3602297 - RNA, 16 nt, Pseudomonas putida KT2440
ucgaacuucuccagcg

SEQ ID NO: 3602298 - RNA, 19 nt, Pseudomonas putida KT2440
ucgaagaacacggcuucgc

SEQ ID NO: 3602299 - RNA, 14 nt, Pseudomonas putida KT2440
ucgaagaucagcuc

SEQ ID NO: 3602300 - RNA, 13 nt, Pseudomonas putida KT2440
ucgaagcagcagc

SEQ ID NO: 3602301 - RNA, 14 nt, Pseudomonas putida KT2440
ucgaagcagcagcu

SEQ ID NO: 3602302 - RNA, 16 nt, Pseudomonas putida KT2440
ucgaagcgacagcggc

SEQ ID NO: 3602303 - RNA, 13 nt, Pseudomonas putida KT2440
ucgaagcgcaccu

SEQ ID NO: 3602304 - RNA, 19 nt, Pseudomonas putida KT2440
ucgaagcgcucaugcaaca

SEQ ID NO: 3602305 - RNA, 12 nt, Pseudomonas putida KT2440
ucgaagcgcucc

SEQ ID NO: 3602306 - RNA, 21 nt, Pseudomonas putida KT2440
ucgaaggccuucagguugcuc

SEQ ID NO: 3602307 - RNA, 13 nt, Pseudomonas putida KT2440
ucgaaggcuucgu

SEQ ID NO: 3602308 - RNA, 22 nt, Pseudomonas putida KT2440
ucgaaguauuccagaaucugca

SEQ ID NO: 3602309 - RNA, 12 nt, Pseudomonas putida KT2440
ucgaagucgucc

SEQ ID NO: 3602310 - RNA, 16 nt, Pseudomonas putida KT2440
ucgaugaugcgugccu

SEQ ID NO: 3602311 - RNA, 15 nt, Pseudomonas putida KT2440
ucgaugauggcugcc

SEQ ID NO: 3602312 - RNA, 16 nt, Pseudomonas putida KT2440
ucgaugauggcugcca

SEQ ID NO: 3602313 - RNA, 18 nt, Pseudomonas putida KT2440
ucgaugcaauccgccaca

SEQ ID NO: 3602314 - RNA, 19 nt, Pseudomonas putida KT2440
ucgaugcaauccgccacaa

SEQ ID NO: 3602315 - RNA, 22 nt, Pseudomonas putida KT2440
ucgaugcacagcucgcgcugcc

SEQ ID NO: 3602316 - RNA, 22 nt, Pseudomonas putida KT2440
ucgaugcacguaccuggcugca

SEQ ID NO: 3602317 - RNA, 11 nt, Pseudomonas putida KT2440
ucgaugcccgu

SEQ ID NO: 3602318 - RNA, 23 nt, Pseudomonas putida KT2440
ucgaugccuacugcuggcgcgac

SEQ ID NO: 3602319 - RNA, 15 nt, Pseudomonas putida KT2440
ucgaugcgcacggca

SEQ ID NO: 3602320 - RNA, 13 nt, Pseudomonas putida KT2440
ucgauggccagga

SEQ ID NO: 3602321 - RNA, 21 nt, Pseudomonas putida KT2440
ucgaugggcaugccgcgcacu

SEQ ID NO: 3602322 - RNA, 17 nt, Pseudomonas putida KT2440
ucgauggucuucgccgc

SEQ ID NO: 3602323 - RNA, 17 nt, Pseudomonas putida KT2440
ucgauguccagcgaggg

SEQ ID NO: 3602324 - RNA, 16 nt, Pseudomonas putida KT2440
ucgauguucagcaccu

SEQ ID NO: 3602325 - RNA, 14 nt, Pseudomonas putida KT2440
ucgauuacccagcg

SEQ ID NO: 3602326 - RNA, 17 nt, Pseudomonas putida KT2440
ucgauugggucuuccag

SEQ ID NO: 3602327 - RNA, 20 nt, Pseudomonas putida KT2440
ucgauuuugcagucgauguc

SEQ ID NO: 3602328 - RNA, 16 nt, Pseudomonas putida KT2440
ucgcaaaaaacuucaa

SEQ ID NO: 3602329 - RNA, 16 nt, Pseudomonas putida KT2440
ucgcacagguccagcc

SEQ ID NO: 3602330 - RNA, 14 nt, Pseudomonas putida KT2440
ucgcacgcaugucc

SEQ ID NO: 3602331 - RNA, 21 nt, Pseudomonas putida KT2440
ucgcagcacaagacugcugug

SEQ ID NO: 3602332 - RNA, 14 nt, Pseudomonas putida KT2440
ucgcagcagcaccg

SEQ ID NO: 3602333 - RNA, 15 nt, Pseudomonas putida KT2440
ucgcagccaaugcug

SEQ ID NO: 3602334 - RNA, 12 nt, Pseudomonas putida KT2440
ucgcagcccacg

SEQ ID NO: 3602335 - RNA, 17 nt, Pseudomonas putida KT2440
ucgcagguauccggguc

SEQ ID NO: 3602336 - RNA, 16 nt, Pseudomonas putida KT2440
ucgcagguucgaaucc

SEQ ID NO: 3602337 - RNA, 23 nt, Pseudomonas putida KT2440
ucgcaguacaacgucacaugcgc

SEQ ID NO: 3602338 - RNA, 18 nt, Pseudomonas putida KT2440
ucgcaguacuugcuggau

SEQ ID NO: 3602339 - RNA, 24 nt, Pseudomonas putida KT2440
ucgcagucgaaggggaucagcacg

SEQ ID NO: 3602340 - RNA, 19 nt, Pseudomonas putida KT2440
ucgcauaugccccaggcau

SEQ ID NO: 3602341 - RNA, 21 nt, Pseudomonas putida KT2440
ucgcaugcagguucgaccaga

SEQ ID NO: 3602342 - RNA, 17 nt, Pseudomonas putida KT2440
ucgcaugcggccgugaa

SEQ ID NO: 3602343 - RNA, 18 nt, Pseudomonas putida KT2440
ucgcaugcggccgugaac

SEQ ID NO: 3602344 - RNA, 15 nt, Pseudomonas putida KT2440
ucgcauucgccggca

SEQ ID NO: 3602345 - RNA, 20 nt, Pseudomonas putida KT2440
ucgcauuucuagcuuggucu

SEQ ID NO: 3602346 - RNA, 19 nt, Pseudomonas putida KT2440
ucgccaaauucgaccagca

SEQ ID NO: 3602347 - RNA, 14 nt, Pseudomonas putida KT2440
ucgccaaccgccag

SEQ ID NO: 3602348 - RNA, 16 nt, Pseudomonas putida KT2440
ucgccaaccgccagca

SEQ ID NO: 3602349 - RNA, 15 nt, Pseudomonas putida KT2440
ucgccaacuucgccg

SEQ ID NO: 3602350 - RNA, 21 nt, Pseudomonas putida KT2440
ucgccaaggccucgaacagca

SEQ ID NO: 3602351 - RNA, 13 nt, Pseudomonas putida KT2440
ucgccaaggucca

SEQ ID NO: 3602352 - RNA, 19 nt, Pseudomonas putida KT2440
ucgccaagguccagccacg

SEQ ID NO: 3602353 - RNA, 14 nt, Pseudomonas putida KT2440
ucgccaaucaaccg

SEQ ID NO: 3602354 - RNA, 18 nt, Pseudomonas putida KT2440
ucgccaaucucguugcgc

SEQ ID NO: 3602355 - RNA, 22 nt, Pseudomonas putida KT2440
ucgccacacaagccccccugua

SEQ ID NO: 3602356 - RNA, 15 nt, Pseudomonas putida KT2440
ucgccacaccacagc

SEQ ID NO: 3602357 - RNA, 18 nt, Pseudomonas putida KT2440
ucgccacaccacagcugc

SEQ ID NO: 3602358 - RNA, 19 nt, Pseudomonas putida KT2440
ucgccacaccacagcugca

SEQ ID NO: 3602359 - RNA, 18 nt, Pseudomonas putida KT2440
ucgccaccggcauucccg

SEQ ID NO: 3602360 - RNA, 13 nt, Pseudomonas putida KT2440
ucgccacuugcug

SEQ ID NO: 3602361 - RNA, 20 nt, Pseudomonas putida KT2440
ucgccagcaccaucaggcac

SEQ ID NO: 3602362 - RNA, 14 nt, Pseudomonas putida KT2440
ucgccagcagcgcu

SEQ ID NO: 3602363 - RNA, 15 nt, Pseudomonas putida KT2440
ucgccagcagcgcuc

SEQ ID NO: 3602364 - RNA, 14 nt, Pseudomonas putida KT2440
ucgccagcaggccg

SEQ ID NO: 3602365 - RNA, 20 nt, Pseudomonas putida KT2440
ucgccagcaggccgccgacg

SEQ ID NO: 3602366 - RNA, 14 nt, Pseudomonas putida KT2440
ucgccagccccagc

SEQ ID NO: 3602367 - RNA, 16 nt, Pseudomonas putida KT2440
ucgccagccccagccc

SEQ ID NO: 3602368 - RNA, 19 nt, Pseudomonas putida KT2440
ucgccagccugcagcgcgg

SEQ ID NO: 3602369 - RNA, 18 nt, Pseudomonas putida KT2440
ucgccaggaucggcacga

SEQ ID NO: 3602370 - RNA, 14 nt, Pseudomonas putida KT2440
ucgccaggccccga

SEQ ID NO: 3602371 - RNA, 21 nt, Pseudomonas putida KT2440
ucgccaggccccgauacagcg

SEQ ID NO: 3602372 - RNA, 19 nt, Pseudomonas putida KT2440
ucgccaggccuucaucggc

SEQ ID NO: 3602373 - RNA, 22 nt, Pseudomonas putida KT2440
ucgccaggcuucagaucacccu

SEQ ID NO: 3602374 - RNA, 21 nt, Pseudomonas putida KT2440
ucgccagggcucaagacaguc

SEQ ID NO: 3602375 - RNA, 18 nt, Pseudomonas putida KT2440
ucgccagguacaguuccc

SEQ ID NO: 3602376 - RNA, 18 nt, Pseudomonas putida KT2440
ucgccaggugcucagcca

SEQ ID NO: 3602377 - RNA, 19 nt, Pseudomonas putida KT2440
ucgccaggugcucagccac

SEQ ID NO: 3602378 - RNA, 20 nt, Pseudomonas putida KT2440
ucgccaggugcucagccacg

SEQ ID NO: 3602379 - RNA, 20 nt, Pseudomonas putida KT2440
ucgccagguggaagcgcgca

SEQ ID NO: 3602380 - RNA, 20 nt, Pseudomonas putida KT2440
ucgccagguuggcccugaac

SEQ ID NO: 3602381 - RNA, 19 nt, Pseudomonas putida KT2440
ucgccauaggccgccugcc

SEQ ID NO: 3602382 - RNA, 20 nt, Pseudomonas putida KT2440
ucgccauggccgaucuucag

SEQ ID NO: 3602383 - RNA, 20 nt, Pseudomonas putida KT2440
ucgccauguguacgccgcug

SEQ ID NO: 3602384 - RNA, 16 nt, Pseudomonas putida KT2440
ucgccauucaccagcu

SEQ ID NO: 3602385 - RNA, 19 nt, Pseudomonas putida KT2440
ucgcccacgaucucacgcg

SEQ ID NO: 3602386 - RNA, 22 nt, Pseudomonas putida KT2440
ucgcccagacgguucgggaagu

SEQ ID NO: 3602387 - RNA, 15 nt, Pseudomonas putida KT2440
ucgcccagcgcucgu

SEQ ID NO: 3602388 - RNA, 17 nt, Pseudomonas putida KT2440
ucgcccaggccgccgau

SEQ ID NO: 3602389 - RNA, 18 nt, Pseudomonas putida KT2440
ucgcccaguuccaugucg

SEQ ID NO: 3602390 - RNA, 21 nt, Pseudomonas putida KT2440
ucgcccaugauguggcuggug

SEQ ID NO: 3602391 - RNA, 23 nt, Pseudomonas putida KT2440
ucgccccauaaaaaaacccgcug

SEQ ID NO: 3602392 - RNA, 14 nt, Pseudomonas putida KT2440
ucgcccccgcugca

SEQ ID NO: 3602393 - RNA, 17 nt, Pseudomonas putida KT2440
ucgcccccgcugcacag

SEQ ID NO: 3602394 - RNA, 16 nt, Pseudomonas putida KT2440
ucgccccgccagcgcc

SEQ ID NO: 3602395 - RNA, 14 nt, Pseudomonas putida KT2440
ucgcccgaccgcca

SEQ ID NO: 3602396 - RNA, 22 nt, Pseudomonas putida KT2440
ucgcccgcaacauaaggugcaa

SEQ ID NO: 3602397 - RNA, 17 nt, Pseudomonas putida KT2440
ucgcccgccagguagcg

SEQ ID NO: 3602398 - RNA, 22 nt, Pseudomonas putida KT2440
ucgcccgccagguagcgauugc

SEQ ID NO: 3602399 - RNA, 13 nt, Pseudomonas putida KT2440
ucgcccgccucgc

SEQ ID NO: 3602400 - RNA, 19 nt, Pseudomonas putida KT2440
ucgcccguguucgcgggca

SEQ ID NO: 3602401 - RNA, 13 nt, Pseudomonas putida KT2440
ucgcccucgcggc

SEQ ID NO: 3602402 - RNA, 21 nt, Pseudomonas putida KT2440
ucgcccuuugguacugcgccg

SEQ ID NO: 3602403 - RNA, 18 nt, Pseudomonas putida KT2440
ucgcccuuuuuuuauucc

SEQ ID NO: 3602404 - RNA, 13 nt, Pseudomonas putida KT2440
ucgccgacggcau

SEQ ID NO: 3602405 - RNA, 18 nt, Pseudomonas putida KT2440
ucgccgacggcauggccg

SEQ ID NO: 3602406 - RNA, 14 nt, Pseudomonas putida KT2440
ucgccgagaaaugg

SEQ ID NO: 3602407 - RNA, 18 nt, Pseudomonas putida KT2440
ucgccgagaaauggcagu

SEQ ID NO: 3602408 - RNA, 22 nt, Pseudomonas putida KT2440
ucgccgaggaauugcgccagga

SEQ ID NO: 3602409 - RNA, 13 nt, Pseudomonas putida KT2440
ucgccgaggcguu

SEQ ID NO: 3602410 - RNA, 19 nt, Pseudomonas putida KT2440
ucgccgaucagcuggguga

SEQ ID NO: 3602411 - RNA, 12 nt, Pseudomonas putida KT2440
ucgccgcaaccg

SEQ ID NO: 3602412 - RNA, 21 nt, Pseudomonas putida KT2440
ucgccgccacccaccacggcc

SEQ ID NO: 3602413 - RNA, 23 nt, Pseudomonas putida KT2440
ucgccgccacccaccacggccug

SEQ ID NO: 3602414 - RNA, 23 nt, Pseudomonas putida KT2440
ucgccgccaugguuuugggcacg

SEQ ID NO: 3602415 - RNA, 21 nt, Pseudomonas putida KT2440
ucgcgggcaugcccgcuccca

SEQ ID NO: 3602416 - RNA, 15 nt, Pseudomonas putida KT2440
ucgcgggccagccca

SEQ ID NO: 3602417 - RNA, 21 nt, Pseudomonas putida KT2440
ucgcgggcgcgcccgcuccca

SEQ ID NO: 3602418 - RNA, 18 nt, Pseudomonas putida KT2440
ucgcgggcgugcccgcga

SEQ ID NO: 3602419 - RNA, 17 nt, Pseudomonas putida KT2440
ucgcggguaaacccgcg

SEQ ID NO: 3602420 - RNA, 18 nt, Pseudomonas putida KT2440
ucgcggguaaacccgcgc

SEQ ID NO: 3602421 - RNA, 21 nt, Pseudomonas putida KT2440
ucgcggguaaacccgcgccua

SEQ ID NO: 3602422 - RNA, 17 nt, Pseudomonas putida KT2440
ucgcggguaaacccgcu

SEQ ID NO: 3602423 - RNA, 23 nt, Pseudomonas putida KT2440
ucgcggguaaacccgggucaggc

SEQ ID NO: 3602424 - RNA, 21 nt, Pseudomonas putida KT2440
ucgcggguaagcccgcuccua

SEQ ID NO: 3602425 - RNA, 21 nt, Pseudomonas putida KT2440
ucgcggguagacccgcuccua

SEQ ID NO: 3602426 - RNA, 17 nt, Pseudomonas putida KT2440
ucgcgggugaacccgcu

SEQ ID NO: 3602427 - RNA, 21 nt, Pseudomonas putida KT2440
ucgcgggugaacccgcuccua

SEQ ID NO: 3602428 - RNA, 18 nt, Pseudomonas putida KT2440
ucgcgguagagcugcagg

SEQ ID NO: 3602429 - RNA, 22 nt, Pseudomonas putida KT2440
ucgcggucuuguaucccaggcg

SEQ ID NO: 3602430 - RNA, 23 nt, Pseudomonas putida KT2440
ucgcggugcaacauguccacacc

SEQ ID NO: 3602431 - RNA, 14 nt, Pseudomonas putida KT2440
ucgcgucagcaccg

SEQ ID NO: 3602432 - RNA, 14 nt, Pseudomonas putida KT2440
ucgcguuguucagc

SEQ ID NO: 3602433 - RNA, 16 nt, Pseudomonas putida KT2440
ucgcguuguucagcag

SEQ ID NO: 3602434 - RNA, 17 nt, Pseudomonas putida KT2440
ucgcguuguucagcagc

SEQ ID NO: 3602435 - RNA, 17 nt, Pseudomonas putida KT2440
ucgcuaagguggugcgg

SEQ ID NO: 3602436 - RNA, 15 nt, Pseudomonas putida KT2440
ucgcuagaaaacguc

SEQ ID NO: 3602437 - RNA, 19 nt, Pseudomonas putida KT2440
ucgcuauuccgauacgccg

SEQ ID NO: 3602438 - RNA, 22 nt, Pseudomonas putida KT2440
ucgcucaacacgucggcuggca

SEQ ID NO: 3602439 - RNA, 20 nt, Pseudomonas putida KT2440
ucgcucagcuugaacuugcu

SEQ ID NO: 3602440 - RNA, 11 nt, Pseudomonas putida KT2440
ucgcucaggcu

SEQ ID NO: 3602441 - RNA, 20 nt, Pseudomonas putida KT2440
ucgcucaggcucuugaacug

SEQ ID NO: 3602442 - RNA, 18 nt, Pseudomonas putida KT2440
ucgcucagguagcgcgcc

SEQ ID NO: 3602443 - RNA, 15 nt, Pseudomonas putida KT2440
ucgcucagguaggca

SEQ ID NO: 3602444 - RNA, 14 nt, Pseudomonas putida KT2440
ucgcucaggugcac

SEQ ID NO: 3602445 - RNA, 14 nt, Pseudomonas putida KT2440
ucgcuccaggcggc

SEQ ID NO: 3602446 - RNA, 17 nt, Pseudomonas putida KT2440
ucgcuccaguggugcaa

SEQ ID NO: 3602447 - RNA, 13 nt, Pseudomonas putida KT2440
ucgcucuucaacc

SEQ ID NO: 3602448 - RNA, 12 nt, Pseudomonas putida KT2440
ucgcugaacacg

SEQ ID NO: 3602449 - RNA, 22 nt, Pseudomonas putida KT2440
ucgcugagggaaaacucgguca

SEQ ID NO: 3602450 - RNA, 19 nt, Pseudomonas putida KT2440
ucgcugauccgcuuucggc

SEQ ID NO: 3602451 - RNA, 14 nt, Pseudomonas putida KT2440
ucgcugaugcgccg

SEQ ID NO: 3602452 - RNA, 17 nt, Pseudomonas putida KT2440
ucgcugccacgcaugcc

SEQ ID NO: 3602453 - RNA, 22 nt, Pseudomonas putida KT2440
ucgcugccagcguuuccggguu

SEQ ID NO: 3602454 - RNA, 16 nt, Pseudomonas putida KT2440
ucgcugcccaacgccu

SEQ ID NO: 3602455 - RNA, 17 nt, Pseudomonas putida KT2440
ucgcugcccaacgccug

SEQ ID NO: 3602456 - RNA, 18 nt, Pseudomonas putida KT2440
ucgcugcccaacgccuga

SEQ ID NO: 3602457 - RNA, 13 nt, Pseudomonas putida KT2440
ucgcugcccgggc

SEQ ID NO: 3602458 - RNA, 13 nt, Pseudomonas putida KT2440
ucgcugccgccuu

SEQ ID NO: 3602459 - RNA, 20 nt, Pseudomonas putida KT2440
ucgcugccggucguagcguc

SEQ ID NO: 3602460 - RNA, 13 nt, Pseudomonas putida KT2440
ucgcugccgugca

SEQ ID NO: 3602461 - RNA, 13 nt, Pseudomonas putida KT2440
ucgcugcgauaga

SEQ ID NO: 3602462 - RNA, 15 nt, Pseudomonas putida KT2440
ucgcugcgcuggcca

SEQ ID NO: 3602463 - RNA, 17 nt, Pseudomonas putida KT2440
ucgcugcugccuucccg

SEQ ID NO: 3602464 - RNA, 13 nt, Pseudomonas putida KT2440
ucgcugcugugcg

SEQ ID NO: 3602465 - RNA, 21 nt, Pseudomonas putida KT2440
ucgcuggccugccccagcauc

SEQ ID NO: 3602466 - RNA, 17 nt, Pseudomonas putida KT2440
ucgcuggguacuggcuu

SEQ ID NO: 3602467 - RNA, 20 nt, Pseudomonas putida KT2440
ucgcugugcaacagcgccug

SEQ ID NO: 3602468 - RNA, 23 nt, Pseudomonas putida KT2440
ucgcuucggcgcgggcacccugg

SEQ ID NO: 3602469 - RNA, 23 nt, Pseudomonas putida KT2440
ucgcuucugcacucccgcugcug

SEQ ID NO: 3602470 - RNA, 14 nt, Pseudomonas putida KT2440
ucgcuucuuugcga

SEQ ID NO: 3602471 - RNA, 17 nt, Pseudomonas putida KT2440
ucgcuuucaccuugcug

SEQ ID NO: 3602472 - RNA, 15 nt, Pseudomonas putida KT2440
ucgcuuugcgggcac

SEQ ID NO: 3602473 - RNA, 16 nt, Pseudomonas putida KT2440
ucgcuuugcgggcacg

SEQ ID NO: 3602474 - RNA, 15 nt, Pseudomonas putida KT2440
ucgcuuuugcuugca

SEQ ID NO: 3602475 - RNA, 18 nt, Pseudomonas putida KT2440
ucggaaggggccgcaaag

SEQ ID NO: 3602476 - RNA, 17 nt, Pseudomonas putida KT2440
ucggaaugccacccuug

SEQ ID NO: 3602477 - RNA, 17 nt, Pseudomonas putida KT2440
ucggacagggucagcgg

SEQ ID NO: 3602478 - RNA, 18 nt, Pseudomonas putida KT2440
ucggacagggucagcggg

SEQ ID NO: 3602479 - RNA, 23 nt, Pseudomonas putida KT2440
ucggacagguagucaccguugag

SEQ ID NO: 3602480 - RNA, 16 nt, Pseudomonas putida KT2440
ucggacagguuggcgc

SEQ ID NO: 3602481 - RNA, 17 nt, Pseudomonas putida KT2440
ucggagcgggcuugccc

SEQ ID NO: 3602482 - RNA, 20 nt, Pseudomonas putida KT2440
ucggauacuccgggaacagc

SEQ ID NO: 3602483 - RNA, 20 nt, Pseudomonas putida KT2440
ucggauccaauguuagcccg

SEQ ID NO: 3602484 - RNA, 22 nt, Pseudomonas putida KT2440
ucggauccaauguuagcccgac

SEQ ID NO: 3602485 - RNA, 21 nt, Pseudomonas putida KT2440
ucggaugccacgcugaacacg

SEQ ID NO: 3602486 - RNA, 23 nt, Pseudomonas putida KT2440
ucggcaaacacauccagcgccgc

SEQ ID NO: 3602487 - RNA, 22 nt, Pseudomonas putida KT2440
ucggcaaacagguucucggcac

SEQ ID NO: 3602488 - RNA, 23 nt, Pseudomonas putida KT2440
ucggcaaagcguucgguguccuu

SEQ ID NO: 3602489 - RNA, 15 nt, Pseudomonas putida KT2440
ucggcaaccgagauc

SEQ ID NO: 3602490 - RNA, 21 nt, Pseudomonas putida KT2440
ucggcaaccgagaucucggua

SEQ ID NO: 3602491 - RNA, 16 nt, Pseudomonas putida KT2440
ucggcaacgauggucg

SEQ ID NO: 3602492 - RNA, 22 nt, Pseudomonas putida KT2440
ucggcaacgauggucgccacau

SEQ ID NO: 3602493 - RNA, 21 nt, Pseudomonas putida KT2440
ucggcaaucacccgcaggguc

SEQ ID NO: 3602494 - RNA, 23 nt, Pseudomonas putida KT2440
ucggcaaucacccgcagggucgu

SEQ ID NO: 3602495 - RNA, 13 nt, Pseudomonas putida KT2440
ucggcaaucaccg

SEQ ID NO: 3602496 - RNA, 13 nt, Pseudomonas putida KT2440
ucggcaaucagca

SEQ ID NO: 3602497 - RNA, 14 nt, Pseudomonas putida KT2440
ucggcaaucagcag

SEQ ID NO: 3602498 - RNA, 18 nt, Pseudomonas putida KT2440
ucggcaaucagcaggucg

SEQ ID NO: 3602499 - RNA, 14 nt, Pseudomonas putida KT2440
ucggcaaucugcuu

SEQ ID NO: 3602500 - RNA, 15 nt, Pseudomonas putida KT2440
ucggcaaucugcuug

SEQ ID NO: 3602501 - RNA, 15 nt, Pseudomonas putida KT2440
ucggcaaugcgcgcg

SEQ ID NO: 3602502 - RNA, 22 nt, Pseudomonas putida KT2440
ucggcaaugcgcgcgaaggccc

SEQ ID NO: 3602503 - RNA, 23 nt, Pseudomonas putida KT2440
ucggcacacgguuuccaggcgua

SEQ ID NO: 3602504 - RNA, 14 nt, Pseudomonas putida KT2440
ucggcaccaccgau

SEQ ID NO: 3602505 - RNA, 12 nt, Pseudomonas putida KT2440
ucggcaccgcac

SEQ ID NO: 3602506 - RNA, 17 nt, Pseudomonas putida KT2440
ucggcaccggcgacgcg

SEQ ID NO: 3602507 - RNA, 15 nt, Pseudomonas putida KT2440
ucggcacgcccagca

SEQ ID NO: 3602508 - RNA, 21 nt, Pseudomonas putida KT2440
ucggcacgcccagcaacugcg

SEQ ID NO: 3602509 - RNA, 16 nt, Pseudomonas putida KT2440
ucggcacgcgccagca

SEQ ID NO: 3602510 - RNA, 16 nt, Pseudomonas putida KT2440
ucggcacgcgcccggu

SEQ ID NO: 3602511 - RNA, 23 nt, Pseudomonas putida KT2440
ucggcacgcguaccccuggcgcu

SEQ ID NO: 3602512 - RNA, 17 nt, Pseudomonas putida KT2440
ucggcagaauuucaggc

SEQ ID NO: 3602513 - RNA, 21 nt, Pseudomonas putida KT2440
ucggcagaauuucaggcuggg

SEQ ID NO: 3602514 - RNA, 15 nt, Pseudomonas putida KT2440
ucggcagagcgccag

SEQ ID NO: 3602515 - RNA, 18 nt, Pseudomonas putida KT2440
ucggcagcacccgcuugg

SEQ ID NO: 3602516 - RNA, 21 nt, Pseudomonas putida KT2440
ucggcagcacccgcuuggcca

SEQ ID NO: 3602517 - RNA, 20 nt, Pseudomonas putida KT2440
ucggcaggcgguccagcaag

SEQ ID NO: 3602518 - RNA, 20 nt, Pseudomonas putida KT2440
ucggcaguguaaauagcugc

SEQ ID NO: 3602519 - RNA, 19 nt, Pseudomonas putida KT2440
ucggcauccucaagcugca

SEQ ID NO: 3602520 - RNA, 19 nt, Pseudomonas putida KT2440
ucgguaaagcgcgccucca

SEQ ID NO: 3602521 - RNA, 23 nt, Pseudomonas putida KT2440
ucgguaccacgcuagucaagcug

SEQ ID NO: 3602522 - RNA, 18 nt, Pseudomonas putida KT2440
ucgguacccgccagcaau

SEQ ID NO: 3602523 - RNA, 15 nt, Pseudomonas putida KT2440
ucgguaccuggccgu

SEQ ID NO: 3602524 - RNA, 18 nt, Pseudomonas putida KT2440
ucgguaccuggccgugcc

SEQ ID NO: 3602525 - RNA, 18 nt, Pseudomonas putida KT2440
ucgguagacuucugcgug

SEQ ID NO: 3602526 - RNA, 23 nt, Pseudomonas putida KT2440
ucgguagggaucaccgccagcag

SEQ ID NO: 3602527 - RNA, 14 nt, Pseudomonas putida KT2440
ucggucagcaccug

SEQ ID NO: 3602528 - RNA, 17 nt, Pseudomonas putida KT2440
ucggucagccagaugcg

SEQ ID NO: 3602529 - RNA, 17 nt, Pseudomonas putida KT2440
ucggucagggcgaugau

SEQ ID NO: 3602530 - RNA, 19 nt, Pseudomonas putida KT2440
ucggucucgaaccacagca

SEQ ID NO: 3602531 - RNA, 21 nt, Pseudomonas putida KT2440
ucggugaacagguugcgcgcc

SEQ ID NO: 3602532 - RNA, 16 nt, Pseudomonas putida KT2440
ucggugaagccgacca

SEQ ID NO: 3602533 - RNA, 20 nt, Pseudomonas putida KT2440
ucggugacgaucaccagggc

SEQ ID NO: 3602534 - RNA, 15 nt, Pseudomonas putida KT2440
ucggugaugaucagg

SEQ ID NO: 3602535 - RNA, 15 nt, Pseudomonas putida KT2440
ucggugcagcggcag

SEQ ID NO: 3602536 - RNA, 14 nt, Pseudomonas putida KT2440
ucggugcucaggcu

SEQ ID NO: 3602537 - RNA, 22 nt, Pseudomonas putida KT2440
ucggugcuccuuuauuacuaga

SEQ ID NO: 3602538 - RNA, 19 nt, Pseudomonas putida KT2440
ucgguggaaauuggccagc

SEQ ID NO: 3602539 - RNA, 12 nt, Pseudomonas putida KT2440
ucggugguugga

SEQ ID NO: 3602540 - RNA, 19 nt, Pseudomonas putida KT2440
ucgguugaugcagcgcccg

SEQ ID NO: 3602541 - RNA, 23 nt, Pseudomonas putida KT2440
ucgguuggguuggcacguugcug

SEQ ID NO: 3602542 - RNA, 13 nt, Pseudomonas putida KT2440
ucgguuucgccgg

SEQ ID NO: 3602543 - RNA, 22 nt, Pseudomonas putida KT2440
ucgguuucgccgguguucuuca

SEQ ID NO: 3602544 - RNA, 14 nt, Pseudomonas putida KT2440
ucgguuuuuccaug

SEQ ID NO: 3602545 - RNA, 15 nt, Pseudomonas putida KT2440
ucguacaucggguaa

SEQ ID NO: 3602546 - RNA, 22 nt, Pseudomonas putida KT2440
ucguaccgcauuguccucguca

SEQ ID NO: 3602547 - RNA, 19 nt, Pseudomonas putida KT2440
ucguacgcgggcagacuuc

SEQ ID NO: 3602548 - RNA, 16 nt, Pseudomonas putida KT2440
ucguacucggccgggc

SEQ ID NO: 3602549 - RNA, 14 nt, Pseudomonas putida KT2440
ucguagacgaagcc

SEQ ID NO: 3602550 - RNA, 18 nt, Pseudomonas putida KT2440
ucguagccggcuaucgga

SEQ ID NO: 3602551 - RNA, 22 nt, Pseudomonas putida KT2440
ucguagcgguugcgcaaaucgc

SEQ ID NO: 3602552 - RNA, 24 nt, Pseudomonas putida KT2440
ucguaggagcggguucacccgcga

SEQ ID NO: 3602553 - RNA, 14 nt, Pseudomonas putida KT2440
ucguaggcugcagc

SEQ ID NO: 3602554 - RNA, 14 nt, Pseudomonas putida KT2440
ucguaggcuucacg

SEQ ID NO: 3602555 - RNA, 23 nt, Pseudomonas putida KT2440
ucguaggucacggucuuggccgc

SEQ ID NO: 3602556 - RNA, 15 nt, Pseudomonas putida KT2440
ucguaguaauggccg

SEQ ID NO: 3602557 - RNA, 21 nt, Pseudomonas putida KT2440
ucgucaaaccggcaccggcga

SEQ ID NO: 3602558 - RNA, 18 nt, Pseudomonas putida KT2440
ucgucaagcucuuccuug

SEQ ID NO: 3602559 - RNA, 18 nt, Pseudomonas putida KT2440
ucgucaaggaagcuccag

SEQ ID NO: 3602560 - RNA, 21 nt, Pseudomonas putida KT2440
ucgucaaggaagcuccaggcg

SEQ ID NO: 3602561 - RNA, 17 nt, Pseudomonas putida KT2440
ucgucaccgccccagcg

SEQ ID NO: 3602562 - RNA, 23 nt, Pseudomonas putida KT2440
ucgucaccugacacauaggcagc

SEQ ID NO: 3602563 - RNA, 14 nt, Pseudomonas putida KT2440
ucgucacugacccu

SEQ ID NO: 3602564 - RNA, 22 nt, Pseudomonas putida KT2440
ucgucacugacccucaagugcc

SEQ ID NO: 3602565 - RNA, 20 nt, Pseudomonas putida KT2440
ucgucagggucuuccggcag

SEQ ID NO: 3602566 - RNA, 21 nt, Pseudomonas putida KT2440
ucgucaguugcagacgcgcag

SEQ ID NO: 3602567 - RNA, 14 nt, Pseudomonas putida KT2440
ucgucaugcagcgc

SEQ ID NO: 3602568 - RNA, 15 nt, Pseudomonas putida KT2440
ucgucaugcagcgcc

SEQ ID NO: 3602569 - RNA, 20 nt, Pseudomonas putida KT2440
ucguccacgcgcaggccacg

SEQ ID NO: 3602570 - RNA, 22 nt, Pseudomonas putida KT2440
ucguccagcucgcgcagggcau

SEQ ID NO: 3602571 - RNA, 13 nt, Pseudomonas putida KT2440
ucguccagggcau

SEQ ID NO: 3602572 - RNA, 21 nt, Pseudomonas putida KT2440
ucguccccgcgcuuugugcac

SEQ ID NO: 3602573 - RNA, 21 nt, Pseudomonas putida KT2440
ucgucccucggcaaggugcuc

SEQ ID NO: 3602574 - RNA, 19 nt, Pseudomonas putida KT2440
ucguccucgacccacggcu

SEQ ID NO: 3602575 - RNA, 18 nt, Pseudomonas putida KT2440
ucgucgaacucgcgccca

SEQ ID NO: 3602576 - RNA, 18 nt, Pseudomonas putida KT2440
ucgucgaccgcgaccaug

SEQ ID NO: 3602577 - RNA, 21 nt, Pseudomonas putida KT2440
ucgucgagcaacuugcgcagc

SEQ ID NO: 3602578 - RNA, 22 nt, Pseudomonas putida KT2440
ucgucgagcaacuugcgcagcu

SEQ ID NO: 3602579 - RNA, 21 nt, Pseudomonas putida KT2440
ucgucgaggcugucgaucaga

SEQ ID NO: 3602580 - RNA, 13 nt, Pseudomonas putida KT2440
ucgucgcccaggc

SEQ ID NO: 3602581 - RNA, 21 nt, Pseudomonas putida KT2440
ucgucgcugucaccgguaucg

SEQ ID NO: 3602582 - RNA, 23 nt, Pseudomonas putida KT2440
ucgucggcaagcuugccagcguc

SEQ ID NO: 3602583 - RNA, 20 nt, Pseudomonas putida KT2440
ucgucggugaugaucaggga

SEQ ID NO: 3602584 - RNA, 19 nt, Pseudomonas putida KT2440
ucgucgguuuccucgacgc

SEQ ID NO: 3602585 - RNA, 17 nt, Pseudomonas putida KT2440
ucgucguccgcaguccc

SEQ ID NO: 3602586 - RNA, 14 nt, Pseudomonas putida KT2440
ucgucuggcacuga

SEQ ID NO: 3602587 - RNA, 18 nt, Pseudomonas putida KT2440
ucgugaagcaccgccaca

SEQ ID NO: 3602588 - RNA, 14 nt, Pseudomonas putida KT2440
ucgugagaccugca

SEQ ID NO: 3602589 - RNA, 22 nt, Pseudomonas putida KT2440
ucgugaucauccccagcauggc

SEQ ID NO: 3602590 - RNA, 14 nt, Pseudomonas putida KT2440
ucgugcgccucaug

SEQ ID NO: 3602591 - RNA, 18 nt, Pseudomonas putida KT2440
ucgugcucacgccccuug

SEQ ID NO: 3602592 - RNA, 13 nt, Pseudomonas putida KT2440
ucgugcucgucuu

SEQ ID NO: 3602593 - RNA, 18 nt, Pseudomonas putida KT2440
ucguggcgcuggcgggca

SEQ ID NO: 3602594 - RNA, 23 nt, Pseudomonas putida KT2440
ucgugggucaugucggcagccag

SEQ ID NO: 3602595 - RNA, 17 nt, Pseudomonas putida KT2440
ucguuacccaccagcuc

SEQ ID NO: 3602596 - RNA, 14 nt, Pseudomonas putida KT2440
ucguuauccagcac

SEQ ID NO: 3602597 - RNA, 22 nt, Pseudomonas putida KT2440
ucguuauccugcagcaccagcu

SEQ ID NO: 3602598 - RNA, 22 nt, Pseudomonas putida KT2440
ucguucaacaccuucucggccu

SEQ ID NO: 3602599 - RNA, 13 nt, Pseudomonas putida KT2440
ucguucaugcccu

SEQ ID NO: 3602600 - RNA, 22 nt, Pseudomonas putida KT2440
ucguuccagugaagcuuccagu

SEQ ID NO: 3602601 - RNA, 13 nt, Pseudomonas putida KT2440
ucguucgcgggca

SEQ ID NO: 3602602 - RNA, 14 nt, Pseudomonas putida KT2440
ucguucgcgggcac

SEQ ID NO: 3602603 - RNA, 16 nt, Pseudomonas putida KT2440
ucguugaccguccaca

SEQ ID NO: 3602604 - RNA, 18 nt, Pseudomonas putida KT2440
ucguugaccguccacacc

SEQ ID NO: 3602605 - RNA, 19 nt, Pseudomonas putida KT2440
ucguugaugcgcuugaagu

SEQ ID NO: 3602606 - RNA, 14 nt, Pseudomonas putida KT2440
ucguugcgggucag

SEQ ID NO: 3602607 - RNA, 17 nt, Pseudomonas putida KT2440
ucguugcgggucagcuc

SEQ ID NO: 3602608 - RNA, 12 nt, Pseudomonas putida KT2440
ucguuggccagc

SEQ ID NO: 3602609 - RNA, 17 nt, Pseudomonas putida KT2440
ucguugguguagucggu

SEQ ID NO: 3602610 - RNA, 16 nt, Pseudomonas putida KT2440
ucguuguagcugacug

SEQ ID NO: 3602611 - RNA, 18 nt, Pseudomonas putida KT2440
ucguuguccagcagcagc

SEQ ID NO: 3602612 - RNA, 17 nt, Pseudomonas putida KT2440
ucguuucccgcuccaaa

SEQ ID NO: 3602613 - RNA, 21 nt, Pseudomonas putida KT2440
ucguuugcgaagguaaccugg

SEQ ID NO: 3602614 - RNA, 14 nt, Pseudomonas putida KT2440
ucguuuucgcugau

SEQ ID NO: 3602615 - RNA, 21 nt, Pseudomonas putida KT2440
ucuaaaaucaucggcaaauga

SEQ ID NO: 3602616 - RNA, 20 nt, Pseudomonas putida KT2440
ucuaccaaccugccaugcag

SEQ ID NO: 3602617 - RNA, 19 nt, Pseudomonas putida KT2440
ucuaccggcauaccaucuu

SEQ ID NO: 3602618 - RNA, 20 nt, Pseudomonas putida KT2440
ucuaccguuggcaucugcug

SEQ ID NO: 3602619 - RNA, 18 nt, Pseudomonas putida KT2440
ucuaccucacugacagca

SEQ ID NO: 3602620 - RNA, 18 nt, Pseudomonas putida KT2440
ucuaccugagccugcagg

SEQ ID NO: 3602621 - RNA, 14 nt, Pseudomonas putida KT2440
ucuaccugagcuuc

SEQ ID NO: 3602622 - RNA, 22 nt, Pseudomonas putida KT2440
ucuaccugagcuucaacgcgac

SEQ ID NO: 3602623 - RNA, 16 nt, Pseudomonas putida KT2440
ucuaguacuuuuucag

SEQ ID NO: 3602624 - RNA, 16 nt, Pseudomonas putida KT2440
ucugcucuucugccag

SEQ ID NO: 3602625 - RNA, 21 nt, Pseudomonas putida KT2440
ucugcugcggauacagcgccc

SEQ ID NO: 3602626 - RNA, 20 nt, Pseudomonas putida KT2440
ucugcugcggcaggcuggca

SEQ ID NO: 3602627 - RNA, 17 nt, Pseudomonas putida KT2440
ucugcuggauacccagc

SEQ ID NO: 3602628 - RNA, 20 nt, Pseudomonas putida KT2440
ucugcuggauacccagcgcc

SEQ ID NO: 3602629 - RNA, 20 nt, Pseudomonas putida KT2440
ucugcuuccuugcgcacgcg

SEQ ID NO: 3602630 - RNA, 18 nt, Pseudomonas putida KT2440
ucugcuucgcugccagga

SEQ ID NO: 3602631 - RNA, 14 nt, Pseudomonas putida KT2440
ucugcuugcccaga

SEQ ID NO: 3602632 - RNA, 19 nt, Pseudomonas putida KT2440
ucugcuugcucugugcaug

SEQ ID NO: 3602633 - RNA, 20 nt, Pseudomonas putida KT2440
ucugcuugggcaauggcgua

SEQ ID NO: 3602634 - RNA, 15 nt, Pseudomonas putida KT2440
ucuggauaugcucca

SEQ ID NO: 3602635 - RNA, 12 nt, Pseudomonas putida KT2440
ucuggcaacagc

SEQ ID NO: 3602636 - RNA, 22 nt, Pseudomonas putida KT2440
ucuggcaccaguuccagggcgg

SEQ ID NO: 3602637 - RNA, 14 nt, Pseudomonas putida KT2440
ucuggcccugggag

SEQ ID NO: 3602638 - RNA, 12 nt, Pseudomonas putida KT2440
ucuggcgcagcg

SEQ ID NO: 3602639 - RNA, 13 nt, Pseudomonas putida KT2440
ucuggcgcguguc

SEQ ID NO: 3602640 - RNA, 14 nt, Pseudomonas putida KT2440
ucuggcgugcaccu

SEQ ID NO: 3602641 - RNA, 20 nt, Pseudomonas putida KT2440
ucuggcugcaagguccaggc

SEQ ID NO: 3602642 - RNA, 21 nt, Pseudomonas putida KT2440
ucuggcuggagccguccagga

SEQ ID NO: 3602643 - RNA, 16 nt, Pseudomonas putida KT2440
ucugggguuggaccca

SEQ ID NO: 3602644 - RNA, 23 nt, Pseudomonas putida KT2440
ucugguaauaccacauccccgcc

SEQ ID NO: 3602645 - RNA, 15 nt, Pseudomonas putida KT2440
ucugguacaacaaca

SEQ ID NO: 3602646 - RNA, 20 nt, Pseudomonas putida KT2440
ucugguaggccggccguggg

SEQ ID NO: 3602647 - RNA, 15 nt, Pseudomonas putida KT2440
ucuggucaccuucgu

SEQ ID NO: 3602648 - RNA, 18 nt, Pseudomonas putida KT2440
ucuggucaccuucguccu

SEQ ID NO: 3602649 - RNA, 22 nt, Pseudomonas putida KT2440
ucuggucgaucuucagcgcauc

SEQ ID NO: 3602650 - RNA, 23 nt, Pseudomonas putida KT2440
ucuggucguugguggugcgcccg

SEQ ID NO: 3602651 - RNA, 22 nt, Pseudomonas putida KT2440
ucugguuacccaacagaccacc

SEQ ID NO: 3602652 - RNA, 13 nt, Pseudomonas putida KT2440
ucugguugaacug

SEQ ID NO: 3602653 - RNA, 17 nt, Pseudomonas putida KT2440
ucugguugccgccagcc

SEQ ID NO: 3602654 - RNA, 22 nt, Pseudomonas putida KT2440
ucuguaaucaggcuguccacac

SEQ ID NO: 3602655 - RNA, 20 nt, Pseudomonas putida KT2440
ucuguacaguggcacuggcg

SEQ ID NO: 3602656 - RNA, 15 nt, Pseudomonas putida KT2440
ucuguacugcggcug

SEQ ID NO: 3602657 - RNA, 16 nt, Pseudomonas putida KT2440
ucuguaucgaacaggc

SEQ ID NO: 3602658 - RNA, 14 nt, Pseudomonas putida KT2440
ucugucagcgccag

SEQ ID NO: 3602659 - RNA, 13 nt, Pseudomonas putida KT2440
ucugugcccgcga

SEQ ID NO: 3602660 - RNA, 12 nt, Pseudomonas putida KT2440
ucugugggagcg

SEQ ID NO: 3602661 - RNA, 18 nt, Pseudomonas putida KT2440
ucugugggagcggccuug

SEQ ID NO: 3602662 - RNA, 18 nt, Pseudomonas putida KT2440
ucugugggagcgggcuug

SEQ ID NO: 3602663 - RNA, 13 nt, Pseudomonas putida KT2440
ucuguguucuuca

SEQ ID NO: 3602664 - RNA, 21 nt, Pseudomonas putida KT2440
ucuguuacuauuaaccgcuug

SEQ ID NO: 3602665 - RNA, 18 nt, Pseudomonas putida KT2440
ucuguugcugcagguucu

SEQ ID NO: 3602666 - RNA, 15 nt, Pseudomonas putida KT2440
ucuguuucaccagca

SEQ ID NO: 3602667 - RNA, 16 nt, Pseudomonas putida KT2440
ucuucaaccaguucag

SEQ ID NO: 3602668 - RNA, 20 nt, Pseudomonas putida KT2440
ucuucaaccuguuccggccu

SEQ ID NO: 3602669 - RNA, 22 nt, Pseudomonas putida KT2440
ucuucaagcagcgaaugcagcu

SEQ ID NO: 3602670 - RNA, 19 nt, Pseudomonas putida KT2440
ucuucaagcucgaagcgcu

SEQ ID NO: 3602671 - RNA, 14 nt, Pseudomonas putida KT2440
ucuucaaggccacc

SEQ ID NO: 3602672 - RNA, 21 nt, Pseudomonas putida KT2440
ucuucaaggccgccaccucgc

SEQ ID NO: 3602673 - RNA, 15 nt, Pseudomonas putida KT2440
ucuucacaccggccu

SEQ ID NO: 3602674 - RNA, 17 nt, Pseudomonas putida KT2440
ucuucaccaugggccug

SEQ ID NO: 3602675 - RNA, 19 nt, Pseudomonas putida KT2440
ucuucaccguacuugcugc

SEQ ID NO: 3602676 - RNA, 14 nt, Pseudomonas putida KT2440
ucuucaccuugccu

SEQ ID NO: 3602677 - RNA, 23 nt, Pseudomonas putida KT2440
ucuucagccaccgcacucugcug

SEQ ID NO: 3602678 - RNA, 21 nt, Pseudomonas putida KT2440
ucuucagccgucgccgcuucg

SEQ ID NO: 3602679 - RNA, 12 nt, Pseudomonas putida KT2440
ucuucaggcaau

SEQ ID NO: 3602680 - RNA, 13 nt, Pseudomonas putida KT2440
ucuucaggcaaug

SEQ ID NO: 3602681 - RNA, 18 nt, Pseudomonas putida KT2440
ucuucaugcaauaaccaa

SEQ ID NO: 3602682 - RNA, 19 nt, Pseudomonas putida KT2440
ucuuccaaguuggcucugu

SEQ ID NO: 3602683 - RNA, 21 nt, Pseudomonas putida KT2440
ucuuccaccgccucgaccugg

SEQ ID NO: 3602684 - RNA, 12 nt, Pseudomonas putida KT2440
ucuuccacgccc

SEQ ID NO: 3602685 - RNA, 13 nt, Pseudomonas putida KT2440
ucuuccagcucgc

SEQ ID NO: 3602686 - RNA, 19 nt, Pseudomonas putida KT2440
ucuuccagcucgcuuuccu

SEQ ID NO: 3602687 - RNA, 13 nt, Pseudomonas putida KT2440
ucuuccagcucuu

SEQ ID NO: 3602688 - RNA, 21 nt, Pseudomonas putida KT2440
ucuuccaguuccauccagucc

SEQ ID NO: 3602689 - RNA, 12 nt, Pseudomonas putida KT2440
ucuucccaccac

SEQ ID NO: 3602690 - RNA, 19 nt, Pseudomonas putida KT2440
ucuucccaccaccagcgcc

SEQ ID NO: 3602691 - RNA, 15 nt, Pseudomonas putida KT2440
ucuuccccgcccaag

SEQ ID NO: 3602692 - RNA, 22 nt, Pseudomonas putida KT2440
ucuuccgcacgggucaccucau

SEQ ID NO: 3602693 - RNA, 19 nt, Pseudomonas putida KT2440
ucuuccgccagccaacgcu

SEQ ID NO: 3602694 - RNA, 16 nt, Pseudomonas putida KT2440
ucuuccggcagguaag

SEQ ID NO: 3602695 - RNA, 23 nt, Pseudomonas putida KT2440
ucuuccggcaggucggcaaccau

SEQ ID NO: 3602696 - RNA, 18 nt, Pseudomonas putida KT2440
ucuuccggcaugaacaca

SEQ ID NO: 3602697 - RNA, 16 nt, Pseudomonas putida KT2440
ucuuccucgacccagc

SEQ ID NO: 3602698 - RNA, 17 nt, Pseudomonas putida KT2440
ucuuccucgacccagcc

SEQ ID NO: 3602699 - RNA, 16 nt, Pseudomonas putida KT2440
ucuuccuggcuggcag

SEQ ID NO: 3602700 - RNA, 21 nt, Pseudomonas putida KT2440
ucuuccuggcuggcagccggc

SEQ ID NO: 3602701 - RNA, 12 nt, Pseudomonas putida KT2440
ucuuccugguuu

SEQ ID NO: 3602702 - RNA, 22 nt, Pseudomonas putida KT2440
ucuucgacacugaucucgcgca

SEQ ID NO: 3602703 - RNA, 21 nt, Pseudomonas putida KT2440
ucuucgaggaugcggcugacc

SEQ ID NO: 3602704 - RNA, 13 nt, Pseudomonas putida KT2440
ucuucgaggucau

SEQ ID NO: 3602705 - RNA, 18 nt, Pseudomonas putida KT2440
ucuucgaucuggaucacu

SEQ ID NO: 3602706 - RNA, 15 nt, Pseudomonas putida KT2440
ucuucgccugcagca

SEQ ID NO: 3602707 - RNA, 22 nt, Pseudomonas putida KT2440
ucuucgcgcucgaacaacgccu

SEQ ID NO: 3602708 - RNA, 14 nt, Pseudomonas putida KT2440
ucuucgcgggcaag

SEQ ID NO: 3602709 - RNA, 18 nt, Pseudomonas putida KT2440
ucuucgcgggcaagcccg

SEQ ID NO: 3602710 - RNA, 23 nt, Pseudomonas putida KT2440
ucuucgcgggcacgcccgcuccc

SEQ ID NO: 3602711 - RNA, 20 nt, Pseudomonas putida KT2440
ucuucgcggguaaacccgcu

SEQ ID NO: 3602712 - RNA, 20 nt, Pseudomonas putida KT2440
ucuucgcgggugaacccgcu

SEQ ID NO: 3602713 - RNA, 21 nt, Pseudomonas putida KT2440
ucuucgcgggugaacccgcuc

SEQ ID NO: 3602714 - RNA, 19 nt, Pseudomonas putida KT2440
ucuucgcucacaaagcccu

SEQ ID NO: 3602715 - RNA, 17 nt, Pseudomonas putida KT2440
ucuucgcuguaaccugg

SEQ ID NO: 3602716 - RNA, 15 nt, Pseudomonas putida KT2440
ucuucggccagcaac

SEQ ID NO: 3602717 - RNA, 16 nt, Pseudomonas putida KT2440
ucuucggccagcaacu

SEQ ID NO: 3602718 - RNA, 22 nt, Pseudomonas putida KT2440
ucuucggccaguuucagcgccu

SEQ ID NO: 3602719 - RNA, 22 nt, Pseudomonas putida KT2440
ucuucgguagacuucugcgugc

SEQ ID NO: 3602720 - RNA, 16 nt, Pseudomonas putida KT2440
ucuucggucagcuggu

SEQ ID NO: 3602721 - RNA, 22 nt, Pseudomonas putida KT2440
ucuucgguggcguugucagcaa

SEQ ID NO: 3602722 - RNA, 22 nt, Pseudomonas putida KT2440
ucuucggugucggccagcugcg

SEQ ID NO: 3602723 - RNA, 16 nt, Pseudomonas putida KT2440
ucuucgugcgccucau

SEQ ID NO: 3602724 - RNA, 22 nt, Pseudomonas putida KT2440
ucuucgugcgccucaugcagca

SEQ ID NO: 3602725 - RNA, 21 nt, Pseudomonas putida KT2440
ucuucguggaacugcagagcg

SEQ ID NO: 3602726 - RNA, 19 nt, Pseudomonas putida KT2440
ucuucguucuugaagauga

SEQ ID NO: 3602727 - RNA, 16 nt, Pseudomonas putida KT2440
ucuucucggcagaccc

SEQ ID NO: 3602728 - RNA, 21 nt, Pseudomonas putida KT2440
ucuucucguugggcuugaucc

SEQ ID NO: 3602729 - RNA, 15 nt, Pseudomonas putida KT2440
ugaaggcaggucagc

SEQ ID NO: 3602730 - RNA, 12 nt, Pseudomonas putida KT2440
ugaaggccagug

SEQ ID NO: 3602731 - RNA, 23 nt, Pseudomonas putida KT2440
ugaaggccagugcgaucugagua

SEQ ID NO: 3602732 - RNA, 12 nt, Pseudomonas putida KT2440
ugaaggcccagc

SEQ ID NO: 3602733 - RNA, 19 nt, Pseudomonas putida KT2440
ugaaggcgaaugagaggcg

SEQ ID NO: 3602734 - RNA, 21 nt, Pseudomonas putida KT2440
ugaagggacuuaaucaaugca

SEQ ID NO: 3602735 - RNA, 20 nt, Pseudomonas putida KT2440
ugaaguacucggcacgcgcc

SEQ ID NO: 3602736 - RNA, 19 nt, Pseudomonas putida KT2440
ugaaguacuggucgcgugc

SEQ ID NO: 3602737 - RNA, 19 nt, Pseudomonas putida KT2440
ugaaguagaacuggcgcag

SEQ ID NO: 3602738 - RNA, 24 nt, Pseudomonas putida KT2440
ugaaguaguccccaucacgcagcg

SEQ ID NO: 3602739 - RNA, 14 nt, Pseudomonas putida KT2440
ugaaguauaaaggu

SEQ ID NO: 3602740 - RNA, 15 nt, Pseudomonas putida KT2440
ugaagugccaaggcu

SEQ ID NO: 3602741 - RNA, 15 nt, Pseudomonas putida KT2440
ugaaguugcaggcau

SEQ ID NO: 3602742 - RNA, 22 nt, Pseudomonas putida KT2440
ugaaguugcggcauagcucgag

SEQ ID NO: 3602743 - RNA, 21 nt, Pseudomonas putida KT2440
ugaauaaagaaagugaugaaa

SEQ ID NO: 3602744 - RNA, 14 nt, Pseudomonas putida KT2440
ugaauaaccugguu

SEQ ID NO: 3602745 - RNA, 15 nt, Pseudomonas putida KT2440
ugaauacaccagcuu

SEQ ID NO: 3602746 - RNA, 13 nt, Pseudomonas putida KT2440
ugaaucagcaaac

SEQ ID NO: 3602747 - RNA, 15 nt, Pseudomonas putida KT2440
ugaaucagcaaaccg

SEQ ID NO: 3602748 - RNA, 19 nt, Pseudomonas putida KT2440
ugaaucagccccagccggu

SEQ ID NO: 3602749 - RNA, 15 nt, Pseudomonas putida KT2440
ugaaucccugagcca

SEQ ID NO: 3602750 - RNA, 22 nt, Pseudomonas putida KT2440
ugaaucuucggugcccacugca

SEQ ID NO: 3602751 - RNA, 16 nt, Pseudomonas putida KT2440
ugaaucuugcgcgcca

SEQ ID NO: 3602752 - RNA, 20 nt, Pseudomonas putida KT2440
ugaaugaaaaagccccgcca

SEQ ID NO: 3602753 - RNA, 21 nt, Pseudomonas putida KT2440
ugaaugaaaaagccccgccag

SEQ ID NO: 3602754 - RNA, 12 nt, Pseudomonas putida KT2440
ugaauuccuugc

SEQ ID NO: 3602755 - RNA, 15 nt, Pseudomonas putida KT2440
ugaauuccuugcagc

SEQ ID NO: 3602756 - RNA, 18 nt, Pseudomonas putida KT2440
ugaauuggagcugaaacu

SEQ ID NO: 3602757 - RNA, 18 nt, Pseudomonas putida KT2440
ugaauuuuuuauagcuuu

SEQ ID NO: 3602758 - RNA, 21 nt, Pseudomonas putida KT2440
ugacaaacgccagcaugcugg

SEQ ID NO: 3602759 - RNA, 19 nt, Pseudomonas putida KT2440
ugacaaagcggaucggccg

SEQ ID NO: 3602760 - RNA, 18 nt, Pseudomonas putida KT2440
ugacaaaggccggcaccg

SEQ ID NO: 3602761 - RNA, 17 nt, Pseudomonas putida KT2440
ugacaacgaugugcgag

SEQ ID NO: 3602762 - RNA, 16 nt, Pseudomonas putida KT2440
ugacacauaggcagcc

SEQ ID NO: 3602763 - RNA, 13 nt, Pseudomonas putida KT2440
ugacaccgcugcc

SEQ ID NO: 3602764 - RNA, 19 nt, Pseudomonas putida KT2440
ugacaccgcugccgggcaa

SEQ ID NO: 3602765 - RNA, 15 nt, Pseudomonas putida KT2440
ugacaccggcuacga

SEQ ID NO: 3602766 - RNA, 21 nt, Pseudomonas putida KT2440
ugacagcaggaacagcggcag

SEQ ID NO: 3602767 - RNA, 12 nt, Pseudomonas putida KT2440
ugacagcccugc

SEQ ID NO: 3602768 - RNA, 23 nt, Pseudomonas putida KT2440
ugacaggcagucaugggccaugc

SEQ ID NO: 3602769 - RNA, 19 nt, Pseudomonas putida KT2440
ugacaggcgaucagucagu

SEQ ID NO: 3602770 - RNA, 19 nt, Pseudomonas putida KT2440
ugaccaaggaacugcgcug

SEQ ID NO: 3602771 - RNA, 21 nt, Pseudomonas putida KT2440
ugaccaaggaacugcgcugcc

SEQ ID NO: 3602772 - RNA, 17 nt, Pseudomonas putida KT2440
ugaccaccgugcugugu

SEQ ID NO: 3602773 - RNA, 18 nt, Pseudomonas putida KT2440
ugaccacgaugcccaugg

SEQ ID NO: 3602774 - RNA, 21 nt, Pseudomonas putida KT2440
ugaccagcaacggccgcgccg

SEQ ID NO: 3602775 - RNA, 16 nt, Pseudomonas putida KT2440
ugaccagcccgcugca

SEQ ID NO: 3602776 - RNA, 12 nt, Pseudomonas putida KT2440
ugaccagcggca

SEQ ID NO: 3602777 - RNA, 15 nt, Pseudomonas putida KT2440
ugaccagcggcagca

SEQ ID NO: 3602778 - RNA, 16 nt, Pseudomonas putida KT2440
ugaccagcggcagcaa

SEQ ID NO: 3602779 - RNA, 15 nt, Pseudomonas putida KT2440
ugaccaggcccagca

SEQ ID NO: 3602780 - RNA, 17 nt, Pseudomonas putida KT2440
ugaccaggcccagcagg

SEQ ID NO: 3602781 - RNA, 21 nt, Pseudomonas putida KT2440
ugaccagugucugcaacugcc

SEQ ID NO: 3602782 - RNA, 22 nt, Pseudomonas putida KT2440
ugaccaguugcucgcagacuuc

SEQ ID NO: 3602783 - RNA, 18 nt, Pseudomonas putida KT2440
ugaccauuggccaaccag

SEQ ID NO: 3602784 - RNA, 16 nt, Pseudomonas putida KT2440
ugaccauuuccggguc

SEQ ID NO: 3602785 - RNA, 14 nt, Pseudomonas putida KT2440
ugacccagcgcugg

SEQ ID NO: 3602786 - RNA, 17 nt, Pseudomonas putida KT2440
ugacccagcgcugguuu

SEQ ID NO: 3602787 - RNA, 16 nt, Pseudomonas putida KT2440
ugacccaguucgcgga

SEQ ID NO: 3602788 - RNA, 13 nt, Pseudomonas putida KT2440
ugacccgcuccca

SEQ ID NO: 3602789 - RNA, 20 nt, Pseudomonas putida KT2440
ugacccggccuuucgcgcca

SEQ ID NO: 3602790 - RNA, 17 nt, Pseudomonas putida KT2440
ugacccggugcacccac

SEQ ID NO: 3602791 - RNA, 16 nt, Pseudomonas putida KT2440
ugacccuuccagcccg

SEQ ID NO: 3602792 - RNA, 21 nt, Pseudomonas putida KT2440
ugacccuuccagcccgccugc

SEQ ID NO: 3602793 - RNA, 18 nt, Pseudomonas putida KT2440
ugaccgagaacaggcggc

SEQ ID NO: 3602794 - RNA, 17 nt, Pseudomonas putida KT2440
ugaccgagguaccaccg

SEQ ID NO: 3602795 - RNA, 18 nt, Pseudomonas putida KT2440
ugaccgagguaccaccgg

SEQ ID NO: 3602796 - RNA, 22 nt, Pseudomonas putida KT2440
ugaccgaugaucugccgggcca

SEQ ID NO: 3602797 - RNA, 15 nt, Pseudomonas putida KT2440
ugaccgcccagcguc

SEQ ID NO: 3602798 - RNA, 21 nt, Pseudomonas putida KT2440
ugaccgcccagcgucgucugc

SEQ ID NO: 3602799 - RNA, 14 nt, Pseudomonas putida KT2440
ugaccgccccgccc

SEQ ID NO: 3602800 - RNA, 12 nt, Pseudomonas putida KT2440
ugaccgccgcca

SEQ ID NO: 3602801 - RNA, 20 nt, Pseudomonas putida KT2440
ugaccgcgcauuugcuccag

SEQ ID NO: 3602802 - RNA, 20 nt, Pseudomonas putida KT2440
ugaccggaauguuaccggcc

SEQ ID NO: 3602803 - RNA, 17 nt, Pseudomonas putida KT2440
ugaccggcacugcacag

SEQ ID NO: 3602804 - RNA, 20 nt, Pseudomonas putida KT2440
ugaccggggcugcuuugcag

SEQ ID NO: 3602805 - RNA, 14 nt, Pseudomonas putida KT2440
ugaccguccacacc

SEQ ID NO: 3602806 - RNA, 23 nt, Pseudomonas putida KT2440
ugaccguguauccauacuuggcc

SEQ ID NO: 3602807 - RNA, 19 nt, Pseudomonas putida KT2440
ugaccguguugcagcgggu

SEQ ID NO: 3602808 - RNA, 18 nt, Pseudomonas putida KT2440
ugaccguuggucgcgccg

SEQ ID NO: 3602809 - RNA, 15 nt, Pseudomonas putida KT2440
ugaccguuugcagcg

SEQ ID NO: 3602810 - RNA, 21 nt, Pseudomonas putida KT2440
ugaccucgaccaggcgcucgc

SEQ ID NO: 3602811 - RNA, 16 nt, Pseudomonas putida KT2440
ugaccucgacccgccc

SEQ ID NO: 3602812 - RNA, 20 nt, Pseudomonas putida KT2440
ugaccucugguuuugucggc

SEQ ID NO: 3602813 - RNA, 14 nt, Pseudomonas putida KT2440
ugaccuggaucgcc

SEQ ID NO: 3602814 - RNA, 17 nt, Pseudomonas putida KT2440
ugaccuggaucgccagg

SEQ ID NO: 3602815 - RNA, 15 nt, Pseudomonas putida KT2440
ugaccuugcugcuca

SEQ ID NO: 3602816 - RNA, 12 nt, Pseudomonas putida KT2440
ugaccuuggcug

SEQ ID NO: 3602817 - RNA, 13 nt, Pseudomonas putida KT2440
ugaccuuggcugg

SEQ ID NO: 3602818 - RNA, 19 nt, Pseudomonas putida KT2440
ugacgaccgauaaagagaa

SEQ ID NO: 3602819 - RNA, 20 nt, Pseudomonas putida KT2440
ugacgcaagcgcgccgccac

SEQ ID NO: 3602820 - RNA, 13 nt, Pseudomonas putida KT2440
ugacgccgccagc

SEQ ID NO: 3602821 - RNA, 17 nt, Pseudomonas putida KT2440
ugacgcgccaggucuuc

SEQ ID NO: 3602822 - RNA, 14 nt, Pseudomonas putida KT2440
ugacgcggagccgg

SEQ ID NO: 3602823 - RNA, 12 nt, Pseudomonas putida KT2440
ugacgcuacgcc

SEQ ID NO: 3602824 - RNA, 13 nt, Pseudomonas putida KT2440
ugacgcugcacuu

SEQ ID NO: 3602825 - RNA, 16 nt, Pseudomonas putida KT2440
ugacgcugcacuucca

SEQ ID NO: 3602826 - RNA, 14 nt, Pseudomonas putida KT2440
ugacggcgcugcug

SEQ ID NO: 3602827 - RNA, 16 nt, Pseudomonas putida KT2440
ugacgggccucuucgc

SEQ ID NO: 3602828 - RNA, 19 nt, Pseudomonas putida KT2440
ugacggugcgcgccagcgg

SEQ ID NO: 3602829 - RNA, 21 nt, Pseudomonas putida KT2440
ugacggugugcggaucgccgc

SEQ ID NO: 3602830 - RNA, 21 nt, Pseudomonas putida KT2440
ugacgucauucaaggucagcu

SEQ ID NO: 3602831 - RNA, 20 nt, Pseudomonas putida KT2440
ugacgugcgcuccuggucau

SEQ ID NO: 3602832 - RNA, 22 nt, Pseudomonas putida KT2440
ugacguugcaggauuugcccgc

SEQ ID NO: 3602833 - RNA, 15 nt, Pseudomonas putida KT2440
ugacguuggccgcca

SEQ ID NO: 3602834 - RNA, 14 nt, Pseudomonas putida KT2440
ugaucaucagaccg

SEQ ID NO: 3602835 - RNA, 14 nt, Pseudomonas putida KT2440
ugaucauccccagc

SEQ ID NO: 3602836 - RNA, 16 nt, Pseudomonas putida KT2440
ugaucauguccuugcu

SEQ ID NO: 3602837 - RNA, 14 nt, Pseudomonas putida KT2440
ugaucauucaggca

SEQ ID NO: 3602838 - RNA, 15 nt, Pseudomonas putida KT2440
ugauccaaauugcuc

SEQ ID NO: 3602839 - RNA, 20 nt, Pseudomonas putida KT2440
ugauccgcuuucggcagugu

SEQ ID NO: 3602840 - RNA, 16 nt, Pseudomonas putida KT2440
ugauccggcacuccag

SEQ ID NO: 3602841 - RNA, 15 nt, Pseudomonas putida KT2440
ugauccucacgcaca

SEQ ID NO: 3602842 - RNA, 21 nt, Pseudomonas putida KT2440
ugauccuguugcgauuucuug

SEQ ID NO: 3602843 - RNA, 17 nt, Pseudomonas putida KT2440
ugaucgaaagcgguuga

SEQ ID NO: 3602844 - RNA, 21 nt, Pseudomonas putida KT2440
ugaucgagccgaucaggaagc

SEQ ID NO: 3602845 - RNA, 14 nt, Pseudomonas putida KT2440
ugaucgcggcguug

SEQ ID NO: 3602846 - RNA, 22 nt, Pseudomonas putida KT2440
ugaucgcggcguugucagccuu

SEQ ID NO: 3602847 - RNA, 18 nt, Pseudomonas putida KT2440
ugaucgcguuacccacca

SEQ ID NO: 3602848 - RNA, 19 nt, Pseudomonas putida KT2440
ugaucgcguuacccaccag

SEQ ID NO: 3602849 - RNA, 15 nt, Pseudomonas putida KT2440
ugaucgcuacagagg

SEQ ID NO: 3602850 - RNA, 20 nt, Pseudomonas putida KT2440
ugaucgcuucggcgcgggca

SEQ ID NO: 3602851 - RNA, 13 nt, Pseudomonas putida KT2440
ugaucgcuugcgc

SEQ ID NO: 3602852 - RNA, 16 nt, Pseudomonas putida KT2440
ugaucguugcgcgcca

SEQ ID NO: 3602853 - RNA, 21 nt, Pseudomonas putida KT2440
ugaucugcgcgcucacugcau

SEQ ID NO: 3602854 - RNA, 18 nt, Pseudomonas putida KT2440
ugaucugcuggauaccca

SEQ ID NO: 3602855 - RNA, 18 nt, Pseudomonas putida KT2440
ugaucuguugcugcaggu

SEQ ID NO: 3602856 - RNA, 21 nt, Pseudomonas putida KT2440
ugaucuugguggucagccagg

SEQ ID NO: 3602857 - RNA, 22 nt, Pseudomonas putida KT2440
ugaucuugguggucagccaggc

SEQ ID NO: 3602858 - RNA, 18 nt, Pseudomonas putida KT2440
ugaugaaacuuuucauug

SEQ ID NO: 3602859 - RNA, 21 nt, Pseudomonas putida KT2440
ugaugaagccacgcucgugca

SEQ ID NO: 3602860 - RNA, 13 nt, Pseudomonas putida KT2440
ugaugaucugcuc

SEQ ID NO: 3602861 - RNA, 19 nt, Pseudomonas putida KT2440
ugaugcagcagugccagca

SEQ ID NO: 3602862 - RNA, 13 nt, Pseudomonas putida KT2440
ugaugccacgggc

SEQ ID NO: 3602863 - RNA, 19 nt, Pseudomonas putida KT2440
ugaugccccugcgccgcca

SEQ ID NO: 3602864 - RNA, 18 nt, Pseudomonas putida KT2440
ugaugccggaguggaaga

SEQ ID NO: 3602865 - RNA, 23 nt, Pseudomonas putida KT2440
ugaugcgcaccggaguccccacc

SEQ ID NO: 3602866 - RNA, 14 nt, Pseudomonas putida KT2440
ugaugcgcccuucg

SEQ ID NO: 3602867 - RNA, 18 nt, Pseudomonas putida KT2440
ugaugcgcguccagcccg

SEQ ID NO: 3602868 - RNA, 23 nt, Pseudomonas putida KT2440
ugaugcgcguccagcccggucca

SEQ ID NO: 3602869 - RNA, 12 nt, Pseudomonas putida KT2440
ugaugcgcuugc

SEQ ID NO: 3602870 - RNA, 15 nt, Pseudomonas putida KT2440
ugaugcgcuugccag

SEQ ID NO: 3602871 - RNA, 15 nt, Pseudomonas putida KT2440
ugaugcggacccagc

SEQ ID NO: 3602872 - RNA, 16 nt, Pseudomonas putida KT2440
ugaugcggacccagcg

SEQ ID NO: 3602873 - RNA, 18 nt, Pseudomonas putida KT2440
ugaugcgggaccagcacc

SEQ ID NO: 3602874 - RNA, 23 nt, Pseudomonas putida KT2440
ugauggauuccucgcgcuugccu

SEQ ID NO: 3602875 - RNA, 17 nt, Pseudomonas putida KT2440
ugaugguaucugccagc

SEQ ID NO: 3602876 - RNA, 12 nt, Pseudomonas putida KT2440
ugauggucaccu

SEQ ID NO: 3602877 - RNA, 18 nt, Pseudomonas putida KT2440
ugauggucaccuugucca

SEQ ID NO: 3602878 - RNA, 11 nt, Pseudomonas putida KT2440
ugaugguugac

SEQ ID NO: 3602879 - RNA, 22 nt, Pseudomonas putida KT2440
ugaugucuacccacaagcgcag

SEQ ID NO: 3602880 - RNA, 15 nt, Pseudomonas putida KT2440
ugaugucuucgcgga

SEQ ID NO: 3602881 - RNA, 23 nt, Pseudomonas putida KT2440
ugauguuacggacgggcguugau

SEQ ID NO: 3602882 - RNA, 18 nt, Pseudomonas putida KT2440
ugauguucggugcucagg

SEQ ID NO: 3602883 - RNA, 20 nt, Pseudomonas putida KT2440
ugauguucggugcucaggcu

SEQ ID NO: 3602884 - RNA, 22 nt, Pseudomonas putida KT2440
ugauuaccagcgccccgccgca

SEQ ID NO: 3602885 - RNA, 14 nt, Pseudomonas putida KT2440
ugauucaacgcccc

SEQ ID NO: 3602886 - RNA, 18 nt, Pseudomonas putida KT2440
ugauucaagacaguggaa

SEQ ID NO: 3602887 - RNA, 18 nt, Pseudomonas putida KT2440
ugauucagcacaccgcuc

SEQ ID NO: 3602888 - RNA, 20 nt, Pseudomonas putida KT2440
ugauucagcacaccgcucaa

SEQ ID NO: 3602889 - RNA, 20 nt, Pseudomonas putida KT2440
ugauugcagucaccuucgau

SEQ ID NO: 3602890 - RNA, 13 nt, Pseudomonas putida KT2440
ugauugccuggcu

SEQ ID NO: 3602891 - RNA, 12 nt, Pseudomonas putida KT2440
ugauuuccagcg

SEQ ID NO: 3602892 - RNA, 20 nt, Pseudomonas putida KT2440
ugcaaaacuuggguagugca

SEQ ID NO: 3602893 - RNA, 15 nt, Pseudomonas putida KT2440
ugcaaagcagcccca

SEQ ID NO: 3602894 - RNA, 12 nt, Pseudomonas putida KT2440
ugcaaagcgccc

SEQ ID NO: 3602895 - RNA, 21 nt, Pseudomonas putida KT2440
ugcaaagcgcgucugauagcc

SEQ ID NO: 3602896 - RNA, 23 nt, Pseudomonas putida KT2440
ugcaaagcgcgucugauagccag

SEQ ID NO: 3602897 - RNA, 19 nt, Pseudomonas putida KT2440
ugcaaauacggccaauaac

SEQ ID NO: 3602898 - RNA, 20 nt, Pseudomonas putida KT2440
ugcaacaaggucgccaggcg

SEQ ID NO: 3602899 - RNA, 18 nt, Pseudomonas putida KT2440
ugcaacagaaaaugcccg

SEQ ID NO: 3602900 - RNA, 17 nt, Pseudomonas putida KT2440
ugcaacagcucauccag

SEQ ID NO: 3602901 - RNA, 15 nt, Pseudomonas putida KT2440
ugcaacagcuccagc

SEQ ID NO: 3602902 - RNA, 24 nt, Pseudomonas putida KT2440
ugcaacagcuccagcaacugcgcc

SEQ ID NO: 3602903 - RNA, 13 nt, Pseudomonas putida KT2440
ugcaaccaggcgc

SEQ ID NO: 3602904 - RNA, 16 nt, Pseudomonas putida KT2440
ugcaacccggccuugg

SEQ ID NO: 3602905 - RNA, 22 nt, Pseudomonas putida KT2440
ugcaacccggccuuggccgcug

SEQ ID NO: 3602906 - RNA, 23 nt, Pseudomonas putida KT2440
ugcaacccgucagugcucggcaa

SEQ ID NO: 3602907 - RNA, 14 nt, Pseudomonas putida KT2440
ugcaaccgacgcga

SEQ ID NO: 3602908 - RNA, 15 nt, Pseudomonas putida KT2440
ugcaacgcagcgcgu

SEQ ID NO: 3602909 - RNA, 19 nt, Pseudomonas putida KT2440
ugcaacgccuugcgcucga

SEQ ID NO: 3602910 - RNA, 16 nt, Pseudomonas putida KT2440
ugcaacuggcgcaggc

SEQ ID NO: 3602911 - RNA, 22 nt, Pseudomonas putida KT2440
ugcaagccggcgaacagcacug

SEQ ID NO: 3602912 - RNA, 19 nt, Pseudomonas putida KT2440
ugcaagcgcaccugcaggu

SEQ ID NO: 3602913 - RNA, 14 nt, Pseudomonas putida KT2440
ugcaagcggcgaua

SEQ ID NO: 3602914 - RNA, 16 nt, Pseudomonas putida KT2440
ugcaaggaucaccaag

SEQ ID NO: 3602915 - RNA, 19 nt, Pseudomonas putida KT2440
ugcaaggaucaccaaggcu

SEQ ID NO: 3602916 - RNA, 16 nt, Pseudomonas putida KT2440
ugcaaggccagcggaa

SEQ ID NO: 3602917 - RNA, 18 nt, Pseudomonas putida KT2440
ugcaaggucaaacucccc

SEQ ID NO: 3602918 - RNA, 19 nt, Pseudomonas putida KT2440
ugcaagguccaggcguggg

SEQ ID NO: 3602919 - RNA, 19 nt, Pseudomonas putida KT2440
ugcaaguaaucuggggcgc

SEQ ID NO: 3602920 - RNA, 18 nt, Pseudomonas putida KT2440
ugcaauaccagccuggcc

SEQ ID NO: 3602921 - RNA, 14 nt, Pseudomonas putida KT2440
ugcaauaccgugcu

SEQ ID NO: 3602922 - RNA, 13 nt, Pseudomonas putida KT2440
ugcaauccgccac

SEQ ID NO: 3602923 - RNA, 17 nt, Pseudomonas putida KT2440
ugcaauccgccacaaac

SEQ ID NO: 3602924 - RNA, 14 nt, Pseudomonas putida KT2440
ugcaaugcagcccc

SEQ ID NO: 3602925 - RNA, 13 nt, Pseudomonas putida KT2440
ugcaaugccgcug

SEQ ID NO: 3602926 - RNA, 19 nt, Pseudomonas putida KT2440
ugcaaugguaaauucaaua

SEQ ID NO: 3602927 - RNA, 22 nt, Pseudomonas putida KT2440
ugcaauucgugaaccaagcaaa

SEQ ID NO: 3602928 - RNA, 22 nt, Pseudomonas putida KT2440
ugcaauugcaguugaaugccgc

SEQ ID NO: 3602929 - RNA, 15 nt, Pseudomonas putida KT2440
ugcacaaucagcucg

SEQ ID NO: 3602930 - RNA, 16 nt, Pseudomonas putida KT2440
ugcacacgcaacugau

SEQ ID NO: 3602931 - RNA, 19 nt, Pseudomonas putida KT2440
ugcacacugcccagcagcc

SEQ ID NO: 3602932 - RNA, 16 nt, Pseudomonas putida KT2440
ugcacagcaucagcac

SEQ ID NO: 3602933 - RNA, 17 nt, Pseudomonas putida KT2440
ugcacagcgcucgaugc

SEQ ID NO: 3602934 - RNA, 16 nt, Pseudomonas putida KT2440
ugcacagcguccaguu

SEQ ID NO: 3602935 - RNA, 21 nt, Pseudomonas putida KT2440
ugcacagcucgcgcugccagg

SEQ ID NO: 3602936 - RNA, 14 nt, Pseudomonas putida KT2440
ugcacaggccagcc

SEQ ID NO: 3602937 - RNA, 16 nt, Pseudomonas putida KT2440
ugcacagggcggccaa

SEQ ID NO: 3602938 - RNA, 18 nt, Pseudomonas putida KT2440
ugcacagggcggccaagg

SEQ ID NO: 3602939 - RNA, 14 nt, Pseudomonas putida KT2440
ugcagccugacgcg

SEQ ID NO: 3602940 - RNA, 14 nt, Pseudomonas putida KT2440
ugcagcgaacacug

SEQ ID NO: 3602941 - RNA, 16 nt, Pseudomonas putida KT2440
ugcagcgaccaucacc

SEQ ID NO: 3602942 - RNA, 14 nt, Pseudomonas putida KT2440
ugcagcgccgcauc

SEQ ID NO: 3602943 - RNA, 22 nt, Pseudomonas putida KT2440
ugcagcgccgcauccagcacug

SEQ ID NO: 3602944 - RNA, 20 nt, Pseudomonas putida KT2440
ugcagcgcgucauccgccaa

SEQ ID NO: 3602945 - RNA, 16 nt, Pseudomonas putida KT2440
ugcagcggcaagguag

SEQ ID NO: 3602946 - RNA, 20 nt, Pseudomonas putida KT2440
ugcagcgggucgcacucggc

SEQ ID NO: 3602947 - RNA, 21 nt, Pseudomonas putida KT2440
ugcagcguccacucaccggca

SEQ ID NO: 3602948 - RNA, 24 nt, Pseudomonas putida KT2440
ugcagcgucggcagagcgccagca

SEQ ID NO: 3602949 - RNA, 15 nt, Pseudomonas putida KT2440
ugcagcucgaaaauc

SEQ ID NO: 3602950 - RNA, 21 nt, Pseudomonas putida KT2440
ugcagcucgacaaacugcuga

SEQ ID NO: 3602951 - RNA, 21 nt, Pseudomonas putida KT2440
ugcagcucuugucgacaguga

SEQ ID NO: 3602952 - RNA, 22 nt, Pseudomonas putida KT2440
ugcagcucuugucgacagugaa

SEQ ID NO: 3602953 - RNA, 16 nt, Pseudomonas putida KT2440
ugcagcuucccggccu

SEQ ID NO: 3602954 - RNA, 20 nt, Pseudomonas putida KT2440
ugcagcuugaggucgccagg

SEQ ID NO: 3602955 - RNA, 21 nt, Pseudomonas putida KT2440
ugcagcuuugaggcucaugac

SEQ ID NO: 3602956 - RNA, 21 nt, Pseudomonas putida KT2440
ugcaggaacuccugcugcagc

SEQ ID NO: 3602957 - RNA, 17 nt, Pseudomonas putida KT2440
ugcaggauuugcccgca

SEQ ID NO: 3602958 - RNA, 22 nt, Pseudomonas putida KT2440
ugcaggcaucgaacgccgccug

SEQ ID NO: 3602959 - RNA, 12 nt, Pseudomonas putida KT2440
ugcaggccagcg

SEQ ID NO: 3602960 - RNA, 23 nt, Pseudomonas putida KT2440
ugcaggcgaucguugguccgcga

SEQ ID NO: 3602961 - RNA, 15 nt, Pseudomonas putida KT2440
ugcaggcgcacaucc

SEQ ID NO: 3602962 - RNA, 15 nt, Pseudomonas putida KT2440
ugcaggcgcagggug

SEQ ID NO: 3602963 - RNA, 23 nt, Pseudomonas putida KT2440
ugcaggcgcagggugugcugcug

SEQ ID NO: 3602964 - RNA, 18 nt, Pseudomonas putida KT2440
ugcaggcggcgacaaccg

SEQ ID NO: 3602965 - RNA, 19 nt, Pseudomonas putida KT2440
ugcaggcguaacucagcaa

SEQ ID NO: 3602966 - RNA, 16 nt, Pseudomonas putida KT2440
ugcaggcucggccacc

SEQ ID NO: 3602967 - RNA, 14 nt, Pseudomonas putida KT2440
ugcaggcucugaau

SEQ ID NO: 3602968 - RNA, 15 nt, Pseudomonas putida KT2440
ugcagggcacgccaa

SEQ ID NO: 3602969 - RNA, 23 nt, Pseudomonas putida KT2440
ugcagggcgagcacacccggcgu

SEQ ID NO: 3602970 - RNA, 20 nt, Pseudomonas putida KT2440
ugcaggggagggcgugaaaa

SEQ ID NO: 3602971 - RNA, 15 nt, Pseudomonas putida KT2440
ugcaggggcugcaag

SEQ ID NO: 3602972 - RNA, 22 nt, Pseudomonas putida KT2440
ugcagggggguaaggcuggcuu

SEQ ID NO: 3602973 - RNA, 22 nt, Pseudomonas putida KT2440
ugcaggggugggaugcccaugg

SEQ ID NO: 3602974 - RNA, 15 nt, Pseudomonas putida KT2440
ugcaggguaggggug

SEQ ID NO: 3602975 - RNA, 18 nt, Pseudomonas putida KT2440
ugcagguacagcagcugc

SEQ ID NO: 3602976 - RNA, 19 nt, Pseudomonas putida KT2440
ugcagguacagcagcugca

SEQ ID NO: 3602977 - RNA, 22 nt, Pseudomonas putida KT2440
ugcagguaccaguuguacucga

SEQ ID NO: 3602978 - RNA, 14 nt, Pseudomonas putida KT2440
ugcagguccggaaa

SEQ ID NO: 3602979 - RNA, 18 nt, Pseudomonas putida KT2440
ugcaggucgacgaucgcc

SEQ ID NO: 3602980 - RNA, 13 nt, Pseudomonas putida KT2440
ugcaggucggcac

SEQ ID NO: 3602981 - RNA, 16 nt, Pseudomonas putida KT2440
ugcaggugcagggugc

SEQ ID NO: 3602982 - RNA, 16 nt, Pseudomonas putida KT2440
ugcaggugcagguucg

SEQ ID NO: 3602983 - RNA, 20 nt, Pseudomonas putida KT2440
ugcagguggauguugaugcc

SEQ ID NO: 3602984 - RNA, 19 nt, Pseudomonas putida KT2440
ugcagguucgaccaccgca

SEQ ID NO: 3602985 - RNA, 21 nt, Pseudomonas putida KT2440
ugcagguugcccucggccacc

SEQ ID NO: 3602986 - RNA, 15 nt, Pseudomonas putida KT2440
ugcagucaaagccuu

SEQ ID NO: 3602987 - RNA, 16 nt, Pseudomonas putida KT2440
ugcagucguuguccag

SEQ ID NO: 3602988 - RNA, 20 nt, Pseudomonas putida KT2440
ugcagugccucacgcaugcc

SEQ ID NO: 3602989 - RNA, 22 nt, Pseudomonas putida KT2440
ugcagugguugugcuggcccuu

SEQ ID NO: 3602990 - RNA, 17 nt, Pseudomonas putida KT2440
ugcaguguguugcggug

SEQ ID NO: 3602991 - RNA, 16 nt, Pseudomonas putida KT2440
ugcaguucuaccagca

SEQ ID NO: 3602992 - RNA, 18 nt, Pseudomonas putida KT2440
ugcaguucuaccagcagc

SEQ ID NO: 3602993 - RNA, 14 nt, Pseudomonas putida KT2440
ugcaguucuuccag

SEQ ID NO: 3602994 - RNA, 15 nt, Pseudomonas putida KT2440
ugcaguucuuccagc

SEQ ID NO: 3602995 - RNA, 16 nt, Pseudomonas putida KT2440
ugcaguuguccaggcu

SEQ ID NO: 3602996 - RNA, 17 nt, Pseudomonas putida KT2440
ugcaguuguccaggcug

SEQ ID NO: 3602997 - RNA, 18 nt, Pseudomonas putida KT2440
ugcaguugucugcuagga

SEQ ID NO: 3602998 - RNA, 14 nt, Pseudomonas putida KT2440
ugcauaagccacuu

SEQ ID NO: 3602999 - RNA, 22 nt, Pseudomonas putida KT2440
ugcauaaucguucugcuugucc

SEQ ID NO: 3603000 - RNA, 15 nt, Pseudomonas putida KT2440
ugcauacgcaccaac

SEQ ID NO: 3603001 - RNA, 17 nt, Pseudomonas putida KT2440
ugcauaugcagggccuu

SEQ ID NO: 3603002 - RNA, 22 nt, Pseudomonas putida KT2440
ugcauaugcagggccuuuucau

SEQ ID NO: 3603003 - RNA, 20 nt, Pseudomonas putida KT2440
ugcaucagcgugugacccag

SEQ ID NO: 3603004 - RNA, 12 nt, Pseudomonas putida KT2440
ugcaucaggguc

SEQ ID NO: 3603005 - RNA, 15 nt, Pseudomonas putida KT2440
ugcauccaacgcugc

SEQ ID NO: 3603006 - RNA, 17 nt, Pseudomonas putida KT2440
ugcauccaacgcugccu

SEQ ID NO: 3603007 - RNA, 19 nt, Pseudomonas putida KT2440
ugcauccacaccagcggcg

SEQ ID NO: 3603008 - RNA, 17 nt, Pseudomonas putida KT2440
ugcauccacccacuugg

SEQ ID NO: 3603009 - RNA, 13 nt, Pseudomonas putida KT2440
ugcauccgcccca

SEQ ID NO: 3603010 - RNA, 15 nt, Pseudomonas putida KT2440
ugcaucgaagcaggc

SEQ ID NO: 3603011 - RNA, 19 nt, Pseudomonas putida KT2440
ugcaucgcgcacuugccag

SEQ ID NO: 3603012 - RNA, 20 nt, Pseudomonas putida KT2440
ugcaucggugguuggacaca

SEQ ID NO: 3603013 - RNA, 15 nt, Pseudomonas putida KT2440
ugcaucgucacaucc

SEQ ID NO: 3603014 - RNA, 21 nt, Pseudomonas putida KT2440
ugcaucgucacauccugcucg

SEQ ID NO: 3603015 - RNA, 17 nt, Pseudomonas putida KT2440
ugcaucugcucccccag

SEQ ID NO: 3603016 - RNA, 15 nt, Pseudomonas putida KT2440
ugcaugaucgacuuc

SEQ ID NO: 3603017 - RNA, 21 nt, Pseudomonas putida KT2440
ugcaugccaguagaagcccag

SEQ ID NO: 3603018 - RNA, 15 nt, Pseudomonas putida KT2440
ugcaugccuuccugc

SEQ ID NO: 3603019 - RNA, 15 nt, Pseudomonas putida KT2440
ugcaugcuguuucuu

SEQ ID NO: 3603020 - RNA, 19 nt, Pseudomonas putida KT2440
ugcauggcauaggcuguca

SEQ ID NO: 3603021 - RNA, 14 nt, Pseudomonas putida KT2440
ugcauggcauucgc

SEQ ID NO: 3603022 - RNA, 17 nt, Pseudomonas putida KT2440
ugcauggcauucgccac

SEQ ID NO: 3603023 - RNA, 16 nt, Pseudomonas putida KT2440
ugcauggcucgcagcc

SEQ ID NO: 3603024 - RNA, 17 nt, Pseudomonas putida KT2440
ugcauguccugaagcag

SEQ ID NO: 3603025 - RNA, 21 nt, Pseudomonas putida KT2440
ugcaugugccgcucguacugg

SEQ ID NO: 3603026 - RNA, 17 nt, Pseudomonas putida KT2440
ugcauuacgucagcuac

SEQ ID NO: 3603027 - RNA, 21 nt, Pseudomonas putida KT2440
ugcauuuaacggcugucgcga

SEQ ID NO: 3603028 - RNA, 13 nt, Pseudomonas putida KT2440
ugcauuuucggca

SEQ ID NO: 3603029 - RNA, 19 nt, Pseudomonas putida KT2440
ugccaaaguccggcgaagc

SEQ ID NO: 3603030 - RNA, 16 nt, Pseudomonas putida KT2440
ugccaacgcaccgacc

SEQ ID NO: 3603031 - RNA, 18 nt, Pseudomonas putida KT2440
ugccaagccacuggccag

SEQ ID NO: 3603032 - RNA, 15 nt, Pseudomonas putida KT2440
ugccaagcccacaca

SEQ ID NO: 3603033 - RNA, 15 nt, Pseudomonas putida KT2440
ugccaaggaucagcu

SEQ ID NO: 3603034 - RNA, 17 nt, Pseudomonas putida KT2440
ugccaaggaucagcucg

SEQ ID NO: 3603035 - RNA, 21 nt, Pseudomonas putida KT2440
ugccaaggaucagcucggcaa

SEQ ID NO: 3603036 - RNA, 13 nt, Pseudomonas putida KT2440
ugccaaggcuuuu

SEQ ID NO: 3603037 - RNA, 17 nt, Pseudomonas putida KT2440
ugccaauaaccggcaca

SEQ ID NO: 3603038 - RNA, 17 nt, Pseudomonas putida KT2440
ugccaaugcucagugga

SEQ ID NO: 3603039 - RNA, 22 nt, Pseudomonas putida KT2440
ugccaauuuccauaccaauggc

SEQ ID NO: 3603040 - RNA, 19 nt, Pseudomonas putida KT2440
ugccacagguacugcgcaa

SEQ ID NO: 3603041 - RNA, 19 nt, Pseudomonas putida KT2440
ugccaccaguucauggcuc

SEQ ID NO: 3603042 - RNA, 18 nt, Pseudomonas putida KT2440
ugccaccaucgaccuggc

SEQ ID NO: 3603043 - RNA, 14 nt, Pseudomonas putida KT2440
ugccacccaaggca

SEQ ID NO: 3603044 - RNA, 22 nt, Pseudomonas putida KT2440
ugcccagggcugcuucacgggu

SEQ ID NO: 3603045 - RNA, 15 nt, Pseudomonas putida KT2440
ugcccaggugccagg

SEQ ID NO: 3603046 - RNA, 18 nt, Pseudomonas putida KT2440
ugcccaggugccaggcuc

SEQ ID NO: 3603047 - RNA, 17 nt, Pseudomonas putida KT2440
ugcccauaaaagccuca

SEQ ID NO: 3603048 - RNA, 13 nt, Pseudomonas putida KT2440
ugcccaucaccuc

SEQ ID NO: 3603049 - RNA, 20 nt, Pseudomonas putida KT2440
ugcccaugaagcggccggcc

SEQ ID NO: 3603050 - RNA, 18 nt, Pseudomonas putida KT2440
ugcccaugcacagcgagc

SEQ ID NO: 3603051 - RNA, 15 nt, Pseudomonas putida KT2440
ugcccaugccaagcc

SEQ ID NO: 3603052 - RNA, 16 nt, Pseudomonas putida KT2440
ugcccaugccaagccc

SEQ ID NO: 3603053 - RNA, 14 nt, Pseudomonas putida KT2440
ugcccauggccagc

SEQ ID NO: 3603054 - RNA, 17 nt, Pseudomonas putida KT2440
ugcccauggccagcgug

SEQ ID NO: 3603055 - RNA, 21 nt, Pseudomonas putida KT2440
ugcccauggccagcguggccg

SEQ ID NO: 3603056 - RNA, 15 nt, Pseudomonas putida KT2440
ugcccauggccaggc

SEQ ID NO: 3603057 - RNA, 16 nt, Pseudomonas putida KT2440
ugcccauggcgcagcu

SEQ ID NO: 3603058 - RNA, 21 nt, Pseudomonas putida KT2440
ugcccauggcgcagcuccacu

SEQ ID NO: 3603059 - RNA, 19 nt, Pseudomonas putida KT2440
ugcccauuccugaagugaa

SEQ ID NO: 3603060 - RNA, 18 nt, Pseudomonas putida KT2440
ugccccacucggcgcugu

SEQ ID NO: 3603061 - RNA, 19 nt, Pseudomonas putida KT2440
ugccccagcaucaacgcug

SEQ ID NO: 3603062 - RNA, 12 nt, Pseudomonas putida KT2440
ugccccagcguc

SEQ ID NO: 3603063 - RNA, 16 nt, Pseudomonas putida KT2440
ugccccaugcgaacug

SEQ ID NO: 3603064 - RNA, 19 nt, Pseudomonas putida KT2440
ugccccaugcgaacugcag

SEQ ID NO: 3603065 - RNA, 19 nt, Pseudomonas putida KT2440
ugcccccaaugggcaccgg

SEQ ID NO: 3603066 - RNA, 21 nt, Pseudomonas putida KT2440
ugcccccagccggucauccag

SEQ ID NO: 3603067 - RNA, 17 nt, Pseudomonas putida KT2440
ugcccccccaacaacag

SEQ ID NO: 3603068 - RNA, 22 nt, Pseudomonas putida KT2440
ugcccccccaacaacagucaac

SEQ ID NO: 3603069 - RNA, 20 nt, Pseudomonas putida KT2440
ugccccccggugccggccaa

SEQ ID NO: 3603070 - RNA, 18 nt, Pseudomonas putida KT2440
ugcccccgccgaagccau

SEQ ID NO: 3603071 - RNA, 23 nt, Pseudomonas putida KT2440
ugcccccgccgaagccaugagcg

SEQ ID NO: 3603072 - RNA, 17 nt, Pseudomonas putida KT2440
ugcccccgucagcggca

SEQ ID NO: 3603073 - RNA, 13 nt, Pseudomonas putida KT2440
ugccccgcaggcc

SEQ ID NO: 3603074 - RNA, 14 nt, Pseudomonas putida KT2440
ugccccgcaggccg

SEQ ID NO: 3603075 - RNA, 22 nt, Pseudomonas putida KT2440
ugccccgggugcagccgcaccc

SEQ ID NO: 3603076 - RNA, 15 nt, Pseudomonas putida KT2440
ugccccgguccagca

SEQ ID NO: 3603077 - RNA, 17 nt, Pseudomonas putida KT2440
ugccccgguccagcaca

SEQ ID NO: 3603078 - RNA, 23 nt, Pseudomonas putida KT2440
ugccccgguccagcacacugagc

SEQ ID NO: 3603079 - RNA, 15 nt, Pseudomonas putida KT2440
ugccccuaccgccaa

SEQ ID NO: 3603080 - RNA, 17 nt, Pseudomonas putida KT2440
ugccccucaaugcugcc

SEQ ID NO: 3603081 - RNA, 21 nt, Pseudomonas putida KT2440
ugccccugauaggacugcuuc

SEQ ID NO: 3603082 - RNA, 22 nt, Pseudomonas putida KT2440
ugccccugauaggacugcuuca

SEQ ID NO: 3603083 - RNA, 16 nt, Pseudomonas putida KT2440
ugccccugaucaucca

SEQ ID NO: 3603084 - RNA, 17 nt, Pseudomonas putida KT2440
ugccccugaucauccac

SEQ ID NO: 3603085 - RNA, 16 nt, Pseudomonas putida KT2440
ugccccugcgccgcca

SEQ ID NO: 3603086 - RNA, 12 nt, Pseudomonas putida KT2440
ugccccuggcug

SEQ ID NO: 3603087 - RNA, 16 nt, Pseudomonas putida KT2440
ugcccgaagccacgau

SEQ ID NO: 3603088 - RNA, 20 nt, Pseudomonas putida KT2440
ugcccgacaagccacgcacc

SEQ ID NO: 3603089 - RNA, 17 nt, Pseudomonas putida KT2440
ugcccgaucaccgcgaa

SEQ ID NO: 3603090 - RNA, 20 nt, Pseudomonas putida KT2440
ugcccgaucgccucgcuggc

SEQ ID NO: 3603091 - RNA, 17 nt, Pseudomonas putida KT2440
ugcccgaucggguacuc

SEQ ID NO: 3603092 - RNA, 14 nt, Pseudomonas putida KT2440
ugcccgcagcaacu

SEQ ID NO: 3603093 - RNA, 15 nt, Pseudomonas putida KT2440
ugcccgccaaaaggc

SEQ ID NO: 3603094 - RNA, 22 nt, Pseudomonas putida KT2440
ugcccgccacaccugccaggcc

SEQ ID NO: 3603095 - RNA, 12 nt, Pseudomonas putida KT2440
ugcccgccaggc

SEQ ID NO: 3603096 - RNA, 20 nt, Pseudomonas putida KT2440
ugcccgccaggcgcaagccu

SEQ ID NO: 3603097 - RNA, 21 nt, Pseudomonas putida KT2440
ugcccgcccacgccgcuggua

SEQ ID NO: 3603098 - RNA, 21 nt, Pseudomonas putida KT2440
ugcccgcccccacagagccgc

SEQ ID NO: 3603099 - RNA, 18 nt, Pseudomonas putida KT2440
ugcccgccccccaccugg

SEQ ID NO: 3603100 - RNA, 16 nt, Pseudomonas putida KT2440
ugcccgccccugccag

SEQ ID NO: 3603101 - RNA, 20 nt, Pseudomonas putida KT2440
ugcccgcgaagaggccagca

SEQ ID NO: 3603102 - RNA, 20 nt, Pseudomonas putida KT2440
ugcccgcgaagcagccacca

SEQ ID NO: 3603103 - RNA, 19 nt, Pseudomonas putida KT2440
ugcccgcgaagggccgcca

SEQ ID NO: 3603104 - RNA, 21 nt, Pseudomonas putida KT2440
ugcccgcgaagggccgcgaag

SEQ ID NO: 3603105 - RNA, 14 nt, Pseudomonas putida KT2440
ugcccgcgaaugca

SEQ ID NO: 3603106 - RNA, 17 nt, Pseudomonas putida KT2440
ugcccgcgaauggccuu

SEQ ID NO: 3603107 - RNA, 17 nt, Pseudomonas putida KT2440
ugcccgcgaguccucca

SEQ ID NO: 3603108 - RNA, 13 nt, Pseudomonas putida KT2440
ugcccgcgcaaag

SEQ ID NO: 3603109 - RNA, 20 nt, Pseudomonas putida KT2440
ugcccgcgcaaaucgccgca

SEQ ID NO: 3603110 - RNA, 16 nt, Pseudomonas putida KT2440
ugcccgcgccuugcgc

SEQ ID NO: 3603111 - RNA, 23 nt, Pseudomonas putida KT2440
ugcccgcgguaaugcgcacggcu

SEQ ID NO: 3603112 - RNA, 16 nt, Pseudomonas putida KT2440
ugcccgcguacucggc

SEQ ID NO: 3603113 - RNA, 18 nt, Pseudomonas putida KT2440
ugcccgcucccacagguu

SEQ ID NO: 3603114 - RNA, 16 nt, Pseudomonas putida KT2440
ugcccgcucucacagg

SEQ ID NO: 3603115 - RNA, 20 nt, Pseudomonas putida KT2440
ugcccgcucucacagggacc

SEQ ID NO: 3603116 - RNA, 18 nt, Pseudomonas putida KT2440
ugcccgcuguugagcagc

SEQ ID NO: 3603117 - RNA, 22 nt, Pseudomonas putida KT2440
ugcccggcagguugcuggccuu

SEQ ID NO: 3603118 - RNA, 16 nt, Pseudomonas putida KT2440
ugcccggccagcagga

SEQ ID NO: 3603119 - RNA, 20 nt, Pseudomonas putida KT2440
ugcccggcucaccgcagccc

SEQ ID NO: 3603120 - RNA, 16 nt, Pseudomonas putida KT2440
ugcccgggaacggcug

SEQ ID NO: 3603121 - RNA, 23 nt, Pseudomonas putida KT2440
ugcccgggaacggcugccguccc

SEQ ID NO: 3603122 - RNA, 14 nt, Pseudomonas putida KT2440
ugcccgggccgcuu

SEQ ID NO: 3603123 - RNA, 18 nt, Pseudomonas putida KT2440
ugcccgggccuucaaccu

SEQ ID NO: 3603124 - RNA, 18 nt, Pseudomonas putida KT2440
ugcccgggcgcaggcagc

SEQ ID NO: 3603125 - RNA, 19 nt, Pseudomonas putida KT2440
ugcccgggcgcaggcagca

SEQ ID NO: 3603126 - RNA, 22 nt, Pseudomonas putida KT2440
ugcccgggcgcaggcagcacau

SEQ ID NO: 3603127 - RNA, 20 nt, Pseudomonas putida KT2440
ugcccggguacagccccugc

SEQ ID NO: 3603128 - RNA, 11 nt, Pseudomonas putida KT2440
ugcccggugcc

SEQ ID NO: 3603129 - RNA, 14 nt, Pseudomonas putida KT2440
ugcccggugccgcg

SEQ ID NO: 3603130 - RNA, 17 nt, Pseudomonas putida KT2440
ugcccggugccgcgcca

SEQ ID NO: 3603131 - RNA, 15 nt, Pseudomonas putida KT2440
ugcccgucaccguca

SEQ ID NO: 3603132 - RNA, 22 nt, Pseudomonas putida KT2440
ugcccgucggcguauggcuuca

SEQ ID NO: 3603133 - RNA, 16 nt, Pseudomonas putida KT2440
ugcccgugccucgcgc

SEQ ID NO: 3603134 - RNA, 21 nt, Pseudomonas putida KT2440
ugcccgugcugucggugaagc

SEQ ID NO: 3603135 - RNA, 16 nt, Pseudomonas putida KT2440
ugcccguugcgcauca

SEQ ID NO: 3603136 - RNA, 19 nt, Pseudomonas putida KT2440
ugcccuccuaucgcgacac

SEQ ID NO: 3603137 - RNA, 19 nt, Pseudomonas putida KT2440
ugcccucgacaaucgccag

SEQ ID NO: 3603138 - RNA, 16 nt, Pseudomonas putida KT2440
ugcccucgcaugcggc

SEQ ID NO: 3603139 - RNA, 18 nt, Pseudomonas putida KT2440
ugcccucggccaccuggc

SEQ ID NO: 3603140 - RNA, 22 nt, Pseudomonas putida KT2440
ugcccucggccaccuggccuuc

SEQ ID NO: 3603141 - RNA, 16 nt, Pseudomonas putida KT2440
ugcccucgggcagccu

SEQ ID NO: 3603142 - RNA, 18 nt, Pseudomonas putida KT2440
ugcccuguaggcgcgggu

SEQ ID NO: 3603143 - RNA, 13 nt, Pseudomonas putida KT2440
ugcccuguggcug

SEQ ID NO: 3603144 - RNA, 20 nt, Pseudomonas putida KT2440
ugcccuuaccggaugcgcug

SEQ ID NO: 3603145 - RNA, 14 nt, Pseudomonas putida KT2440
ugcccuucacuggg

SEQ ID NO: 3603146 - RNA, 22 nt, Pseudomonas putida KT2440
ugccgaacagucauccagaaag

SEQ ID NO: 3603147 - RNA, 16 nt, Pseudomonas putida KT2440
ugccgaaccaccgaug

SEQ ID NO: 3603148 - RNA, 23 nt, Pseudomonas putida KT2440
ugccgaagcccagcgaggccgcg

SEQ ID NO: 3603149 - RNA, 20 nt, Pseudomonas putida KT2440
ugccucaucaggccgaaggc

SEQ ID NO: 3603150 - RNA, 14 nt, Pseudomonas putida KT2440
ugccucgcccaggu

SEQ ID NO: 3603151 - RNA, 13 nt, Pseudomonas putida KT2440
ugccucgggcuug

SEQ ID NO: 3603152 - RNA, 13 nt, Pseudomonas putida KT2440
ugccucugcugcg

SEQ ID NO: 3603153 - RNA, 17 nt, Pseudomonas putida KT2440
ugccugaccggucagcc

SEQ ID NO: 3603154 - RNA, 18 nt, Pseudomonas putida KT2440
ugccugacgggccucuuc

SEQ ID NO: 3603155 - RNA, 19 nt, Pseudomonas putida KT2440
ugccugcaaucagcucaca

SEQ ID NO: 3603156 - RNA, 17 nt, Pseudomonas putida KT2440
ugccugcaugcgugccu

SEQ ID NO: 3603157 - RNA, 20 nt, Pseudomonas putida KT2440
ugccugcgauuuaugcuugc

SEQ ID NO: 3603158 - RNA, 20 nt, Pseudomonas putida KT2440
ugccugcgcuucaccuucgu

SEQ ID NO: 3603159 - RNA, 14 nt, Pseudomonas putida KT2440
ugccuggcgugcug

SEQ ID NO: 3603160 - RNA, 14 nt, Pseudomonas putida KT2440
ugccuggcucaggc

SEQ ID NO: 3603161 - RNA, 20 nt, Pseudomonas putida KT2440
ugccuggcucaggcgcuggc

SEQ ID NO: 3603162 - RNA, 14 nt, Pseudomonas putida KT2440
ugccugggucagcu

SEQ ID NO: 3603163 - RNA, 23 nt, Pseudomonas putida KT2440
ugccuggugguuuugcguggccu

SEQ ID NO: 3603164 - RNA, 18 nt, Pseudomonas putida KT2440
ugccugugagaucgagcg

SEQ ID NO: 3603165 - RNA, 23 nt, Pseudomonas putida KT2440
ugccugugauuuacgcugggcgu

SEQ ID NO: 3603166 - RNA, 14 nt, Pseudomonas putida KT2440
ugccugugccggcc

SEQ ID NO: 3603167 - RNA, 21 nt, Pseudomonas putida KT2440
ugccugugucgaaccacugau

SEQ ID NO: 3603168 - RNA, 23 nt, Pseudomonas putida KT2440
ugccugugucgaaccacugaugc

SEQ ID NO: 3603169 - RNA, 16 nt, Pseudomonas putida KT2440
ugccuguugccaaugc

SEQ ID NO: 3603170 - RNA, 14 nt, Pseudomonas putida KT2440
ugccuucaccagcu

SEQ ID NO: 3603171 - RNA, 20 nt, Pseudomonas putida KT2440
ugccuuccaaccagccagcc

SEQ ID NO: 3603172 - RNA, 17 nt, Pseudomonas putida KT2440
ugccuuccucggccaug

SEQ ID NO: 3603173 - RNA, 18 nt, Pseudomonas putida KT2440
ugccuuccucggccaugc

SEQ ID NO: 3603174 - RNA, 19 nt, Pseudomonas putida KT2440
ugccuuccucggccaugcg

SEQ ID NO: 3603175 - RNA, 17 nt, Pseudomonas putida KT2440
ugccuucgcgaccgcca

SEQ ID NO: 3603176 - RNA, 22 nt, Pseudomonas putida KT2440
ugccuucgguggcaauggccug

SEQ ID NO: 3603177 - RNA, 22 nt, Pseudomonas putida KT2440
ugccuucugugauuuccagcgu

SEQ ID NO: 3603178 - RNA, 22 nt, Pseudomonas putida KT2440
ugccuucuucgauguacggcag

SEQ ID NO: 3603179 - RNA, 20 nt, Pseudomonas putida KT2440
ugccuugagcggcucgcgcu

SEQ ID NO: 3603180 - RNA, 15 nt, Pseudomonas putida KT2440
ugccuugccugggcc

SEQ ID NO: 3603181 - RNA, 14 nt, Pseudomonas putida KT2440
ugccuuggaaugca

SEQ ID NO: 3603182 - RNA, 24 nt, Pseudomonas putida KT2440
ugccuuggcauuggugccagcgcc

SEQ ID NO: 3603183 - RNA, 15 nt, Pseudomonas putida KT2440
ugccuuuggccgcca

SEQ ID NO: 3603184 - RNA, 22 nt, Pseudomonas putida KT2440
ugcgaaaaccccggcucggucc

SEQ ID NO: 3603185 - RNA, 22 nt, Pseudomonas putida KT2440
ugcgaaacccccggaaugcccg

SEQ ID NO: 3603186 - RNA, 22 nt, Pseudomonas putida KT2440
ugcgaaccucaguaccggucau

SEQ ID NO: 3603187 - RNA, 19 nt, Pseudomonas putida KT2440
ugcgaacugcagagccugc

SEQ ID NO: 3603188 - RNA, 18 nt, Pseudomonas putida KT2440
ugcgaagaggccccgaca

SEQ ID NO: 3603189 - RNA, 21 nt, Pseudomonas putida KT2440
ugcgaagaggccccgacagca

SEQ ID NO: 3603190 - RNA, 16 nt, Pseudomonas putida KT2440
ugcgaagcaagcgcau

SEQ ID NO: 3603191 - RNA, 23 nt, Pseudomonas putida KT2440
ugcgaagcaagcgcaugguggua

SEQ ID NO: 3603192 - RNA, 18 nt, Pseudomonas putida KT2440
ugcgaaggggcgcccaga

SEQ ID NO: 3603193 - RNA, 17 nt, Pseudomonas putida KT2440
ugcgaagguaaccuggu

SEQ ID NO: 3603194 - RNA, 18 nt, Pseudomonas putida KT2440
ugcgaauggccgcaaccc

SEQ ID NO: 3603195 - RNA, 22 nt, Pseudomonas putida KT2440
ugcgacaggcgucggggccgga

SEQ ID NO: 3603196 - RNA, 16 nt, Pseudomonas putida KT2440
ugcgaccaguaccgcg

SEQ ID NO: 3603197 - RNA, 14 nt, Pseudomonas putida KT2440
ugcgacgaacucaa

SEQ ID NO: 3603198 - RNA, 16 nt, Pseudomonas putida KT2440
ugcgacggcgaaugac

SEQ ID NO: 3603199 - RNA, 15 nt, Pseudomonas putida KT2440
ugcgacugaggcacc

SEQ ID NO: 3603200 - RNA, 18 nt, Pseudomonas putida KT2440
ugcgacuugugcauccug

SEQ ID NO: 3603201 - RNA, 20 nt, Pseudomonas putida KT2440
ugcgacuugugcauccugca

SEQ ID NO: 3603202 - RNA, 15 nt, Pseudomonas putida KT2440
ugcgagacgccacca

SEQ ID NO: 3603203 - RNA, 19 nt, Pseudomonas putida KT2440
ugcgagacgccaccaagcc

SEQ ID NO: 3603204 - RNA, 15 nt, Pseudomonas putida KT2440
ugcgagcccuugucc

SEQ ID NO: 3603205 - RNA, 14 nt, Pseudomonas putida KT2440
ugcgagcgaacagc

SEQ ID NO: 3603206 - RNA, 15 nt, Pseudomonas putida KT2440
ugcgagcgaacagcu

SEQ ID NO: 3603207 - RNA, 14 nt, Pseudomonas putida KT2440
ugcgaggaucagcg

SEQ ID NO: 3603208 - RNA, 19 nt, Pseudomonas putida KT2440
ugcgagguaccguugcgga

SEQ ID NO: 3603209 - RNA, 20 nt, Pseudomonas putida KT2440
ugcgauagaacuccaccagc

SEQ ID NO: 3603210 - RNA, 23 nt, Pseudomonas putida KT2440
ugcgauagaacuccaccagccca

SEQ ID NO: 3603211 - RNA, 14 nt, Pseudomonas putida KT2440
ugcgauccaggauc

SEQ ID NO: 3603212 - RNA, 15 nt, Pseudomonas putida KT2440
ugcgauccaggauca

SEQ ID NO: 3603213 - RNA, 19 nt, Pseudomonas putida KT2440
ugcgauccgccccauagcc

SEQ ID NO: 3603214 - RNA, 20 nt, Pseudomonas putida KT2440
ugcgaucgaaaucagccuuc

SEQ ID NO: 3603215 - RNA, 17 nt, Pseudomonas putida KT2440
ugcgcaacgacaaggua

SEQ ID NO: 3603216 - RNA, 20 nt, Pseudomonas putida KT2440
ugcgcaacgacaagguacuc

SEQ ID NO: 3603217 - RNA, 19 nt, Pseudomonas putida KT2440
ugcgcaagcaaccgggggc

SEQ ID NO: 3603218 - RNA, 23 nt, Pseudomonas putida KT2440
ugcgcaaggacgacgugguacgc

SEQ ID NO: 3603219 - RNA, 18 nt, Pseudomonas putida KT2440
ugcgcaccagagggaagg

SEQ ID NO: 3603220 - RNA, 23 nt, Pseudomonas putida KT2440
ugcgcaccuuggcguccagguaa

SEQ ID NO: 3603221 - RNA, 22 nt, Pseudomonas putida KT2440
ugcgcacgaagaucaccgacaa

SEQ ID NO: 3603222 - RNA, 14 nt, Pseudomonas putida KT2440
ugcgcacgccggua

SEQ ID NO: 3603223 - RNA, 22 nt, Pseudomonas putida KT2440
ugcgcacgccgguaucacccag

SEQ ID NO: 3603224 - RNA, 17 nt, Pseudomonas putida KT2440
ugcgcacgcgcucugca

SEQ ID NO: 3603225 - RNA, 14 nt, Pseudomonas putida KT2440
ugcgcacgcugccc

SEQ ID NO: 3603226 - RNA, 16 nt, Pseudomonas putida KT2440
ugcgcacgcugcccag

SEQ ID NO: 3603227 - RNA, 15 nt, Pseudomonas putida KT2440
ugcgcacggccucca

SEQ ID NO: 3603228 - RNA, 21 nt, Pseudomonas putida KT2440
ugcgcacggccuccaccaccu

SEQ ID NO: 3603229 - RNA, 16 nt, Pseudomonas putida KT2440
ugcgcacggcgcuggg

SEQ ID NO: 3603230 - RNA, 12 nt, Pseudomonas putida KT2440
ugcgcacggcuu

SEQ ID NO: 3603231 - RNA, 20 nt, Pseudomonas putida KT2440
ugcgcacggucuccggcgaa

SEQ ID NO: 3603232 - RNA, 21 nt, Pseudomonas putida KT2440
ugcgcagcccauucgcgggua

SEQ ID NO: 3603233 - RNA, 13 nt, Pseudomonas putida KT2440
ugcgcagcccugu

SEQ ID NO: 3603234 - RNA, 14 nt, Pseudomonas putida KT2440
ugcgcagccggccu

SEQ ID NO: 3603235 - RNA, 17 nt, Pseudomonas putida KT2440
ugcgcagccggccuugc

SEQ ID NO: 3603236 - RNA, 21 nt, Pseudomonas putida KT2440
ugcgcagcggcgucaccuucc

SEQ ID NO: 3603237 - RNA, 13 nt, Pseudomonas putida KT2440
ugcgcagcuuguu

SEQ ID NO: 3603238 - RNA, 19 nt, Pseudomonas putida KT2440
ugcgcagcuuguugaucuu

SEQ ID NO: 3603239 - RNA, 19 nt, Pseudomonas putida KT2440
ugcgcaggcagcgauggcc

SEQ ID NO: 3603240 - RNA, 19 nt, Pseudomonas putida KT2440
ugcgcaggcgccgccagcu

SEQ ID NO: 3603241 - RNA, 23 nt, Pseudomonas putida KT2440
ugcgcaggcgccgccagcugcug

SEQ ID NO: 3603242 - RNA, 23 nt, Pseudomonas putida KT2440
ugcgcaggcuuucggccacccgg

SEQ ID NO: 3603243 - RNA, 12 nt, Pseudomonas putida KT2440
ugcgcagggugg

SEQ ID NO: 3603244 - RNA, 18 nt, Pseudomonas putida KT2440
ugcgcagguacacgggca

SEQ ID NO: 3603245 - RNA, 22 nt, Pseudomonas putida KT2440
ugcgcagguaggggugagggcg

SEQ ID NO: 3603246 - RNA, 18 nt, Pseudomonas putida KT2440
ugcgcagguuggugcaau

SEQ ID NO: 3603247 - RNA, 19 nt, Pseudomonas putida KT2440
ugcgcagguuggugcaauu

SEQ ID NO: 3603248 - RNA, 18 nt, Pseudomonas putida KT2440
ugcgcaguaacaggcgca

SEQ ID NO: 3603249 - RNA, 22 nt, Pseudomonas putida KT2440
ugcgcaguacaggcugccgccg

SEQ ID NO: 3603250 - RNA, 20 nt, Pseudomonas putida KT2440
ugcgcaguaccuguggcagc

SEQ ID NO: 3603251 - RNA, 18 nt, Pseudomonas putida KT2440
ugcgcagucauuuucaug

SEQ ID NO: 3603252 - RNA, 21 nt, Pseudomonas putida KT2440
ugcgcagucauuuucaugcag

SEQ ID NO: 3603253 - RNA, 18 nt, Pseudomonas putida KT2440
ugcgcuuugcguggcacc

SEQ ID NO: 3603254 - RNA, 20 nt, Pseudomonas putida KT2440
ugcggaaaaggccggccaua

SEQ ID NO: 3603255 - RNA, 23 nt, Pseudomonas putida KT2440
ugcggaacauacgcaucagcgca

SEQ ID NO: 3603256 - RNA, 17 nt, Pseudomonas putida KT2440
ugcggacagcaaggcau

SEQ ID NO: 3603257 - RNA, 14 nt, Pseudomonas putida KT2440
ugcggauacagcgc

SEQ ID NO: 3603258 - RNA, 15 nt, Pseudomonas putida KT2440
ugcggaucaucggca

SEQ ID NO: 3603259 - RNA, 16 nt, Pseudomonas putida KT2440
ugcggaucaucggcac

SEQ ID NO: 3603260 - RNA, 20 nt, Pseudomonas putida KT2440
ugcggaucaucggcacgccc

SEQ ID NO: 3603261 - RNA, 19 nt, Pseudomonas putida KT2440
ugcggaucaucuccaugaa

SEQ ID NO: 3603262 - RNA, 20 nt, Pseudomonas putida KT2440
ugcggaucaucuccaugaag

SEQ ID NO: 3603263 - RNA, 15 nt, Pseudomonas putida KT2440
ugcggaucgccgccg

SEQ ID NO: 3603264 - RNA, 17 nt, Pseudomonas putida KT2440
ugcggcaaccaccaaca

SEQ ID NO: 3603265 - RNA, 19 nt, Pseudomonas putida KT2440
ugcggcaccgucgccugca

SEQ ID NO: 3603266 - RNA, 18 nt, Pseudomonas putida KT2440
ugcggcagauccugcagc

SEQ ID NO: 3603267 - RNA, 19 nt, Pseudomonas putida KT2440
ugcggcagauccugcagcc

SEQ ID NO: 3603268 - RNA, 16 nt, Pseudomonas putida KT2440
ugcggcagccagcauc

SEQ ID NO: 3603269 - RNA, 16 nt, Pseudomonas putida KT2440
ugcggcagcucgccgu

SEQ ID NO: 3603270 - RNA, 18 nt, Pseudomonas putida KT2440
ugcggcaggcuggcacgu

SEQ ID NO: 3603271 - RNA, 14 nt, Pseudomonas putida KT2440
ugcggcaggugggu

SEQ ID NO: 3603272 - RNA, 19 nt, Pseudomonas putida KT2440
ugcggcaugaaggcccagc

SEQ ID NO: 3603273 - RNA, 14 nt, Pseudomonas putida KT2440
ugcggccaccgccu

SEQ ID NO: 3603274 - RNA, 18 nt, Pseudomonas putida KT2440
ugcggcccaaucgccaca

SEQ ID NO: 3603275 - RNA, 15 nt, Pseudomonas putida KT2440
ugcggcccaucgcau

SEQ ID NO: 3603276 - RNA, 22 nt, Pseudomonas putida KT2440
ugcggcccccugguuuuccacc

SEQ ID NO: 3603277 - RNA, 16 nt, Pseudomonas putida KT2440
ugcggcccuuggcagc

SEQ ID NO: 3603278 - RNA, 22 nt, Pseudomonas putida KT2440
ugcggcccuuggcagcgcugca

SEQ ID NO: 3603279 - RNA, 14 nt, Pseudomonas putida KT2440
ugcggccuggcccg

SEQ ID NO: 3603280 - RNA, 20 nt, Pseudomonas putida KT2440
ugcggcgaaagccagcagug

SEQ ID NO: 3603281 - RNA, 18 nt, Pseudomonas putida KT2440
ugcggcgacgcacuucac

SEQ ID NO: 3603282 - RNA, 16 nt, Pseudomonas putida KT2440
ugcggcgccaucggca

SEQ ID NO: 3603283 - RNA, 20 nt, Pseudomonas putida KT2440
ugcggcgccgucuucagaca

SEQ ID NO: 3603284 - RNA, 16 nt, Pseudomonas putida KT2440
ugcggcguauacccgg

SEQ ID NO: 3603285 - RNA, 23 nt, Pseudomonas putida KT2440
ugcggcucaucguaauggccuac

SEQ ID NO: 3603286 - RNA, 23 nt, Pseudomonas putida KT2440
ugcggcuccggcguguccagcag

SEQ ID NO: 3603287 - RNA, 17 nt, Pseudomonas putida KT2440
ugcggcuguucgcagca

SEQ ID NO: 3603288 - RNA, 20 nt, Pseudomonas putida KT2440
ugcgggaaguccgccaggaa

SEQ ID NO: 3603289 - RNA, 16 nt, Pseudomonas putida KT2440
ugcgggaccagcacca

SEQ ID NO: 3603290 - RNA, 20 nt, Pseudomonas putida KT2440
ugcgggaccagcaccaccug

SEQ ID NO: 3603291 - RNA, 19 nt, Pseudomonas putida KT2440
ugcgggcaaagaacaucac

SEQ ID NO: 3603292 - RNA, 16 nt, Pseudomonas putida KT2440
ugcgggcccuggucau

SEQ ID NO: 3603293 - RNA, 14 nt, Pseudomonas putida KT2440
ugcgggccggcacg

SEQ ID NO: 3603294 - RNA, 17 nt, Pseudomonas putida KT2440
ugcgggcgucuuccagg

SEQ ID NO: 3603295 - RNA, 14 nt, Pseudomonas putida KT2440
ugcgggcuuucuca

SEQ ID NO: 3603296 - RNA, 16 nt, Pseudomonas putida KT2440
ugcggggcaucgccga

SEQ ID NO: 3603297 - RNA, 17 nt, Pseudomonas putida KT2440
ugcggggcauucggcga

SEQ ID NO: 3603298 - RNA, 21 nt, Pseudomonas putida KT2440
ugcgggggccccaccaggcac

SEQ ID NO: 3603299 - RNA, 17 nt, Pseudomonas putida KT2440
ugcgggucauccucaag

SEQ ID NO: 3603300 - RNA, 17 nt, Pseudomonas putida KT2440
ugcgggugagcaugccg

SEQ ID NO: 3603301 - RNA, 17 nt, Pseudomonas putida KT2440
ugcggguuucgucgauc

SEQ ID NO: 3603302 - RNA, 22 nt, Pseudomonas putida KT2440
ugcgguauaggccgcaagcccg

SEQ ID NO: 3603303 - RNA, 14 nt, Pseudomonas putida KT2440
ugcggucaggccaa

SEQ ID NO: 3603304 - RNA, 21 nt, Pseudomonas putida KT2440
ugcggucaucaccacccccag

SEQ ID NO: 3603305 - RNA, 15 nt, Pseudomonas putida KT2440
ugcgguccgcccuug

SEQ ID NO: 3603306 - RNA, 21 nt, Pseudomonas putida KT2440
ugcgguccugcaccacaugca

SEQ ID NO: 3603307 - RNA, 21 nt, Pseudomonas putida KT2440
ugcggucgggucgcugccgug

SEQ ID NO: 3603308 - RNA, 16 nt, Pseudomonas putida KT2440
ugcggugaccgaggcg

SEQ ID NO: 3603309 - RNA, 18 nt, Pseudomonas putida KT2440
ugcggugaccgaggcgaa

SEQ ID NO: 3603310 - RNA, 15 nt, Pseudomonas putida KT2440
ugcggugcagcaccu

SEQ ID NO: 3603311 - RNA, 14 nt, Pseudomonas putida KT2440
ugcggugcaugcgc

SEQ ID NO: 3603312 - RNA, 15 nt, Pseudomonas putida KT2440
ugcggugcucaugca

SEQ ID NO: 3603313 - RNA, 20 nt, Pseudomonas putida KT2440
ugcgguugccuguaggcgcg

SEQ ID NO: 3603314 - RNA, 15 nt, Pseudomonas putida KT2440
ugcguaauuccugug

SEQ ID NO: 3603315 - RNA, 17 nt, Pseudomonas putida KT2440
ugcguagccuucagcgg

SEQ ID NO: 3603316 - RNA, 22 nt, Pseudomonas putida KT2440
ugcguagguuauuggccagguc

SEQ ID NO: 3603317 - RNA, 13 nt, Pseudomonas putida KT2440
ugcgucagcaucc

SEQ ID NO: 3603318 - RNA, 16 nt, Pseudomonas putida KT2440
ugcgucaggccaugcc

SEQ ID NO: 3603319 - RNA, 14 nt, Pseudomonas putida KT2440
ugcgucaggcuuca

SEQ ID NO: 3603320 - RNA, 14 nt, Pseudomonas putida KT2440
ugcgucaucaucag

SEQ ID NO: 3603321 - RNA, 18 nt, Pseudomonas putida KT2440
ugcguccgucgccggccg

SEQ ID NO: 3603322 - RNA, 18 nt, Pseudomonas putida KT2440
ugcgucggcguggaacaa

SEQ ID NO: 3603323 - RNA, 19 nt, Pseudomonas putida KT2440
ugcgucucuuccuccaucu

SEQ ID NO: 3603324 - RNA, 22 nt, Pseudomonas putida KT2440
ugcgugaccgccccgcccgaag

SEQ ID NO: 3603325 - RNA, 14 nt, Pseudomonas putida KT2440
ugcgugauggcagc

SEQ ID NO: 3603326 - RNA, 21 nt, Pseudomonas putida KT2440
ugcgugcaguguguugcggug

SEQ ID NO: 3603327 - RNA, 21 nt, Pseudomonas putida KT2440
ugcgugccucagccaggcuga

SEQ ID NO: 3603328 - RNA, 18 nt, Pseudomonas putida KT2440
ugcgugccucgcccaggu

SEQ ID NO: 3603329 - RNA, 19 nt, Pseudomonas putida KT2440
ugcgugccucgcccagguc

SEQ ID NO: 3603330 - RNA, 14 nt, Pseudomonas putida KT2440
ugcgugccugcugc

SEQ ID NO: 3603331 - RNA, 21 nt, Pseudomonas putida KT2440
ugcgugccugcugcucgcuau

SEQ ID NO: 3603332 - RNA, 15 nt, Pseudomonas putida KT2440
ugcguggcaccggcg

SEQ ID NO: 3603333 - RNA, 13 nt, Pseudomonas putida KT2440
ugcguggcauccu

SEQ ID NO: 3603334 - RNA, 16 nt, Pseudomonas putida KT2440
ugcguucaccggcacc

SEQ ID NO: 3603335 - RNA, 19 nt, Pseudomonas putida KT2440
ugcguucuagaacucggcg

SEQ ID NO: 3603336 - RNA, 19 nt, Pseudomonas putida KT2440
ugcguucuugccugucccc

SEQ ID NO: 3603337 - RNA, 12 nt, Pseudomonas putida KT2440
ugcguugcaaca

SEQ ID NO: 3603338 - RNA, 16 nt, Pseudomonas putida KT2440
ugcguugcccccagcc

SEQ ID NO: 3603339 - RNA, 14 nt, Pseudomonas putida KT2440
ugcguugccuguga

SEQ ID NO: 3603340 - RNA, 21 nt, Pseudomonas putida KT2440
ugcguugcggucagcgcugcg

SEQ ID NO: 3603341 - RNA, 21 nt, Pseudomonas putida KT2440
ugcguuucgcuggccugcccc

SEQ ID NO: 3603342 - RNA, 13 nt, Pseudomonas putida KT2440
ugcuaauuucagg

SEQ ID NO: 3603343 - RNA, 23 nt, Pseudomonas putida KT2440
ugcuacagaagccucaccgccgc

SEQ ID NO: 3603344 - RNA, 20 nt, Pseudomonas putida KT2440
ugcuaccaaccuccagguca

SEQ ID NO: 3603345 - RNA, 14 nt, Pseudomonas putida KT2440
ugcuaccggcgcca

SEQ ID NO: 3603346 - RNA, 23 nt, Pseudomonas putida KT2440
ugcuacgcgcgggguugacagag

SEQ ID NO: 3603347 - RNA, 17 nt, Pseudomonas putida KT2440
ugcuacggccgugcagg

SEQ ID NO: 3603348 - RNA, 16 nt, Pseudomonas putida KT2440
ugcuauccgcuugcug

SEQ ID NO: 3603349 - RNA, 23 nt, Pseudomonas putida KT2440
ugcucaaccggugcaacugccac

SEQ ID NO: 3603350 - RNA, 19 nt, Pseudomonas putida KT2440
ugcucaacuucccucugcc

SEQ ID NO: 3603351 - RNA, 22 nt, Pseudomonas putida KT2440
ugcucaacuucccucugccugc

SEQ ID NO: 3603352 - RNA, 15 nt, Pseudomonas putida KT2440
ugcucaagcgccagg

SEQ ID NO: 3603353 - RNA, 18 nt, Pseudomonas putida KT2440
ugcucaagcgccagggca

SEQ ID NO: 3603354 - RNA, 20 nt, Pseudomonas putida KT2440
ugcucaaggugucgauacuc

SEQ ID NO: 3603355 - RNA, 12 nt, Pseudomonas putida KT2440
ugcucaccagcu

SEQ ID NO: 3603356 - RNA, 14 nt, Pseudomonas putida KT2440
ugcucaccagcuuc

SEQ ID NO: 3603357 - RNA, 17 nt, Pseudomonas putida KT2440
ugcucaccauguuccag

SEQ ID NO: 3603358 - RNA, 16 nt, Pseudomonas putida KT2440
ugcugcggcaggcugg

SEQ ID NO: 3603359 - RNA, 14 nt, Pseudomonas putida KT2440
ugcugcggccgcgc

SEQ ID NO: 3603360 - RNA, 20 nt, Pseudomonas putida KT2440
ugcugcggggugcucugccg

SEQ ID NO: 3603361 - RNA, 22 nt, Pseudomonas putida KT2440
ugcugcggggugcucugccgca

SEQ ID NO: 3603362 - RNA, 21 nt, Pseudomonas putida KT2440
ugcugcgguaccggccagcug

SEQ ID NO: 3603363 - RNA, 20 nt, Pseudomonas putida KT2440
ugcugcgucucuuccuccau

SEQ ID NO: 3603364 - RNA, 13 nt, Pseudomonas putida KT2440
ugcugcucugcaa

SEQ ID NO: 3603365 - RNA, 17 nt, Pseudomonas putida KT2440
ugcugcucugcaaugcc

SEQ ID NO: 3603366 - RNA, 14 nt, Pseudomonas putida KT2440
ugcugcucugccgc

SEQ ID NO: 3603367 - RNA, 21 nt, Pseudomonas putida KT2440
ugcugcugcagcacugccugc

SEQ ID NO: 3603368 - RNA, 19 nt, Pseudomonas putida KT2440
ugcugcugccagugggcac

SEQ ID NO: 3603369 - RNA, 14 nt, Pseudomonas putida KT2440
ugcugcuggcacgc

SEQ ID NO: 3603370 - RNA, 22 nt, Pseudomonas putida KT2440
ugcugcuggccgccagacaacu

SEQ ID NO: 3603371 - RNA, 14 nt, Pseudomonas putida KT2440
ugcuggaacugcug

SEQ ID NO: 3603372 - RNA, 16 nt, Pseudomonas putida KT2440
ugcuggcaauccagcg

SEQ ID NO: 3603373 - RNA, 22 nt, Pseudomonas putida KT2440
ugcuggcacgccuucagcagcc

SEQ ID NO: 3603374 - RNA, 14 nt, Pseudomonas putida KT2440
ugcuggcacugcgg

SEQ ID NO: 3603375 - RNA, 22 nt, Pseudomonas putida KT2440
ugcuggccaaggucuccagcac

SEQ ID NO: 3603376 - RNA, 22 nt, Pseudomonas putida KT2440
ugcuggccaauuucuacccgcc

SEQ ID NO: 3603377 - RNA, 11 nt, Pseudomonas putida KT2440
ugcuggccacc

SEQ ID NO: 3603378 - RNA, 12 nt, Pseudomonas putida KT2440
ugcuggccaccg

SEQ ID NO: 3603379 - RNA, 16 nt, Pseudomonas putida KT2440
ugcuggccgccagaca

SEQ ID NO: 3603380 - RNA, 15 nt, Pseudomonas putida KT2440
ugcuggccgcgcagg

SEQ ID NO: 3603381 - RNA, 16 nt, Pseudomonas putida KT2440
ugcuggcgacgcugcc

SEQ ID NO: 3603382 - RNA, 17 nt, Pseudomonas putida KT2440
ugcuggcgacgcugccc

SEQ ID NO: 3603383 - RNA, 17 nt, Pseudomonas putida KT2440
ugcuggcgccagcgaug

SEQ ID NO: 3603384 - RNA, 21 nt, Pseudomonas putida KT2440
ugcuggcggcugagccggcug

SEQ ID NO: 3603385 - RNA, 16 nt, Pseudomonas putida KT2440
ugcuggcggugaucgu

SEQ ID NO: 3603386 - RNA, 19 nt, Pseudomonas putida KT2440
ugcuggcgucauccugcgc

SEQ ID NO: 3603387 - RNA, 15 nt, Pseudomonas putida KT2440
ugcugggcaagggcc

SEQ ID NO: 3603388 - RNA, 13 nt, Pseudomonas putida KT2440
ugcugggucagca

SEQ ID NO: 3603389 - RNA, 14 nt, Pseudomonas putida KT2440
ugcugggucagcac

SEQ ID NO: 3603390 - RNA, 17 nt, Pseudomonas putida KT2440
ugcugguacaugccgcc

SEQ ID NO: 3603391 - RNA, 19 nt, Pseudomonas putida KT2440
ugcugguagaaccacucca

SEQ ID NO: 3603392 - RNA, 19 nt, Pseudomonas putida KT2440
ugcuggucagugcacuugc

SEQ ID NO: 3603393 - RNA, 15 nt, Pseudomonas putida KT2440
ugcugguccuccccu

SEQ ID NO: 3603394 - RNA, 17 nt, Pseudomonas putida KT2440
ugcugguccucgacggg

SEQ ID NO: 3603395 - RNA, 21 nt, Pseudomonas putida KT2440
ugcuggucgaacaacuugugc

SEQ ID NO: 3603396 - RNA, 21 nt, Pseudomonas putida KT2440
ugcuggucgccgugcagcacc

SEQ ID NO: 3603397 - RNA, 14 nt, Pseudomonas putida KT2440
ugcugguggccacg

SEQ ID NO: 3603398 - RNA, 15 nt, Pseudomonas putida KT2440
ugcugguggccacgc

SEQ ID NO: 3603399 - RNA, 22 nt, Pseudomonas putida KT2440
ugcugguucaucgacuggaugc

SEQ ID NO: 3603400 - RNA, 14 nt, Pseudomonas putida KT2440
ugcugugcacugcg

SEQ ID NO: 3603401 - RNA, 18 nt, Pseudomonas putida KT2440
ugcuguggaacagccuug

SEQ ID NO: 3603402 - RNA, 18 nt, Pseudomonas putida KT2440
ugcuguguuaccagucca

SEQ ID NO: 3603403 - RNA, 18 nt, Pseudomonas putida KT2440
ugcuguugcugcaguuca

SEQ ID NO: 3603404 - RNA, 14 nt, Pseudomonas putida KT2440
ugcuguuggcgcga

SEQ ID NO: 3603405 - RNA, 21 nt, Pseudomonas putida KT2440
ugcuguuugggcugcgcggca

SEQ ID NO: 3603406 - RNA, 14 nt, Pseudomonas putida KT2440
ugcuucaaucaacc

SEQ ID NO: 3603407 - RNA, 22 nt, Pseudomonas putida KT2440
ugcuucauagccaucuacuccu

SEQ ID NO: 3603408 - RNA, 17 nt, Pseudomonas putida KT2440
ugcuuccagggcgccgu

SEQ ID NO: 3603409 - RNA, 20 nt, Pseudomonas putida KT2440
ugcuucgcccagugccugac

SEQ ID NO: 3603410 - RNA, 16 nt, Pseudomonas putida KT2440
ugcuucgcgggcacgc

SEQ ID NO: 3603411 - RNA, 18 nt, Pseudomonas putida KT2440
ugcuucgcgggcacgccc

SEQ ID NO: 3603412 - RNA, 14 nt, Pseudomonas putida KT2440
ugcuucgcugccag

SEQ ID NO: 3603413 - RNA, 16 nt, Pseudomonas putida KT2440
ugcuucgcugccagga

SEQ ID NO: 3603414 - RNA, 15 nt, Pseudomonas putida KT2440
ugcuucggcugaucu

SEQ ID NO: 3603415 - RNA, 20 nt, Pseudomonas putida KT2440
ugcuucgggaauaccaggcc

SEQ ID NO: 3603416 - RNA, 15 nt, Pseudomonas putida KT2440
ugcuucugcagaucc

SEQ ID NO: 3603417 - RNA, 15 nt, Pseudomonas putida KT2440
ugcuugagcgcagcg

SEQ ID NO: 3603418 - RNA, 15 nt, Pseudomonas putida KT2440
ugcuugcccagaucc

SEQ ID NO: 3603419 - RNA, 16 nt, Pseudomonas putida KT2440
ugcuugcggaacaccc

SEQ ID NO: 3603420 - RNA, 13 nt, Pseudomonas putida KT2440
ugcuugcgggccc

SEQ ID NO: 3603421 - RNA, 18 nt, Pseudomonas putida KT2440
ugcuugcgggcccaguuc

SEQ ID NO: 3603422 - RNA, 15 nt, Pseudomonas putida KT2440
ugcuugguaccgucg

SEQ ID NO: 3603423 - RNA, 21 nt, Pseudomonas putida KT2440
ugcuugucauaagccuuucau

SEQ ID NO: 3603424 - RNA, 14 nt, Pseudomonas putida KT2440
ugcuuguccauccc

SEQ ID NO: 3603425 - RNA, 15 nt, Pseudomonas putida KT2440
ugcuuucaguugagg

SEQ ID NO: 3603426 - RNA, 23 nt, Pseudomonas putida KT2440
ugcuuuuccugcgggucauccuc

SEQ ID NO: 3603427 - RNA, 16 nt, Pseudomonas putida KT2440
ugcuuuuuugugccug

SEQ ID NO: 3603428 - RNA, 12 nt, Pseudomonas putida KT2440
uggaaaacagcg

SEQ ID NO: 3603429 - RNA, 14 nt, Pseudomonas putida KT2440
uggaaaacagcgcg

SEQ ID NO: 3603430 - RNA, 15 nt, Pseudomonas putida KT2440
uggaaaacagcgcgc

SEQ ID NO: 3603431 - RNA, 13 nt, Pseudomonas putida KT2440
uggaaaagcaagg

SEQ ID NO: 3603432 - RNA, 14 nt, Pseudomonas putida KT2440
uggaaaaugaugca

SEQ ID NO: 3603433 - RNA, 13 nt, Pseudomonas putida KT2440
uggaaaucgccug

SEQ ID NO: 3603434 - RNA, 16 nt, Pseudomonas putida KT2440
uggaaaucgccugcuu

SEQ ID NO: 3603435 - RNA, 22 nt, Pseudomonas putida KT2440
uggaaauucucggcugccuggg

SEQ ID NO: 3603436 - RNA, 19 nt, Pseudomonas putida KT2440
uggaacaggauggcaaagc

SEQ ID NO: 3603437 - RNA, 22 nt, Pseudomonas putida KT2440
uggaacaggauggcaaagcgca

SEQ ID NO: 3603438 - RNA, 14 nt, Pseudomonas putida KT2440
uggaacgcuuggcc

SEQ ID NO: 3603439 - RNA, 17 nt, Pseudomonas putida KT2440
uggaacgcuuggccaga

SEQ ID NO: 3603440 - RNA, 13 nt, Pseudomonas putida KT2440
uggaacugcugca

SEQ ID NO: 3603441 - RNA, 15 nt, Pseudomonas putida KT2440
uggaagcgcgcauca

SEQ ID NO: 3603442 - RNA, 19 nt, Pseudomonas putida KT2440
uggaagcuggcuacccgcu

SEQ ID NO: 3603443 - RNA, 21 nt, Pseudomonas putida KT2440
uggaagggcggguugcacagg

SEQ ID NO: 3603444 - RNA, 14 nt, Pseudomonas putida KT2440
uggaaguuccugcu

SEQ ID NO: 3603445 - RNA, 21 nt, Pseudomonas putida KT2440
uggaauaagaucuaugaccaa

SEQ ID NO: 3603446 - RNA, 13 nt, Pseudomonas putida KT2440
uggaauaccaccu

SEQ ID NO: 3603447 - RNA, 16 nt, Pseudomonas putida KT2440
uggaauuccugccggg

SEQ ID NO: 3603448 - RNA, 23 nt, Pseudomonas putida KT2440
uggaauucgcugcgcaucacccg

SEQ ID NO: 3603449 - RNA, 13 nt, Pseudomonas putida KT2440
uggacacagaccg

SEQ ID NO: 3603450 - RNA, 15 nt, Pseudomonas putida KT2440
uggacaccucccgcg

SEQ ID NO: 3603451 - RNA, 15 nt, Pseudomonas putida KT2440
uggacacugccguga

SEQ ID NO: 3603452 - RNA, 19 nt, Pseudomonas putida KT2440
uggacagcccaaggccugc

SEQ ID NO: 3603453 - RNA, 17 nt, Pseudomonas putida KT2440
uggacagcggcagcauc

SEQ ID NO: 3603454 - RNA, 18 nt, Pseudomonas putida KT2440
uggacagcggcagcaucg

SEQ ID NO: 3603455 - RNA, 19 nt, Pseudomonas putida KT2440
uggacccaaucgcugugca

SEQ ID NO: 3603456 - RNA, 13 nt, Pseudomonas putida KT2440
uggacgccgcacc

SEQ ID NO: 3603457 - RNA, 13 nt, Pseudomonas putida KT2440
uggacuaacaggu

SEQ ID NO: 3603458 - RNA, 23 nt, Pseudomonas putida KT2440
uggacuucaucgcgggccaggug

SEQ ID NO: 3603459 - RNA, 15 nt, Pseudomonas putida KT2440
uggagaagcgaucga

SEQ ID NO: 3603460 - RNA, 16 nt, Pseudomonas putida KT2440
uggagagccccaccag

SEQ ID NO: 3603461 - RNA, 20 nt, Pseudomonas putida KT2440
uggagagcgauuccaagugc

SEQ ID NO: 3603462 - RNA, 15 nt, Pseudomonas putida KT2440
uggagagguacaccc

SEQ ID NO: 3603463 - RNA, 21 nt, Pseudomonas putida KT2440
uggagauaccguagcggucau

SEQ ID NO: 3603464 - RNA, 23 nt, Pseudomonas putida KT2440
uggccaccaggguggcgauccac

SEQ ID NO: 3603465 - RNA, 19 nt, Pseudomonas putida KT2440
uggccaccaugaacagcac

SEQ ID NO: 3603466 - RNA, 16 nt, Pseudomonas putida KT2440
uggccacccggcugcu

SEQ ID NO: 3603467 - RNA, 12 nt, Pseudomonas putida KT2440
uggccaccgcgc

SEQ ID NO: 3603468 - RNA, 16 nt, Pseudomonas putida KT2440
uggccacgcccaaccc

SEQ ID NO: 3603469 - RNA, 21 nt, Pseudomonas putida KT2440
uggccacguaggcacucgguc

SEQ ID NO: 3603470 - RNA, 14 nt, Pseudomonas putida KT2440
uggccacuguugca

SEQ ID NO: 3603471 - RNA, 19 nt, Pseudomonas putida KT2440
uggccacuguugcagcgcc

SEQ ID NO: 3603472 - RNA, 20 nt, Pseudomonas putida KT2440
uggccacuucgcgagcgagc

SEQ ID NO: 3603473 - RNA, 17 nt, Pseudomonas putida KT2440
uggccagaaacggcggc

SEQ ID NO: 3603474 - RNA, 15 nt, Pseudomonas putida KT2440
uggccagacgaugau

SEQ ID NO: 3603475 - RNA, 21 nt, Pseudomonas putida KT2440
uggccagacucagcugcugcu

SEQ ID NO: 3603476 - RNA, 22 nt, Pseudomonas putida KT2440
uggccagacucagcugcugcuc

SEQ ID NO: 3603477 - RNA, 24 nt, Pseudomonas putida KT2440
uggccagagcgcgccacgcaccag

SEQ ID NO: 3603478 - RNA, 13 nt, Pseudomonas putida KT2440
uggccagcagccc

SEQ ID NO: 3603479 - RNA, 15 nt, Pseudomonas putida KT2440
uggccagcagggccg

SEQ ID NO: 3603480 - RNA, 18 nt, Pseudomonas putida KT2440
uggccagcagggccgccc

SEQ ID NO: 3603481 - RNA, 18 nt, Pseudomonas putida KT2440
uggccagcucauccagcc

SEQ ID NO: 3603482 - RNA, 22 nt, Pseudomonas putida KT2440
uggccagcucauccagccgcgu

SEQ ID NO: 3603483 - RNA, 18 nt, Pseudomonas putida KT2440
uggccagggugcgggcgu

SEQ ID NO: 3603484 - RNA, 19 nt, Pseudomonas putida KT2440
uggccagugccaugaacac

SEQ ID NO: 3603485 - RNA, 22 nt, Pseudomonas putida KT2440
uggccauaguugaccagcacca

SEQ ID NO: 3603486 - RNA, 18 nt, Pseudomonas putida KT2440
uggccaucacuucacggg

SEQ ID NO: 3603487 - RNA, 22 nt, Pseudomonas putida KT2440
uggccaucacuuccggcugcag

SEQ ID NO: 3603488 - RNA, 15 nt, Pseudomonas putida KT2440
uggccaugaucgccg

SEQ ID NO: 3603489 - RNA, 15 nt, Pseudomonas putida KT2440
uggccauuucgcggc

SEQ ID NO: 3603490 - RNA, 12 nt, Pseudomonas putida KT2440
uggcccaaggcg

SEQ ID NO: 3603491 - RNA, 17 nt, Pseudomonas putida KT2440
uggcccacgccuuccac

SEQ ID NO: 3603492 - RNA, 17 nt, Pseudomonas putida KT2440
uggcccaugacguucuu

SEQ ID NO: 3603493 - RNA, 17 nt, Pseudomonas putida KT2440
uggcccaugaucgcggc

SEQ ID NO: 3603494 - RNA, 14 nt, Pseudomonas putida KT2440
uggccccacccaac

SEQ ID NO: 3603495 - RNA, 16 nt, Pseudomonas putida KT2440
uggccccggccaggcc

SEQ ID NO: 3603496 - RNA, 13 nt, Pseudomonas putida KT2440
uggcccgaacagc

SEQ ID NO: 3603497 - RNA, 16 nt, Pseudomonas putida KT2440
uggcccgaacagcacg

SEQ ID NO: 3603498 - RNA, 22 nt, Pseudomonas putida KT2440
uggcccgaacgcagcgccgcca

SEQ ID NO: 3603499 - RNA, 20 nt, Pseudomonas putida KT2440
uggcccgacaaagaagcgcc

SEQ ID NO: 3603500 - RNA, 16 nt, Pseudomonas putida KT2440
uggcccgcagcgcuuc

SEQ ID NO: 3603501 - RNA, 18 nt, Pseudomonas putida KT2440
uggcccgccaguaggcug

SEQ ID NO: 3603502 - RNA, 22 nt, Pseudomonas putida KT2440
uggcccgccaguaggcugcagc

SEQ ID NO: 3603503 - RNA, 22 nt, Pseudomonas putida KT2440
uggcccgccgccaccagcgccg

SEQ ID NO: 3603504 - RNA, 22 nt, Pseudomonas putida KT2440
uggcccgcgaugccgacagcca

SEQ ID NO: 3603505 - RNA, 12 nt, Pseudomonas putida KT2440
uggcccgcgcca

SEQ ID NO: 3603506 - RNA, 18 nt, Pseudomonas putida KT2440
uggcccgcgcccuugcgg

SEQ ID NO: 3603507 - RNA, 16 nt, Pseudomonas putida KT2440
uggcccggucccgcug

SEQ ID NO: 3603508 - RNA, 21 nt, Pseudomonas putida KT2440
uggcccgucugcgugcaccca

SEQ ID NO: 3603509 - RNA, 12 nt, Pseudomonas putida KT2440
uggcccucugcg

SEQ ID NO: 3603510 - RNA, 20 nt, Pseudomonas putida KT2440
uggcccugaccgcggugcug

SEQ ID NO: 3603511 - RNA, 15 nt, Pseudomonas putida KT2440
uggcccugaucugcc

SEQ ID NO: 3603512 - RNA, 14 nt, Pseudomonas putida KT2440
uggcccuucgcgga

SEQ ID NO: 3603513 - RNA, 23 nt, Pseudomonas putida KT2440
uggccgaaaccagccccuugcuc

SEQ ID NO: 3603514 - RNA, 13 nt, Pseudomonas putida KT2440
uggccgaaggccg

SEQ ID NO: 3603515 - RNA, 15 nt, Pseudomonas putida KT2440
uggccgacuggcgca

SEQ ID NO: 3603516 - RNA, 23 nt, Pseudomonas putida KT2440
uggccgagcaggagcugaacugc

SEQ ID NO: 3603517 - RNA, 20 nt, Pseudomonas putida KT2440
uggccgagccaagaggcagc

SEQ ID NO: 3603518 - RNA, 16 nt, Pseudomonas putida KT2440
uggccgagcugauccg

SEQ ID NO: 3603519 - RNA, 22 nt, Pseudomonas putida KT2440
uggccgagcugauccgccuggc

SEQ ID NO: 3603520 - RNA, 23 nt, Pseudomonas putida KT2440
uggccgcaacacauuauccacca

SEQ ID NO: 3603521 - RNA, 13 nt, Pseudomonas putida KT2440
uggccgcaaccug

SEQ ID NO: 3603522 - RNA, 13 nt, Pseudomonas putida KT2440
uggccgcacccag

SEQ ID NO: 3603523 - RNA, 14 nt, Pseudomonas putida KT2440
uggccgcaggccca

SEQ ID NO: 3603524 - RNA, 19 nt, Pseudomonas putida KT2440
uggccgcaggcccaaacau

SEQ ID NO: 3603525 - RNA, 16 nt, Pseudomonas putida KT2440
uggccgccaacagcgc

SEQ ID NO: 3603526 - RNA, 19 nt, Pseudomonas putida KT2440
uggccgccaacagcgcagg

SEQ ID NO: 3603527 - RNA, 23 nt, Pseudomonas putida KT2440
uggccgccagacaacuggccagg

SEQ ID NO: 3603528 - RNA, 16 nt, Pseudomonas putida KT2440
uggccgccagcggcgu

SEQ ID NO: 3603529 - RNA, 18 nt, Pseudomonas putida KT2440
uggccgccaugaucugcc

SEQ ID NO: 3603530 - RNA, 23 nt, Pseudomonas putida KT2440
uggccgcgaagcggcggguagag

SEQ ID NO: 3603531 - RNA, 21 nt, Pseudomonas putida KT2440
uggccgcgcaggaagaaggca

SEQ ID NO: 3603532 - RNA, 21 nt, Pseudomonas putida KT2440
uggccgcugaaccucaccgcc

SEQ ID NO: 3603533 - RNA, 22 nt, Pseudomonas putida KT2440
uggccgcugaaccucaccgccg

SEQ ID NO: 3603534 - RNA, 15 nt, Pseudomonas putida KT2440
uggccgcuggcccuu

SEQ ID NO: 3603535 - RNA, 20 nt, Pseudomonas putida KT2440
uggccggaggcaaauuuuca

SEQ ID NO: 3603536 - RNA, 16 nt, Pseudomonas putida KT2440
uggccggcacugacca

SEQ ID NO: 3603537 - RNA, 16 nt, Pseudomonas putida KT2440
uggccggcaucgcagc

SEQ ID NO: 3603538 - RNA, 21 nt, Pseudomonas putida KT2440
uggccggccgggcucugggca

SEQ ID NO: 3603539 - RNA, 12 nt, Pseudomonas putida KT2440
uggccggcgcug

SEQ ID NO: 3603540 - RNA, 22 nt, Pseudomonas putida KT2440
uggccggcgcugagcgacagca

SEQ ID NO: 3603541 - RNA, 17 nt, Pseudomonas putida KT2440
uggccggcuuggcaccu

SEQ ID NO: 3603542 - RNA, 16 nt, Pseudomonas putida KT2440
uggccgggcucggccg

SEQ ID NO: 3603543 - RNA, 23 nt, Pseudomonas putida KT2440
uggccggucuguucggcaaggua

SEQ ID NO: 3603544 - RNA, 19 nt, Pseudomonas putida KT2440
uggccgguguggccaaggc

SEQ ID NO: 3603545 - RNA, 17 nt, Pseudomonas putida KT2440
uggccgguuucagucag

SEQ ID NO: 3603546 - RNA, 18 nt, Pseudomonas putida KT2440
uggccguagccaggcauu

SEQ ID NO: 3603547 - RNA, 16 nt, Pseudomonas putida KT2440
uggccgugccgaggac

SEQ ID NO: 3603548 - RNA, 20 nt, Pseudomonas putida KT2440
uggccguguucgacgaucga

SEQ ID NO: 3603549 - RNA, 16 nt, Pseudomonas putida KT2440
uggccucgaacauggc

SEQ ID NO: 3603550 - RNA, 21 nt, Pseudomonas putida KT2440
uggccucgaacauggccacgg

SEQ ID NO: 3603551 - RNA, 19 nt, Pseudomonas putida KT2440
uggccucggcgaucgccag

SEQ ID NO: 3603552 - RNA, 20 nt, Pseudomonas putida KT2440
uggccucuggcuuggcugcg

SEQ ID NO: 3603553 - RNA, 15 nt, Pseudomonas putida KT2440
uggccucuucgcggg

SEQ ID NO: 3603554 - RNA, 20 nt, Pseudomonas putida KT2440
uggccugacgcuucaucgag

SEQ ID NO: 3603555 - RNA, 12 nt, Pseudomonas putida KT2440
uggccugagccg

SEQ ID NO: 3603556 - RNA, 13 nt, Pseudomonas putida KT2440
uggccugagccgg

SEQ ID NO: 3603557 - RNA, 14 nt, Pseudomonas putida KT2440
uggccugcaagccg

SEQ ID NO: 3603558 - RNA, 23 nt, Pseudomonas putida KT2440
uggccugcaagccggcgaacagc

SEQ ID NO: 3603559 - RNA, 24 nt, Pseudomonas putida KT2440
uggccugcagagacaucuccauag

SEQ ID NO: 3603560 - RNA, 19 nt, Pseudomonas putida KT2440
uggccugcagccguugcug

SEQ ID NO: 3603561 - RNA, 13 nt, Pseudomonas putida KT2440
uggccugcauguc

SEQ ID NO: 3603562 - RNA, 12 nt, Pseudomonas putida KT2440
uggccugcucac

SEQ ID NO: 3603563 - RNA, 15 nt, Pseudomonas putida KT2440
uggccugcucacccg

SEQ ID NO: 3603564 - RNA, 17 nt, Pseudomonas putida KT2440
uggccugcucacccgac

SEQ ID NO: 3603565 - RNA, 20 nt, Pseudomonas putida KT2440
uggccugcucacccgaccag

SEQ ID NO: 3603566 - RNA, 15 nt, Pseudomonas putida KT2440
uggccugcuugauca

SEQ ID NO: 3603567 - RNA, 19 nt, Pseudomonas putida KT2440
uggccuggcgagucagggc

SEQ ID NO: 3603568 - RNA, 21 nt, Pseudomonas putida KT2440
uggccuggucgaaggucaggc

SEQ ID NO: 3603569 - RNA, 14 nt, Pseudomonas putida KT2440
uggcguugccuucg

SEQ ID NO: 3603570 - RNA, 19 nt, Pseudomonas putida KT2440
uggcguugucagcaaccgg

SEQ ID NO: 3603571 - RNA, 15 nt, Pseudomonas putida KT2440
uggcguuguccagca

SEQ ID NO: 3603572 - RNA, 15 nt, Pseudomonas putida KT2440
uggcguuuuucacac

SEQ ID NO: 3603573 - RNA, 18 nt, Pseudomonas putida KT2440
uggcuacccgcucggccu

SEQ ID NO: 3603574 - RNA, 15 nt, Pseudomonas putida KT2440
uggcuagccucauca

SEQ ID NO: 3603575 - RNA, 21 nt, Pseudomonas putida KT2440
uggcuagccucaucagagcgu

SEQ ID NO: 3603576 - RNA, 19 nt, Pseudomonas putida KT2440
uggcuagggucguccuggg

SEQ ID NO: 3603577 - RNA, 16 nt, Pseudomonas putida KT2440
uggcuauccuucugcc

SEQ ID NO: 3603578 - RNA, 14 nt, Pseudomonas putida KT2440
uggcuaugccggcc

SEQ ID NO: 3603579 - RNA, 16 nt, Pseudomonas putida KT2440
uggcucacacccaggc

SEQ ID NO: 3603580 - RNA, 23 nt, Pseudomonas putida KT2440
uggcucacacccaggcucgcccg

SEQ ID NO: 3603581 - RNA, 15 nt, Pseudomonas putida KT2440
uggcucagcgagcgg

SEQ ID NO: 3603582 - RNA, 16 nt, Pseudomonas putida KT2440
uggcucagcucggcau

SEQ ID NO: 3603583 - RNA, 15 nt, Pseudomonas putida KT2440
uggcucaguggcugc

SEQ ID NO: 3603584 - RNA, 13 nt, Pseudomonas putida KT2440
uggcucaucaccg

SEQ ID NO: 3603585 - RNA, 18 nt, Pseudomonas putida KT2440
uggcucaucaccggcguu

SEQ ID NO: 3603586 - RNA, 19 nt, Pseudomonas putida KT2440
uggcucaucaccggcguug

SEQ ID NO: 3603587 - RNA, 22 nt, Pseudomonas putida KT2440
uggcucaucagcaacccggcca

SEQ ID NO: 3603588 - RNA, 18 nt, Pseudomonas putida KT2440
uggcucaugcgccagggc

SEQ ID NO: 3603589 - RNA, 21 nt, Pseudomonas putida KT2440
uggcucaugcgccagggcuga

SEQ ID NO: 3603590 - RNA, 17 nt, Pseudomonas putida KT2440
uggcucgacacgcuugc

SEQ ID NO: 3603591 - RNA, 14 nt, Pseudomonas putida KT2440
uggcucgcagccaa

SEQ ID NO: 3603592 - RNA, 15 nt, Pseudomonas putida KT2440
uggcucgcagccaau

SEQ ID NO: 3603593 - RNA, 15 nt, Pseudomonas putida KT2440
uggcucgcugcccca

SEQ ID NO: 3603594 - RNA, 21 nt, Pseudomonas putida KT2440
uggcucuccucucccaccagc

SEQ ID NO: 3603595 - RNA, 20 nt, Pseudomonas putida KT2440
uggcucugcagcguauucag

SEQ ID NO: 3603596 - RNA, 16 nt, Pseudomonas putida KT2440
uggcucuucaacacca

SEQ ID NO: 3603597 - RNA, 19 nt, Pseudomonas putida KT2440
uggcucuucaacaccagca

SEQ ID NO: 3603598 - RNA, 15 nt, Pseudomonas putida KT2440
uggcugaccggcacg

SEQ ID NO: 3603599 - RNA, 17 nt, Pseudomonas putida KT2440
uggcugagcgcauuauc

SEQ ID NO: 3603600 - RNA, 23 nt, Pseudomonas putida KT2440
uggcugaggguuguugaagaaga

SEQ ID NO: 3603601 - RNA, 19 nt, Pseudomonas putida KT2440
uggcugauagccgccagca

SEQ ID NO: 3603602 - RNA, 21 nt, Pseudomonas putida KT2440
uggcugauagccgccagcauc

SEQ ID NO: 3603603 - RNA, 19 nt, Pseudomonas putida KT2440
uggcugcaagguccaggcg

SEQ ID NO: 3603604 - RNA, 18 nt, Pseudomonas putida KT2440
uggcugcaccccgaucca

SEQ ID NO: 3603605 - RNA, 12 nt, Pseudomonas putida KT2440
uggcugcacugg

SEQ ID NO: 3603606 - RNA, 14 nt, Pseudomonas putida KT2440
uggcugcacuucga

SEQ ID NO: 3603607 - RNA, 19 nt, Pseudomonas putida KT2440
uggcugcaggucggccagc

SEQ ID NO: 3603608 - RNA, 15 nt, Pseudomonas putida KT2440
uggcugccagcgcgc

SEQ ID NO: 3603609 - RNA, 21 nt, Pseudomonas putida KT2440
uggcugccagcgcgcugcgca

SEQ ID NO: 3603610 - RNA, 15 nt, Pseudomonas putida KT2440
uggcugcccgagagc

SEQ ID NO: 3603611 - RNA, 12 nt, Pseudomonas putida KT2440
uggcugccgcug

SEQ ID NO: 3603612 - RNA, 13 nt, Pseudomonas putida KT2440
uggcugccggccu

SEQ ID NO: 3603613 - RNA, 20 nt, Pseudomonas putida KT2440
uggcugccguccaacgggcg

SEQ ID NO: 3603614 - RNA, 17 nt, Pseudomonas putida KT2440
uggcugccuucgcucag

SEQ ID NO: 3603615 - RNA, 13 nt, Pseudomonas putida KT2440
uggcugcggcagg

SEQ ID NO: 3603616 - RNA, 19 nt, Pseudomonas putida KT2440
uggcugcgggugcccgggc

SEQ ID NO: 3603617 - RNA, 18 nt, Pseudomonas putida KT2440
uggcugcguucaggcagg

SEQ ID NO: 3603618 - RNA, 14 nt, Pseudomonas putida KT2440
uggcuggcagcacg

SEQ ID NO: 3603619 - RNA, 21 nt, Pseudomonas putida KT2440
uggcuggcagccggcgccggu

SEQ ID NO: 3603620 - RNA, 20 nt, Pseudomonas putida KT2440
uggcugggcuucgacaaccg

SEQ ID NO: 3603621 - RNA, 22 nt, Pseudomonas putida KT2440
uggcugggggcgcuuugcgccc

SEQ ID NO: 3603622 - RNA, 14 nt, Pseudomonas putida KT2440
uggcuggucuccag

SEQ ID NO: 3603623 - RNA, 17 nt, Pseudomonas putida KT2440
uggcuggucuccagcag

SEQ ID NO: 3603624 - RNA, 21 nt, Pseudomonas putida KT2440
uggcuggucuccagcagugcc

SEQ ID NO: 3603625 - RNA, 12 nt, Pseudomonas putida KT2440
uggcuggugaag

SEQ ID NO: 3603626 - RNA, 19 nt, Pseudomonas putida KT2440
uggcuggugaagcccuucg

SEQ ID NO: 3603627 - RNA, 16 nt, Pseudomonas putida KT2440
uggcuggugaaggcag

SEQ ID NO: 3603628 - RNA, 23 nt, Pseudomonas putida KT2440
uggcuggugaaggcaggucagcg

SEQ ID NO: 3603629 - RNA, 22 nt, Pseudomonas putida KT2440
uggcugugauacagcacgcgca

SEQ ID NO: 3603630 - RNA, 23 nt, Pseudomonas putida KT2440
uggcugugauacagcacgcgcau

SEQ ID NO: 3603631 - RNA, 16 nt, Pseudomonas putida KT2440
uggcuguucaggccgg

SEQ ID NO: 3603632 - RNA, 16 nt, Pseudomonas putida KT2440
uggcuguugcgguugc

SEQ ID NO: 3603633 - RNA, 22 nt, Pseudomonas putida KT2440
uggcuguugcgguugccaagca

SEQ ID NO: 3603634 - RNA, 18 nt, Pseudomonas putida KT2440
uggcuuacaacaggaaca

SEQ ID NO: 3603635 - RNA, 15 nt, Pseudomonas putida KT2440
uggcuuacagcgugg

SEQ ID NO: 3603636 - RNA, 17 nt, Pseudomonas putida KT2440
uggcuuagcgcgggccu

SEQ ID NO: 3603637 - RNA, 16 nt, Pseudomonas putida KT2440
uggcuuccugcuggcu

SEQ ID NO: 3603638 - RNA, 15 nt, Pseudomonas putida KT2440
uggcuucgccggcca

SEQ ID NO: 3603639 - RNA, 17 nt, Pseudomonas putida KT2440
uggcuuguucggcaucg

SEQ ID NO: 3603640 - RNA, 16 nt, Pseudomonas putida KT2440
uggcuuucccccagcc

SEQ ID NO: 3603641 - RNA, 18 nt, Pseudomonas putida KT2440
ugggaaugugucagggcu

SEQ ID NO: 3603642 - RNA, 20 nt, Pseudomonas putida KT2440
ugggacugcguugcaguccu

SEQ ID NO: 3603643 - RNA, 14 nt, Pseudomonas putida KT2440
ugggagagcgccug

SEQ ID NO: 3603644 - RNA, 15 nt, Pseudomonas putida KT2440
ugggagagcgccugc

SEQ ID NO: 3603645 - RNA, 13 nt, Pseudomonas putida KT2440
ugggagcaggcau

SEQ ID NO: 3603646 - RNA, 17 nt, Pseudomonas putida KT2440
ugggagcggccuugugc

SEQ ID NO: 3603647 - RNA, 20 nt, Pseudomonas putida KT2440
ugggagcggccuugugucgc

SEQ ID NO: 3603648 - RNA, 22 nt, Pseudomonas putida KT2440
ugggagcggccuugugucgcga

SEQ ID NO: 3603649 - RNA, 17 nt, Pseudomonas putida KT2440
ugggagcgggcaugccc

SEQ ID NO: 3603650 - RNA, 21 nt, Pseudomonas putida KT2440
ugggagcgggcgcgcccgcga

SEQ ID NO: 3603651 - RNA, 13 nt, Pseudomonas putida KT2440
ugggagcgggcgu

SEQ ID NO: 3603652 - RNA, 20 nt, Pseudomonas putida KT2440
ugggagcgggcgugcccgcg

SEQ ID NO: 3603653 - RNA, 21 nt, Pseudomonas putida KT2440
ugggagcgggcgugcccgcga

SEQ ID NO: 3603654 - RNA, 12 nt, Pseudomonas putida KT2440
ugggagcgggcu

SEQ ID NO: 3603655 - RNA, 20 nt, Pseudomonas putida KT2440
ugggagucggcucuggcaag

SEQ ID NO: 3603656 - RNA, 23 nt, Pseudomonas putida KT2440
ugggauuugugcauugccuguuc

SEQ ID NO: 3603657 - RNA, 20 nt, Pseudomonas putida KT2440
ugggcaacaccgccagaaaa

SEQ ID NO: 3603658 - RNA, 15 nt, Pseudomonas putida KT2440
ugggcaagggccugc

SEQ ID NO: 3603659 - RNA, 18 nt, Pseudomonas putida KT2440
ugggcaagggccugcagg

SEQ ID NO: 3603660 - RNA, 22 nt, Pseudomonas putida KT2440
ugggcaagggccugcaggcagc

SEQ ID NO: 3603661 - RNA, 13 nt, Pseudomonas putida KT2440
ugggcaagugcgu

SEQ ID NO: 3603662 - RNA, 16 nt, Pseudomonas putida KT2440
ugggcaauguccagcc

SEQ ID NO: 3603663 - RNA, 17 nt, Pseudomonas putida KT2440
ugggcaauguccagccc

SEQ ID NO: 3603664 - RNA, 17 nt, Pseudomonas putida KT2440
ugggcaauguucgcugc

SEQ ID NO: 3603665 - RNA, 20 nt, Pseudomonas putida KT2440
ugggcaccagcuuccagaag

SEQ ID NO: 3603666 - RNA, 17 nt, Pseudomonas putida KT2440
ugggcacuggccacccc

SEQ ID NO: 3603667 - RNA, 20 nt, Pseudomonas putida KT2440
ugggcauccagcuugccacc

SEQ ID NO: 3603668 - RNA, 12 nt, Pseudomonas putida KT2440
ugggcaucgaca

SEQ ID NO: 3603669 - RNA, 19 nt, Pseudomonas putida KT2440
ugggcaugagccuggccgg

SEQ ID NO: 3603670 - RNA, 16 nt, Pseudomonas putida KT2440
ugggcaugaucgcgcu

SEQ ID NO: 3603671 - RNA, 22 nt, Pseudomonas putida KT2440
ugggccagaaaugguguccacu

SEQ ID NO: 3603672 - RNA, 16 nt, Pseudomonas putida KT2440
ugggccccaggcggug

SEQ ID NO: 3603673 - RNA, 23 nt, Pseudomonas putida KT2440
ugggccccaggcggugcacggcc

SEQ ID NO: 3603674 - RNA, 22 nt, Pseudomonas putida KT2440
ugguccccauagcuuuccagca

SEQ ID NO: 3603675 - RNA, 18 nt, Pseudomonas putida KT2440
uggucccccacuucugcc

SEQ ID NO: 3603676 - RNA, 18 nt, Pseudomonas putida KT2440
ugguccccuucgucgaug

SEQ ID NO: 3603677 - RNA, 21 nt, Pseudomonas putida KT2440
ugguccgggucugauugggcc

SEQ ID NO: 3603678 - RNA, 17 nt, Pseudomonas putida KT2440
ugguccggucacugcgc

SEQ ID NO: 3603679 - RNA, 20 nt, Pseudomonas putida KT2440
ugguccuccccuucccgcca

SEQ ID NO: 3603680 - RNA, 22 nt, Pseudomonas putida KT2440
ugguccuccccuucccgccauu

SEQ ID NO: 3603681 - RNA, 17 nt, Pseudomonas putida KT2440
uggucgaaccaguacug

SEQ ID NO: 3603682 - RNA, 19 nt, Pseudomonas putida KT2440
uggucgaaccgcaacuggc

SEQ ID NO: 3603683 - RNA, 20 nt, Pseudomonas putida KT2440
uggucgaaccgcaacuggcc

SEQ ID NO: 3603684 - RNA, 18 nt, Pseudomonas putida KT2440
uggucgaaugcgugcaac

SEQ ID NO: 3603685 - RNA, 13 nt, Pseudomonas putida KT2440
uggucgaccgaca

SEQ ID NO: 3603686 - RNA, 20 nt, Pseudomonas putida KT2440
uggucgacgucggcguccuu

SEQ ID NO: 3603687 - RNA, 21 nt, Pseudomonas putida KT2440
uggucgaggcaaagaacagcg

SEQ ID NO: 3603688 - RNA, 23 nt, Pseudomonas putida KT2440
uggucgaggcaaagaacagcgug

SEQ ID NO: 3603689 - RNA, 15 nt, Pseudomonas putida KT2440
uggucgaucccggcu

SEQ ID NO: 3603690 - RNA, 17 nt, Pseudomonas putida KT2440
uggucgcaguacaacgu

SEQ ID NO: 3603691 - RNA, 19 nt, Pseudomonas putida KT2440
uggucgccaggaucaccuc

SEQ ID NO: 3603692 - RNA, 21 nt, Pseudomonas putida KT2440
uggucgccggaaacacuagcg

SEQ ID NO: 3603693 - RNA, 20 nt, Pseudomonas putida KT2440
uggucgccucgacgcagaca

SEQ ID NO: 3603694 - RNA, 12 nt, Pseudomonas putida KT2440
uggucgcggcaa

SEQ ID NO: 3603695 - RNA, 17 nt, Pseudomonas putida KT2440
uggucgcggcgcuggcc

SEQ ID NO: 3603696 - RNA, 15 nt, Pseudomonas putida KT2440
uggucgcgggccagc

SEQ ID NO: 3603697 - RNA, 18 nt, Pseudomonas putida KT2440
uggucgcgggccagccca

SEQ ID NO: 3603698 - RNA, 14 nt, Pseudomonas putida KT2440
uggucgcgugccgc

SEQ ID NO: 3603699 - RNA, 21 nt, Pseudomonas putida KT2440
uggucgcgugccgccaguucg

SEQ ID NO: 3603700 - RNA, 20 nt, Pseudomonas putida KT2440
uggucgcguuguucagcagc

SEQ ID NO: 3603701 - RNA, 13 nt, Pseudomonas putida KT2440
uggucgcugcccu

SEQ ID NO: 3603702 - RNA, 19 nt, Pseudomonas putida KT2440
uggucgcugcccucggccg

SEQ ID NO: 3603703 - RNA, 19 nt, Pseudomonas putida KT2440
uggucgcugcggcacacca

SEQ ID NO: 3603704 - RNA, 15 nt, Pseudomonas putida KT2440
uggucggcagggccg

SEQ ID NO: 3603705 - RNA, 20 nt, Pseudomonas putida KT2440
uggucuccgggcgcccuggc

SEQ ID NO: 3603706 - RNA, 21 nt, Pseudomonas putida KT2440
uggucucgaacugaugaccgg

SEQ ID NO: 3603707 - RNA, 21 nt, Pseudomonas putida KT2440
uggucugguugaccgagaaca

SEQ ID NO: 3603708 - RNA, 15 nt, Pseudomonas putida KT2440
uggucuucaaggcca

SEQ ID NO: 3603709 - RNA, 16 nt, Pseudomonas putida KT2440
uggugaaagucgacca

SEQ ID NO: 3603710 - RNA, 20 nt, Pseudomonas putida KT2440
uggugaaagucgaccagcag

SEQ ID NO: 3603711 - RNA, 18 nt, Pseudomonas putida KT2440
uggugaaaugguugaaga

SEQ ID NO: 3603712 - RNA, 20 nt, Pseudomonas putida KT2440
uggugaagaagcaacuguug

SEQ ID NO: 3603713 - RNA, 21 nt, Pseudomonas putida KT2440
uggugaaggccaggaacagcg

SEQ ID NO: 3603714 - RNA, 14 nt, Pseudomonas putida KT2440
uggugaaucagccc

SEQ ID NO: 3603715 - RNA, 19 nt, Pseudomonas putida KT2440
uggugaauggcgagcccgg

SEQ ID NO: 3603716 - RNA, 14 nt, Pseudomonas putida KT2440
uggugaccucgaug

SEQ ID NO: 3603717 - RNA, 13 nt, Pseudomonas putida KT2440
uggugacugccag

SEQ ID NO: 3603718 - RNA, 23 nt, Pseudomonas putida KT2440
uggugacugccagcacgaucaug

SEQ ID NO: 3603719 - RNA, 20 nt, Pseudomonas putida KT2440
uggugagcccugugggagcg

SEQ ID NO: 3603720 - RNA, 16 nt, Pseudomonas putida KT2440
uggugauguucucauc

SEQ ID NO: 3603721 - RNA, 14 nt, Pseudomonas putida KT2440
uggugcaccagcuu

SEQ ID NO: 3603722 - RNA, 18 nt, Pseudomonas putida KT2440
uggugcaccagcuugugc

SEQ ID NO: 3603723 - RNA, 21 nt, Pseudomonas putida KT2440
uggugccagcggccacuuaca

SEQ ID NO: 3603724 - RNA, 14 nt, Pseudomonas putida KT2440
uggugccaucaccg

SEQ ID NO: 3603725 - RNA, 13 nt, Pseudomonas putida KT2440
uggugcccgccag

SEQ ID NO: 3603726 - RNA, 13 nt, Pseudomonas putida KT2440
uggugccggcacg

SEQ ID NO: 3603727 - RNA, 19 nt, Pseudomonas putida KT2440
uggugccggucggcgucca

SEQ ID NO: 3603728 - RNA, 20 nt, Pseudomonas putida KT2440
uggugccguuggacgccgca

SEQ ID NO: 3603729 - RNA, 17 nt, Pseudomonas putida KT2440
uggugcgccuccagcag

SEQ ID NO: 3603730 - RNA, 19 nt, Pseudomonas putida KT2440
uggugcgccuccagcagcg

SEQ ID NO: 3603731 - RNA, 11 nt, Pseudomonas putida KT2440
uggugcgcgca

SEQ ID NO: 3603732 - RNA, 14 nt, Pseudomonas putida KT2440
uggugcggcugggc

SEQ ID NO: 3603733 - RNA, 18 nt, Pseudomonas putida KT2440
uggugcggcugggcccca

SEQ ID NO: 3603734 - RNA, 20 nt, Pseudomonas putida KT2440
uggugcugguggccacgccg

SEQ ID NO: 3603735 - RNA, 18 nt, Pseudomonas putida KT2440
ugguggcaaugccaugcc

SEQ ID NO: 3603736 - RNA, 17 nt, Pseudomonas putida KT2440
ugguggcauagcgcggc

SEQ ID NO: 3603737 - RNA, 13 nt, Pseudomonas putida KT2440
ugguggcccugac

SEQ ID NO: 3603738 - RNA, 14 nt, Pseudomonas putida KT2440
ugguggcccugacc

SEQ ID NO: 3603739 - RNA, 12 nt, Pseudomonas putida KT2440
ugguggcggcau

SEQ ID NO: 3603740 - RNA, 12 nt, Pseudomonas putida KT2440
ugguggucagcc

SEQ ID NO: 3603741 - RNA, 14 nt, Pseudomonas putida KT2440
ugguggucggcagc

SEQ ID NO: 3603742 - RNA, 19 nt, Pseudomonas putida KT2440
uggugguuuauccggcaca

SEQ ID NO: 3603743 - RNA, 22 nt, Pseudomonas putida KT2440
ugguguccuugucggcgaaggc

SEQ ID NO: 3603744 - RNA, 13 nt, Pseudomonas putida KT2440
uggugucggccag

SEQ ID NO: 3603745 - RNA, 22 nt, Pseudomonas putida KT2440
ugguguucugguugaacugcuu

SEQ ID NO: 3603746 - RNA, 14 nt, Pseudomonas putida KT2440
ugguguuuugcaaa

SEQ ID NO: 3603747 - RNA, 20 nt, Pseudomonas putida KT2440
ugguuaaaagccaacugcuc

SEQ ID NO: 3603748 - RNA, 22 nt, Pseudomonas putida KT2440
ugguuaacaugcuggccauccc

SEQ ID NO: 3603749 - RNA, 23 nt, Pseudomonas putida KT2440
ugguuauuuuuuaacaaggcacg

SEQ ID NO: 3603750 - RNA, 16 nt, Pseudomonas putida KT2440
ugguucauugccaaca

SEQ ID NO: 3603751 - RNA, 20 nt, Pseudomonas putida KT2440
ugguucauugccaacagcag

SEQ ID NO: 3603752 - RNA, 15 nt, Pseudomonas putida KT2440
ugguuccugggaagc

SEQ ID NO: 3603753 - RNA, 14 nt, Pseudomonas putida KT2440
ugguugaugcgcuc

SEQ ID NO: 3603754 - RNA, 13 nt, Pseudomonas putida KT2440
ugguugccggucg

SEQ ID NO: 3603755 - RNA, 20 nt, Pseudomonas putida KT2440
ugguuggacacagaccgucg

SEQ ID NO: 3603756 - RNA, 17 nt, Pseudomonas putida KT2440
ugguuggcggagccagc

SEQ ID NO: 3603757 - RNA, 20 nt, Pseudomonas putida KT2440
ugguuggcggagccagccac

SEQ ID NO: 3603758 - RNA, 14 nt, Pseudomonas putida KT2440
ugguuuaguccugc

SEQ ID NO: 3603759 - RNA, 22 nt, Pseudomonas putida KT2440
ugguuuauccggcacagaaucc

SEQ ID NO: 3603760 - RNA, 23 nt, Pseudomonas putida KT2440
ugguuucacacucgccaggaucg

SEQ ID NO: 3603761 - RNA, 16 nt, Pseudomonas putida KT2440
ugguuugacgcugcuc

SEQ ID NO: 3603762 - RNA, 20 nt, Pseudomonas putida KT2440
uguaaagaaaagccgcuggc

SEQ ID NO: 3603763 - RNA, 23 nt, Pseudomonas putida KT2440
uguaaugaaaaucgccuugcguc

SEQ ID NO: 3603764 - RNA, 20 nt, Pseudomonas putida KT2440
uguacaacgcagccggcacc

SEQ ID NO: 3603765 - RNA, 18 nt, Pseudomonas putida KT2440
uguacacagcccaaggcu

SEQ ID NO: 3603766 - RNA, 22 nt, Pseudomonas putida KT2440
uguacacagcccaaggcuggcc

SEQ ID NO: 3603767 - RNA, 21 nt, Pseudomonas putida KT2440
uguacaccccgaccaaggcca

SEQ ID NO: 3603768 - RNA, 15 nt, Pseudomonas putida KT2440
uguacauggccgcca

SEQ ID NO: 3603769 - RNA, 12 nt, Pseudomonas putida KT2440
uguaccagaacc

SEQ ID NO: 3603770 - RNA, 19 nt, Pseudomonas putida KT2440
uguaccagaaccccggccc

SEQ ID NO: 3603771 - RNA, 18 nt, Pseudomonas putida KT2440
uguaccgggcggccaccg

SEQ ID NO: 3603772 - RNA, 14 nt, Pseudomonas putida KT2440
uguacgccagguga

SEQ ID NO: 3603773 - RNA, 18 nt, Pseudomonas putida KT2440
uguacgcuggccaaggcc

SEQ ID NO: 3603774 - RNA, 17 nt, Pseudomonas putida KT2440
uguacgggacaaggcau

SEQ ID NO: 3603775 - RNA, 14 nt, Pseudomonas putida KT2440
uguacgugcgggcc

SEQ ID NO: 3603776 - RNA, 24 nt, Pseudomonas putida KT2440
uguagaacggcagcaggccaaugc

SEQ ID NO: 3603777 - RNA, 17 nt, Pseudomonas putida KT2440
uguagaccaccagcguu

SEQ ID NO: 3603778 - RNA, 13 nt, Pseudomonas putida KT2440
uguagagcgccuu

SEQ ID NO: 3603779 - RNA, 21 nt, Pseudomonas putida KT2440
ugucuguacaguggcacuggc

SEQ ID NO: 3603780 - RNA, 18 nt, Pseudomonas putida KT2440
ugucuuccagaccagaca

SEQ ID NO: 3603781 - RNA, 12 nt, Pseudomonas putida KT2440
ugucuuccaggu

SEQ ID NO: 3603782 - RNA, 17 nt, Pseudomonas putida KT2440
ugucuuccggcaggucg

SEQ ID NO: 3603783 - RNA, 20 nt, Pseudomonas putida KT2440
ugucuuccggcaugaacaca

SEQ ID NO: 3603784 - RNA, 20 nt, Pseudomonas putida KT2440
ugucuucgcggaaggccuca

SEQ ID NO: 3603785 - RNA, 16 nt, Pseudomonas putida KT2440
ugugaagccagggcaa

SEQ ID NO: 3603786 - RNA, 18 nt, Pseudomonas putida KT2440
ugugaagccagggcaagc

SEQ ID NO: 3603787 - RNA, 19 nt, Pseudomonas putida KT2440
ugugaagccagggcaagca

SEQ ID NO: 3603788 - RNA, 15 nt, Pseudomonas putida KT2440
ugugaggccuucagc

SEQ ID NO: 3603789 - RNA, 16 nt, Pseudomonas putida KT2440
ugugauuuccagcguc

SEQ ID NO: 3603790 - RNA, 19 nt, Pseudomonas putida KT2440
ugugcaaagaacacuuccg

SEQ ID NO: 3603791 - RNA, 13 nt, Pseudomonas putida KT2440
ugugcaacagcgc

SEQ ID NO: 3603792 - RNA, 13 nt, Pseudomonas putida KT2440
ugugcaagucuga

SEQ ID NO: 3603793 - RNA, 17 nt, Pseudomonas putida KT2440
ugugcacacgcaacuga

SEQ ID NO: 3603794 - RNA, 16 nt, Pseudomonas putida KT2440
ugugcacauucuccag

SEQ ID NO: 3603795 - RNA, 11 nt, Pseudomonas putida KT2440
ugugcacugcg

SEQ ID NO: 3603796 - RNA, 14 nt, Pseudomonas putida KT2440
ugugcacuggcagg

SEQ ID NO: 3603797 - RNA, 21 nt, Pseudomonas putida KT2440
ugugcagcgcucgcugccggu

SEQ ID NO: 3603798 - RNA, 23 nt, Pseudomonas putida KT2440
ugugcaggucgauguccaggccg

SEQ ID NO: 3603799 - RNA, 14 nt, Pseudomonas putida KT2440
ugugcaucagcgug

SEQ ID NO: 3603800 - RNA, 13 nt, Pseudomonas putida KT2440
ugugcauccagcc

SEQ ID NO: 3603801 - RNA, 19 nt, Pseudomonas putida KT2440
ugugcauccugcacugcaa

SEQ ID NO: 3603802 - RNA, 17 nt, Pseudomonas putida KT2440
ugugcccuugaacggcc

SEQ ID NO: 3603803 - RNA, 21 nt, Pseudomonas putida KT2440
ugugccgcucguacuggucga

SEQ ID NO: 3603804 - RNA, 20 nt, Pseudomonas putida KT2440
ugugccgcuuuggcagcagc

SEQ ID NO: 3603805 - RNA, 22 nt, Pseudomonas putida KT2440
ugugccggccucuucgcgggca

SEQ ID NO: 3603806 - RNA, 16 nt, Pseudomonas putida KT2440
ugugccguaccugugg

SEQ ID NO: 3603807 - RNA, 23 nt, Pseudomonas putida KT2440
ugugccuggcgcuugaucagccu

SEQ ID NO: 3603808 - RNA, 20 nt, Pseudomonas putida KT2440
ugugcgagcccuuguccagg

SEQ ID NO: 3603809 - RNA, 20 nt, Pseudomonas putida KT2440
ugugcgauagcggugugaca

SEQ ID NO: 3603810 - RNA, 17 nt, Pseudomonas putida KT2440
ugugcgccgucaccagc

SEQ ID NO: 3603811 - RNA, 18 nt, Pseudomonas putida KT2440
ugugcguucaccggcacc

SEQ ID NO: 3603812 - RNA, 15 nt, Pseudomonas putida KT2440
ugugcuccagcucca

SEQ ID NO: 3603813 - RNA, 23 nt, Pseudomonas putida KT2440
ugugcucggccugggcagguuca

SEQ ID NO: 3603814 - RNA, 19 nt, Pseudomonas putida KT2440
ugugcugccauaagcccaa

SEQ ID NO: 3603815 - RNA, 18 nt, Pseudomonas putida KT2440
ugugcugcggccaccgcc

SEQ ID NO: 3603816 - RNA, 15 nt, Pseudomonas putida KT2440
ugugcugcguuguug

SEQ ID NO: 3603817 - RNA, 15 nt, Pseudomonas putida KT2440
ugugcuggcggcugc

SEQ ID NO: 3603818 - RNA, 15 nt, Pseudomonas putida KT2440
ugugcuuugagcagg

SEQ ID NO: 3603819 - RNA, 21 nt, Pseudomonas putida KT2440
ugugcuuugagcaggcgcucg

SEQ ID NO: 3603820 - RNA, 18 nt, Pseudomonas putida KT2440
uguggaacagccuugugc

SEQ ID NO: 3603821 - RNA, 20 nt, Pseudomonas putida KT2440
uguggaagcgggcgugcccg

SEQ ID NO: 3603822 - RNA, 20 nt, Pseudomonas putida KT2440
uguggauaacuuacaucugc

SEQ ID NO: 3603823 - RNA, 19 nt, Pseudomonas putida KT2440
uguggcagcggcuuggccg

SEQ ID NO: 3603824 - RNA, 20 nt, Pseudomonas putida KT2440
uguggcagcggcuuggccgc

SEQ ID NO: 3603825 - RNA, 14 nt, Pseudomonas putida KT2440
uguggcagcucugc

SEQ ID NO: 3603826 - RNA, 15 nt, Pseudomonas putida KT2440
uguggccaauggcga

SEQ ID NO: 3603827 - RNA, 13 nt, Pseudomonas putida KT2440
uguggcgcacaga

SEQ ID NO: 3603828 - RNA, 12 nt, Pseudomonas putida KT2440
uguggcgcagca

SEQ ID NO: 3603829 - RNA, 24 nt, Pseudomonas putida KT2440
ugugggagcacaagcacgcgcuga

SEQ ID NO: 3603830 - RNA, 20 nt, Pseudomonas putida KT2440
ugugggagcaggcaugcccg

SEQ ID NO: 3603831 - RNA, 20 nt, Pseudomonas putida KT2440
ugugggagcgggcaugcccg

SEQ ID NO: 3603832 - RNA, 18 nt, Pseudomonas putida KT2440
ugugggagcgggcgugcc

SEQ ID NO: 3603833 - RNA, 14 nt, Pseudomonas putida KT2440
ugugggagcgggcu

SEQ ID NO: 3603834 - RNA, 13 nt, Pseudomonas putida KT2440
ugugggagcgggg

SEQ ID NO: 3603835 - RNA, 20 nt, Pseudomonas putida KT2440
uguguacgccgcugucaucc

SEQ ID NO: 3603836 - RNA, 14 nt, Pseudomonas putida KT2440
ugugugccugcucc

SEQ ID NO: 3603837 - RNA, 15 nt, Pseudomonas putida KT2440
ugugugccugcuccg

SEQ ID NO: 3603838 - RNA, 17 nt, Pseudomonas putida KT2440
uguguugcgguggaagc

SEQ ID NO: 3603839 - RNA, 22 nt, Pseudomonas putida KT2440
uguuaccucccgcacauuucac

SEQ ID NO: 3603840 - RNA, 20 nt, Pseudomonas putida KT2440
uguuaggcuugacgaccgac

SEQ ID NO: 3603841 - RNA, 19 nt, Pseudomonas putida KT2440
uguucaacgcaaugggcac

SEQ ID NO: 3603842 - RNA, 17 nt, Pseudomonas putida KT2440
uguucacggcggccuug

SEQ ID NO: 3603843 - RNA, 15 nt, Pseudomonas putida KT2440
uguucagcagcgaag

SEQ ID NO: 3603844 - RNA, 20 nt, Pseudomonas putida KT2440
uguucagguaggccgcagcc

SEQ ID NO: 3603845 - RNA, 22 nt, Pseudomonas putida KT2440
uguucauuccguuggccaccac

SEQ ID NO: 3603846 - RNA, 21 nt, Pseudomonas putida KT2440
uguucauugacggucagugaa

SEQ ID NO: 3603847 - RNA, 16 nt, Pseudomonas putida KT2440
uguuccaguucggaaa

SEQ ID NO: 3603848 - RNA, 17 nt, Pseudomonas putida KT2440
uguuccauuucacuggc

SEQ ID NO: 3603849 - RNA, 13 nt, Pseudomonas putida KT2440
uguuccauuuccc

SEQ ID NO: 3603850 - RNA, 20 nt, Pseudomonas putida KT2440
uguuccauuucccuacagcc

SEQ ID NO: 3603851 - RNA, 19 nt, Pseudomonas putida KT2440
uguucccucaacaagcuga

SEQ ID NO: 3603852 - RNA, 12 nt, Pseudomonas putida KT2440
uguuccgcccag

SEQ ID NO: 3603853 - RNA, 22 nt, Pseudomonas putida KT2440
uguucgauuucaccggcuucua

SEQ ID NO: 3603854 - RNA, 22 nt, Pseudomonas putida KT2440
uguucgccguuguucacgguca

SEQ ID NO: 3603855 - RNA, 17 nt, Pseudomonas putida KT2440
uguucgcgcaggaucca

SEQ ID NO: 3603856 - RNA, 15 nt, Pseudomonas putida KT2440
uguucggugcucagg

SEQ ID NO: 3603857 - RNA, 16 nt, Pseudomonas putida KT2440
uguucguaggucaggu

SEQ ID NO: 3603858 - RNA, 14 nt, Pseudomonas putida KT2440
uguucucgccgccg

SEQ ID NO: 3603859 - RNA, 17 nt, Pseudomonas putida KT2440
uguucuguuucaccagc

SEQ ID NO: 3603860 - RNA, 22 nt, Pseudomonas putida KT2440
uguugaacaugcggaagcaacc

SEQ ID NO: 3603861 - RNA, 21 nt, Pseudomonas putida KT2440
uguugaccccgggcacaugca

SEQ ID NO: 3603862 - RNA, 13 nt, Pseudomonas putida KT2440
uguugaccucugg

SEQ ID NO: 3603863 - RNA, 15 nt, Pseudomonas putida KT2440
uguugagcagcagcc

SEQ ID NO: 3603864 - RNA, 20 nt, Pseudomonas putida KT2440
uguugagcagcagcccuucg

SEQ ID NO: 3603865 - RNA, 14 nt, Pseudomonas putida KT2440
uguugcagcgccag

SEQ ID NO: 3603866 - RNA, 22 nt, Pseudomonas putida KT2440
uguugccaaugccggcacagcc

SEQ ID NO: 3603867 - RNA, 13 nt, Pseudomonas putida KT2440
uguugcccggcau

SEQ ID NO: 3603868 - RNA, 18 nt, Pseudomonas putida KT2440
uguugcgcaccuugugca

SEQ ID NO: 3603869 - RNA, 21 nt, Pseudomonas putida KT2440
uguugcgcagguacacgggca

SEQ ID NO: 3603870 - RNA, 11 nt, Pseudomonas putida KT2440
uguugcugggc

SEQ ID NO: 3603871 - RNA, 15 nt, Pseudomonas putida KT2440
uguugcuguuggcgc

SEQ ID NO: 3603872 - RNA, 15 nt, Pseudomonas putida KT2440
uguugcuugucccag

SEQ ID NO: 3603873 - RNA, 19 nt, Pseudomonas putida KT2440
uguuggaaaugaacagccg

SEQ ID NO: 3603874 - RNA, 11 nt, Pseudomonas putida KT2440
uguuggccacg

SEQ ID NO: 3603875 - RNA, 14 nt, Pseudomonas putida KT2440
uguuggcugugaga

SEQ ID NO: 3603876 - RNA, 21 nt, Pseudomonas putida KT2440
uguugggcagggugucgacga

SEQ ID NO: 3603877 - RNA, 22 nt, Pseudomonas putida KT2440
uguuggggucugcuuugcagcc

SEQ ID NO: 3603878 - RNA, 13 nt, Pseudomonas putida KT2440
uguugucugugcc

SEQ ID NO: 3603879 - RNA, 18 nt, Pseudomonas putida KT2440
uguuucagcccuugcucg

SEQ ID NO: 3603880 - RNA, 17 nt, Pseudomonas putida KT2440
uguuucagccuuggccg

SEQ ID NO: 3603881 - RNA, 11 nt, Pseudomonas putida KT2440
uguuugaagcu

SEQ ID NO: 3603882 - RNA, 11 nt, Pseudomonas putida KT2440
uguuugaccac

SEQ ID NO: 3603883 - RNA, 16 nt, Pseudomonas putida KT2440
uguuugaccaccagac

SEQ ID NO: 3603884 - RNA, 19 nt, Pseudomonas putida KT2440
uucauauccgcuuugcuug

SEQ ID NO: 3603885 - RNA, 21 nt, Pseudomonas putida KT2440
uucaucaaaagccccccugcc

SEQ ID NO: 3603886 - RNA, 16 nt, Pseudomonas putida KT2440
uucaucaccagccccc

SEQ ID NO: 3603887 - RNA, 14 nt, Pseudomonas putida KT2440
uucaucacccaguu

SEQ ID NO: 3603888 - RNA, 19 nt, Pseudomonas putida KT2440
uucauccagccggcugaug

SEQ ID NO: 3603889 - RNA, 14 nt, Pseudomonas putida KT2440
uucaucgaaggccu

SEQ ID NO: 3603890 - RNA, 22 nt, Pseudomonas putida KT2440
uucaucgauggucuucgccgcc

SEQ ID NO: 3603891 - RNA, 19 nt, Pseudomonas putida KT2440
uucaucgcgggccaggugg

SEQ ID NO: 3603892 - RNA, 19 nt, Pseudomonas putida KT2440
uucaucgcugacuuccagc

SEQ ID NO: 3603893 - RNA, 13 nt, Pseudomonas putida KT2440
uucaucugucagc

SEQ ID NO: 3603894 - RNA, 18 nt, Pseudomonas putida KT2440
uucauuaccauccaucac

SEQ ID NO: 3603895 - RNA, 16 nt, Pseudomonas putida KT2440
uucauucagcuuuggc

SEQ ID NO: 3603896 - RNA, 17 nt, Pseudomonas putida KT2440
uucauugccaacagcag

SEQ ID NO: 3603897 - RNA, 21 nt, Pseudomonas putida KT2440
uucauuuucuauuuaccuguc

SEQ ID NO: 3603898 - RNA, 14 nt, Pseudomonas putida KT2440
uuccacacccagcg

SEQ ID NO: 3603899 - RNA, 19 nt, Pseudomonas putida KT2440
uuccacagguaccaggcug

SEQ ID NO: 3603900 - RNA, 19 nt, Pseudomonas putida KT2440
uuccaccauucccugcaca

SEQ ID NO: 3603901 - RNA, 19 nt, Pseudomonas putida KT2440
uuccaccccggcagugccu

SEQ ID NO: 3603902 - RNA, 23 nt, Pseudomonas putida KT2440
uuccaccgccucgaccuggcccg

SEQ ID NO: 3603903 - RNA, 11 nt, Pseudomonas putida KT2440
uuccaccggca

SEQ ID NO: 3603904 - RNA, 16 nt, Pseudomonas putida KT2440
uuccaccggcacggca

SEQ ID NO: 3603905 - RNA, 14 nt, Pseudomonas putida KT2440
uuccaccggcuugc

SEQ ID NO: 3603906 - RNA, 14 nt, Pseudomonas putida KT2440
uuccaccuggccac

SEQ ID NO: 3603907 - RNA, 17 nt, Pseudomonas putida KT2440
uuccacgcgcaggcgcu

SEQ ID NO: 3603908 - RNA, 16 nt, Pseudomonas putida KT2440
uuccagaaucugcaca

SEQ ID NO: 3603909 - RNA, 20 nt, Pseudomonas putida KT2440
uuccagaaucugcacacugc

SEQ ID NO: 3603910 - RNA, 23 nt, Pseudomonas putida KT2440
uuccagaaucugcacacugcgcu

SEQ ID NO: 3603911 - RNA, 19 nt, Pseudomonas putida KT2440
uuccagcagcgacacugac

SEQ ID NO: 3603912 - RNA, 17 nt, Pseudomonas putida KT2440
uuccagcccuuccacca

SEQ ID NO: 3603913 - RNA, 15 nt, Pseudomonas putida KT2440
uuccagccugcagca

SEQ ID NO: 3603914 - RNA, 13 nt, Pseudomonas putida KT2440
uuccagcuccuuc

SEQ ID NO: 3603915 - RNA, 23 nt, Pseudomonas putida KT2440
uuccagcugcgccugcaauucga

SEQ ID NO: 3603916 - RNA, 18 nt, Pseudomonas putida KT2440
uuccagcugucauuaccc

SEQ ID NO: 3603917 - RNA, 23 nt, Pseudomonas putida KT2440
uuccagguagcgucgcgcgccca

SEQ ID NO: 3603918 - RNA, 15 nt, Pseudomonas putida KT2440
uuccagguggccgcc

SEQ ID NO: 3603919 - RNA, 20 nt, Pseudomonas putida KT2440
uuccagugaagcuuccaguu

SEQ ID NO: 3603920 - RNA, 19 nt, Pseudomonas putida KT2440
uuccagugccgccaccugg

SEQ ID NO: 3603921 - RNA, 16 nt, Pseudomonas putida KT2440
uuccaguuggccggca

SEQ ID NO: 3603922 - RNA, 13 nt, Pseudomonas putida KT2440
uuccauagugugc

SEQ ID NO: 3603923 - RNA, 17 nt, Pseudomonas putida KT2440
uuccauagugugcucac

SEQ ID NO: 3603924 - RNA, 12 nt, Pseudomonas putida KT2440
uuccaucaugcg

SEQ ID NO: 3603925 - RNA, 23 nt, Pseudomonas putida KT2440
uuccaugccccucaaugcugccu

SEQ ID NO: 3603926 - RNA, 16 nt, Pseudomonas putida KT2440
uuccaugcgcgcagcg

SEQ ID NO: 3603927 - RNA, 20 nt, Pseudomonas putida KT2440
uuccauuucgaagcugucuu

SEQ ID NO: 3603928 - RNA, 23 nt, Pseudomonas putida KT2440
uuccauuugcgcuggcugccgcg

SEQ ID NO: 3603929 - RNA, 14 nt, Pseudomonas putida KT2440
uucccaauccucag

SEQ ID NO: 3603930 - RNA, 12 nt, Pseudomonas putida KT2440
uucccagcaccc

SEQ ID NO: 3603931 - RNA, 15 nt, Pseudomonas putida KT2440
uuccccagcaagucc

SEQ ID NO: 3603932 - RNA, 20 nt, Pseudomonas putida KT2440
uuccccaggccgcccaccca

SEQ ID NO: 3603933 - RNA, 22 nt, Pseudomonas putida KT2440
uuccccaggccgcccacccacc

SEQ ID NO: 3603934 - RNA, 13 nt, Pseudomonas putida KT2440
uuccccgaccaaa

SEQ ID NO: 3603935 - RNA, 19 nt, Pseudomonas putida KT2440
uuccccgcccaagcggcag

SEQ ID NO: 3603936 - RNA, 20 nt, Pseudomonas putida KT2440
uuccccgcccaagcggcaga

SEQ ID NO: 3603937 - RNA, 14 nt, Pseudomonas putida KT2440
uuccccggucagca

SEQ ID NO: 3603938 - RNA, 12 nt, Pseudomonas putida KT2440
uuccccuuggcg

SEQ ID NO: 3603939 - RNA, 15 nt, Pseudomonas putida KT2440
uucccgcgcaaaugc

SEQ ID NO: 3603940 - RNA, 20 nt, Pseudomonas putida KT2440
uucccgggaaaagccugcca

SEQ ID NO: 3603941 - RNA, 14 nt, Pseudomonas putida KT2440
uucccucugccugc

SEQ ID NO: 3603942 - RNA, 15 nt, Pseudomonas putida KT2440
uucccucugccugcc

SEQ ID NO: 3603943 - RNA, 15 nt, Pseudomonas putida KT2440
uuccgcguccuugac

SEQ ID NO: 3603944 - RNA, 16 nt, Pseudomonas putida KT2440
uuccgcguccuugacg

SEQ ID NO: 3603945 - RNA, 17 nt, Pseudomonas putida KT2440
uuccggauugucaugcg

SEQ ID NO: 3603946 - RNA, 22 nt, Pseudomonas putida KT2440
uuccggcagggugaaguugauc

SEQ ID NO: 3603947 - RNA, 21 nt, Pseudomonas putida KT2440
uuccggccucuucgcgggcaa

SEQ ID NO: 3603948 - RNA, 16 nt, Pseudomonas putida KT2440
uuccggguccagugcc

SEQ ID NO: 3603949 - RNA, 16 nt, Pseudomonas putida KT2440
uuccgugcaaccgcuc

SEQ ID NO: 3603950 - RNA, 23 nt, Pseudomonas putida KT2440
uuccuacagaaacgagcaagccu

SEQ ID NO: 3603951 - RNA, 15 nt, Pseudomonas putida KT2440
uuccucgacccagcc

SEQ ID NO: 3603952 - RNA, 14 nt, Pseudomonas putida KT2440
uuccugaagugaau

SEQ ID NO: 3603953 - RNA, 15 nt, Pseudomonas putida KT2440
uuccugagcggugaa

SEQ ID NO: 3603954 - RNA, 16 nt, Pseudomonas putida KT2440
uuccugagcggugaaa

SEQ ID NO: 3603955 - RNA, 14 nt, Pseudomonas putida KT2440
uuccugcaccuugu

SEQ ID NO: 3603956 - RNA, 22 nt, Pseudomonas putida KT2440
uuccuggaugacgauaugcccg

SEQ ID NO: 3603957 - RNA, 18 nt, Pseudomonas putida KT2440
uuccuggccuuccuugcc

SEQ ID NO: 3603958 - RNA, 23 nt, Pseudomonas putida KT2440
uuccuggcggaacgacagcuugu

SEQ ID NO: 3603959 - RNA, 14 nt, Pseudomonas putida KT2440
uuccuggcuggcag

SEQ ID NO: 3603960 - RNA, 17 nt, Pseudomonas putida KT2440
uuccugggaagcugcag

SEQ ID NO: 3603961 - RNA, 19 nt, Pseudomonas putida KT2440
uuccugggaagcugcagca

SEQ ID NO: 3603962 - RNA, 22 nt, Pseudomonas putida KT2440
uuccugggaagcugcagcagcu

SEQ ID NO: 3603963 - RNA, 19 nt, Pseudomonas putida KT2440
uuccugggcuucaugcugc

SEQ ID NO: 3603964 - RNA, 19 nt, Pseudomonas putida KT2440
uuccugugccgcuuuggca

SEQ ID NO: 3603965 - RNA, 23 nt, Pseudomonas putida KT2440
uuccugugccgcuuuggcagcag

SEQ ID NO: 3603966 - RNA, 23 nt, Pseudomonas putida KT2440
uuccuucuugugcacaaagccca

SEQ ID NO: 3603967 - RNA, 15 nt, Pseudomonas putida KT2440
uuccuugcagcgccg

SEQ ID NO: 3603968 - RNA, 13 nt, Pseudomonas putida KT2440
uuccuugcagcuc

SEQ ID NO: 3603969 - RNA, 21 nt, Pseudomonas putida KT2440
uuccuugcccagccaacccuc

SEQ ID NO: 3603970 - RNA, 22 nt, Pseudomonas putida KT2440
uuccuuguaggccauuucccaa

SEQ ID NO: 3603971 - RNA, 21 nt, Pseudomonas putida KT2440
uuccuugucagucucuuucaa

SEQ ID NO: 3603972 - RNA, 16 nt, Pseudomonas putida KT2440
uucgaaaaccugcuga

SEQ ID NO: 3603973 - RNA, 21 nt, Pseudomonas putida KT2440
uucgaaaacgauaucgacuuc

SEQ ID NO: 3603974 - RNA, 15 nt, Pseudomonas putida KT2440
uucgaacacccgcuu

SEQ ID NO: 3603975 - RNA, 14 nt, Pseudomonas putida KT2440
uucgaagugccacg

SEQ ID NO: 3603976 - RNA, 18 nt, Pseudomonas putida KT2440
uucgaaucgcucaugccc

SEQ ID NO: 3603977 - RNA, 19 nt, Pseudomonas putida KT2440
uucgaccaaggcuuccgcc

SEQ ID NO: 3603978 - RNA, 13 nt, Pseudomonas putida KT2440
uucgaccugcgug

SEQ ID NO: 3603979 - RNA, 20 nt, Pseudomonas putida KT2440
uucgacgaucgacuucauca

SEQ ID NO: 3603980 - RNA, 15 nt, Pseudomonas putida KT2440
uucgacgcucaaguc

SEQ ID NO: 3603981 - RNA, 20 nt, Pseudomonas putida KT2440
uucgacgcugcugucgguca

SEQ ID NO: 3603982 - RNA, 21 nt, Pseudomonas putida KT2440
uucgacgcugcugucggucag

SEQ ID NO: 3603983 - RNA, 17 nt, Pseudomonas putida KT2440
uucgacucccgcugccu

SEQ ID NO: 3603984 - RNA, 15 nt, Pseudomonas putida KT2440
uucgagacuuuagcu

SEQ ID NO: 3603985 - RNA, 18 nt, Pseudomonas putida KT2440
uucgaguuuggccagccg

SEQ ID NO: 3603986 - RNA, 18 nt, Pseudomonas putida KT2440
uucgaucagccgugacag

SEQ ID NO: 3603987 - RNA, 20 nt, Pseudomonas putida KT2440
uucgauccacuugucccggc

SEQ ID NO: 3603988 - RNA, 18 nt, Pseudomonas putida KT2440
uucgauccgcgccaucag

SEQ ID NO: 3603989 - RNA, 18 nt, Pseudomonas putida KT2440
uugaacagguugcugccg

SEQ ID NO: 3603990 - RNA, 16 nt, Pseudomonas putida KT2440
uugaacgagccagcca

SEQ ID NO: 3603991 - RNA, 14 nt, Pseudomonas putida KT2440
uugaagaacagugu

SEQ ID NO: 3603992 - RNA, 16 nt, Pseudomonas putida KT2440
uugaagaccgccauga

SEQ ID NO: 3603993 - RNA, 22 nt, Pseudomonas putida KT2440
uugaagcaccagguuugcugcc

SEQ ID NO: 3603994 - RNA, 23 nt, Pseudomonas putida KT2440
uugaagcaccagguuugcugccu

SEQ ID NO: 3603995 - RNA, 11 nt, Pseudomonas putida KT2440
uugaagcgccg

SEQ ID NO: 3603996 - RNA, 23 nt, Pseudomonas putida KT2440
uugaagcgcggcaugcccgcccc

SEQ ID NO: 3603997 - RNA, 15 nt, Pseudomonas putida KT2440
uugaauaaagaaagu

SEQ ID NO: 3603998 - RNA, 17 nt, Pseudomonas putida KT2440
uugaaucagccuuugcc

SEQ ID NO: 3603999 - RNA, 16 nt, Pseudomonas putida KT2440
uugaaugccgccaucc

SEQ ID NO: 3604000 - RNA, 18 nt, Pseudomonas putida KT2440
uugacacccucuugaauc

SEQ ID NO: 3604001 - RNA, 19 nt, Pseudomonas putida KT2440
uugacacccucuugaaucc

SEQ ID NO: 3604002 - RNA, 21 nt, Pseudomonas putida KT2440
uugaccaccagacgggcaugg

SEQ ID NO: 3604003 - RNA, 13 nt, Pseudomonas putida KT2440
uugaccagcaacg

SEQ ID NO: 3604004 - RNA, 17 nt, Pseudomonas putida KT2440
uugaccagcaccagcga

SEQ ID NO: 3604005 - RNA, 12 nt, Pseudomonas putida KT2440
uugaccaggcag

SEQ ID NO: 3604006 - RNA, 19 nt, Pseudomonas putida KT2440
uugaccaggcaguccugca

SEQ ID NO: 3604007 - RNA, 14 nt, Pseudomonas putida KT2440
uugacccccuucgg

SEQ ID NO: 3604008 - RNA, 11 nt, Pseudomonas putida KT2440
uugacccgcuu

SEQ ID NO: 3604009 - RNA, 19 nt, Pseudomonas putida KT2440
uugaccggggcugcuuugc

SEQ ID NO: 3604010 - RNA, 13 nt, Pseudomonas putida KT2440
uugaccguccaca

SEQ ID NO: 3604011 - RNA, 16 nt, Pseudomonas putida KT2440
uugaccguccacaccg

SEQ ID NO: 3604012 - RNA, 19 nt, Pseudomonas putida KT2440
uugaccgugaucaucagcg

SEQ ID NO: 3604013 - RNA, 19 nt, Pseudomonas putida KT2440
uugacgaucgccagcccca

SEQ ID NO: 3604014 - RNA, 22 nt, Pseudomonas putida KT2440
uugacgaucuucugcacgcccg

SEQ ID NO: 3604015 - RNA, 21 nt, Pseudomonas putida KT2440
uugacgggugaccaggcccag

SEQ ID NO: 3604016 - RNA, 17 nt, Pseudomonas putida KT2440
uugacggugaauuccuu

SEQ ID NO: 3604017 - RNA, 16 nt, Pseudomonas putida KT2440
uugacguuguagcggc

SEQ ID NO: 3604018 - RNA, 23 nt, Pseudomonas putida KT2440
uugagaugaugguugacagcgcu

SEQ ID NO: 3604019 - RNA, 12 nt, Pseudomonas putida KT2440
uugagcaccccc

SEQ ID NO: 3604020 - RNA, 19 nt, Pseudomonas putida KT2440
uugagcacgaaacugcgcu

SEQ ID NO: 3604021 - RNA, 20 nt, Pseudomonas putida KT2440
uugagcaggucgaacagccc

SEQ ID NO: 3604022 - RNA, 17 nt, Pseudomonas putida KT2440
uugagcaguucgguaau

SEQ ID NO: 3604023 - RNA, 16 nt, Pseudomonas putida KT2440
uugagccgccaacccg

SEQ ID NO: 3604024 - RNA, 21 nt, Pseudomonas putida KT2440
uugagcgcagcgacgaccugc

SEQ ID NO: 3604025 - RNA, 21 nt, Pseudomonas putida KT2440
uugaggcugaucaggaacacu

SEQ ID NO: 3604026 - RNA, 17 nt, Pseudomonas putida KT2440
uugaggguggcaaugcu

SEQ ID NO: 3604027 - RNA, 17 nt, Pseudomonas putida KT2440
uugagguccgccucgau

SEQ ID NO: 3604028 - RNA, 20 nt, Pseudomonas putida KT2440
uugauaccugcuugcugacu

SEQ ID NO: 3604029 - RNA, 12 nt, Pseudomonas putida KT2440
uugaucaacccg

SEQ ID NO: 3604030 - RNA, 11 nt, Pseudomonas putida KT2440
uugaucagccu

SEQ ID NO: 3604031 - RNA, 16 nt, Pseudomonas putida KT2440
uugaucaggaaggcgu

SEQ ID NO: 3604032 - RNA, 17 nt, Pseudomonas putida KT2440
uugaucagguaccccuc

SEQ ID NO: 3604033 - RNA, 23 nt, Pseudomonas putida KT2440
uugaucaugcccauggccagcgu

SEQ ID NO: 3604034 - RNA, 17 nt, Pseudomonas putida KT2440
uugaucgcuugucucca

SEQ ID NO: 3604035 - RNA, 20 nt, Pseudomonas putida KT2440
uugaucuugcgccccagcag

SEQ ID NO: 3604036 - RNA, 19 nt, Pseudomonas putida KT2440
uugaugacuuuggcgucgg

SEQ ID NO: 3604037 - RNA, 19 nt, Pseudomonas putida KT2440
uugauggucuuguggcuca

SEQ ID NO: 3604038 - RNA, 17 nt, Pseudomonas putida KT2440
uugauguacuccugcac

SEQ ID NO: 3604039 - RNA, 15 nt, Pseudomonas putida KT2440
uugaugugcaggucg

SEQ ID NO: 3604040 - RNA, 15 nt, Pseudomonas putida KT2440
uugcaaccaggcgcc

SEQ ID NO: 3604041 - RNA, 15 nt, Pseudomonas putida KT2440
uugcacuuugccgcc

SEQ ID NO: 3604042 - RNA, 20 nt, Pseudomonas putida KT2440
uugcagcccauucgcgggca

SEQ ID NO: 3604043 - RNA, 12 nt, Pseudomonas putida KT2440
uugcagccccug

SEQ ID NO: 3604044 - RNA, 13 nt, Pseudomonas putida KT2440
uugcagcccuucg

SEQ ID NO: 3604045 - RNA, 21 nt, Pseudomonas putida KT2440
uugcagcgccgcauccagcac

SEQ ID NO: 3604046 - RNA, 23 nt, Pseudomonas putida KT2440
uugcagcgccgcauccagcacug

SEQ ID NO: 3604047 - RNA, 12 nt, Pseudomonas putida KT2440
uugcagcggguu

SEQ ID NO: 3604048 - RNA, 17 nt, Pseudomonas putida KT2440
uugcagcucacccuucu

SEQ ID NO: 3604049 - RNA, 18 nt, Pseudomonas putida KT2440
uugcaggccagcgucgug

SEQ ID NO: 3604050 - RNA, 14 nt, Pseudomonas putida KT2440
uugcaggcgagcug

SEQ ID NO: 3604051 - RNA, 16 nt, Pseudomonas putida KT2440
uugcagucaccuggcc

SEQ ID NO: 3604052 - RNA, 17 nt, Pseudomonas putida KT2440
uugcaguccuuucgcga

SEQ ID NO: 3604053 - RNA, 21 nt, Pseudomonas putida KT2440
uugccaacagcaguugcugcu

SEQ ID NO: 3604054 - RNA, 22 nt, Pseudomonas putida KT2440
uugccaacagcaguugcugcug

SEQ ID NO: 3604055 - RNA, 21 nt, Pseudomonas putida KT2440
uugccaagcacggcgccgacc

SEQ ID NO: 3604056 - RNA, 21 nt, Pseudomonas putida KT2440
uugccaccacccggggcagca

SEQ ID NO: 3604057 - RNA, 22 nt, Pseudomonas putida KT2440
uugccaccacccggggcagcau

SEQ ID NO: 3604058 - RNA, 12 nt, Pseudomonas putida KT2440
uugccaccagca

SEQ ID NO: 3604059 - RNA, 13 nt, Pseudomonas putida KT2440
uugccaccagugc

SEQ ID NO: 3604060 - RNA, 22 nt, Pseudomonas putida KT2440
uugccaccaucgaccuggcccg

SEQ ID NO: 3604061 - RNA, 17 nt, Pseudomonas putida KT2440
uugccacggcguggagc

SEQ ID NO: 3604062 - RNA, 13 nt, Pseudomonas putida KT2440
uugccagccgccc

SEQ ID NO: 3604063 - RNA, 12 nt, Pseudomonas putida KT2440
uugccagcgucu

SEQ ID NO: 3604064 - RNA, 17 nt, Pseudomonas putida KT2440
uugccagcguguuccau

SEQ ID NO: 3604065 - RNA, 12 nt, Pseudomonas putida KT2440
uugccaggcgca

SEQ ID NO: 3604066 - RNA, 16 nt, Pseudomonas putida KT2440
uugccagggugccaga

SEQ ID NO: 3604067 - RNA, 20 nt, Pseudomonas putida KT2440
uugccauucucgccgccgcu

SEQ ID NO: 3604068 - RNA, 16 nt, Pseudomonas putida KT2440
uugccauucuugucca

SEQ ID NO: 3604069 - RNA, 17 nt, Pseudomonas putida KT2440
uugcccaagcgcuccgc

SEQ ID NO: 3604070 - RNA, 19 nt, Pseudomonas putida KT2440
uugcccagcuccagcaccu

SEQ ID NO: 3604071 - RNA, 17 nt, Pseudomonas putida KT2440
uugcccgacaccucaau

SEQ ID NO: 3604072 - RNA, 20 nt, Pseudomonas putida KT2440
uugcccgagcgcuuaaauca

SEQ ID NO: 3604073 - RNA, 20 nt, Pseudomonas putida KT2440
uugcccgcgaacacgggcga

SEQ ID NO: 3604074 - RNA, 18 nt, Pseudomonas putida KT2440
uugcccgcgaagcagcca

SEQ ID NO: 3604075 - RNA, 12 nt, Pseudomonas putida KT2440
uugcccgcugca

SEQ ID NO: 3604076 - RNA, 20 nt, Pseudomonas putida KT2440
uugcccggcaugaucagcuu

SEQ ID NO: 3604077 - RNA, 15 nt, Pseudomonas putida KT2440
uugcccuccuaucgc

SEQ ID NO: 3604078 - RNA, 17 nt, Pseudomonas putida KT2440
uugcccucgcaugcggc

SEQ ID NO: 3604079 - RNA, 21 nt, Pseudomonas putida KT2440
uugccgaucagguugcccagc

SEQ ID NO: 3604080 - RNA, 22 nt, Pseudomonas putida KT2440
uugccgaucagguugcccagca

SEQ ID NO: 3604081 - RNA, 15 nt, Pseudomonas putida KT2440
uugccgccagccccg

SEQ ID NO: 3604082 - RNA, 20 nt, Pseudomonas putida KT2440
uugccgcgcccgcaaccucg

SEQ ID NO: 3604083 - RNA, 21 nt, Pseudomonas putida KT2440
uugccggggcugcuuugcagc

SEQ ID NO: 3604084 - RNA, 22 nt, Pseudomonas putida KT2440
uugccggucacuggcgacagcc

SEQ ID NO: 3604085 - RNA, 15 nt, Pseudomonas putida KT2440
uugccggucgggcaa

SEQ ID NO: 3604086 - RNA, 19 nt, Pseudomonas putida KT2440
uugccgguguucgcgggca

SEQ ID NO: 3604087 - RNA, 15 nt, Pseudomonas putida KT2440
uugccucaggcccca

SEQ ID NO: 3604088 - RNA, 20 nt, Pseudomonas putida KT2440
uugccucaggugcacagggc

SEQ ID NO: 3604089 - RNA, 17 nt, Pseudomonas putida KT2440
uugccugcaaucagcuc

SEQ ID NO: 3604090 - RNA, 15 nt, Pseudomonas putida KT2440
uugccugccagaauc

SEQ ID NO: 3604091 - RNA, 19 nt, Pseudomonas putida KT2440
uugccuggcuuuccagguc

SEQ ID NO: 3604092 - RNA, 20 nt, Pseudomonas putida KT2440
uugccuggcuuuccaggucc

SEQ ID NO: 3604093 - RNA, 16 nt, Pseudomonas putida KT2440
uugccugggcgagcca

SEQ ID NO: 3604094 - RNA, 19 nt, Pseudomonas putida KT2440
uugggggugaagcccugcu

SEQ ID NO: 3604095 - RNA, 18 nt, Pseudomonas putida KT2440
uugguaccgucgaucagc

SEQ ID NO: 3604096 - RNA, 16 nt, Pseudomonas putida KT2440
uuggucagcaucaccg

SEQ ID NO: 3604097 - RNA, 13 nt, Pseudomonas putida KT2440
uuggucaggauca

SEQ ID NO: 3604098 - RNA, 17 nt, Pseudomonas putida KT2440
uuggucaggaucaccca

SEQ ID NO: 3604099 - RNA, 15 nt, Pseudomonas putida KT2440
uuggugaaagcgcaa

SEQ ID NO: 3604100 - RNA, 18 nt, Pseudomonas putida KT2440
uuggugaugcuggcuuca

SEQ ID NO: 3604101 - RNA, 18 nt, Pseudomonas putida KT2440
uuggugccaaccuugacc

SEQ ID NO: 3604102 - RNA, 18 nt, Pseudomonas putida KT2440
uuggugcgccuccagcag

SEQ ID NO: 3604103 - RNA, 11 nt, Pseudomonas putida KT2440
uugguguccuu

SEQ ID NO: 3604104 - RNA, 16 nt, Pseudomonas putida KT2440
uugguuugacgcugcu

SEQ ID NO: 3604105 - RNA, 13 nt, Pseudomonas putida KT2440
uugguuuuuucac

SEQ ID NO: 3604106 - RNA, 20 nt, Pseudomonas putida KT2440
uuguaccugugguggcugcu

SEQ ID NO: 3604107 - RNA, 17 nt, Pseudomonas putida KT2440
uuguagcccaccaccuu

SEQ ID NO: 3604108 - RNA, 23 nt, Pseudomonas putida KT2440
uuguagcucagguagaccugcgu

SEQ ID NO: 3604109 - RNA, 13 nt, Pseudomonas putida KT2440
uugucagccuuca

SEQ ID NO: 3604110 - RNA, 15 nt, Pseudomonas putida KT2440
uugucaguucugcuc

SEQ ID NO: 3604111 - RNA, 19 nt, Pseudomonas putida KT2440
uugucaguucugcucagcu

SEQ ID NO: 3604112 - RNA, 22 nt, Pseudomonas putida KT2440
uugucaguucugcucagcuacg

SEQ ID NO: 3604113 - RNA, 16 nt, Pseudomonas putida KT2440
uugucaugccuuggcu

SEQ ID NO: 3604114 - RNA, 18 nt, Pseudomonas putida KT2440
uugucaugccuuggcuac

SEQ ID NO: 3604115 - RNA, 16 nt, Pseudomonas putida KT2440
uuguccaccugacgcg

SEQ ID NO: 3604116 - RNA, 19 nt, Pseudomonas putida KT2440
uuguccacgcuuacaggua

SEQ ID NO: 3604117 - RNA, 13 nt, Pseudomonas putida KT2440
uuguccagcagca

SEQ ID NO: 3604118 - RNA, 14 nt, Pseudomonas putida KT2440
uuguccagcagcag

SEQ ID NO: 3604119 - RNA, 16 nt, Pseudomonas putida KT2440
uuguccagcagcagcg

SEQ ID NO: 3604120 - RNA, 12 nt, Pseudomonas putida KT2440
uugucccaggcc

SEQ ID NO: 3604121 - RNA, 19 nt, Pseudomonas putida KT2440
uuguccgacagcuugccca

SEQ ID NO: 3604122 - RNA, 23 nt, Pseudomonas putida KT2440
uuguccgccaagauccgcggcau

SEQ ID NO: 3604123 - RNA, 11 nt, Pseudomonas putida KT2440
uugucgaccug

SEQ ID NO: 3604124 - RNA, 21 nt, Pseudomonas putida KT2440
uugucgaccuggcucuucaac

SEQ ID NO: 3604125 - RNA, 17 nt, Pseudomonas putida KT2440
uugucgcccgcccagcc

SEQ ID NO: 3604126 - RNA, 22 nt, Pseudomonas putida KT2440
uugucggcgcgcggcucggcca

SEQ ID NO: 3604127 - RNA, 14 nt, Pseudomonas putida KT2440
uugucggucaggua

SEQ ID NO: 3604128 - RNA, 22 nt, Pseudomonas putida KT2440
uugucggucucgaaccacagca

SEQ ID NO: 3604129 - RNA, 17 nt, Pseudomonas putida KT2440
uugucuccgaacgccuu

SEQ ID NO: 3604130 - RNA, 13 nt, Pseudomonas putida KT2440
uugucugacagca

SEQ ID NO: 3604131 - RNA, 20 nt, Pseudomonas putida KT2440
uugucuuccaguuccaucca

SEQ ID NO: 3604132 - RNA, 21 nt, Pseudomonas putida KT2440
uugugaaacaccacacuagcc

SEQ ID NO: 3604133 - RNA, 20 nt, Pseudomonas putida KT2440
uugugcaacugguucuccag

SEQ ID NO: 3604134 - RNA, 17 nt, Pseudomonas putida KT2440
uugugcagcacuucgau

SEQ ID NO: 3604135 - RNA, 20 nt, Pseudomonas putida KT2440
uugugcaguucgcacagcuc

SEQ ID NO: 3604136 - RNA, 23 nt, Pseudomonas putida KT2440
uugugcaguucgcacagcucgau

SEQ ID NO: 3604137 - RNA, 16 nt, Pseudomonas putida KT2440
uugugcauccugcacu

SEQ ID NO: 3604138 - RNA, 18 nt, Pseudomonas putida KT2440
uugugcucaucggcggcu

SEQ ID NO: 3604139 - RNA, 14 nt, Pseudomonas putida KT2440
uuguggcuuggccc

SEQ ID NO: 3604140 - RNA, 11 nt, Pseudomonas putida KT2440
uugugggagcg

SEQ ID NO: 3604141 - RNA, 14 nt, Pseudomonas putida KT2440
uuguguugcgaugg

SEQ ID NO: 3604142 - RNA, 22 nt, Pseudomonas putida KT2440
uuguuccagccgcgccacuccc

SEQ ID NO: 3604143 - RNA, 17 nt, Pseudomonas putida KT2440
uuguuccgccgcuuugu

SEQ ID NO: 3604144 - RNA, 18 nt, Pseudomonas putida KT2440
uuguucggcaucggugcu

SEQ ID NO: 3604145 - RNA, 14 nt, Pseudomonas putida KT2440
uuguucgucgagca

SEQ ID NO: 3604146 - RNA, 17 nt, Pseudomonas putida KT2440
uuguucgucgagcacca

SEQ ID NO: 3604147 - RNA, 14 nt, Pseudomonas putida KT2440
uuguucuggccacc

SEQ ID NO: 3604148 - RNA, 17 nt, Pseudomonas putida KT2440
uuguugcaaccaggcgc

SEQ ID NO: 3604149 - RNA, 13 nt, Pseudomonas putida KT2440
uuguugccagcgg

SEQ ID NO: 3604150 - RNA, 20 nt, Pseudomonas putida KT2440
uuguugguguggcagcucug

SEQ ID NO: 3604151 - RNA, 16 nt, Pseudomonas putida KT2440
uuguuuggcuuugccg

SEQ ID NO: 3604152 - RNA, 11 nt, Pseudomonas putida KT2440
uuuaaaccuuc

SEQ ID NO: 3604153 - RNA, 18 nt, Pseudomonas putida KT2440
uuuacccgcgaagaagcc

SEQ ID NO: 3604154 - RNA, 18 nt, Pseudomonas putida KT2440
uuuacuggccauccaguc

SEQ ID NO: 3604155 - RNA, 12 nt, Pseudomonas putida KT2440
uuuagcaggcaa

SEQ ID NO: 3604156 - RNA, 12 nt, Pseudomonas putida KT2440
uuuagcaggcac

SEQ ID NO: 3604157 - RNA, 18 nt, Pseudomonas putida KT2440
uuuaggcacgaucccguu

SEQ ID NO: 3604158 - RNA, 20 nt, Pseudomonas putida KT2440
uuuaugccgcguuccuuucu

SEQ ID NO: 3604159 - RNA, 12 nt, Pseudomonas putida KT2440
uuucaaaugucc

SEQ ID NO: 3604160 - RNA, 15 nt, Pseudomonas putida KT2440
uuucaagcuuuguau

SEQ ID NO: 3604161 - RNA, 22 nt, Pseudomonas putida KT2440
uuucacacgccacuaagaagca

SEQ ID NO: 3604162 - RNA, 17 nt, Pseudomonas putida KT2440
uuucacacucgccagga

SEQ ID NO: 3604163 - RNA, 23 nt, Pseudomonas putida KT2440
uuucacgcuacgggauugccguc

SEQ ID NO: 3604164 - RNA, 16 nt, Pseudomonas putida KT2440
uuucacuuucuugaaa

SEQ ID NO: 3604165 - RNA, 20 nt, Pseudomonas putida KT2440
uuucagcccuugcucggcca

SEQ ID NO: 3604166 - RNA, 15 nt, Pseudomonas putida KT2440
uuucaggcgcagcac

SEQ ID NO: 3604167 - RNA, 16 nt, Pseudomonas putida KT2440
uuucagggguugcccc

SEQ ID NO: 3604168 - RNA, 21 nt, Pseudomonas putida KT2440
uuucagguuucgggcaacuug

SEQ ID NO: 3604169 - RNA, 11 nt, Pseudomonas putida KT2440
uuuccacgccu

SEQ ID NO: 3604170 - RNA, 18 nt, Pseudomonas putida KT2440
uuuccagauacaggcugu

SEQ ID NO: 3604171 - RNA, 19 nt, Pseudomonas putida KT2440
uuuccagcaaagucuucag

SEQ ID NO: 3604172 - RNA, 13 nt, Pseudomonas putida KT2440
uuuccagcccguc

SEQ ID NO: 3604173 - RNA, 21 nt, Pseudomonas putida KT2440
uuuccagcccuuccaccacau

SEQ ID NO: 3604174 - RNA, 17 nt, Pseudomonas putida KT2440
uuuccagcucggccuug

SEQ ID NO: 3604175 - RNA, 21 nt, Pseudomonas putida KT2440
uuuccaggcguaaacccaggu

SEQ ID NO: 3604176 - RNA, 19 nt, Pseudomonas putida KT2440
uuucccacauguaaugaaa

SEQ ID NO: 3604177 - RNA, 22 nt, Pseudomonas putida KT2440
uuucccacauguaaugaaaauc

SEQ ID NO: 3604178 - RNA, 23 nt, Pseudomonas putida KT2440
uuuccggguugcacgagauguac

SEQ ID NO: 3604179 - RNA, 17 nt, Pseudomonas putida KT2440
uuucgaucaucgccacc

SEQ ID NO: 3604180 - RNA, 17 nt, Pseudomonas putida KT2440
uuucgaucgagccacug

SEQ ID NO: 3604181 - RNA, 19 nt, Pseudomonas putida KT2440
uuucgccacccucgcacca

SEQ ID NO: 3604182 - RNA, 20 nt, Pseudomonas putida KT2440
uuucgcggcccagcccagua

SEQ ID NO: 3604183 - RNA, 20 nt, Pseudomonas putida KT2440
uuucgcgggcacgcccgcuc

SEQ ID NO: 3604184 - RNA, 19 nt, Pseudomonas putida KT2440
uuucgcgggcgugcccgcg

SEQ ID NO: 3604185 - RNA, 20 nt, Pseudomonas putida KT2440
uuucgcggguaaacccccuc

SEQ ID NO: 3604186 - RNA, 19 nt, Pseudomonas putida KT2440
uuucgcggguaaacccgcu

SEQ ID NO: 3604187 - RNA, 20 nt, Pseudomonas putida KT2440
uuucgcgggugaacccgcuc

SEQ ID NO: 3604188 - RNA, 18 nt, Pseudomonas putida KT2440
uuucgcuaaguuugccca

SEQ ID NO: 3604189 - RNA, 17 nt, Pseudomonas putida KT2440
uuucgcuggccugcccc

SEQ ID NO: 3604190 - RNA, 17 nt, Pseudomonas putida KT2440
uuucggcagcacccgcu

SEQ ID NO: 3604191 - RNA, 16 nt, Pseudomonas putida KT2440
uuucggcggccugcag

SEQ ID NO: 3604192 - RNA, 13 nt, Pseudomonas putida KT2440
uuucggugcgcug

SEQ ID NO: 3604193 - RNA, 14 nt, Pseudomonas putida KT2440
uuucguuggccagc

SEQ ID NO: 3604194 - RNA, 23 nt, Pseudomonas putida KT2440
uuucuaguacuuuuucagguuua

SEQ ID NO: 3604195 - RNA, 23 nt, Pseudomonas putida KT2440
uuucuucaggugccguuccggca

SEQ ID NO: 3604196 - RNA, 13 nt, Pseudomonas putida KT2440
uuucuucaucccu

SEQ ID NO: 3604197 - RNA, 19 nt, Pseudomonas putida KT2440
uuucuugaggcacaaaaaa

SEQ ID NO: 3604198 - RNA, 13 nt, Pseudomonas putida KT2440
uuugaacaccuua

SEQ ID NO: 3604199 - RNA, 20 nt, Salmonella enterica enterica serovar Typhi
aaaaauagcauuaagcugau

SEQ ID NO: 3604200 - RNA, 13 nt, Salmonella enterica enterica serovar Typhi
aaaaauaggcuuu

SEQ ID NO: 3604201 - RNA, 18 nt, Salmonella enterica enterica serovar Typhi
aaaaauaucauuaaauca

SEQ ID NO: 3604202 - RNA, 22 nt, Salmonella enterica enterica serovar Typhi
aaaaauauggucgaaaauaucg

SEQ ID NO: 3604203 - RNA, 13 nt, Salmonella enterica enterica serovar Typhi
aaaaaucagcauu

SEQ ID NO: 3604204 - RNA, 11 nt, Salmonella enterica enterica serovar Typhi
aaaaaucagcc

SEQ ID NO: 3604205 - RNA, 15 nt, Salmonella enterica enterica serovar Typhi
aaaaaugauguguuu

SEQ ID NO: 3604206 - RNA, 22 nt, Salmonella enterica enterica serovar Typhi
aaaaaugauguguuucagcagc

SEQ ID NO: 3604207 - RNA, 16 nt, Salmonella enterica enterica serovar Typhi
aaaaauggaccagcca

SEQ ID NO: 3604208 - RNA, 22 nt, Salmonella enterica enterica serovar Typhi
aaaaauggguaugcgacugaaa

SEQ ID NO: 3604209 - RNA, 12 nt, Salmonella enterica enterica serovar Typhi
aaaaauuaaaaa

SEQ ID NO: 3604210 - RNA, 13 nt, Salmonella enterica enterica serovar Typhi
aaaaauucuuuua

SEQ ID NO: 3604211 - RNA, 12 nt, Salmonella enterica enterica serovar Typhi
aaaaauuucgaa

SEQ ID NO: 3604212 - RNA, 17 nt, Salmonella enterica enterica serovar Typhi
aaaaauuucgcuaagau

SEQ ID NO: 3604213 - RNA, 14 nt, Salmonella enterica enterica serovar Typhi
aaaacaagcaguau

SEQ ID NO: 3604214 - RNA, 22 nt, Salmonella enterica enterica serovar Typhi
aaaacagaaccccaucgccuga

SEQ ID NO: 3604215 - RNA, 13 nt, Salmonella enterica enterica serovar Typhi
aaaacagcauaau

SEQ ID NO: 3604216 - RNA, 19 nt, Salmonella enterica enterica serovar Typhi
aaaacagcaugguguuagu

SEQ ID NO: 3604217 - RNA, 13 nt, Salmonella enterica enterica serovar Typhi
aaaacagccgcca

SEQ ID NO: 3604218 - RNA, 19 nt, Salmonella enterica enterica serovar Typhi
aaaacagugauuacaaaau

SEQ ID NO: 3604219 - RNA, 20 nt, Salmonella enterica enterica serovar Typhi
aaaacaguuuugucaucaga

SEQ ID NO: 3604220 - RNA, 23 nt, Salmonella enterica enterica serovar Typhi
aaaaccaccuacgccguuccagc

SEQ ID NO: 3604221 - RNA, 21 nt, Salmonella enterica enterica serovar Typhi
aaaaccauagcccguacgauc

SEQ ID NO: 3604222 - RNA, 16 nt, Salmonella enterica enterica serovar Typhi
aaaaccccaucccggc

SEQ ID NO: 3604223 - RNA, 18 nt, Salmonella enterica enterica serovar Typhi
aaaacccguuaaauacca

SEQ ID NO: 3604224 - RNA, 16 nt, Salmonella enterica enterica serovar Typhi
aaaaccgacagcaaua

SEQ ID NO: 3604225 - RNA, 21 nt, Salmonella enterica enterica serovar Typhi
aaaaccgacgaaagauaaaaa

SEQ ID NO: 3604226 - RNA, 15 nt, Salmonella enterica enterica serovar Typhi
aaaaccgaucuccca

SEQ ID NO: 3604227 - RNA, 21 nt, Salmonella enterica enterica serovar Typhi
aaaaccggaauuuguugguuu

SEQ ID NO: 3604228 - RNA, 23 nt, Salmonella enterica enterica serovar Typhi
aaaaccggcauacacgccgggca

SEQ ID NO: 3604229 - RNA, 14 nt, Salmonella enterica enterica serovar Typhi
aaaaccggcccagc

SEQ ID NO: 3604230 - RNA, 22 nt, Salmonella enterica enterica serovar Typhi
aaaaccguccacauccagcgcc

SEQ ID NO: 3604231 - RNA, 18 nt, Salmonella enterica enterica serovar Typhi
aaaaccgucggcaauaca

SEQ ID NO: 3604232 - RNA, 14 nt, Salmonella enterica enterica serovar Typhi
aaaaccuccggcua

SEQ ID NO: 3604233 - RNA, 18 nt, Salmonella enterica enterica serovar Typhi
aaaaccuccggcuaugcc

SEQ ID NO: 3604234 - RNA, 18 nt, Salmonella enterica enterica serovar Typhi
aaaaccuucauaaauacg

SEQ ID NO: 3604235 - RNA, 20 nt, Salmonella enterica enterica serovar Typhi
aaaacgcccccugccagcgc

SEQ ID NO: 3604236 - RNA, 12 nt, Salmonella enterica enterica serovar Typhi
aaaacgccugcc

SEQ ID NO: 3604237 - RNA, 13 nt, Salmonella enterica enterica serovar Typhi
aaaacgccuguaa

SEQ ID NO: 3604238 - RNA, 18 nt, Salmonella enterica enterica serovar Typhi
aaaacgcgcucgccagcg

SEQ ID NO: 3604239 - RNA, 14 nt, Salmonella enterica enterica serovar Typhi
aaaacggccaguga

SEQ ID NO: 3604240 - RNA, 22 nt, Salmonella enterica enterica serovar Typhi
aaaacguaacguacgggugucc

SEQ ID NO: 3604241 - RNA, 20 nt, Salmonella enterica enterica serovar Typhi
aaaacguugacuuaaaaagc

SEQ ID NO: 3604242 - RNA, 14 nt, Salmonella enterica enterica serovar Typhi
aaaacguugcugga

SEQ ID NO: 3604243 - RNA, 21 nt, Salmonella enterica enterica serovar Typhi
aaaacguuugcaaauagguuu

SEQ ID NO: 3604244 - RNA, 13 nt, Salmonella enterica enterica serovar Typhi
aaaacucaggaaa

SEQ ID NO: 3604245 - RNA, 21 nt, Salmonella enterica enterica serovar Typhi
aaaacucgccgcgaacaaagc

SEQ ID NO: 3604246 - RNA, 17 nt, Salmonella enterica enterica serovar Typhi
aaaacugucccugaugu

SEQ ID NO: 3604247 - RNA, 18 nt, Salmonella enterica enterica serovar Typhi
aaaacuuuaacacuaacu

SEQ ID NO: 3604248 - RNA, 12 nt, Salmonella enterica enterica serovar Typhi
aaaagaaaaaac

SEQ ID NO: 3604249 - RNA, 13 nt, Salmonella enterica enterica serovar Typhi
aaaagaaaaaacu

SEQ ID NO: 3604250 - RNA, 15 nt, Salmonella enterica enterica serovar Typhi
aaaagaaaaaaguga

SEQ ID NO: 3604251 - RNA, 11 nt, Salmonella enterica enterica serovar Typhi
aaaagaaacug

SEQ ID NO: 3604252 - RNA, 15 nt, Salmonella enterica enterica serovar Typhi
aaaagaacaauaauc

SEQ ID NO: 3604253 - RNA, 15 nt, Salmonella enterica enterica serovar Typhi
aaaagaacucacuca

SEQ ID NO: 3604254 - RNA, 20 nt, Salmonella enterica enterica serovar Typhi
aaaagaagcuguaacacugc

SEQ ID NO: 3604255 - RNA, 20 nt, Salmonella enterica enterica serovar Typhi
aaaagaccauccgguuuuaa

SEQ ID NO: 3604256 - RNA, 16 nt, Salmonella enterica enterica serovar Typhi
aaaagagagcgccaaa

SEQ ID NO: 3604257 - RNA, 14 nt, Salmonella enterica enterica serovar Typhi
aaaagauaaccauu

SEQ ID NO: 3604258 - RNA, 17 nt, Salmonella enterica enterica serovar Typhi
aaaagcagaggccugaa

SEQ ID NO: 3604259 - RNA, 18 nt, Salmonella enterica enterica serovar Typhi
aaaagcaucguaccuuca

SEQ ID NO: 3604260 - RNA, 17 nt, Salmonella enterica enterica serovar Typhi
aaaagccagauaaagca

SEQ ID NO: 3604261 - RNA, 22 nt, Salmonella enterica enterica serovar Typhi
aaaagccagcacggcuucacgu

SEQ ID NO: 3604262 - RNA, 22 nt, Salmonella enterica enterica serovar Typhi
aaaagccggcggaaaaaagcag

SEQ ID NO: 3604263 - RNA, 14 nt, Salmonella enterica enterica serovar Typhi
aaaagcgaaaauaa

SEQ ID NO: 3604264 - RNA, 19 nt, Salmonella enterica enterica serovar Typhi
aaaagcgauuuauucuuug

SEQ ID NO: 3604265 - RNA, 13 nt, Salmonella enterica enterica serovar Typhi
aaaagcugauuaa

SEQ ID NO: 3604266 - RNA, 22 nt, Salmonella enterica enterica serovar Typhi
aaaagcugguauugaauauuug

SEQ ID NO: 3604267 - RNA, 20 nt, Salmonella enterica enterica serovar Typhi
aaaagcuguagcauaaaugc

SEQ ID NO: 3604268 - RNA, 15 nt, Salmonella enterica enterica serovar Typhi
aaaaggaaagauuac

SEQ ID NO: 3604269 - RNA, 15 nt, Salmonella enterica enterica serovar Typhi
aaaaggcaauaaagu

SEQ ID NO: 3604270 - RNA, 19 nt, Salmonella enterica enterica serovar Typhi
aaaaggccuggcugagaaa

SEQ ID NO: 3604271 - RNA, 20 nt, Salmonella enterica enterica serovar Typhi
aaaaggcgacgaugugcaua

SEQ ID NO: 3604272 - RNA, 16 nt, Salmonella enterica enterica serovar Typhi
aaaagggaaaagccau

SEQ ID NO: 3604273 - RNA, 16 nt, Salmonella enterica enterica serovar Typhi
aaaaguauauaucccg

SEQ ID NO: 3604274 - RNA, 14 nt, Salmonella enterica enterica serovar Typhi
aaaaguauggcggu

SEQ ID NO: 3604275 - RNA, 23 nt, Salmonella enterica enterica serovar Typhi
aaaagucacuuacuuucuugcca

SEQ ID NO: 3604276 - RNA, 17 nt, Salmonella enterica enterica serovar Typhi
aaaagucguucagacau

SEQ ID NO: 3604277 - RNA, 21 nt, Salmonella enterica enterica serovar Typhi
aaaagugaacgguugagcuuu

SEQ ID NO: 3604278 - RNA, 21 nt, Salmonella enterica enterica serovar Typhi
aaaagugcgcacucagaaaau

SEQ ID NO: 3604279 - RNA, 19 nt, Salmonella enterica enterica serovar Typhi
aaaaguguguaccagcagc

SEQ ID NO: 3604280 - RNA, 20 nt, Salmonella enterica enterica serovar Typhi
aaaaguguguaccagcagcg

SEQ ID NO: 3604281 - RNA, 15 nt, Salmonella enterica enterica serovar Typhi
aaaauaaaaaaggca

SEQ ID NO: 3604282 - RNA, 18 nt, Salmonella enterica enterica serovar Typhi
aaaauaaaauuauauucu

SEQ ID NO: 3604283 - RNA, 12 nt, Salmonella enterica enterica serovar Typhi
aaaauaaacacu

SEQ ID NO: 3604284 - RNA, 13 nt, Salmonella enterica enterica serovar Typhi
aaaauaacaggca

SEQ ID NO: 3604285 - RNA, 18 nt, Salmonella enterica enterica serovar Typhi
aaaccaaagguauugccu

SEQ ID NO: 3604286 - RNA, 21 nt, Salmonella enterica enterica serovar Typhi
aaaccaacaucgcugaauuuc

SEQ ID NO: 3604287 - RNA, 20 nt, Salmonella enterica enterica serovar Typhi
aaaccaaccacggggcaugc

SEQ ID NO: 3604288 - RNA, 14 nt, Salmonella enterica enterica serovar Typhi
aaaccacaaucaca

SEQ ID NO: 3604289 - RNA, 19 nt, Salmonella enterica enterica serovar Typhi
aaaccacaaucacagcgca

SEQ ID NO: 3604290 - RNA, 13 nt, Salmonella enterica enterica serovar Typhi
aaaccacagugac

SEQ ID NO: 3604291 - RNA, 19 nt, Salmonella enterica enterica serovar Typhi
aaaccacagugaugacggc

SEQ ID NO: 3604292 - RNA, 19 nt, Salmonella enterica enterica serovar Typhi
aaaccacaugaccagcgcc

SEQ ID NO: 3604293 - RNA, 16 nt, Salmonella enterica enterica serovar Typhi
aaaccaccgagacuac

SEQ ID NO: 3604294 - RNA, 12 nt, Salmonella enterica enterica serovar Typhi
aaaccacuccgg

SEQ ID NO: 3604295 - RNA, 20 nt, Salmonella enterica enterica serovar Typhi
aaaccagcgcggauaaaaaa

SEQ ID NO: 3604296 - RNA, 21 nt, Salmonella enterica enterica serovar Typhi
aaaccaggcacugcaggcggg

SEQ ID NO: 3604297 - RNA, 19 nt, Salmonella enterica enterica serovar Typhi
aaaccaucccagguuauuc

SEQ ID NO: 3604298 - RNA, 20 nt, Salmonella enterica enterica serovar Typhi
aaaccauguugaucguaaaa

SEQ ID NO: 3604299 - RNA, 15 nt, Salmonella enterica enterica serovar Typhi
aaacccauauuccug

SEQ ID NO: 3604300 - RNA, 17 nt, Salmonella enterica enterica serovar Typhi
aaaccccaucccggcaa

SEQ ID NO: 3604301 - RNA, 15 nt, Salmonella enterica enterica serovar Typhi
aaacccggugcggca

SEQ ID NO: 3604302 - RNA, 18 nt, Salmonella enterica enterica serovar Typhi
aaacccguuaaauaccag

SEQ ID NO: 3604303 - RNA, 15 nt, Salmonella enterica enterica serovar Typhi
aaaccgaauucgucc

SEQ ID NO: 3604304 - RNA, 16 nt, Salmonella enterica enterica serovar Typhi
aaaccgacagcaauau

SEQ ID NO: 3604305 - RNA, 16 nt, Salmonella enterica enterica serovar Typhi
aaaccgacccaaaaau

SEQ ID NO: 3604306 - RNA, 13 nt, Salmonella enterica enterica serovar Typhi
aaaccgauaauca

SEQ ID NO: 3604307 - RNA, 11 nt, Salmonella enterica enterica serovar Typhi
aaaccgaucuc

SEQ ID NO: 3604308 - RNA, 16 nt, Salmonella enterica enterica serovar Typhi
aaaccgaucucccagc

SEQ ID NO: 3604309 - RNA, 19 nt, Salmonella enterica enterica serovar Typhi
aaaccgcagaaggucacgc

SEQ ID NO: 3604310 - RNA, 22 nt, Salmonella enterica enterica serovar Typhi
aaaccgcucgccgccucccccu

SEQ ID NO: 3604311 - RNA, 23 nt, Salmonella enterica enterica serovar Typhi
aaaccggcgcgccuuccagcaau

SEQ ID NO: 3604312 - RNA, 17 nt, Salmonella enterica enterica serovar Typhi
aaaccggcggccuacca

SEQ ID NO: 3604313 - RNA, 19 nt, Salmonella enterica enterica serovar Typhi
aaaccggcggucaugcugg

SEQ ID NO: 3604314 - RNA, 16 nt, Salmonella enterica enterica serovar Typhi
aaaccgggaaaucccg

SEQ ID NO: 3604315 - RNA, 15 nt, Salmonella enterica enterica serovar Typhi
aaaccggggagcuau

SEQ ID NO: 3604316 - RNA, 20 nt, Salmonella enterica enterica serovar Typhi
aaaccggucagguagcagac

SEQ ID NO: 3604317 - RNA, 15 nt, Salmonella enterica enterica serovar Typhi
aaaccguagauuuuc

SEQ ID NO: 3604318 - RNA, 22 nt, Salmonella enterica enterica serovar Typhi
aaaccguagauuuucaucauau

SEQ ID NO: 3604319 - RNA, 15 nt, Salmonella enterica enterica serovar Typhi
aaaccguuaugaauc

SEQ ID NO: 3604320 - RNA, 20 nt, Salmonella enterica enterica serovar Typhi
aaaccguucacgcucacgca

SEQ ID NO: 3604321 - RNA, 15 nt, Salmonella enterica enterica serovar Typhi
aaaccuaccggcaua

SEQ ID NO: 3604322 - RNA, 19 nt, Salmonella enterica enterica serovar Typhi
aaaccuaccggcauaguac

SEQ ID NO: 3604323 - RNA, 12 nt, Salmonella enterica enterica serovar Typhi
aaaccuccggcu

SEQ ID NO: 3604324 - RNA, 16 nt, Salmonella enterica enterica serovar Typhi
aaaccugagcauauaa

SEQ ID NO: 3604325 - RNA, 17 nt, Salmonella enterica enterica serovar Typhi
aaaccugguauuacaac

SEQ ID NO: 3604326 - RNA, 23 nt, Salmonella enterica enterica serovar Typhi
aaaccuucgcuuuuaaaacuucc

SEQ ID NO: 3604327 - RNA, 13 nt, Salmonella enterica enterica serovar Typhi
aaaccuuucuucu

SEQ ID NO: 3604328 - RNA, 16 nt, Salmonella enterica enterica serovar Typhi
aaacgaaucucaucag

SEQ ID NO: 3604329 - RNA, 15 nt, Salmonella enterica enterica serovar Typhi
aaacgacgcguuuca

SEQ ID NO: 3604330 - RNA, 18 nt, Salmonella enterica enterica serovar Typhi
aaacgacucaucaguccg

SEQ ID NO: 3604331 - RNA, 19 nt, Salmonella enterica enterica serovar Typhi
aaacgauuaauaaccaaua

SEQ ID NO: 3604332 - RNA, 13 nt, Salmonella enterica enterica serovar Typhi
aaacgcacccgcg

SEQ ID NO: 3604333 - RNA, 15 nt, Salmonella enterica enterica serovar Typhi
aaacgccaagaauga

SEQ ID NO: 3604334 - RNA, 12 nt, Salmonella enterica enterica serovar Typhi
aaacgccagcga

SEQ ID NO: 3604335 - RNA, 23 nt, Salmonella enterica enterica serovar Typhi
aaacgccauugcgaacaucacga

SEQ ID NO: 3604336 - RNA, 16 nt, Salmonella enterica enterica serovar Typhi
aaacgccgcagaaaau

SEQ ID NO: 3604337 - RNA, 15 nt, Salmonella enterica enterica serovar Typhi
aaacgccgucacaaa

SEQ ID NO: 3604338 - RNA, 15 nt, Salmonella enterica enterica serovar Typhi
aaacgcgcuaucaac

SEQ ID NO: 3604339 - RNA, 20 nt, Salmonella enterica enterica serovar Typhi
aaacgcgguaagcuguuccg

SEQ ID NO: 3604340 - RNA, 20 nt, Salmonella enterica enterica serovar Typhi
aaacgcgucuucaucagcca

SEQ ID NO: 3604341 - RNA, 23 nt, Salmonella enterica enterica serovar Typhi
aaacgcgucuucaucagccagca

SEQ ID NO: 3604342 - RNA, 16 nt, Salmonella enterica enterica serovar Typhi
aaacgcuauuuaaccc

SEQ ID NO: 3604343 - RNA, 12 nt, Salmonella enterica enterica serovar Typhi
aaacgcugcgcu

SEQ ID NO: 3604344 - RNA, 13 nt, Salmonella enterica enterica serovar Typhi
aaacgcuggugcu

SEQ ID NO: 3604345 - RNA, 22 nt, Salmonella enterica enterica serovar Typhi
aaacggaaccaaaugcccagcu

SEQ ID NO: 3604346 - RNA, 14 nt, Salmonella enterica enterica serovar Typhi
aaacggaucuucca

SEQ ID NO: 3604347 - RNA, 18 nt, Salmonella enterica enterica serovar Typhi
aaacggccagugaaauaa

SEQ ID NO: 3604348 - RNA, 15 nt, Salmonella enterica enterica serovar Typhi
aaacggccugcgcug

SEQ ID NO: 3604349 - RNA, 20 nt, Salmonella enterica enterica serovar Typhi
aaacggcuuuaauaccccug

SEQ ID NO: 3604350 - RNA, 14 nt, Salmonella enterica enterica serovar Typhi
aaacggcuuuaauc

SEQ ID NO: 3604351 - RNA, 14 nt, Salmonella enterica enterica serovar Typhi
aaacgggcgcggca

SEQ ID NO: 3604352 - RNA, 15 nt, Salmonella enterica enterica serovar Typhi
aaacgguaugaaaca

SEQ ID NO: 3604353 - RNA, 14 nt, Salmonella enterica enterica serovar Typhi
aaacgguauuucca

SEQ ID NO: 3604354 - RNA, 16 nt, Salmonella enterica enterica serovar Typhi
aaacguaccugagaga

SEQ ID NO: 3604355 - RNA, 19 nt, Salmonella enterica enterica serovar Typhi
aaacguagcguucauuccc

SEQ ID NO: 3604356 - RNA, 18 nt, Salmonella enterica enterica serovar Typhi
aaacgucacaauacuucc

SEQ ID NO: 3604357 - RNA, 17 nt, Salmonella enterica enterica serovar Typhi
aaacgucguaaaaccug

SEQ ID NO: 3604358 - RNA, 23 nt, Salmonella enterica enterica serovar Typhi
aaacgugcuggauggcagacaaa

SEQ ID NO: 3604359 - RNA, 15 nt, Salmonella enterica enterica serovar Typhi
aaacguuccugccag

SEQ ID NO: 3604360 - RNA, 18 nt, Salmonella enterica enterica serovar Typhi
aaacuaaguaaggaggaa

SEQ ID NO: 3604361 - RNA, 17 nt, Salmonella enterica enterica serovar Typhi
aaacuaauccucuucuc

SEQ ID NO: 3604362 - RNA, 23 nt, Salmonella enterica enterica serovar Typhi
aaacuaauccucuucucugaaaa

SEQ ID NO: 3604363 - RNA, 15 nt, Salmonella enterica enterica serovar Typhi
aaacuauccuggccu

SEQ ID NO: 3604364 - RNA, 13 nt, Salmonella enterica enterica serovar Typhi
aaacuauuuuuag

SEQ ID NO: 3604365 - RNA, 19 nt, Salmonella enterica enterica serovar Typhi
aaacuauuuuuagcccuug

SEQ ID NO: 3604366 - RNA, 14 nt, Salmonella enterica enterica serovar Typhi
aaacucaaucaggc

SEQ ID NO: 3604367 - RNA, 19 nt, Salmonella enterica enterica serovar Typhi
aaacucacguuccccagca

SEQ ID NO: 3604368 - RNA, 23 nt, Salmonella enterica enterica serovar Typhi
aaacucacguuccccagcaccga

SEQ ID NO: 3604369 - RNA, 16 nt, Salmonella enterica enterica serovar Typhi
aaacuccaccugaucg

SEQ ID NO: 3604370 - RNA, 12 nt, Salmonella enterica enterica serovar Typhi
aaacuccagcag

SEQ ID NO: 3604371 - RNA, 23 nt, Salmonella enterica enterica serovar Typhi
aaagcgcgcugauacuuauuacg

SEQ ID NO: 3604372 - RNA, 20 nt, Salmonella enterica enterica serovar Typhi
aaagcgcuacagggcguuuu

SEQ ID NO: 3604373 - RNA, 22 nt, Salmonella enterica enterica serovar Typhi
aaagcggauaagauagcaggcg

SEQ ID NO: 3604374 - RNA, 21 nt, Salmonella enterica enterica serovar Typhi
aaagcggauggccugcucaau

SEQ ID NO: 3604375 - RNA, 22 nt, Salmonella enterica enterica serovar Typhi
aaagcggcgaauauagcuaaug

SEQ ID NO: 3604376 - RNA, 15 nt, Salmonella enterica enterica serovar Typhi
aaagcguuucaucau

SEQ ID NO: 3604377 - RNA, 21 nt, Salmonella enterica enterica serovar Typhi
aaagcuccggacgcaccagcc

SEQ ID NO: 3604378 - RNA, 23 nt, Salmonella enterica enterica serovar Typhi
aaagcuccggacgcaccagccag

SEQ ID NO: 3604379 - RNA, 20 nt, Salmonella enterica enterica serovar Typhi
aaagcugcaccaggagcaaa

SEQ ID NO: 3604380 - RNA, 22 nt, Salmonella enterica enterica serovar Typhi
aaagcuggccuucagguuuuua

SEQ ID NO: 3604381 - RNA, 19 nt, Salmonella enterica enterica serovar Typhi
aaagcugguauugaauauu

SEQ ID NO: 3604382 - RNA, 20 nt, Salmonella enterica enterica serovar Typhi
aaagcugguauugaauauuu

SEQ ID NO: 3604383 - RNA, 13 nt, Salmonella enterica enterica serovar Typhi
aaagcuguagcau

SEQ ID NO: 3604384 - RNA, 20 nt, Salmonella enterica enterica serovar Typhi
aaagcuugaaagcagucccg

SEQ ID NO: 3604385 - RNA, 21 nt, Salmonella enterica enterica serovar Typhi
aaaggaaagauuacuucaggc

SEQ ID NO: 3604386 - RNA, 15 nt, Salmonella enterica enterica serovar Typhi
aaaggaaagggacga

SEQ ID NO: 3604387 - RNA, 18 nt, Salmonella enterica enterica serovar Typhi
aaaggaaugccugcgcuu

SEQ ID NO: 3604388 - RNA, 16 nt, Salmonella enterica enterica serovar Typhi
aaaggagccuuacggc

SEQ ID NO: 3604389 - RNA, 16 nt, Salmonella enterica enterica serovar Typhi
aaaggcauuaagucau

SEQ ID NO: 3604390 - RNA, 13 nt, Salmonella enterica enterica serovar Typhi
aaaggccagcagc

SEQ ID NO: 3604391 - RNA, 16 nt, Salmonella enterica enterica serovar Typhi
aaaggccagcagcagc

SEQ ID NO: 3604392 - RNA, 18 nt, Salmonella enterica enterica serovar Typhi
aaaggccuggcugagaaa

SEQ ID NO: 3604393 - RNA, 20 nt, Salmonella enterica enterica serovar Typhi
aaaggccuggcugagaaaaa

SEQ ID NO: 3604394 - RNA, 23 nt, Salmonella enterica enterica serovar Typhi
aaaggccuggcugagaaaaauac

SEQ ID NO: 3604395 - RNA, 19 nt, Salmonella enterica enterica serovar Typhi
aaaggcgcaacgucgccau

SEQ ID NO: 3604396 - RNA, 22 nt, Salmonella enterica enterica serovar Typhi
aaaggcguguguuuagauaaca

SEQ ID NO: 3604397 - RNA, 14 nt, Salmonella enterica enterica serovar Typhi
aaaggcuaccgguu

SEQ ID NO: 3604398 - RNA, 15 nt, Salmonella enterica enterica serovar Typhi
aaaggcuuguuuagc

SEQ ID NO: 3604399 - RNA, 16 nt, Salmonella enterica enterica serovar Typhi
aaaggcuuuaaagcag

SEQ ID NO: 3604400 - RNA, 14 nt, Salmonella enterica enterica serovar Typhi
aaaggggagggcaa

SEQ ID NO: 3604401 - RNA, 21 nt, Salmonella enterica enterica serovar Typhi
aaaggggagggcaacaaacau

SEQ ID NO: 3604402 - RNA, 22 nt, Salmonella enterica enterica serovar Typhi
aaaggggagucgguacuccccu

SEQ ID NO: 3604403 - RNA, 18 nt, Salmonella enterica enterica serovar Typhi
aaaggggaucguguaaca

SEQ ID NO: 3604404 - RNA, 20 nt, Salmonella enterica enterica serovar Typhi
aaaggggaucguguaacaau

SEQ ID NO: 3604405 - RNA, 20 nt, Salmonella enterica enterica serovar Typhi
aaaggguaacgggacacugc

SEQ ID NO: 3604406 - RNA, 15 nt, Salmonella enterica enterica serovar Typhi
aaaggucgacauuua

SEQ ID NO: 3604407 - RNA, 22 nt, Salmonella enterica enterica serovar Typhi
aaaggucuuucuguguugcuca

SEQ ID NO: 3604408 - RNA, 22 nt, Salmonella enterica enterica serovar Typhi
aaaguacaucauuggcccggcg

SEQ ID NO: 3604409 - RNA, 17 nt, Salmonella enterica enterica serovar Typhi
aaaguaccaaaacagaa

SEQ ID NO: 3604410 - RNA, 19 nt, Salmonella enterica enterica serovar Typhi
aaaguaccaaaacagaaaa

SEQ ID NO: 3604411 - RNA, 17 nt, Salmonella enterica enterica serovar Typhi
aaaguacgcaaacaguu

SEQ ID NO: 3604412 - RNA, 16 nt, Salmonella enterica enterica serovar Typhi
aaaguacuucacaauc

SEQ ID NO: 3604413 - RNA, 12 nt, Salmonella enterica enterica serovar Typhi
aaaguagccaau

SEQ ID NO: 3604414 - RNA, 19 nt, Salmonella enterica enterica serovar Typhi
aaaguauaaagcugguuga

SEQ ID NO: 3604415 - RNA, 20 nt, Salmonella enterica enterica serovar Typhi
aaagucaacugcucuaccaa

SEQ ID NO: 3604416 - RNA, 21 nt, Salmonella enterica enterica serovar Typhi
aaagugauuauaaaucaauag

SEQ ID NO: 3604417 - RNA, 20 nt, Salmonella enterica enterica serovar Typhi
aaaguggaaggaagggcgcu

SEQ ID NO: 3604418 - RNA, 15 nt, Salmonella enterica enterica serovar Typhi
aaaguggugggugau

SEQ ID NO: 3604419 - RNA, 17 nt, Salmonella enterica enterica serovar Typhi
aaaguuaacacgauaaa

SEQ ID NO: 3604420 - RNA, 13 nt, Salmonella enterica enterica serovar Typhi
aaaguuauucacg

SEQ ID NO: 3604421 - RNA, 16 nt, Salmonella enterica enterica serovar Typhi
aaaguuauuuuuucuu

SEQ ID NO: 3604422 - RNA, 16 nt, Salmonella enterica enterica serovar Typhi
aaaguucagccgauaa

SEQ ID NO: 3604423 - RNA, 15 nt, Salmonella enterica enterica serovar Typhi
aaaguugcaucaaga

SEQ ID NO: 3604424 - RNA, 16 nt, Salmonella enterica enterica serovar Typhi
aaaguuuauuugaaua

SEQ ID NO: 3604425 - RNA, 12 nt, Salmonella enterica enterica serovar Typhi
aaaguuucagga

SEQ ID NO: 3604426 - RNA, 12 nt, Salmonella enterica enterica serovar Typhi
aaaguuugaagu

SEQ ID NO: 3604427 - RNA, 15 nt, Salmonella enterica enterica serovar Typhi
aaauaaaaaaggcag

SEQ ID NO: 3604428 - RNA, 13 nt, Salmonella enterica enterica serovar Typhi
aaauaaaaauucc

SEQ ID NO: 3604429 - RNA, 12 nt, Salmonella enterica enterica serovar Typhi
aaauaaaaccag

SEQ ID NO: 3604430 - RNA, 17 nt, Salmonella enterica enterica serovar Typhi
aaauaaaaggggccugc

SEQ ID NO: 3604431 - RNA, 12 nt, Salmonella enterica enterica serovar Typhi
aaauaaaauacg

SEQ ID NO: 3604432 - RNA, 16 nt, Salmonella enterica enterica serovar Typhi
aaauaaaauacuucca

SEQ ID NO: 3604433 - RNA, 13 nt, Salmonella enterica enterica serovar Typhi
aaauaaacaccau

SEQ ID NO: 3604434 - RNA, 22 nt, Salmonella enterica enterica serovar Typhi
aaauaaacacuaaaucauaauu

SEQ ID NO: 3604435 - RNA, 21 nt, Salmonella enterica enterica serovar Typhi
aaauaaagugcugaacaauaa

SEQ ID NO: 3604436 - RNA, 16 nt, Salmonella enterica enterica serovar Typhi
aaauaaauaaaaccag

SEQ ID NO: 3604437 - RNA, 20 nt, Salmonella enterica enterica serovar Typhi
aaauaaauauguuauuuaca

SEQ ID NO: 3604438 - RNA, 16 nt, Salmonella enterica enterica serovar Typhi
aaauaaauccaugaga

SEQ ID NO: 3604439 - RNA, 19 nt, Salmonella enterica enterica serovar Typhi
aaauaaaugauauuuaaaa

SEQ ID NO: 3604440 - RNA, 21 nt, Salmonella enterica enterica serovar Typhi
aaauaacaauauuaaauaaau

SEQ ID NO: 3604441 - RNA, 14 nt, Salmonella enterica enterica serovar Typhi
aaauaacagacgaa

SEQ ID NO: 3604442 - RNA, 21 nt, Salmonella enterica enterica serovar Typhi
aaauaacaggaaucauucuau

SEQ ID NO: 3604443 - RNA, 21 nt, Salmonella enterica enterica serovar Typhi
aaauaacgccuuucaccauuc

SEQ ID NO: 3604444 - RNA, 17 nt, Salmonella enterica enterica serovar Typhi
aaauaacgguagagaau

SEQ ID NO: 3604445 - RNA, 13 nt, Salmonella enterica enterica serovar Typhi
aaauaacuuuuaa

SEQ ID NO: 3604446 - RNA, 21 nt, Salmonella enterica enterica serovar Typhi
aaauaacuuuuaauuuuuaug

SEQ ID NO: 3604447 - RNA, 22 nt, Salmonella enterica enterica serovar Typhi
aaauaaggcugcgcguuuucau

SEQ ID NO: 3604448 - RNA, 13 nt, Salmonella enterica enterica serovar Typhi
aaauaauauuauu

SEQ ID NO: 3604449 - RNA, 22 nt, Salmonella enterica enterica serovar Typhi
aaauaauccgcugcaacucccg

SEQ ID NO: 3604450 - RNA, 14 nt, Salmonella enterica enterica serovar Typhi
aaauaauucauauu

SEQ ID NO: 3604451 - RNA, 23 nt, Salmonella enterica enterica serovar Typhi
aaauacagagucgcuuaucugcu

SEQ ID NO: 3604452 - RNA, 14 nt, Salmonella enterica enterica serovar Typhi
aaauaccaaauauu

SEQ ID NO: 3604453 - RNA, 13 nt, Salmonella enterica enterica serovar Typhi
aaauaccacauca

SEQ ID NO: 3604454 - RNA, 9 nt, Salmonella enterica enterica serovar Typhi
aaauaccag

SEQ ID NO: 3604455 - RNA, 12 nt, Salmonella enterica enterica serovar Typhi
aaauaccagcac

SEQ ID NO: 3604456 - RNA, 22 nt, Salmonella enterica enterica serovar Typhi
aaauuucaacccgaucgccauc

SEQ ID NO: 3604457 - RNA, 23 nt, Salmonella enterica enterica serovar Typhi
aaauuucacgucacguucauccu

SEQ ID NO: 3604458 - RNA, 21 nt, Salmonella enterica enterica serovar Typhi
aaauuucgaaacaggaaaaac

SEQ ID NO: 3604459 - RNA, 20 nt, Salmonella enterica enterica serovar Typhi
aaauuugucagacaugauaa

SEQ ID NO: 3604460 - RNA, 20 nt, Salmonella enterica enterica serovar Typhi
aaauuuucaaccacggauaa

SEQ ID NO: 3604461 - RNA, 22 nt, Salmonella enterica enterica serovar Typhi
aaauuuucaauacgucauauca

SEQ ID NO: 3604462 - RNA, 19 nt, Salmonella enterica enterica serovar Typhi
aacaaaaaccugcucucgg

SEQ ID NO: 3604463 - RNA, 22 nt, Salmonella enterica enterica serovar Typhi
aacaaaaagauauuauaaaaua

SEQ ID NO: 3604464 - RNA, 14 nt, Salmonella enterica enterica serovar Typhi
aacaaaaccagcau

SEQ ID NO: 3604465 - RNA, 16 nt, Salmonella enterica enterica serovar Typhi
aacaaaacggaauguu

SEQ ID NO: 3604466 - RNA, 14 nt, Salmonella enterica enterica serovar Typhi
aacaaaccaaacug

SEQ ID NO: 3604467 - RNA, 14 nt, Salmonella enterica enterica serovar Typhi
aacaaagggcaccu

SEQ ID NO: 3604468 - RNA, 20 nt, Salmonella enterica enterica serovar Typhi
aacaaagggcaccugggcaa

SEQ ID NO: 3604469 - RNA, 17 nt, Salmonella enterica enterica serovar Typhi
aacaaauaaauccauga

SEQ ID NO: 3604470 - RNA, 18 nt, Salmonella enterica enterica serovar Typhi
aacaaauaaauccaugag

SEQ ID NO: 3604471 - RNA, 14 nt, Salmonella enterica enterica serovar Typhi
aacaacaggccgcc

SEQ ID NO: 3604472 - RNA, 22 nt, Salmonella enterica enterica serovar Typhi
aacaacauugaggcuacccaga

SEQ ID NO: 3604473 - RNA, 15 nt, Salmonella enterica enterica serovar Typhi
aacaaccagaauaau

SEQ ID NO: 3604474 - RNA, 14 nt, Salmonella enterica enterica serovar Typhi
aacaacggcacaca

SEQ ID NO: 3604475 - RNA, 20 nt, Salmonella enterica enterica serovar Typhi
aacaacuguuuuucacuaau

SEQ ID NO: 3604476 - RNA, 23 nt, Salmonella enterica enterica serovar Typhi
aacaagccgccaacgccagcagc

SEQ ID NO: 3604477 - RNA, 13 nt, Salmonella enterica enterica serovar Typhi
aacaagggcauaa

SEQ ID NO: 3604478 - RNA, 18 nt, Salmonella enterica enterica serovar Typhi
aacaagggcauaaugauu

SEQ ID NO: 3604479 - RNA, 14 nt, Salmonella enterica enterica serovar Typhi
aacaagugcagaag

SEQ ID NO: 3604480 - RNA, 23 nt, Salmonella enterica enterica serovar Typhi
aacaauaucgauagcauuuuuac

SEQ ID NO: 3604481 - RNA, 12 nt, Salmonella enterica enterica serovar Typhi
aacaauauuaaa

SEQ ID NO: 3604482 - RNA, 19 nt, Salmonella enterica enterica serovar Typhi
aacaauccccgucacagcg

SEQ ID NO: 3604483 - RNA, 20 nt, Salmonella enterica enterica serovar Typhi
aacaauuacgccuacuggga

SEQ ID NO: 3604484 - RNA, 18 nt, Salmonella enterica enterica serovar Typhi
aacacacaguugccuucg

SEQ ID NO: 3604485 - RNA, 19 nt, Salmonella enterica enterica serovar Typhi
aacacacgcuuagcuugcc

SEQ ID NO: 3604486 - RNA, 23 nt, Salmonella enterica enterica serovar Typhi
aacacacguaacaaccagaauaa

SEQ ID NO: 3604487 - RNA, 14 nt, Salmonella enterica enterica serovar Typhi
aacacagccagcac

SEQ ID NO: 3604488 - RNA, 16 nt, Salmonella enterica enterica serovar Typhi
aacacauaagcaacuu

SEQ ID NO: 3604489 - RNA, 15 nt, Salmonella enterica enterica serovar Typhi
aacaccacaacacac

SEQ ID NO: 3604490 - RNA, 20 nt, Salmonella enterica enterica serovar Typhi
aacacccgcaaacuaauggc

SEQ ID NO: 3604491 - RNA, 17 nt, Salmonella enterica enterica serovar Typhi
aacaccugaaccagcgc

SEQ ID NO: 3604492 - RNA, 22 nt, Salmonella enterica enterica serovar Typhi
aacaccuguaacgucacauucc

SEQ ID NO: 3604493 - RNA, 16 nt, Salmonella enterica enterica serovar Typhi
aacaccuuauccggcc

SEQ ID NO: 3604494 - RNA, 20 nt, Salmonella enterica enterica serovar Typhi
aacaccuuauccggccuaca

SEQ ID NO: 3604495 - RNA, 13 nt, Salmonella enterica enterica serovar Typhi
aacacgaauaugc

SEQ ID NO: 3604496 - RNA, 18 nt, Salmonella enterica enterica serovar Typhi
aacacgaccagcgacagu

SEQ ID NO: 3604497 - RNA, 18 nt, Salmonella enterica enterica serovar Typhi
aacacgauggcaaauaau

SEQ ID NO: 3604498 - RNA, 22 nt, Salmonella enterica enterica serovar Typhi
aacacgauggcaaauaauacca

SEQ ID NO: 3604499 - RNA, 13 nt, Salmonella enterica enterica serovar Typhi
aacacggcgcuca

SEQ ID NO: 3604500 - RNA, 15 nt, Salmonella enterica enterica serovar Typhi
aacacgucgauuuuc

SEQ ID NO: 3604501 - RNA, 20 nt, Salmonella enterica enterica serovar Typhi
aacacguuaucugaccuaca

SEQ ID NO: 3604502 - RNA, 20 nt, Salmonella enterica enterica serovar Typhi
aacacuaacuaauuguuugu

SEQ ID NO: 3604503 - RNA, 20 nt, Salmonella enterica enterica serovar Typhi
aacacuaccgggcagcaucu

SEQ ID NO: 3604504 - RNA, 18 nt, Salmonella enterica enterica serovar Typhi
aacacuauauguccuuua

SEQ ID NO: 3604505 - RNA, 14 nt, Salmonella enterica enterica serovar Typhi
aacacucuccacca

SEQ ID NO: 3604506 - RNA, 21 nt, Salmonella enterica enterica serovar Typhi
aacagaaaaaaugcaccgccu

SEQ ID NO: 3604507 - RNA, 16 nt, Salmonella enterica enterica serovar Typhi
aacagaaaagaucgcu

SEQ ID NO: 3604508 - RNA, 21 nt, Salmonella enterica enterica serovar Typhi
aacagaaaccauaaacaaaac

SEQ ID NO: 3604509 - RNA, 23 nt, Salmonella enterica enterica serovar Typhi
aacagaaaccauaaacaaaacaa

SEQ ID NO: 3604510 - RNA, 19 nt, Salmonella enterica enterica serovar Typhi
aacagaaucgcgcugaggg

SEQ ID NO: 3604511 - RNA, 17 nt, Salmonella enterica enterica serovar Typhi
aacagaauuaccugggu

SEQ ID NO: 3604512 - RNA, 22 nt, Salmonella enterica enterica serovar Typhi
aacagacaauuagcgacgcaua

SEQ ID NO: 3604513 - RNA, 17 nt, Salmonella enterica enterica serovar Typhi
aacagacgccuuucaga

SEQ ID NO: 3604514 - RNA, 13 nt, Salmonella enterica enterica serovar Typhi
aacagacuccguc

SEQ ID NO: 3604515 - RNA, 18 nt, Salmonella enterica enterica serovar Typhi
aacagagagggaaaaaaa

SEQ ID NO: 3604516 - RNA, 12 nt, Salmonella enterica enterica serovar Typhi
aacagagcaauu

SEQ ID NO: 3604517 - RNA, 15 nt, Salmonella enterica enterica serovar Typhi
aacagaguaacccga

SEQ ID NO: 3604518 - RNA, 18 nt, Salmonella enterica enterica serovar Typhi
aacagauacggcgcgucg

SEQ ID NO: 3604519 - RNA, 13 nt, Salmonella enterica enterica serovar Typhi
aacagauacugga

SEQ ID NO: 3604520 - RNA, 20 nt, Salmonella enterica enterica serovar Typhi
aacagcaaaucgggaaaaug

SEQ ID NO: 3604521 - RNA, 12 nt, Salmonella enterica enterica serovar Typhi
aacagcaaugcc

SEQ ID NO: 3604522 - RNA, 12 nt, Salmonella enterica enterica serovar Typhi
aacagcaccagc

SEQ ID NO: 3604523 - RNA, 15 nt, Salmonella enterica enterica serovar Typhi
aacagcaccagcagg

SEQ ID NO: 3604524 - RNA, 16 nt, Salmonella enterica enterica serovar Typhi
aacagcacgcccugcc

SEQ ID NO: 3604525 - RNA, 12 nt, Salmonella enterica enterica serovar Typhi
aacagcagcagc

SEQ ID NO: 3604526 - RNA, 12 nt, Salmonella enterica enterica serovar Typhi
aacagcaggacc

SEQ ID NO: 3604527 - RNA, 13 nt, Salmonella enterica enterica serovar Typhi
aacagcaggaccc

SEQ ID NO: 3604528 - RNA, 23 nt, Salmonella enterica enterica serovar Typhi
aacagccaaucauaaacgccuga

SEQ ID NO: 3604529 - RNA, 15 nt, Salmonella enterica enterica serovar Typhi
aacagccagaagccu

SEQ ID NO: 3604530 - RNA, 13 nt, Salmonella enterica enterica serovar Typhi
aacagccagcagc

SEQ ID NO: 3604531 - RNA, 14 nt, Salmonella enterica enterica serovar Typhi
aacagccagcagcg

SEQ ID NO: 3604532 - RNA, 12 nt, Salmonella enterica enterica serovar Typhi
aacagccaggcu

SEQ ID NO: 3604533 - RNA, 15 nt, Salmonella enterica enterica serovar Typhi
aacagcgccaucagg

SEQ ID NO: 3604534 - RNA, 15 nt, Salmonella enterica enterica serovar Typhi
aacagcgccgcgaau

SEQ ID NO: 3604535 - RNA, 15 nt, Salmonella enterica enterica serovar Typhi
aacagcgccggcagc

SEQ ID NO: 3604536 - RNA, 19 nt, Salmonella enterica enterica serovar Typhi
aacagcgcuaucaggaaga

SEQ ID NO: 3604537 - RNA, 12 nt, Salmonella enterica enterica serovar Typhi
aacagcgcucca

SEQ ID NO: 3604538 - RNA, 22 nt, Salmonella enterica enterica serovar Typhi
aacagcgugaacacgccccaca

SEQ ID NO: 3604539 - RNA, 22 nt, Salmonella enterica enterica serovar Typhi
aacagcuuaccccuguccuuuc

SEQ ID NO: 3604540 - RNA, 22 nt, Salmonella enterica enterica serovar Typhi
aacagcuucaugcgccgcgaca

SEQ ID NO: 3604541 - RNA, 14 nt, Salmonella enterica enterica serovar Typhi
aacagcuugaucau

SEQ ID NO: 3604542 - RNA, 22 nt, Salmonella enterica enterica serovar Typhi
aaccauguugaucguaaaauga

SEQ ID NO: 3604543 - RNA, 15 nt, Salmonella enterica enterica serovar Typhi
aaccauucaaauuca

SEQ ID NO: 3604544 - RNA, 20 nt, Salmonella enterica enterica serovar Typhi
aaccauucccgauaaugacc

SEQ ID NO: 3604545 - RNA, 17 nt, Salmonella enterica enterica serovar Typhi
aaccauuucuccugcau

SEQ ID NO: 3604546 - RNA, 14 nt, Salmonella enterica enterica serovar Typhi
aacccaccagcagg

SEQ ID NO: 3604547 - RNA, 15 nt, Salmonella enterica enterica serovar Typhi
aacccaccagcgcca

SEQ ID NO: 3604548 - RNA, 20 nt, Salmonella enterica enterica serovar Typhi
aacccaccauaggccagcgu

SEQ ID NO: 3604549 - RNA, 15 nt, Salmonella enterica enterica serovar Typhi
aacccacgacgcggu

SEQ ID NO: 3604550 - RNA, 14 nt, Salmonella enterica enterica serovar Typhi
aacccacuuugcuu

SEQ ID NO: 3604551 - RNA, 18 nt, Salmonella enterica enterica serovar Typhi
aacccagauaucagucug

SEQ ID NO: 3604552 - RNA, 17 nt, Salmonella enterica enterica serovar Typhi
aacccauauuccugcgg

SEQ ID NO: 3604553 - RNA, 17 nt, Salmonella enterica enterica serovar Typhi
aacccauuggcgaggaa

SEQ ID NO: 3604554 - RNA, 22 nt, Salmonella enterica enterica serovar Typhi
aaccccggaaugugaaauacag

SEQ ID NO: 3604555 - RNA, 22 nt, Salmonella enterica enterica serovar Typhi
aaccccggcaaaccuaccggca

SEQ ID NO: 3604556 - RNA, 18 nt, Salmonella enterica enterica serovar Typhi
aaccccguggugacacaa

SEQ ID NO: 3604557 - RNA, 14 nt, Salmonella enterica enterica serovar Typhi
aacccgauacccug

SEQ ID NO: 3604558 - RNA, 13 nt, Salmonella enterica enterica serovar Typhi
aacccgccgccau

SEQ ID NO: 3604559 - RNA, 17 nt, Salmonella enterica enterica serovar Typhi
aacccgccucaaacgcc

SEQ ID NO: 3604560 - RNA, 14 nt, Salmonella enterica enterica serovar Typhi
aacccggcauuucu

SEQ ID NO: 3604561 - RNA, 18 nt, Salmonella enterica enterica serovar Typhi
aacccggcgaccggugau

SEQ ID NO: 3604562 - RNA, 21 nt, Salmonella enterica enterica serovar Typhi
aacccguuaaauaccagcacc

SEQ ID NO: 3604563 - RNA, 21 nt, Salmonella enterica enterica serovar Typhi
aacccuauugccacaauauca

SEQ ID NO: 3604564 - RNA, 21 nt, Salmonella enterica enterica serovar Typhi
aacccuucauaggugaacaug

SEQ ID NO: 3604565 - RNA, 23 nt, Salmonella enterica enterica serovar Typhi
aacccuuucauucgucaaauuca

SEQ ID NO: 3604566 - RNA, 16 nt, Salmonella enterica enterica serovar Typhi
aaccgaauaacgccag

SEQ ID NO: 3604567 - RNA, 15 nt, Salmonella enterica enterica serovar Typhi
aaccgaauucgucca

SEQ ID NO: 3604568 - RNA, 19 nt, Salmonella enterica enterica serovar Typhi
aaccgacaauauucgccgc

SEQ ID NO: 3604569 - RNA, 18 nt, Salmonella enterica enterica serovar Typhi
aaccgacgaaagauaaaa

SEQ ID NO: 3604570 - RNA, 18 nt, Salmonella enterica enterica serovar Typhi
aaccgacuaucagaaaaa

SEQ ID NO: 3604571 - RNA, 23 nt, Salmonella enterica enterica serovar Typhi
aaccgacugucgaaaccagcaua

SEQ ID NO: 3604572 - RNA, 17 nt, Salmonella enterica enterica serovar Typhi
aaccgagcauccgcgca

SEQ ID NO: 3604573 - RNA, 15 nt, Salmonella enterica enterica serovar Typhi
aaccgauaaucacca

SEQ ID NO: 3604574 - RNA, 19 nt, Salmonella enterica enterica serovar Typhi
aaccgauaaucaccagccc

SEQ ID NO: 3604575 - RNA, 13 nt, Salmonella enterica enterica serovar Typhi
aaccgaucuccca

SEQ ID NO: 3604576 - RNA, 15 nt, Salmonella enterica enterica serovar Typhi
aaccgaucucccagc

SEQ ID NO: 3604577 - RNA, 16 nt, Salmonella enterica enterica serovar Typhi
aaccgaugcaaccgcu

SEQ ID NO: 3604578 - RNA, 13 nt, Salmonella enterica enterica serovar Typhi
aaccgccagcagu

SEQ ID NO: 3604579 - RNA, 19 nt, Salmonella enterica enterica serovar Typhi
aaccgcccaucaacaccag

SEQ ID NO: 3604580 - RNA, 15 nt, Salmonella enterica enterica serovar Typhi
aaccgcccccaacug

SEQ ID NO: 3604581 - RNA, 18 nt, Salmonella enterica enterica serovar Typhi
aaccgcccgcggcgauca

SEQ ID NO: 3604582 - RNA, 19 nt, Salmonella enterica enterica serovar Typhi
aaccgcgccaaagauaaga

SEQ ID NO: 3604583 - RNA, 16 nt, Salmonella enterica enterica serovar Typhi
aaccgcgccggaugac

SEQ ID NO: 3604584 - RNA, 18 nt, Salmonella enterica enterica serovar Typhi
aaccgcggucggcaggcg

SEQ ID NO: 3604585 - RNA, 14 nt, Salmonella enterica enterica serovar Typhi
aaccgcucacgguu

SEQ ID NO: 3604586 - RNA, 19 nt, Salmonella enterica enterica serovar Typhi
aaccgcuucgaaguuuuga

SEQ ID NO: 3604587 - RNA, 19 nt, Salmonella enterica enterica serovar Typhi
aaccgcuuuuccugcugcc

SEQ ID NO: 3604588 - RNA, 19 nt, Salmonella enterica enterica serovar Typhi
aaccggaccagcacaaaaa

SEQ ID NO: 3604589 - RNA, 18 nt, Salmonella enterica enterica serovar Typhi
aaccggcaacucgccggu

SEQ ID NO: 3604590 - RNA, 23 nt, Salmonella enterica enterica serovar Typhi
aaccggcaacucgccgguuuuuu

SEQ ID NO: 3604591 - RNA, 21 nt, Salmonella enterica enterica serovar Typhi
aaccggcacauccagcgccug

SEQ ID NO: 3604592 - RNA, 22 nt, Salmonella enterica enterica serovar Typhi
aaccggcccagcuuaguaaccc

SEQ ID NO: 3604593 - RNA, 13 nt, Salmonella enterica enterica serovar Typhi
aaccggccccauc

SEQ ID NO: 3604594 - RNA, 21 nt, Salmonella enterica enterica serovar Typhi
aaccggcgcgccuuccagcaa

SEQ ID NO: 3604595 - RNA, 23 nt, Salmonella enterica enterica serovar Typhi
aaccggcguuccgcccaggcggg

SEQ ID NO: 3604596 - RNA, 15 nt, Salmonella enterica enterica serovar Typhi
aaccggcugccagcg

SEQ ID NO: 3604597 - RNA, 16 nt, Salmonella enterica enterica serovar Typhi
aaccggguugcggaag

SEQ ID NO: 3604598 - RNA, 19 nt, Salmonella enterica enterica serovar Typhi
aaccggucagguagcagac

SEQ ID NO: 3604599 - RNA, 22 nt, Salmonella enterica enterica serovar Typhi
aaccggucucuuaaugccagcg

SEQ ID NO: 3604600 - RNA, 23 nt, Salmonella enterica enterica serovar Typhi
aaccggucucuuaaugccagcgg

SEQ ID NO: 3604601 - RNA, 22 nt, Salmonella enterica enterica serovar Typhi
aaccguaucacuguaaaaggga

SEQ ID NO: 3604602 - RNA, 14 nt, Salmonella enterica enterica serovar Typhi
aaccgucaucagcc

SEQ ID NO: 3604603 - RNA, 14 nt, Salmonella enterica enterica serovar Typhi
aaccguccacaucc

SEQ ID NO: 3604604 - RNA, 21 nt, Salmonella enterica enterica serovar Typhi
aaccguccacauccagcgcca

SEQ ID NO: 3604605 - RNA, 23 nt, Salmonella enterica enterica serovar Typhi
aaccgucgggcgucgccugccag

SEQ ID NO: 3604606 - RNA, 18 nt, Salmonella enterica enterica serovar Typhi
aaccgucucaccaggcgu

SEQ ID NO: 3604607 - RNA, 17 nt, Salmonella enterica enterica serovar Typhi
aaccgucuggcugccau

SEQ ID NO: 3604608 - RNA, 21 nt, Salmonella enterica enterica serovar Typhi
aaccguucaucuaucgccagc

SEQ ID NO: 3604609 - RNA, 16 nt, Salmonella enterica enterica serovar Typhi
aaccguucuuccuggg

SEQ ID NO: 3604610 - RNA, 21 nt, Salmonella enterica enterica serovar Typhi
aaccguuuuaccuucugccgc

SEQ ID NO: 3604611 - RNA, 12 nt, Salmonella enterica enterica serovar Typhi
aaccuaaaaacc

SEQ ID NO: 3604612 - RNA, 14 nt, Salmonella enterica enterica serovar Typhi
aaccuauuuuacaa

SEQ ID NO: 3604613 - RNA, 19 nt, Salmonella enterica enterica serovar Typhi
aaccucaucccggcuuaaa

SEQ ID NO: 3604614 - RNA, 19 nt, Salmonella enterica enterica serovar Typhi
aaccuccggcuaugccgga

SEQ ID NO: 3604615 - RNA, 22 nt, Salmonella enterica enterica serovar Typhi
aaccuccugcaaucguucuugc

SEQ ID NO: 3604616 - RNA, 17 nt, Salmonella enterica enterica serovar Typhi
aaccucggcuugcuuca

SEQ ID NO: 3604617 - RNA, 14 nt, Salmonella enterica enterica serovar Typhi
aaccucucaccgcc

SEQ ID NO: 3604618 - RNA, 16 nt, Salmonella enterica enterica serovar Typhi
aaccucuuuuuccgcc

SEQ ID NO: 3604619 - RNA, 12 nt, Salmonella enterica enterica serovar Typhi
aaccugaacaau

SEQ ID NO: 3604620 - RNA, 13 nt, Salmonella enterica enterica serovar Typhi
aaccugagcgcga

SEQ ID NO: 3604621 - RNA, 21 nt, Salmonella enterica enterica serovar Typhi
aaccugagcgcgaacgcucca

SEQ ID NO: 3604622 - RNA, 14 nt, Salmonella enterica enterica serovar Typhi
aaccugauauugcg

SEQ ID NO: 3604623 - RNA, 13 nt, Salmonella enterica enterica serovar Typhi
aaccugcgaaaag

SEQ ID NO: 3604624 - RNA, 21 nt, Salmonella enterica enterica serovar Typhi
aaccugcgccgcgauaaagaa

SEQ ID NO: 3604625 - RNA, 14 nt, Salmonella enterica enterica serovar Typhi
aaccugguaugaua

SEQ ID NO: 3604626 - RNA, 16 nt, Salmonella enterica enterica serovar Typhi
aaccugguauuacaac

SEQ ID NO: 3604627 - RNA, 20 nt, Salmonella enterica enterica serovar Typhi
aacgcgcauuuuauuuaaaa

SEQ ID NO: 3604628 - RNA, 13 nt, Salmonella enterica enterica serovar Typhi
aacgcgccacgcg

SEQ ID NO: 3604629 - RNA, 16 nt, Salmonella enterica enterica serovar Typhi
aacgcgccauccggca

SEQ ID NO: 3604630 - RNA, 18 nt, Salmonella enterica enterica serovar Typhi
aacgcgcccaacggaugc

SEQ ID NO: 3604631 - RNA, 15 nt, Salmonella enterica enterica serovar Typhi
aacgcgcucgccagc

SEQ ID NO: 3604632 - RNA, 17 nt, Salmonella enterica enterica serovar Typhi
aacgcgcucgccagcgc

SEQ ID NO: 3604633 - RNA, 12 nt, Salmonella enterica enterica serovar Typhi
aacgcggccugg

SEQ ID NO: 3604634 - RNA, 23 nt, Salmonella enterica enterica serovar Typhi
aacgcggcgccgaagcaggcgga

SEQ ID NO: 3604635 - RNA, 21 nt, Salmonella enterica enterica serovar Typhi
aacgcggcguagccgccgagc

SEQ ID NO: 3604636 - RNA, 17 nt, Salmonella enterica enterica serovar Typhi
aacgcguacggcuucaa

SEQ ID NO: 3604637 - RNA, 19 nt, Salmonella enterica enterica serovar Typhi
aacgcgucuucaucagcca

SEQ ID NO: 3604638 - RNA, 22 nt, Salmonella enterica enterica serovar Typhi
aacgcgucuucaucagccagca

SEQ ID NO: 3604639 - RNA, 22 nt, Salmonella enterica enterica serovar Typhi
aacgcguuaaucacuaccugca

SEQ ID NO: 3604640 - RNA, 15 nt, Salmonella enterica enterica serovar Typhi
aacgcuaggcaaccu

SEQ ID NO: 3604641 - RNA, 21 nt, Salmonella enterica enterica serovar Typhi
aacgcuaucaccgccgcccgu

SEQ ID NO: 3604642 - RNA, 13 nt, Salmonella enterica enterica serovar Typhi
aacgcuaugcgcc

SEQ ID NO: 3604643 - RNA, 21 nt, Salmonella enterica enterica serovar Typhi
aacgcucaguacgcugccauc

SEQ ID NO: 3604644 - RNA, 13 nt, Salmonella enterica enterica serovar Typhi
aacgcuccagcag

SEQ ID NO: 3604645 - RNA, 15 nt, Salmonella enterica enterica serovar Typhi
aacgcucgcgcauga

SEQ ID NO: 3604646 - RNA, 19 nt, Salmonella enterica enterica serovar Typhi
aacgcucucuuuucuuacu

SEQ ID NO: 3604647 - RNA, 23 nt, Salmonella enterica enterica serovar Typhi
aacgcucuuaccgcuaaaauacc

SEQ ID NO: 3604648 - RNA, 16 nt, Salmonella enterica enterica serovar Typhi
aacgcugagucagaaa

SEQ ID NO: 3604649 - RNA, 16 nt, Salmonella enterica enterica serovar Typhi
aacgcugcaaaguuau

SEQ ID NO: 3604650 - RNA, 22 nt, Salmonella enterica enterica serovar Typhi
aacgcugcauccuguaccacca

SEQ ID NO: 3604651 - RNA, 19 nt, Salmonella enterica enterica serovar Typhi
aacgcuggcggcaggccua

SEQ ID NO: 3604652 - RNA, 15 nt, Salmonella enterica enterica serovar Typhi
aacgcuuaaucccuu

SEQ ID NO: 3604653 - RNA, 16 nt, Salmonella enterica enterica serovar Typhi
aacgcuuugcgauagc

SEQ ID NO: 3604654 - RNA, 17 nt, Salmonella enterica enterica serovar Typhi
aacgcuuuguacagaca

SEQ ID NO: 3604655 - RNA, 19 nt, Salmonella enterica enterica serovar Typhi
aacggaaaagcauugcuuc

SEQ ID NO: 3604656 - RNA, 22 nt, Salmonella enterica enterica serovar Typhi
aacggaauggcacagcgcagca

SEQ ID NO: 3604657 - RNA, 19 nt, Salmonella enterica enterica serovar Typhi
aacggaccggcaaucgccu

SEQ ID NO: 3604658 - RNA, 17 nt, Salmonella enterica enterica serovar Typhi
aacggacgugcgcuuca

SEQ ID NO: 3604659 - RNA, 22 nt, Salmonella enterica enterica serovar Typhi
aacggcaacaguaccugauaaa

SEQ ID NO: 3604660 - RNA, 20 nt, Salmonella enterica enterica serovar Typhi
aacggcagccgccaccacaa

SEQ ID NO: 3604661 - RNA, 19 nt, Salmonella enterica enterica serovar Typhi
aacggccagugaaauaaau

SEQ ID NO: 3604662 - RNA, 17 nt, Salmonella enterica enterica serovar Typhi
aacggcgacaagaauau

SEQ ID NO: 3604663 - RNA, 18 nt, Salmonella enterica enterica serovar Typhi
aacggcgagcuuuaauga

SEQ ID NO: 3604664 - RNA, 20 nt, Salmonella enterica enterica serovar Typhi
aacggcgcaaagacagguga

SEQ ID NO: 3604665 - RNA, 13 nt, Salmonella enterica enterica serovar Typhi
aacggcgccagcu

SEQ ID NO: 3604666 - RNA, 23 nt, Salmonella enterica enterica serovar Typhi
aacggcggaaccauuuuccccag

SEQ ID NO: 3604667 - RNA, 19 nt, Salmonella enterica enterica serovar Typhi
aacggcgugaaucccccug

SEQ ID NO: 3604668 - RNA, 21 nt, Salmonella enterica enterica serovar Typhi
aacggcugacgcccaucagca

SEQ ID NO: 3604669 - RNA, 21 nt, Salmonella enterica enterica serovar Typhi
aacggcuuuccagcagccaga

SEQ ID NO: 3604670 - RNA, 22 nt, Salmonella enterica enterica serovar Typhi
aacgggacggcggccagcauuu

SEQ ID NO: 3604671 - RNA, 23 nt, Salmonella enterica enterica serovar Typhi
aacgggcggugugauuaauccaa

SEQ ID NO: 3604672 - RNA, 19 nt, Salmonella enterica enterica serovar Typhi
aacgggcguugcucaaugg

SEQ ID NO: 3604673 - RNA, 19 nt, Salmonella enterica enterica serovar Typhi
aacggguuugauugccauc

SEQ ID NO: 3604674 - RNA, 14 nt, Salmonella enterica enterica serovar Typhi
aacgguaacggaca

SEQ ID NO: 3604675 - RNA, 23 nt, Salmonella enterica enterica serovar Typhi
aacgguuucgauuucuucgaccg

SEQ ID NO: 3604676 - RNA, 20 nt, Salmonella enterica enterica serovar Typhi
aacguaaacggcagccgcca

SEQ ID NO: 3604677 - RNA, 21 nt, Salmonella enterica enterica serovar Typhi
aacguaaauagagaaaucaac

SEQ ID NO: 3604678 - RNA, 20 nt, Salmonella enterica enterica serovar Typhi
aacguaacuugauuccuggc

SEQ ID NO: 3604679 - RNA, 21 nt, Salmonella enterica enterica serovar Typhi
aacguaacuugauuccuggcu

SEQ ID NO: 3604680 - RNA, 20 nt, Salmonella enterica enterica serovar Typhi
aacguaaucaucaugcugca

SEQ ID NO: 3604681 - RNA, 18 nt, Salmonella enterica enterica serovar Typhi
aacguaccgaugacggca

SEQ ID NO: 3604682 - RNA, 19 nt, Salmonella enterica enterica serovar Typhi
aacguauuucuuuugccau

SEQ ID NO: 3604683 - RNA, 21 nt, Salmonella enterica enterica serovar Typhi
aacgucaccucaucaacgcca

SEQ ID NO: 3604684 - RNA, 20 nt, Salmonella enterica enterica serovar Typhi
aacgucagcgccacccauuu

SEQ ID NO: 3604685 - RNA, 11 nt, Salmonella enterica enterica serovar Typhi
aacgucaguac

SEQ ID NO: 3604686 - RNA, 17 nt, Salmonella enterica enterica serovar Typhi
aacgucgcguacaccuu

SEQ ID NO: 3604687 - RNA, 16 nt, Salmonella enterica enterica serovar Typhi
aacgucguaaaaccug

SEQ ID NO: 3604688 - RNA, 19 nt, Salmonella enterica enterica serovar Typhi
aacgucguaaaaccugcgu

SEQ ID NO: 3604689 - RNA, 17 nt, Salmonella enterica enterica serovar Typhi
aacgucuugccaugugc

SEQ ID NO: 3604690 - RNA, 18 nt, Salmonella enterica enterica serovar Typhi
aacgugccgaccagcggu

SEQ ID NO: 3604691 - RNA, 12 nt, Salmonella enterica enterica serovar Typhi
aacguguuaucg

SEQ ID NO: 3604692 - RNA, 22 nt, Salmonella enterica enterica serovar Typhi
aacguuacauuuuccaugccuu

SEQ ID NO: 3604693 - RNA, 18 nt, Salmonella enterica enterica serovar Typhi
aacguuaccgcagcgaau

SEQ ID NO: 3604694 - RNA, 19 nt, Salmonella enterica enterica serovar Typhi
aacguuauuggcaggaugu

SEQ ID NO: 3604695 - RNA, 12 nt, Salmonella enterica enterica serovar Typhi
aacguucaaaau

SEQ ID NO: 3604696 - RNA, 22 nt, Salmonella enterica enterica serovar Typhi
aacguucggugaagaaaaagaa

SEQ ID NO: 3604697 - RNA, 15 nt, Salmonella enterica enterica serovar Typhi
aacguuguauaaaca

SEQ ID NO: 3604698 - RNA, 16 nt, Salmonella enterica enterica serovar Typhi
aacuaaaaauucaaaa

SEQ ID NO: 3604699 - RNA, 17 nt, Salmonella enterica enterica serovar Typhi
aacuaauggcaauaaua

SEQ ID NO: 3604700 - RNA, 21 nt, Salmonella enterica enterica serovar Typhi
aacuaauuguuuguagaaagu

SEQ ID NO: 3604701 - RNA, 22 nt, Salmonella enterica enterica serovar Typhi
aacuacucguaaucuaaaauua

SEQ ID NO: 3604702 - RNA, 21 nt, Salmonella enterica enterica serovar Typhi
aacuauaauugcuuuuuucca

SEQ ID NO: 3604703 - RNA, 17 nt, Salmonella enterica enterica serovar Typhi
aacuaugccagaauaca

SEQ ID NO: 3604704 - RNA, 22 nt, Salmonella enterica enterica serovar Typhi
aacuauguacgccaagcugcaa

SEQ ID NO: 3604705 - RNA, 20 nt, Salmonella enterica enterica serovar Typhi
aacuauugcugccccggcgc

SEQ ID NO: 3604706 - RNA, 14 nt, Salmonella enterica enterica serovar Typhi
aacucaaucaggcu

SEQ ID NO: 3604707 - RNA, 12 nt, Salmonella enterica enterica serovar Typhi
aacucaggaaau

SEQ ID NO: 3604708 - RNA, 15 nt, Salmonella enterica enterica serovar Typhi
aacucaucaugauau

SEQ ID NO: 3604709 - RNA, 14 nt, Salmonella enterica enterica serovar Typhi
aacucaucgccagc

SEQ ID NO: 3604710 - RNA, 18 nt, Salmonella enterica enterica serovar Typhi
aacucaucggaacaguaa

SEQ ID NO: 3604711 - RNA, 22 nt, Salmonella enterica enterica serovar Typhi
aacucaugccguagaacagcau

SEQ ID NO: 3604712 - RNA, 18 nt, Salmonella enterica enterica serovar Typhi
aacuccaaauaccggauu

SEQ ID NO: 3604713 - RNA, 14 nt, Salmonella enterica enterica serovar Typhi
aacuccaccugauc

SEQ ID NO: 3604714 - RNA, 17 nt, Salmonella enterica enterica serovar Typhi
aacucccgcauauauug

SEQ ID NO: 3604715 - RNA, 21 nt, Salmonella enterica enterica serovar Typhi
aacuccggacguacccaggcg

SEQ ID NO: 3604716 - RNA, 13 nt, Salmonella enterica enterica serovar Typhi
aacuccuccggcg

SEQ ID NO: 3604717 - RNA, 21 nt, Salmonella enterica enterica serovar Typhi
aacuccuccgggaaaacauca

SEQ ID NO: 3604718 - RNA, 16 nt, Salmonella enterica enterica serovar Typhi
aacuccugggcaaaau

SEQ ID NO: 3604719 - RNA, 16 nt, Salmonella enterica enterica serovar Typhi
aacucgcacaguacac

SEQ ID NO: 3604720 - RNA, 16 nt, Salmonella enterica enterica serovar Typhi
aacucgccaugccauc

SEQ ID NO: 3604721 - RNA, 14 nt, Salmonella enterica enterica serovar Typhi
aacucuaugcaaaa

SEQ ID NO: 3604722 - RNA, 23 nt, Salmonella enterica enterica serovar Typhi
aacucuaugcaaaagaaaaaacu

SEQ ID NO: 3604723 - RNA, 19 nt, Salmonella enterica enterica serovar Typhi
aacucugcgacgccaggcg

SEQ ID NO: 3604724 - RNA, 21 nt, Salmonella enterica enterica serovar Typhi
aacucuuccgggcugacauaa

SEQ ID NO: 3604725 - RNA, 23 nt, Salmonella enterica enterica serovar Typhi
aacucuuucagaccauaguccau

SEQ ID NO: 3604726 - RNA, 19 nt, Salmonella enterica enterica serovar Typhi
aacucuuuuucagcaaaua

SEQ ID NO: 3604727 - RNA, 13 nt, Salmonella enterica enterica serovar Typhi
aacugacaauuuc

SEQ ID NO: 3604728 - RNA, 21 nt, Salmonella enterica enterica serovar Typhi
aacugaccgauacgaucgucu

SEQ ID NO: 3604729 - RNA, 14 nt, Salmonella enterica enterica serovar Typhi
aacugacgaccggg

SEQ ID NO: 3604730 - RNA, 22 nt, Salmonella enterica enterica serovar Typhi
aacugauccugcguuaacgacc

SEQ ID NO: 3604731 - RNA, 20 nt, Salmonella enterica enterica serovar Typhi
aacugauggcgcuaagccag

SEQ ID NO: 3604732 - RNA, 23 nt, Salmonella enterica enterica serovar Typhi
aacugauggcgcuaagccagcca

SEQ ID NO: 3604733 - RNA, 22 nt, Salmonella enterica enterica serovar Typhi
aacugauuuguaggccugauaa

SEQ ID NO: 3604734 - RNA, 10 nt, Salmonella enterica enterica serovar Typhi
aacugcacca

SEQ ID NO: 3604735 - RNA, 23 nt, Salmonella enterica enterica serovar Typhi
aacugcaccuuuuuuuccagcgu

SEQ ID NO: 3604736 - RNA, 19 nt, Salmonella enterica enterica serovar Typhi
aacugcauaucgccgcuuu

SEQ ID NO: 3604737 - RNA, 19 nt, Salmonella enterica enterica serovar Typhi
aacugccccuugucguaau

SEQ ID NO: 3604738 - RNA, 14 nt, Salmonella enterica enterica serovar Typhi
aacugccgcugacc

SEQ ID NO: 3604739 - RNA, 21 nt, Salmonella enterica enterica serovar Typhi
aacugccggauggcgcugccg

SEQ ID NO: 3604740 - RNA, 17 nt, Salmonella enterica enterica serovar Typhi
aacugcgaaaucaccga

SEQ ID NO: 3604741 - RNA, 16 nt, Salmonella enterica enterica serovar Typhi
aacugcgccaaaucgg

SEQ ID NO: 3604742 - RNA, 15 nt, Salmonella enterica enterica serovar Typhi
aacugcgccugaaga

SEQ ID NO: 3604743 - RNA, 15 nt, Salmonella enterica enterica serovar Typhi
aacugcgccugcuca

SEQ ID NO: 3604744 - RNA, 11 nt, Salmonella enterica enterica serovar Typhi
aacugcggcua

SEQ ID NO: 3604745 - RNA, 20 nt, Salmonella enterica enterica serovar Typhi
aacugcggcuauauaaaauc

SEQ ID NO: 3604746 - RNA, 16 nt, Salmonella enterica enterica serovar Typhi
aacugcucuaccaacu

SEQ ID NO: 3604747 - RNA, 18 nt, Salmonella enterica enterica serovar Typhi
aacugcugcgcgugcugu

SEQ ID NO: 3604748 - RNA, 11 nt, Salmonella enterica enterica serovar Typhi
aacugcugcuc

SEQ ID NO: 3604749 - RNA, 14 nt, Salmonella enterica enterica serovar Typhi
aacugcuguagcac

SEQ ID NO: 3604750 - RNA, 15 nt, Salmonella enterica enterica serovar Typhi
aacuggaagcgauca

SEQ ID NO: 3604751 - RNA, 17 nt, Salmonella enterica enterica serovar Typhi
aacuggaagcgaucaag

SEQ ID NO: 3604752 - RNA, 17 nt, Salmonella enterica enterica serovar Typhi
aacuggcaaucaugcgc

SEQ ID NO: 3604753 - RNA, 22 nt, Salmonella enterica enterica serovar Typhi
aacuggcacgccguuugccaua

SEQ ID NO: 3604754 - RNA, 16 nt, Salmonella enterica enterica serovar Typhi
aacuggcagcagugac

SEQ ID NO: 3604755 - RNA, 17 nt, Salmonella enterica enterica serovar Typhi
aacuggccacagcaaau

SEQ ID NO: 3604756 - RNA, 19 nt, Salmonella enterica enterica serovar Typhi
aacuggcgcaucuggucau

SEQ ID NO: 3604757 - RNA, 16 nt, Salmonella enterica enterica serovar Typhi
aacuggcgccggaguc

SEQ ID NO: 3604758 - RNA, 16 nt, Salmonella enterica enterica serovar Typhi
aacuggguaugcagug

SEQ ID NO: 3604759 - RNA, 19 nt, Salmonella enterica enterica serovar Typhi
aacugggugccgugaauau

SEQ ID NO: 3604760 - RNA, 22 nt, Salmonella enterica enterica serovar Typhi
aacugggugcggcgaacgucgc

SEQ ID NO: 3604761 - RNA, 17 nt, Salmonella enterica enterica serovar Typhi
aacuggugaaacagguu

SEQ ID NO: 3604762 - RNA, 21 nt, Salmonella enterica enterica serovar Typhi
aacugguuaccacaauaaucg

SEQ ID NO: 3604763 - RNA, 19 nt, Salmonella enterica enterica serovar Typhi
aacuguagcaggauauuuu

SEQ ID NO: 3604764 - RNA, 14 nt, Salmonella enterica enterica serovar Typhi
aacugucgccgcua

SEQ ID NO: 3604765 - RNA, 15 nt, Salmonella enterica enterica serovar Typhi
aacuguucagccagc

SEQ ID NO: 3604766 - RNA, 14 nt, Salmonella enterica enterica serovar Typhi
aacuguuuacccac

SEQ ID NO: 3604767 - RNA, 22 nt, Salmonella enterica enterica serovar Typhi
aacuguuuuaccaaaucaauag

SEQ ID NO: 3604768 - RNA, 14 nt, Salmonella enterica enterica serovar Typhi
aacuguuuuucacu

SEQ ID NO: 3604769 - RNA, 23 nt, Salmonella enterica enterica serovar Typhi
aacuuaaauuaaugauuaaaaua

SEQ ID NO: 3604770 - RNA, 20 nt, Salmonella enterica enterica serovar Typhi
aacuuacacuuaccugauua

SEQ ID NO: 3604771 - RNA, 17 nt, Salmonella enterica enterica serovar Typhi
aacuuauugauuuucaa

SEQ ID NO: 3604772 - RNA, 17 nt, Salmonella enterica enterica serovar Typhi
aacuuauuuuauuuuua

SEQ ID NO: 3604773 - RNA, 18 nt, Salmonella enterica enterica serovar Typhi
aacuucaauucagaaagu

SEQ ID NO: 3604774 - RNA, 21 nt, Salmonella enterica enterica serovar Typhi
aacuuccaccaccuccugcug

SEQ ID NO: 3604775 - RNA, 20 nt, Salmonella enterica enterica serovar Typhi
aacuuccgguagguuaaaua

SEQ ID NO: 3604776 - RNA, 13 nt, Salmonella enterica enterica serovar Typhi
aacuuccuuugcc

SEQ ID NO: 3604777 - RNA, 18 nt, Salmonella enterica enterica serovar Typhi
aacuucgcgguuagaaag

SEQ ID NO: 3604778 - RNA, 19 nt, Salmonella enterica enterica serovar Typhi
aacuugaaguuuucgggca

SEQ ID NO: 3604779 - RNA, 15 nt, Salmonella enterica enterica serovar Typhi
aacuugauuccuggc

SEQ ID NO: 3604780 - RNA, 13 nt, Salmonella enterica enterica serovar Typhi
aacuuguaaaaau

SEQ ID NO: 3604781 - RNA, 15 nt, Salmonella enterica enterica serovar Typhi
aacuuuaucaccagc

SEQ ID NO: 3604782 - RNA, 15 nt, Salmonella enterica enterica serovar Typhi
aacuuucagaauaau

SEQ ID NO: 3604783 - RNA, 20 nt, Salmonella enterica enterica serovar Typhi
aacuuugcgccauuucaaua

SEQ ID NO: 3604784 - RNA, 16 nt, Salmonella enterica enterica serovar Typhi
aacuuuuaauuuuuau

SEQ ID NO: 3604785 - RNA, 19 nt, Salmonella enterica enterica serovar Typhi
aacuuuuccuaauuuuuaa

SEQ ID NO: 3604786 - RNA, 16 nt, Salmonella enterica enterica serovar Typhi
aacuuuuggugcccau

SEQ ID NO: 3604787 - RNA, 17 nt, Salmonella enterica enterica serovar Typhi
aagaaaaaacuggugca

SEQ ID NO: 3604788 - RNA, 22 nt, Salmonella enterica enterica serovar Typhi
aagaaacgccgcgcaaagcaau

SEQ ID NO: 3604789 - RNA, 22 nt, Salmonella enterica enterica serovar Typhi
aagaaacgcuuaaagcguucca

SEQ ID NO: 3604790 - RNA, 15 nt, Salmonella enterica enterica serovar Typhi
aagaaagauaaaaua

SEQ ID NO: 3604791 - RNA, 17 nt, Salmonella enterica enterica serovar Typhi
aagaaagggagaauacc

SEQ ID NO: 3604792 - RNA, 17 nt, Salmonella enterica enterica serovar Typhi
aagaaauugggcuucca

SEQ ID NO: 3604793 - RNA, 14 nt, Salmonella enterica enterica serovar Typhi
aagaacaugacggc

SEQ ID NO: 3604794 - RNA, 22 nt, Salmonella enterica enterica serovar Typhi
aagaaccgacugucgaaaccag

SEQ ID NO: 3604795 - RNA, 20 nt, Salmonella enterica enterica serovar Typhi
aagaacgccgcaaacgccga

SEQ ID NO: 3604796 - RNA, 15 nt, Salmonella enterica enterica serovar Typhi
aagaacguguuuuuc

SEQ ID NO: 3604797 - RNA, 19 nt, Salmonella enterica enterica serovar Typhi
aagcgccagauaugaucga

SEQ ID NO: 3604798 - RNA, 23 nt, Salmonella enterica enterica serovar Typhi
aagcgccagauaugaucgaaaau

SEQ ID NO: 3604799 - RNA, 18 nt, Salmonella enterica enterica serovar Typhi
aagcgcccaggccgggcg

SEQ ID NO: 3604800 - RNA, 20 nt, Salmonella enterica enterica serovar Typhi
aagcgcccaugaagauguag

SEQ ID NO: 3604801 - RNA, 23 nt, Salmonella enterica enterica serovar Typhi
aagcgccggaugaggacauaaac

SEQ ID NO: 3604802 - RNA, 16 nt, Salmonella enterica enterica serovar Typhi
aagcgccugcugcgca

SEQ ID NO: 3604803 - RNA, 18 nt, Salmonella enterica enterica serovar Typhi
aagcgccuguucaacaug

SEQ ID NO: 3604804 - RNA, 19 nt, Salmonella enterica enterica serovar Typhi
aagcgcgcccaccgaugac

SEQ ID NO: 3604805 - RNA, 13 nt, Salmonella enterica enterica serovar Typhi
aagcgcggacagc

SEQ ID NO: 3604806 - RNA, 14 nt, Salmonella enterica enterica serovar Typhi
aagcgcggcagcag

SEQ ID NO: 3604807 - RNA, 20 nt, Salmonella enterica enterica serovar Typhi
aagcgcgguaaauuucuuga

SEQ ID NO: 3604808 - RNA, 17 nt, Salmonella enterica enterica serovar Typhi
aagcgcuaugcccaccg

SEQ ID NO: 3604809 - RNA, 19 nt, Salmonella enterica enterica serovar Typhi
aagcgcucaugccacgcca

SEQ ID NO: 3604810 - RNA, 23 nt, Salmonella enterica enterica serovar Typhi
aagcggaaaggacguucuucucc

SEQ ID NO: 3604811 - RNA, 17 nt, Salmonella enterica enterica serovar Typhi
aagcggauaagauagca

SEQ ID NO: 3604812 - RNA, 21 nt, Salmonella enterica enterica serovar Typhi
aagcggauaagauagcaggcg

SEQ ID NO: 3604813 - RNA, 22 nt, Salmonella enterica enterica serovar Typhi
aagcggauaagauagcaggcga

SEQ ID NO: 3604814 - RNA, 23 nt, Salmonella enterica enterica serovar Typhi
aagcggcagacgugauuuuggca

SEQ ID NO: 3604815 - RNA, 21 nt, Salmonella enterica enterica serovar Typhi
aagcgguaguuaagcgucagc

SEQ ID NO: 3604816 - RNA, 18 nt, Salmonella enterica enterica serovar Typhi
aagcgguguaaaagccag

SEQ ID NO: 3604817 - RNA, 15 nt, Salmonella enterica enterica serovar Typhi
aagcguaacagcgcu

SEQ ID NO: 3604818 - RNA, 23 nt, Salmonella enterica enterica serovar Typhi
aagcguaacagcgcuaucaggaa

SEQ ID NO: 3604819 - RNA, 12 nt, Salmonella enterica enterica serovar Typhi
aagcguaagcgu

SEQ ID NO: 3604820 - RNA, 20 nt, Salmonella enterica enterica serovar Typhi
aagcguacaugaauaauaau

SEQ ID NO: 3604821 - RNA, 16 nt, Salmonella enterica enterica serovar Typhi
aagcguagccgcgcca

SEQ ID NO: 3604822 - RNA, 19 nt, Salmonella enterica enterica serovar Typhi
aagcguagcgcauccggca

SEQ ID NO: 3604823 - RNA, 12 nt, Salmonella enterica enterica serovar Typhi
aagcguagcgcc

SEQ ID NO: 3604824 - RNA, 13 nt, Salmonella enterica enterica serovar Typhi
aagcguagcgcca

SEQ ID NO: 3604825 - RNA, 22 nt, Salmonella enterica enterica serovar Typhi
aagcguaguacguuccagcguu

SEQ ID NO: 3604826 - RNA, 15 nt, Salmonella enterica enterica serovar Typhi
aagcgucauccggca

SEQ ID NO: 3604827 - RNA, 22 nt, Salmonella enterica enterica serovar Typhi
aagcgucucagauggaaaaaaa

SEQ ID NO: 3604828 - RNA, 23 nt, Salmonella enterica enterica serovar Typhi
aagcgucucagauggaaaaaaag

SEQ ID NO: 3604829 - RNA, 21 nt, Salmonella enterica enterica serovar Typhi
aagcgucuuuaaagccuucau

SEQ ID NO: 3604830 - RNA, 22 nt, Salmonella enterica enterica serovar Typhi
aagcguuaaugcguuuacacag

SEQ ID NO: 3604831 - RNA, 21 nt, Salmonella enterica enterica serovar Typhi
aagcguuagcgucauccggca

SEQ ID NO: 3604832 - RNA, 20 nt, Salmonella enterica enterica serovar Typhi
aagcguugccguaggcaacg

SEQ ID NO: 3604833 - RNA, 16 nt, Salmonella enterica enterica serovar Typhi
aagcguuguaacaaac

SEQ ID NO: 3604834 - RNA, 21 nt, Salmonella enterica enterica serovar Typhi
aagcguuguacggauggggua

SEQ ID NO: 3604835 - RNA, 21 nt, Salmonella enterica enterica serovar Typhi
aagcguuuaauuccaucggca

SEQ ID NO: 3604836 - RNA, 15 nt, Salmonella enterica enterica serovar Typhi
aagcguuucucuugu

SEQ ID NO: 3604837 - RNA, 15 nt, Salmonella enterica enterica serovar Typhi
aagcuaguaaagaaa

SEQ ID NO: 3604838 - RNA, 16 nt, Salmonella enterica enterica serovar Typhi
aagcuauuacaaaaau

SEQ ID NO: 3604839 - RNA, 22 nt, Salmonella enterica enterica serovar Typhi
aagcuauuacaaaaaucaugcc

SEQ ID NO: 3604840 - RNA, 17 nt, Salmonella enterica enterica serovar Typhi
aagcucaacgcaggcug

SEQ ID NO: 3604841 - RNA, 18 nt, Salmonella enterica enterica serovar Typhi
aagcucaacgcaggcugg

SEQ ID NO: 3604842 - RNA, 13 nt, Salmonella enterica enterica serovar Typhi
aagcucagcggca

SEQ ID NO: 3604843 - RNA, 22 nt, Salmonella enterica enterica serovar Typhi
aagcucauuucccaauaguuua

SEQ ID NO: 3604844 - RNA, 21 nt, Salmonella enterica enterica serovar Typhi
aagcugaccagggcaaauuau

SEQ ID NO: 3604845 - RNA, 22 nt, Salmonella enterica enterica serovar Typhi
aagcugagaaaagggcgcacca

SEQ ID NO: 3604846 - RNA, 13 nt, Salmonella enterica enterica serovar Typhi
aagcugauauuuu

SEQ ID NO: 3604847 - RNA, 17 nt, Salmonella enterica enterica serovar Typhi
aagcugcaccaggagca

SEQ ID NO: 3604848 - RNA, 16 nt, Salmonella enterica enterica serovar Typhi
aagcugccgucccagc

SEQ ID NO: 3604849 - RNA, 22 nt, Salmonella enterica enterica serovar Typhi
aagcugcgcggcuuucguaccg

SEQ ID NO: 3604850 - RNA, 15 nt, Salmonella enterica enterica serovar Typhi
aagcugcggcccaga

SEQ ID NO: 3604851 - RNA, 19 nt, Salmonella enterica enterica serovar Typhi
aagcugcggcccagauaac

SEQ ID NO: 3604852 - RNA, 21 nt, Salmonella enterica enterica serovar Typhi
aagcugcggcccagauaacgc

SEQ ID NO: 3604853 - RNA, 17 nt, Salmonella enterica enterica serovar Typhi
aagcuggagccacaucg

SEQ ID NO: 3604854 - RNA, 21 nt, Salmonella enterica enterica serovar Typhi
aagcuggauaccgcgccagcg

SEQ ID NO: 3604855 - RNA, 18 nt, Salmonella enterica enterica serovar Typhi
aagcuggccuucagguuu

SEQ ID NO: 3604856 - RNA, 17 nt, Salmonella enterica enterica serovar Typhi
aagcugguaauccucuu

SEQ ID NO: 3604857 - RNA, 18 nt, Salmonella enterica enterica serovar Typhi
aagcugguagucgagggu

SEQ ID NO: 3604858 - RNA, 19 nt, Salmonella enterica enterica serovar Typhi
aagcuggucgagauacugc

SEQ ID NO: 3604859 - RNA, 21 nt, Salmonella enterica enterica serovar Typhi
aagcugguggcgaguccugcc

SEQ ID NO: 3604860 - RNA, 23 nt, Salmonella enterica enterica serovar Typhi
aagcugguuaaugaccugccgcg

SEQ ID NO: 3604861 - RNA, 23 nt, Salmonella enterica enterica serovar Typhi
aagcuguuaauuugcaucaggcc

SEQ ID NO: 3604862 - RNA, 20 nt, Salmonella enterica enterica serovar Typhi
aagcuguuccggcuucguua

SEQ ID NO: 3604863 - RNA, 13 nt, Salmonella enterica enterica serovar Typhi
aagcuguuguugc

SEQ ID NO: 3604864 - RNA, 21 nt, Salmonella enterica enterica serovar Typhi
aagcuguuucuccguuguugc

SEQ ID NO: 3604865 - RNA, 16 nt, Salmonella enterica enterica serovar Typhi
aagcuucagcaaauaa

SEQ ID NO: 3604866 - RNA, 17 nt, Salmonella enterica enterica serovar Typhi
aagcuucgucaggcggc

SEQ ID NO: 3604867 - RNA, 20 nt, Salmonella enterica enterica serovar Typhi
aagcuugaaagcagucccgc

SEQ ID NO: 3604868 - RNA, 18 nt, Salmonella enterica enterica serovar Typhi
aagcuuucaucuuuaaaa

SEQ ID NO: 3604869 - RNA, 19 nt, Salmonella enterica enterica serovar Typhi
aagcuuucugaauuucacg

SEQ ID NO: 3604870 - RNA, 21 nt, Salmonella enterica enterica serovar Typhi
aagcuuugcguaaaaaacauc

SEQ ID NO: 3604871 - RNA, 22 nt, Salmonella enterica enterica serovar Typhi
aagcuuuuaguuacgcacgcca

SEQ ID NO: 3604872 - RNA, 23 nt, Salmonella enterica enterica serovar Typhi
aagcuuuuucugcgugagccgga

SEQ ID NO: 3604873 - RNA, 11 nt, Salmonella enterica enterica serovar Typhi
aaggaaauuca

SEQ ID NO: 3604874 - RNA, 13 nt, Salmonella enterica enterica serovar Typhi
aaggaagggcgcu

SEQ ID NO: 3604875 - RNA, 21 nt, Salmonella enterica enterica serovar Typhi
aaggauaauaguguuagcguc

SEQ ID NO: 3604876 - RNA, 16 nt, Salmonella enterica enterica serovar Typhi
aaggauacggaaugga

SEQ ID NO: 3604877 - RNA, 17 nt, Salmonella enterica enterica serovar Typhi
aaggauacucagcgacg

SEQ ID NO: 3604878 - RNA, 19 nt, Salmonella enterica enterica serovar Typhi
aaggaugaacucuaugcaa

SEQ ID NO: 3604879 - RNA, 16 nt, Salmonella enterica enterica serovar Typhi
aaggaugacuaaucaa

SEQ ID NO: 3604880 - RNA, 16 nt, Salmonella enterica enterica serovar Typhi
aaggcaaaaugccagc

SEQ ID NO: 3604881 - RNA, 20 nt, Salmonella enterica enterica serovar Typhi
aaggcaaaaugccagcccga

SEQ ID NO: 3604882 - RNA, 22 nt, Salmonella enterica enterica serovar Typhi
aagugccagggcggaagcagau

SEQ ID NO: 3604883 - RNA, 17 nt, Salmonella enterica enterica serovar Typhi
aagugcgcacucagaaa

SEQ ID NO: 3604884 - RNA, 14 nt, Salmonella enterica enterica serovar Typhi
aaguggugggugau

SEQ ID NO: 3604885 - RNA, 18 nt, Salmonella enterica enterica serovar Typhi
aagugguuaacagcgcag

SEQ ID NO: 3604886 - RNA, 16 nt, Salmonella enterica enterica serovar Typhi
aaguguggcaccugcu

SEQ ID NO: 3604887 - RNA, 21 nt, Salmonella enterica enterica serovar Typhi
aaguguguaccagcagcgcca

SEQ ID NO: 3604888 - RNA, 14 nt, Salmonella enterica enterica serovar Typhi
aaguuaaaacgcca

SEQ ID NO: 3604889 - RNA, 21 nt, Salmonella enterica enterica serovar Typhi
aaguuacaggcuccaaguauu

SEQ ID NO: 3604890 - RNA, 15 nt, Salmonella enterica enterica serovar Typhi
aaguucaaacucauu

SEQ ID NO: 3604891 - RNA, 19 nt, Salmonella enterica enterica serovar Typhi
aaguucucguucaacggca

SEQ ID NO: 3604892 - RNA, 15 nt, Salmonella enterica enterica serovar Typhi
aaguugaaaggaaag

SEQ ID NO: 3604893 - RNA, 18 nt, Salmonella enterica enterica serovar Typhi
aaguugacuuuuacgcca

SEQ ID NO: 3604894 - RNA, 23 nt, Salmonella enterica enterica serovar Typhi
aaguugcucggcaauuucuuugu

SEQ ID NO: 3604895 - RNA, 19 nt, Salmonella enterica enterica serovar Typhi
aaguuuaacgcgcguucau

SEQ ID NO: 3604896 - RNA, 15 nt, Salmonella enterica enterica serovar Typhi
aaguuuaauuccgaa

SEQ ID NO: 3604897 - RNA, 19 nt, Salmonella enterica enterica serovar Typhi
aaguuugaaguguuccuga

SEQ ID NO: 3604898 - RNA, 21 nt, Salmonella enterica enterica serovar Typhi
aaguuugaugcaaaugucaga

SEQ ID NO: 3604899 - RNA, 16 nt, Salmonella enterica enterica serovar Typhi
aaguuuuucauaucca

SEQ ID NO: 3604900 - RNA, 14 nt, Salmonella enterica enterica serovar Typhi
aaguuuuuuuaaaa

SEQ ID NO: 3604901 - RNA, 18 nt, Salmonella enterica enterica serovar Typhi
aaguuuuuuuaaaaaacc

SEQ ID NO: 3604902 - RNA, 13 nt, Salmonella enterica enterica serovar Typhi
aauaaaaauaaau

SEQ ID NO: 3604903 - RNA, 14 nt, Salmonella enterica enterica serovar Typhi
aauaaaaauaaaua

SEQ ID NO: 3604904 - RNA, 22 nt, Salmonella enterica enterica serovar Typhi
aauaaaaauaagcuauugcgcu

SEQ ID NO: 3604905 - RNA, 13 nt, Salmonella enterica enterica serovar Typhi
aauaaaaauaauc

SEQ ID NO: 3604906 - RNA, 13 nt, Salmonella enterica enterica serovar Typhi
aauaaaaauuccc

SEQ ID NO: 3604907 - RNA, 15 nt, Salmonella enterica enterica serovar Typhi
aauaaaauucagcgc

SEQ ID NO: 3604908 - RNA, 22 nt, Salmonella enterica enterica serovar Typhi
aauaaacaccauacgacgaucc

SEQ ID NO: 3604909 - RNA, 22 nt, Salmonella enterica enterica serovar Typhi
aauaaacacgauggcaaauaau

SEQ ID NO: 3604910 - RNA, 23 nt, Salmonella enterica enterica serovar Typhi
aauaaacacgauggcaaauaaua

SEQ ID NO: 3604911 - RNA, 16 nt, Salmonella enterica enterica serovar Typhi
aauaaacacuaaauca

SEQ ID NO: 3604912 - RNA, 22 nt, Salmonella enterica enterica serovar Typhi
aauaaacacuuugcgcggauua

SEQ ID NO: 3604913 - RNA, 14 nt, Salmonella enterica enterica serovar Typhi
aauaaacaucagcc

SEQ ID NO: 3604914 - RNA, 15 nt, Salmonella enterica enterica serovar Typhi
aauaaacaucagcca

SEQ ID NO: 3604915 - RNA, 11 nt, Salmonella enterica enterica serovar Typhi
aauaaacuccc

SEQ ID NO: 3604916 - RNA, 23 nt, Salmonella enterica enterica serovar Typhi
aauaaacuguccaguuuuugcau

SEQ ID NO: 3604917 - RNA, 11 nt, Salmonella enterica enterica serovar Typhi
aauaaagaaag

SEQ ID NO: 3604918 - RNA, 21 nt, Salmonella enterica enterica serovar Typhi
aauaaagaaagcauuaaauca

SEQ ID NO: 3604919 - RNA, 16 nt, Salmonella enterica enterica serovar Typhi
aauaaagccagauacg

SEQ ID NO: 3604920 - RNA, 15 nt, Salmonella enterica enterica serovar Typhi
aauaaagccgcccau

SEQ ID NO: 3604921 - RNA, 21 nt, Salmonella enterica enterica serovar Typhi
aauaaaggauuguacuuauua

SEQ ID NO: 3604922 - RNA, 19 nt, Salmonella enterica enterica serovar Typhi
aauaaagugcugaacaaua

SEQ ID NO: 3604923 - RNA, 20 nt, Salmonella enterica enterica serovar Typhi
aauaaagugcugaacaauaa

SEQ ID NO: 3604924 - RNA, 19 nt, Salmonella enterica enterica serovar Typhi
aauaaauaaaaccagcagc

SEQ ID NO: 3604925 - RNA, 14 nt, Salmonella enterica enterica serovar Typhi
aauaaauauucauc

SEQ ID NO: 3604926 - RNA, 22 nt, Salmonella enterica enterica serovar Typhi
aauaaaucacaacguaaucauc

SEQ ID NO: 3604927 - RNA, 23 nt, Salmonella enterica enterica serovar Typhi
aauaacagacuccgucucuuuau

SEQ ID NO: 3604928 - RNA, 16 nt, Salmonella enterica enterica serovar Typhi
aauaacaggaaucauu

SEQ ID NO: 3604929 - RNA, 20 nt, Salmonella enterica enterica serovar Typhi
aauaacaggaaucauucuau

SEQ ID NO: 3604930 - RNA, 22 nt, Salmonella enterica enterica serovar Typhi
aauaacaucguaaaucaaauga

SEQ ID NO: 3604931 - RNA, 14 nt, Salmonella enterica enterica serovar Typhi
aauaaccccagcug

SEQ ID NO: 3604932 - RNA, 12 nt, Salmonella enterica enterica serovar Typhi
aauaaccgccag

SEQ ID NO: 3604933 - RNA, 21 nt, Salmonella enterica enterica serovar Typhi
aauaaccgguaacugucagau

SEQ ID NO: 3604934 - RNA, 20 nt, Salmonella enterica enterica serovar Typhi
aauaacgaacugauggcgcu

SEQ ID NO: 3604935 - RNA, 21 nt, Salmonella enterica enterica serovar Typhi
aauaacgaucuggucgccaag

SEQ ID NO: 3604936 - RNA, 15 nt, Salmonella enterica enterica serovar Typhi
aauaacgaugaugaa

SEQ ID NO: 3604937 - RNA, 19 nt, Salmonella enterica enterica serovar Typhi
aauaacgaugaugaaaaag

SEQ ID NO: 3604938 - RNA, 22 nt, Salmonella enterica enterica serovar Typhi
aauaacgaugaugaaaaagaau

SEQ ID NO: 3604939 - RNA, 19 nt, Salmonella enterica enterica serovar Typhi
aauaacgcacuaccagaaa

SEQ ID NO: 3604940 - RNA, 21 nt, Salmonella enterica enterica serovar Typhi
aauaacgcggcuaaucagggu

SEQ ID NO: 3604941 - RNA, 15 nt, Salmonella enterica enterica serovar Typhi
aauaacgugucagga

SEQ ID NO: 3604942 - RNA, 16 nt, Salmonella enterica enterica serovar Typhi
aauaacuauaauugcu

SEQ ID NO: 3604943 - RNA, 17 nt, Salmonella enterica enterica serovar Typhi
aauaacuauaauugcuu

SEQ ID NO: 3604944 - RNA, 21 nt, Salmonella enterica enterica serovar Typhi
aauaacuauaauugcuuuuuu

SEQ ID NO: 3604945 - RNA, 15 nt, Salmonella enterica enterica serovar Typhi
aauaacugacagacu

SEQ ID NO: 3604946 - RNA, 23 nt, Salmonella enterica enterica serovar Typhi
aauaacuuuuaauuuuuauguca

SEQ ID NO: 3604947 - RNA, 19 nt, Salmonella enterica enterica serovar Typhi
aauaagcgcccaugaagau

SEQ ID NO: 3604948 - RNA, 23 nt, Salmonella enterica enterica serovar Typhi
aauaagcgccgaguagcugagcg

SEQ ID NO: 3604949 - RNA, 12 nt, Salmonella enterica enterica serovar Typhi
aauaaggcuggc

SEQ ID NO: 3604950 - RNA, 13 nt, Salmonella enterica enterica serovar Typhi
aauaaggcuggca

SEQ ID NO: 3604951 - RNA, 23 nt, Salmonella enterica enterica serovar Typhi
aauaauaugccccgacaucagau

SEQ ID NO: 3604952 - RNA, 20 nt, Salmonella enterica enterica serovar Typhi
aauaauauguuccacaauca

SEQ ID NO: 3604953 - RNA, 22 nt, Salmonella enterica enterica serovar Typhi
aauaaucaaccauacauccuga

SEQ ID NO: 3604954 - RNA, 11 nt, Salmonella enterica enterica serovar Typhi
aauaaucacug

SEQ ID NO: 3604955 - RNA, 17 nt, Salmonella enterica enterica serovar Typhi
aauaaucccuucuuuua

SEQ ID NO: 3604956 - RNA, 15 nt, Salmonella enterica enterica serovar Typhi
aauaaucgaaauaaa

SEQ ID NO: 3604957 - RNA, 17 nt, Salmonella enterica enterica serovar Typhi
aauaaucgaaauaaagu

SEQ ID NO: 3604958 - RNA, 18 nt, Salmonella enterica enterica serovar Typhi
aauaaucgcgagaaaaua

SEQ ID NO: 3604959 - RNA, 20 nt, Salmonella enterica enterica serovar Typhi
aauaaucgcgagaaaauaga

SEQ ID NO: 3604960 - RNA, 19 nt, Salmonella enterica enterica serovar Typhi
aauaaugaagacguugaau

SEQ ID NO: 3604961 - RNA, 12 nt, Salmonella enterica enterica serovar Typhi
aauaaugacuaa

SEQ ID NO: 3604962 - RNA, 14 nt, Salmonella enterica enterica serovar Typhi
aauaaugcaaugcc

SEQ ID NO: 3604963 - RNA, 18 nt, Salmonella enterica enterica serovar Typhi
aauaauggcgcgaaaaca

SEQ ID NO: 3604964 - RNA, 20 nt, Salmonella enterica enterica serovar Typhi
aauaauggcgcgaaaacagc

SEQ ID NO: 3604965 - RNA, 22 nt, Salmonella enterica enterica serovar Typhi
aauaauggcgcgaaaacagcug

SEQ ID NO: 3604966 - RNA, 21 nt, Salmonella enterica enterica serovar Typhi
aauaauggggauuaucaggau

SEQ ID NO: 3604967 - RNA, 22 nt, Salmonella enterica enterica serovar Typhi
aauaggccaggcucgccagacc

SEQ ID NO: 3604968 - RNA, 22 nt, Salmonella enterica enterica serovar Typhi
aauaggccggagaaaagaccag

SEQ ID NO: 3604969 - RNA, 21 nt, Salmonella enterica enterica serovar Typhi
aauaggcgaggaaaacauucg

SEQ ID NO: 3604970 - RNA, 13 nt, Salmonella enterica enterica serovar Typhi
aauagguugaaag

SEQ ID NO: 3604971 - RNA, 14 nt, Salmonella enterica enterica serovar Typhi
aauaguaaauagaa

SEQ ID NO: 3604972 - RNA, 18 nt, Salmonella enterica enterica serovar Typhi
aauaguaaauagaaaaua

SEQ ID NO: 3604973 - RNA, 19 nt, Salmonella enterica enterica serovar Typhi
aauaguaaauagaaaauaa

SEQ ID NO: 3604974 - RNA, 21 nt, Salmonella enterica enterica serovar Typhi
aauaguauccauaauuuuccc

SEQ ID NO: 3604975 - RNA, 16 nt, Salmonella enterica enterica serovar Typhi
aauagugacuucugcu

SEQ ID NO: 3604976 - RNA, 16 nt, Salmonella enterica enterica serovar Typhi
aauaguggugcgcauc

SEQ ID NO: 3604977 - RNA, 15 nt, Salmonella enterica enterica serovar Typhi
aauaguucagcgcag

SEQ ID NO: 3604978 - RNA, 20 nt, Salmonella enterica enterica serovar Typhi
aauaguugucagaccuucaa

SEQ ID NO: 3604979 - RNA, 23 nt, Salmonella enterica enterica serovar Typhi
aauaguuuauugagauaauuuau

SEQ ID NO: 3604980 - RNA, 15 nt, Salmonella enterica enterica serovar Typhi
aauauaaccaauuua

SEQ ID NO: 3604981 - RNA, 17 nt, Salmonella enterica enterica serovar Typhi
aauauaaccaauuuaaa

SEQ ID NO: 3604982 - RNA, 20 nt, Salmonella enterica enterica serovar Typhi
aauauacaccugacggcagc

SEQ ID NO: 3604983 - RNA, 12 nt, Salmonella enterica enterica serovar Typhi
aauauacauuca

SEQ ID NO: 3604984 - RNA, 14 nt, Salmonella enterica enterica serovar Typhi
aauauacgccaccu

SEQ ID NO: 3604985 - RNA, 19 nt, Salmonella enterica enterica serovar Typhi
aauauagccguggcuggcg

SEQ ID NO: 3604986 - RNA, 19 nt, Salmonella enterica enterica serovar Typhi
aauauagcuaaugcaauaa

SEQ ID NO: 3604987 - RNA, 17 nt, Salmonella enterica enterica serovar Typhi
aauauaucaggcugagc

SEQ ID NO: 3604988 - RNA, 17 nt, Salmonella enterica enterica serovar Typhi
aauauaucuguuccaca

SEQ ID NO: 3604989 - RNA, 23 nt, Salmonella enterica enterica serovar Typhi
aauauaucuguuccacagaucua

SEQ ID NO: 3604990 - RNA, 16 nt, Salmonella enterica enterica serovar Typhi
aauauaugaaccaaga

SEQ ID NO: 3604991 - RNA, 11 nt, Salmonella enterica enterica serovar Typhi
aauauaugagc

SEQ ID NO: 3604992 - RNA, 15 nt, Salmonella enterica enterica serovar Typhi
aauauauucaucuuu

SEQ ID NO: 3604993 - RNA, 17 nt, Salmonella enterica enterica serovar Typhi
aauauauuucacuucau

SEQ ID NO: 3604994 - RNA, 14 nt, Salmonella enterica enterica serovar Typhi
aauaucaauauaau

SEQ ID NO: 3604995 - RNA, 18 nt, Salmonella enterica enterica serovar Typhi
aauaucaaucagcaaggc

SEQ ID NO: 3604996 - RNA, 20 nt, Salmonella enterica enterica serovar Typhi
aauaucauucgcgucauacu

SEQ ID NO: 3604997 - RNA, 20 nt, Salmonella enterica enterica serovar Typhi
aauaucauugaggucuuugc

SEQ ID NO: 3604998 - RNA, 11 nt, Salmonella enterica enterica serovar Typhi
aauauccauuu

SEQ ID NO: 3604999 - RNA, 20 nt, Salmonella enterica enterica serovar Typhi
aauauccauuugcgacauca

SEQ ID NO: 3605000 - RNA, 23 nt, Salmonella enterica enterica serovar Typhi
aauauccccaucccagaccauuc

SEQ ID NO: 3605001 - RNA, 13 nt, Salmonella enterica enterica serovar Typhi
aauauccccugac

SEQ ID NO: 3605002 - RNA, 14 nt, Salmonella enterica enterica serovar Typhi
aauauccccugaca

SEQ ID NO: 3605003 - RNA, 15 nt, Salmonella enterica enterica serovar Typhi
aauauccgcugcggu

SEQ ID NO: 3605004 - RNA, 12 nt, Salmonella enterica enterica serovar Typhi
aauauccugcgg

SEQ ID NO: 3605005 - RNA, 19 nt, Salmonella enterica enterica serovar Typhi
aauauccuguaacucaucu

SEQ ID NO: 3605006 - RNA, 17 nt, Salmonella enterica enterica serovar Typhi
aauaucgagcggcagua

SEQ ID NO: 3605007 - RNA, 18 nt, Salmonella enterica enterica serovar Typhi
aauaucgauagcauuuuu

SEQ ID NO: 3605008 - RNA, 15 nt, Salmonella enterica enterica serovar Typhi
aauaucgcugccggu

SEQ ID NO: 3605009 - RNA, 14 nt, Salmonella enterica enterica serovar Typhi
aauaucggcaaagu

SEQ ID NO: 3605010 - RNA, 17 nt, Salmonella enterica enterica serovar Typhi
aauaucggguauccauu

SEQ ID NO: 3605011 - RNA, 22 nt, Salmonella enterica enterica serovar Typhi
aauaucucccguuuguauaaau

SEQ ID NO: 3605012 - RNA, 22 nt, Salmonella enterica enterica serovar Typhi
aauaucucuauugcuuauuaga

SEQ ID NO: 3605013 - RNA, 21 nt, Salmonella enterica enterica serovar Typhi
aauaucuguuucauggagauc

SEQ ID NO: 3605014 - RNA, 15 nt, Salmonella enterica enterica serovar Typhi
aauaugaaagagaaa

SEQ ID NO: 3605015 - RNA, 23 nt, Salmonella enterica enterica serovar Typhi
aauaugauauguguaucuugcuu

SEQ ID NO: 3605016 - RNA, 16 nt, Salmonella enterica enterica serovar Typhi
aauaugaucugcacaa

SEQ ID NO: 3605017 - RNA, 16 nt, Salmonella enterica enterica serovar Typhi
aauaugccagauauuu

SEQ ID NO: 3605018 - RNA, 13 nt, Salmonella enterica enterica serovar Typhi
aauaugccaggcu

SEQ ID NO: 3605019 - RNA, 18 nt, Salmonella enterica enterica serovar Typhi
aauaugccaggcuuccug

SEQ ID NO: 3605020 - RNA, 15 nt, Salmonella enterica enterica serovar Typhi
aauaugcgcaaucac

SEQ ID NO: 3605021 - RNA, 17 nt, Salmonella enterica enterica serovar Typhi
aauaugcggcgccauca

SEQ ID NO: 3605022 - RNA, 15 nt, Salmonella enterica enterica serovar Typhi
aauaugcgucagcgc

SEQ ID NO: 3605023 - RNA, 21 nt, Salmonella enterica enterica serovar Typhi
aauaugcucaacuuccagagc

SEQ ID NO: 3605024 - RNA, 14 nt, Salmonella enterica enterica serovar Typhi
aauaugcuggcuua

SEQ ID NO: 3605025 - RNA, 17 nt, Salmonella enterica enterica serovar Typhi
aauaugcuggcuuaacu

SEQ ID NO: 3605026 - RNA, 20 nt, Salmonella enterica enterica serovar Typhi
aauaugcuguuuauggcgcu

SEQ ID NO: 3605027 - RNA, 20 nt, Salmonella enterica enterica serovar Typhi
aauauggcugcgauaaugaa

SEQ ID NO: 3605028 - RNA, 22 nt, Salmonella enterica enterica serovar Typhi
aauauggugaguaauaacaaaa

SEQ ID NO: 3605029 - RNA, 15 nt, Salmonella enterica enterica serovar Typhi
aauaugguuauccag

SEQ ID NO: 3605030 - RNA, 17 nt, Salmonella enterica enterica serovar Typhi
aauauuaacggucuuuc

SEQ ID NO: 3605031 - RNA, 21 nt, Salmonella enterica enterica serovar Typhi
aauauuaaggccgaauuugaa

SEQ ID NO: 3605032 - RNA, 16 nt, Salmonella enterica enterica serovar Typhi
aauauuaaugaauaaa

SEQ ID NO: 3605033 - RNA, 22 nt, Salmonella enterica enterica serovar Typhi
aauauuauugacgcuuucuucc

SEQ ID NO: 3605034 - RNA, 17 nt, Salmonella enterica enterica serovar Typhi
aauauucacgcgaauuc

SEQ ID NO: 3605035 - RNA, 18 nt, Salmonella enterica enterica serovar Typhi
aauauucagaauaugcca

SEQ ID NO: 3605036 - RNA, 16 nt, Salmonella enterica enterica serovar Typhi
aauauucaucaaaaug

SEQ ID NO: 3605037 - RNA, 10 nt, Salmonella enterica enterica serovar Typhi
aauauucauu

SEQ ID NO: 3605038 - RNA, 12 nt, Salmonella enterica enterica serovar Typhi
aauauucgcgcc

SEQ ID NO: 3605039 - RNA, 19 nt, Salmonella enterica enterica serovar Typhi
aauauucgcuucuucggca

SEQ ID NO: 3605040 - RNA, 16 nt, Salmonella enterica enterica serovar Typhi
aauauugaacauuuuu

SEQ ID NO: 3605041 - RNA, 18 nt, Salmonella enterica enterica serovar Typhi
aauauuguuuaacguuuc

SEQ ID NO: 3605042 - RNA, 17 nt, Salmonella enterica enterica serovar Typhi
aauauuugaucacauca

SEQ ID NO: 3605043 - RNA, 21 nt, Salmonella enterica enterica serovar Typhi
aauauuuuuccgcggagagau

SEQ ID NO: 3605044 - RNA, 16 nt, Salmonella enterica enterica serovar Typhi
aaucaaaaacaucgcu

SEQ ID NO: 3605045 - RNA, 17 nt, Salmonella enterica enterica serovar Typhi
aaucaaaaaguuaugcu

SEQ ID NO: 3605046 - RNA, 12 nt, Salmonella enterica enterica serovar Typhi
aaucaaacucac

SEQ ID NO: 3605047 - RNA, 18 nt, Salmonella enterica enterica serovar Typhi
aaucaacgccgccaggau

SEQ ID NO: 3605048 - RNA, 20 nt, Salmonella enterica enterica serovar Typhi
aaucaacgccgccaggauaa

SEQ ID NO: 3605049 - RNA, 18 nt, Salmonella enterica enterica serovar Typhi
aaucaacuccauaauuug

SEQ ID NO: 3605050 - RNA, 13 nt, Salmonella enterica enterica serovar Typhi
aaucaagauuaau

SEQ ID NO: 3605051 - RNA, 16 nt, Salmonella enterica enterica serovar Typhi
aaucaauguauuuaag

SEQ ID NO: 3605052 - RNA, 14 nt, Salmonella enterica enterica serovar Typhi
aaucacaaagccgu

SEQ ID NO: 3605053 - RNA, 22 nt, Salmonella enterica enterica serovar Typhi
aauccggcgccagguaaguuca

SEQ ID NO: 3605054 - RNA, 23 nt, Salmonella enterica enterica serovar Typhi
aauccgugcccgaaucgccgcuu

SEQ ID NO: 3605055 - RNA, 18 nt, Salmonella enterica enterica serovar Typhi
aauccgugcguaaaauau

SEQ ID NO: 3605056 - RNA, 23 nt, Salmonella enterica enterica serovar Typhi
aauccucauuaguucaaguuuag

SEQ ID NO: 3605057 - RNA, 19 nt, Salmonella enterica enterica serovar Typhi
aauccucuaccggaaaaca

SEQ ID NO: 3605058 - RNA, 21 nt, Salmonella enterica enterica serovar Typhi
aauccucuaccggaaaacagc

SEQ ID NO: 3605059 - RNA, 16 nt, Salmonella enterica enterica serovar Typhi
aauccugauuaaguuu

SEQ ID NO: 3605060 - RNA, 15 nt, Salmonella enterica enterica serovar Typhi
aauccugcacccgcc

SEQ ID NO: 3605061 - RNA, 18 nt, Salmonella enterica enterica serovar Typhi
aauccugcacuuccagcc

SEQ ID NO: 3605062 - RNA, 23 nt, Salmonella enterica enterica serovar Typhi
aauccugcuccaucguauagcga

SEQ ID NO: 3605063 - RNA, 17 nt, Salmonella enterica enterica serovar Typhi
aauccugucgucaccag

SEQ ID NO: 3605064 - RNA, 22 nt, Salmonella enterica enterica serovar Typhi
aauccugucgucaccagcaggu

SEQ ID NO: 3605065 - RNA, 15 nt, Salmonella enterica enterica serovar Typhi
aauccuuauuuaaua

SEQ ID NO: 3605066 - RNA, 23 nt, Salmonella enterica enterica serovar Typhi
aauccuucuaccuucacccccau

SEQ ID NO: 3605067 - RNA, 18 nt, Salmonella enterica enterica serovar Typhi
aauccuuguccauguaaa

SEQ ID NO: 3605068 - RNA, 23 nt, Salmonella enterica enterica serovar Typhi
aauccuuguccauguaaacucca

SEQ ID NO: 3605069 - RNA, 19 nt, Salmonella enterica enterica serovar Typhi
aauccuuuauuuaauugcu

SEQ ID NO: 3605070 - RNA, 21 nt, Salmonella enterica enterica serovar Typhi
aauccuuuuucaugcaauaau

SEQ ID NO: 3605071 - RNA, 21 nt, Salmonella enterica enterica serovar Typhi
aaucgaaucguucgccaguga

SEQ ID NO: 3605072 - RNA, 14 nt, Salmonella enterica enterica serovar Typhi
aaucgacaauccgc

SEQ ID NO: 3605073 - RNA, 14 nt, Salmonella enterica enterica serovar Typhi
aaucgagaucagac

SEQ ID NO: 3605074 - RNA, 22 nt, Salmonella enterica enterica serovar Typhi
aaucgagcccagacuuuccagc

SEQ ID NO: 3605075 - RNA, 16 nt, Salmonella enterica enterica serovar Typhi
aaucgaguucgcuuuu

SEQ ID NO: 3605076 - RNA, 14 nt, Salmonella enterica enterica serovar Typhi
aaucgauaagccag

SEQ ID NO: 3605077 - RNA, 19 nt, Salmonella enterica enterica serovar Typhi
aaucgauagcgauuuuuga

SEQ ID NO: 3605078 - RNA, 19 nt, Salmonella enterica enterica serovar Typhi
aaucgauauaauuuuauua

SEQ ID NO: 3605079 - RNA, 22 nt, Salmonella enterica enterica serovar Typhi
aaucgaugccacagcgcauuca

SEQ ID NO: 3605080 - RNA, 19 nt, Salmonella enterica enterica serovar Typhi
aaucgauguaguuguucuu

SEQ ID NO: 3605081 - RNA, 14 nt, Salmonella enterica enterica serovar Typhi
aaucgauuuucucc

SEQ ID NO: 3605082 - RNA, 19 nt, Salmonella enterica enterica serovar Typhi
aaucgcaucauaaauggcu

SEQ ID NO: 3605083 - RNA, 17 nt, Salmonella enterica enterica serovar Typhi
aaucgccagcagcgcga

SEQ ID NO: 3605084 - RNA, 21 nt, Salmonella enterica enterica serovar Typhi
aaucgccaucagcgcgaaaau

SEQ ID NO: 3605085 - RNA, 11 nt, Salmonella enterica enterica serovar Typhi
aaucgccgcuu

SEQ ID NO: 3605086 - RNA, 17 nt, Salmonella enterica enterica serovar Typhi
aaucgccgugaucccaa

SEQ ID NO: 3605087 - RNA, 21 nt, Salmonella enterica enterica serovar Typhi
aaucgccucaaccaacggcgc

SEQ ID NO: 3605088 - RNA, 21 nt, Salmonella enterica enterica serovar Typhi
aaucgcgagaaaauagaggaa

SEQ ID NO: 3605089 - RNA, 20 nt, Salmonella enterica enterica serovar Typhi
aaucgcgauaucaacccagu

SEQ ID NO: 3605090 - RNA, 18 nt, Salmonella enterica enterica serovar Typhi
aaucgcgauccagcccca

SEQ ID NO: 3605091 - RNA, 16 nt, Salmonella enterica enterica serovar Typhi
aaucgcuaaggcggca

SEQ ID NO: 3605092 - RNA, 21 nt, Salmonella enterica enterica serovar Typhi
aaucgcucacccgauaaaauc

SEQ ID NO: 3605093 - RNA, 13 nt, Salmonella enterica enterica serovar Typhi
aaucgcuucacgg

SEQ ID NO: 3605094 - RNA, 19 nt, Salmonella enterica enterica serovar Typhi
aaucggaugccauguuucu

SEQ ID NO: 3605095 - RNA, 20 nt, Salmonella enterica enterica serovar Typhi
aaucggcaaauacaucgcca

SEQ ID NO: 3605096 - RNA, 13 nt, Salmonella enterica enterica serovar Typhi
aaucggcaggcca

SEQ ID NO: 3605097 - RNA, 14 nt, Salmonella enterica enterica serovar Typhi
aaucggccagcgaa

SEQ ID NO: 3605098 - RNA, 17 nt, Salmonella enterica enterica serovar Typhi
aaucggccagcgaaaac

SEQ ID NO: 3605099 - RNA, 20 nt, Salmonella enterica enterica serovar Typhi
aaucggccagcgaaaaccag

SEQ ID NO: 3605100 - RNA, 18 nt, Salmonella enterica enterica serovar Typhi
aaucggcgucuggagcgu

SEQ ID NO: 3605101 - RNA, 18 nt, Salmonella enterica enterica serovar Typhi
aaucggcgucuugccgca

SEQ ID NO: 3605102 - RNA, 13 nt, Salmonella enterica enterica serovar Typhi
aaucggcuucucc

SEQ ID NO: 3605103 - RNA, 17 nt, Salmonella enterica enterica serovar Typhi
aaucgguuaugcgauuu

SEQ ID NO: 3605104 - RNA, 20 nt, Salmonella enterica enterica serovar Typhi
aaucguagcgugcgcaauau

SEQ ID NO: 3605105 - RNA, 22 nt, Salmonella enterica enterica serovar Typhi
aaucguaugcgccugucuuaaa

SEQ ID NO: 3605106 - RNA, 14 nt, Salmonella enterica enterica serovar Typhi
aaucgucacagacc

SEQ ID NO: 3605107 - RNA, 18 nt, Salmonella enterica enterica serovar Typhi
aaucgucgaggaagcugc

SEQ ID NO: 3605108 - RNA, 20 nt, Salmonella enterica enterica serovar Typhi
aaucgucguuccgccaggcg

SEQ ID NO: 3605109 - RNA, 16 nt, Salmonella enterica enterica serovar Typhi
aaucgucucucauccg

SEQ ID NO: 3605110 - RNA, 19 nt, Salmonella enterica enterica serovar Typhi
aaucguucgccagugacaa

SEQ ID NO: 3605111 - RNA, 13 nt, Salmonella enterica enterica serovar Typhi
aaucguuuuaugc

SEQ ID NO: 3605112 - RNA, 14 nt, Salmonella enterica enterica serovar Typhi
aaucguuuuaugcc

SEQ ID NO: 3605113 - RNA, 13 nt, Salmonella enterica enterica serovar Typhi
aaucuaaaauuau

SEQ ID NO: 3605114 - RNA, 17 nt, Salmonella enterica enterica serovar Typhi
aaucuaccagaucgcgg

SEQ ID NO: 3605115 - RNA, 14 nt, Salmonella enterica enterica serovar Typhi
aaucucaauaccac

SEQ ID NO: 3605116 - RNA, 17 nt, Salmonella enterica enterica serovar Typhi
aaucucacugcccauuc

SEQ ID NO: 3605117 - RNA, 20 nt, Salmonella enterica enterica serovar Typhi
aaucucaucugcaaaauaua

SEQ ID NO: 3605118 - RNA, 22 nt, Salmonella enterica enterica serovar Typhi
aaucuccuccggcuucagcaac

SEQ ID NO: 3605119 - RNA, 19 nt, Salmonella enterica enterica serovar Typhi
aaucucgugaucgccaaag

SEQ ID NO: 3605120 - RNA, 16 nt, Salmonella enterica enterica serovar Typhi
aaucucuacgccggcg

SEQ ID NO: 3605121 - RNA, 17 nt, Salmonella enterica enterica serovar Typhi
aaucucuucccagcgca

SEQ ID NO: 3605122 - RNA, 23 nt, Salmonella enterica enterica serovar Typhi
aaucugacgcauccgcuucucua

SEQ ID NO: 3605123 - RNA, 21 nt, Salmonella enterica enterica serovar Typhi
aaucugcauguaguaagccau

SEQ ID NO: 3605124 - RNA, 19 nt, Salmonella enterica enterica serovar Typhi
aaucugccaucagcaccuu

SEQ ID NO: 3605125 - RNA, 17 nt, Salmonella enterica enterica serovar Typhi
aaucugccgucaucgac

SEQ ID NO: 3605126 - RNA, 20 nt, Salmonella enterica enterica serovar Typhi
aaucugccgucaucgacuuc

SEQ ID NO: 3605127 - RNA, 23 nt, Salmonella enterica enterica serovar Typhi
aaucugcgccaaucgcgauauca

SEQ ID NO: 3605128 - RNA, 12 nt, Salmonella enterica enterica serovar Typhi
aaucugcuuuuu

SEQ ID NO: 3605129 - RNA, 13 nt, Salmonella enterica enterica serovar Typhi
aaucuggccuacg

SEQ ID NO: 3605130 - RNA, 19 nt, Salmonella enterica enterica serovar Typhi
aaucuggucggugauauau

SEQ ID NO: 3605131 - RNA, 18 nt, Salmonella enterica enterica serovar Typhi
aaucuggucguaagaauu

SEQ ID NO: 3605132 - RNA, 21 nt, Salmonella enterica enterica serovar Typhi
aaucuggugauaaagcagacc

SEQ ID NO: 3605133 - RNA, 17 nt, Salmonella enterica enterica serovar Typhi
aaucuguucguugcugu

SEQ ID NO: 3605134 - RNA, 15 nt, Salmonella enterica enterica serovar Typhi
aaucuuaccuguucc

SEQ ID NO: 3605135 - RNA, 14 nt, Salmonella enterica enterica serovar Typhi
aaucuugcguacca

SEQ ID NO: 3605136 - RNA, 21 nt, Salmonella enterica enterica serovar Typhi
aaucuuuacacucgcggauaa

SEQ ID NO: 3605137 - RNA, 22 nt, Salmonella enterica enterica serovar Typhi
aaucuuuuauauguugaauauu

SEQ ID NO: 3605138 - RNA, 20 nt, Salmonella enterica enterica serovar Typhi
aauggauuuauggcacauca

SEQ ID NO: 3605139 - RNA, 12 nt, Salmonella enterica enterica serovar Typhi
aauggcaauaau

SEQ ID NO: 3605140 - RNA, 16 nt, Salmonella enterica enterica serovar Typhi
aauggcaauaauacag

SEQ ID NO: 3605141 - RNA, 16 nt, Salmonella enterica enterica serovar Typhi
aauggcaauggcggcg

SEQ ID NO: 3605142 - RNA, 19 nt, Salmonella enterica enterica serovar Typhi
aauggcagaauaaaacagc

SEQ ID NO: 3605143 - RNA, 22 nt, Salmonella enterica enterica serovar Typhi
aauggccgcagcgccauaaaaa

SEQ ID NO: 3605144 - RNA, 11 nt, Salmonella enterica enterica serovar Typhi
aauggccuaca

SEQ ID NO: 3605145 - RNA, 17 nt, Salmonella enterica enterica serovar Typhi
aauggccuugccagcga

SEQ ID NO: 3605146 - RNA, 12 nt, Salmonella enterica enterica serovar Typhi
aauggcgaaaaa

SEQ ID NO: 3605147 - RNA, 21 nt, Salmonella enterica enterica serovar Typhi
aauggcgacgacgcuguuuau

SEQ ID NO: 3605148 - RNA, 19 nt, Salmonella enterica enterica serovar Typhi
aauggcgcgaaaacagcug

SEQ ID NO: 3605149 - RNA, 15 nt, Salmonella enterica enterica serovar Typhi
aauggcgcguuuuau

SEQ ID NO: 3605150 - RNA, 16 nt, Salmonella enterica enterica serovar Typhi
aauggcgcucuuuucc

SEQ ID NO: 3605151 - RNA, 20 nt, Salmonella enterica enterica serovar Typhi
aauggcggagaucuccagau

SEQ ID NO: 3605152 - RNA, 15 nt, Salmonella enterica enterica serovar Typhi
aauggcguugcuggc

SEQ ID NO: 3605153 - RNA, 14 nt, Salmonella enterica enterica serovar Typhi
aauggcuuuguccg

SEQ ID NO: 3605154 - RNA, 21 nt, Salmonella enterica enterica serovar Typhi
aaugggaucuucaaugaacaa

SEQ ID NO: 3605155 - RNA, 16 nt, Salmonella enterica enterica serovar Typhi
aaugggcaggagauga

SEQ ID NO: 3605156 - RNA, 13 nt, Salmonella enterica enterica serovar Typhi
aauggucgcgcca

SEQ ID NO: 3605157 - RNA, 14 nt, Salmonella enterica enterica serovar Typhi
aauggucgcgccag

SEQ ID NO: 3605158 - RNA, 21 nt, Salmonella enterica enterica serovar Typhi
aauggucuuaaaugccgccgg

SEQ ID NO: 3605159 - RNA, 12 nt, Salmonella enterica enterica serovar Typhi
aaugguugcguu

SEQ ID NO: 3605160 - RNA, 13 nt, Salmonella enterica enterica serovar Typhi
aaugguugcguuu

SEQ ID NO: 3605161 - RNA, 15 nt, Salmonella enterica enterica serovar Typhi
aaugguuucccaggu

SEQ ID NO: 3605162 - RNA, 12 nt, Salmonella enterica enterica serovar Typhi
aaugguuuugcc

SEQ ID NO: 3605163 - RNA, 17 nt, Salmonella enterica enterica serovar Typhi
aauguaaaaaaauaaaa

SEQ ID NO: 3605164 - RNA, 20 nt, Salmonella enterica enterica serovar Typhi
aauguaauucaccaaauccu

SEQ ID NO: 3605165 - RNA, 14 nt, Salmonella enterica enterica serovar Typhi
aauguacgccuaaa

SEQ ID NO: 3605166 - RNA, 22 nt, Salmonella enterica enterica serovar Typhi
aauguauaauccaacauuauca

SEQ ID NO: 3605167 - RNA, 22 nt, Salmonella enterica enterica serovar Typhi
aauguauucucccgucagcaac

SEQ ID NO: 3605168 - RNA, 23 nt, Salmonella enterica enterica serovar Typhi
aauguauucucccgucagcaaca

SEQ ID NO: 3605169 - RNA, 20 nt, Salmonella enterica enterica serovar Typhi
aaugucaugacugguuuuuc

SEQ ID NO: 3605170 - RNA, 14 nt, Salmonella enterica enterica serovar Typhi
aaugucaugcgcca

SEQ ID NO: 3605171 - RNA, 17 nt, Salmonella enterica enterica serovar Typhi
aauguccauaaauagau

SEQ ID NO: 3605172 - RNA, 20 nt, Salmonella enterica enterica serovar Typhi
aauguccauaaauagaucau

SEQ ID NO: 3605173 - RNA, 20 nt, Salmonella enterica enterica serovar Typhi
aauguccguuuucgacaugg

SEQ ID NO: 3605174 - RNA, 16 nt, Salmonella enterica enterica serovar Typhi
aaugucgcaaucggcu

SEQ ID NO: 3605175 - RNA, 15 nt, Salmonella enterica enterica serovar Typhi
aaugucgcgcaggcg

SEQ ID NO: 3605176 - RNA, 14 nt, Salmonella enterica enterica serovar Typhi
aaugucgcgucagg

SEQ ID NO: 3605177 - RNA, 17 nt, Salmonella enterica enterica serovar Typhi
aaugucgcgucagguuu

SEQ ID NO: 3605178 - RNA, 16 nt, Salmonella enterica enterica serovar Typhi
aaugucguccaugcug

SEQ ID NO: 3605179 - RNA, 21 nt, Salmonella enterica enterica serovar Typhi
aaugucguuacggcugaagcu

SEQ ID NO: 3605180 - RNA, 13 nt, Salmonella enterica enterica serovar Typhi
aaugucugaauau

SEQ ID NO: 3605181 - RNA, 22 nt, Salmonella enterica enterica serovar Typhi
aaugucugaauauuaaaguuca

SEQ ID NO: 3605182 - RNA, 18 nt, Salmonella enterica enterica serovar Typhi
aaugucuggcgcuaaaau

SEQ ID NO: 3605183 - RNA, 19 nt, Salmonella enterica enterica serovar Typhi
aaugucuggcgcuaaaauc

SEQ ID NO: 3605184 - RNA, 21 nt, Salmonella enterica enterica serovar Typhi
aaugugaaauacagccagguu

SEQ ID NO: 3605185 - RNA, 16 nt, Salmonella enterica enterica serovar Typhi
aaugugauccgccccc

SEQ ID NO: 3605186 - RNA, 23 nt, Salmonella enterica enterica serovar Typhi
aaugugcaaucacacuacacgaa

SEQ ID NO: 3605187 - RNA, 18 nt, Salmonella enterica enterica serovar Typhi
aauguguguacaaccauc

SEQ ID NO: 3605188 - RNA, 18 nt, Salmonella enterica enterica serovar Typhi
aauguucgguauaugaau

SEQ ID NO: 3605189 - RNA, 15 nt, Salmonella enterica enterica serovar Typhi
aauguuguuccagag

SEQ ID NO: 3605190 - RNA, 21 nt, Salmonella enterica enterica serovar Typhi
aauguuuaaucggccagcgaa

SEQ ID NO: 3605191 - RNA, 22 nt, Salmonella enterica enterica serovar Typhi
aauguuuaaucggccagcgaaa

SEQ ID NO: 3605192 - RNA, 20 nt, Salmonella enterica enterica serovar Typhi
aauguuuagucuuuuaguau

SEQ ID NO: 3605193 - RNA, 22 nt, Salmonella enterica enterica serovar Typhi
aauguuuggauuucgucgcuaa

SEQ ID NO: 3605194 - RNA, 11 nt, Salmonella enterica enterica serovar Typhi
aauuaaaaaua

SEQ ID NO: 3605195 - RNA, 21 nt, Salmonella enterica enterica serovar Typhi
aauuaacauuuaagaaacaau

SEQ ID NO: 3605196 - RNA, 13 nt, Salmonella enterica enterica serovar Typhi
aauuaacccacau

SEQ ID NO: 3605197 - RNA, 15 nt, Salmonella enterica enterica serovar Typhi
aauuaacucaucaca

SEQ ID NO: 3605198 - RNA, 23 nt, Salmonella enterica enterica serovar Typhi
aauuaagcaauccauuuuaaaua

SEQ ID NO: 3605199 - RNA, 13 nt, Salmonella enterica enterica serovar Typhi
aauuaauauuuaa

SEQ ID NO: 3605200 - RNA, 12 nt, Salmonella enterica enterica serovar Typhi
aauuaaucaggc

SEQ ID NO: 3605201 - RNA, 17 nt, Salmonella enterica enterica serovar Typhi
aauuaaucccaacccga

SEQ ID NO: 3605202 - RNA, 17 nt, Salmonella enterica enterica serovar Typhi
aauuaaugauuaaaaua

SEQ ID NO: 3605203 - RNA, 17 nt, Salmonella enterica enterica serovar Typhi
aauuacaucaauaaaca

SEQ ID NO: 3605204 - RNA, 17 nt, Salmonella enterica enterica serovar Typhi
aauuacgcccaucagcc

SEQ ID NO: 3605205 - RNA, 19 nt, Salmonella enterica enterica serovar Typhi
aauuacuaucuucaaagcc

SEQ ID NO: 3605206 - RNA, 17 nt, Salmonella enterica enterica serovar Typhi
aauuacuuaugauauau

SEQ ID NO: 3605207 - RNA, 18 nt, Salmonella enterica enterica serovar Typhi
aauuagcucgggaauaaa

SEQ ID NO: 3605208 - RNA, 13 nt, Salmonella enterica enterica serovar Typhi
aauuauaaagcau

SEQ ID NO: 3605209 - RNA, 17 nt, Salmonella enterica enterica serovar Typhi
aauuauacacucaacca

SEQ ID NO: 3605210 - RNA, 22 nt, Salmonella enterica enterica serovar Typhi
aauuauauugcguaaaaacccu

SEQ ID NO: 3605211 - RNA, 23 nt, Salmonella enterica enterica serovar Typhi
aauuaucuguugauaaaacacuc

SEQ ID NO: 3605212 - RNA, 16 nt, Salmonella enterica enterica serovar Typhi
aauuaugaccaauguu

SEQ ID NO: 3605213 - RNA, 14 nt, Salmonella enterica enterica serovar Typhi
aauuauuaccaaug

SEQ ID NO: 3605214 - RNA, 22 nt, Salmonella enterica enterica serovar Typhi
aauuauuaucaauuucauauua

SEQ ID NO: 3605215 - RNA, 20 nt, Salmonella enterica enterica serovar Typhi
aauuauuuuuacuuaaaauu

SEQ ID NO: 3605216 - RNA, 19 nt, Salmonella enterica enterica serovar Typhi
aauuauuuuucaaaugauc

SEQ ID NO: 3605217 - RNA, 18 nt, Salmonella enterica enterica serovar Typhi
aauuauuuuuucaugacu

SEQ ID NO: 3605218 - RNA, 12 nt, Salmonella enterica enterica serovar Typhi
aauucaaucacu

SEQ ID NO: 3605219 - RNA, 15 nt, Salmonella enterica enterica serovar Typhi
aauucaccaaauccu

SEQ ID NO: 3605220 - RNA, 18 nt, Salmonella enterica enterica serovar Typhi
aauucacccguuauucau

SEQ ID NO: 3605221 - RNA, 21 nt, Salmonella enterica enterica serovar Typhi
aauucacccguuauucauuca

SEQ ID NO: 3605222 - RNA, 15 nt, Salmonella enterica enterica serovar Typhi
aauucaccgcaugac

SEQ ID NO: 3605223 - RNA, 18 nt, Salmonella enterica enterica serovar Typhi
aauucacgcuucucuggc

SEQ ID NO: 3605224 - RNA, 14 nt, Salmonella enterica enterica serovar Typhi
acaaaccaccacca

SEQ ID NO: 3605225 - RNA, 16 nt, Salmonella enterica enterica serovar Typhi
acaaaccccacccacu

SEQ ID NO: 3605226 - RNA, 16 nt, Salmonella enterica enterica serovar Typhi
acaaacccccagccau

SEQ ID NO: 3605227 - RNA, 22 nt, Salmonella enterica enterica serovar Typhi
acaaacucacguuccccagcac

SEQ ID NO: 3605228 - RNA, 12 nt, Salmonella enterica enterica serovar Typhi
acaaacugcgcu

SEQ ID NO: 3605229 - RNA, 16 nt, Salmonella enterica enterica serovar Typhi
acaaagagcuccccac

SEQ ID NO: 3605230 - RNA, 22 nt, Salmonella enterica enterica serovar Typhi
acaaagagcuccccacgaaagu

SEQ ID NO: 3605231 - RNA, 14 nt, Salmonella enterica enterica serovar Typhi
acaaagccggauau

SEQ ID NO: 3605232 - RNA, 19 nt, Salmonella enterica enterica serovar Typhi
acaaagcgguaaaucgcaa

SEQ ID NO: 3605233 - RNA, 15 nt, Salmonella enterica enterica serovar Typhi
acaaaggccagcagc

SEQ ID NO: 3605234 - RNA, 16 nt, Salmonella enterica enterica serovar Typhi
acaaaggccagcagca

SEQ ID NO: 3605235 - RNA, 19 nt, Salmonella enterica enterica serovar Typhi
acaaaggccagcagcagcu

SEQ ID NO: 3605236 - RNA, 17 nt, Salmonella enterica enterica serovar Typhi
acaaagguuuguuuaau

SEQ ID NO: 3605237 - RNA, 23 nt, Salmonella enterica enterica serovar Typhi
acaaauaacagacgaaaaaaaag

SEQ ID NO: 3605238 - RNA, 13 nt, Salmonella enterica enterica serovar Typhi
acaaauacauggu

SEQ ID NO: 3605239 - RNA, 23 nt, Salmonella enterica enterica serovar Typhi
acaaauagaagccacaaucugau

SEQ ID NO: 3605240 - RNA, 21 nt, Salmonella enterica enterica serovar Typhi
acaaaucacuggagcgcauuu

SEQ ID NO: 3605241 - RNA, 22 nt, Salmonella enterica enterica serovar Typhi
acaaaucaucgguuacuccuua

SEQ ID NO: 3605242 - RNA, 19 nt, Salmonella enterica enterica serovar Typhi
acaaaucgacagccagcau

SEQ ID NO: 3605243 - RNA, 16 nt, Salmonella enterica enterica serovar Typhi
acaaaugacgucagca

SEQ ID NO: 3605244 - RNA, 23 nt, Salmonella enterica enterica serovar Typhi
acaaauuccggcacaaccuggcu

SEQ ID NO: 3605245 - RNA, 15 nt, Salmonella enterica enterica serovar Typhi
acaaauucugaagag

SEQ ID NO: 3605246 - RNA, 16 nt, Salmonella enterica enterica serovar Typhi
acaaauugcagcgcgc

SEQ ID NO: 3605247 - RNA, 12 nt, Salmonella enterica enterica serovar Typhi
acaaauuuaaac

SEQ ID NO: 3605248 - RNA, 13 nt, Salmonella enterica enterica serovar Typhi
acaacaaaaagau

SEQ ID NO: 3605249 - RNA, 21 nt, Salmonella enterica enterica serovar Typhi
acaacaaggauagcuuuguau

SEQ ID NO: 3605250 - RNA, 16 nt, Salmonella enterica enterica serovar Typhi
acaacaucccagaaaa

SEQ ID NO: 3605251 - RNA, 17 nt, Salmonella enterica enterica serovar Typhi
acaacauugaggcuacc

SEQ ID NO: 3605252 - RNA, 18 nt, Salmonella enterica enterica serovar Typhi
acaacauuguuauguuuu

SEQ ID NO: 3605253 - RNA, 12 nt, Salmonella enterica enterica serovar Typhi
acaaccagcgaa

SEQ ID NO: 3605254 - RNA, 21 nt, Salmonella enterica enterica serovar Typhi
acaacccacauuggccccugg

SEQ ID NO: 3605255 - RNA, 16 nt, Salmonella enterica enterica serovar Typhi
acaacccuuuuccgga

SEQ ID NO: 3605256 - RNA, 20 nt, Salmonella enterica enterica serovar Typhi
acaaccugcgcgacggcggc

SEQ ID NO: 3605257 - RNA, 13 nt, Salmonella enterica enterica serovar Typhi
acaacgagauuca

SEQ ID NO: 3605258 - RNA, 19 nt, Salmonella enterica enterica serovar Typhi
acaacgagauucaauaaug

SEQ ID NO: 3605259 - RNA, 19 nt, Salmonella enterica enterica serovar Typhi
acaacgccaucagccgcgc

SEQ ID NO: 3605260 - RNA, 17 nt, Salmonella enterica enterica serovar Typhi
acaacgccgccuggcau

SEQ ID NO: 3605261 - RNA, 21 nt, Salmonella enterica enterica serovar Typhi
acaacgccgguacgcagcagg

SEQ ID NO: 3605262 - RNA, 19 nt, Salmonella enterica enterica serovar Typhi
acaacgcuccagcaguucu

SEQ ID NO: 3605263 - RNA, 16 nt, Salmonella enterica enterica serovar Typhi
acaacggcaauuuuua

SEQ ID NO: 3605264 - RNA, 19 nt, Salmonella enterica enterica serovar Typhi
acaacggcaauuuuuacaa

SEQ ID NO: 3605265 - RNA, 19 nt, Salmonella enterica enterica serovar Typhi
acaacguaauauuaagcag

SEQ ID NO: 3605266 - RNA, 19 nt, Salmonella enterica enterica serovar Typhi
acaacgucaguggaaaaca

SEQ ID NO: 3605267 - RNA, 21 nt, Salmonella enterica enterica serovar Typhi
acaacgucaguggaaaacagc

SEQ ID NO: 3605268 - RNA, 19 nt, Salmonella enterica enterica serovar Typhi
acaacguucggucauggau

SEQ ID NO: 3605269 - RNA, 19 nt, Salmonella enterica enterica serovar Typhi
acaagaacuuaaauuaaug

SEQ ID NO: 3605270 - RNA, 12 nt, Salmonella enterica enterica serovar Typhi
acaagaagggua

SEQ ID NO: 3605271 - RNA, 19 nt, Salmonella enterica enterica serovar Typhi
acaagaaggguauagagca

SEQ ID NO: 3605272 - RNA, 13 nt, Salmonella enterica enterica serovar Typhi
acaagaauaugca

SEQ ID NO: 3605273 - RNA, 21 nt, Salmonella enterica enterica serovar Typhi
acaagaauuuaucgcaauaua

SEQ ID NO: 3605274 - RNA, 20 nt, Salmonella enterica enterica serovar Typhi
acaagaucaaugugcucaac

SEQ ID NO: 3605275 - RNA, 21 nt, Salmonella enterica enterica serovar Typhi
acaagcaaaccuauuucagua

SEQ ID NO: 3605276 - RNA, 23 nt, Salmonella enterica enterica serovar Typhi
acaagcaguaucguguuauuuuc

SEQ ID NO: 3605277 - RNA, 22 nt, Salmonella enterica enterica serovar Typhi
acaagcaguaugaccccuccgg

SEQ ID NO: 3605278 - RNA, 16 nt, Salmonella enterica enterica serovar Typhi
acaagcagugcuggca

SEQ ID NO: 3605279 - RNA, 22 nt, Salmonella enterica enterica serovar Typhi
acaagccccccgcacagcacau

SEQ ID NO: 3605280 - RNA, 21 nt, Salmonella enterica enterica serovar Typhi
acaagccgccaacgccagcag

SEQ ID NO: 3605281 - RNA, 23 nt, Salmonella enterica enterica serovar Typhi
acaagccgccaacgccagcagcg

SEQ ID NO: 3605282 - RNA, 15 nt, Salmonella enterica enterica serovar Typhi
acaagcgaucgccag

SEQ ID NO: 3605283 - RNA, 15 nt, Salmonella enterica enterica serovar Typhi
acaagcuaaucccca

SEQ ID NO: 3605284 - RNA, 13 nt, Salmonella enterica enterica serovar Typhi
acaagcucauuuc

SEQ ID NO: 3605285 - RNA, 14 nt, Salmonella enterica enterica serovar Typhi
acaaggaaugacac

SEQ ID NO: 3605286 - RNA, 15 nt, Salmonella enterica enterica serovar Typhi
acaaggauauccgcc

SEQ ID NO: 3605287 - RNA, 19 nt, Salmonella enterica enterica serovar Typhi
acaaggcauucaggccgga

SEQ ID NO: 3605288 - RNA, 21 nt, Salmonella enterica enterica serovar Typhi
acaaggucggcuccuggugag

SEQ ID NO: 3605289 - RNA, 21 nt, Salmonella enterica enterica serovar Typhi
acaagguugaucaggaaguug

SEQ ID NO: 3605290 - RNA, 15 nt, Salmonella enterica enterica serovar Typhi
acaaguaauaaaaua

SEQ ID NO: 3605291 - RNA, 17 nt, Salmonella enterica enterica serovar Typhi
acaaguaauaaaauaau

SEQ ID NO: 3605292 - RNA, 18 nt, Salmonella enterica enterica serovar Typhi
acaaguaauaaaauaaua

SEQ ID NO: 3605293 - RNA, 20 nt, Salmonella enterica enterica serovar Typhi
acaauaacgccggauauguu

SEQ ID NO: 3605294 - RNA, 19 nt, Salmonella enterica enterica serovar Typhi
acaauaauucgugugauuu

SEQ ID NO: 3605295 - RNA, 12 nt, Salmonella enterica enterica serovar Typhi
acaauaccaaua

SEQ ID NO: 3605296 - RNA, 17 nt, Salmonella enterica enterica serovar Typhi
acaauaccaauaagaac

SEQ ID NO: 3605297 - RNA, 19 nt, Salmonella enterica enterica serovar Typhi
acaauacuuaaaccugcgc

SEQ ID NO: 3605298 - RNA, 14 nt, Salmonella enterica enterica serovar Typhi
acaauaucaucguc

SEQ ID NO: 3605299 - RNA, 23 nt, Salmonella enterica enterica serovar Typhi
acaaucaaauggcuggcgcuauu

SEQ ID NO: 3605300 - RNA, 15 nt, Salmonella enterica enterica serovar Typhi
acaaucacagcgcag

SEQ ID NO: 3605301 - RNA, 16 nt, Salmonella enterica enterica serovar Typhi
acaaucacagcgcaga

SEQ ID NO: 3605302 - RNA, 12 nt, Salmonella enterica enterica serovar Typhi
acaaucagaaga

SEQ ID NO: 3605303 - RNA, 15 nt, Salmonella enterica enterica serovar Typhi
acaaucagcacacua

SEQ ID NO: 3605304 - RNA, 17 nt, Salmonella enterica enterica serovar Typhi
acaaucagcacacuaca

SEQ ID NO: 3605305 - RNA, 13 nt, Salmonella enterica enterica serovar Typhi
acaaucagcacca

SEQ ID NO: 3605306 - RNA, 14 nt, Salmonella enterica enterica serovar Typhi
acaaucagcaccau

SEQ ID NO: 3605307 - RNA, 14 nt, Salmonella enterica enterica serovar Typhi
acaaucagcgcaau

SEQ ID NO: 3605308 - RNA, 20 nt, Salmonella enterica enterica serovar Typhi
acaaucaggcugcggaugau

SEQ ID NO: 3605309 - RNA, 21 nt, Salmonella enterica enterica serovar Typhi
acacguaacugacaauuucca

SEQ ID NO: 3605310 - RNA, 19 nt, Salmonella enterica enterica serovar Typhi
acacguaauucauuacgaa

SEQ ID NO: 3605311 - RNA, 14 nt, Salmonella enterica enterica serovar Typhi
acacguugcgacaa

SEQ ID NO: 3605312 - RNA, 21 nt, Salmonella enterica enterica serovar Typhi
acacguuugcccgaugucgcu

SEQ ID NO: 3605313 - RNA, 13 nt, Salmonella enterica enterica serovar Typhi
acacuaaaucaua

SEQ ID NO: 3605314 - RNA, 18 nt, Salmonella enterica enterica serovar Typhi
acacucacaaaacuauuu

SEQ ID NO: 3605315 - RNA, 15 nt, Salmonella enterica enterica serovar Typhi
acacuccgcgcaugu

SEQ ID NO: 3605316 - RNA, 23 nt, Salmonella enterica enterica serovar Typhi
acacuccggcgcgcgcgccaucg

SEQ ID NO: 3605317 - RNA, 12 nt, Salmonella enterica enterica serovar Typhi
acacucgcggau

SEQ ID NO: 3605318 - RNA, 15 nt, Salmonella enterica enterica serovar Typhi
acacugccaccgcuc

SEQ ID NO: 3605319 - RNA, 22 nt, Salmonella enterica enterica serovar Typhi
acacuggaaacagccaaucaua

SEQ ID NO: 3605320 - RNA, 22 nt, Salmonella enterica enterica serovar Typhi
acacuguugccgacagcggaaa

SEQ ID NO: 3605321 - RNA, 14 nt, Salmonella enterica enterica serovar Typhi
acacuucagccaga

SEQ ID NO: 3605322 - RNA, 21 nt, Salmonella enterica enterica serovar Typhi
acacuugcaacucgcacugau

SEQ ID NO: 3605323 - RNA, 14 nt, Salmonella enterica enterica serovar Typhi
acacuuucaucagc

SEQ ID NO: 3605324 - RNA, 22 nt, Salmonella enterica enterica serovar Typhi
acagaaaaucacaaauaacaga

SEQ ID NO: 3605325 - RNA, 15 nt, Salmonella enterica enterica serovar Typhi
acagaagcgccuguc

SEQ ID NO: 3605326 - RNA, 18 nt, Salmonella enterica enterica serovar Typhi
acagaagcgcugguaaau

SEQ ID NO: 3605327 - RNA, 13 nt, Salmonella enterica enterica serovar Typhi
acagaagcggccu

SEQ ID NO: 3605328 - RNA, 23 nt, Salmonella enterica enterica serovar Typhi
acagaagguuauucgccuuucac

SEQ ID NO: 3605329 - RNA, 20 nt, Salmonella enterica enterica serovar Typhi
acagaaugcugaacagccgu

SEQ ID NO: 3605330 - RNA, 13 nt, Salmonella enterica enterica serovar Typhi
acagacaauacca

SEQ ID NO: 3605331 - RNA, 20 nt, Salmonella enterica enterica serovar Typhi
acagacaucggagauuucau

SEQ ID NO: 3605332 - RNA, 22 nt, Salmonella enterica enterica serovar Typhi
acagacccaguacaaacaaaua

SEQ ID NO: 3605333 - RNA, 12 nt, Salmonella enterica enterica serovar Typhi
acagaccgccau

SEQ ID NO: 3605334 - RNA, 19 nt, Salmonella enterica enterica serovar Typhi
acagaccuaaauaagcgcc

SEQ ID NO: 3605335 - RNA, 13 nt, Salmonella enterica enterica serovar Typhi
acagacgaaaaaa

SEQ ID NO: 3605336 - RNA, 16 nt, Salmonella enterica enterica serovar Typhi
acagacgacuccaaua

SEQ ID NO: 3605337 - RNA, 19 nt, Salmonella enterica enterica serovar Typhi
acagacgccuuucagacuu

SEQ ID NO: 3605338 - RNA, 12 nt, Salmonella enterica enterica serovar Typhi
acagacgcugcg

SEQ ID NO: 3605339 - RNA, 15 nt, Salmonella enterica enterica serovar Typhi
acagagaaugcgccg

SEQ ID NO: 3605340 - RNA, 18 nt, Salmonella enterica enterica serovar Typhi
acagagagggaaaaaaau

SEQ ID NO: 3605341 - RNA, 13 nt, Salmonella enterica enterica serovar Typhi
acagaggaaugaa

SEQ ID NO: 3605342 - RNA, 18 nt, Salmonella enterica enterica serovar Typhi
acagaggaaugaaaacga

SEQ ID NO: 3605343 - RNA, 21 nt, Salmonella enterica enterica serovar Typhi
acagagucgcuuaucugcugc

SEQ ID NO: 3605344 - RNA, 14 nt, Salmonella enterica enterica serovar Typhi
acagauaacaccag

SEQ ID NO: 3605345 - RNA, 17 nt, Salmonella enterica enterica serovar Typhi
acagauaagcgucugca

SEQ ID NO: 3605346 - RNA, 16 nt, Salmonella enterica enterica serovar Typhi
acagauacggcgcguc

SEQ ID NO: 3605347 - RNA, 20 nt, Salmonella enterica enterica serovar Typhi
acagauggcgcugcguuucc

SEQ ID NO: 3605348 - RNA, 12 nt, Salmonella enterica enterica serovar Typhi
acagauuaucag

SEQ ID NO: 3605349 - RNA, 16 nt, Salmonella enterica enterica serovar Typhi
acagauuuaauaaucg

SEQ ID NO: 3605350 - RNA, 17 nt, Salmonella enterica enterica serovar Typhi
acagcaaaacgcgcuau

SEQ ID NO: 3605351 - RNA, 14 nt, Salmonella enterica enterica serovar Typhi
acagcaacaucuau

SEQ ID NO: 3605352 - RNA, 13 nt, Salmonella enterica enterica serovar Typhi
acagcaauaaaag

SEQ ID NO: 3605353 - RNA, 13 nt, Salmonella enterica enterica serovar Typhi
acagcaauaucag

SEQ ID NO: 3605354 - RNA, 18 nt, Salmonella enterica enterica serovar Typhi
acagcaauaucagccauu

SEQ ID NO: 3605355 - RNA, 14 nt, Salmonella enterica enterica serovar Typhi
acagcaccagcagg

SEQ ID NO: 3605356 - RNA, 13 nt, Salmonella enterica enterica serovar Typhi
acagcaccaucau

SEQ ID NO: 3605357 - RNA, 20 nt, Salmonella enterica enterica serovar Typhi
acagcacuaacgaggccacc

SEQ ID NO: 3605358 - RNA, 18 nt, Salmonella enterica enterica serovar Typhi
acagcagaauauugcuga

SEQ ID NO: 3605359 - RNA, 17 nt, Salmonella enterica enterica serovar Typhi
acagcaggcuuugcugc

SEQ ID NO: 3605360 - RNA, 21 nt, Salmonella enterica enterica serovar Typhi
acagcaggcuuugcugcugcg

SEQ ID NO: 3605361 - RNA, 15 nt, Salmonella enterica enterica serovar Typhi
acagccaaucauaaa

SEQ ID NO: 3605362 - RNA, 14 nt, Salmonella enterica enterica serovar Typhi
acagccacacugcu

SEQ ID NO: 3605363 - RNA, 13 nt, Salmonella enterica enterica serovar Typhi
acagccagcagcg

SEQ ID NO: 3605364 - RNA, 12 nt, Salmonella enterica enterica serovar Typhi
acagccagcauu

SEQ ID NO: 3605365 - RNA, 14 nt, Salmonella enterica enterica serovar Typhi
acagccauccgacg

SEQ ID NO: 3605366 - RNA, 21 nt, Salmonella enterica enterica serovar Typhi
acagccccccuuugcauuacg

SEQ ID NO: 3605367 - RNA, 16 nt, Salmonella enterica enterica serovar Typhi
acagcccgauaaacaa

SEQ ID NO: 3605368 - RNA, 16 nt, Salmonella enterica enterica serovar Typhi
acagcccuuucaggaa

SEQ ID NO: 3605369 - RNA, 16 nt, Salmonella enterica enterica serovar Typhi
acagccgcauuuuuuc

SEQ ID NO: 3605370 - RNA, 23 nt, Salmonella enterica enterica serovar Typhi
acagccgcuguuuuucaucauca

SEQ ID NO: 3605371 - RNA, 21 nt, Salmonella enterica enterica serovar Typhi
acagccuaaaaaaccggccca

SEQ ID NO: 3605372 - RNA, 23 nt, Salmonella enterica enterica serovar Typhi
acagcgaacaguguaaacgccag

SEQ ID NO: 3605373 - RNA, 13 nt, Salmonella enterica enterica serovar Typhi
acagcgacgccag

SEQ ID NO: 3605374 - RNA, 13 nt, Salmonella enterica enterica serovar Typhi
acagcgaucacgc

SEQ ID NO: 3605375 - RNA, 15 nt, Salmonella enterica enterica serovar Typhi
acagcgccaucagga

SEQ ID NO: 3605376 - RNA, 19 nt, Salmonella enterica enterica serovar Typhi
acagcgcgaccaggaaacc

SEQ ID NO: 3605377 - RNA, 13 nt, Salmonella enterica enterica serovar Typhi
acagcgcgcgcga

SEQ ID NO: 3605378 - RNA, 14 nt, Salmonella enterica enterica serovar Typhi
acagcgcuccacgc

SEQ ID NO: 3605379 - RNA, 23 nt, Salmonella enterica enterica serovar Typhi
acagcgcuuuaguacgcguucac

SEQ ID NO: 3605380 - RNA, 13 nt, Salmonella enterica enterica serovar Typhi
acagcggagagac

SEQ ID NO: 3605381 - RNA, 14 nt, Salmonella enterica enterica serovar Typhi
acagcggcaggcgg

SEQ ID NO: 3605382 - RNA, 15 nt, Salmonella enterica enterica serovar Typhi
acagcggcaggcgga

SEQ ID NO: 3605383 - RNA, 14 nt, Salmonella enterica enterica serovar Typhi
acagcggcgcgcca

SEQ ID NO: 3605384 - RNA, 14 nt, Salmonella enterica enterica serovar Typhi
acagcguaaauaag

SEQ ID NO: 3605385 - RNA, 15 nt, Salmonella enterica enterica serovar Typhi
acagcguacaauggc

SEQ ID NO: 3605386 - RNA, 17 nt, Salmonella enterica enterica serovar Typhi
acagcguacaauggcag

SEQ ID NO: 3605387 - RNA, 20 nt, Salmonella enterica enterica serovar Typhi
acagcguacaauggcaggca

SEQ ID NO: 3605388 - RNA, 15 nt, Salmonella enterica enterica serovar Typhi
acagcguacaggcgg

SEQ ID NO: 3605389 - RNA, 17 nt, Salmonella enterica enterica serovar Typhi
acagcguaggccaggca

SEQ ID NO: 3605390 - RNA, 14 nt, Salmonella enterica enterica serovar Typhi
acagcguauuaagc

SEQ ID NO: 3605391 - RNA, 15 nt, Salmonella enterica enterica serovar Typhi
acagcguauuaagcc

SEQ ID NO: 3605392 - RNA, 20 nt, Salmonella enterica enterica serovar Typhi
acagcguauuaagccaacgu

SEQ ID NO: 3605393 - RNA, 20 nt, Salmonella enterica enterica serovar Typhi
acagcgucauccaguguuaa

SEQ ID NO: 3605394 - RNA, 21 nt, Salmonella enterica enterica serovar Typhi
acagcuggcgauauccgugcc

SEQ ID NO: 3605395 - RNA, 21 nt, Salmonella enterica enterica serovar Typhi
acauacguuuaaagcgcucgu

SEQ ID NO: 3605396 - RNA, 20 nt, Salmonella enterica enterica serovar Typhi
acauacugaaauuucuuuuc

SEQ ID NO: 3605397 - RNA, 22 nt, Salmonella enterica enterica serovar Typhi
acauacugaaauuucuuuucca

SEQ ID NO: 3605398 - RNA, 23 nt, Salmonella enterica enterica serovar Typhi
acauacugaaauuucuuuuccag

SEQ ID NO: 3605399 - RNA, 15 nt, Salmonella enterica enterica serovar Typhi
acauagcauaauaau

SEQ ID NO: 3605400 - RNA, 19 nt, Salmonella enterica enterica serovar Typhi
acauagccgccacccggca

SEQ ID NO: 3605401 - RNA, 20 nt, Salmonella enterica enterica serovar Typhi
acauagccucaagagaugca

SEQ ID NO: 3605402 - RNA, 17 nt, Salmonella enterica enterica serovar Typhi
acauagcuaaauaaaaa

SEQ ID NO: 3605403 - RNA, 19 nt, Salmonella enterica enterica serovar Typhi
acauagcuaaauaaaaaua

SEQ ID NO: 3605404 - RNA, 16 nt, Salmonella enterica enterica serovar Typhi
acauagcuaccgcgcg

SEQ ID NO: 3605405 - RNA, 15 nt, Salmonella enterica enterica serovar Typhi
acauagcugaacaau

SEQ ID NO: 3605406 - RNA, 19 nt, Salmonella enterica enterica serovar Typhi
acauaggcaaacaccucag

SEQ ID NO: 3605407 - RNA, 17 nt, Salmonella enterica enterica serovar Typhi
acauauacucuucgcca

SEQ ID NO: 3605408 - RNA, 13 nt, Salmonella enterica enterica serovar Typhi
acauauacugucu

SEQ ID NO: 3605409 - RNA, 21 nt, Salmonella enterica enterica serovar Typhi
acauauagcagcagucucuac

SEQ ID NO: 3605410 - RNA, 22 nt, Salmonella enterica enterica serovar Typhi
acauauauauccgcuauuacca

SEQ ID NO: 3605411 - RNA, 12 nt, Salmonella enterica enterica serovar Typhi
acauauccaguu

SEQ ID NO: 3605412 - RNA, 16 nt, Salmonella enterica enterica serovar Typhi
acauauccgcgcacag

SEQ ID NO: 3605413 - RNA, 22 nt, Salmonella enterica enterica serovar Typhi
acauaucgcaauugauacauuu

SEQ ID NO: 3605414 - RNA, 19 nt, Salmonella enterica enterica serovar Typhi
acauaucgccggggaaaau

SEQ ID NO: 3605415 - RNA, 20 nt, Salmonella enterica enterica serovar Typhi
acauaucgccggggaaaaua

SEQ ID NO: 3605416 - RNA, 14 nt, Salmonella enterica enterica serovar Typhi
acauauucaauaau

SEQ ID NO: 3605417 - RNA, 15 nt, Salmonella enterica enterica serovar Typhi
acauauucaauaaua

SEQ ID NO: 3605418 - RNA, 23 nt, Salmonella enterica enterica serovar Typhi
acauauucaauaauauuaucaua

SEQ ID NO: 3605419 - RNA, 14 nt, Salmonella enterica enterica serovar Typhi
acauauuccagaag

SEQ ID NO: 3605420 - RNA, 14 nt, Salmonella enterica enterica serovar Typhi
acauauuugcgugu

SEQ ID NO: 3605421 - RNA, 16 nt, Salmonella enterica enterica serovar Typhi
acauauuuuucacaca

SEQ ID NO: 3605422 - RNA, 22 nt, Salmonella enterica enterica serovar Typhi
acauauuuuucacacauaagca

SEQ ID NO: 3605423 - RNA, 19 nt, Salmonella enterica enterica serovar Typhi
acauauuuuuguugaaaua

SEQ ID NO: 3605424 - RNA, 22 nt, Salmonella enterica enterica serovar Typhi
acaucaacaaagggcaccuggg

SEQ ID NO: 3605425 - RNA, 14 nt, Salmonella enterica enterica serovar Typhi
acaucaauaaacau

SEQ ID NO: 3605426 - RNA, 16 nt, Salmonella enterica enterica serovar Typhi
acaucacguucgcgca

SEQ ID NO: 3605427 - RNA, 17 nt, Salmonella enterica enterica serovar Typhi
acaucagcggcacauag

SEQ ID NO: 3605428 - RNA, 21 nt, Salmonella enterica enterica serovar Typhi
acaucaucguuugcgcgcacg

SEQ ID NO: 3605429 - RNA, 21 nt, Salmonella enterica enterica serovar Typhi
acaucaugaugaucuucagcc

SEQ ID NO: 3605430 - RNA, 22 nt, Salmonella enterica enterica serovar Typhi
acaucaugcuugcuuugcggca

SEQ ID NO: 3605431 - RNA, 14 nt, Salmonella enterica enterica serovar Typhi
acauccagacagcc

SEQ ID NO: 3605432 - RNA, 19 nt, Salmonella enterica enterica serovar Typhi
acauccagcgccugcugua

SEQ ID NO: 3605433 - RNA, 12 nt, Salmonella enterica enterica serovar Typhi
acauccagcugu

SEQ ID NO: 3605434 - RNA, 21 nt, Salmonella enterica enterica serovar Typhi
acauccagcuguuuaagcgcc

SEQ ID NO: 3605435 - RNA, 17 nt, Salmonella enterica enterica serovar Typhi
acauccaucacuccuua

SEQ ID NO: 3605436 - RNA, 19 nt, Salmonella enterica enterica serovar Typhi
acauccccgccgagaaaau

SEQ ID NO: 3605437 - RNA, 21 nt, Salmonella enterica enterica serovar Typhi
acauccccgccgagaaaauac

SEQ ID NO: 3605438 - RNA, 21 nt, Salmonella enterica enterica serovar Typhi
acauccccgcguuaagccccu

SEQ ID NO: 3605439 - RNA, 14 nt, Salmonella enterica enterica serovar Typhi
acaucccgaauacg

SEQ ID NO: 3605440 - RNA, 15 nt, Salmonella enterica enterica serovar Typhi
acauccggcggcguc

SEQ ID NO: 3605441 - RNA, 18 nt, Salmonella enterica enterica serovar Typhi
acauccugugaaguaaaa

SEQ ID NO: 3605442 - RNA, 16 nt, Salmonella enterica enterica serovar Typhi
acaucgcaaaauuccg

SEQ ID NO: 3605443 - RNA, 17 nt, Salmonella enterica enterica serovar Typhi
acaucgcaaugccacca

SEQ ID NO: 3605444 - RNA, 16 nt, Salmonella enterica enterica serovar Typhi
acaucgccaccaccag

SEQ ID NO: 3605445 - RNA, 20 nt, Salmonella enterica enterica serovar Typhi
acaucgcccugauggcgcgc

SEQ ID NO: 3605446 - RNA, 17 nt, Salmonella enterica enterica serovar Typhi
acaucgccggagccgcc

SEQ ID NO: 3605447 - RNA, 14 nt, Salmonella enterica enterica serovar Typhi
acaucgcucgcgcc

SEQ ID NO: 3605448 - RNA, 22 nt, Salmonella enterica enterica serovar Typhi
acaucgcucgcgccacgcagau

SEQ ID NO: 3605449 - RNA, 12 nt, Salmonella enterica enterica serovar Typhi
acaucgcugaua

SEQ ID NO: 3605450 - RNA, 15 nt, Salmonella enterica enterica serovar Typhi
acaucgcuggcgcgc

SEQ ID NO: 3605451 - RNA, 17 nt, Salmonella enterica enterica serovar Typhi
acaucguaaaucagcgu

SEQ ID NO: 3605452 - RNA, 24 nt, Salmonella enterica enterica serovar Typhi
acaucgucuuuuaccgcgucgcua

SEQ ID NO: 3605453 - RNA, 22 nt, Salmonella enterica enterica serovar Typhi
acaucugccgcuuugaggauca

SEQ ID NO: 3605454 - RNA, 16 nt, Salmonella enterica enterica serovar Typhi
acaucuguuugagaaa

SEQ ID NO: 3605455 - RNA, 17 nt, Salmonella enterica enterica serovar Typhi
acaucuucuacaugccc

SEQ ID NO: 3605456 - RNA, 13 nt, Salmonella enterica enterica serovar Typhi
acaucuuugccaa

SEQ ID NO: 3605457 - RNA, 22 nt, Salmonella enterica enterica serovar Typhi
acaugaaagaagaaucgcccca

SEQ ID NO: 3605458 - RNA, 17 nt, Salmonella enterica enterica serovar Typhi
acaugaauaauaauaca

SEQ ID NO: 3605459 - RNA, 22 nt, Salmonella enterica enterica serovar Typhi
acaugacauccaugauaaucag

SEQ ID NO: 3605460 - RNA, 18 nt, Salmonella enterica enterica serovar Typhi
acaugaccagcgcaaaca

SEQ ID NO: 3605461 - RNA, 18 nt, Salmonella enterica enterica serovar Typhi
acaugaccugaauauggc

SEQ ID NO: 3605462 - RNA, 20 nt, Salmonella enterica enterica serovar Typhi
acaugaccugaauauggcca

SEQ ID NO: 3605463 - RNA, 20 nt, Salmonella enterica enterica serovar Typhi
acaugacgguucaucgcaga

SEQ ID NO: 3605464 - RNA, 22 nt, Salmonella enterica enterica serovar Typhi
acaugacguauucaccucccug

SEQ ID NO: 3605465 - RNA, 19 nt, Salmonella enterica enterica serovar Typhi
acaugccgacggagacgau

SEQ ID NO: 3605466 - RNA, 23 nt, Salmonella enterica enterica serovar Typhi
acaugccgcuaugcggcguuaau

SEQ ID NO: 3605467 - RNA, 20 nt, Salmonella enterica enterica serovar Typhi
acaugccggugcgagaaaaa

SEQ ID NO: 3605468 - RNA, 17 nt, Salmonella enterica enterica serovar Typhi
acaugcgcagaaaggcg

SEQ ID NO: 3605469 - RNA, 17 nt, Salmonella enterica enterica serovar Typhi
acaugcguaccugcgcg

SEQ ID NO: 3605470 - RNA, 21 nt, Salmonella enterica enterica serovar Typhi
acauggacaccggaagugaau

SEQ ID NO: 3605471 - RNA, 22 nt, Salmonella enterica enterica serovar Typhi
acauggacaccggaagugaauu

SEQ ID NO: 3605472 - RNA, 16 nt, Salmonella enterica enterica serovar Typhi
acauggcaauggcuuc

SEQ ID NO: 3605473 - RNA, 21 nt, Salmonella enterica enterica serovar Typhi
acauggcggucgccauauguu

SEQ ID NO: 3605474 - RNA, 17 nt, Salmonella enterica enterica serovar Typhi
acaugguguuugcggca

SEQ ID NO: 3605475 - RNA, 14 nt, Salmonella enterica enterica serovar Typhi
acauguucagcgca

SEQ ID NO: 3605476 - RNA, 23 nt, Salmonella enterica enterica serovar Typhi
acauguucagcgcagaagcagac

SEQ ID NO: 3605477 - RNA, 18 nt, Salmonella enterica enterica serovar Typhi
acauguuuauguagccag

SEQ ID NO: 3605478 - RNA, 17 nt, Salmonella enterica enterica serovar Typhi
acauuaacgccgcguuc

SEQ ID NO: 3605479 - RNA, 15 nt, Salmonella enterica enterica serovar Typhi
acauuaaucuuaucc

SEQ ID NO: 3605480 - RNA, 13 nt, Salmonella enterica enterica serovar Typhi
acauuacauccuc

SEQ ID NO: 3605481 - RNA, 20 nt, Salmonella enterica enterica serovar Typhi
acauuagcggugcgucaugc

SEQ ID NO: 3605482 - RNA, 14 nt, Salmonella enterica enterica serovar Typhi
acauuaugcgcaug

SEQ ID NO: 3605483 - RNA, 21 nt, Salmonella enterica enterica serovar Typhi
acauuauuaaaaugucuuuuc

SEQ ID NO: 3605484 - RNA, 23 nt, Salmonella enterica enterica serovar Typhi
acauuauucacgcuauguuugcu

SEQ ID NO: 3605485 - RNA, 17 nt, Salmonella enterica enterica serovar Typhi
acauuccugacauuuau

SEQ ID NO: 3605486 - RNA, 15 nt, Salmonella enterica enterica serovar Typhi
acauucgauaaccgc

SEQ ID NO: 3605487 - RNA, 15 nt, Salmonella enterica enterica serovar Typhi
acauucguaacaugc

SEQ ID NO: 3605488 - RNA, 18 nt, Salmonella enterica enterica serovar Typhi
acauucugcuuccagaau

SEQ ID NO: 3605489 - RNA, 22 nt, Salmonella enterica enterica serovar Typhi
acauugagcgucaggccaucgc

SEQ ID NO: 3605490 - RNA, 14 nt, Salmonella enterica enterica serovar Typhi
acauugaguaaaua

SEQ ID NO: 3605491 - RNA, 12 nt, Salmonella enterica enterica serovar Typhi
acauugccccuc

SEQ ID NO: 3605492 - RNA, 15 nt, Salmonella enterica enterica serovar Typhi
acauugccggcauca

SEQ ID NO: 3605493 - RNA, 14 nt, Salmonella enterica enterica serovar Typhi
acauuggcgcggca

SEQ ID NO: 3605494 - RNA, 21 nt, Salmonella enterica enterica serovar Typhi
acauuggcgcggcaggaaugu

SEQ ID NO: 3605495 - RNA, 16 nt, Salmonella enterica enterica serovar Typhi
acauugggucguaaua

SEQ ID NO: 3605496 - RNA, 22 nt, Salmonella enterica enterica serovar Typhi
acauuguaugcaagaacgggcu

SEQ ID NO: 3605497 - RNA, 20 nt, Salmonella enterica enterica serovar Typhi
acauuuaagauuuaaaacaa

SEQ ID NO: 3605498 - RNA, 21 nt, Salmonella enterica enterica serovar Typhi
acauuuaagauuuaaaacaag

SEQ ID NO: 3605499 - RNA, 17 nt, Salmonella enterica enterica serovar Typhi
acauuuacgccagccag

SEQ ID NO: 3605500 - RNA, 15 nt, Salmonella enterica enterica serovar Typhi
acauuucgucaucgc

SEQ ID NO: 3605501 - RNA, 12 nt, Salmonella enterica enterica serovar Typhi
acauuucuuuug

SEQ ID NO: 3605502 - RNA, 13 nt, Salmonella enterica enterica serovar Typhi
acauuuucccaac

SEQ ID NO: 3605503 - RNA, 15 nt, Salmonella enterica enterica serovar Typhi
acauuuuuuucuugc

SEQ ID NO: 3605504 - RNA, 17 nt, Salmonella enterica enterica serovar Typhi
accaaaaacgcccccag

SEQ ID NO: 3605505 - RNA, 20 nt, Salmonella enterica enterica serovar Typhi
accaaaaacgcccccagaua

SEQ ID NO: 3605506 - RNA, 21 nt, Salmonella enterica enterica serovar Typhi
accaaacagcaauuccgccau

SEQ ID NO: 3605507 - RNA, 15 nt, Salmonella enterica enterica serovar Typhi
accaaacgaauuuaa

SEQ ID NO: 3605508 - RNA, 22 nt, Salmonella enterica enterica serovar Typhi
accaaaguccaacuguuaucau

SEQ ID NO: 3605509 - RNA, 15 nt, Salmonella enterica enterica serovar Typhi
accaaaucaauagaa

SEQ ID NO: 3605510 - RNA, 15 nt, Salmonella enterica enterica serovar Typhi
accaaaugcccagcu

SEQ ID NO: 3605511 - RNA, 21 nt, Salmonella enterica enterica serovar Typhi
accaacaaacgcgacaacgcc

SEQ ID NO: 3605512 - RNA, 20 nt, Salmonella enterica enterica serovar Typhi
accaaccaggcaaaccagca

SEQ ID NO: 3605513 - RNA, 15 nt, Salmonella enterica enterica serovar Typhi
accaacccagccugc

SEQ ID NO: 3605514 - RNA, 16 nt, Salmonella enterica enterica serovar Typhi
accaacgcauaaaaac

SEQ ID NO: 3605515 - RNA, 23 nt, Salmonella enterica enterica serovar Typhi
accaacggcgacgcccgccaucu

SEQ ID NO: 3605516 - RNA, 15 nt, Salmonella enterica enterica serovar Typhi
accaacggcgcuggc

SEQ ID NO: 3605517 - RNA, 15 nt, Salmonella enterica enterica serovar Typhi
accaacguuuuuccu

SEQ ID NO: 3605518 - RNA, 16 nt, Salmonella enterica enterica serovar Typhi
accaagucucaggagu

SEQ ID NO: 3605519 - RNA, 19 nt, Salmonella enterica enterica serovar Typhi
accaauaaaggucggcugc

SEQ ID NO: 3605520 - RNA, 22 nt, Salmonella enterica enterica serovar Typhi
accaauaaaggucggcugcccu

SEQ ID NO: 3605521 - RNA, 22 nt, Salmonella enterica enterica serovar Typhi
accaauagagagcgacagcccg

SEQ ID NO: 3605522 - RNA, 13 nt, Salmonella enterica enterica serovar Typhi
accaauagccuug

SEQ ID NO: 3605523 - RNA, 14 nt, Salmonella enterica enterica serovar Typhi
accaauaguaucca

SEQ ID NO: 3605524 - RNA, 15 nt, Salmonella enterica enterica serovar Typhi
accaauaucgccguu

SEQ ID NO: 3605525 - RNA, 17 nt, Salmonella enterica enterica serovar Typhi
accaaugccaaaaaaac

SEQ ID NO: 3605526 - RNA, 18 nt, Salmonella enterica enterica serovar Typhi
accaauggcgcgucuuaa

SEQ ID NO: 3605527 - RNA, 15 nt, Salmonella enterica enterica serovar Typhi
accaaugugcaaaga

SEQ ID NO: 3605528 - RNA, 18 nt, Salmonella enterica enterica serovar Typhi
accaauguuaauaagcag

SEQ ID NO: 3605529 - RNA, 20 nt, Salmonella enterica enterica serovar Typhi
accaauguuaauaagcagaa

SEQ ID NO: 3605530 - RNA, 16 nt, Salmonella enterica enterica serovar Typhi
accaauuccaccaccu

SEQ ID NO: 3605531 - RNA, 17 nt, Salmonella enterica enterica serovar Typhi
accaauuccaccaccuc

SEQ ID NO: 3605532 - RNA, 22 nt, Salmonella enterica enterica serovar Typhi
accacaaacgccgucacaaagc

SEQ ID NO: 3605533 - RNA, 15 nt, Salmonella enterica enterica serovar Typhi
accacaaaggcgcgu

SEQ ID NO: 3605534 - RNA, 14 nt, Salmonella enterica enterica serovar Typhi
accacaacacacgu

SEQ ID NO: 3605535 - RNA, 18 nt, Salmonella enterica enterica serovar Typhi
accacaccugaugguuau

SEQ ID NO: 3605536 - RNA, 21 nt, Salmonella enterica enterica serovar Typhi
accacacggaauccccggcuu

SEQ ID NO: 3605537 - RNA, 15 nt, Salmonella enterica enterica serovar Typhi
accacagccgugucc

SEQ ID NO: 3605538 - RNA, 21 nt, Salmonella enterica enterica serovar Typhi
accacagccuuauaagaacca

SEQ ID NO: 3605539 - RNA, 22 nt, Salmonella enterica enterica serovar Typhi
accacagcggacacccgcagcc

SEQ ID NO: 3605540 - RNA, 17 nt, Salmonella enterica enterica serovar Typhi
accacaggcggaaaaca

SEQ ID NO: 3605541 - RNA, 21 nt, Salmonella enterica enterica serovar Typhi
accacagugacccgccgccag

SEQ ID NO: 3605542 - RNA, 20 nt, Salmonella enterica enterica serovar Typhi
accacaucagaccgccaagc

SEQ ID NO: 3605543 - RNA, 14 nt, Salmonella enterica enterica serovar Typhi
accacauccacccc

SEQ ID NO: 3605544 - RNA, 16 nt, Salmonella enterica enterica serovar Typhi
accacaugaccagcgc

SEQ ID NO: 3605545 - RNA, 17 nt, Salmonella enterica enterica serovar Typhi
accacaugaccagcgcc

SEQ ID NO: 3605546 - RNA, 14 nt, Salmonella enterica enterica serovar Typhi
accacauuuucucg

SEQ ID NO: 3605547 - RNA, 12 nt, Salmonella enterica enterica serovar Typhi
accaccacgccc

SEQ ID NO: 3605548 - RNA, 17 nt, Salmonella enterica enterica serovar Typhi
accaccaggaacgccau

SEQ ID NO: 3605549 - RNA, 16 nt, Salmonella enterica enterica serovar Typhi
accaccaguaaccgcc

SEQ ID NO: 3605550 - RNA, 21 nt, Salmonella enterica enterica serovar Typhi
accaccaguaaccgccacagc

SEQ ID NO: 3605551 - RNA, 14 nt, Salmonella enterica enterica serovar Typhi
accaccaguacaug

SEQ ID NO: 3605552 - RNA, 12 nt, Salmonella enterica enterica serovar Typhi
accacccagcca

SEQ ID NO: 3605553 - RNA, 20 nt, Salmonella enterica enterica serovar Typhi
accacccagccagacgccag

SEQ ID NO: 3605554 - RNA, 17 nt, Salmonella enterica enterica serovar Typhi
accaccccacaguaaug

SEQ ID NO: 3605555 - RNA, 22 nt, Salmonella enterica enterica serovar Typhi
accacccgggaaaaaugacgcc

SEQ ID NO: 3605556 - RNA, 15 nt, Salmonella enterica enterica serovar Typhi
accaccgcccugucc

SEQ ID NO: 3605557 - RNA, 16 nt, Salmonella enterica enterica serovar Typhi
accaccgcgcuagugc

SEQ ID NO: 3605558 - RNA, 13 nt, Salmonella enterica enterica serovar Typhi
accaccguccgag

SEQ ID NO: 3605559 - RNA, 18 nt, Salmonella enterica enterica serovar Typhi
accaccguuuaaucgccc

SEQ ID NO: 3605560 - RNA, 14 nt, Salmonella enterica enterica serovar Typhi
accaccugcuguug

SEQ ID NO: 3605561 - RNA, 16 nt, Salmonella enterica enterica serovar Typhi
accacgacgccggaga

SEQ ID NO: 3605562 - RNA, 15 nt, Salmonella enterica enterica serovar Typhi
accacgcacaugggc

SEQ ID NO: 3605563 - RNA, 19 nt, Salmonella enterica enterica serovar Typhi
accacgccauggccgcagc

SEQ ID NO: 3605564 - RNA, 17 nt, Salmonella enterica enterica serovar Typhi
accacgcccgccgccag

SEQ ID NO: 3605565 - RNA, 15 nt, Salmonella enterica enterica serovar Typhi
accacggcuucagcg

SEQ ID NO: 3605566 - RNA, 18 nt, Salmonella enterica enterica serovar Typhi
accaguaccgucauuucc

SEQ ID NO: 3605567 - RNA, 22 nt, Salmonella enterica enterica serovar Typhi
accaguccagugcgucacuuua

SEQ ID NO: 3605568 - RNA, 14 nt, Salmonella enterica enterica serovar Typhi
accagucccagccc

SEQ ID NO: 3605569 - RNA, 17 nt, Salmonella enterica enterica serovar Typhi
accagucgaccgcagac

SEQ ID NO: 3605570 - RNA, 20 nt, Salmonella enterica enterica serovar Typhi
accagucgaccgcagaccgg

SEQ ID NO: 3605571 - RNA, 20 nt, Salmonella enterica enterica serovar Typhi
accagucggcaaagaccaau

SEQ ID NO: 3605572 - RNA, 22 nt, Salmonella enterica enterica serovar Typhi
accagugaacgucugcacggca

SEQ ID NO: 3605573 - RNA, 22 nt, Salmonella enterica enterica serovar Typhi
accagugcggcaaccaccagca

SEQ ID NO: 3605574 - RNA, 20 nt, Salmonella enterica enterica serovar Typhi
accaguggcggggcagaacc

SEQ ID NO: 3605575 - RNA, 16 nt, Salmonella enterica enterica serovar Typhi
accaguuaauuucuuu

SEQ ID NO: 3605576 - RNA, 14 nt, Salmonella enterica enterica serovar Typhi
accaguucacuccu

SEQ ID NO: 3605577 - RNA, 21 nt, Salmonella enterica enterica serovar Typhi
accaguuguuccgcgcugaug

SEQ ID NO: 3605578 - RNA, 13 nt, Salmonella enterica enterica serovar Typhi
accaguuuuuccg

SEQ ID NO: 3605579 - RNA, 16 nt, Salmonella enterica enterica serovar Typhi
accauaaacaaaacaa

SEQ ID NO: 3605580 - RNA, 19 nt, Salmonella enterica enterica serovar Typhi
accauaaacaaaacaacaa

SEQ ID NO: 3605581 - RNA, 22 nt, Salmonella enterica enterica serovar Typhi
accauaaacggcaccuggaagu

SEQ ID NO: 3605582 - RNA, 18 nt, Salmonella enterica enterica serovar Typhi
accauaaaugaaaugccc

SEQ ID NO: 3605583 - RNA, 14 nt, Salmonella enterica enterica serovar Typhi
accauaauuaccgg

SEQ ID NO: 3605584 - RNA, 19 nt, Salmonella enterica enterica serovar Typhi
accauaccggugcgcccca

SEQ ID NO: 3605585 - RNA, 21 nt, Salmonella enterica enterica serovar Typhi
accauagccguagcccuugau

SEQ ID NO: 3605586 - RNA, 21 nt, Salmonella enterica enterica serovar Typhi
accauaggccagcgucaccuc

SEQ ID NO: 3605587 - RNA, 16 nt, Salmonella enterica enterica serovar Typhi
accauaucgccgcugc

SEQ ID NO: 3605588 - RNA, 14 nt, Salmonella enterica enterica serovar Typhi
accauauucacgca

SEQ ID NO: 3605589 - RNA, 23 nt, Salmonella enterica enterica serovar Typhi
accauauucccacaguuaacgcc

SEQ ID NO: 3605590 - RNA, 16 nt, Salmonella enterica enterica serovar Typhi
accaucaaaaaaaaua

SEQ ID NO: 3605591 - RNA, 20 nt, Salmonella enterica enterica serovar Typhi
accaucaaaaaaaauagcca

SEQ ID NO: 3605592 - RNA, 12 nt, Salmonella enterica enterica serovar Typhi
accaucacugaa

SEQ ID NO: 3605593 - RNA, 14 nt, Salmonella enterica enterica serovar Typhi
accaucaguucagg

SEQ ID NO: 3605594 - RNA, 19 nt, Salmonella enterica enterica serovar Typhi
accaucauuaauauaaucc

SEQ ID NO: 3605595 - RNA, 20 nt, Salmonella enterica enterica serovar Typhi
accaucccagguuauucagg

SEQ ID NO: 3605596 - RNA, 13 nt, Salmonella enterica enterica serovar Typhi
accaucccggcgu

SEQ ID NO: 3605597 - RNA, 16 nt, Salmonella enterica enterica serovar Typhi
accauccgcgccgagg

SEQ ID NO: 3605598 - RNA, 14 nt, Salmonella enterica enterica serovar Typhi
accaucgcgccgcu

SEQ ID NO: 3605599 - RNA, 14 nt, Salmonella enterica enterica serovar Typhi
accaucgcguugua

SEQ ID NO: 3605600 - RNA, 23 nt, Salmonella enterica enterica serovar Typhi
accaucgcguuguaaucgccuga

SEQ ID NO: 3605601 - RNA, 22 nt, Salmonella enterica enterica serovar Typhi
accaucuggcccugacgaaauu

SEQ ID NO: 3605602 - RNA, 21 nt, Salmonella enterica enterica serovar Typhi
accaucuggccuacgcgcuca

SEQ ID NO: 3605603 - RNA, 22 nt, Salmonella enterica enterica serovar Typhi
accaugacgcagggcaauauua

SEQ ID NO: 3605604 - RNA, 17 nt, Salmonella enterica enterica serovar Typhi
accaugauaauaaucau

SEQ ID NO: 3605605 - RNA, 22 nt, Salmonella enterica enterica serovar Typhi
accaugauccguucgaucagcu

SEQ ID NO: 3605606 - RNA, 14 nt, Salmonella enterica enterica serovar Typhi
accaugcugguugg

SEQ ID NO: 3605607 - RNA, 19 nt, Salmonella enterica enterica serovar Typhi
accauuaagacagguaacu

SEQ ID NO: 3605608 - RNA, 21 nt, Salmonella enterica enterica serovar Typhi
accauuacgcccccucgcccu

SEQ ID NO: 3605609 - RNA, 16 nt, Salmonella enterica enterica serovar Typhi
accauuaucgcuccgg

SEQ ID NO: 3605610 - RNA, 22 nt, Salmonella enterica enterica serovar Typhi
accauucuucaacaaucguuaa

SEQ ID NO: 3605611 - RNA, 16 nt, Salmonella enterica enterica serovar Typhi
accauugauuuccgcg

SEQ ID NO: 3605612 - RNA, 17 nt, Salmonella enterica enterica serovar Typhi
accauugcguauuucac

SEQ ID NO: 3605613 - RNA, 17 nt, Salmonella enterica enterica serovar Typhi
accauuggcaccaccag

SEQ ID NO: 3605614 - RNA, 23 nt, Salmonella enterica enterica serovar Typhi
accauuggcgcgucaucaauauc

SEQ ID NO: 3605615 - RNA, 22 nt, Salmonella enterica enterica serovar Typhi
accauuguuguaagggcuggaa

SEQ ID NO: 3605616 - RNA, 22 nt, Salmonella enterica enterica serovar Typhi
accauuuauuuaggugcuugag

SEQ ID NO: 3605617 - RNA, 16 nt, Salmonella enterica enterica serovar Typhi
acccaaaaaccccgac

SEQ ID NO: 3605618 - RNA, 13 nt, Salmonella enterica enterica serovar Typhi
acccaacaccaga

SEQ ID NO: 3605619 - RNA, 15 nt, Salmonella enterica enterica serovar Typhi
acccaacaccagacu

SEQ ID NO: 3605620 - RNA, 15 nt, Salmonella enterica enterica serovar Typhi
acccaacgcaaugcg

SEQ ID NO: 3605621 - RNA, 16 nt, Salmonella enterica enterica serovar Typhi
acccaauugaauuuaa

SEQ ID NO: 3605622 - RNA, 17 nt, Salmonella enterica enterica serovar Typhi
acccacaacgcgccaac

SEQ ID NO: 3605623 - RNA, 19 nt, Salmonella enterica enterica serovar Typhi
acccacaagaaaugcaggc

SEQ ID NO: 3605624 - RNA, 13 nt, Salmonella enterica enterica serovar Typhi
acccacacauaga

SEQ ID NO: 3605625 - RNA, 13 nt, Salmonella enterica enterica serovar Typhi
acccacagccggu

SEQ ID NO: 3605626 - RNA, 23 nt, Salmonella enterica enterica serovar Typhi
acccacaguuucauauccgacag

SEQ ID NO: 3605627 - RNA, 13 nt, Salmonella enterica enterica serovar Typhi
acccaccagcagg

SEQ ID NO: 3605628 - RNA, 13 nt, Salmonella enterica enterica serovar Typhi
acccaccagcgcc

SEQ ID NO: 3605629 - RNA, 15 nt, Salmonella enterica enterica serovar Typhi
acccacgccagcagc

SEQ ID NO: 3605630 - RNA, 16 nt, Salmonella enterica enterica serovar Typhi
acccacgccggaaauc

SEQ ID NO: 3605631 - RNA, 21 nt, Salmonella enterica enterica serovar Typhi
acccacggcaaagaccgcguc

SEQ ID NO: 3605632 - RNA, 18 nt, Salmonella enterica enterica serovar Typhi
acccacuguaucgacaua

SEQ ID NO: 3605633 - RNA, 15 nt, Salmonella enterica enterica serovar Typhi
acccacuucuuccag

SEQ ID NO: 3605634 - RNA, 20 nt, Salmonella enterica enterica serovar Typhi
acccacuucuuccagcgugu

SEQ ID NO: 3605635 - RNA, 18 nt, Salmonella enterica enterica serovar Typhi
acccacuuugcuuuucug

SEQ ID NO: 3605636 - RNA, 22 nt, Salmonella enterica enterica serovar Typhi
acccagaaucaguaacacaauc

SEQ ID NO: 3605637 - RNA, 23 nt, Salmonella enterica enterica serovar Typhi
acccagacaaaauucagacucaa

SEQ ID NO: 3605638 - RNA, 13 nt, Salmonella enterica enterica serovar Typhi
acccagacggcga

SEQ ID NO: 3605639 - RNA, 14 nt, Salmonella enterica enterica serovar Typhi
acccagauaucagu

SEQ ID NO: 3605640 - RNA, 19 nt, Salmonella enterica enterica serovar Typhi
acccagauuauggguaaug

SEQ ID NO: 3605641 - RNA, 13 nt, Salmonella enterica enterica serovar Typhi
acccagcagcaga

SEQ ID NO: 3605642 - RNA, 20 nt, Salmonella enterica enterica serovar Typhi
acccagccacaugauguugu

SEQ ID NO: 3605643 - RNA, 17 nt, Salmonella enterica enterica serovar Typhi
acccagccagacgccag

SEQ ID NO: 3605644 - RNA, 18 nt, Salmonella enterica enterica serovar Typhi
acccagcgccaacgccac

SEQ ID NO: 3605645 - RNA, 20 nt, Salmonella enterica enterica serovar Typhi
acccaggugugcggucgcuu

SEQ ID NO: 3605646 - RNA, 21 nt, Salmonella enterica enterica serovar Typhi
acccagguuugcgcggcgggu

SEQ ID NO: 3605647 - RNA, 17 nt, Salmonella enterica enterica serovar Typhi
acccagucgcagccacc

SEQ ID NO: 3605648 - RNA, 14 nt, Salmonella enterica enterica serovar Typhi
acccagugccacca

SEQ ID NO: 3605649 - RNA, 20 nt, Salmonella enterica enterica serovar Typhi
acccaguucaaaucgaugcc

SEQ ID NO: 3605650 - RNA, 18 nt, Salmonella enterica enterica serovar Typhi
acccaguuuuaagcgcag

SEQ ID NO: 3605651 - RNA, 20 nt, Salmonella enterica enterica serovar Typhi
accgaaaucgguacgcgucu

SEQ ID NO: 3605652 - RNA, 18 nt, Salmonella enterica enterica serovar Typhi
accgaagaacauaaacag

SEQ ID NO: 3605653 - RNA, 17 nt, Salmonella enterica enterica serovar Typhi
accgacagauagcccug

SEQ ID NO: 3605654 - RNA, 20 nt, Salmonella enterica enterica serovar Typhi
accgacagauagcccugagc

SEQ ID NO: 3605655 - RNA, 12 nt, Salmonella enterica enterica serovar Typhi
accgaccugccu

SEQ ID NO: 3605656 - RNA, 13 nt, Salmonella enterica enterica serovar Typhi
accgaccugccuu

SEQ ID NO: 3605657 - RNA, 23 nt, Salmonella enterica enterica serovar Typhi
accgacuaaggggguacgcguaa

SEQ ID NO: 3605658 - RNA, 14 nt, Salmonella enterica enterica serovar Typhi
accgacuuucaaau

SEQ ID NO: 3605659 - RNA, 22 nt, Salmonella enterica enterica serovar Typhi
accgagaauguguucucccugc

SEQ ID NO: 3605660 - RNA, 14 nt, Salmonella enterica enterica serovar Typhi
accgagauacgcug

SEQ ID NO: 3605661 - RNA, 13 nt, Salmonella enterica enterica serovar Typhi
accgagcagcuug

SEQ ID NO: 3605662 - RNA, 20 nt, Salmonella enterica enterica serovar Typhi
accgagguucaccagcgcgc

SEQ ID NO: 3605663 - RNA, 24 nt, Salmonella enterica enterica serovar Typhi
accgaguaauguugaugucacuca

SEQ ID NO: 3605664 - RNA, 20 nt, Salmonella enterica enterica serovar Typhi
accgauagagacugccgccg

SEQ ID NO: 3605665 - RNA, 18 nt, Salmonella enterica enterica serovar Typhi
accgauagcuaucacaca

SEQ ID NO: 3605666 - RNA, 19 nt, Salmonella enterica enterica serovar Typhi
accgauauagagcccucug

SEQ ID NO: 3605667 - RNA, 22 nt, Salmonella enterica enterica serovar Typhi
accgaugcaaccgcucuccgca

SEQ ID NO: 3605668 - RNA, 11 nt, Salmonella enterica enterica serovar Typhi
accgaugcagc

SEQ ID NO: 3605669 - RNA, 19 nt, Salmonella enterica enterica serovar Typhi
accgaugccgugaggcuga

SEQ ID NO: 3605670 - RNA, 14 nt, Salmonella enterica enterica serovar Typhi
accgauuccugguu

SEQ ID NO: 3605671 - RNA, 17 nt, Salmonella enterica enterica serovar Typhi
accgauuucaucgcuga

SEQ ID NO: 3605672 - RNA, 21 nt, Salmonella enterica enterica serovar Typhi
accgcaaaccgaauucgucca

SEQ ID NO: 3605673 - RNA, 14 nt, Salmonella enterica enterica serovar Typhi
accgcagaagguca

SEQ ID NO: 3605674 - RNA, 20 nt, Salmonella enterica enterica serovar Typhi
accgcagaaggucacgccgg

SEQ ID NO: 3605675 - RNA, 13 nt, Salmonella enterica enterica serovar Typhi
accgcagccuuga

SEQ ID NO: 3605676 - RNA, 15 nt, Salmonella enterica enterica serovar Typhi
accgcagcgcggccu

SEQ ID NO: 3605677 - RNA, 16 nt, Salmonella enterica enterica serovar Typhi
accgcagcuuauucca

SEQ ID NO: 3605678 - RNA, 14 nt, Salmonella enterica enterica serovar Typhi
accgcauacugaac

SEQ ID NO: 3605679 - RNA, 22 nt, Salmonella enterica enterica serovar Typhi
accgcaucaaugcccagcgcaa

SEQ ID NO: 3605680 - RNA, 15 nt, Salmonella enterica enterica serovar Typhi
accgcaucacgcgaa

SEQ ID NO: 3605681 - RNA, 14 nt, Salmonella enterica enterica serovar Typhi
accgcaucacggca

SEQ ID NO: 3605682 - RNA, 15 nt, Salmonella enterica enterica serovar Typhi
accgcaucgcgccca

SEQ ID NO: 3605683 - RNA, 15 nt, Salmonella enterica enterica serovar Typhi
accgcaucggcauca

SEQ ID NO: 3605684 - RNA, 13 nt, Salmonella enterica enterica serovar Typhi
accgcaugacaau

SEQ ID NO: 3605685 - RNA, 15 nt, Salmonella enterica enterica serovar Typhi
accgcaugacaauau

SEQ ID NO: 3605686 - RNA, 15 nt, Salmonella enterica enterica serovar Typhi
accgcauggaaucga

SEQ ID NO: 3605687 - RNA, 15 nt, Salmonella enterica enterica serovar Typhi
accgccagccauggc

SEQ ID NO: 3605688 - RNA, 22 nt, Salmonella enterica enterica serovar Typhi
accgccagcggcguuuuuuccu

SEQ ID NO: 3605689 - RNA, 15 nt, Salmonella enterica enterica serovar Typhi
accgccagucacccu

SEQ ID NO: 3605690 - RNA, 15 nt, Salmonella enterica enterica serovar Typhi
accgccagucccagc

SEQ ID NO: 3605691 - RNA, 15 nt, Salmonella enterica enterica serovar Typhi
accgccauauauuua

SEQ ID NO: 3605692 - RNA, 15 nt, Salmonella enterica enterica serovar Typhi
accgccaucaaacgc

SEQ ID NO: 3605693 - RNA, 19 nt, Salmonella enterica enterica serovar Typhi
accgccauccggcgauguc

SEQ ID NO: 3605694 - RNA, 20 nt, Salmonella enterica enterica serovar Typhi
accgcccagagaauauuggc

SEQ ID NO: 3605695 - RNA, 19 nt, Salmonella enterica enterica serovar Typhi
accgcccauggaugcgccg

SEQ ID NO: 3605696 - RNA, 20 nt, Salmonella enterica enterica serovar Typhi
accgcccgccgggcgucacc

SEQ ID NO: 3605697 - RNA, 16 nt, Salmonella enterica enterica serovar Typhi
accgccgacaccggcc

SEQ ID NO: 3605698 - RNA, 21 nt, Salmonella enterica enterica serovar Typhi
accgccgacaccggccugccu

SEQ ID NO: 3605699 - RNA, 13 nt, Salmonella enterica enterica serovar Typhi
accgccgcccguc

SEQ ID NO: 3605700 - RNA, 22 nt, Salmonella enterica enterica serovar Typhi
accgccgcgauagaccacgcca

SEQ ID NO: 3605701 - RNA, 22 nt, Salmonella enterica enterica serovar Typhi
accgccgcuuuucagggguccc

SEQ ID NO: 3605702 - RNA, 20 nt, Salmonella enterica enterica serovar Typhi
accgccuacacaaaaucauu

SEQ ID NO: 3605703 - RNA, 14 nt, Salmonella enterica enterica serovar Typhi
accgccuccaggcc

SEQ ID NO: 3605704 - RNA, 19 nt, Salmonella enterica enterica serovar Typhi
accgccucgccaaagcgcu

SEQ ID NO: 3605705 - RNA, 15 nt, Salmonella enterica enterica serovar Typhi
accgccugcgcugau

SEQ ID NO: 3605706 - RNA, 16 nt, Salmonella enterica enterica serovar Typhi
accgccugcguuugcg

SEQ ID NO: 3605707 - RNA, 18 nt, Salmonella enterica enterica serovar Typhi
accgccuuauccggccua

SEQ ID NO: 3605708 - RNA, 14 nt, Salmonella enterica enterica serovar Typhi
accgccuuccugcu

SEQ ID NO: 3605709 - RNA, 17 nt, Salmonella enterica enterica serovar Typhi
accgccuuccugcugcg

SEQ ID NO: 3605710 - RNA, 16 nt, Salmonella enterica enterica serovar Typhi
accgcgaacauuggaa

SEQ ID NO: 3605711 - RNA, 19 nt, Salmonella enterica enterica serovar Typhi
accgcgaauuucaccaccg

SEQ ID NO: 3605712 - RNA, 22 nt, Salmonella enterica enterica serovar Typhi
accgcgacuuggaaaguugcgc

SEQ ID NO: 3605713 - RNA, 21 nt, Salmonella enterica enterica serovar Typhi
accgcgaucgaugugauaaau

SEQ ID NO: 3605714 - RNA, 14 nt, Salmonella enterica enterica serovar Typhi
accgcgcaaucaaa

SEQ ID NO: 3605715 - RNA, 18 nt, Salmonella enterica enterica serovar Typhi
accgcgcaguucaauauu

SEQ ID NO: 3605716 - RNA, 22 nt, Salmonella enterica enterica serovar Typhi
accgcgccacggccaacgcgcc

SEQ ID NO: 3605717 - RNA, 18 nt, Salmonella enterica enterica serovar Typhi
accgcgcgcccgacgcgc

SEQ ID NO: 3605718 - RNA, 13 nt, Salmonella enterica enterica serovar Typhi
accgcgcggcguu

SEQ ID NO: 3605719 - RNA, 14 nt, Salmonella enterica enterica serovar Typhi
accgcgcggcguuc

SEQ ID NO: 3605720 - RNA, 15 nt, Salmonella enterica enterica serovar Typhi
accgcgcggcguucu

SEQ ID NO: 3605721 - RNA, 21 nt, Salmonella enterica enterica serovar Typhi
accgcgcuccuggaaccagug

SEQ ID NO: 3605722 - RNA, 18 nt, Salmonella enterica enterica serovar Typhi
accgcggcaaccagccca

SEQ ID NO: 3605723 - RNA, 14 nt, Salmonella enterica enterica serovar Typhi
accgcguaaaaagu

SEQ ID NO: 3605724 - RNA, 24 nt, Salmonella enterica enterica serovar Typhi
accgcguuuaacgcagcgcgcgua

SEQ ID NO: 3605725 - RNA, 17 nt, Salmonella enterica enterica serovar Typhi
accgcguuugcgcaaca

SEQ ID NO: 3605726 - RNA, 19 nt, Salmonella enterica enterica serovar Typhi
accgcguuugcgcaacaga

SEQ ID NO: 3605727 - RNA, 17 nt, Salmonella enterica enterica serovar Typhi
accgcguuugcgucguu

SEQ ID NO: 3605728 - RNA, 16 nt, Salmonella enterica enterica serovar Typhi
accgcuaaaaaacagg

SEQ ID NO: 3605729 - RNA, 15 nt, Salmonella enterica enterica serovar Typhi
accgcuacccggcac

SEQ ID NO: 3605730 - RNA, 23 nt, Salmonella enterica enterica serovar Typhi
accgcuaucauaccuacaccaac

SEQ ID NO: 3605731 - RNA, 18 nt, Salmonella enterica enterica serovar Typhi
accgcuauucaccagcgu

SEQ ID NO: 3605732 - RNA, 13 nt, Salmonella enterica enterica serovar Typhi
accgcucaauauc

SEQ ID NO: 3605733 - RNA, 21 nt, Salmonella enterica enterica serovar Typhi
accgcucacgguuucaacuuc

SEQ ID NO: 3605734 - RNA, 13 nt, Salmonella enterica enterica serovar Typhi
accgcucaggcgc

SEQ ID NO: 3605735 - RNA, 15 nt, Salmonella enterica enterica serovar Typhi
accgcuccgcgcauc

SEQ ID NO: 3605736 - RNA, 20 nt, Salmonella enterica enterica serovar Typhi
accgcuccgcgcauccggca

SEQ ID NO: 3605737 - RNA, 22 nt, Salmonella enterica enterica serovar Typhi
accgucuucaggucauucagga

SEQ ID NO: 3605738 - RNA, 22 nt, Salmonella enterica enterica serovar Typhi
accgugaauaaugaccagcgcc

SEQ ID NO: 3605739 - RNA, 14 nt, Salmonella enterica enterica serovar Typhi
accgugacugacca

SEQ ID NO: 3605740 - RNA, 14 nt, Salmonella enterica enterica serovar Typhi
accgugauuuuuac

SEQ ID NO: 3605741 - RNA, 18 nt, Salmonella enterica enterica serovar Typhi
accgugauuuuuaccgcc

SEQ ID NO: 3605742 - RNA, 21 nt, Salmonella enterica enterica serovar Typhi
accgugauuuuuaccgccggu

SEQ ID NO: 3605743 - RNA, 14 nt, Salmonella enterica enterica serovar Typhi
accgugcacgcugc

SEQ ID NO: 3605744 - RNA, 15 nt, Salmonella enterica enterica serovar Typhi
accgugcacgcugcg

SEQ ID NO: 3605745 - RNA, 19 nt, Salmonella enterica enterica serovar Typhi
accguggcggcagugggcu

SEQ ID NO: 3605746 - RNA, 14 nt, Salmonella enterica enterica serovar Typhi
accgugugcaguga

SEQ ID NO: 3605747 - RNA, 22 nt, Salmonella enterica enterica serovar Typhi
accgugugcagugacagaggaa

SEQ ID NO: 3605748 - RNA, 21 nt, Salmonella enterica enterica serovar Typhi
accguuaacguuuuacgcugc

SEQ ID NO: 3605749 - RNA, 16 nt, Salmonella enterica enterica serovar Typhi
accguuaggaaagcag

SEQ ID NO: 3605750 - RNA, 19 nt, Salmonella enterica enterica serovar Typhi
accguucacgcucacgcag

SEQ ID NO: 3605751 - RNA, 17 nt, Salmonella enterica enterica serovar Typhi
accguucagaucgccaa

SEQ ID NO: 3605752 - RNA, 18 nt, Salmonella enterica enterica serovar Typhi
accguuccguccgucagg

SEQ ID NO: 3605753 - RNA, 15 nt, Salmonella enterica enterica serovar Typhi
accguucucaauccg

SEQ ID NO: 3605754 - RNA, 23 nt, Salmonella enterica enterica serovar Typhi
accguucuggcugccgucaaagu

SEQ ID NO: 3605755 - RNA, 15 nt, Salmonella enterica enterica serovar Typhi
accguugcgcccauc

SEQ ID NO: 3605756 - RNA, 18 nt, Salmonella enterica enterica serovar Typhi
accguugcgcccaucauc

SEQ ID NO: 3605757 - RNA, 19 nt, Salmonella enterica enterica serovar Typhi
accguugcgcccaucauca

SEQ ID NO: 3605758 - RNA, 17 nt, Salmonella enterica enterica serovar Typhi
accguuggaauaaauca

SEQ ID NO: 3605759 - RNA, 18 nt, Salmonella enterica enterica serovar Typhi
accguuuaaaaacaucau

SEQ ID NO: 3605760 - RNA, 12 nt, Salmonella enterica enterica serovar Typhi
accguuuuccag

SEQ ID NO: 3605761 - RNA, 21 nt, Salmonella enterica enterica serovar Typhi
accguuuuguaggccggauaa

SEQ ID NO: 3605762 - RNA, 20 nt, Salmonella enterica enterica serovar Typhi
accguuuuuuuaugcagccg

SEQ ID NO: 3605763 - RNA, 15 nt, Salmonella enterica enterica serovar Typhi
accuaauagccagcc

SEQ ID NO: 3605764 - RNA, 16 nt, Salmonella enterica enterica serovar Typhi
accuaauagccagccc

SEQ ID NO: 3605765 - RNA, 15 nt, Salmonella enterica enterica serovar Typhi
accuacagaaaauca

SEQ ID NO: 3605766 - RNA, 18 nt, Salmonella enterica enterica serovar Typhi
accuacuguggugugccu

SEQ ID NO: 3605767 - RNA, 19 nt, Salmonella enterica enterica serovar Typhi
accuacuguggugugccug

SEQ ID NO: 3605768 - RNA, 20 nt, Salmonella enterica enterica serovar Typhi
accuacuguggugugccugc

SEQ ID NO: 3605769 - RNA, 15 nt, Salmonella enterica enterica serovar Typhi
accuauccgguugac

SEQ ID NO: 3605770 - RNA, 14 nt, Salmonella enterica enterica serovar Typhi
accuauugaaaaua

SEQ ID NO: 3605771 - RNA, 13 nt, Salmonella enterica enterica serovar Typhi
accuauuuaauaa

SEQ ID NO: 3605772 - RNA, 13 nt, Salmonella enterica enterica serovar Typhi
accuauuuuaaau

SEQ ID NO: 3605773 - RNA, 20 nt, Salmonella enterica enterica serovar Typhi
accuauuuuaaauucccagc

SEQ ID NO: 3605774 - RNA, 20 nt, Salmonella enterica enterica serovar Typhi
accucaaaauggaaaauaau

SEQ ID NO: 3605775 - RNA, 11 nt, Salmonella enterica enterica serovar Typhi
accucaauaug

SEQ ID NO: 3605776 - RNA, 16 nt, Salmonella enterica enterica serovar Typhi
accucaccguccgcca

SEQ ID NO: 3605777 - RNA, 21 nt, Salmonella enterica enterica serovar Typhi
accucaccguccgccaggccc

SEQ ID NO: 3605778 - RNA, 14 nt, Salmonella enterica enterica serovar Typhi
accucagccaccca

SEQ ID NO: 3605779 - RNA, 18 nt, Salmonella enterica enterica serovar Typhi
accucagguaaauccgcc

SEQ ID NO: 3605780 - RNA, 20 nt, Salmonella enterica enterica serovar Typhi
accucagguaaauccgccag

SEQ ID NO: 3605781 - RNA, 13 nt, Salmonella enterica enterica serovar Typhi
accucaucaaaca

SEQ ID NO: 3605782 - RNA, 17 nt, Salmonella enterica enterica serovar Typhi
accucaucaccuacccu

SEQ ID NO: 3605783 - RNA, 13 nt, Salmonella enterica enterica serovar Typhi
accucaucgcuac

SEQ ID NO: 3605784 - RNA, 12 nt, Salmonella enterica enterica serovar Typhi
accucaugcgcc

SEQ ID NO: 3605785 - RNA, 17 nt, Salmonella enterica enterica serovar Typhi
accuccaaagcgcuaca

SEQ ID NO: 3605786 - RNA, 22 nt, Salmonella enterica enterica serovar Typhi
accuccacgcccagcgccgaga

SEQ ID NO: 3605787 - RNA, 19 nt, Salmonella enterica enterica serovar Typhi
accuccagcacgcgcugcg

SEQ ID NO: 3605788 - RNA, 13 nt, Salmonella enterica enterica serovar Typhi
accuccagcgccu

SEQ ID NO: 3605789 - RNA, 19 nt, Salmonella enterica enterica serovar Typhi
accucccgccggggcuccc

SEQ ID NO: 3605790 - RNA, 14 nt, Salmonella enterica enterica serovar Typhi
accuccgcccggug

SEQ ID NO: 3605791 - RNA, 22 nt, Salmonella enterica enterica serovar Typhi
accuccgcccggugcucaauaa

SEQ ID NO: 3605792 - RNA, 19 nt, Salmonella enterica enterica serovar Typhi
accuccggcuaugccggag

SEQ ID NO: 3605793 - RNA, 11 nt, Salmonella enterica enterica serovar Typhi
accuccgggug

SEQ ID NO: 3605794 - RNA, 13 nt, Salmonella enterica enterica serovar Typhi
accuccugcaucg

SEQ ID NO: 3605795 - RNA, 20 nt, Salmonella enterica enterica serovar Typhi
accucgaaaagcgucuucuu

SEQ ID NO: 3605796 - RNA, 20 nt, Salmonella enterica enterica serovar Typhi
accucgcaauauucaugcca

SEQ ID NO: 3605797 - RNA, 16 nt, Salmonella enterica enterica serovar Typhi
accucgccacauucaa

SEQ ID NO: 3605798 - RNA, 15 nt, Salmonella enterica enterica serovar Typhi
accucgccagucagg

SEQ ID NO: 3605799 - RNA, 18 nt, Salmonella enterica enterica serovar Typhi
accucgcgcuuauccgca

SEQ ID NO: 3605800 - RNA, 20 nt, Salmonella enterica enterica serovar Typhi
accucgcuucccugacgcgc

SEQ ID NO: 3605801 - RNA, 23 nt, Salmonella enterica enterica serovar Typhi
accucgcuucccugacgcgcagc

SEQ ID NO: 3605802 - RNA, 18 nt, Salmonella enterica enterica serovar Typhi
accucggguaaagguuug

SEQ ID NO: 3605803 - RNA, 16 nt, Salmonella enterica enterica serovar Typhi
accucguccagauggg

SEQ ID NO: 3605804 - RNA, 13 nt, Salmonella enterica enterica serovar Typhi
accucuaaaugga

SEQ ID NO: 3605805 - RNA, 16 nt, Salmonella enterica enterica serovar Typhi
accucucaccgccuag

SEQ ID NO: 3605806 - RNA, 15 nt, Salmonella enterica enterica serovar Typhi
accucuuccccgguc

SEQ ID NO: 3605807 - RNA, 18 nt, Salmonella enterica enterica serovar Typhi
accucuucguucauccgu

SEQ ID NO: 3605808 - RNA, 22 nt, Salmonella enterica enterica serovar Typhi
accucuugcuggguuaacgcgc

SEQ ID NO: 3605809 - RNA, 13 nt, Salmonella enterica enterica serovar Typhi
accucuuuuuccg

SEQ ID NO: 3605810 - RNA, 14 nt, Salmonella enterica enterica serovar Typhi
accugaaaucagcc

SEQ ID NO: 3605811 - RNA, 15 nt, Salmonella enterica enterica serovar Typhi
accugaaaucagccu

SEQ ID NO: 3605812 - RNA, 16 nt, Salmonella enterica enterica serovar Typhi
accugaaaucagccug

SEQ ID NO: 3605813 - RNA, 22 nt, Salmonella enterica enterica serovar Typhi
accugaagcccuuuagugaauu

SEQ ID NO: 3605814 - RNA, 14 nt, Salmonella enterica enterica serovar Typhi
accugaauauucgg

SEQ ID NO: 3605815 - RNA, 13 nt, Salmonella enterica enterica serovar Typhi
accugaaugcaaa

SEQ ID NO: 3605816 - RNA, 21 nt, Salmonella enterica enterica serovar Typhi
accugaaugcaaagaagggca

SEQ ID NO: 3605817 - RNA, 23 nt, Salmonella enterica enterica serovar Typhi
accugaaugcaaagaagggcagg

SEQ ID NO: 3605818 - RNA, 16 nt, Salmonella enterica enterica serovar Typhi
accugacggcagccac

SEQ ID NO: 3605819 - RNA, 19 nt, Salmonella enterica enterica serovar Typhi
accugagcgugcaauguca

SEQ ID NO: 3605820 - RNA, 18 nt, Salmonella enterica enterica serovar Typhi
accugaggaaaaagcgca

SEQ ID NO: 3605821 - RNA, 23 nt, Salmonella enterica enterica serovar Typhi
accugauauugcguaagcagcug

SEQ ID NO: 3605822 - RNA, 17 nt, Salmonella enterica enterica serovar Typhi
accugauugauacgcgc

SEQ ID NO: 3605823 - RNA, 22 nt, Salmonella enterica enterica serovar Typhi
acgaaugccgauagucuccgcc

SEQ ID NO: 3605824 - RNA, 23 nt, Salmonella enterica enterica serovar Typhi
acgaaugccgauagucuccgcca

SEQ ID NO: 3605825 - RNA, 19 nt, Salmonella enterica enterica serovar Typhi
acgaaugucgcgucagguu

SEQ ID NO: 3605826 - RNA, 15 nt, Salmonella enterica enterica serovar Typhi
acgacaaaaauacca

SEQ ID NO: 3605827 - RNA, 12 nt, Salmonella enterica enterica serovar Typhi
acgacagaauau

SEQ ID NO: 3605828 - RNA, 13 nt, Salmonella enterica enterica serovar Typhi
acgacagaauaug

SEQ ID NO: 3605829 - RNA, 21 nt, Salmonella enterica enterica serovar Typhi
acgacagugcuauacaguaaa

SEQ ID NO: 3605830 - RNA, 23 nt, Salmonella enterica enterica serovar Typhi
acgacauaaccggcaaccaaagu

SEQ ID NO: 3605831 - RNA, 13 nt, Salmonella enterica enterica serovar Typhi
acgaccaaacaag

SEQ ID NO: 3605832 - RNA, 23 nt, Salmonella enterica enterica serovar Typhi
acgaccacucuuuggacggcauc

SEQ ID NO: 3605833 - RNA, 23 nt, Salmonella enterica enterica serovar Typhi
acgaccaugguucccgccacuga

SEQ ID NO: 3605834 - RNA, 17 nt, Salmonella enterica enterica serovar Typhi
acgaccggucagccggu

SEQ ID NO: 3605835 - RNA, 21 nt, Salmonella enterica enterica serovar Typhi
acgaccugguggcgaacaaua

SEQ ID NO: 3605836 - RNA, 20 nt, Salmonella enterica enterica serovar Typhi
acgaccuuucgccgucaccu

SEQ ID NO: 3605837 - RNA, 18 nt, Salmonella enterica enterica serovar Typhi
acgacgaauaagcugaau

SEQ ID NO: 3605838 - RNA, 13 nt, Salmonella enterica enterica serovar Typhi
acgacgccagcca

SEQ ID NO: 3605839 - RNA, 14 nt, Salmonella enterica enterica serovar Typhi
acgacgccagcccu

SEQ ID NO: 3605840 - RNA, 15 nt, Salmonella enterica enterica serovar Typhi
acgacgcuccagaau

SEQ ID NO: 3605841 - RNA, 19 nt, Salmonella enterica enterica serovar Typhi
acgacgcugccacaauggc

SEQ ID NO: 3605842 - RNA, 16 nt, Salmonella enterica enterica serovar Typhi
acgacggcgaccggca

SEQ ID NO: 3605843 - RNA, 15 nt, Salmonella enterica enterica serovar Typhi
acgacgggaaaaagc

SEQ ID NO: 3605844 - RNA, 14 nt, Salmonella enterica enterica serovar Typhi
acgacugaguauug

SEQ ID NO: 3605845 - RNA, 20 nt, Salmonella enterica enterica serovar Typhi
acgacuuauugcaccauuua

SEQ ID NO: 3605846 - RNA, 16 nt, Salmonella enterica enterica serovar Typhi
acgacuucguuaguga

SEQ ID NO: 3605847 - RNA, 19 nt, Salmonella enterica enterica serovar Typhi
acgagaacccacuuugcuu

SEQ ID NO: 3605848 - RNA, 16 nt, Salmonella enterica enterica serovar Typhi
acgagagacugauaau

SEQ ID NO: 3605849 - RNA, 18 nt, Salmonella enterica enterica serovar Typhi
acgagauacgcuuaauca

SEQ ID NO: 3605850 - RNA, 19 nt, Salmonella enterica enterica serovar Typhi
acgagcacuguagcggcug

SEQ ID NO: 3605851 - RNA, 12 nt, Salmonella enterica enterica serovar Typhi
acgagcgcguca

SEQ ID NO: 3605852 - RNA, 16 nt, Salmonella enterica enterica serovar Typhi
acgagcggucaggcca

SEQ ID NO: 3605853 - RNA, 19 nt, Salmonella enterica enterica serovar Typhi
acgaggauuagacuucuuc

SEQ ID NO: 3605854 - RNA, 21 nt, Salmonella enterica enterica serovar Typhi
acgaguccccucaaacaggcu

SEQ ID NO: 3605855 - RNA, 19 nt, Salmonella enterica enterica serovar Typhi
acgagucggaucaugaaaa

SEQ ID NO: 3605856 - RNA, 17 nt, Salmonella enterica enterica serovar Typhi
acgagugcguucuucca

SEQ ID NO: 3605857 - RNA, 23 nt, Salmonella enterica enterica serovar Typhi
acgaguugaauaacguguuaugc

SEQ ID NO: 3605858 - RNA, 22 nt, Salmonella enterica enterica serovar Typhi
acgaguuucguuaccccgcagc

SEQ ID NO: 3605859 - RNA, 12 nt, Salmonella enterica enterica serovar Typhi
acgauaaaaaaa

SEQ ID NO: 3605860 - RNA, 12 nt, Salmonella enterica enterica serovar Typhi
acgauaaaaugc

SEQ ID NO: 3605861 - RNA, 18 nt, Salmonella enterica enterica serovar Typhi
acgauaaaccucacgcaa

SEQ ID NO: 3605862 - RNA, 14 nt, Salmonella enterica enterica serovar Typhi
acgauaaauuucac

SEQ ID NO: 3605863 - RNA, 20 nt, Salmonella enterica enterica serovar Typhi
acgauaaauuuucagacacu

SEQ ID NO: 3605864 - RNA, 15 nt, Salmonella enterica enterica serovar Typhi
acgauaaggccaaua

SEQ ID NO: 3605865 - RNA, 20 nt, Salmonella enterica enterica serovar Typhi
acgauaauguugguaaauuu

SEQ ID NO: 3605866 - RNA, 22 nt, Salmonella enterica enterica serovar Typhi
acgauacagcacggcaguacac

SEQ ID NO: 3605867 - RNA, 13 nt, Salmonella enterica enterica serovar Typhi
acgauacccacca

SEQ ID NO: 3605868 - RNA, 16 nt, Salmonella enterica enterica serovar Typhi
acgauagacagcacca

SEQ ID NO: 3605869 - RNA, 21 nt, Salmonella enterica enterica serovar Typhi
acgauagcaauuaauaaacaa

SEQ ID NO: 3605870 - RNA, 18 nt, Salmonella enterica enterica serovar Typhi
acgauaguuugccagaga

SEQ ID NO: 3605871 - RNA, 13 nt, Salmonella enterica enterica serovar Typhi
acgauauaaaaac

SEQ ID NO: 3605872 - RNA, 16 nt, Salmonella enterica enterica serovar Typhi
acgauauaggguuuuc

SEQ ID NO: 3605873 - RNA, 21 nt, Salmonella enterica enterica serovar Typhi
acgauauccagcaccucauca

SEQ ID NO: 3605874 - RNA, 16 nt, Salmonella enterica enterica serovar Typhi
acgauaugcauaaucg

SEQ ID NO: 3605875 - RNA, 19 nt, Salmonella enterica enterica serovar Typhi
acgauauucuguuagcgcc

SEQ ID NO: 3605876 - RNA, 16 nt, Salmonella enterica enterica serovar Typhi
acgaucaacagaccga

SEQ ID NO: 3605877 - RNA, 23 nt, Salmonella enterica enterica serovar Typhi
acgaucaauaaaauuauccaguu

SEQ ID NO: 3605878 - RNA, 17 nt, Salmonella enterica enterica serovar Typhi
acgaucccuaauaaaau

SEQ ID NO: 3605879 - RNA, 17 nt, Salmonella enterica enterica serovar Typhi
acgaucccuucaauauc

SEQ ID NO: 3605880 - RNA, 22 nt, Salmonella enterica enterica serovar Typhi
acgaucccuucaauaucaagau

SEQ ID NO: 3605881 - RNA, 15 nt, Salmonella enterica enterica serovar Typhi
acgaucgauaaagcg

SEQ ID NO: 3605882 - RNA, 18 nt, Salmonella enterica enterica serovar Typhi
acgaucgccuaauccgcc

SEQ ID NO: 3605883 - RNA, 13 nt, Salmonella enterica enterica serovar Typhi
acgaucgcgcaca

SEQ ID NO: 3605884 - RNA, 17 nt, Salmonella enterica enterica serovar Typhi
acgaucgcgcacaugcu

SEQ ID NO: 3605885 - RNA, 20 nt, Salmonella enterica enterica serovar Typhi
acgaucgguuaucacgguau

SEQ ID NO: 3605886 - RNA, 22 nt, Salmonella enterica enterica serovar Typhi
acgaucugacauuugcaucaaa

SEQ ID NO: 3605887 - RNA, 15 nt, Salmonella enterica enterica serovar Typhi
acgaucuggucgcca

SEQ ID NO: 3605888 - RNA, 15 nt, Salmonella enterica enterica serovar Typhi
acgaugaugaaaaag

SEQ ID NO: 3605889 - RNA, 17 nt, Salmonella enterica enterica serovar Typhi
acgaugaugaaaaagaa

SEQ ID NO: 3605890 - RNA, 16 nt, Salmonella enterica enterica serovar Typhi
acgaugauguagccgc

SEQ ID NO: 3605891 - RNA, 18 nt, Salmonella enterica enterica serovar Typhi
acgaugcagcaccagaua

SEQ ID NO: 3605892 - RNA, 17 nt, Salmonella enterica enterica serovar Typhi
acgauggcaaauaauac

SEQ ID NO: 3605893 - RNA, 17 nt, Salmonella enterica enterica serovar Typhi
acgauguaaaaccuggc

SEQ ID NO: 3605894 - RNA, 19 nt, Salmonella enterica enterica serovar Typhi
acgauguaaaaccuggcac

SEQ ID NO: 3605895 - RNA, 17 nt, Salmonella enterica enterica serovar Typhi
acgauguucgucccugc

SEQ ID NO: 3605896 - RNA, 15 nt, Salmonella enterica enterica serovar Typhi
acgauugaucucauc

SEQ ID NO: 3605897 - RNA, 21 nt, Salmonella enterica enterica serovar Typhi
acgcaaagacaccccagccua

SEQ ID NO: 3605898 - RNA, 20 nt, Salmonella enterica enterica serovar Typhi
acgcaaaggcguugugcugc

SEQ ID NO: 3605899 - RNA, 13 nt, Salmonella enterica enterica serovar Typhi
acgcaacaacagu

SEQ ID NO: 3605900 - RNA, 20 nt, Salmonella enterica enterica serovar Typhi
acgcaacgcuucugagaauu

SEQ ID NO: 3605901 - RNA, 19 nt, Salmonella enterica enterica serovar Typhi
acgcaacucacgccauucc

SEQ ID NO: 3605902 - RNA, 17 nt, Salmonella enterica enterica serovar Typhi
acgcaaggaaauauuaa

SEQ ID NO: 3605903 - RNA, 14 nt, Salmonella enterica enterica serovar Typhi
acgcaaugccugac

SEQ ID NO: 3605904 - RNA, 16 nt, Salmonella enterica enterica serovar Typhi
acgcacaguacgcccg

SEQ ID NO: 3605905 - RNA, 16 nt, Salmonella enterica enterica serovar Typhi
acgcaccagccaggcg

SEQ ID NO: 3605906 - RNA, 13 nt, Salmonella enterica enterica serovar Typhi
acgcacuaccaga

SEQ ID NO: 3605907 - RNA, 22 nt, Salmonella enterica enterica serovar Typhi
acgcagauaucuuccagcgcgu

SEQ ID NO: 3605908 - RNA, 13 nt, Salmonella enterica enterica serovar Typhi
acgcccgcccgcc

SEQ ID NO: 3605909 - RNA, 22 nt, Salmonella enterica enterica serovar Typhi
acgcccgcuuucaccaucgcga

SEQ ID NO: 3605910 - RNA, 22 nt, Salmonella enterica enterica serovar Typhi
acgcccggcggguauggcaaug

SEQ ID NO: 3605911 - RNA, 16 nt, Salmonella enterica enterica serovar Typhi
acgcccguccggcuuu

SEQ ID NO: 3605912 - RNA, 14 nt, Salmonella enterica enterica serovar Typhi
acgcccucaauauc

SEQ ID NO: 3605913 - RNA, 16 nt, Salmonella enterica enterica serovar Typhi
acgcccucaauaucuu

SEQ ID NO: 3605914 - RNA, 17 nt, Salmonella enterica enterica serovar Typhi
acgcccucaauaucuuu

SEQ ID NO: 3605915 - RNA, 14 nt, Salmonella enterica enterica serovar Typhi
acgcccugcaaagc

SEQ ID NO: 3605916 - RNA, 16 nt, Salmonella enterica enterica serovar Typhi
acgcccugcaaagcaa

SEQ ID NO: 3605917 - RNA, 14 nt, Salmonella enterica enterica serovar Typhi
acgcccugccauuc

SEQ ID NO: 3605918 - RNA, 20 nt, Salmonella enterica enterica serovar Typhi
acgcccugcccaugaagcga

SEQ ID NO: 3605919 - RNA, 18 nt, Salmonella enterica enterica serovar Typhi
acgcccugcucccacagc

SEQ ID NO: 3605920 - RNA, 16 nt, Salmonella enterica enterica serovar Typhi
acgcccuucaauauca

SEQ ID NO: 3605921 - RNA, 16 nt, Salmonella enterica enterica serovar Typhi
acgcccuucacgccga

SEQ ID NO: 3605922 - RNA, 20 nt, Salmonella enterica enterica serovar Typhi
acgccgaacaacacggcggc

SEQ ID NO: 3605923 - RNA, 17 nt, Salmonella enterica enterica serovar Typhi
acgccgacgcauccgcc

SEQ ID NO: 3605924 - RNA, 23 nt, Salmonella enterica enterica serovar Typhi
acgccgagcaucgcuuuuaggcu

SEQ ID NO: 3605925 - RNA, 15 nt, Salmonella enterica enterica serovar Typhi
acgccgauaaccagc

SEQ ID NO: 3605926 - RNA, 15 nt, Salmonella enterica enterica serovar Typhi
acgccgauuaaugcu

SEQ ID NO: 3605927 - RNA, 16 nt, Salmonella enterica enterica serovar Typhi
acgccgauuaaugcuc

SEQ ID NO: 3605928 - RNA, 13 nt, Salmonella enterica enterica serovar Typhi
acgccgcaaacgc

SEQ ID NO: 3605929 - RNA, 22 nt, Salmonella enterica enterica serovar Typhi
acgccgcacacagcagaaagca

SEQ ID NO: 3605930 - RNA, 15 nt, Salmonella enterica enterica serovar Typhi
acgccgccagccacu

SEQ ID NO: 3605931 - RNA, 18 nt, Salmonella enterica enterica serovar Typhi
acgccgccauccgacaac

SEQ ID NO: 3605932 - RNA, 16 nt, Salmonella enterica enterica serovar Typhi
acgccgccauccggca

SEQ ID NO: 3605933 - RNA, 17 nt, Salmonella enterica enterica serovar Typhi
acgccgccauccggcaa

SEQ ID NO: 3605934 - RNA, 18 nt, Salmonella enterica enterica serovar Typhi
acgccgccauccggcacg

SEQ ID NO: 3605935 - RNA, 21 nt, Salmonella enterica enterica serovar Typhi
acgccgcccgccugagcgcgc

SEQ ID NO: 3605936 - RNA, 13 nt, Salmonella enterica enterica serovar Typhi
acgccgccgccca

SEQ ID NO: 3605937 - RNA, 23 nt, Salmonella enterica enterica serovar Typhi
acgccgccgcguccuaccgccgc

SEQ ID NO: 3605938 - RNA, 22 nt, Salmonella enterica enterica serovar Typhi
acgccgcuaucgaccagcaccu

SEQ ID NO: 3605939 - RNA, 23 nt, Salmonella enterica enterica serovar Typhi
acgccggauauguuugacaagca

SEQ ID NO: 3605940 - RNA, 21 nt, Salmonella enterica enterica serovar Typhi
acgccggcgcguaauuccgca

SEQ ID NO: 3605941 - RNA, 16 nt, Salmonella enterica enterica serovar Typhi
acgccgggccugccag

SEQ ID NO: 3605942 - RNA, 19 nt, Salmonella enterica enterica serovar Typhi
acgccgggugaucgucgaa

SEQ ID NO: 3605943 - RNA, 11 nt, Salmonella enterica enterica serovar Typhi
acgccgguacu

SEQ ID NO: 3605944 - RNA, 15 nt, Salmonella enterica enterica serovar Typhi
acgccgguaucauca

SEQ ID NO: 3605945 - RNA, 23 nt, Salmonella enterica enterica serovar Typhi
acgccggucaggauacagccgac

SEQ ID NO: 3605946 - RNA, 15 nt, Salmonella enterica enterica serovar Typhi
acgccggugccugcc

SEQ ID NO: 3605947 - RNA, 13 nt, Salmonella enterica enterica serovar Typhi
acgccguccagca

SEQ ID NO: 3605948 - RNA, 14 nt, Salmonella enterica enterica serovar Typhi
acgccguccagcac

SEQ ID NO: 3605949 - RNA, 22 nt, Salmonella enterica enterica serovar Typhi
acgccguccagcaccaccugca

SEQ ID NO: 3605950 - RNA, 14 nt, Salmonella enterica enterica serovar Typhi
acgccguccggcga

SEQ ID NO: 3605951 - RNA, 20 nt, Salmonella enterica enterica serovar Typhi
acgccgucgaugauggcggc

SEQ ID NO: 3605952 - RNA, 14 nt, Salmonella enterica enterica serovar Typhi
acgccgucucuuuu

SEQ ID NO: 3605953 - RNA, 19 nt, Salmonella enterica enterica serovar Typhi
acgccgucugguacggcca

SEQ ID NO: 3605954 - RNA, 16 nt, Salmonella enterica enterica serovar Typhi
acgccgugcacuucug

SEQ ID NO: 3605955 - RNA, 15 nt, Salmonella enterica enterica serovar Typhi
acgccgugcggcgug

SEQ ID NO: 3605956 - RNA, 16 nt, Salmonella enterica enterica serovar Typhi
acgccguuaccagcau

SEQ ID NO: 3605957 - RNA, 16 nt, Salmonella enterica enterica serovar Typhi
acgccuaaaaaugagg

SEQ ID NO: 3605958 - RNA, 13 nt, Salmonella enterica enterica serovar Typhi
acgccuaaaugaa

SEQ ID NO: 3605959 - RNA, 16 nt, Salmonella enterica enterica serovar Typhi
acgccuaaugaagcgc

SEQ ID NO: 3605960 - RNA, 20 nt, Salmonella enterica enterica serovar Typhi
acgccucauccggccuggcg

SEQ ID NO: 3605961 - RNA, 19 nt, Salmonella enterica enterica serovar Typhi
acgccugaaaugcuuaaaa

SEQ ID NO: 3605962 - RNA, 21 nt, Salmonella enterica enterica serovar Typhi
acgccugaauuucgucaggaa

SEQ ID NO: 3605963 - RNA, 13 nt, Salmonella enterica enterica serovar Typhi
acgccugaugcug

SEQ ID NO: 3605964 - RNA, 16 nt, Salmonella enterica enterica serovar Typhi
acgccugcauaaagga

SEQ ID NO: 3605965 - RNA, 22 nt, Salmonella enterica enterica serovar Typhi
acgccugccagauaguuagcua

SEQ ID NO: 3605966 - RNA, 22 nt, Salmonella enterica enterica serovar Typhi
acgccuggcgcauuuuaaugau

SEQ ID NO: 3605967 - RNA, 18 nt, Salmonella enterica enterica serovar Typhi
acgccugggcauuuguug

SEQ ID NO: 3605968 - RNA, 19 nt, Salmonella enterica enterica serovar Typhi
acgccuuauccgaccuaca

SEQ ID NO: 3605969 - RNA, 21 nt, Salmonella enterica enterica serovar Typhi
acgccuuauccggccuacaga

SEQ ID NO: 3605970 - RNA, 13 nt, Salmonella enterica enterica serovar Typhi
acgccuucaguca

SEQ ID NO: 3605971 - RNA, 17 nt, Salmonella enterica enterica serovar Typhi
acgccuuccuccagcau

SEQ ID NO: 3605972 - RNA, 22 nt, Salmonella enterica enterica serovar Typhi
acgccuucguccggauguucga

SEQ ID NO: 3605973 - RNA, 19 nt, Salmonella enterica enterica serovar Typhi
acgccuuuacccuuacggc

SEQ ID NO: 3605974 - RNA, 17 nt, Salmonella enterica enterica serovar Typhi
acgcgaaaauaccccag

SEQ ID NO: 3605975 - RNA, 23 nt, Salmonella enterica enterica serovar Typhi
acgcgaagauuaacccggucauc

SEQ ID NO: 3605976 - RNA, 15 nt, Salmonella enterica enterica serovar Typhi
acgcgaagcggcguc

SEQ ID NO: 3605977 - RNA, 21 nt, Salmonella enterica enterica serovar Typhi
acgcgaauagccagacagccc

SEQ ID NO: 3605978 - RNA, 15 nt, Salmonella enterica enterica serovar Typhi
acgcgaauccgccau

SEQ ID NO: 3605979 - RNA, 16 nt, Salmonella enterica enterica serovar Typhi
acgcgaccagacacgg

SEQ ID NO: 3605980 - RNA, 18 nt, Salmonella enterica enterica serovar Typhi
acgcgaccagacacggug

SEQ ID NO: 3605981 - RNA, 15 nt, Salmonella enterica enterica serovar Typhi
acgcgaccagcgcgc

SEQ ID NO: 3605982 - RNA, 14 nt, Salmonella enterica enterica serovar Typhi
acgcgacgcgccag

SEQ ID NO: 3605983 - RNA, 16 nt, Salmonella enterica enterica serovar Typhi
acgcgacgcgccagcc

SEQ ID NO: 3605984 - RNA, 19 nt, Salmonella enterica enterica serovar Typhi
acgcgacucccaggcgcgc

SEQ ID NO: 3605985 - RNA, 20 nt, Salmonella enterica enterica serovar Typhi
acgcgacuuuuuucacccag

SEQ ID NO: 3605986 - RNA, 21 nt, Salmonella enterica enterica serovar Typhi
acgcgagaagaagaauuauua

SEQ ID NO: 3605987 - RNA, 18 nt, Salmonella enterica enterica serovar Typhi
acgcgagaagcccggcca

SEQ ID NO: 3605988 - RNA, 20 nt, Salmonella enterica enterica serovar Typhi
acgcgauaaaaacccaccag

SEQ ID NO: 3605989 - RNA, 21 nt, Salmonella enterica enterica serovar Typhi
acgcgauacacuccggcgcgc

SEQ ID NO: 3605990 - RNA, 15 nt, Salmonella enterica enterica serovar Typhi
acgcgauagcgcagc

SEQ ID NO: 3605991 - RNA, 18 nt, Salmonella enterica enterica serovar Typhi
acgcgauauguuugcgcg

SEQ ID NO: 3605992 - RNA, 20 nt, Salmonella enterica enterica serovar Typhi
acgcgaugcaaccccugacg

SEQ ID NO: 3605993 - RNA, 20 nt, Salmonella enterica enterica serovar Typhi
acgcuuacccggccuacauu

SEQ ID NO: 3605994 - RNA, 18 nt, Salmonella enterica enterica serovar Typhi
acgcuuaucaggccuaca

SEQ ID NO: 3605995 - RNA, 19 nt, Salmonella enterica enterica serovar Typhi
acgcuuaucaggccuacaa

SEQ ID NO: 3605996 - RNA, 14 nt, Salmonella enterica enterica serovar Typhi
acgcuuaucccagc

SEQ ID NO: 3605997 - RNA, 16 nt, Salmonella enterica enterica serovar Typhi
acgcuuaucccagccg

SEQ ID NO: 3605998 - RNA, 11 nt, Salmonella enterica enterica serovar Typhi
acgcuuauccu

SEQ ID NO: 3605999 - RNA, 14 nt, Salmonella enterica enterica serovar Typhi
acgcuuauccugcc

SEQ ID NO: 3606000 - RNA, 22 nt, Salmonella enterica enterica serovar Typhi
acgcuuaucgccaaaccagacc

SEQ ID NO: 3606001 - RNA, 19 nt, Salmonella enterica enterica serovar Typhi
acgcuuaucgggccuacga

SEQ ID NO: 3606002 - RNA, 23 nt, Salmonella enterica enterica serovar Typhi
acgcuuauucggucugacggccu

SEQ ID NO: 3606003 - RNA, 15 nt, Salmonella enterica enterica serovar Typhi
acgcuucagagcagg

SEQ ID NO: 3606004 - RNA, 22 nt, Salmonella enterica enterica serovar Typhi
acgcuucauugguuaauucaaa

SEQ ID NO: 3606005 - RNA, 23 nt, Salmonella enterica enterica serovar Typhi
acgcuuccagaugaagcgcaucg

SEQ ID NO: 3606006 - RNA, 20 nt, Salmonella enterica enterica serovar Typhi
acgcuuccggcgaggcguaa

SEQ ID NO: 3606007 - RNA, 18 nt, Salmonella enterica enterica serovar Typhi
acgcuucguugccccgug

SEQ ID NO: 3606008 - RNA, 14 nt, Salmonella enterica enterica serovar Typhi
acgcuucugcgccg

SEQ ID NO: 3606009 - RNA, 21 nt, Salmonella enterica enterica serovar Typhi
acgcuugcaugaccauccacg

SEQ ID NO: 3606010 - RNA, 16 nt, Salmonella enterica enterica serovar Typhi
acgcuugcccgguucg

SEQ ID NO: 3606011 - RNA, 23 nt, Salmonella enterica enterica serovar Typhi
acgcuuuauucugucgccaccac

SEQ ID NO: 3606012 - RNA, 21 nt, Salmonella enterica enterica serovar Typhi
acgcuuuccaguugcggcauc

SEQ ID NO: 3606013 - RNA, 19 nt, Salmonella enterica enterica serovar Typhi
acgcuuucuucccuccccu

SEQ ID NO: 3606014 - RNA, 23 nt, Salmonella enterica enterica serovar Typhi
acgcuuugcgauagcccggcaug

SEQ ID NO: 3606015 - RNA, 17 nt, Salmonella enterica enterica serovar Typhi
acgcuuuguacagacaa

SEQ ID NO: 3606016 - RNA, 23 nt, Salmonella enterica enterica serovar Typhi
acgcuuuuaaauucgcuccacug

SEQ ID NO: 3606017 - RNA, 15 nt, Salmonella enterica enterica serovar Typhi
acgcuuuucagcgcc

SEQ ID NO: 3606018 - RNA, 16 nt, Salmonella enterica enterica serovar Typhi
acgcuuuugcgcacug

SEQ ID NO: 3606019 - RNA, 21 nt, Salmonella enterica enterica serovar Typhi
acgcuuuuuuauuuugugacc

SEQ ID NO: 3606020 - RNA, 20 nt, Salmonella enterica enterica serovar Typhi
acgcuuuuuugcuggcuggc

SEQ ID NO: 3606021 - RNA, 14 nt, Salmonella enterica enterica serovar Typhi
acggaaaaaauacu

SEQ ID NO: 3606022 - RNA, 14 nt, Salmonella enterica enterica serovar Typhi
acggaaaccagcau

SEQ ID NO: 3606023 - RNA, 22 nt, Salmonella enterica enterica serovar Typhi
acggaaaucacgcaucacuuuu

SEQ ID NO: 3606024 - RNA, 15 nt, Salmonella enterica enterica serovar Typhi
acggaacaaaacgga

SEQ ID NO: 3606025 - RNA, 14 nt, Salmonella enterica enterica serovar Typhi
acggaaccaaaaua

SEQ ID NO: 3606026 - RNA, 18 nt, Salmonella enterica enterica serovar Typhi
acggaaccaaaugcccag

SEQ ID NO: 3606027 - RNA, 22 nt, Salmonella enterica enterica serovar Typhi
acggaaccauuccgacagugaa

SEQ ID NO: 3606028 - RNA, 15 nt, Salmonella enterica enterica serovar Typhi
acggaaggaaauaac

SEQ ID NO: 3606029 - RNA, 12 nt, Salmonella enterica enterica serovar Typhi
acggaaggggcc

SEQ ID NO: 3606030 - RNA, 20 nt, Salmonella enterica enterica serovar Typhi
acggaagguaauagcccucg

SEQ ID NO: 3606031 - RNA, 19 nt, Salmonella enterica enterica serovar Typhi
acggaauaucccgcaagaa

SEQ ID NO: 3606032 - RNA, 18 nt, Salmonella enterica enterica serovar Typhi
acggaaucucgcacauca

SEQ ID NO: 3606033 - RNA, 16 nt, Salmonella enterica enterica serovar Typhi
acggacaucagaggua

SEQ ID NO: 3606034 - RNA, 19 nt, Salmonella enterica enterica serovar Typhi
acggacgauggaaccacau

SEQ ID NO: 3606035 - RNA, 22 nt, Salmonella enterica enterica serovar Typhi
acggagaugaucguuuccagca

SEQ ID NO: 3606036 - RNA, 15 nt, Salmonella enterica enterica serovar Typhi
acggagauuaacagc

SEQ ID NO: 3606037 - RNA, 17 nt, Salmonella enterica enterica serovar Typhi
acggaggcgggcgcgca

SEQ ID NO: 3606038 - RNA, 16 nt, Salmonella enterica enterica serovar Typhi
acggaggugccagaga

SEQ ID NO: 3606039 - RNA, 20 nt, Salmonella enterica enterica serovar Typhi
acggaguuggaaccaaacac

SEQ ID NO: 3606040 - RNA, 12 nt, Salmonella enterica enterica serovar Typhi
acggauaagcca

SEQ ID NO: 3606041 - RNA, 18 nt, Salmonella enterica enterica serovar Typhi
acggauacguucgcgggu

SEQ ID NO: 3606042 - RNA, 15 nt, Salmonella enterica enterica serovar Typhi
acggauccagaacug

SEQ ID NO: 3606043 - RNA, 12 nt, Salmonella enterica enterica serovar Typhi
acggaucuucca

SEQ ID NO: 3606044 - RNA, 19 nt, Salmonella enterica enterica serovar Typhi
acggcaaaaagcauaugcg

SEQ ID NO: 3606045 - RNA, 22 nt, Salmonella enterica enterica serovar Typhi
acggcaaaauaaauauccuccg

SEQ ID NO: 3606046 - RNA, 13 nt, Salmonella enterica enterica serovar Typhi
acggcaaacgcug

SEQ ID NO: 3606047 - RNA, 17 nt, Salmonella enterica enterica serovar Typhi
acggcaaacgcuggugc

SEQ ID NO: 3606048 - RNA, 19 nt, Salmonella enterica enterica serovar Typhi
acggcaaacgcuggugcug

SEQ ID NO: 3606049 - RNA, 20 nt, Salmonella enterica enterica serovar Typhi
acggcaaaucgcgguaaaaa

SEQ ID NO: 3606050 - RNA, 18 nt, Salmonella enterica enterica serovar Typhi
acggcaacaguaccugau

SEQ ID NO: 3606051 - RNA, 22 nt, Salmonella enterica enterica serovar Typhi
acggcaacggcgacaagaauau

SEQ ID NO: 3606052 - RNA, 19 nt, Salmonella enterica enterica serovar Typhi
acggcaaguauacuuauug

SEQ ID NO: 3606053 - RNA, 22 nt, Salmonella enterica enterica serovar Typhi
acggcacaacggccagcaaaau

SEQ ID NO: 3606054 - RNA, 20 nt, Salmonella enterica enterica serovar Typhi
acggcaccggaaccggcauc

SEQ ID NO: 3606055 - RNA, 16 nt, Salmonella enterica enterica serovar Typhi
acggcagccacgccga

SEQ ID NO: 3606056 - RNA, 18 nt, Salmonella enterica enterica serovar Typhi
acggcaguguuucccaac

SEQ ID NO: 3606057 - RNA, 13 nt, Salmonella enterica enterica serovar Typhi
acggcaucaggaa

SEQ ID NO: 3606058 - RNA, 18 nt, Salmonella enterica enterica serovar Typhi
acggcaucugcggcauga

SEQ ID NO: 3606059 - RNA, 15 nt, Salmonella enterica enterica serovar Typhi
acggccaauccugca

SEQ ID NO: 3606060 - RNA, 16 nt, Salmonella enterica enterica serovar Typhi
acggccaccaggccug

SEQ ID NO: 3606061 - RNA, 18 nt, Salmonella enterica enterica serovar Typhi
acggccacgcgcgucagg

SEQ ID NO: 3606062 - RNA, 18 nt, Salmonella enterica enterica serovar Typhi
acggcccgugauauugac

SEQ ID NO: 3606063 - RNA, 20 nt, Salmonella enterica enterica serovar Typhi
acggccuagcugcguuucca

SEQ ID NO: 3606064 - RNA, 23 nt, Salmonella enterica enterica serovar Typhi
acggccugcaaacgaaucaccuc

SEQ ID NO: 3606065 - RNA, 16 nt, Salmonella enterica enterica serovar Typhi
acggccugcgcggcga

SEQ ID NO: 3606066 - RNA, 16 nt, Salmonella enterica enterica serovar Typhi
acggccugcgcuggaa

SEQ ID NO: 3606067 - RNA, 18 nt, Salmonella enterica enterica serovar Typhi
acggccuucgcagaucgc

SEQ ID NO: 3606068 - RNA, 22 nt, Salmonella enterica enterica serovar Typhi
acggccuucgcagaucgccugg

SEQ ID NO: 3606069 - RNA, 16 nt, Salmonella enterica enterica serovar Typhi
acggcgaauacgggau

SEQ ID NO: 3606070 - RNA, 15 nt, Salmonella enterica enterica serovar Typhi
acggcgacaggcaca

SEQ ID NO: 3606071 - RNA, 20 nt, Salmonella enterica enterica serovar Typhi
acggcgacggcuucacugcc

SEQ ID NO: 3606072 - RNA, 20 nt, Salmonella enterica enterica serovar Typhi
acggcgauaaaugucaggau

SEQ ID NO: 3606073 - RNA, 15 nt, Salmonella enterica enterica serovar Typhi
acggcgauaccagua

SEQ ID NO: 3606074 - RNA, 18 nt, Salmonella enterica enterica serovar Typhi
acggcgauaccaguaaua

SEQ ID NO: 3606075 - RNA, 16 nt, Salmonella enterica enterica serovar Typhi
acggcgauacugcucc

SEQ ID NO: 3606076 - RNA, 12 nt, Salmonella enterica enterica serovar Typhi
acggcgaucagc

SEQ ID NO: 3606077 - RNA, 19 nt, Salmonella enterica enterica serovar Typhi
acggcgcagguaaaaucca

SEQ ID NO: 3606078 - RNA, 16 nt, Salmonella enterica enterica serovar Typhi
acguagcccauuguca

SEQ ID NO: 3606079 - RNA, 23 nt, Salmonella enterica enterica serovar Typhi
acguagcccauugucaucaguau

SEQ ID NO: 3606080 - RNA, 14 nt, Salmonella enterica enterica serovar Typhi
acguagcgcauugc

SEQ ID NO: 3606081 - RNA, 19 nt, Salmonella enterica enterica serovar Typhi
acguagcuuauaaaucagc

SEQ ID NO: 3606082 - RNA, 21 nt, Salmonella enterica enterica serovar Typhi
acguagcuuauaaaucagcuu

SEQ ID NO: 3606083 - RNA, 20 nt, Salmonella enterica enterica serovar Typhi
acguaggccgaauaagacgc

SEQ ID NO: 3606084 - RNA, 15 nt, Salmonella enterica enterica serovar Typhi
acguaggccugauaa

SEQ ID NO: 3606085 - RNA, 16 nt, Salmonella enterica enterica serovar Typhi
acguaggccugauaag

SEQ ID NO: 3606086 - RNA, 17 nt, Salmonella enterica enterica serovar Typhi
acguagucguccgcgcc

SEQ ID NO: 3606087 - RNA, 14 nt, Salmonella enterica enterica serovar Typhi
acguauuauuauua

SEQ ID NO: 3606088 - RNA, 21 nt, Salmonella enterica enterica serovar Typhi
acgucaaaccccucccggguc

SEQ ID NO: 3606089 - RNA, 22 nt, Salmonella enterica enterica serovar Typhi
acgucaauguaauucaccaaau

SEQ ID NO: 3606090 - RNA, 19 nt, Salmonella enterica enterica serovar Typhi
acgucagacgaggguaaua

SEQ ID NO: 3606091 - RNA, 22 nt, Salmonella enterica enterica serovar Typhi
acgucagccgggauaaucaggu

SEQ ID NO: 3606092 - RNA, 21 nt, Salmonella enterica enterica serovar Typhi
acgucagcgaccauugcguau

SEQ ID NO: 3606093 - RNA, 18 nt, Salmonella enterica enterica serovar Typhi
acgucaggaaccucgaaa

SEQ ID NO: 3606094 - RNA, 17 nt, Salmonella enterica enterica serovar Typhi
acgucaguggaaaacag

SEQ ID NO: 3606095 - RNA, 19 nt, Salmonella enterica enterica serovar Typhi
acgucaguggaaaacagca

SEQ ID NO: 3606096 - RNA, 22 nt, Salmonella enterica enterica serovar Typhi
acgucauaucauccagccccgg

SEQ ID NO: 3606097 - RNA, 14 nt, Salmonella enterica enterica serovar Typhi
acgucaucaugaaa

SEQ ID NO: 3606098 - RNA, 10 nt, Salmonella enterica enterica serovar Typhi
acgucaugcc

SEQ ID NO: 3606099 - RNA, 23 nt, Salmonella enterica enterica serovar Typhi
acgucaugccuuuuuuaccaauu

SEQ ID NO: 3606100 - RNA, 16 nt, Salmonella enterica enterica serovar Typhi
acgucauuuuuucaau

SEQ ID NO: 3606101 - RNA, 21 nt, Salmonella enterica enterica serovar Typhi
acguccauaccgguugcgcgc

SEQ ID NO: 3606102 - RNA, 12 nt, Salmonella enterica enterica serovar Typhi
acguccauccgc

SEQ ID NO: 3606103 - RNA, 19 nt, Salmonella enterica enterica serovar Typhi
acguccauccggguaauuu

SEQ ID NO: 3606104 - RNA, 15 nt, Salmonella enterica enterica serovar Typhi
acgucccaugacgac

SEQ ID NO: 3606105 - RNA, 20 nt, Salmonella enterica enterica serovar Typhi
acgucccgucagggcgaggc

SEQ ID NO: 3606106 - RNA, 16 nt, Salmonella enterica enterica serovar Typhi
acgucccugccacagu

SEQ ID NO: 3606107 - RNA, 13 nt, Salmonella enterica enterica serovar Typhi
acguccgccaaca

SEQ ID NO: 3606108 - RNA, 14 nt, Salmonella enterica enterica serovar Typhi
acgucgcaaagauu

SEQ ID NO: 3606109 - RNA, 16 nt, Salmonella enterica enterica serovar Typhi
acgucgcaagacgaaa

SEQ ID NO: 3606110 - RNA, 17 nt, Salmonella enterica enterica serovar Typhi
acgucgcaagacgaaaa

SEQ ID NO: 3606111 - RNA, 20 nt, Salmonella enterica enterica serovar Typhi
acgucgcaagacgaaaaaug

SEQ ID NO: 3606112 - RNA, 18 nt, Salmonella enterica enterica serovar Typhi
acgucgccuggcauggug

SEQ ID NO: 3606113 - RNA, 20 nt, Salmonella enterica enterica serovar Typhi
acgucgcucuuuucaggcgc

SEQ ID NO: 3606114 - RNA, 20 nt, Salmonella enterica enterica serovar Typhi
acgucggcgaauuucgcguu

SEQ ID NO: 3606115 - RNA, 14 nt, Salmonella enterica enterica serovar Typhi
acgucguaaaaccu

SEQ ID NO: 3606116 - RNA, 15 nt, Salmonella enterica enterica serovar Typhi
acgucgucaccacgg

SEQ ID NO: 3606117 - RNA, 16 nt, Salmonella enterica enterica serovar Typhi
acgucgucccaggcca

SEQ ID NO: 3606118 - RNA, 20 nt, Salmonella enterica enterica serovar Typhi
acgucugcgcuguugauaac

SEQ ID NO: 3606119 - RNA, 20 nt, Salmonella enterica enterica serovar Typhi
acgucuggaaacccgcucgc

SEQ ID NO: 3606120 - RNA, 14 nt, Salmonella enterica enterica serovar Typhi
acgugacgcgccag

SEQ ID NO: 3606121 - RNA, 13 nt, Salmonella enterica enterica serovar Typhi
acgugcaucuccu

SEQ ID NO: 3606122 - RNA, 22 nt, Salmonella enterica enterica serovar Typhi
acgugcauuauuuuagugaaaa

SEQ ID NO: 3606123 - RNA, 22 nt, Salmonella enterica enterica serovar Typhi
acgugccgccguuuuaucuaca

SEQ ID NO: 3606124 - RNA, 19 nt, Salmonella enterica enterica serovar Typhi
acgugcgaaccacggcgua

SEQ ID NO: 3606125 - RNA, 19 nt, Salmonella enterica enterica serovar Typhi
acgugcggcggccucuuug

SEQ ID NO: 3606126 - RNA, 16 nt, Salmonella enterica enterica serovar Typhi
acguggggguucaagu

SEQ ID NO: 3606127 - RNA, 13 nt, Salmonella enterica enterica serovar Typhi
acgugggucgaga

SEQ ID NO: 3606128 - RNA, 18 nt, Salmonella enterica enterica serovar Typhi
acguggugcgggauacgu

SEQ ID NO: 3606129 - RNA, 16 nt, Salmonella enterica enterica serovar Typhi
acguguuaugcgccug

SEQ ID NO: 3606130 - RNA, 19 nt, Salmonella enterica enterica serovar Typhi
acguuaaagccgaccaucg

SEQ ID NO: 3606131 - RNA, 21 nt, Salmonella enterica enterica serovar Typhi
acguuaaagccgaccaucgcg

SEQ ID NO: 3606132 - RNA, 13 nt, Salmonella enterica enterica serovar Typhi
acguuaauacauc

SEQ ID NO: 3606133 - RNA, 19 nt, Salmonella enterica enterica serovar Typhi
acguuaauacaucaugcuu

SEQ ID NO: 3606134 - RNA, 21 nt, Salmonella enterica enterica serovar Typhi
acguuacgcggcgcgccguaa

SEQ ID NO: 3606135 - RNA, 23 nt, Salmonella enterica enterica serovar Typhi
acguuaucgccgacaaacaguga

SEQ ID NO: 3606136 - RNA, 19 nt, Salmonella enterica enterica serovar Typhi
acguuaucgcgcacgcgcc

SEQ ID NO: 3606137 - RNA, 18 nt, Salmonella enterica enterica serovar Typhi
acguuaucucgccaggaa

SEQ ID NO: 3606138 - RNA, 16 nt, Salmonella enterica enterica serovar Typhi
acguuauuggcaggau

SEQ ID NO: 3606139 - RNA, 15 nt, Salmonella enterica enterica serovar Typhi
acguucaaaaucaaa

SEQ ID NO: 3606140 - RNA, 16 nt, Salmonella enterica enterica serovar Typhi
acguucagcauaucca

SEQ ID NO: 3606141 - RNA, 17 nt, Salmonella enterica enterica serovar Typhi
acguucagcauauccag

SEQ ID NO: 3606142 - RNA, 19 nt, Salmonella enterica enterica serovar Typhi
acguucaucaggccugcaa

SEQ ID NO: 3606143 - RNA, 23 nt, Salmonella enterica enterica serovar Typhi
acguucauccgaccacggccaca

SEQ ID NO: 3606144 - RNA, 19 nt, Salmonella enterica enterica serovar Typhi
acguuccauggucucuuuu

SEQ ID NO: 3606145 - RNA, 20 nt, Salmonella enterica enterica serovar Typhi
acguucgcggguaacgucga

SEQ ID NO: 3606146 - RNA, 23 nt, Salmonella enterica enterica serovar Typhi
acguucggcaaaacgccgcagaa

SEQ ID NO: 3606147 - RNA, 22 nt, Salmonella enterica enterica serovar Typhi
acguucggugaagaaaaagaag

SEQ ID NO: 3606148 - RNA, 17 nt, Salmonella enterica enterica serovar Typhi
acguucuuccagaacgc

SEQ ID NO: 3606149 - RNA, 19 nt, Salmonella enterica enterica serovar Typhi
acguucuucgauaaaggga

SEQ ID NO: 3606150 - RNA, 12 nt, Salmonella enterica enterica serovar Typhi
acguucuucucc

SEQ ID NO: 3606151 - RNA, 14 nt, Salmonella enterica enterica serovar Typhi
acguucuucuccca

SEQ ID NO: 3606152 - RNA, 17 nt, Salmonella enterica enterica serovar Typhi
acguugaucgccaucgc

SEQ ID NO: 3606153 - RNA, 16 nt, Salmonella enterica enterica serovar Typhi
acguugcuggcgcgcg

SEQ ID NO: 3606154 - RNA, 19 nt, Salmonella enterica enterica serovar Typhi
acguuggggauaaccagaa

SEQ ID NO: 3606155 - RNA, 19 nt, Salmonella enterica enterica serovar Typhi
acguuggugcguccgguag

SEQ ID NO: 3606156 - RNA, 17 nt, Salmonella enterica enterica serovar Typhi
acguuguccagcggcca

SEQ ID NO: 3606157 - RNA, 22 nt, Salmonella enterica enterica serovar Typhi
acguuucaguuuuuucaguagc

SEQ ID NO: 3606158 - RNA, 22 nt, Salmonella enterica enterica serovar Typhi
acguuuccgcuagggcaucaga

SEQ ID NO: 3606159 - RNA, 15 nt, Salmonella enterica enterica serovar Typhi
acguuucgcuaucgc

SEQ ID NO: 3606160 - RNA, 18 nt, Salmonella enterica enterica serovar Typhi
acguuugaccugcagcuc

SEQ ID NO: 3606161 - RNA, 19 nt, Salmonella enterica enterica serovar Typhi
acguuugccggugccauuc

SEQ ID NO: 3606162 - RNA, 20 nt, Salmonella enterica enterica serovar Typhi
acguuuuccugcgcuugcau

SEQ ID NO: 3606163 - RNA, 17 nt, Salmonella enterica enterica serovar Typhi
acucaucaugauauaau

SEQ ID NO: 3606164 - RNA, 19 nt, Salmonella enterica enterica serovar Typhi
acucauccaccuuauccug

SEQ ID NO: 3606165 - RNA, 14 nt, Salmonella enterica enterica serovar Typhi
acucauccagacca

SEQ ID NO: 3606166 - RNA, 16 nt, Salmonella enterica enterica serovar Typhi
acucaucgccgcaaug

SEQ ID NO: 3606167 - RNA, 18 nt, Salmonella enterica enterica serovar Typhi
acucaucgccgcaaugac

SEQ ID NO: 3606168 - RNA, 14 nt, Salmonella enterica enterica serovar Typhi
acucaucggaacag

SEQ ID NO: 3606169 - RNA, 19 nt, Salmonella enterica enterica serovar Typhi
acucaucggccaccacaua

SEQ ID NO: 3606170 - RNA, 21 nt, Salmonella enterica enterica serovar Typhi
acucauggacaaaaaaggaaa

SEQ ID NO: 3606171 - RNA, 13 nt, Salmonella enterica enterica serovar Typhi
acucauuaaaaaa

SEQ ID NO: 3606172 - RNA, 14 nt, Salmonella enterica enterica serovar Typhi
acucauuaaaaaaa

SEQ ID NO: 3606173 - RNA, 14 nt, Salmonella enterica enterica serovar Typhi
acucauuaccggcu

SEQ ID NO: 3606174 - RNA, 17 nt, Salmonella enterica enterica serovar Typhi
acuccaaaaauaaacac

SEQ ID NO: 3606175 - RNA, 14 nt, Salmonella enterica enterica serovar Typhi
acuccaaauaccgg

SEQ ID NO: 3606176 - RNA, 11 nt, Salmonella enterica enterica serovar Typhi
acuccagaccu

SEQ ID NO: 3606177 - RNA, 11 nt, Salmonella enterica enterica serovar Typhi
acuccagcaga

SEQ ID NO: 3606178 - RNA, 12 nt, Salmonella enterica enterica serovar Typhi
acuccagcagac

SEQ ID NO: 3606179 - RNA, 14 nt, Salmonella enterica enterica serovar Typhi
acuccagcagacgc

SEQ ID NO: 3606180 - RNA, 14 nt, Salmonella enterica enterica serovar Typhi
acuccagcccauca

SEQ ID NO: 3606181 - RNA, 15 nt, Salmonella enterica enterica serovar Typhi
acuccagcccaucag

SEQ ID NO: 3606182 - RNA, 17 nt, Salmonella enterica enterica serovar Typhi
acuccagcggcaggauc

SEQ ID NO: 3606183 - RNA, 22 nt, Salmonella enterica enterica serovar Typhi
acuccaucgccugaugaccgcc

SEQ ID NO: 3606184 - RNA, 16 nt, Salmonella enterica enterica serovar Typhi
acuccaugcccacaca

SEQ ID NO: 3606185 - RNA, 16 nt, Salmonella enterica enterica serovar Typhi
acuccauuaaauuacu

SEQ ID NO: 3606186 - RNA, 22 nt, Salmonella enterica enterica serovar Typhi
acucccaggcgcgcagcugcca

SEQ ID NO: 3606187 - RNA, 21 nt, Salmonella enterica enterica serovar Typhi
acucccaggugugacguccca

SEQ ID NO: 3606188 - RNA, 12 nt, Salmonella enterica enterica serovar Typhi
acucccaguccg

SEQ ID NO: 3606189 - RNA, 17 nt, Salmonella enterica enterica serovar Typhi
acuccccggcuugcggg

SEQ ID NO: 3606190 - RNA, 18 nt, Salmonella enterica enterica serovar Typhi
acucccgucgccuguuuc

SEQ ID NO: 3606191 - RNA, 18 nt, Salmonella enterica enterica serovar Typhi
acucccugagucuugccu

SEQ ID NO: 3606192 - RNA, 17 nt, Salmonella enterica enterica serovar Typhi
acucccugcuuuuucag

SEQ ID NO: 3606193 - RNA, 22 nt, Salmonella enterica enterica serovar Typhi
acuccgccggcgcggaagggau

SEQ ID NO: 3606194 - RNA, 15 nt, Salmonella enterica enterica serovar Typhi
acuccgcgcuggcaa

SEQ ID NO: 3606195 - RNA, 19 nt, Salmonella enterica enterica serovar Typhi
acuccgcgguagagcgcgg

SEQ ID NO: 3606196 - RNA, 13 nt, Salmonella enterica enterica serovar Typhi
acuccggcgacca

SEQ ID NO: 3606197 - RNA, 14 nt, Salmonella enterica enterica serovar Typhi
acuccggugcccau

SEQ ID NO: 3606198 - RNA, 14 nt, Salmonella enterica enterica serovar Typhi
acuccgucaaagaa

SEQ ID NO: 3606199 - RNA, 16 nt, Salmonella enterica enterica serovar Typhi
acuccgucaaagaaaa

SEQ ID NO: 3606200 - RNA, 15 nt, Salmonella enterica enterica serovar Typhi
acuccuaagagaaaa

SEQ ID NO: 3606201 - RNA, 15 nt, Salmonella enterica enterica serovar Typhi
acuccugcaacagaa

SEQ ID NO: 3606202 - RNA, 21 nt, Salmonella enterica enterica serovar Typhi
acuccugcaucgauuccccac

SEQ ID NO: 3606203 - RNA, 14 nt, Salmonella enterica enterica serovar Typhi
acuccugccugaca

SEQ ID NO: 3606204 - RNA, 15 nt, Salmonella enterica enterica serovar Typhi
acuccugggcaaaau

SEQ ID NO: 3606205 - RNA, 16 nt, Salmonella enterica enterica serovar Typhi
acuccuuaggccguca

SEQ ID NO: 3606206 - RNA, 16 nt, Salmonella enterica enterica serovar Typhi
acuccuucuaauucca

SEQ ID NO: 3606207 - RNA, 13 nt, Salmonella enterica enterica serovar Typhi
acucgaauuauuu

SEQ ID NO: 3606208 - RNA, 22 nt, Salmonella enterica enterica serovar Typhi
acucgaccuucaucucuuugcc

SEQ ID NO: 3606209 - RNA, 19 nt, Salmonella enterica enterica serovar Typhi
acucgaggaacuguucagc

SEQ ID NO: 3606210 - RNA, 19 nt, Salmonella enterica enterica serovar Typhi
acucgccaugccaucggcc

SEQ ID NO: 3606211 - RNA, 16 nt, Salmonella enterica enterica serovar Typhi
acucgccucgcugcug

SEQ ID NO: 3606212 - RNA, 15 nt, Salmonella enterica enterica serovar Typhi
acucgccuuucucca

SEQ ID NO: 3606213 - RNA, 19 nt, Salmonella enterica enterica serovar Typhi
acucgcuguauuucccucu

SEQ ID NO: 3606214 - RNA, 15 nt, Salmonella enterica enterica serovar Typhi
acucguagccaaaau

SEQ ID NO: 3606215 - RNA, 17 nt, Salmonella enterica enterica serovar Typhi
acucuaugcaaaagaaa

SEQ ID NO: 3606216 - RNA, 16 nt, Salmonella enterica enterica serovar Typhi
acucuauguucaguag

SEQ ID NO: 3606217 - RNA, 21 nt, Salmonella enterica enterica serovar Typhi
acucucaaugcccaucugacg

SEQ ID NO: 3606218 - RNA, 20 nt, Salmonella enterica enterica serovar Typhi
acucucaccgaccugccuug

SEQ ID NO: 3606219 - RNA, 21 nt, Salmonella enterica enterica serovar Typhi
acucucaccgaccugccuugc

SEQ ID NO: 3606220 - RNA, 20 nt, Salmonella enterica enterica serovar Typhi
acucucggccuauaaaccac

SEQ ID NO: 3606221 - RNA, 16 nt, Salmonella enterica enterica serovar Typhi
acucucuccaguuugc

SEQ ID NO: 3606222 - RNA, 17 nt, Salmonella enterica enterica serovar Typhi
acucucuugccagcgca

SEQ ID NO: 3606223 - RNA, 17 nt, Salmonella enterica enterica serovar Typhi
acucugaaaaaauuucg

SEQ ID NO: 3606224 - RNA, 13 nt, Salmonella enterica enterica serovar Typhi
acucuguuauaua

SEQ ID NO: 3606225 - RNA, 15 nt, Salmonella enterica enterica serovar Typhi
acucuuaauuauaaa

SEQ ID NO: 3606226 - RNA, 19 nt, Salmonella enterica enterica serovar Typhi
acucuuaauuauaaagcau

SEQ ID NO: 3606227 - RNA, 14 nt, Salmonella enterica enterica serovar Typhi
acucuucaucgcgc

SEQ ID NO: 3606228 - RNA, 13 nt, Salmonella enterica enterica serovar Typhi
acucuuccaccac

SEQ ID NO: 3606229 - RNA, 17 nt, Salmonella enterica enterica serovar Typhi
acucuuccaccauccgc

SEQ ID NO: 3606230 - RNA, 12 nt, Salmonella enterica enterica serovar Typhi
acucuuccagca

SEQ ID NO: 3606231 - RNA, 20 nt, Salmonella enterica enterica serovar Typhi
acucuuccagcugcucuccu

SEQ ID NO: 3606232 - RNA, 23 nt, Salmonella enterica enterica serovar Typhi
acucuuccccgaucagaaaaccu

SEQ ID NO: 3606233 - RNA, 16 nt, Salmonella enterica enterica serovar Typhi
acucuuccgcaaucac

SEQ ID NO: 3606234 - RNA, 22 nt, Salmonella enterica enterica serovar Typhi
acucuuccgggcgcgaucuguu

SEQ ID NO: 3606235 - RNA, 15 nt, Salmonella enterica enterica serovar Typhi
acucuuccugcugcg

SEQ ID NO: 3606236 - RNA, 22 nt, Salmonella enterica enterica serovar Typhi
acucuucgacacauuucagcgc

SEQ ID NO: 3606237 - RNA, 17 nt, Salmonella enterica enterica serovar Typhi
acucuucgacauauuua

SEQ ID NO: 3606238 - RNA, 11 nt, Salmonella enterica enterica serovar Typhi
acucuucugac

SEQ ID NO: 3606239 - RNA, 21 nt, Salmonella enterica enterica serovar Typhi
acucuucugaccaucuuaccu

SEQ ID NO: 3606240 - RNA, 19 nt, Salmonella enterica enterica serovar Typhi
acucuuugccgauggcuau

SEQ ID NO: 3606241 - RNA, 15 nt, Salmonella enterica enterica serovar Typhi
acucuuugugggacu

SEQ ID NO: 3606242 - RNA, 16 nt, Salmonella enterica enterica serovar Typhi
acucuuuuuccgcgag

SEQ ID NO: 3606243 - RNA, 16 nt, Salmonella enterica enterica serovar Typhi
acucuuuuuucagaau

SEQ ID NO: 3606244 - RNA, 13 nt, Salmonella enterica enterica serovar Typhi
acugaaaccaggc

SEQ ID NO: 3606245 - RNA, 14 nt, Salmonella enterica enterica serovar Typhi
acugaaccaacagc

SEQ ID NO: 3606246 - RNA, 20 nt, Salmonella enterica enterica serovar Typhi
acugaagauaaacagcagcg

SEQ ID NO: 3606247 - RNA, 16 nt, Salmonella enterica enterica serovar Typhi
acugaagguuuuuccc

SEQ ID NO: 3606248 - RNA, 20 nt, Salmonella enterica enterica serovar Typhi
acugaauuacugcguaaacc

SEQ ID NO: 3606249 - RNA, 15 nt, Salmonella enterica enterica serovar Typhi
acuggcauaccggug

SEQ ID NO: 3606250 - RNA, 12 nt, Salmonella enterica enterica serovar Typhi
acuggccuccca

SEQ ID NO: 3606251 - RNA, 18 nt, Salmonella enterica enterica serovar Typhi
acuggccucccaguuccc

SEQ ID NO: 3606252 - RNA, 16 nt, Salmonella enterica enterica serovar Typhi
acuggcgaccggcagc

SEQ ID NO: 3606253 - RNA, 21 nt, Salmonella enterica enterica serovar Typhi
acuggcgccuuuuggcagcag

SEQ ID NO: 3606254 - RNA, 22 nt, Salmonella enterica enterica serovar Typhi
acuggcggugcggucacaggca

SEQ ID NO: 3606255 - RNA, 22 nt, Salmonella enterica enterica serovar Typhi
acuggcugugcgugacccacag

SEQ ID NO: 3606256 - RNA, 15 nt, Salmonella enterica enterica serovar Typhi
acuggcuuuccugau

SEQ ID NO: 3606257 - RNA, 16 nt, Salmonella enterica enterica serovar Typhi
acugggcaaucaucag

SEQ ID NO: 3606258 - RNA, 19 nt, Salmonella enterica enterica serovar Typhi
acugggcgcaugaggccug

SEQ ID NO: 3606259 - RNA, 16 nt, Salmonella enterica enterica serovar Typhi
acuggguaugcagugg

SEQ ID NO: 3606260 - RNA, 20 nt, Salmonella enterica enterica serovar Typhi
acuggugcccgcaaaaccuu

SEQ ID NO: 3606261 - RNA, 23 nt, Salmonella enterica enterica serovar Typhi
acugguggaauaaauauaagauc

SEQ ID NO: 3606262 - RNA, 19 nt, Salmonella enterica enterica serovar Typhi
acugguuaaggaugacuaa

SEQ ID NO: 3606263 - RNA, 17 nt, Salmonella enterica enterica serovar Typhi
acugguuuguugcgucu

SEQ ID NO: 3606264 - RNA, 14 nt, Salmonella enterica enterica serovar Typhi
acuguaaaucugcc

SEQ ID NO: 3606265 - RNA, 15 nt, Salmonella enterica enterica serovar Typhi
acuguaagccucgcu

SEQ ID NO: 3606266 - RNA, 22 nt, Salmonella enterica enterica serovar Typhi
acuguaagccucgcucaccggu

SEQ ID NO: 3606267 - RNA, 15 nt, Salmonella enterica enterica serovar Typhi
acuguaccugaucca

SEQ ID NO: 3606268 - RNA, 18 nt, Salmonella enterica enterica serovar Typhi
acuguaccugauccagcu

SEQ ID NO: 3606269 - RNA, 21 nt, Salmonella enterica enterica serovar Typhi
acugucccagggccaaacugg

SEQ ID NO: 3606270 - RNA, 14 nt, Salmonella enterica enterica serovar Typhi
acugucgaaaccag

SEQ ID NO: 3606271 - RNA, 18 nt, Salmonella enterica enterica serovar Typhi
acugucgaaaccagcaua

SEQ ID NO: 3606272 - RNA, 13 nt, Salmonella enterica enterica serovar Typhi
acugucgcuggau

SEQ ID NO: 3606273 - RNA, 23 nt, Salmonella enterica enterica serovar Typhi
acugucggcgauauagcgcugaa

SEQ ID NO: 3606274 - RNA, 21 nt, Salmonella enterica enterica serovar Typhi
acugucuuaucaggccuacac

SEQ ID NO: 3606275 - RNA, 20 nt, Salmonella enterica enterica serovar Typhi
acugugccgucguacucacc

SEQ ID NO: 3606276 - RNA, 18 nt, Salmonella enterica enterica serovar Typhi
acugugcgucgcguucgc

SEQ ID NO: 3606277 - RNA, 22 nt, Salmonella enterica enterica serovar Typhi
acugugcugauuuuggcuucac

SEQ ID NO: 3606278 - RNA, 16 nt, Salmonella enterica enterica serovar Typhi
acugugggauuuuugg

SEQ ID NO: 3606279 - RNA, 12 nt, Salmonella enterica enterica serovar Typhi
acuguggugugc

SEQ ID NO: 3606280 - RNA, 19 nt, Salmonella enterica enterica serovar Typhi
acuguggugugccugcgcu

SEQ ID NO: 3606281 - RNA, 18 nt, Salmonella enterica enterica serovar Typhi
acuguggugugccugcgu

SEQ ID NO: 3606282 - RNA, 13 nt, Salmonella enterica enterica serovar Typhi
acuguucagccag

SEQ ID NO: 3606283 - RNA, 21 nt, Salmonella enterica enterica serovar Typhi
acuguucaucaaagaaaacca

SEQ ID NO: 3606284 - RNA, 15 nt, Salmonella enterica enterica serovar Typhi
acuguucggggauua

SEQ ID NO: 3606285 - RNA, 20 nt, Salmonella enterica enterica serovar Typhi
acuguugaaagccccggcuc

SEQ ID NO: 3606286 - RNA, 23 nt, Salmonella enterica enterica serovar Typhi
acuguugccgacagcggaaaauc

SEQ ID NO: 3606287 - RNA, 18 nt, Salmonella enterica enterica serovar Typhi
acuguuguucuucauaca

SEQ ID NO: 3606288 - RNA, 15 nt, Salmonella enterica enterica serovar Typhi
acuguuugcugacaa

SEQ ID NO: 3606289 - RNA, 19 nt, Salmonella enterica enterica serovar Typhi
acuguuuuaccaaaucaau

SEQ ID NO: 3606290 - RNA, 20 nt, Salmonella enterica enterica serovar Typhi
acuguuuuaccaaaucaaua

SEQ ID NO: 3606291 - RNA, 21 nt, Salmonella enterica enterica serovar Typhi
acuguuuuaucagggaauggu

SEQ ID NO: 3606292 - RNA, 14 nt, Salmonella enterica enterica serovar Typhi
acuguuuuugcuuu

SEQ ID NO: 3606293 - RNA, 15 nt, Salmonella enterica enterica serovar Typhi
acuuaaaauugaauu

SEQ ID NO: 3606294 - RNA, 20 nt, Salmonella enterica enterica serovar Typhi
acuuaaauuaaugauuaaaa

SEQ ID NO: 3606295 - RNA, 16 nt, Salmonella enterica enterica serovar Typhi
acuuaccgggcaucug

SEQ ID NO: 3606296 - RNA, 14 nt, Salmonella enterica enterica serovar Typhi
acuuacgacgcgcc

SEQ ID NO: 3606297 - RNA, 12 nt, Salmonella enterica enterica serovar Typhi
acuuacuuucuu

SEQ ID NO: 3606298 - RNA, 15 nt, Salmonella enterica enterica serovar Typhi
acuuagagccuaucc

SEQ ID NO: 3606299 - RNA, 17 nt, Salmonella enterica enterica serovar Typhi
acuuagcccuggccaau

SEQ ID NO: 3606300 - RNA, 11 nt, Salmonella enterica enterica serovar Typhi
acuuaucucuu

SEQ ID NO: 3606301 - RNA, 16 nt, Salmonella enterica enterica serovar Typhi
acuuauugauccacgg

SEQ ID NO: 3606302 - RNA, 22 nt, Salmonella enterica enterica serovar Typhi
acuuauugcaccauuuacagga

SEQ ID NO: 3606303 - RNA, 17 nt, Salmonella enterica enterica serovar Typhi
acuuauuugcucaguuc

SEQ ID NO: 3606304 - RNA, 17 nt, Salmonella enterica enterica serovar Typhi
acuucaaaaauggcuuc

SEQ ID NO: 3606305 - RNA, 18 nt, Salmonella enterica enterica serovar Typhi
acuucaauauugaugcua

SEQ ID NO: 3606306 - RNA, 12 nt, Salmonella enterica enterica serovar Typhi
acuucaaucacu

SEQ ID NO: 3606307 - RNA, 17 nt, Salmonella enterica enterica serovar Typhi
acuucaauuuuccagau

SEQ ID NO: 3606308 - RNA, 13 nt, Salmonella enterica enterica serovar Typhi
acuucacaaacaa

SEQ ID NO: 3606309 - RNA, 20 nt, Salmonella enterica enterica serovar Typhi
acuucacaaucagcgcaaua

SEQ ID NO: 3606310 - RNA, 15 nt, Salmonella enterica enterica serovar Typhi
acuucacacgaacuu

SEQ ID NO: 3606311 - RNA, 18 nt, Salmonella enterica enterica serovar Typhi
acuucaccauaaaucauu

SEQ ID NO: 3606312 - RNA, 21 nt, Salmonella enterica enterica serovar Typhi
acuucaccauaaaucauuacu

SEQ ID NO: 3606313 - RNA, 14 nt, Salmonella enterica enterica serovar Typhi
acuucacccaucgc

SEQ ID NO: 3606314 - RNA, 12 nt, Salmonella enterica enterica serovar Typhi
acuucacgcugg

SEQ ID NO: 3606315 - RNA, 12 nt, Salmonella enterica enterica serovar Typhi
acuucacuuucc

SEQ ID NO: 3606316 - RNA, 16 nt, Salmonella enterica enterica serovar Typhi
acuucagagcugaaaa

SEQ ID NO: 3606317 - RNA, 21 nt, Salmonella enterica enterica serovar Typhi
acuucauacgaauggguaaua

SEQ ID NO: 3606318 - RNA, 18 nt, Salmonella enterica enterica serovar Typhi
acuucaugcguuagccua

SEQ ID NO: 3606319 - RNA, 16 nt, Salmonella enterica enterica serovar Typhi
acuucauuuuccacaa

SEQ ID NO: 3606320 - RNA, 10 nt, Salmonella enterica enterica serovar Typhi
acuuccagcg

SEQ ID NO: 3606321 - RNA, 22 nt, Salmonella enterica enterica serovar Typhi
acuuccagcgcgccgucaucgc

SEQ ID NO: 3606322 - RNA, 18 nt, Salmonella enterica enterica serovar Typhi
acuuccgcacgcgcgccc

SEQ ID NO: 3606323 - RNA, 14 nt, Salmonella enterica enterica serovar Typhi
acuuccgccucgcc

SEQ ID NO: 3606324 - RNA, 15 nt, Salmonella enterica enterica serovar Typhi
acuuccggaucgcua

SEQ ID NO: 3606325 - RNA, 20 nt, Salmonella enterica enterica serovar Typhi
acuuccgguauccguucauc

SEQ ID NO: 3606326 - RNA, 20 nt, Salmonella enterica enterica serovar Typhi
acuuccgguugaccgcauaa

SEQ ID NO: 3606327 - RNA, 19 nt, Salmonella enterica enterica serovar Typhi
acuucgcaguuggugacau

SEQ ID NO: 3606328 - RNA, 18 nt, Salmonella enterica enterica serovar Typhi
acuucgcgguuagaaagu

SEQ ID NO: 3606329 - RNA, 21 nt, Salmonella enterica enterica serovar Typhi
acuucgcuuuguuuuccagau

SEQ ID NO: 3606330 - RNA, 12 nt, Salmonella enterica enterica serovar Typhi
acuucuaauuuu

SEQ ID NO: 3606331 - RNA, 13 nt, Salmonella enterica enterica serovar Typhi
acuucuccgccau

SEQ ID NO: 3606332 - RNA, 16 nt, Salmonella enterica enterica serovar Typhi
acuucugacccaauca

SEQ ID NO: 3606333 - RNA, 18 nt, Salmonella enterica enterica serovar Typhi
acuucugacccaaucaga

SEQ ID NO: 3606334 - RNA, 11 nt, Salmonella enterica enterica serovar Typhi
acuucuucagu

SEQ ID NO: 3606335 - RNA, 12 nt, Salmonella enterica enterica serovar Typhi
agaaauauucag

SEQ ID NO: 3606336 - RNA, 14 nt, Salmonella enterica enterica serovar Typhi
agaaauauuuugcc

SEQ ID NO: 3606337 - RNA, 14 nt, Salmonella enterica enterica serovar Typhi
agaaaucaacgaaa

SEQ ID NO: 3606338 - RNA, 18 nt, Salmonella enterica enterica serovar Typhi
agaaaucaacgaaaucag

SEQ ID NO: 3606339 - RNA, 19 nt, Salmonella enterica enterica serovar Typhi
agaaaucaacgaaaucaga

SEQ ID NO: 3606340 - RNA, 13 nt, Salmonella enterica enterica serovar Typhi
agaaaucagcagg

SEQ ID NO: 3606341 - RNA, 13 nt, Salmonella enterica enterica serovar Typhi
agaaaucugaaug

SEQ ID NO: 3606342 - RNA, 16 nt, Salmonella enterica enterica serovar Typhi
agaaauuauuuuaaau

SEQ ID NO: 3606343 - RNA, 21 nt, Salmonella enterica enterica serovar Typhi
agaaauuauuuuaaauuuccu

SEQ ID NO: 3606344 - RNA, 18 nt, Salmonella enterica enterica serovar Typhi
agaaauucgcagcgcagg

SEQ ID NO: 3606345 - RNA, 16 nt, Salmonella enterica enterica serovar Typhi
agaaauugaauuauaa

SEQ ID NO: 3606346 - RNA, 23 nt, Salmonella enterica enterica serovar Typhi
agaaauuuaggucaaaaaagcga

SEQ ID NO: 3606347 - RNA, 15 nt, Salmonella enterica enterica serovar Typhi
agaacauaaacagcg

SEQ ID NO: 3606348 - RNA, 18 nt, Salmonella enterica enterica serovar Typhi
agaacauaaacagcguga

SEQ ID NO: 3606349 - RNA, 14 nt, Salmonella enterica enterica serovar Typhi
agaacaugacggca

SEQ ID NO: 3606350 - RNA, 16 nt, Salmonella enterica enterica serovar Typhi
agaacauuucccgaaa

SEQ ID NO: 3606351 - RNA, 19 nt, Salmonella enterica enterica serovar Typhi
agaacauuucccgaaaaaa

SEQ ID NO: 3606352 - RNA, 20 nt, Salmonella enterica enterica serovar Typhi
agaaccaauaguauggagca

SEQ ID NO: 3606353 - RNA, 14 nt, Salmonella enterica enterica serovar Typhi
agaaccacuugaac

SEQ ID NO: 3606354 - RNA, 16 nt, Salmonella enterica enterica serovar Typhi
agaaccccugccacaa

SEQ ID NO: 3606355 - RNA, 23 nt, Salmonella enterica enterica serovar Typhi
agaaccguugcgcccaucaucau

SEQ ID NO: 3606356 - RNA, 23 nt, Salmonella enterica enterica serovar Typhi
agaaccuguucaugccagauuuu

SEQ ID NO: 3606357 - RNA, 13 nt, Salmonella enterica enterica serovar Typhi
agaacgaauuuac

SEQ ID NO: 3606358 - RNA, 21 nt, Salmonella enterica enterica serovar Typhi
agaacggaaguugcauauaag

SEQ ID NO: 3606359 - RNA, 21 nt, Salmonella enterica enterica serovar Typhi
agaacggcacaauagcgcuaa

SEQ ID NO: 3606360 - RNA, 15 nt, Salmonella enterica enterica serovar Typhi
agaacguauuauuau

SEQ ID NO: 3606361 - RNA, 18 nt, Salmonella enterica enterica serovar Typhi
agaacucacgcucaagau

SEQ ID NO: 3606362 - RNA, 12 nt, Salmonella enterica enterica serovar Typhi
agaacucaucuu

SEQ ID NO: 3606363 - RNA, 18 nt, Salmonella enterica enterica serovar Typhi
agaacugcaaauaccaca

SEQ ID NO: 3606364 - RNA, 22 nt, Salmonella enterica enterica serovar Typhi
agaacugcugcauccgcgcuuu

SEQ ID NO: 3606365 - RNA, 16 nt, Salmonella enterica enterica serovar Typhi
agaacuggcgcgauga

SEQ ID NO: 3606366 - RNA, 14 nt, Salmonella enterica enterica serovar Typhi
agaacuuaaauuaa

SEQ ID NO: 3606367 - RNA, 17 nt, Salmonella enterica enterica serovar Typhi
agaacuuguaaaaaugc

SEQ ID NO: 3606368 - RNA, 20 nt, Salmonella enterica enterica serovar Typhi
agaagaaaccgcagaaaaag

SEQ ID NO: 3606369 - RNA, 17 nt, Salmonella enterica enterica serovar Typhi
agaagaaucgccccauu

SEQ ID NO: 3606370 - RNA, 19 nt, Salmonella enterica enterica serovar Typhi
agaagagaauggccagcac

SEQ ID NO: 3606371 - RNA, 15 nt, Salmonella enterica enterica serovar Typhi
agaagauuucuuaau

SEQ ID NO: 3606372 - RNA, 13 nt, Salmonella enterica enterica serovar Typhi
agaagcaaauuca

SEQ ID NO: 3606373 - RNA, 17 nt, Salmonella enterica enterica serovar Typhi
agaagcgccugucuauu

SEQ ID NO: 3606374 - RNA, 19 nt, Salmonella enterica enterica serovar Typhi
agaagcucaugugcagcau

SEQ ID NO: 3606375 - RNA, 22 nt, Salmonella enterica enterica serovar Typhi
agaagcucaugugcagcaucca

SEQ ID NO: 3606376 - RNA, 20 nt, Salmonella enterica enterica serovar Typhi
agaagcugggcgucaacgug

SEQ ID NO: 3606377 - RNA, 16 nt, Salmonella enterica enterica serovar Typhi
agaaggcgaacauaag

SEQ ID NO: 3606378 - RNA, 20 nt, Salmonella enterica enterica serovar Typhi
agaagggcaggggaaagcug

SEQ ID NO: 3606379 - RNA, 23 nt, Salmonella enterica enterica serovar Typhi
agaaggucagguuaugcgcgcca

SEQ ID NO: 3606380 - RNA, 14 nt, Salmonella enterica enterica serovar Typhi
agaagucugugaga

SEQ ID NO: 3606381 - RNA, 16 nt, Salmonella enterica enterica serovar Typhi
agaagugccaguaacu

SEQ ID NO: 3606382 - RNA, 21 nt, Salmonella enterica enterica serovar Typhi
agaauaaaaagugcgcacuca

SEQ ID NO: 3606383 - RNA, 21 nt, Salmonella enterica enterica serovar Typhi
agaauaacgaugaugaaaaag

SEQ ID NO: 3606384 - RNA, 13 nt, Salmonella enterica enterica serovar Typhi
agaauaacucagc

SEQ ID NO: 3606385 - RNA, 23 nt, Salmonella enterica enterica serovar Typhi
agaauacugaagucgaaauuuuc

SEQ ID NO: 3606386 - RNA, 14 nt, Salmonella enterica enterica serovar Typhi
agaauagacuggcg

SEQ ID NO: 3606387 - RNA, 18 nt, Salmonella enterica enterica serovar Typhi
agaauagccggauaaaau

SEQ ID NO: 3606388 - RNA, 20 nt, Salmonella enterica enterica serovar Typhi
agaauagccggauaaaauua

SEQ ID NO: 3606389 - RNA, 21 nt, Salmonella enterica enterica serovar Typhi
agaauagcgccguggccgaua

SEQ ID NO: 3606390 - RNA, 16 nt, Salmonella enterica enterica serovar Typhi
agaauaggaaauaauu

SEQ ID NO: 3606391 - RNA, 16 nt, Salmonella enterica enterica serovar Typhi
agaauauaggagagcg

SEQ ID NO: 3606392 - RNA, 18 nt, Salmonella enterica enterica serovar Typhi
agaauauaguuagaaaau

SEQ ID NO: 3606393 - RNA, 13 nt, Salmonella enterica enterica serovar Typhi
agaauaugccagg

SEQ ID NO: 3606394 - RNA, 17 nt, Salmonella enterica enterica serovar Typhi
agaauauuuuucucagc

SEQ ID NO: 3606395 - RNA, 23 nt, Salmonella enterica enterica serovar Typhi
agaauauuuuucucagccagauc

SEQ ID NO: 3606396 - RNA, 13 nt, Salmonella enterica enterica serovar Typhi
agaaucaccucuu

SEQ ID NO: 3606397 - RNA, 19 nt, Salmonella enterica enterica serovar Typhi
agaaucacgccgaugacca

SEQ ID NO: 3606398 - RNA, 12 nt, Salmonella enterica enterica serovar Typhi
agaaucagaugc

SEQ ID NO: 3606399 - RNA, 23 nt, Salmonella enterica enterica serovar Typhi
agaaucauuaauacacugcguag

SEQ ID NO: 3606400 - RNA, 21 nt, Salmonella enterica enterica serovar Typhi
agaaucgauguaguuguucuu

SEQ ID NO: 3606401 - RNA, 20 nt, Salmonella enterica enterica serovar Typhi
agaaucgguagcuacucagg

SEQ ID NO: 3606402 - RNA, 15 nt, Salmonella enterica enterica serovar Typhi
agaaucucugacagg

SEQ ID NO: 3606403 - RNA, 16 nt, Salmonella enterica enterica serovar Typhi
agaaugaaaaaaaaau

SEQ ID NO: 3606404 - RNA, 15 nt, Salmonella enterica enterica serovar Typhi
agaaugaccagccga

SEQ ID NO: 3606405 - RNA, 23 nt, Salmonella enterica enterica serovar Typhi
agaaugccagcgccgucauggca

SEQ ID NO: 3606406 - RNA, 15 nt, Salmonella enterica enterica serovar Typhi
agaaugcuccauugc

SEQ ID NO: 3606407 - RNA, 22 nt, Salmonella enterica enterica serovar Typhi
agaauggucgguauuaucaaua

SEQ ID NO: 3606408 - RNA, 18 nt, Salmonella enterica enterica serovar Typhi
agaauguccaucucuuua

SEQ ID NO: 3606409 - RNA, 14 nt, Salmonella enterica enterica serovar Typhi
agaaugucgccaua

SEQ ID NO: 3606410 - RNA, 13 nt, Salmonella enterica enterica serovar Typhi
agaauuaucugaa

SEQ ID NO: 3606411 - RNA, 16 nt, Salmonella enterica enterica serovar Typhi
agaauuauuaccaaug

SEQ ID NO: 3606412 - RNA, 20 nt, Salmonella enterica enterica serovar Typhi
agaauuauuaucaauuucau

SEQ ID NO: 3606413 - RNA, 21 nt, Salmonella enterica enterica serovar Typhi
agaauucccuauguaaagaau

SEQ ID NO: 3606414 - RNA, 20 nt, Salmonella enterica enterica serovar Typhi
agaauuccgaugaaaaacug

SEQ ID NO: 3606415 - RNA, 23 nt, Salmonella enterica enterica serovar Typhi
agaauuccgaugaaaaacuggaa

SEQ ID NO: 3606416 - RNA, 18 nt, Salmonella enterica enterica serovar Typhi
agaauugcgccaccuuaa

SEQ ID NO: 3606417 - RNA, 14 nt, Salmonella enterica enterica serovar Typhi
agacaaaagcuggu

SEQ ID NO: 3606418 - RNA, 15 nt, Salmonella enterica enterica serovar Typhi
agacaaaagcuggug

SEQ ID NO: 3606419 - RNA, 16 nt, Salmonella enterica enterica serovar Typhi
agacaaaagcugguga

SEQ ID NO: 3606420 - RNA, 13 nt, Salmonella enterica enterica serovar Typhi
agacugauaucca

SEQ ID NO: 3606421 - RNA, 17 nt, Salmonella enterica enterica serovar Typhi
agacugcacuuccugcg

SEQ ID NO: 3606422 - RNA, 14 nt, Salmonella enterica enterica serovar Typhi
agacugcccggcau

SEQ ID NO: 3606423 - RNA, 14 nt, Salmonella enterica enterica serovar Typhi
agacugcuccggca

SEQ ID NO: 3606424 - RNA, 12 nt, Salmonella enterica enterica serovar Typhi
agacuggaugga

SEQ ID NO: 3606425 - RNA, 22 nt, Salmonella enterica enterica serovar Typhi
agacuggguaagcgcagcgcca

SEQ ID NO: 3606426 - RNA, 16 nt, Salmonella enterica enterica serovar Typhi
agacuggucgcccgga

SEQ ID NO: 3606427 - RNA, 21 nt, Salmonella enterica enterica serovar Typhi
agacuguaaaucugccgucau

SEQ ID NO: 3606428 - RNA, 21 nt, Salmonella enterica enterica serovar Typhi
agacuguugaaagccccggcu

SEQ ID NO: 3606429 - RNA, 14 nt, Salmonella enterica enterica serovar Typhi
agacuuagcccugg

SEQ ID NO: 3606430 - RNA, 12 nt, Salmonella enterica enterica serovar Typhi
agacuucaacgc

SEQ ID NO: 3606431 - RNA, 13 nt, Salmonella enterica enterica serovar Typhi
agacuucuuccau

SEQ ID NO: 3606432 - RNA, 20 nt, Salmonella enterica enterica serovar Typhi
agacuucuuccauacgacca

SEQ ID NO: 3606433 - RNA, 16 nt, Salmonella enterica enterica serovar Typhi
agacuuuccagcacga

SEQ ID NO: 3606434 - RNA, 18 nt, Salmonella enterica enterica serovar Typhi
agacuuugcacagucugc

SEQ ID NO: 3606435 - RNA, 10 nt, Salmonella enterica enterica serovar Typhi
agagaaaaaa

SEQ ID NO: 3606436 - RNA, 11 nt, Salmonella enterica enterica serovar Typhi
agagaaaaaaa

SEQ ID NO: 3606437 - RNA, 12 nt, Salmonella enterica enterica serovar Typhi
agagaaaaaaau

SEQ ID NO: 3606438 - RNA, 21 nt, Salmonella enterica enterica serovar Typhi
agagaaaaccccguacaggac

SEQ ID NO: 3606439 - RNA, 12 nt, Salmonella enterica enterica serovar Typhi
agagaacagcau

SEQ ID NO: 3606440 - RNA, 12 nt, Salmonella enterica enterica serovar Typhi
agagaaccguuc

SEQ ID NO: 3606441 - RNA, 16 nt, Salmonella enterica enterica serovar Typhi
agagaaccugaacaau

SEQ ID NO: 3606442 - RNA, 18 nt, Salmonella enterica enterica serovar Typhi
agagaaccugaacaauaa

SEQ ID NO: 3606443 - RNA, 21 nt, Salmonella enterica enterica serovar Typhi
agagaaccugaacaauaaucg

SEQ ID NO: 3606444 - RNA, 22 nt, Salmonella enterica enterica serovar Typhi
agagaacgaaauauggcacagc

SEQ ID NO: 3606445 - RNA, 15 nt, Salmonella enterica enterica serovar Typhi
agagaauaacgauga

SEQ ID NO: 3606446 - RNA, 18 nt, Salmonella enterica enterica serovar Typhi
agagaauuuuuagcgugc

SEQ ID NO: 3606447 - RNA, 17 nt, Salmonella enterica enterica serovar Typhi
agagacauugccuucca

SEQ ID NO: 3606448 - RNA, 22 nt, Salmonella enterica enterica serovar Typhi
agagacggcgacaguugauauu

SEQ ID NO: 3606449 - RNA, 19 nt, Salmonella enterica enterica serovar Typhi
agagacuggcgacagccgc

SEQ ID NO: 3606450 - RNA, 15 nt, Salmonella enterica enterica serovar Typhi
agagagaaucggguc

SEQ ID NO: 3606451 - RNA, 16 nt, Salmonella enterica enterica serovar Typhi
agagagccuuacaggc

SEQ ID NO: 3606452 - RNA, 19 nt, Salmonella enterica enterica serovar Typhi
agagagcgccaaaaagaaa

SEQ ID NO: 3606453 - RNA, 18 nt, Salmonella enterica enterica serovar Typhi
agagaguuccuccuggcu

SEQ ID NO: 3606454 - RNA, 21 nt, Salmonella enterica enterica serovar Typhi
agagauaauuuucccaguuca

SEQ ID NO: 3606455 - RNA, 19 nt, Salmonella enterica enterica serovar Typhi
agagauauaccagccguug

SEQ ID NO: 3606456 - RNA, 18 nt, Salmonella enterica enterica serovar Typhi
agagaucaggaguaaaua

SEQ ID NO: 3606457 - RNA, 20 nt, Salmonella enterica enterica serovar Typhi
agagaucaggaguaaauaac

SEQ ID NO: 3606458 - RNA, 17 nt, Salmonella enterica enterica serovar Typhi
agagaucgacagcgcgc

SEQ ID NO: 3606459 - RNA, 18 nt, Salmonella enterica enterica serovar Typhi
agagauggaacaucuuuu

SEQ ID NO: 3606460 - RNA, 20 nt, Salmonella enterica enterica serovar Typhi
agagauucgccguucuguuc

SEQ ID NO: 3606461 - RNA, 20 nt, Salmonella enterica enterica serovar Typhi
agagcaaauacuggaaaaaa

SEQ ID NO: 3606462 - RNA, 18 nt, Salmonella enterica enterica serovar Typhi
agagcaacauaccgcaga

SEQ ID NO: 3606463 - RNA, 13 nt, Salmonella enterica enterica serovar Typhi
agagcaacgccau

SEQ ID NO: 3606464 - RNA, 18 nt, Salmonella enterica enterica serovar Typhi
agagcaacgccaucagca

SEQ ID NO: 3606465 - RNA, 20 nt, Salmonella enterica enterica serovar Typhi
agagcaacgccaucagcaaa

SEQ ID NO: 3606466 - RNA, 22 nt, Salmonella enterica enterica serovar Typhi
agagcaacgccaucagcaaaau

SEQ ID NO: 3606467 - RNA, 19 nt, Salmonella enterica enterica serovar Typhi
agagcagcgccagcgacag

SEQ ID NO: 3606468 - RNA, 18 nt, Salmonella enterica enterica serovar Typhi
agagcaguuuuacgugga

SEQ ID NO: 3606469 - RNA, 16 nt, Salmonella enterica enterica serovar Typhi
agagcauaugcgcugc

SEQ ID NO: 3606470 - RNA, 18 nt, Salmonella enterica enterica serovar Typhi
agagcauaugcgcugcga

SEQ ID NO: 3606471 - RNA, 17 nt, Salmonella enterica enterica serovar Typhi
agagcaucaauggugaa

SEQ ID NO: 3606472 - RNA, 14 nt, Salmonella enterica enterica serovar Typhi
agagcaucaucugc

SEQ ID NO: 3606473 - RNA, 15 nt, Salmonella enterica enterica serovar Typhi
agagcaucgcggcau

SEQ ID NO: 3606474 - RNA, 21 nt, Salmonella enterica enterica serovar Typhi
agagcaucuaccgcauacuga

SEQ ID NO: 3606475 - RNA, 21 nt, Salmonella enterica enterica serovar Typhi
agagcauuuguagcggcaaca

SEQ ID NO: 3606476 - RNA, 18 nt, Salmonella enterica enterica serovar Typhi
agagccggaaccuguccu

SEQ ID NO: 3606477 - RNA, 15 nt, Salmonella enterica enterica serovar Typhi
agagccuuacaggcg

SEQ ID NO: 3606478 - RNA, 16 nt, Salmonella enterica enterica serovar Typhi
agagcgacguugucuu

SEQ ID NO: 3606479 - RNA, 13 nt, Salmonella enterica enterica serovar Typhi
agagcgccaaaaa

SEQ ID NO: 3606480 - RNA, 21 nt, Salmonella enterica enterica serovar Typhi
agagcgcgcucugccuuuuuu

SEQ ID NO: 3606481 - RNA, 22 nt, Salmonella enterica enterica serovar Typhi
agagcggauaagcgcagcgcca

SEQ ID NO: 3606482 - RNA, 18 nt, Salmonella enterica enterica serovar Typhi
agagcgggucaacgccaa

SEQ ID NO: 3606483 - RNA, 15 nt, Salmonella enterica enterica serovar Typhi
agagcguauccagca

SEQ ID NO: 3606484 - RNA, 16 nt, Salmonella enterica enterica serovar Typhi
agagcguggucauuag

SEQ ID NO: 3606485 - RNA, 19 nt, Salmonella enterica enterica serovar Typhi
agagcuaaucaauaaguuu

SEQ ID NO: 3606486 - RNA, 17 nt, Salmonella enterica enterica serovar Typhi
agagcucgaccaacaua

SEQ ID NO: 3606487 - RNA, 13 nt, Salmonella enterica enterica serovar Typhi
agagcugaaaaug

SEQ ID NO: 3606488 - RNA, 23 nt, Salmonella enterica enterica serovar Typhi
agagcuuuuccuguucgcuuauu

SEQ ID NO: 3606489 - RNA, 16 nt, Salmonella enterica enterica serovar Typhi
agaggacacguuaauu

SEQ ID NO: 3606490 - RNA, 18 nt, Salmonella enterica enterica serovar Typhi
agaggccaccagcgccag

SEQ ID NO: 3606491 - RNA, 20 nt, Salmonella enterica enterica serovar Typhi
agaggcgccgacuuuacggc

SEQ ID NO: 3606492 - RNA, 19 nt, Salmonella enterica enterica serovar Typhi
agaggucagaauaacucag

SEQ ID NO: 3606493 - RNA, 18 nt, Salmonella enterica enterica serovar Typhi
agagguguuauggcaggc

SEQ ID NO: 3606494 - RNA, 22 nt, Salmonella enterica enterica serovar Typhi
agagguuaccgggcuaaaccac

SEQ ID NO: 3606495 - RNA, 18 nt, Salmonella enterica enterica serovar Typhi
agaguaaaaccggcacau

SEQ ID NO: 3606496 - RNA, 15 nt, Salmonella enterica enterica serovar Typhi
agaguaacccuuuag

SEQ ID NO: 3606497 - RNA, 21 nt, Salmonella enterica enterica serovar Typhi
agaguaaucguauucauugcc

SEQ ID NO: 3606498 - RNA, 19 nt, Salmonella enterica enterica serovar Typhi
agagucaaggcauccagca

SEQ ID NO: 3606499 - RNA, 17 nt, Salmonella enterica enterica serovar Typhi
agaguccagcgccagcg

SEQ ID NO: 3606500 - RNA, 12 nt, Salmonella enterica enterica serovar Typhi
agagucguuacc

SEQ ID NO: 3606501 - RNA, 20 nt, Salmonella enterica enterica serovar Typhi
agagugagccacguuuuccu

SEQ ID NO: 3606502 - RNA, 20 nt, Salmonella enterica enterica serovar Typhi
agagugauccaccaccagca

SEQ ID NO: 3606503 - RNA, 24 nt, Salmonella enterica enterica serovar Typhi
agaguucauaacgcacaacgucag

SEQ ID NO: 3606504 - RNA, 15 nt, Salmonella enterica enterica serovar Typhi
agauaaaaaagcugc

SEQ ID NO: 3606505 - RNA, 21 nt, Salmonella enterica enterica serovar Typhi
agauaaaacugcugacaauca

SEQ ID NO: 3606506 - RNA, 18 nt, Salmonella enterica enterica serovar Typhi
agauuggcccgcccagca

SEQ ID NO: 3606507 - RNA, 14 nt, Salmonella enterica enterica serovar Typhi
agauuggccgucac

SEQ ID NO: 3606508 - RNA, 17 nt, Salmonella enterica enterica serovar Typhi
agauuguuucggauaau

SEQ ID NO: 3606509 - RNA, 14 nt, Salmonella enterica enterica serovar Typhi
agauuuaaaacaag

SEQ ID NO: 3606510 - RNA, 15 nt, Salmonella enterica enterica serovar Typhi
agauuuacaacagau

SEQ ID NO: 3606511 - RNA, 15 nt, Salmonella enterica enterica serovar Typhi
agauuuaucaauuuu

SEQ ID NO: 3606512 - RNA, 12 nt, Salmonella enterica enterica serovar Typhi
agauuucaucag

SEQ ID NO: 3606513 - RNA, 15 nt, Salmonella enterica enterica serovar Typhi
agauuucgcgucagg

SEQ ID NO: 3606514 - RNA, 16 nt, Salmonella enterica enterica serovar Typhi
agauuucuuaauuccu

SEQ ID NO: 3606515 - RNA, 18 nt, Salmonella enterica enterica serovar Typhi
agauuucuuaauuccuca

SEQ ID NO: 3606516 - RNA, 13 nt, Salmonella enterica enterica serovar Typhi
agauuuucaucau

SEQ ID NO: 3606517 - RNA, 20 nt, Salmonella enterica enterica serovar Typhi
agauuuucaucauaucugau

SEQ ID NO: 3606518 - RNA, 15 nt, Salmonella enterica enterica serovar Typhi
agauuuuucgccagg

SEQ ID NO: 3606519 - RNA, 17 nt, Salmonella enterica enterica serovar Typhi
agauuuuucucacacau

SEQ ID NO: 3606520 - RNA, 19 nt, Salmonella enterica enterica serovar Typhi
agcaaaaaagcgccuuuag

SEQ ID NO: 3606521 - RNA, 14 nt, Salmonella enterica enterica serovar Typhi
agcaaaaaucacca

SEQ ID NO: 3606522 - RNA, 15 nt, Salmonella enterica enterica serovar Typhi
agcaaaaaucaccac

SEQ ID NO: 3606523 - RNA, 12 nt, Salmonella enterica enterica serovar Typhi
agcaaaacaccg

SEQ ID NO: 3606524 - RNA, 16 nt, Salmonella enterica enterica serovar Typhi
agcaaaaucaccauca

SEQ ID NO: 3606525 - RNA, 18 nt, Salmonella enterica enterica serovar Typhi
agcaaaccggcaugaaga

SEQ ID NO: 3606526 - RNA, 21 nt, Salmonella enterica enterica serovar Typhi
agcaaacgccauagcaucgac

SEQ ID NO: 3606527 - RNA, 17 nt, Salmonella enterica enterica serovar Typhi
agcaaacuggcgcguac

SEQ ID NO: 3606528 - RNA, 18 nt, Salmonella enterica enterica serovar Typhi
agcaaaucgggaaaauga

SEQ ID NO: 3606529 - RNA, 13 nt, Salmonella enterica enterica serovar Typhi
agcaaauucaggg

SEQ ID NO: 3606530 - RNA, 21 nt, Salmonella enterica enterica serovar Typhi
agcaaauucaggguugucuca

SEQ ID NO: 3606531 - RNA, 14 nt, Salmonella enterica enterica serovar Typhi
agcaaauugcugau

SEQ ID NO: 3606532 - RNA, 22 nt, Salmonella enterica enterica serovar Typhi
agcaacacuuugcgcugcgcau

SEQ ID NO: 3606533 - RNA, 19 nt, Salmonella enterica enterica serovar Typhi
agcaacagcguaccuuuau

SEQ ID NO: 3606534 - RNA, 19 nt, Salmonella enterica enterica serovar Typhi
agcaacagugggcuaugaa

SEQ ID NO: 3606535 - RNA, 20 nt, Salmonella enterica enterica serovar Typhi
agcaacccuggcgcuuuaaa

SEQ ID NO: 3606536 - RNA, 12 nt, Salmonella enterica enterica serovar Typhi
agcaacccuuuu

SEQ ID NO: 3606537 - RNA, 16 nt, Salmonella enterica enterica serovar Typhi
agcaacggaagcugac

SEQ ID NO: 3606538 - RNA, 22 nt, Salmonella enterica enterica serovar Typhi
agcaacgugaacugcgccugca

SEQ ID NO: 3606539 - RNA, 18 nt, Salmonella enterica enterica serovar Typhi
agcaacguuaaggccgca

SEQ ID NO: 3606540 - RNA, 20 nt, Salmonella enterica enterica serovar Typhi
agcaacguuuguaacagcag

SEQ ID NO: 3606541 - RNA, 20 nt, Salmonella enterica enterica serovar Typhi
agcaacugcgcgcggguuuc

SEQ ID NO: 3606542 - RNA, 12 nt, Salmonella enterica enterica serovar Typhi
agcaagaacaga

SEQ ID NO: 3606543 - RNA, 16 nt, Salmonella enterica enterica serovar Typhi
agcaagaacagagcaa

SEQ ID NO: 3606544 - RNA, 18 nt, Salmonella enterica enterica serovar Typhi
agcaagaacagagcaauu

SEQ ID NO: 3606545 - RNA, 18 nt, Salmonella enterica enterica serovar Typhi
agcaagcgcacgguuaau

SEQ ID NO: 3606546 - RNA, 13 nt, Salmonella enterica enterica serovar Typhi
agcaaggcaagaa

SEQ ID NO: 3606547 - RNA, 13 nt, Salmonella enterica enterica serovar Typhi
agcaaggcggcgg

SEQ ID NO: 3606548 - RNA, 22 nt, Salmonella enterica enterica serovar Typhi
agcaauauuuuguaguuguuuu

SEQ ID NO: 3606549 - RNA, 16 nt, Salmonella enterica enterica serovar Typhi
agcaauauuuuuccgc

SEQ ID NO: 3606550 - RNA, 20 nt, Salmonella enterica enterica serovar Typhi
agcaaucagguauuuccugc

SEQ ID NO: 3606551 - RNA, 20 nt, Salmonella enterica enterica serovar Typhi
agcaauccauuuuaaauaca

SEQ ID NO: 3606552 - RNA, 22 nt, Salmonella enterica enterica serovar Typhi
agcaaucucuauaccauaaaug

SEQ ID NO: 3606553 - RNA, 14 nt, Salmonella enterica enterica serovar Typhi
agcaaugauuuuua

SEQ ID NO: 3606554 - RNA, 16 nt, Salmonella enterica enterica serovar Typhi
agcaaugcccaaaaua

SEQ ID NO: 3606555 - RNA, 20 nt, Salmonella enterica enterica serovar Typhi
agcaaugcccaaaauagcgu

SEQ ID NO: 3606556 - RNA, 16 nt, Salmonella enterica enterica serovar Typhi
agcaauuaauaaacaa

SEQ ID NO: 3606557 - RNA, 22 nt, Salmonella enterica enterica serovar Typhi
agcaauuaauauuuaacacauu

SEQ ID NO: 3606558 - RNA, 18 nt, Salmonella enterica enterica serovar Typhi
agcaauuggccaucuucg

SEQ ID NO: 3606559 - RNA, 19 nt, Salmonella enterica enterica serovar Typhi
agcaauuucagcauccucc

SEQ ID NO: 3606560 - RNA, 19 nt, Salmonella enterica enterica serovar Typhi
agcaauuucucgcccgcca

SEQ ID NO: 3606561 - RNA, 21 nt, Salmonella enterica enterica serovar Typhi
agcacaaagaauucuucugug

SEQ ID NO: 3606562 - RNA, 15 nt, Salmonella enterica enterica serovar Typhi
agcacaagaacuuaa

SEQ ID NO: 3606563 - RNA, 21 nt, Salmonella enterica enterica serovar Typhi
agcacaagaacuuaaauuaau

SEQ ID NO: 3606564 - RNA, 13 nt, Salmonella enterica enterica serovar Typhi
agcacaccauuuc

SEQ ID NO: 3606565 - RNA, 16 nt, Salmonella enterica enterica serovar Typhi
agcacaccauuucaca

SEQ ID NO: 3606566 - RNA, 20 nt, Salmonella enterica enterica serovar Typhi
agcacaccgccguaaaggga

SEQ ID NO: 3606567 - RNA, 12 nt, Salmonella enterica enterica serovar Typhi
agcacacgcauc

SEQ ID NO: 3606568 - RNA, 16 nt, Salmonella enterica enterica serovar Typhi
agcacagcccaguaau

SEQ ID NO: 3606569 - RNA, 21 nt, Salmonella enterica enterica serovar Typhi
agcacaucacucauaaugaug

SEQ ID NO: 3606570 - RNA, 18 nt, Salmonella enterica enterica serovar Typhi
agcacaucagcaaaugaa

SEQ ID NO: 3606571 - RNA, 22 nt, Salmonella enterica enterica serovar Typhi
agcacaucagccguaucuuccg

SEQ ID NO: 3606572 - RNA, 12 nt, Salmonella enterica enterica serovar Typhi
agcacauccaug

SEQ ID NO: 3606573 - RNA, 14 nt, Salmonella enterica enterica serovar Typhi
agcacauccucaau

SEQ ID NO: 3606574 - RNA, 15 nt, Salmonella enterica enterica serovar Typhi
agcacauucagcagc

SEQ ID NO: 3606575 - RNA, 18 nt, Salmonella enterica enterica serovar Typhi
agcaccagaccgacaagc

SEQ ID NO: 3606576 - RNA, 13 nt, Salmonella enterica enterica serovar Typhi
agcaccagcagcg

SEQ ID NO: 3606577 - RNA, 12 nt, Salmonella enterica enterica serovar Typhi
agcaccagcauu

SEQ ID NO: 3606578 - RNA, 14 nt, Salmonella enterica enterica serovar Typhi
agcaccaggccaac

SEQ ID NO: 3606579 - RNA, 12 nt, Salmonella enterica enterica serovar Typhi
agcaccaucaug

SEQ ID NO: 3606580 - RNA, 14 nt, Salmonella enterica enterica serovar Typhi
agcaccauuucgcc

SEQ ID NO: 3606581 - RNA, 13 nt, Salmonella enterica enterica serovar Typhi
agcacccaggcac

SEQ ID NO: 3606582 - RNA, 18 nt, Salmonella enterica enterica serovar Typhi
agcaccgauccaauauua

SEQ ID NO: 3606583 - RNA, 16 nt, Salmonella enterica enterica serovar Typhi
agcaccgccgggaaga

SEQ ID NO: 3606584 - RNA, 20 nt, Salmonella enterica enterica serovar Typhi
agcaccucaucgcuaccuuc

SEQ ID NO: 3606585 - RNA, 21 nt, Salmonella enterica enterica serovar Typhi
agcaccucgguauguccugcc

SEQ ID NO: 3606586 - RNA, 20 nt, Salmonella enterica enterica serovar Typhi
agcaccuggcggagcugcgc

SEQ ID NO: 3606587 - RNA, 17 nt, Salmonella enterica enterica serovar Typhi
agcaccuuauccggccu

SEQ ID NO: 3606588 - RNA, 22 nt, Salmonella enterica enterica serovar Typhi
agcaccuuugaacgucgcugau

SEQ ID NO: 3606589 - RNA, 13 nt, Salmonella enterica enterica serovar Typhi
agcacgacacaaa

SEQ ID NO: 3606590 - RNA, 19 nt, Salmonella enterica enterica serovar Typhi
agcacgaccuuuucuucau

SEQ ID NO: 3606591 - RNA, 17 nt, Salmonella enterica enterica serovar Typhi
agcacgauauccagcac

SEQ ID NO: 3606592 - RNA, 14 nt, Salmonella enterica enterica serovar Typhi
agcaucaugucacc

SEQ ID NO: 3606593 - RNA, 13 nt, Salmonella enterica enterica serovar Typhi
agcaucauguccc

SEQ ID NO: 3606594 - RNA, 15 nt, Salmonella enterica enterica serovar Typhi
agcauccagaucggc

SEQ ID NO: 3606595 - RNA, 21 nt, Salmonella enterica enterica serovar Typhi
agcauccagcucauguaguca

SEQ ID NO: 3606596 - RNA, 12 nt, Salmonella enterica enterica serovar Typhi
agcaucccacga

SEQ ID NO: 3606597 - RNA, 18 nt, Salmonella enterica enterica serovar Typhi
agcaucccgcuggcgcca

SEQ ID NO: 3606598 - RNA, 19 nt, Salmonella enterica enterica serovar Typhi
agcaucccgcuggcgccac

SEQ ID NO: 3606599 - RNA, 21 nt, Salmonella enterica enterica serovar Typhi
agcauccgcgcaauaugcggc

SEQ ID NO: 3606600 - RNA, 21 nt, Salmonella enterica enterica serovar Typhi
agcauccgggauauaaaauua

SEQ ID NO: 3606601 - RNA, 22 nt, Salmonella enterica enterica serovar Typhi
agcaucgacccuugcgaccacu

SEQ ID NO: 3606602 - RNA, 18 nt, Salmonella enterica enterica serovar Typhi
agcaucgccgguagcuuc

SEQ ID NO: 3606603 - RNA, 17 nt, Salmonella enterica enterica serovar Typhi
agcaucgcuaaccggcg

SEQ ID NO: 3606604 - RNA, 21 nt, Salmonella enterica enterica serovar Typhi
agcaucgcuuuuaggcugaaa

SEQ ID NO: 3606605 - RNA, 23 nt, Salmonella enterica enterica serovar Typhi
agcaucguaagccgcauuacaaa

SEQ ID NO: 3606606 - RNA, 15 nt, Salmonella enterica enterica serovar Typhi
agcaucguuaccgcu

SEQ ID NO: 3606607 - RNA, 13 nt, Salmonella enterica enterica serovar Typhi
agcaucugauagc

SEQ ID NO: 3606608 - RNA, 14 nt, Salmonella enterica enterica serovar Typhi
agcaucugcggcuu

SEQ ID NO: 3606609 - RNA, 18 nt, Salmonella enterica enterica serovar Typhi
agcaucugcggcuuucau

SEQ ID NO: 3606610 - RNA, 16 nt, Salmonella enterica enterica serovar Typhi
agcaucuuaugcgcaa

SEQ ID NO: 3606611 - RNA, 15 nt, Salmonella enterica enterica serovar Typhi
agcaugacaauaacg

SEQ ID NO: 3606612 - RNA, 20 nt, Salmonella enterica enterica serovar Typhi
agcaugaucauacugccgcc

SEQ ID NO: 3606613 - RNA, 14 nt, Salmonella enterica enterica serovar Typhi
agcaugcccgccag

SEQ ID NO: 3606614 - RNA, 18 nt, Salmonella enterica enterica serovar Typhi
agcaugggcauccccaug

SEQ ID NO: 3606615 - RNA, 23 nt, Salmonella enterica enterica serovar Typhi
agcauuacccccgccauaaugca

SEQ ID NO: 3606616 - RNA, 16 nt, Salmonella enterica enterica serovar Typhi
agcauuaccccguggu

SEQ ID NO: 3606617 - RNA, 14 nt, Salmonella enterica enterica serovar Typhi
agcauuauuuuuaa

SEQ ID NO: 3606618 - RNA, 15 nt, Salmonella enterica enterica serovar Typhi
agcauuauuuuuaac

SEQ ID NO: 3606619 - RNA, 14 nt, Salmonella enterica enterica serovar Typhi
agcauucuauuguu

SEQ ID NO: 3606620 - RNA, 21 nt, Salmonella enterica enterica serovar Typhi
agcauugccguuuucaauaau

SEQ ID NO: 3606621 - RNA, 16 nt, Salmonella enterica enterica serovar Typhi
agcauuggaaauucag

SEQ ID NO: 3606622 - RNA, 19 nt, Salmonella enterica enterica serovar Typhi
agcauugggccgauaaagc

SEQ ID NO: 3606623 - RNA, 15 nt, Salmonella enterica enterica serovar Typhi
agcauuguauuucag

SEQ ID NO: 3606624 - RNA, 13 nt, Salmonella enterica enterica serovar Typhi
agcauuuccagcu

SEQ ID NO: 3606625 - RNA, 16 nt, Salmonella enterica enterica serovar Typhi
agcauuucuucaagcg

SEQ ID NO: 3606626 - RNA, 16 nt, Salmonella enterica enterica serovar Typhi
agcauuuuucacaguu

SEQ ID NO: 3606627 - RNA, 11 nt, Salmonella enterica enterica serovar Typhi
agcauuuuucc

SEQ ID NO: 3606628 - RNA, 15 nt, Salmonella enterica enterica serovar Typhi
agccaaacacuuccc

SEQ ID NO: 3606629 - RNA, 18 nt, Salmonella enterica enterica serovar Typhi
agccaaacuccucacugc

SEQ ID NO: 3606630 - RNA, 19 nt, Salmonella enterica enterica serovar Typhi
agccaaacucugaaaaaau

SEQ ID NO: 3606631 - RNA, 14 nt, Salmonella enterica enterica serovar Typhi
agccaaacugcugu

SEQ ID NO: 3606632 - RNA, 23 nt, Salmonella enterica enterica serovar Typhi
agccaaagauuagccccagcgcc

SEQ ID NO: 3606633 - RNA, 15 nt, Salmonella enterica enterica serovar Typhi
agccaaagcgaggua

SEQ ID NO: 3606634 - RNA, 16 nt, Salmonella enterica enterica serovar Typhi
agccaacaaagaggca

SEQ ID NO: 3606635 - RNA, 12 nt, Salmonella enterica enterica serovar Typhi
agccaauaauca

SEQ ID NO: 3606636 - RNA, 18 nt, Salmonella enterica enterica serovar Typhi
agccaauaaucaaaugau

SEQ ID NO: 3606637 - RNA, 13 nt, Salmonella enterica enterica serovar Typhi
agccaaucagccc

SEQ ID NO: 3606638 - RNA, 19 nt, Salmonella enterica enterica serovar Typhi
agccaaucagccccagcac

SEQ ID NO: 3606639 - RNA, 15 nt, Salmonella enterica enterica serovar Typhi
agccaauccagaaua

SEQ ID NO: 3606640 - RNA, 17 nt, Salmonella enterica enterica serovar Typhi
agccacaagagcagcaa

SEQ ID NO: 3606641 - RNA, 17 nt, Salmonella enterica enterica serovar Typhi
agccacaaucugauaau

SEQ ID NO: 3606642 - RNA, 23 nt, Salmonella enterica enterica serovar Typhi
agccacaaugggggcauaauacg

SEQ ID NO: 3606643 - RNA, 18 nt, Salmonella enterica enterica serovar Typhi
agccacacccauagcagc

SEQ ID NO: 3606644 - RNA, 17 nt, Salmonella enterica enterica serovar Typhi
agccacacgacgguauu

SEQ ID NO: 3606645 - RNA, 22 nt, Salmonella enterica enterica serovar Typhi
agccacacugcaucgaaaucuc

SEQ ID NO: 3606646 - RNA, 14 nt, Salmonella enterica enterica serovar Typhi
agccacagcgguua

SEQ ID NO: 3606647 - RNA, 20 nt, Salmonella enterica enterica serovar Typhi
agccacauuguaugcaagaa

SEQ ID NO: 3606648 - RNA, 17 nt, Salmonella enterica enterica serovar Typhi
agccacccacugacgaa

SEQ ID NO: 3606649 - RNA, 17 nt, Salmonella enterica enterica serovar Typhi
agccaccggauugccuu

SEQ ID NO: 3606650 - RNA, 15 nt, Salmonella enterica enterica serovar Typhi
agccacgcaagcagc

SEQ ID NO: 3606651 - RNA, 19 nt, Salmonella enterica enterica serovar Typhi
agccacgcccgccgccuga

SEQ ID NO: 3606652 - RNA, 22 nt, Salmonella enterica enterica serovar Typhi
agccacggcguguugaaauccu

SEQ ID NO: 3606653 - RNA, 12 nt, Salmonella enterica enterica serovar Typhi
agccacgucuga

SEQ ID NO: 3606654 - RNA, 15 nt, Salmonella enterica enterica serovar Typhi
agccacguucuucca

SEQ ID NO: 3606655 - RNA, 18 nt, Salmonella enterica enterica serovar Typhi
agccacguucuuccagaa

SEQ ID NO: 3606656 - RNA, 14 nt, Salmonella enterica enterica serovar Typhi
agccacucacggca

SEQ ID NO: 3606657 - RNA, 18 nt, Salmonella enterica enterica serovar Typhi
agccacugcgccauuaac

SEQ ID NO: 3606658 - RNA, 22 nt, Salmonella enterica enterica serovar Typhi
agccacuuaccaaucgcggcga

SEQ ID NO: 3606659 - RNA, 23 nt, Salmonella enterica enterica serovar Typhi
agccacuucaugcgcuuuuucac

SEQ ID NO: 3606660 - RNA, 21 nt, Salmonella enterica enterica serovar Typhi
agccacuucuuccagcggcag

SEQ ID NO: 3606661 - RNA, 13 nt, Salmonella enterica enterica serovar Typhi
agccagaacagaa

SEQ ID NO: 3606662 - RNA, 15 nt, Salmonella enterica enterica serovar Typhi
agccagaacagaagu

SEQ ID NO: 3606663 - RNA, 20 nt, Salmonella enterica enterica serovar Typhi
agccagaacgagaggaggag

SEQ ID NO: 3606664 - RNA, 13 nt, Salmonella enterica enterica serovar Typhi
agccagaagccug

SEQ ID NO: 3606665 - RNA, 13 nt, Salmonella enterica enterica serovar Typhi
agccagacaucac

SEQ ID NO: 3606666 - RNA, 18 nt, Salmonella enterica enterica serovar Typhi
agccagacgccagccacu

SEQ ID NO: 3606667 - RNA, 16 nt, Salmonella enterica enterica serovar Typhi
agccagacgcgcagca

SEQ ID NO: 3606668 - RNA, 20 nt, Salmonella enterica enterica serovar Typhi
agccagacggcgcccagccu

SEQ ID NO: 3606669 - RNA, 14 nt, Salmonella enterica enterica serovar Typhi
agccagauaucgcg

SEQ ID NO: 3606670 - RNA, 21 nt, Salmonella enterica enterica serovar Typhi
agccagauggauaaccugccg

SEQ ID NO: 3606671 - RNA, 11 nt, Salmonella enterica enterica serovar Typhi
agccagcacga

SEQ ID NO: 3606672 - RNA, 15 nt, Salmonella enterica enterica serovar Typhi
agccagcagcucaac

SEQ ID NO: 3606673 - RNA, 12 nt, Salmonella enterica enterica serovar Typhi
agccagcaucau

SEQ ID NO: 3606674 - RNA, 18 nt, Salmonella enterica enterica serovar Typhi
agccagcaucaugggcuc

SEQ ID NO: 3606675 - RNA, 18 nt, Salmonella enterica enterica serovar Typhi
agccagcauuuccagcug

SEQ ID NO: 3606676 - RNA, 15 nt, Salmonella enterica enterica serovar Typhi
agccagcccucaaca

SEQ ID NO: 3606677 - RNA, 19 nt, Salmonella enterica enterica serovar Typhi
agccagccgccaaaaauau

SEQ ID NO: 3606678 - RNA, 12 nt, Salmonella enterica enterica serovar Typhi
agccgcccggcg

SEQ ID NO: 3606679 - RNA, 13 nt, Salmonella enterica enterica serovar Typhi
agccgcccggcgc

SEQ ID NO: 3606680 - RNA, 22 nt, Salmonella enterica enterica serovar Typhi
agccgccggugacggcggaaga

SEQ ID NO: 3606681 - RNA, 21 nt, Salmonella enterica enterica serovar Typhi
agccgccguagaacgggccga

SEQ ID NO: 3606682 - RNA, 23 nt, Salmonella enterica enterica serovar Typhi
agccgccguguugugugccgcgc

SEQ ID NO: 3606683 - RNA, 15 nt, Salmonella enterica enterica serovar Typhi
agccgcgcagcgcaa

SEQ ID NO: 3606684 - RNA, 16 nt, Salmonella enterica enterica serovar Typhi
agccgcgcauagcugg

SEQ ID NO: 3606685 - RNA, 20 nt, Salmonella enterica enterica serovar Typhi
agccgcgcauagcuggcgua

SEQ ID NO: 3606686 - RNA, 13 nt, Salmonella enterica enterica serovar Typhi
agccgcgccaucu

SEQ ID NO: 3606687 - RNA, 21 nt, Salmonella enterica enterica serovar Typhi
agccgcgccguaacgcgaugc

SEQ ID NO: 3606688 - RNA, 16 nt, Salmonella enterica enterica serovar Typhi
agccgcggaccuuuug

SEQ ID NO: 3606689 - RNA, 17 nt, Salmonella enterica enterica serovar Typhi
agccgcucaggguaauc

SEQ ID NO: 3606690 - RNA, 20 nt, Salmonella enterica enterica serovar Typhi
agccgcucaggguaaucacc

SEQ ID NO: 3606691 - RNA, 21 nt, Salmonella enterica enterica serovar Typhi
agccgcuccggguuuucaaua

SEQ ID NO: 3606692 - RNA, 11 nt, Salmonella enterica enterica serovar Typhi
agccgcugccu

SEQ ID NO: 3606693 - RNA, 18 nt, Salmonella enterica enterica serovar Typhi
agccgcuguuuuucauca

SEQ ID NO: 3606694 - RNA, 19 nt, Salmonella enterica enterica serovar Typhi
agccgcuuacucagccaga

SEQ ID NO: 3606695 - RNA, 16 nt, Salmonella enterica enterica serovar Typhi
agccgcuuuccgccgc

SEQ ID NO: 3606696 - RNA, 23 nt, Salmonella enterica enterica serovar Typhi
agccgcuuuccgccgccgccauc

SEQ ID NO: 3606697 - RNA, 15 nt, Salmonella enterica enterica serovar Typhi
agccggaaaagcgcu

SEQ ID NO: 3606698 - RNA, 17 nt, Salmonella enterica enterica serovar Typhi
agccggaaaagcgcugg

SEQ ID NO: 3606699 - RNA, 18 nt, Salmonella enterica enterica serovar Typhi
agccggauaaaauuauuu

SEQ ID NO: 3606700 - RNA, 16 nt, Salmonella enterica enterica serovar Typhi
agccggauaagccgcg

SEQ ID NO: 3606701 - RNA, 20 nt, Salmonella enterica enterica serovar Typhi
agccggauaagcguagcgcc

SEQ ID NO: 3606702 - RNA, 19 nt, Salmonella enterica enterica serovar Typhi
agccggauguaggccugau

SEQ ID NO: 3606703 - RNA, 16 nt, Salmonella enterica enterica serovar Typhi
agccggauuuuaaauu

SEQ ID NO: 3606704 - RNA, 16 nt, Salmonella enterica enterica serovar Typhi
agccggcgauagcgcc

SEQ ID NO: 3606705 - RNA, 14 nt, Salmonella enterica enterica serovar Typhi
agccggcggaaaaa

SEQ ID NO: 3606706 - RNA, 13 nt, Salmonella enterica enterica serovar Typhi
agccgggcaggaa

SEQ ID NO: 3606707 - RNA, 19 nt, Salmonella enterica enterica serovar Typhi
agccgguaaucacugccgc

SEQ ID NO: 3606708 - RNA, 20 nt, Salmonella enterica enterica serovar Typhi
agccgguaaucacugccgcc

SEQ ID NO: 3606709 - RNA, 16 nt, Salmonella enterica enterica serovar Typhi
agccgguuagccacaa

SEQ ID NO: 3606710 - RNA, 19 nt, Salmonella enterica enterica serovar Typhi
agccgguuagccacaauga

SEQ ID NO: 3606711 - RNA, 17 nt, Salmonella enterica enterica serovar Typhi
agccguaucuuccggug

SEQ ID NO: 3606712 - RNA, 22 nt, Salmonella enterica enterica serovar Typhi
agccgucgccggccuguuaaug

SEQ ID NO: 3606713 - RNA, 17 nt, Salmonella enterica enterica serovar Typhi
agccgucguugcugucg

SEQ ID NO: 3606714 - RNA, 22 nt, Salmonella enterica enterica serovar Typhi
agccgugaauggucacauucug

SEQ ID NO: 3606715 - RNA, 13 nt, Salmonella enterica enterica serovar Typhi
agccguuaccgcc

SEQ ID NO: 3606716 - RNA, 15 nt, Salmonella enterica enterica serovar Typhi
agccguuaccgccga

SEQ ID NO: 3606717 - RNA, 18 nt, Salmonella enterica enterica serovar Typhi
agccguuacuucccccau

SEQ ID NO: 3606718 - RNA, 23 nt, Salmonella enterica enterica serovar Typhi
agccguucaccagccacugcgcc

SEQ ID NO: 3606719 - RNA, 15 nt, Salmonella enterica enterica serovar Typhi
agccguucuccagcg

SEQ ID NO: 3606720 - RNA, 14 nt, Salmonella enterica enterica serovar Typhi
agccguuucuuguc

SEQ ID NO: 3606721 - RNA, 18 nt, Salmonella enterica enterica serovar Typhi
agccguuuugcugucugg

SEQ ID NO: 3606722 - RNA, 22 nt, Salmonella enterica enterica serovar Typhi
agccuaaugacggacgcagacc

SEQ ID NO: 3606723 - RNA, 22 nt, Salmonella enterica enterica serovar Typhi
agccuaaugggccagauucuua

SEQ ID NO: 3606724 - RNA, 14 nt, Salmonella enterica enterica serovar Typhi
agccuaccugccgc

SEQ ID NO: 3606725 - RNA, 18 nt, Salmonella enterica enterica serovar Typhi
agccuaccugccgccaua

SEQ ID NO: 3606726 - RNA, 21 nt, Salmonella enterica enterica serovar Typhi
agccucauuuuugaguuuguc

SEQ ID NO: 3606727 - RNA, 23 nt, Salmonella enterica enterica serovar Typhi
agccucauuuuugaguuugucau

SEQ ID NO: 3606728 - RNA, 14 nt, Salmonella enterica enterica serovar Typhi
agccucgcgcaucc

SEQ ID NO: 3606729 - RNA, 11 nt, Salmonella enterica enterica serovar Typhi
agccucuuuca

SEQ ID NO: 3606730 - RNA, 18 nt, Salmonella enterica enterica serovar Typhi
agccugaagccagcaauc

SEQ ID NO: 3606731 - RNA, 22 nt, Salmonella enterica enterica serovar Typhi
agccugaagccagcaaucagcc

SEQ ID NO: 3606732 - RNA, 17 nt, Salmonella enterica enterica serovar Typhi
agccugacgaauagcgc

SEQ ID NO: 3606733 - RNA, 17 nt, Salmonella enterica enterica serovar Typhi
agccugagcgcgaggca

SEQ ID NO: 3606734 - RNA, 18 nt, Salmonella enterica enterica serovar Typhi
agccugauacuuuuacuc

SEQ ID NO: 3606735 - RNA, 21 nt, Salmonella enterica enterica serovar Typhi
agccugauggcgcuacgcuua

SEQ ID NO: 3606736 - RNA, 23 nt, Salmonella enterica enterica serovar Typhi
agccugcuggucugaaucugcuc

SEQ ID NO: 3606737 - RNA, 21 nt, Salmonella enterica enterica serovar Typhi
agccuggauagcaauuucagc

SEQ ID NO: 3606738 - RNA, 14 nt, Salmonella enterica enterica serovar Typhi
agccugggcaaggc

SEQ ID NO: 3606739 - RNA, 14 nt, Salmonella enterica enterica serovar Typhi
agccuggugcccaa

SEQ ID NO: 3606740 - RNA, 17 nt, Salmonella enterica enterica serovar Typhi
agccugugaucggagaa

SEQ ID NO: 3606741 - RNA, 16 nt, Salmonella enterica enterica serovar Typhi
agccugugcaaccagc

SEQ ID NO: 3606742 - RNA, 20 nt, Salmonella enterica enterica serovar Typhi
agccugugcaaccagcucuu

SEQ ID NO: 3606743 - RNA, 15 nt, Salmonella enterica enterica serovar Typhi
agccugugcgccugc

SEQ ID NO: 3606744 - RNA, 22 nt, Salmonella enterica enterica serovar Typhi
agccuuaaucaacugcgccaca

SEQ ID NO: 3606745 - RNA, 20 nt, Salmonella enterica enterica serovar Typhi
agccuuacaggcgcaucaga

SEQ ID NO: 3606746 - RNA, 21 nt, Salmonella enterica enterica serovar Typhi
agccuuacaggcgcaucagaa

SEQ ID NO: 3606747 - RNA, 22 nt, Salmonella enterica enterica serovar Typhi
agccuuacaggcgcaucagaaa

SEQ ID NO: 3606748 - RNA, 23 nt, Salmonella enterica enterica serovar Typhi
agccuuacaggcgcaucagaaaa

SEQ ID NO: 3606749 - RNA, 12 nt, Salmonella enterica enterica serovar Typhi
agccuuauaaga

SEQ ID NO: 3606750 - RNA, 17 nt, Salmonella enterica enterica serovar Typhi
agccuuauaagaaccau

SEQ ID NO: 3606751 - RNA, 13 nt, Salmonella enterica enterica serovar Typhi
agccuucaacaaa

SEQ ID NO: 3606752 - RNA, 16 nt, Salmonella enterica enterica serovar Typhi
agccuucaaguuuuag

SEQ ID NO: 3606753 - RNA, 23 nt, Salmonella enterica enterica serovar Typhi
agccuucaauuugaccugaccug

SEQ ID NO: 3606754 - RNA, 15 nt, Salmonella enterica enterica serovar Typhi
agccuuccuggucug

SEQ ID NO: 3606755 - RNA, 19 nt, Salmonella enterica enterica serovar Typhi
agccuuccuggucugccag

SEQ ID NO: 3606756 - RNA, 15 nt, Salmonella enterica enterica serovar Typhi
agccuucuccccuuc

SEQ ID NO: 3606757 - RNA, 22 nt, Salmonella enterica enterica serovar Typhi
agccuucuccccuucaucagua

SEQ ID NO: 3606758 - RNA, 14 nt, Salmonella enterica enterica serovar Typhi
agccuuuccgcaug

SEQ ID NO: 3606759 - RNA, 19 nt, Salmonella enterica enterica serovar Typhi
agcgaaaauaaacgcuuga

SEQ ID NO: 3606760 - RNA, 16 nt, Salmonella enterica enterica serovar Typhi
agcgaaacugauauua

SEQ ID NO: 3606761 - RNA, 21 nt, Salmonella enterica enterica serovar Typhi
agcgaaaugacggccaccagc

SEQ ID NO: 3606762 - RNA, 15 nt, Salmonella enterica enterica serovar Typhi
agcgaaaugcgaauc

SEQ ID NO: 3606763 - RNA, 14 nt, Salmonella enterica enterica serovar Typhi
agcgccaugaagau

SEQ ID NO: 3606764 - RNA, 13 nt, Salmonella enterica enterica serovar Typhi
agcgccauugcua

SEQ ID NO: 3606765 - RNA, 14 nt, Salmonella enterica enterica serovar Typhi
agcgccccaguaac

SEQ ID NO: 3606766 - RNA, 15 nt, Salmonella enterica enterica serovar Typhi
agcgcccccagcaaa

SEQ ID NO: 3606767 - RNA, 21 nt, Salmonella enterica enterica serovar Typhi
agcgcccgcuguccgcccagu

SEQ ID NO: 3606768 - RNA, 13 nt, Salmonella enterica enterica serovar Typhi
agcgcccggugau

SEQ ID NO: 3606769 - RNA, 22 nt, Salmonella enterica enterica serovar Typhi
agcgcccgguucaucggcucga

SEQ ID NO: 3606770 - RNA, 15 nt, Salmonella enterica enterica serovar Typhi
agcgcccuggucagc

SEQ ID NO: 3606771 - RNA, 16 nt, Salmonella enterica enterica serovar Typhi
agcgcccuggucagca

SEQ ID NO: 3606772 - RNA, 19 nt, Salmonella enterica enterica serovar Typhi
agcgcccuggucagcauca

SEQ ID NO: 3606773 - RNA, 13 nt, Salmonella enterica enterica serovar Typhi
agcgccgccaaga

SEQ ID NO: 3606774 - RNA, 17 nt, Salmonella enterica enterica serovar Typhi
agcgccgccagauaaag

SEQ ID NO: 3606775 - RNA, 21 nt, Salmonella enterica enterica serovar Typhi
agcgccgccagauaaagcgaa

SEQ ID NO: 3606776 - RNA, 19 nt, Salmonella enterica enterica serovar Typhi
agcgccggaucgggcuucc

SEQ ID NO: 3606777 - RNA, 20 nt, Salmonella enterica enterica serovar Typhi
agcgccggaugaggacauaa

SEQ ID NO: 3606778 - RNA, 16 nt, Salmonella enterica enterica serovar Typhi
agcgccggcaaagcca

SEQ ID NO: 3606779 - RNA, 15 nt, Salmonella enterica enterica serovar Typhi
agcgccggcagcagu

SEQ ID NO: 3606780 - RNA, 20 nt, Salmonella enterica enterica serovar Typhi
agcgccggcagcaguucuuc

SEQ ID NO: 3606781 - RNA, 15 nt, Salmonella enterica enterica serovar Typhi
agcgccgguuucucc

SEQ ID NO: 3606782 - RNA, 21 nt, Salmonella enterica enterica serovar Typhi
agcgccgucauggcaaacgaa

SEQ ID NO: 3606783 - RNA, 20 nt, Salmonella enterica enterica serovar Typhi
agcgccgucgccaucaccag

SEQ ID NO: 3606784 - RNA, 18 nt, Salmonella enterica enterica serovar Typhi
agcgccguuaaacugcgc

SEQ ID NO: 3606785 - RNA, 21 nt, Salmonella enterica enterica serovar Typhi
agcgccguuaacgcggccgua

SEQ ID NO: 3606786 - RNA, 15 nt, Salmonella enterica enterica serovar Typhi
agcgccuccggguuu

SEQ ID NO: 3606787 - RNA, 14 nt, Salmonella enterica enterica serovar Typhi
agcgccucgcaaaa

SEQ ID NO: 3606788 - RNA, 16 nt, Salmonella enterica enterica serovar Typhi
agcgccucugauuuuu

SEQ ID NO: 3606789 - RNA, 20 nt, Salmonella enterica enterica serovar Typhi
agcgccugcugcgcaacauc

SEQ ID NO: 3606790 - RNA, 22 nt, Salmonella enterica enterica serovar Typhi
agcgccugcuguaaaauauccc

SEQ ID NO: 3606791 - RNA, 20 nt, Salmonella enterica enterica serovar Typhi
agcgccuguaaacguuccug

SEQ ID NO: 3606792 - RNA, 14 nt, Salmonella enterica enterica serovar Typhi
agcgccuguagcgu

SEQ ID NO: 3606793 - RNA, 20 nt, Salmonella enterica enterica serovar Typhi
agcgccugugcuuucgccac

SEQ ID NO: 3606794 - RNA, 20 nt, Salmonella enterica enterica serovar Typhi
agcgccuuauccggccuacg

SEQ ID NO: 3606795 - RNA, 14 nt, Salmonella enterica enterica serovar Typhi
agcgccuucaggca

SEQ ID NO: 3606796 - RNA, 15 nt, Salmonella enterica enterica serovar Typhi
agcgccuuugcgaau

SEQ ID NO: 3606797 - RNA, 15 nt, Salmonella enterica enterica serovar Typhi
agcgccuuuuaaggu

SEQ ID NO: 3606798 - RNA, 16 nt, Salmonella enterica enterica serovar Typhi
agcgcgaacaggcugg

SEQ ID NO: 3606799 - RNA, 16 nt, Salmonella enterica enterica serovar Typhi
agcgcgaaugauuuua

SEQ ID NO: 3606800 - RNA, 23 nt, Salmonella enterica enterica serovar Typhi
agcgcgaauuuuauuaagcaggc

SEQ ID NO: 3606801 - RNA, 14 nt, Salmonella enterica enterica serovar Typhi
agcgcgaccgguuu

SEQ ID NO: 3606802 - RNA, 20 nt, Salmonella enterica enterica serovar Typhi
agcgcgagagucaaggcauc

SEQ ID NO: 3606803 - RNA, 12 nt, Salmonella enterica enterica serovar Typhi
agcgcgauaaaa

SEQ ID NO: 3606804 - RNA, 21 nt, Salmonella enterica enterica serovar Typhi
agcgcgauacgcagcaccgcc

SEQ ID NO: 3606805 - RNA, 19 nt, Salmonella enterica enterica serovar Typhi
agcgcgauacgcgacggcg

SEQ ID NO: 3606806 - RNA, 21 nt, Salmonella enterica enterica serovar Typhi
agcgcgaucgccccgaccagg

SEQ ID NO: 3606807 - RNA, 17 nt, Salmonella enterica enterica serovar Typhi
agcgcgcagcugggccu

SEQ ID NO: 3606808 - RNA, 20 nt, Salmonella enterica enterica serovar Typhi
agcgcgcagcugggccugcu

SEQ ID NO: 3606809 - RNA, 21 nt, Salmonella enterica enterica serovar Typhi
agcgcgccaauggccgccccc

SEQ ID NO: 3606810 - RNA, 22 nt, Salmonella enterica enterica serovar Typhi
agcgcgccaugagacgcguaaa

SEQ ID NO: 3606811 - RNA, 17 nt, Salmonella enterica enterica serovar Typhi
agcgcgccgcagcgccg

SEQ ID NO: 3606812 - RNA, 18 nt, Salmonella enterica enterica serovar Typhi
agcgcgccgcagcgccga

SEQ ID NO: 3606813 - RNA, 15 nt, Salmonella enterica enterica serovar Typhi
agcgcgccgcccugu

SEQ ID NO: 3606814 - RNA, 21 nt, Salmonella enterica enterica serovar Typhi
agcgcgccggauauggcgucc

SEQ ID NO: 3606815 - RNA, 15 nt, Salmonella enterica enterica serovar Typhi
agcgcgcgcaguuug

SEQ ID NO: 3606816 - RNA, 13 nt, Salmonella enterica enterica serovar Typhi
agcgcgcgcgccu

SEQ ID NO: 3606817 - RNA, 20 nt, Salmonella enterica enterica serovar Typhi
agcgcgcgcgccugaugcgc

SEQ ID NO: 3606818 - RNA, 21 nt, Salmonella enterica enterica serovar Typhi
agcgcgcgcgccugaugcgcc

SEQ ID NO: 3606819 - RNA, 16 nt, Salmonella enterica enterica serovar Typhi
agcgcgcguagcagca

SEQ ID NO: 3606820 - RNA, 13 nt, Salmonella enterica enterica serovar Typhi
agcgcgcuggcaa

SEQ ID NO: 3606821 - RNA, 23 nt, Salmonella enterica enterica serovar Typhi
agcgcggaagccacguucuucca

SEQ ID NO: 3606822 - RNA, 23 nt, Salmonella enterica enterica serovar Typhi
agcgcggacagcagaauauugcu

SEQ ID NO: 3606823 - RNA, 19 nt, Salmonella enterica enterica serovar Typhi
agcgcggcauuaauuucuu

SEQ ID NO: 3606824 - RNA, 15 nt, Salmonella enterica enterica serovar Typhi
agcgcggccagaaug

SEQ ID NO: 3606825 - RNA, 16 nt, Salmonella enterica enterica serovar Typhi
agcgcggccagcgccu

SEQ ID NO: 3606826 - RNA, 13 nt, Salmonella enterica enterica serovar Typhi
agcgcggcgccca

SEQ ID NO: 3606827 - RNA, 22 nt, Salmonella enterica enterica serovar Typhi
agcgcggcggcaacugagcgaa

SEQ ID NO: 3606828 - RNA, 19 nt, Salmonella enterica enterica serovar Typhi
agcgcggcgugaucaaauu

SEQ ID NO: 3606829 - RNA, 17 nt, Salmonella enterica enterica serovar Typhi
agcgcgggccugccugu

SEQ ID NO: 3606830 - RNA, 21 nt, Salmonella enterica enterica serovar Typhi
agcgcgguggcuuuuuccugc

SEQ ID NO: 3606831 - RNA, 17 nt, Salmonella enterica enterica serovar Typhi
agcgcguaggccagaug

SEQ ID NO: 3606832 - RNA, 15 nt, Salmonella enterica enterica serovar Typhi
agcgcgucagcgccu

SEQ ID NO: 3606833 - RNA, 18 nt, Salmonella enterica enterica serovar Typhi
agcgcgucagcgccuccg

SEQ ID NO: 3606834 - RNA, 18 nt, Salmonella enterica enterica serovar Typhi
agcgcgucguugccuuug

SEQ ID NO: 3606835 - RNA, 14 nt, Salmonella enterica enterica serovar Typhi
agcgcguucagggu

SEQ ID NO: 3606836 - RNA, 19 nt, Salmonella enterica enterica serovar Typhi
agcgcguucgccgucacgc

SEQ ID NO: 3606837 - RNA, 16 nt, Salmonella enterica enterica serovar Typhi
agcgcuaagcaacagu

SEQ ID NO: 3606838 - RNA, 16 nt, Salmonella enterica enterica serovar Typhi
agcgcuaauugugcgg

SEQ ID NO: 3606839 - RNA, 14 nt, Salmonella enterica enterica serovar Typhi
agcgcuacgccugu

SEQ ID NO: 3606840 - RNA, 17 nt, Salmonella enterica enterica serovar Typhi
agcgcucaaauaaugca

SEQ ID NO: 3606841 - RNA, 14 nt, Salmonella enterica enterica serovar Typhi
agcgcucaggcagc

SEQ ID NO: 3606842 - RNA, 12 nt, Salmonella enterica enterica serovar Typhi
agcgcuccccac

SEQ ID NO: 3606843 - RNA, 15 nt, Salmonella enterica enterica serovar Typhi
agcgcuccggcauaa

SEQ ID NO: 3606844 - RNA, 18 nt, Salmonella enterica enterica serovar Typhi
agcgcuccgggguucuuu

SEQ ID NO: 3606845 - RNA, 16 nt, Salmonella enterica enterica serovar Typhi
agcgcugaugcaggca

SEQ ID NO: 3606846 - RNA, 15 nt, Salmonella enterica enterica serovar Typhi
agcgcugcggcuaca

SEQ ID NO: 3606847 - RNA, 20 nt, Salmonella enterica enterica serovar Typhi
agcgcuggcgccgcaaacca

SEQ ID NO: 3606848 - RNA, 16 nt, Salmonella enterica enterica serovar Typhi
agcgcuucuaacgaaa

SEQ ID NO: 3606849 - RNA, 18 nt, Salmonella enterica enterica serovar Typhi
agcgucucagcaggcggc

SEQ ID NO: 3606850 - RNA, 22 nt, Salmonella enterica enterica serovar Typhi
agcgucuguuucaacgcaucca

SEQ ID NO: 3606851 - RNA, 21 nt, Salmonella enterica enterica serovar Typhi
agcgucuuccuguaucccaaa

SEQ ID NO: 3606852 - RNA, 22 nt, Salmonella enterica enterica serovar Typhi
agcgugaaaagcuuagaacuca

SEQ ID NO: 3606853 - RNA, 20 nt, Salmonella enterica enterica serovar Typhi
agcgugacgaccggcacggu

SEQ ID NO: 3606854 - RNA, 18 nt, Salmonella enterica enterica serovar Typhi
agcgugcaaccccuugcg

SEQ ID NO: 3606855 - RNA, 12 nt, Salmonella enterica enterica serovar Typhi
agcgugccgacg

SEQ ID NO: 3606856 - RNA, 23 nt, Salmonella enterica enterica serovar Typhi
agcgugccgagcaacagaaacca

SEQ ID NO: 3606857 - RNA, 22 nt, Salmonella enterica enterica serovar Typhi
agcgugcguucauggcgcgaca

SEQ ID NO: 3606858 - RNA, 23 nt, Salmonella enterica enterica serovar Typhi
agcguuaacgacgcuccagaauc

SEQ ID NO: 3606859 - RNA, 13 nt, Salmonella enterica enterica serovar Typhi
agcguuaaucacc

SEQ ID NO: 3606860 - RNA, 20 nt, Salmonella enterica enterica serovar Typhi
agcguuacccagacagcaaa

SEQ ID NO: 3606861 - RNA, 15 nt, Salmonella enterica enterica serovar Typhi
agcguuacgcgcugc

SEQ ID NO: 3606862 - RNA, 15 nt, Salmonella enterica enterica serovar Typhi
agcguuagcgcaaaa

SEQ ID NO: 3606863 - RNA, 20 nt, Salmonella enterica enterica serovar Typhi
agcguuagcgccauccggca

SEQ ID NO: 3606864 - RNA, 20 nt, Salmonella enterica enterica serovar Typhi
agcguuaucuguaauugacg

SEQ ID NO: 3606865 - RNA, 21 nt, Salmonella enterica enterica serovar Typhi
agcguucaugcuggucagcaa

SEQ ID NO: 3606866 - RNA, 21 nt, Salmonella enterica enterica serovar Typhi
agcguucauucccgccaauaa

SEQ ID NO: 3606867 - RNA, 20 nt, Salmonella enterica enterica serovar Typhi
agcguucucacggucuccug

SEQ ID NO: 3606868 - RNA, 18 nt, Salmonella enterica enterica serovar Typhi
agcguucugcacgccggu

SEQ ID NO: 3606869 - RNA, 17 nt, Salmonella enterica enterica serovar Typhi
agcguucuuuccaguuc

SEQ ID NO: 3606870 - RNA, 14 nt, Salmonella enterica enterica serovar Typhi
agcguugauaugcu

SEQ ID NO: 3606871 - RNA, 17 nt, Salmonella enterica enterica serovar Typhi
agcguugauaugcucga

SEQ ID NO: 3606872 - RNA, 19 nt, Salmonella enterica enterica serovar Typhi
agcguugcagccacguugc

SEQ ID NO: 3606873 - RNA, 19 nt, Salmonella enterica enterica serovar Typhi
agcguuuaaaaagcugcau

SEQ ID NO: 3606874 - RNA, 19 nt, Salmonella enterica enterica serovar Typhi
agcguuuauguuugcugau

SEQ ID NO: 3606875 - RNA, 14 nt, Salmonella enterica enterica serovar Typhi
agcguuucacgcgc

SEQ ID NO: 3606876 - RNA, 12 nt, Salmonella enterica enterica serovar Typhi
agcguuuccaga

SEQ ID NO: 3606877 - RNA, 15 nt, Salmonella enterica enterica serovar Typhi
agcguuucgccguaa

SEQ ID NO: 3606878 - RNA, 19 nt, Salmonella enterica enterica serovar Typhi
agcguuugacggauuuuuu

SEQ ID NO: 3606879 - RNA, 22 nt, Salmonella enterica enterica serovar Typhi
agcguuuguuugucgauuuccg

SEQ ID NO: 3606880 - RNA, 20 nt, Salmonella enterica enterica serovar Typhi
agcguuuugauguccagaug

SEQ ID NO: 3606881 - RNA, 18 nt, Salmonella enterica enterica serovar Typhi
agcguuuuuaccggcucg

SEQ ID NO: 3606882 - RNA, 13 nt, Salmonella enterica enterica serovar Typhi
agcuaaaaacagc

SEQ ID NO: 3606883 - RNA, 19 nt, Salmonella enterica enterica serovar Typhi
agcuaaauaaaaauaauca

SEQ ID NO: 3606884 - RNA, 23 nt, Salmonella enterica enterica serovar Typhi
agcuaacgacccgaagugguggg

SEQ ID NO: 3606885 - RNA, 15 nt, Salmonella enterica enterica serovar Typhi
agcuaaucacccacu

SEQ ID NO: 3606886 - RNA, 17 nt, Salmonella enterica enterica serovar Typhi
agcuaaucacccacuuc

SEQ ID NO: 3606887 - RNA, 18 nt, Salmonella enterica enterica serovar Typhi
agcuaauccccagcgcuc

SEQ ID NO: 3606888 - RNA, 18 nt, Salmonella enterica enterica serovar Typhi
agcuaaugcaauaaacua

SEQ ID NO: 3606889 - RNA, 22 nt, Salmonella enterica enterica serovar Typhi
agcuacuugaucggcuggcgca

SEQ ID NO: 3606890 - RNA, 18 nt, Salmonella enterica enterica serovar Typhi
agcuauccaguuucugac

SEQ ID NO: 3606891 - RNA, 19 nt, Salmonella enterica enterica serovar Typhi
agcuaucgcgccggacagc

SEQ ID NO: 3606892 - RNA, 19 nt, Salmonella enterica enterica serovar Typhi
agcuauucauuauuuuuaa

SEQ ID NO: 3606893 - RNA, 19 nt, Salmonella enterica enterica serovar Typhi
agcucaacuauuaaagcac

SEQ ID NO: 3606894 - RNA, 18 nt, Salmonella enterica enterica serovar Typhi
agcucaagcccgcgucgu

SEQ ID NO: 3606895 - RNA, 19 nt, Salmonella enterica enterica serovar Typhi
agcucaagcccgcgucguu

SEQ ID NO: 3606896 - RNA, 17 nt, Salmonella enterica enterica serovar Typhi
agcucaccgagacugcc

SEQ ID NO: 3606897 - RNA, 17 nt, Salmonella enterica enterica serovar Typhi
agcucacgcgccagcac

SEQ ID NO: 3606898 - RNA, 18 nt, Salmonella enterica enterica serovar Typhi
agcucacgcgccagcacc

SEQ ID NO: 3606899 - RNA, 19 nt, Salmonella enterica enterica serovar Typhi
agcucacgcgccagcacca

SEQ ID NO: 3606900 - RNA, 18 nt, Salmonella enterica enterica serovar Typhi
agcucagaaauaaaacca

SEQ ID NO: 3606901 - RNA, 23 nt, Salmonella enterica enterica serovar Typhi
agcucagaaauaaaaccagggaa

SEQ ID NO: 3606902 - RNA, 14 nt, Salmonella enterica enterica serovar Typhi
agcucaggcgggga

SEQ ID NO: 3606903 - RNA, 17 nt, Salmonella enterica enterica serovar Typhi
agcucaguugguagagc

SEQ ID NO: 3606904 - RNA, 15 nt, Salmonella enterica enterica serovar Typhi
agcucaguuuccagc

SEQ ID NO: 3606905 - RNA, 18 nt, Salmonella enterica enterica serovar Typhi
agcucaguuuccagccag

SEQ ID NO: 3606906 - RNA, 22 nt, Salmonella enterica enterica serovar Typhi
agcucauguagucauauugcgc

SEQ ID NO: 3606907 - RNA, 13 nt, Salmonella enterica enterica serovar Typhi
agcucauuuuuac

SEQ ID NO: 3606908 - RNA, 17 nt, Salmonella enterica enterica serovar Typhi
agcuccagccgcugccu

SEQ ID NO: 3606909 - RNA, 16 nt, Salmonella enterica enterica serovar Typhi
agcuccagcucagggu

SEQ ID NO: 3606910 - RNA, 19 nt, Salmonella enterica enterica serovar Typhi
agcuccauagaaaucagca

SEQ ID NO: 3606911 - RNA, 19 nt, Salmonella enterica enterica serovar Typhi
agcuccgcaauuuccugau

SEQ ID NO: 3606912 - RNA, 22 nt, Salmonella enterica enterica serovar Typhi
agcuccgcguauucucaaccag

SEQ ID NO: 3606913 - RNA, 16 nt, Salmonella enterica enterica serovar Typhi
agcuccggacgcacca

SEQ ID NO: 3606914 - RNA, 18 nt, Salmonella enterica enterica serovar Typhi
agcuccuuuuaauaaaga

SEQ ID NO: 3606915 - RNA, 21 nt, Salmonella enterica enterica serovar Typhi
agcucgcaugcauagccgcug

SEQ ID NO: 3606916 - RNA, 20 nt, Salmonella enterica enterica serovar Typhi
agcucggcaaagcccaucac

SEQ ID NO: 3606917 - RNA, 21 nt, Salmonella enterica enterica serovar Typhi
agcucggcaaagcccaucacc

SEQ ID NO: 3606918 - RNA, 21 nt, Salmonella enterica enterica serovar Typhi
agcucgguggcgguaucaaug

SEQ ID NO: 3606919 - RNA, 16 nt, Salmonella enterica enterica serovar Typhi
agcucuaccagaccac

SEQ ID NO: 3606920 - RNA, 23 nt, Salmonella enterica enterica serovar Typhi
agcucuguggggggaacggcaga

SEQ ID NO: 3606921 - RNA, 14 nt, Salmonella enterica enterica serovar Typhi
agcucugugugacg

SEQ ID NO: 3606922 - RNA, 16 nt, Salmonella enterica enterica serovar Typhi
agcucuucaauuucca

SEQ ID NO: 3606923 - RNA, 20 nt, Salmonella enterica enterica serovar Typhi
agcucuucaggcguauauuc

SEQ ID NO: 3606924 - RNA, 17 nt, Salmonella enterica enterica serovar Typhi
agcugaaaagauaaagu

SEQ ID NO: 3606925 - RNA, 17 nt, Salmonella enterica enterica serovar Typhi
agcugaacagucccacc

SEQ ID NO: 3606926 - RNA, 14 nt, Salmonella enterica enterica serovar Typhi
agcugaaugguaaa

SEQ ID NO: 3606927 - RNA, 13 nt, Salmonella enterica enterica serovar Typhi
agcugacgcagca

SEQ ID NO: 3606928 - RNA, 18 nt, Salmonella enterica enterica serovar Typhi
agcugacggauacgcugc

SEQ ID NO: 3606929 - RNA, 21 nt, Salmonella enterica enterica serovar Typhi
agcugagcgucaggcgcaucc

SEQ ID NO: 3606930 - RNA, 19 nt, Salmonella enterica enterica serovar Typhi
agcugagcuaaucacccac

SEQ ID NO: 3606931 - RNA, 14 nt, Salmonella enterica enterica serovar Typhi
agcugaguaaggac

SEQ ID NO: 3606932 - RNA, 17 nt, Salmonella enterica enterica serovar Typhi
agcugaguaaggacaga

SEQ ID NO: 3606933 - RNA, 16 nt, Salmonella enterica enterica serovar Typhi
agcugauaagcuagua

SEQ ID NO: 3606934 - RNA, 15 nt, Salmonella enterica enterica serovar Typhi
aggaaggcgugcagc

SEQ ID NO: 3606935 - RNA, 20 nt, Salmonella enterica enterica serovar Typhi
aggaaggucgcauccgcguu

SEQ ID NO: 3606936 - RNA, 20 nt, Salmonella enterica enterica serovar Typhi
aggaaggucuugauggcgau

SEQ ID NO: 3606937 - RNA, 13 nt, Salmonella enterica enterica serovar Typhi
aggaauaacaucg

SEQ ID NO: 3606938 - RNA, 13 nt, Salmonella enterica enterica serovar Typhi
aggaauaacgcgc

SEQ ID NO: 3606939 - RNA, 20 nt, Salmonella enterica enterica serovar Typhi
aggaauacaaaaaagccgau

SEQ ID NO: 3606940 - RNA, 19 nt, Salmonella enterica enterica serovar Typhi
aggaauacauuaacgcugg

SEQ ID NO: 3606941 - RNA, 15 nt, Salmonella enterica enterica serovar Typhi
aggaauauaccauca

SEQ ID NO: 3606942 - RNA, 19 nt, Salmonella enterica enterica serovar Typhi
aggaaugaaaacgaaucga

SEQ ID NO: 3606943 - RNA, 17 nt, Salmonella enterica enterica serovar Typhi
aggaaugcccagcucag

SEQ ID NO: 3606944 - RNA, 20 nt, Salmonella enterica enterica serovar Typhi
aggaaugcccagcucagcuu

SEQ ID NO: 3606945 - RNA, 22 nt, Salmonella enterica enterica serovar Typhi
aggaauuacgggcgauacaccu

SEQ ID NO: 3606946 - RNA, 17 nt, Salmonella enterica enterica serovar Typhi
aggaauuccaguccuuu

SEQ ID NO: 3606947 - RNA, 13 nt, Salmonella enterica enterica serovar Typhi
aggaauucuccac

SEQ ID NO: 3606948 - RNA, 13 nt, Salmonella enterica enterica serovar Typhi
aggacaaaaaugg

SEQ ID NO: 3606949 - RNA, 15 nt, Salmonella enterica enterica serovar Typhi
aggacaaaaauggau

SEQ ID NO: 3606950 - RNA, 14 nt, Salmonella enterica enterica serovar Typhi
aggacacaguaaug

SEQ ID NO: 3606951 - RNA, 16 nt, Salmonella enterica enterica serovar Typhi
aggacaucaaaggcag

SEQ ID NO: 3606952 - RNA, 19 nt, Salmonella enterica enterica serovar Typhi
aggacauucaguacgcuuu

SEQ ID NO: 3606953 - RNA, 17 nt, Salmonella enterica enterica serovar Typhi
aggaccaaaacaguacu

SEQ ID NO: 3606954 - RNA, 16 nt, Salmonella enterica enterica serovar Typhi
aggacgggacuugaac

SEQ ID NO: 3606955 - RNA, 14 nt, Salmonella enterica enterica serovar Typhi
aggacguucuucuc

SEQ ID NO: 3606956 - RNA, 15 nt, Salmonella enterica enterica serovar Typhi
aggacucaaucacuu

SEQ ID NO: 3606957 - RNA, 16 nt, Salmonella enterica enterica serovar Typhi
aggacucaaucacuua

SEQ ID NO: 3606958 - RNA, 17 nt, Salmonella enterica enterica serovar Typhi
aggacugauacagccaa

SEQ ID NO: 3606959 - RNA, 18 nt, Salmonella enterica enterica serovar Typhi
aggagagccagaagaaua

SEQ ID NO: 3606960 - RNA, 19 nt, Salmonella enterica enterica serovar Typhi
aggagagucgauacgcuga

SEQ ID NO: 3606961 - RNA, 17 nt, Salmonella enterica enterica serovar Typhi
aggagaugaccugccca

SEQ ID NO: 3606962 - RNA, 14 nt, Salmonella enterica enterica serovar Typhi
aggagaugucccac

SEQ ID NO: 3606963 - RNA, 17 nt, Salmonella enterica enterica serovar Typhi
aggagcucggccaucug

SEQ ID NO: 3606964 - RNA, 16 nt, Salmonella enterica enterica serovar Typhi
aggaggcgcguuuacu

SEQ ID NO: 3606965 - RNA, 14 nt, Salmonella enterica enterica serovar Typhi
aggaguaguuaaaa

SEQ ID NO: 3606966 - RNA, 22 nt, Salmonella enterica enterica serovar Typhi
aggauaaaauccugcacgccgg

SEQ ID NO: 3606967 - RNA, 15 nt, Salmonella enterica enterica serovar Typhi
aggauaaaaucgcca

SEQ ID NO: 3606968 - RNA, 15 nt, Salmonella enterica enterica serovar Typhi
aggauaaccuuccgg

SEQ ID NO: 3606969 - RNA, 18 nt, Salmonella enterica enterica serovar Typhi
aggauaaccuuccggcac

SEQ ID NO: 3606970 - RNA, 23 nt, Salmonella enterica enterica serovar Typhi
aggauaauaguguuagcgucagu

SEQ ID NO: 3606971 - RNA, 19 nt, Salmonella enterica enterica serovar Typhi
aggauaauucccccaguag

SEQ ID NO: 3606972 - RNA, 15 nt, Salmonella enterica enterica serovar Typhi
aggauacagccgacu

SEQ ID NO: 3606973 - RNA, 19 nt, Salmonella enterica enterica serovar Typhi
aggauagcgaccagcguca

SEQ ID NO: 3606974 - RNA, 21 nt, Salmonella enterica enterica serovar Typhi
aggauagcuuuguauauguuu

SEQ ID NO: 3606975 - RNA, 17 nt, Salmonella enterica enterica serovar Typhi
aggauaguacugaccag

SEQ ID NO: 3606976 - RNA, 15 nt, Salmonella enterica enterica serovar Typhi
aggauagugauauag

SEQ ID NO: 3606977 - RNA, 19 nt, Salmonella enterica enterica serovar Typhi
aggauagugauauagcgcc

SEQ ID NO: 3606978 - RNA, 14 nt, Salmonella enterica enterica serovar Typhi
aggauauaagcgcc

SEQ ID NO: 3606979 - RNA, 15 nt, Salmonella enterica enterica serovar Typhi
aggauauaagcgcca

SEQ ID NO: 3606980 - RNA, 15 nt, Salmonella enterica enterica serovar Typhi
aggauauuuauuugc

SEQ ID NO: 3606981 - RNA, 17 nt, Salmonella enterica enterica serovar Typhi
aggauauuuauuugcau

SEQ ID NO: 3606982 - RNA, 21 nt, Salmonella enterica enterica serovar Typhi
aggauauuuugcggcuucagc

SEQ ID NO: 3606983 - RNA, 20 nt, Salmonella enterica enterica serovar Typhi
aggaucaaaaucgcgcccca

SEQ ID NO: 3606984 - RNA, 19 nt, Salmonella enterica enterica serovar Typhi
aggaucaucggccagauaa

SEQ ID NO: 3606985 - RNA, 22 nt, Salmonella enterica enterica serovar Typhi
aggaucguaacaggucacgaca

SEQ ID NO: 3606986 - RNA, 14 nt, Salmonella enterica enterica serovar Typhi
aggaucguaaugau

SEQ ID NO: 3606987 - RNA, 13 nt, Salmonella enterica enterica serovar Typhi
aggaugagcguuu

SEQ ID NO: 3606988 - RNA, 22 nt, Salmonella enterica enterica serovar Typhi
aggaugccccaucucuuucaga

SEQ ID NO: 3606989 - RNA, 21 nt, Salmonella enterica enterica serovar Typhi
aggauggccagcaccagcauu

SEQ ID NO: 3606990 - RNA, 16 nt, Salmonella enterica enterica serovar Typhi
aggauguccaggcgac

SEQ ID NO: 3606991 - RNA, 20 nt, Salmonella enterica enterica serovar Typhi
aggauuauuggcaucauaaa

SEQ ID NO: 3606992 - RNA, 22 nt, Salmonella enterica enterica serovar Typhi
aggauucgacggccagcgcgcg

SEQ ID NO: 3606993 - RNA, 15 nt, Salmonella enterica enterica serovar Typhi
aggauucgccauucc

SEQ ID NO: 3606994 - RNA, 19 nt, Salmonella enterica enterica serovar Typhi
aggauuugucucaucugau

SEQ ID NO: 3606995 - RNA, 18 nt, Salmonella enterica enterica serovar Typhi
aggcaaaaauaggcuuuu

SEQ ID NO: 3606996 - RNA, 21 nt, Salmonella enterica enterica serovar Typhi
aggcaaaaaucgucaucagau

SEQ ID NO: 3606997 - RNA, 15 nt, Salmonella enterica enterica serovar Typhi
aggcaaaaugccagc

SEQ ID NO: 3606998 - RNA, 12 nt, Salmonella enterica enterica serovar Typhi
aggcaaaccagc

SEQ ID NO: 3606999 - RNA, 20 nt, Salmonella enterica enterica serovar Typhi
aggcaaacgcggugaaggca

SEQ ID NO: 3607000 - RNA, 17 nt, Salmonella enterica enterica serovar Typhi
aggcaaagcauaggcca

SEQ ID NO: 3607001 - RNA, 20 nt, Salmonella enterica enterica serovar Typhi
aggcaaagcauaggccacga

SEQ ID NO: 3607002 - RNA, 14 nt, Salmonella enterica enterica serovar Typhi
aggcaaaggaaugc

SEQ ID NO: 3607003 - RNA, 17 nt, Salmonella enterica enterica serovar Typhi
aggcaaaucaacauuau

SEQ ID NO: 3607004 - RNA, 22 nt, Salmonella enterica enterica serovar Typhi
aggcaaaucaacauuauuaaaa

SEQ ID NO: 3607005 - RNA, 16 nt, Salmonella enterica enterica serovar Typhi
aggcaaccugucagua

SEQ ID NO: 3607006 - RNA, 23 nt, Salmonella enterica enterica serovar Typhi
aggcaagauccggacugauaguc

SEQ ID NO: 3607007 - RNA, 19 nt, Salmonella enterica enterica serovar Typhi
aggcaagguuaacgucaga

SEQ ID NO: 3607008 - RNA, 16 nt, Salmonella enterica enterica serovar Typhi
aggcaauaaacaucag

SEQ ID NO: 3607009 - RNA, 19 nt, Salmonella enterica enterica serovar Typhi
aggcaauagaccagcggcc

SEQ ID NO: 3607010 - RNA, 12 nt, Salmonella enterica enterica serovar Typhi
aggcaauauccu

SEQ ID NO: 3607011 - RNA, 14 nt, Salmonella enterica enterica serovar Typhi
aggcaauauccucc

SEQ ID NO: 3607012 - RNA, 19 nt, Salmonella enterica enterica serovar Typhi
aggcaauauccuccggcgu

SEQ ID NO: 3607013 - RNA, 22 nt, Salmonella enterica enterica serovar Typhi
aggcaaucuuuaacgcuggcag

SEQ ID NO: 3607014 - RNA, 23 nt, Salmonella enterica enterica serovar Typhi
aggcaauucuggcgcacauugcu

SEQ ID NO: 3607015 - RNA, 13 nt, Salmonella enterica enterica serovar Typhi
aggcacaacaaua

SEQ ID NO: 3607016 - RNA, 22 nt, Salmonella enterica enterica serovar Typhi
aggcaccguuucuuugcugccg

SEQ ID NO: 3607017 - RNA, 18 nt, Salmonella enterica enterica serovar Typhi
aggcaccugugccauacu

SEQ ID NO: 3607018 - RNA, 14 nt, Salmonella enterica enterica serovar Typhi
aggcacuguggugu

SEQ ID NO: 3607019 - RNA, 20 nt, Salmonella enterica enterica serovar Typhi
aggcacuuuccagaccaaga

SEQ ID NO: 3607020 - RNA, 15 nt, Salmonella enterica enterica serovar Typhi
aggcgauagccccag

SEQ ID NO: 3607021 - RNA, 15 nt, Salmonella enterica enterica serovar Typhi
aggcgauagccgucc

SEQ ID NO: 3607022 - RNA, 22 nt, Salmonella enterica enterica serovar Typhi
aggcgaucggcgugaauaaaau

SEQ ID NO: 3607023 - RNA, 17 nt, Salmonella enterica enterica serovar Typhi
aggcgauucaacagggc

SEQ ID NO: 3607024 - RNA, 13 nt, Salmonella enterica enterica serovar Typhi
aggcgcaaaacca

SEQ ID NO: 3607025 - RNA, 18 nt, Salmonella enterica enterica serovar Typhi
aggcgcaaaaccauacug

SEQ ID NO: 3607026 - RNA, 14 nt, Salmonella enterica enterica serovar Typhi
aggcgcaaaccggu

SEQ ID NO: 3607027 - RNA, 19 nt, Salmonella enterica enterica serovar Typhi
aggcgcagagugagcaggc

SEQ ID NO: 3607028 - RNA, 14 nt, Salmonella enterica enterica serovar Typhi
aggcgcauaucgcc

SEQ ID NO: 3607029 - RNA, 17 nt, Salmonella enterica enterica serovar Typhi
aggcgcaucagaaaaac

SEQ ID NO: 3607030 - RNA, 19 nt, Salmonella enterica enterica serovar Typhi
aggcgcaucagaaaaaccu

SEQ ID NO: 3607031 - RNA, 20 nt, Salmonella enterica enterica serovar Typhi
aggcgcauccgucaggccca

SEQ ID NO: 3607032 - RNA, 22 nt, Salmonella enterica enterica serovar Typhi
aggcgccgcucaucaccagcag

SEQ ID NO: 3607033 - RNA, 23 nt, Salmonella enterica enterica serovar Typhi
aggcgccggggcagcaauaguug

SEQ ID NO: 3607034 - RNA, 21 nt, Salmonella enterica enterica serovar Typhi
aggcgcgaaaaauaggauggc

SEQ ID NO: 3607035 - RNA, 18 nt, Salmonella enterica enterica serovar Typhi
aggcgcgaccucaucaaa

SEQ ID NO: 3607036 - RNA, 15 nt, Salmonella enterica enterica serovar Typhi
aggcgcgcagcugcc

SEQ ID NO: 3607037 - RNA, 17 nt, Salmonella enterica enterica serovar Typhi
aggcgcgcagcugccac

SEQ ID NO: 3607038 - RNA, 18 nt, Salmonella enterica enterica serovar Typhi
aggcgcguagcuggccuu

SEQ ID NO: 3607039 - RNA, 17 nt, Salmonella enterica enterica serovar Typhi
aggcgcguuuacuggcg

SEQ ID NO: 3607040 - RNA, 18 nt, Salmonella enterica enterica serovar Typhi
aggcgcuaauuaauucua

SEQ ID NO: 3607041 - RNA, 20 nt, Salmonella enterica enterica serovar Typhi
aggcgcuauucccaggcaaa

SEQ ID NO: 3607042 - RNA, 14 nt, Salmonella enterica enterica serovar Typhi
aggcgcuggcgagc

SEQ ID NO: 3607043 - RNA, 16 nt, Salmonella enterica enterica serovar Typhi
aggcgcuguacgccuc

SEQ ID NO: 3607044 - RNA, 18 nt, Salmonella enterica enterica serovar Typhi
aggcggagaaaugcgaca

SEQ ID NO: 3607045 - RNA, 14 nt, Salmonella enterica enterica serovar Typhi
aggcggagccgcca

SEQ ID NO: 3607046 - RNA, 23 nt, Salmonella enterica enterica serovar Typhi
aggcggaguuauacagugccagu

SEQ ID NO: 3607047 - RNA, 12 nt, Salmonella enterica enterica serovar Typhi
aggcggcgagcg

SEQ ID NO: 3607048 - RNA, 13 nt, Salmonella enterica enterica serovar Typhi
aggcggcgccgcg

SEQ ID NO: 3607049 - RNA, 23 nt, Salmonella enterica enterica serovar Typhi
aggcggcgccgcgccgccguagc

SEQ ID NO: 3607050 - RNA, 13 nt, Salmonella enterica enterica serovar Typhi
aggcggcggugau

SEQ ID NO: 3607051 - RNA, 16 nt, Salmonella enterica enterica serovar Typhi
aggcggcuaccgccgu

SEQ ID NO: 3607052 - RNA, 14 nt, Salmonella enterica enterica serovar Typhi
aggcggucaucgcc

SEQ ID NO: 3607053 - RNA, 21 nt, Salmonella enterica enterica serovar Typhi
aggcgguuggcuauacgcggc

SEQ ID NO: 3607054 - RNA, 18 nt, Salmonella enterica enterica serovar Typhi
aggcgguuugcaggccgg

SEQ ID NO: 3607055 - RNA, 16 nt, Salmonella enterica enterica serovar Typhi
aggcguaaaaaggcgc

SEQ ID NO: 3607056 - RNA, 16 nt, Salmonella enterica enterica serovar Typhi
aggcguaaaauugccg

SEQ ID NO: 3607057 - RNA, 14 nt, Salmonella enterica enterica serovar Typhi
aggcguaaccgcca

SEQ ID NO: 3607058 - RNA, 16 nt, Salmonella enterica enterica serovar Typhi
aggcguaaccgccauc

SEQ ID NO: 3607059 - RNA, 13 nt, Salmonella enterica enterica serovar Typhi
aggcguaugaaug

SEQ ID NO: 3607060 - RNA, 17 nt, Salmonella enterica enterica serovar Typhi
aggcgucgaccggucca

SEQ ID NO: 3607061 - RNA, 18 nt, Salmonella enterica enterica serovar Typhi
aggcgugguggauaucca

SEQ ID NO: 3607062 - RNA, 15 nt, Salmonella enterica enterica serovar Typhi
aggcguucaugccuu

SEQ ID NO: 3607063 - RNA, 22 nt, Salmonella enterica enterica serovar Typhi
aggcguucccgaaaugggccaa

SEQ ID NO: 3607064 - RNA, 18 nt, Salmonella enterica enterica serovar Typhi
aggcguugaacauuucau

SEQ ID NO: 3607065 - RNA, 18 nt, Salmonella enterica enterica serovar Typhi
aggcguugcuccagcagc

SEQ ID NO: 3607066 - RNA, 21 nt, Salmonella enterica enterica serovar Typhi
aggcguugcuccagcagcgcc

SEQ ID NO: 3607067 - RNA, 19 nt, Salmonella enterica enterica serovar Typhi
aggcguugugcagaaucau

SEQ ID NO: 3607068 - RNA, 18 nt, Salmonella enterica enterica serovar Typhi
aggcguuuugguccgcgc

SEQ ID NO: 3607069 - RNA, 13 nt, Salmonella enterica enterica serovar Typhi
aggcuaaauggca

SEQ ID NO: 3607070 - RNA, 14 nt, Salmonella enterica enterica serovar Typhi
aggcuacccagaca

SEQ ID NO: 3607071 - RNA, 22 nt, Salmonella enterica enterica serovar Typhi
aggcuacgguacugcccaccuu

SEQ ID NO: 3607072 - RNA, 20 nt, Salmonella enterica enterica serovar Typhi
aggcuauuuuauucgccauu

SEQ ID NO: 3607073 - RNA, 16 nt, Salmonella enterica enterica serovar Typhi
aggcucaggaaaacaa

SEQ ID NO: 3607074 - RNA, 16 nt, Salmonella enterica enterica serovar Typhi
aggcucaucagcgcca

SEQ ID NO: 3607075 - RNA, 21 nt, Salmonella enterica enterica serovar Typhi
aggcuccaaguauugauaccu

SEQ ID NO: 3607076 - RNA, 16 nt, Salmonella enterica enterica serovar Typhi
aggcuccgagacucaa

SEQ ID NO: 3607077 - RNA, 20 nt, Salmonella enterica enterica serovar Typhi
aggcuccgagacucaaagaa

SEQ ID NO: 3607078 - RNA, 22 nt, Salmonella enterica enterica serovar Typhi
aggcuccgagacucaaagaaaa

SEQ ID NO: 3607079 - RNA, 21 nt, Salmonella enterica enterica serovar Typhi
aggcuccggcaccaaaccaua

SEQ ID NO: 3607080 - RNA, 20 nt, Salmonella enterica enterica serovar Typhi
aggcucuuauucaaucaauu

SEQ ID NO: 3607081 - RNA, 22 nt, Salmonella enterica enterica serovar Typhi
aggcugacaaagguugcgccaa

SEQ ID NO: 3607082 - RNA, 18 nt, Salmonella enterica enterica serovar Typhi
aggcugagcguagaccgc

SEQ ID NO: 3607083 - RNA, 15 nt, Salmonella enterica enterica serovar Typhi
aggcugccgccagaa

SEQ ID NO: 3607084 - RNA, 15 nt, Salmonella enterica enterica serovar Typhi
aggcugcgcguuuuc

SEQ ID NO: 3607085 - RNA, 21 nt, Salmonella enterica enterica serovar Typhi
aggcugcggcacgcuaaacca

SEQ ID NO: 3607086 - RNA, 14 nt, Salmonella enterica enterica serovar Typhi
aggcuggagagcaa

SEQ ID NO: 3607087 - RNA, 21 nt, Salmonella enterica enterica serovar Typhi
aggcuggagagcaacgccauc

SEQ ID NO: 3607088 - RNA, 14 nt, Salmonella enterica enterica serovar Typhi
aggcugucugccau

SEQ ID NO: 3607089 - RNA, 17 nt, Salmonella enterica enterica serovar Typhi
aggcuguggcugucguu

SEQ ID NO: 3607090 - RNA, 21 nt, Salmonella enterica enterica serovar Typhi
aggcuguugaggaaauucuga

SEQ ID NO: 3607091 - RNA, 23 nt, Salmonella enterica enterica serovar Typhi
aggcuguugaggaaauucugacg

SEQ ID NO: 3607092 - RNA, 19 nt, Salmonella enterica enterica serovar Typhi
aggcuuaacacccggauau

SEQ ID NO: 3607093 - RNA, 16 nt, Salmonella enterica enterica serovar Typhi
aggcuucaaccguuuc

SEQ ID NO: 3607094 - RNA, 13 nt, Salmonella enterica enterica serovar Typhi
aggcuuccagaag

SEQ ID NO: 3607095 - RNA, 14 nt, Salmonella enterica enterica serovar Typhi
aggcuuccagauac

SEQ ID NO: 3607096 - RNA, 14 nt, Salmonella enterica enterica serovar Typhi
aggcuuccggcagc

SEQ ID NO: 3607097 - RNA, 19 nt, Salmonella enterica enterica serovar Typhi
aggcuugccgcgccagacg

SEQ ID NO: 3607098 - RNA, 17 nt, Salmonella enterica enterica serovar Typhi
aggcuuuaugcugacaa

SEQ ID NO: 3607099 - RNA, 14 nt, Salmonella enterica enterica serovar Typhi
aggcuuugcugcug

SEQ ID NO: 3607100 - RNA, 16 nt, Salmonella enterica enterica serovar Typhi
agggaaaaauagcgau

SEQ ID NO: 3607101 - RNA, 21 nt, Salmonella enterica enterica serovar Typhi
agggaaaaauguguugcggcc

SEQ ID NO: 3607102 - RNA, 13 nt, Salmonella enterica enterica serovar Typhi
agggaaaagaagu

SEQ ID NO: 3607103 - RNA, 14 nt, Salmonella enterica enterica serovar Typhi
agggaaaagccauu

SEQ ID NO: 3607104 - RNA, 23 nt, Salmonella enterica enterica serovar Typhi
agggaaaccauguugaucguaaa

SEQ ID NO: 3607105 - RNA, 18 nt, Salmonella enterica enterica serovar Typhi
agggaagacuauuaccac

SEQ ID NO: 3607106 - RNA, 19 nt, Salmonella enterica enterica serovar Typhi
aggucaucuuucagaugca

SEQ ID NO: 3607107 - RNA, 17 nt, Salmonella enterica enterica serovar Typhi
aggucauuauucaggcc

SEQ ID NO: 3607108 - RNA, 17 nt, Salmonella enterica enterica serovar Typhi
aggucgcgauccgcgag

SEQ ID NO: 3607109 - RNA, 16 nt, Salmonella enterica enterica serovar Typhi
aggucgcuauccagca

SEQ ID NO: 3607110 - RNA, 20 nt, Salmonella enterica enterica serovar Typhi
aggucgcuauccagcaguaa

SEQ ID NO: 3607111 - RNA, 23 nt, Salmonella enterica enterica serovar Typhi
aggucgcuauccagcaguaaaua

SEQ ID NO: 3607112 - RNA, 15 nt, Salmonella enterica enterica serovar Typhi
aggucggguaagcgu

SEQ ID NO: 3607113 - RNA, 20 nt, Salmonella enterica enterica serovar Typhi
aggucggguaagcguagcgc

SEQ ID NO: 3607114 - RNA, 20 nt, Salmonella enterica enterica serovar Typhi
aggucggguaaggcguagcc

SEQ ID NO: 3607115 - RNA, 22 nt, Salmonella enterica enterica serovar Typhi
aggucguaaggauacucagcga

SEQ ID NO: 3607116 - RNA, 14 nt, Salmonella enterica enterica serovar Typhi
aggucgucuucuug

SEQ ID NO: 3607117 - RNA, 22 nt, Salmonella enterica enterica serovar Typhi
aggucguuaggccacuucacac

SEQ ID NO: 3607118 - RNA, 21 nt, Salmonella enterica enterica serovar Typhi
aggucuauugccuaaauaacu

SEQ ID NO: 3607119 - RNA, 15 nt, Salmonella enterica enterica serovar Typhi
aggucugacaacuau

SEQ ID NO: 3607120 - RNA, 23 nt, Salmonella enterica enterica serovar Typhi
aggucugagauaauacauaucau

SEQ ID NO: 3607121 - RNA, 18 nt, Salmonella enterica enterica serovar Typhi
aggucuugccaacaaagg

SEQ ID NO: 3607122 - RNA, 14 nt, Salmonella enterica enterica serovar Typhi
aggugaaccauuga

SEQ ID NO: 3607123 - RNA, 13 nt, Salmonella enterica enterica serovar Typhi
aggugaauagcau

SEQ ID NO: 3607124 - RNA, 13 nt, Salmonella enterica enterica serovar Typhi
aggugagcucuuu

SEQ ID NO: 3607125 - RNA, 15 nt, Salmonella enterica enterica serovar Typhi
aggugagcucuuucu

SEQ ID NO: 3607126 - RNA, 15 nt, Salmonella enterica enterica serovar Typhi
aggugagggcgucgc

SEQ ID NO: 3607127 - RNA, 18 nt, Salmonella enterica enterica serovar Typhi
aggugcggauaguccugc

SEQ ID NO: 3607128 - RNA, 15 nt, Salmonella enterica enterica serovar Typhi
aggugcggcugggcg

SEQ ID NO: 3607129 - RNA, 19 nt, Salmonella enterica enterica serovar Typhi
aggugcggcugggcgaggc

SEQ ID NO: 3607130 - RNA, 16 nt, Salmonella enterica enterica serovar Typhi
aggugcuggugguggg

SEQ ID NO: 3607131 - RNA, 14 nt, Salmonella enterica enterica serovar Typhi
aggugcuuaucuga

SEQ ID NO: 3607132 - RNA, 13 nt, Salmonella enterica enterica serovar Typhi
agguggaagaaac

SEQ ID NO: 3607133 - RNA, 15 nt, Salmonella enterica enterica serovar Typhi
agguggcaauauccu

SEQ ID NO: 3607134 - RNA, 21 nt, Salmonella enterica enterica serovar Typhi
agguggcccauuuuggccgcu

SEQ ID NO: 3607135 - RNA, 17 nt, Salmonella enterica enterica serovar Typhi
agguggccgagaggcug

SEQ ID NO: 3607136 - RNA, 22 nt, Salmonella enterica enterica serovar Typhi
aggugugguacggcuuucacac

SEQ ID NO: 3607137 - RNA, 21 nt, Salmonella enterica enterica serovar Typhi
agguguuacgugggucgagaa

SEQ ID NO: 3607138 - RNA, 22 nt, Salmonella enterica enterica serovar Typhi
agguguucagguaaaugaggac

SEQ ID NO: 3607139 - RNA, 13 nt, Salmonella enterica enterica serovar Typhi
agguuaagugaca

SEQ ID NO: 3607140 - RNA, 14 nt, Salmonella enterica enterica serovar Typhi
agguuaauaacugc

SEQ ID NO: 3607141 - RNA, 21 nt, Salmonella enterica enterica serovar Typhi
agguuaauauacauucauuuu

SEQ ID NO: 3607142 - RNA, 22 nt, Salmonella enterica enterica serovar Typhi
agguuaccgaaauaguaccucc

SEQ ID NO: 3607143 - RNA, 16 nt, Salmonella enterica enterica serovar Typhi
agguuacguucaucag

SEQ ID NO: 3607144 - RNA, 19 nt, Salmonella enterica enterica serovar Typhi
agguuacucuuccaccauc

SEQ ID NO: 3607145 - RNA, 13 nt, Salmonella enterica enterica serovar Typhi
agguuagcagcca

SEQ ID NO: 3607146 - RNA, 20 nt, Salmonella enterica enterica serovar Typhi
agguuaguaaugccuucuga

SEQ ID NO: 3607147 - RNA, 22 nt, Salmonella enterica enterica serovar Typhi
agguuauaaacccccuggccgg

SEQ ID NO: 3607148 - RNA, 17 nt, Salmonella enterica enterica serovar Typhi
agguuaucgccgcccgu

SEQ ID NO: 3607149 - RNA, 21 nt, Salmonella enterica enterica serovar Typhi
agguuaucgccgcccguuucc

SEQ ID NO: 3607150 - RNA, 24 nt, Salmonella enterica enterica serovar Typhi
agguuauuaaaaagccagcguaaa

SEQ ID NO: 3607151 - RNA, 16 nt, Salmonella enterica enterica serovar Typhi
agguuauucaggugga

SEQ ID NO: 3607152 - RNA, 13 nt, Salmonella enterica enterica serovar Typhi
agguuauucgccu

SEQ ID NO: 3607153 - RNA, 19 nt, Salmonella enterica enterica serovar Typhi
agguucaauaugccaggca

SEQ ID NO: 3607154 - RNA, 18 nt, Salmonella enterica enterica serovar Typhi
agguucaccaccacccag

SEQ ID NO: 3607155 - RNA, 19 nt, Salmonella enterica enterica serovar Typhi
agguucauauugcgccgca

SEQ ID NO: 3607156 - RNA, 13 nt, Salmonella enterica enterica serovar Typhi
agguucccgcccu

SEQ ID NO: 3607157 - RNA, 15 nt, Salmonella enterica enterica serovar Typhi
agguucccgccgcca

SEQ ID NO: 3607158 - RNA, 17 nt, Salmonella enterica enterica serovar Typhi
agguugaaaggccuaaa

SEQ ID NO: 3607159 - RNA, 15 nt, Salmonella enterica enterica serovar Typhi
agguugcgcccggcg

SEQ ID NO: 3607160 - RNA, 16 nt, Salmonella enterica enterica serovar Typhi
agguugcgcccggcgc

SEQ ID NO: 3607161 - RNA, 21 nt, Salmonella enterica enterica serovar Typhi
agguugcucagguuauacugu

SEQ ID NO: 3607162 - RNA, 15 nt, Salmonella enterica enterica serovar Typhi
agguuuaaaccacuc

SEQ ID NO: 3607163 - RNA, 21 nt, Salmonella enterica enterica serovar Typhi
agguuuaauguugccguggca

SEQ ID NO: 3607164 - RNA, 15 nt, Salmonella enterica enterica serovar Typhi
agguuucuucaucaa

SEQ ID NO: 3607165 - RNA, 22 nt, Salmonella enterica enterica serovar Typhi
agguuugacucgcuacgcucgc

SEQ ID NO: 3607166 - RNA, 23 nt, Salmonella enterica enterica serovar Typhi
agguuuucuaucgcuuuaaucag

SEQ ID NO: 3607167 - RNA, 21 nt, Salmonella enterica enterica serovar Typhi
agguuuucucauccagcuugc

SEQ ID NO: 3607168 - RNA, 23 nt, Salmonella enterica enterica serovar Typhi
agguuuugucaugguaaaugccg

SEQ ID NO: 3607169 - RNA, 23 nt, Salmonella enterica enterica serovar Typhi
aguaaaaugcccugcuggcgcau

SEQ ID NO: 3607170 - RNA, 16 nt, Salmonella enterica enterica serovar Typhi
aguaaaauuuuuuuca

SEQ ID NO: 3607171 - RNA, 17 nt, Salmonella enterica enterica serovar Typhi
aguaaacgcucaagcaa

SEQ ID NO: 3607172 - RNA, 18 nt, Salmonella enterica enterica serovar Typhi
aguaaacuuucagaccuu

SEQ ID NO: 3607173 - RNA, 23 nt, Salmonella enterica enterica serovar Typhi
aguaaauagaaaauaauucuuaa

SEQ ID NO: 3607174 - RNA, 16 nt, Salmonella enterica enterica serovar Typhi
aguaaaugaacguuuu

SEQ ID NO: 3607175 - RNA, 22 nt, Salmonella enterica enterica serovar Typhi
aguaaauugacgcuugacucug

SEQ ID NO: 3607176 - RNA, 15 nt, Salmonella enterica enterica serovar Typhi
aguaaauuuacucag

SEQ ID NO: 3607177 - RNA, 14 nt, Salmonella enterica enterica serovar Typhi
aguaacauaaugcc

SEQ ID NO: 3607178 - RNA, 15 nt, Salmonella enterica enterica serovar Typhi
aguaaccccagggag

SEQ ID NO: 3607179 - RNA, 19 nt, Salmonella enterica enterica serovar Typhi
aguaacgcacuuuuccagc

SEQ ID NO: 3607180 - RNA, 21 nt, Salmonella enterica enterica serovar Typhi
aguaacggcaguguuucccaa

SEQ ID NO: 3607181 - RNA, 22 nt, Salmonella enterica enterica serovar Typhi
aguaacgggcaucgccgcaacu

SEQ ID NO: 3607182 - RNA, 19 nt, Salmonella enterica enterica serovar Typhi
aguaacguuaauacaucau

SEQ ID NO: 3607183 - RNA, 18 nt, Salmonella enterica enterica serovar Typhi
aguaacugcaaaucuucg

SEQ ID NO: 3607184 - RNA, 17 nt, Salmonella enterica enterica serovar Typhi
aguaacugguuaccaca

SEQ ID NO: 3607185 - RNA, 16 nt, Salmonella enterica enterica serovar Typhi
aguaagcgccagccgu

SEQ ID NO: 3607186 - RNA, 16 nt, Salmonella enterica enterica serovar Typhi
aguaagcuauuccugu

SEQ ID NO: 3607187 - RNA, 20 nt, Salmonella enterica enterica serovar Typhi
aguaauaacaaaaaacauau

SEQ ID NO: 3607188 - RNA, 14 nt, Salmonella enterica enterica serovar Typhi
aguaauaaucacau

SEQ ID NO: 3607189 - RNA, 21 nt, Salmonella enterica enterica serovar Typhi
aguaauauaaccaauuuaaaa

SEQ ID NO: 3607190 - RNA, 23 nt, Salmonella enterica enterica serovar Typhi
aguaaugcgcgaauaucuuuguc

SEQ ID NO: 3607191 - RNA, 18 nt, Salmonella enterica enterica serovar Typhi
agugcauguacaacuuca

SEQ ID NO: 3607192 - RNA, 20 nt, Salmonella enterica enterica serovar Typhi
agugccaagcaacacggcga

SEQ ID NO: 3607193 - RNA, 19 nt, Salmonella enterica enterica serovar Typhi
agugcccagcgcgaccugc

SEQ ID NO: 3607194 - RNA, 15 nt, Salmonella enterica enterica serovar Typhi
agugcccgaaagcaa

SEQ ID NO: 3607195 - RNA, 23 nt, Salmonella enterica enterica serovar Typhi
agugcccguuugcgagacggcga

SEQ ID NO: 3607196 - RNA, 17 nt, Salmonella enterica enterica serovar Typhi
agugcgaaguagcugaa

SEQ ID NO: 3607197 - RNA, 19 nt, Salmonella enterica enterica serovar Typhi
agugcgaugggcuucagau

SEQ ID NO: 3607198 - RNA, 15 nt, Salmonella enterica enterica serovar Typhi
agugcgcacucagaa

SEQ ID NO: 3607199 - RNA, 17 nt, Salmonella enterica enterica serovar Typhi
agugcgcauacuaccgc

SEQ ID NO: 3607200 - RNA, 21 nt, Salmonella enterica enterica serovar Typhi
agugcgcauacuaccgcugcg

SEQ ID NO: 3607201 - RNA, 17 nt, Salmonella enterica enterica serovar Typhi
agugcugcgcaaauacg

SEQ ID NO: 3607202 - RNA, 22 nt, Salmonella enterica enterica serovar Typhi
agugcuguuccacgggaucguu

SEQ ID NO: 3607203 - RNA, 16 nt, Salmonella enterica enterica serovar Typhi
agugcuucugcaaaau

SEQ ID NO: 3607204 - RNA, 19 nt, Salmonella enterica enterica serovar Typhi
agugcuugcauuuuacgua

SEQ ID NO: 3607205 - RNA, 23 nt, Salmonella enterica enterica serovar Typhi
aguggaaaacagcauaauaaagc

SEQ ID NO: 3607206 - RNA, 14 nt, Salmonella enterica enterica serovar Typhi
aguggaaucagcca

SEQ ID NO: 3607207 - RNA, 14 nt, Salmonella enterica enterica serovar Typhi
aguggacgcgucgc

SEQ ID NO: 3607208 - RNA, 14 nt, Salmonella enterica enterica serovar Typhi
aguggaucagcaga

SEQ ID NO: 3607209 - RNA, 19 nt, Salmonella enterica enterica serovar Typhi
aguggcauccgaagaacca

SEQ ID NO: 3607210 - RNA, 20 nt, Salmonella enterica enterica serovar Typhi
aguggcgcaauaacugacuc

SEQ ID NO: 3607211 - RNA, 21 nt, Salmonella enterica enterica serovar Typhi
aguggcgccgcaaugccgccu

SEQ ID NO: 3607212 - RNA, 15 nt, Salmonella enterica enterica serovar Typhi
aguggcggcaaaaaa

SEQ ID NO: 3607213 - RNA, 15 nt, Salmonella enterica enterica serovar Typhi
aguggcuaauuucaa

SEQ ID NO: 3607214 - RNA, 20 nt, Salmonella enterica enterica serovar Typhi
aguggcuaauuucaauuuug

SEQ ID NO: 3607215 - RNA, 22 nt, Salmonella enterica enterica serovar Typhi
agugggcgucaaaaucccggcu

SEQ ID NO: 3607216 - RNA, 15 nt, Salmonella enterica enterica serovar Typhi
agugggcuaugaaga

SEQ ID NO: 3607217 - RNA, 19 nt, Salmonella enterica enterica serovar Typhi
agugguaaaaaagucacuu

SEQ ID NO: 3607218 - RNA, 17 nt, Salmonella enterica enterica serovar Typhi
agugguuccaggcgcgc

SEQ ID NO: 3607219 - RNA, 13 nt, Salmonella enterica enterica serovar Typhi
agugucaacugcg

SEQ ID NO: 3607220 - RNA, 15 nt, Salmonella enterica enterica serovar Typhi
agugucaacugcgcc

SEQ ID NO: 3607221 - RNA, 21 nt, Salmonella enterica enterica serovar Typhi
aguguccacucgcucauuugc

SEQ ID NO: 3607222 - RNA, 23 nt, Salmonella enterica enterica serovar Typhi
aguguccuuacggacgugggggu

SEQ ID NO: 3607223 - RNA, 13 nt, Salmonella enterica enterica serovar Typhi
agugucgccauaa

SEQ ID NO: 3607224 - RNA, 23 nt, Salmonella enterica enterica serovar Typhi
agugucuucccugaccagcgacg

SEQ ID NO: 3607225 - RNA, 19 nt, Salmonella enterica enterica serovar Typhi
agugugauaagccccuuua

SEQ ID NO: 3607226 - RNA, 13 nt, Salmonella enterica enterica serovar Typhi
agugugccgucau

SEQ ID NO: 3607227 - RNA, 20 nt, Salmonella enterica enterica serovar Typhi
aguguggaugucauaauugc

SEQ ID NO: 3607228 - RNA, 17 nt, Salmonella enterica enterica serovar Typhi
aguguguaccagcagcg

SEQ ID NO: 3607229 - RNA, 20 nt, Salmonella enterica enterica serovar Typhi
aguguguaccagcagcgcca

SEQ ID NO: 3607230 - RNA, 19 nt, Salmonella enterica enterica serovar Typhi
aguguuaaucucacgcuca

SEQ ID NO: 3607231 - RNA, 16 nt, Salmonella enterica enterica serovar Typhi
aguguuuaagcgucag

SEQ ID NO: 3607232 - RNA, 12 nt, Salmonella enterica enterica serovar Typhi
aguguuuccggc

SEQ ID NO: 3607233 - RNA, 14 nt, Salmonella enterica enterica serovar Typhi
aguuaaauaaacaa

SEQ ID NO: 3607234 - RNA, 23 nt, Salmonella enterica enterica serovar Typhi
aguuaacagaaugcugaacagcc

SEQ ID NO: 3607235 - RNA, 21 nt, Salmonella enterica enterica serovar Typhi
aguuaacgcguuaaucacuac

SEQ ID NO: 3607236 - RNA, 19 nt, Salmonella enterica enterica serovar Typhi
aguuaagcaacugauuaau

SEQ ID NO: 3607237 - RNA, 17 nt, Salmonella enterica enterica serovar Typhi
aguuaauacaguggaaa

SEQ ID NO: 3607238 - RNA, 14 nt, Salmonella enterica enterica serovar Typhi
aguuaaucagcgcc

SEQ ID NO: 3607239 - RNA, 23 nt, Salmonella enterica enterica serovar Typhi
aguuaaugccaucaucaguaaca

SEQ ID NO: 3607240 - RNA, 24 nt, Salmonella enterica enterica serovar Typhi
aguuaccguaaucaucgcgaucgc

SEQ ID NO: 3607241 - RNA, 15 nt, Salmonella enterica enterica serovar Typhi
aguuacgcucucagc

SEQ ID NO: 3607242 - RNA, 16 nt, Salmonella enterica enterica serovar Typhi
aguuacggacaugcga

SEQ ID NO: 3607243 - RNA, 24 nt, Salmonella enterica enterica serovar Typhi
aguuacggacaugcgacgugucgc

SEQ ID NO: 3607244 - RNA, 16 nt, Salmonella enterica enterica serovar Typhi
aguuacguugcggcgu

SEQ ID NO: 3607245 - RNA, 16 nt, Salmonella enterica enterica serovar Typhi
aguuagcuaucgcgcc

SEQ ID NO: 3607246 - RNA, 16 nt, Salmonella enterica enterica serovar Typhi
aguuagcuuuuuuaug

SEQ ID NO: 3607247 - RNA, 12 nt, Salmonella enterica enterica serovar Typhi
aguuaucacguu

SEQ ID NO: 3607248 - RNA, 15 nt, Salmonella enterica enterica serovar Typhi
aguuauccagcgccc

SEQ ID NO: 3607249 - RNA, 18 nt, Salmonella enterica enterica serovar Typhi
aguucaaauucuucccgg

SEQ ID NO: 3607250 - RNA, 17 nt, Salmonella enterica enterica serovar Typhi
aguucaaguuuagaaaa

SEQ ID NO: 3607251 - RNA, 16 nt, Salmonella enterica enterica serovar Typhi
aguucaccaguuuuuc

SEQ ID NO: 3607252 - RNA, 21 nt, Salmonella enterica enterica serovar Typhi
aguucaccaguuuuucgccaa

SEQ ID NO: 3607253 - RNA, 20 nt, Salmonella enterica enterica serovar Typhi
aguucacuccuaagagaaaa

SEQ ID NO: 3607254 - RNA, 16 nt, Salmonella enterica enterica serovar Typhi
aguucagacaccacgc

SEQ ID NO: 3607255 - RNA, 17 nt, Salmonella enterica enterica serovar Typhi
aguucaggcacgugcau

SEQ ID NO: 3607256 - RNA, 14 nt, Salmonella enterica enterica serovar Typhi
aguucauaaaugua

SEQ ID NO: 3607257 - RNA, 20 nt, Salmonella enterica enterica serovar Typhi
aguucaucauccugcagggu

SEQ ID NO: 3607258 - RNA, 17 nt, Salmonella enterica enterica serovar Typhi
aguucauuucaggcaaa

SEQ ID NO: 3607259 - RNA, 15 nt, Salmonella enterica enterica serovar Typhi
aguuccaaucucuuu

SEQ ID NO: 3607260 - RNA, 20 nt, Salmonella enterica enterica serovar Typhi
aguuccacauaaaguagcca

SEQ ID NO: 3607261 - RNA, 17 nt, Salmonella enterica enterica serovar Typhi
aguuccaggacggacau

SEQ ID NO: 3607262 - RNA, 23 nt, Salmonella enterica enterica serovar Typhi
aguuccaguaagguccagggaaa

SEQ ID NO: 3607263 - RNA, 17 nt, Salmonella enterica enterica serovar Typhi
aguucccagcgguggau

SEQ ID NO: 3607264 - RNA, 13 nt, Salmonella enterica enterica serovar Typhi
aguucccccaucu

SEQ ID NO: 3607265 - RNA, 19 nt, Salmonella enterica enterica serovar Typhi
aguuccgccagacucagcc

SEQ ID NO: 3607266 - RNA, 12 nt, Salmonella enterica enterica serovar Typhi
aguuccggauac

SEQ ID NO: 3607267 - RNA, 24 nt, Salmonella enterica enterica serovar Typhi
aguuccugugcggaauagccuauc

SEQ ID NO: 3607268 - RNA, 14 nt, Salmonella enterica enterica serovar Typhi
aguucgacuuaacg

SEQ ID NO: 3607269 - RNA, 22 nt, Salmonella enterica enterica serovar Typhi
aguucgcccgguaaacgcgcca

SEQ ID NO: 3607270 - RNA, 15 nt, Salmonella enterica enterica serovar Typhi
aguucgccgccagga

SEQ ID NO: 3607271 - RNA, 16 nt, Salmonella enterica enterica serovar Typhi
aguucgccgccaggaa

SEQ ID NO: 3607272 - RNA, 13 nt, Salmonella enterica enterica serovar Typhi
aguucgccgccgg

SEQ ID NO: 3607273 - RNA, 15 nt, Salmonella enterica enterica serovar Typhi
aguucgccuucuuca

SEQ ID NO: 3607274 - RNA, 19 nt, Salmonella enterica enterica serovar Typhi
aguucgccuucuucaucuu

SEQ ID NO: 3607275 - RNA, 16 nt, Salmonella enterica enterica serovar Typhi
aguucggagaucagcg

SEQ ID NO: 3607276 - RNA, 13 nt, Salmonella enterica enterica serovar Typhi
auaaaauccugca

SEQ ID NO: 3607277 - RNA, 13 nt, Salmonella enterica enterica serovar Typhi
auaaaauuauaaa

SEQ ID NO: 3607278 - RNA, 17 nt, Salmonella enterica enterica serovar Typhi
auaaaauuauuggcuuu

SEQ ID NO: 3607279 - RNA, 13 nt, Salmonella enterica enterica serovar Typhi
auaaaauucacuu

SEQ ID NO: 3607280 - RNA, 15 nt, Salmonella enterica enterica serovar Typhi
auaaacacagcaaac

SEQ ID NO: 3607281 - RNA, 20 nt, Salmonella enterica enterica serovar Typhi
auaaacagauaugaaaugag

SEQ ID NO: 3607282 - RNA, 17 nt, Salmonella enterica enterica serovar Typhi
auaaacagcagcgcggc

SEQ ID NO: 3607283 - RNA, 22 nt, Salmonella enterica enterica serovar Typhi
auaaacagcucggcaaagccca

SEQ ID NO: 3607284 - RNA, 21 nt, Salmonella enterica enterica serovar Typhi
auaaaccgccgcuuugauuug

SEQ ID NO: 3607285 - RNA, 22 nt, Salmonella enterica enterica serovar Typhi
auaaaccggcggccuaccaguu

SEQ ID NO: 3607286 - RNA, 21 nt, Salmonella enterica enterica serovar Typhi
auaaacgccaguggaugcgcu

SEQ ID NO: 3607287 - RNA, 15 nt, Salmonella enterica enterica serovar Typhi
auaaacgccugacga

SEQ ID NO: 3607288 - RNA, 18 nt, Salmonella enterica enterica serovar Typhi
auaaacgcgccaaguaaa

SEQ ID NO: 3607289 - RNA, 18 nt, Salmonella enterica enterica serovar Typhi
auaaacggcgcguccagc

SEQ ID NO: 3607290 - RNA, 22 nt, Salmonella enterica enterica serovar Typhi
auaaacgguucagucagcgcga

SEQ ID NO: 3607291 - RNA, 16 nt, Salmonella enterica enterica serovar Typhi
auaaacgguuucagua

SEQ ID NO: 3607292 - RNA, 14 nt, Salmonella enterica enterica serovar Typhi
auaaacuggagcac

SEQ ID NO: 3607293 - RNA, 21 nt, Salmonella enterica enterica serovar Typhi
auaaacuucaauucagaaagu

SEQ ID NO: 3607294 - RNA, 18 nt, Salmonella enterica enterica serovar Typhi
auaaagaaagcauuaaau

SEQ ID NO: 3607295 - RNA, 21 nt, Salmonella enterica enterica serovar Typhi
auaaagaaaguagaucaccag

SEQ ID NO: 3607296 - RNA, 13 nt, Salmonella enterica enterica serovar Typhi
auaaagaaauauu

SEQ ID NO: 3607297 - RNA, 19 nt, Salmonella enterica enterica serovar Typhi
auaaagaacggccucccaa

SEQ ID NO: 3607298 - RNA, 17 nt, Salmonella enterica enterica serovar Typhi
auaaagauauucuccuc

SEQ ID NO: 3607299 - RNA, 12 nt, Salmonella enterica enterica serovar Typhi
auaaagauggca

SEQ ID NO: 3607300 - RNA, 21 nt, Salmonella enterica enterica serovar Typhi
auaaagauuggcaucugcaau

SEQ ID NO: 3607301 - RNA, 17 nt, Salmonella enterica enterica serovar Typhi
auaaagcagcgacaaua

SEQ ID NO: 3607302 - RNA, 12 nt, Salmonella enterica enterica serovar Typhi
auaaagcagggc

SEQ ID NO: 3607303 - RNA, 16 nt, Salmonella enterica enterica serovar Typhi
auaaagcauaaauaca

SEQ ID NO: 3607304 - RNA, 16 nt, Salmonella enterica enterica serovar Typhi
auaaagcgaauaacau

SEQ ID NO: 3607305 - RNA, 20 nt, Salmonella enterica enterica serovar Typhi
auaaagcgcucaugccacgc

SEQ ID NO: 3607306 - RNA, 16 nt, Salmonella enterica enterica serovar Typhi
auaaagcuucugcgcc

SEQ ID NO: 3607307 - RNA, 23 nt, Salmonella enterica enterica serovar Typhi
auaaaggccggcagccgcugaua

SEQ ID NO: 3607308 - RNA, 16 nt, Salmonella enterica enterica serovar Typhi
auaaagguauagugga

SEQ ID NO: 3607309 - RNA, 20 nt, Salmonella enterica enterica serovar Typhi
auaaaggucaaacaccugaa

SEQ ID NO: 3607310 - RNA, 14 nt, Salmonella enterica enterica serovar Typhi
auaaaggucacauc

SEQ ID NO: 3607311 - RNA, 16 nt, Salmonella enterica enterica serovar Typhi
auaaaggucacaucau

SEQ ID NO: 3607312 - RNA, 23 nt, Salmonella enterica enterica serovar Typhi
auaaaguuuauuugaauagucaa

SEQ ID NO: 3607313 - RNA, 23 nt, Salmonella enterica enterica serovar Typhi
auaaauaaccgguaacugucaga

SEQ ID NO: 3607314 - RNA, 13 nt, Salmonella enterica enterica serovar Typhi
auaaauaauaucg

SEQ ID NO: 3607315 - RNA, 14 nt, Salmonella enterica enterica serovar Typhi
auaaauaaugccgu

SEQ ID NO: 3607316 - RNA, 16 nt, Salmonella enterica enterica serovar Typhi
auaaauacaauucaac

SEQ ID NO: 3607317 - RNA, 20 nt, Salmonella enterica enterica serovar Typhi
auaaauaccgcaauaaacac

SEQ ID NO: 3607318 - RNA, 13 nt, Salmonella enterica enterica serovar Typhi
auaaauagccgac

SEQ ID NO: 3607319 - RNA, 14 nt, Salmonella enterica enterica serovar Typhi
auaaauagcgcugg

SEQ ID NO: 3607320 - RNA, 14 nt, Salmonella enterica enterica serovar Typhi
auaaauaguaaaua

SEQ ID NO: 3607321 - RNA, 15 nt, Salmonella enterica enterica serovar Typhi
auaaauauaagaucu

SEQ ID NO: 3607322 - RNA, 14 nt, Salmonella enterica enterica serovar Typhi
auaaauauccuccg

SEQ ID NO: 3607323 - RNA, 18 nt, Salmonella enterica enterica serovar Typhi
auaaauauuaaugaauaa

SEQ ID NO: 3607324 - RNA, 17 nt, Salmonella enterica enterica serovar Typhi
auaaaucaaaagugcac

SEQ ID NO: 3607325 - RNA, 19 nt, Salmonella enterica enterica serovar Typhi
auaaaucaacauacugauu

SEQ ID NO: 3607326 - RNA, 14 nt, Salmonella enterica enterica serovar Typhi
auaaaucagcccga

SEQ ID NO: 3607327 - RNA, 16 nt, Salmonella enterica enterica serovar Typhi
auaaaucaggaaaaag

SEQ ID NO: 3607328 - RNA, 21 nt, Salmonella enterica enterica serovar Typhi
auaaaucccggcgauuaauaa

SEQ ID NO: 3607329 - RNA, 18 nt, Salmonella enterica enterica serovar Typhi
auaaaucccgguggggau

SEQ ID NO: 3607330 - RNA, 17 nt, Salmonella enterica enterica serovar Typhi
auaaaucgcagauagca

SEQ ID NO: 3607331 - RNA, 20 nt, Salmonella enterica enterica serovar Typhi
auaaaucgucggcaggguuu

SEQ ID NO: 3607332 - RNA, 16 nt, Salmonella enterica enterica serovar Typhi
auaaaugaauuauuuu

SEQ ID NO: 3607333 - RNA, 21 nt, Salmonella enterica enterica serovar Typhi
auaaaugguacuuuucaucca

SEQ ID NO: 3607334 - RNA, 19 nt, Salmonella enterica enterica serovar Typhi
auaaauucugucucaauaa

SEQ ID NO: 3607335 - RNA, 20 nt, Salmonella enterica enterica serovar Typhi
auaaauucugucucaauaaa

SEQ ID NO: 3607336 - RNA, 21 nt, Salmonella enterica enterica serovar Typhi
auaaauucugucucaauaaaa

SEQ ID NO: 3607337 - RNA, 21 nt, Salmonella enterica enterica serovar Typhi
auaaauucuuuacgcagcaag

SEQ ID NO: 3607338 - RNA, 20 nt, Salmonella enterica enterica serovar Typhi
auaaauuucauccaugccaa

SEQ ID NO: 3607339 - RNA, 19 nt, Salmonella enterica enterica serovar Typhi
auaaauuugucagacauga

SEQ ID NO: 3607340 - RNA, 20 nt, Salmonella enterica enterica serovar Typhi
auaaauuugucagacaugau

SEQ ID NO: 3607341 - RNA, 16 nt, Salmonella enterica enterica serovar Typhi
auaacaaaaccagcau

SEQ ID NO: 3607342 - RNA, 15 nt, Salmonella enterica enterica serovar Typhi
auaacaaaagcgguu

SEQ ID NO: 3607343 - RNA, 18 nt, Salmonella enterica enterica serovar Typhi
auaacaauauuaaauaaa

SEQ ID NO: 3607344 - RNA, 18 nt, Salmonella enterica enterica serovar Typhi
auaacaccgcauggcugg

SEQ ID NO: 3607345 - RNA, 14 nt, Salmonella enterica enterica serovar Typhi
auaacaggaaucau

SEQ ID NO: 3607346 - RNA, 12 nt, Salmonella enterica enterica serovar Typhi
auaacaucaucc

SEQ ID NO: 3607347 - RNA, 14 nt, Salmonella enterica enterica serovar Typhi
auaacaucuuccau

SEQ ID NO: 3607348 - RNA, 14 nt, Salmonella enterica enterica serovar Typhi
auaaccaauaauug

SEQ ID NO: 3607349 - RNA, 17 nt, Salmonella enterica enterica serovar Typhi
auaaccacgaaaauuau

SEQ ID NO: 3607350 - RNA, 16 nt, Salmonella enterica enterica serovar Typhi
auaaccagauggggcu

SEQ ID NO: 3607351 - RNA, 13 nt, Salmonella enterica enterica serovar Typhi
auaacccgccugg

SEQ ID NO: 3607352 - RNA, 22 nt, Salmonella enterica enterica serovar Typhi
auaaccggugccgaaaucauca

SEQ ID NO: 3607353 - RNA, 16 nt, Salmonella enterica enterica serovar Typhi
auaaccuauuuugcaa

SEQ ID NO: 3607354 - RNA, 15 nt, Salmonella enterica enterica serovar Typhi
auaacgaaaaggguc

SEQ ID NO: 3607355 - RNA, 13 nt, Salmonella enterica enterica serovar Typhi
auaacgaaccauc

SEQ ID NO: 3607356 - RNA, 20 nt, Salmonella enterica enterica serovar Typhi
auaacgaccaaacaagaucg

SEQ ID NO: 3607357 - RNA, 14 nt, Salmonella enterica enterica serovar Typhi
auaacgauaaauuu

SEQ ID NO: 3607358 - RNA, 16 nt, Salmonella enterica enterica serovar Typhi
auaacgauaugagcua

SEQ ID NO: 3607359 - RNA, 15 nt, Salmonella enterica enterica serovar Typhi
auaacgaugauuauu

SEQ ID NO: 3607360 - RNA, 22 nt, Salmonella enterica enterica serovar Typhi
auaacgcaggcgauagccccag

SEQ ID NO: 3607361 - RNA, 17 nt, Salmonella enterica enterica serovar Typhi
auaacgcccugcgcgcc

SEQ ID NO: 3607362 - RNA, 19 nt, Salmonella enterica enterica serovar Typhi
auaauucuguaacucauag

SEQ ID NO: 3607363 - RNA, 15 nt, Salmonella enterica enterica serovar Typhi
auaauugauaauaac

SEQ ID NO: 3607364 - RNA, 11 nt, Salmonella enterica enterica serovar Typhi
auaauugcucu

SEQ ID NO: 3607365 - RNA, 16 nt, Salmonella enterica enterica serovar Typhi
auaauugcucugccag

SEQ ID NO: 3607366 - RNA, 12 nt, Salmonella enterica enterica serovar Typhi
auaauugcugcc

SEQ ID NO: 3607367 - RNA, 16 nt, Salmonella enterica enterica serovar Typhi
auaauuugcgccguca

SEQ ID NO: 3607368 - RNA, 13 nt, Salmonella enterica enterica serovar Typhi
auaauuuuagaaa

SEQ ID NO: 3607369 - RNA, 18 nt, Salmonella enterica enterica serovar Typhi
auaauuuuauuauauuua

SEQ ID NO: 3607370 - RNA, 15 nt, Salmonella enterica enterica serovar Typhi
auaauuuuugccuuu

SEQ ID NO: 3607371 - RNA, 14 nt, Salmonella enterica enterica serovar Typhi
auacaaaacccaua

SEQ ID NO: 3607372 - RNA, 18 nt, Salmonella enterica enterica serovar Typhi
auacaccaaacgaauuua

SEQ ID NO: 3607373 - RNA, 13 nt, Salmonella enterica enterica serovar Typhi
auacaccgcaucc

SEQ ID NO: 3607374 - RNA, 20 nt, Salmonella enterica enterica serovar Typhi
auacaccucggguaaagguu

SEQ ID NO: 3607375 - RNA, 14 nt, Salmonella enterica enterica serovar Typhi
auacacgaacacag

SEQ ID NO: 3607376 - RNA, 19 nt, Salmonella enterica enterica serovar Typhi
auacacgccuuccuccagc

SEQ ID NO: 3607377 - RNA, 15 nt, Salmonella enterica enterica serovar Typhi
auacacgcgacaaug

SEQ ID NO: 3607378 - RNA, 17 nt, Salmonella enterica enterica serovar Typhi
auacacucaaccaacca

SEQ ID NO: 3607379 - RNA, 14 nt, Salmonella enterica enterica serovar Typhi
auacacucaaccau

SEQ ID NO: 3607380 - RNA, 22 nt, Salmonella enterica enterica serovar Typhi
auacacucaaccaucaaaaaaa

SEQ ID NO: 3607381 - RNA, 20 nt, Salmonella enterica enterica serovar Typhi
auacacugcauaaauaucug

SEQ ID NO: 3607382 - RNA, 19 nt, Salmonella enterica enterica serovar Typhi
auacacuuuccauucgaca

SEQ ID NO: 3607383 - RNA, 21 nt, Salmonella enterica enterica serovar Typhi
auacacuuuccauucgacagu

SEQ ID NO: 3607384 - RNA, 19 nt, Salmonella enterica enterica serovar Typhi
auacagaugcugucuuagu

SEQ ID NO: 3607385 - RNA, 11 nt, Salmonella enterica enterica serovar Typhi
auacagcacgg

SEQ ID NO: 3607386 - RNA, 14 nt, Salmonella enterica enterica serovar Typhi
auacagccagguug

SEQ ID NO: 3607387 - RNA, 18 nt, Salmonella enterica enterica serovar Typhi
auacagcggcgcgccaau

SEQ ID NO: 3607388 - RNA, 16 nt, Salmonella enterica enterica serovar Typhi
auacaggaagccggug

SEQ ID NO: 3607389 - RNA, 23 nt, Salmonella enterica enterica serovar Typhi
auacaggcauggccuucaaucag

SEQ ID NO: 3607390 - RNA, 13 nt, Salmonella enterica enterica serovar Typhi
auacaguaccuuu

SEQ ID NO: 3607391 - RNA, 17 nt, Salmonella enterica enterica serovar Typhi
auacaguaguuuucauc

SEQ ID NO: 3607392 - RNA, 11 nt, Salmonella enterica enterica serovar Typhi
auacauaaauc

SEQ ID NO: 3607393 - RNA, 13 nt, Salmonella enterica enterica serovar Typhi
auacauaaauccg

SEQ ID NO: 3607394 - RNA, 18 nt, Salmonella enterica enterica serovar Typhi
auacaucaguccuguuga

SEQ ID NO: 3607395 - RNA, 18 nt, Salmonella enterica enterica serovar Typhi
auacaucaugcuugcuuu

SEQ ID NO: 3607396 - RNA, 23 nt, Salmonella enterica enterica serovar Typhi
auacauccugauuauuacaauaa

SEQ ID NO: 3607397 - RNA, 18 nt, Salmonella enterica enterica serovar Typhi
auacaugccugcgccaug

SEQ ID NO: 3607398 - RNA, 13 nt, Salmonella enterica enterica serovar Typhi
auacaugcuacag

SEQ ID NO: 3607399 - RNA, 13 nt, Salmonella enterica enterica serovar Typhi
auacauuaacgcu

SEQ ID NO: 3607400 - RNA, 14 nt, Salmonella enterica enterica serovar Typhi
auacauucucugcc

SEQ ID NO: 3607401 - RNA, 13 nt, Salmonella enterica enterica serovar Typhi
auacauucuguuu

SEQ ID NO: 3607402 - RNA, 20 nt, Salmonella enterica enterica serovar Typhi
auacauugaguaaauaaauc

SEQ ID NO: 3607403 - RNA, 23 nt, Salmonella enterica enterica serovar Typhi
auacauuuuguauucgcagggcu

SEQ ID NO: 3607404 - RNA, 20 nt, Salmonella enterica enterica serovar Typhi
auacauuuuuguaauaaaaa

SEQ ID NO: 3607405 - RNA, 13 nt, Salmonella enterica enterica serovar Typhi
auaccaaaaauaa

SEQ ID NO: 3607406 - RNA, 23 nt, Salmonella enterica enterica serovar Typhi
auaccaagucucaggagugaaca

SEQ ID NO: 3607407 - RNA, 17 nt, Salmonella enterica enterica serovar Typhi
auaccaaguuuggcaau

SEQ ID NO: 3607408 - RNA, 19 nt, Salmonella enterica enterica serovar Typhi
auaccaccacuucacuauc

SEQ ID NO: 3607409 - RNA, 17 nt, Salmonella enterica enterica serovar Typhi
auaccaccugccaaagc

SEQ ID NO: 3607410 - RNA, 18 nt, Salmonella enterica enterica serovar Typhi
auaccagcgaaaugcgaa

SEQ ID NO: 3607411 - RNA, 21 nt, Salmonella enterica enterica serovar Typhi
auaccagcggcaaacagcgac

SEQ ID NO: 3607412 - RNA, 15 nt, Salmonella enterica enterica serovar Typhi
auaccagggcgauuc

SEQ ID NO: 3607413 - RNA, 21 nt, Salmonella enterica enterica serovar Typhi
auaccaggguucgcuggccag

SEQ ID NO: 3607414 - RNA, 20 nt, Salmonella enterica enterica serovar Typhi
auaccaugcugccauuuuau

SEQ ID NO: 3607415 - RNA, 18 nt, Salmonella enterica enterica serovar Typhi
auacccaguagcagacag

SEQ ID NO: 3607416 - RNA, 21 nt, Salmonella enterica enterica serovar Typhi
auacccaguagcagacagccg

SEQ ID NO: 3607417 - RNA, 19 nt, Salmonella enterica enterica serovar Typhi
auaccccgaucgauauuua

SEQ ID NO: 3607418 - RNA, 19 nt, Salmonella enterica enterica serovar Typhi
auaccccgcacaaacgcuu

SEQ ID NO: 3607419 - RNA, 15 nt, Salmonella enterica enterica serovar Typhi
auaccccuguucaaa

SEQ ID NO: 3607420 - RNA, 15 nt, Salmonella enterica enterica serovar Typhi
auacccggcucccau

SEQ ID NO: 3607421 - RNA, 22 nt, Salmonella enterica enterica serovar Typhi
auacccugcggcgaaacagagu

SEQ ID NO: 3607422 - RNA, 15 nt, Salmonella enterica enterica serovar Typhi
auaccgaaauccgcu

SEQ ID NO: 3607423 - RNA, 13 nt, Salmonella enterica enterica serovar Typhi
auaccgcaauaaa

SEQ ID NO: 3607424 - RNA, 12 nt, Salmonella enterica enterica serovar Typhi
auaccgccaucc

SEQ ID NO: 3607425 - RNA, 15 nt, Salmonella enterica enterica serovar Typhi
auaccggaggagugc

SEQ ID NO: 3607426 - RNA, 19 nt, Salmonella enterica enterica serovar Typhi
auaccggccacgagcuguc

SEQ ID NO: 3607427 - RNA, 16 nt, Salmonella enterica enterica serovar Typhi
auaccgguuauccaua

SEQ ID NO: 3607428 - RNA, 20 nt, Salmonella enterica enterica serovar Typhi
auaccguccagacuccuuuu

SEQ ID NO: 3607429 - RNA, 20 nt, Salmonella enterica enterica serovar Typhi
auaccguggucuccgccugg

SEQ ID NO: 3607430 - RNA, 19 nt, Salmonella enterica enterica serovar Typhi
auaccgugugcagugacag

SEQ ID NO: 3607431 - RNA, 17 nt, Salmonella enterica enterica serovar Typhi
auaccguuucaacugcc

SEQ ID NO: 3607432 - RNA, 19 nt, Salmonella enterica enterica serovar Typhi
auaccguuuggaucugucg

SEQ ID NO: 3607433 - RNA, 16 nt, Salmonella enterica enterica serovar Typhi
auaccuaacucuuccg

SEQ ID NO: 3607434 - RNA, 20 nt, Salmonella enterica enterica serovar Typhi
auaccuaacucuuccgcaau

SEQ ID NO: 3607435 - RNA, 14 nt, Salmonella enterica enterica serovar Typhi
auaccuaauagcga

SEQ ID NO: 3607436 - RNA, 13 nt, Salmonella enterica enterica serovar Typhi
auaccuauuuaau

SEQ ID NO: 3607437 - RNA, 17 nt, Salmonella enterica enterica serovar Typhi
auaccucaaaugcugaa

SEQ ID NO: 3607438 - RNA, 12 nt, Salmonella enterica enterica serovar Typhi
auaccugaaaga

SEQ ID NO: 3607439 - RNA, 22 nt, Salmonella enterica enterica serovar Typhi
auaccuucgugaugugguugug

SEQ ID NO: 3607440 - RNA, 20 nt, Salmonella enterica enterica serovar Typhi
auaccuucuucacuaaaaac

SEQ ID NO: 3607441 - RNA, 21 nt, Salmonella enterica enterica serovar Typhi
auaccuucuucacuaaaaaca

SEQ ID NO: 3607442 - RNA, 12 nt, Salmonella enterica enterica serovar Typhi
auaccuuuucau

SEQ ID NO: 3607443 - RNA, 13 nt, Salmonella enterica enterica serovar Typhi
auacgaaugggua

SEQ ID NO: 3607444 - RNA, 21 nt, Salmonella enterica enterica serovar Typhi
auacgacaucgccaaccgcga

SEQ ID NO: 3607445 - RNA, 15 nt, Salmonella enterica enterica serovar Typhi
auacgaucgcgcaca

SEQ ID NO: 3607446 - RNA, 14 nt, Salmonella enterica enterica serovar Typhi
auacgaucggcugg

SEQ ID NO: 3607447 - RNA, 15 nt, Salmonella enterica enterica serovar Typhi
auacgauguaaaaau

SEQ ID NO: 3607448 - RNA, 17 nt, Salmonella enterica enterica serovar Typhi
auagcaacuuaauaaua

SEQ ID NO: 3607449 - RNA, 13 nt, Salmonella enterica enterica serovar Typhi
auagcaauuaaua

SEQ ID NO: 3607450 - RNA, 22 nt, Salmonella enterica enterica serovar Typhi
auagcaauuucagcauccuccg

SEQ ID NO: 3607451 - RNA, 15 nt, Salmonella enterica enterica serovar Typhi
auagcaccucgcaau

SEQ ID NO: 3607452 - RNA, 15 nt, Salmonella enterica enterica serovar Typhi
auagcagcaaauuua

SEQ ID NO: 3607453 - RNA, 13 nt, Salmonella enterica enterica serovar Typhi
auagcaucaccag

SEQ ID NO: 3607454 - RNA, 22 nt, Salmonella enterica enterica serovar Typhi
auagcauggcguguaguaaugc

SEQ ID NO: 3607455 - RNA, 13 nt, Salmonella enterica enterica serovar Typhi
auagccaaaagcu

SEQ ID NO: 3607456 - RNA, 16 nt, Salmonella enterica enterica serovar Typhi
auagccaacacauaag

SEQ ID NO: 3607457 - RNA, 20 nt, Salmonella enterica enterica serovar Typhi
auagccaacacauaagccac

SEQ ID NO: 3607458 - RNA, 14 nt, Salmonella enterica enterica serovar Typhi
auagccacaggcug

SEQ ID NO: 3607459 - RNA, 18 nt, Salmonella enterica enterica serovar Typhi
auagccagcccccugcca

SEQ ID NO: 3607460 - RNA, 19 nt, Salmonella enterica enterica serovar Typhi
auagccaguaauauaacca

SEQ ID NO: 3607461 - RNA, 13 nt, Salmonella enterica enterica serovar Typhi
auagccauuuaau

SEQ ID NO: 3607462 - RNA, 15 nt, Salmonella enterica enterica serovar Typhi
auagcccguuaugcc

SEQ ID NO: 3607463 - RNA, 16 nt, Salmonella enterica enterica serovar Typhi
auagcccuauucguga

SEQ ID NO: 3607464 - RNA, 21 nt, Salmonella enterica enterica serovar Typhi
auagccgguaacuuucccgcu

SEQ ID NO: 3607465 - RNA, 21 nt, Salmonella enterica enterica serovar Typhi
auagccugauggucgcucugg

SEQ ID NO: 3607466 - RNA, 13 nt, Salmonella enterica enterica serovar Typhi
auagccugggcaa

SEQ ID NO: 3607467 - RNA, 22 nt, Salmonella enterica enterica serovar Typhi
auagccuuugucgaaauugccg

SEQ ID NO: 3607468 - RNA, 22 nt, Salmonella enterica enterica serovar Typhi
auagcgacguuaucucgccagg

SEQ ID NO: 3607469 - RNA, 15 nt, Salmonella enterica enterica serovar Typhi
auagcgcagcauugg

SEQ ID NO: 3607470 - RNA, 17 nt, Salmonella enterica enterica serovar Typhi
auagcgccaucaggcau

SEQ ID NO: 3607471 - RNA, 16 nt, Salmonella enterica enterica serovar Typhi
auagcgccauccugcc

SEQ ID NO: 3607472 - RNA, 11 nt, Salmonella enterica enterica serovar Typhi
auagcgcccca

SEQ ID NO: 3607473 - RNA, 21 nt, Salmonella enterica enterica serovar Typhi
auagcgccccggugcuuucuc

SEQ ID NO: 3607474 - RNA, 16 nt, Salmonella enterica enterica serovar Typhi
auagcgccgcaucgau

SEQ ID NO: 3607475 - RNA, 17 nt, Salmonella enterica enterica serovar Typhi
auagcgcgaaugauuuu

SEQ ID NO: 3607476 - RNA, 14 nt, Salmonella enterica enterica serovar Typhi
auagcgcgcuaaac

SEQ ID NO: 3607477 - RNA, 18 nt, Salmonella enterica enterica serovar Typhi
auagcgcgucguugccuu

SEQ ID NO: 3607478 - RNA, 22 nt, Salmonella enterica enterica serovar Typhi
auagcgcuacauccgccagccg

SEQ ID NO: 3607479 - RNA, 17 nt, Salmonella enterica enterica serovar Typhi
auagcgcugaaguccgc

SEQ ID NO: 3607480 - RNA, 23 nt, Salmonella enterica enterica serovar Typhi
auagcgcugugcuaucaggccua

SEQ ID NO: 3607481 - RNA, 17 nt, Salmonella enterica enterica serovar Typhi
auagcggccagauggca

SEQ ID NO: 3607482 - RNA, 21 nt, Salmonella enterica enterica serovar Typhi
auagcggcguuuauauaaaaa

SEQ ID NO: 3607483 - RNA, 23 nt, Salmonella enterica enterica serovar Typhi
auagcggcguuuauauaaaaaua

SEQ ID NO: 3607484 - RNA, 21 nt, Salmonella enterica enterica serovar Typhi
auagcgggcuuccuucuaccg

SEQ ID NO: 3607485 - RNA, 14 nt, Salmonella enterica enterica serovar Typhi
auagcggguaaaca

SEQ ID NO: 3607486 - RNA, 22 nt, Salmonella enterica enterica serovar Typhi
auagcgguacccggucccuggc

SEQ ID NO: 3607487 - RNA, 16 nt, Salmonella enterica enterica serovar Typhi
auagcguugauaugcu

SEQ ID NO: 3607488 - RNA, 14 nt, Salmonella enterica enterica serovar Typhi
auagcuaaauaaaa

SEQ ID NO: 3607489 - RNA, 14 nt, Salmonella enterica enterica serovar Typhi
auagcugaacauac

SEQ ID NO: 3607490 - RNA, 19 nt, Salmonella enterica enterica serovar Typhi
auagcuggcugucuuccgu

SEQ ID NO: 3607491 - RNA, 20 nt, Salmonella enterica enterica serovar Typhi
auagcuggcuuuauauaaaa

SEQ ID NO: 3607492 - RNA, 18 nt, Salmonella enterica enterica serovar Typhi
auagcuguuccgcaacac

SEQ ID NO: 3607493 - RNA, 17 nt, Salmonella enterica enterica serovar Typhi
auagcuucaaugaucca

SEQ ID NO: 3607494 - RNA, 19 nt, Salmonella enterica enterica serovar Typhi
auagcuuuucaagaauuac

SEQ ID NO: 3607495 - RNA, 22 nt, Salmonella enterica enterica serovar Typhi
auagcuuuucaagaauuacauc

SEQ ID NO: 3607496 - RNA, 15 nt, Salmonella enterica enterica serovar Typhi
auaggcaauauccuc

SEQ ID NO: 3607497 - RNA, 22 nt, Salmonella enterica enterica serovar Typhi
auaggccagcuacaccugggcu

SEQ ID NO: 3607498 - RNA, 13 nt, Salmonella enterica enterica serovar Typhi
auaggccaggcua

SEQ ID NO: 3607499 - RNA, 14 nt, Salmonella enterica enterica serovar Typhi
auaggcgaggaaaa

SEQ ID NO: 3607500 - RNA, 12 nt, Salmonella enterica enterica serovar Typhi
auaggcgccgcc

SEQ ID NO: 3607501 - RNA, 19 nt, Salmonella enterica enterica serovar Typhi
auaggcgcgucauaaccgc

SEQ ID NO: 3607502 - RNA, 15 nt, Salmonella enterica enterica serovar Typhi
auaggucguuccuca

SEQ ID NO: 3607503 - RNA, 19 nt, Salmonella enterica enterica serovar Typhi
auaggugacuuuccuggcu

SEQ ID NO: 3607504 - RNA, 23 nt, Salmonella enterica enterica serovar Typhi
auaggugccgccgcacagaaucg

SEQ ID NO: 3607505 - RNA, 20 nt, Salmonella enterica enterica serovar Typhi
auagguuaagccaaacucac

SEQ ID NO: 3607506 - RNA, 13 nt, Salmonella enterica enterica serovar Typhi
auagguuuuaugc

SEQ ID NO: 3607507 - RNA, 13 nt, Salmonella enterica enterica serovar Typhi
auaguaaauagaa

SEQ ID NO: 3607508 - RNA, 15 nt, Salmonella enterica enterica serovar Typhi
auaguaaauagaaaa

SEQ ID NO: 3607509 - RNA, 23 nt, Salmonella enterica enterica serovar Typhi
auaguaaauagaaaauaauucuu

SEQ ID NO: 3607510 - RNA, 23 nt, Salmonella enterica enterica serovar Typhi
auaguaucgcugcuaaacgagcc

SEQ ID NO: 3607511 - RNA, 16 nt, Salmonella enterica enterica serovar Typhi
auagucauaauuaaaa

SEQ ID NO: 3607512 - RNA, 17 nt, Salmonella enterica enterica serovar Typhi
auagucauaauuaaaaa

SEQ ID NO: 3607513 - RNA, 19 nt, Salmonella enterica enterica serovar Typhi
auagucauugacagcaagu

SEQ ID NO: 3607514 - RNA, 19 nt, Salmonella enterica enterica serovar Typhi
auagucuuaauuugcuguu

SEQ ID NO: 3607515 - RNA, 22 nt, Salmonella enterica enterica serovar Typhi
auagucuuguuacucaauaaaa

SEQ ID NO: 3607516 - RNA, 23 nt, Salmonella enterica enterica serovar Typhi
auagucuuguuacucaauaaaag

SEQ ID NO: 3607517 - RNA, 14 nt, Salmonella enterica enterica serovar Typhi
auagugacuucugc

SEQ ID NO: 3607518 - RNA, 18 nt, Salmonella enterica enterica serovar Typhi
auagugagcgacuucaaa

SEQ ID NO: 3607519 - RNA, 21 nt, Salmonella enterica enterica serovar Typhi
auagugcgugacaaucuccuc

SEQ ID NO: 3607520 - RNA, 19 nt, Salmonella enterica enterica serovar Typhi
auaguggaacgucaggccg

SEQ ID NO: 3607521 - RNA, 17 nt, Salmonella enterica enterica serovar Typhi
auaguggcgucgccaua

SEQ ID NO: 3607522 - RNA, 21 nt, Salmonella enterica enterica serovar Typhi
auaguuauacauuuuuuucuu

SEQ ID NO: 3607523 - RNA, 19 nt, Salmonella enterica enterica serovar Typhi
auaguucaucgugaaauua

SEQ ID NO: 3607524 - RNA, 22 nt, Salmonella enterica enterica serovar Typhi
auaguucaucgugaaauuauuc

SEQ ID NO: 3607525 - RNA, 17 nt, Salmonella enterica enterica serovar Typhi
auaguuuaaauccagcg

SEQ ID NO: 3607526 - RNA, 21 nt, Salmonella enterica enterica serovar Typhi
auaguuucgacuuucauuucu

SEQ ID NO: 3607527 - RNA, 19 nt, Salmonella enterica enterica serovar Typhi
auaguuucgucgugaauua

SEQ ID NO: 3607528 - RNA, 12 nt, Salmonella enterica enterica serovar Typhi
auaguuugcaua

SEQ ID NO: 3607529 - RNA, 19 nt, Salmonella enterica enterica serovar Typhi
auauaaaaaacauauaauu

SEQ ID NO: 3607530 - RNA, 18 nt, Salmonella enterica enterica serovar Typhi
auauaaaaagccagggaa

SEQ ID NO: 3607531 - RNA, 19 nt, Salmonella enterica enterica serovar Typhi
auauaaaaauagcuggcug

SEQ ID NO: 3607532 - RNA, 19 nt, Salmonella enterica enterica serovar Typhi
auauaaaccggaacauaca

SEQ ID NO: 3607533 - RNA, 19 nt, Salmonella enterica enterica serovar Typhi
auaugaucugcgcaacauu

SEQ ID NO: 3607534 - RNA, 12 nt, Salmonella enterica enterica serovar Typhi
auaugaugcagg

SEQ ID NO: 3607535 - RNA, 13 nt, Salmonella enterica enterica serovar Typhi
auaugauuuaaaa

SEQ ID NO: 3607536 - RNA, 14 nt, Salmonella enterica enterica serovar Typhi
auaugauuuaaaaa

SEQ ID NO: 3607537 - RNA, 15 nt, Salmonella enterica enterica serovar Typhi
auaugauuuaaaaaa

SEQ ID NO: 3607538 - RNA, 16 nt, Salmonella enterica enterica serovar Typhi
auaugcagcagccagu

SEQ ID NO: 3607539 - RNA, 18 nt, Salmonella enterica enterica serovar Typhi
auaugcaggcauaaaaaa

SEQ ID NO: 3607540 - RNA, 19 nt, Salmonella enterica enterica serovar Typhi
auaugcaggcauaaaaaag

SEQ ID NO: 3607541 - RNA, 21 nt, Salmonella enterica enterica serovar Typhi
auaugcaggcauaaaaaagag

SEQ ID NO: 3607542 - RNA, 22 nt, Salmonella enterica enterica serovar Typhi
auaugccugcacuaaaccagau

SEQ ID NO: 3607543 - RNA, 19 nt, Salmonella enterica enterica serovar Typhi
auaugcgacagaaauugaa

SEQ ID NO: 3607544 - RNA, 15 nt, Salmonella enterica enterica serovar Typhi
auaugcgccaacugc

SEQ ID NO: 3607545 - RNA, 22 nt, Salmonella enterica enterica serovar Typhi
auaugcgcugcgaagugaauau

SEQ ID NO: 3607546 - RNA, 19 nt, Salmonella enterica enterica serovar Typhi
auaugcggagccucuuccu

SEQ ID NO: 3607547 - RNA, 16 nt, Salmonella enterica enterica serovar Typhi
auaugcggcgccauca

SEQ ID NO: 3607548 - RNA, 21 nt, Salmonella enterica enterica serovar Typhi
auaugcgucagauguucgcga

SEQ ID NO: 3607549 - RNA, 19 nt, Salmonella enterica enterica serovar Typhi
auaugcguguagcagauag

SEQ ID NO: 3607550 - RNA, 19 nt, Salmonella enterica enterica serovar Typhi
auaugcguugacccgucca

SEQ ID NO: 3607551 - RNA, 19 nt, Salmonella enterica enterica serovar Typhi
auauggccguuuucaugca

SEQ ID NO: 3607552 - RNA, 23 nt, Salmonella enterica enterica serovar Typhi
auauggcgcaaguguauggcugg

SEQ ID NO: 3607553 - RNA, 20 nt, Salmonella enterica enterica serovar Typhi
auaugguauucgugcaucag

SEQ ID NO: 3607554 - RNA, 18 nt, Salmonella enterica enterica serovar Typhi
auauguggauguaccaga

SEQ ID NO: 3607555 - RNA, 17 nt, Salmonella enterica enterica serovar Typhi
auauguguaucuugcuu

SEQ ID NO: 3607556 - RNA, 24 nt, Salmonella enterica enterica serovar Typhi
auauguuugauaaacugcgccaug

SEQ ID NO: 3607557 - RNA, 14 nt, Salmonella enterica enterica serovar Typhi
auauguuugcgcgu

SEQ ID NO: 3607558 - RNA, 14 nt, Salmonella enterica enterica serovar Typhi
auauuaaaagccgc

SEQ ID NO: 3607559 - RNA, 13 nt, Salmonella enterica enterica serovar Typhi
auauuaaaguuca

SEQ ID NO: 3607560 - RNA, 21 nt, Salmonella enterica enterica serovar Typhi
auauuaaaguucagccgauaa

SEQ ID NO: 3607561 - RNA, 13 nt, Salmonella enterica enterica serovar Typhi
auauuaaauaaau

SEQ ID NO: 3607562 - RNA, 21 nt, Salmonella enterica enterica serovar Typhi
auauuaaauaaauaguaaaua

SEQ ID NO: 3607563 - RNA, 15 nt, Salmonella enterica enterica serovar Typhi
auauuacuuuccagc

SEQ ID NO: 3607564 - RNA, 22 nt, Salmonella enterica enterica serovar Typhi
auauuagcgguacucuuuuucc

SEQ ID NO: 3607565 - RNA, 14 nt, Salmonella enterica enterica serovar Typhi
auauuaucauaaug

SEQ ID NO: 3607566 - RNA, 18 nt, Salmonella enterica enterica serovar Typhi
auauuauccuuuaauuaa

SEQ ID NO: 3607567 - RNA, 13 nt, Salmonella enterica enterica serovar Typhi
auauuauuauaua

SEQ ID NO: 3607568 - RNA, 17 nt, Salmonella enterica enterica serovar Typhi
auauuauuaugucauag

SEQ ID NO: 3607569 - RNA, 21 nt, Salmonella enterica enterica serovar Typhi
auauuauuaugucauagcaau

SEQ ID NO: 3607570 - RNA, 22 nt, Salmonella enterica enterica serovar Typhi
auauuauugacgcuuucuuccc

SEQ ID NO: 3607571 - RNA, 22 nt, Salmonella enterica enterica serovar Typhi
auauucaacgaaugccugcaua

SEQ ID NO: 3607572 - RNA, 22 nt, Salmonella enterica enterica serovar Typhi
auauucagaauuuuuaaccauc

SEQ ID NO: 3607573 - RNA, 13 nt, Salmonella enterica enterica serovar Typhi
auauucaggagca

SEQ ID NO: 3607574 - RNA, 23 nt, Salmonella enterica enterica serovar Typhi
auauucaguacugacgcaaucug

SEQ ID NO: 3607575 - RNA, 21 nt, Salmonella enterica enterica serovar Typhi
auauucaugccagaagcaaau

SEQ ID NO: 3607576 - RNA, 11 nt, Salmonella enterica enterica serovar Typhi
auauuccccac

SEQ ID NO: 3607577 - RNA, 22 nt, Salmonella enterica enterica serovar Typhi
auauucccguuccagcuugaau

SEQ ID NO: 3607578 - RNA, 18 nt, Salmonella enterica enterica serovar Typhi
auauuccgccucguguaa

SEQ ID NO: 3607579 - RNA, 14 nt, Salmonella enterica enterica serovar Typhi
auauucgggcgcau

SEQ ID NO: 3607580 - RNA, 21 nt, Salmonella enterica enterica serovar Typhi
auauugcccaucgcgccauga

SEQ ID NO: 3607581 - RNA, 21 nt, Salmonella enterica enterica serovar Typhi
auauugcgaauaaaacugccg

SEQ ID NO: 3607582 - RNA, 15 nt, Salmonella enterica enterica serovar Typhi
auauugcgccgcagc

SEQ ID NO: 3607583 - RNA, 19 nt, Salmonella enterica enterica serovar Typhi
auauugcgcuuaccaggua

SEQ ID NO: 3607584 - RNA, 20 nt, Salmonella enterica enterica serovar Typhi
auauugcugugcuaugauaa

SEQ ID NO: 3607585 - RNA, 20 nt, Salmonella enterica enterica serovar Typhi
auauuggcgaggaacaucag

SEQ ID NO: 3607586 - RNA, 16 nt, Salmonella enterica enterica serovar Typhi
auauugucgcccugca

SEQ ID NO: 3607587 - RNA, 23 nt, Salmonella enterica enterica serovar Typhi
auauuguguuuuuuaauauauuc

SEQ ID NO: 3607588 - RNA, 11 nt, Salmonella enterica enterica serovar Typhi
auauuguugaa

SEQ ID NO: 3607589 - RNA, 21 nt, Salmonella enterica enterica serovar Typhi
auauuguuuucuauuuucucc

SEQ ID NO: 3607590 - RNA, 20 nt, Salmonella enterica enterica serovar Typhi
auauuuauuugcauuguacu

SEQ ID NO: 3607591 - RNA, 22 nt, Salmonella enterica enterica serovar Typhi
auauuuauuugcauuguacuuu

SEQ ID NO: 3607592 - RNA, 18 nt, Salmonella enterica enterica serovar Typhi
auauuugcgugucaucaa

SEQ ID NO: 3607593 - RNA, 19 nt, Salmonella enterica enterica serovar Typhi
auauuugcgugucaucaaa

SEQ ID NO: 3607594 - RNA, 21 nt, Salmonella enterica enterica serovar Typhi
auauuuuauggaggauauaaa

SEQ ID NO: 3607595 - RNA, 19 nt, Salmonella enterica enterica serovar Typhi
auauuuucucaauuuuaca

SEQ ID NO: 3607596 - RNA, 13 nt, Salmonella enterica enterica serovar Typhi
auauuuuguaguu

SEQ ID NO: 3607597 - RNA, 19 nt, Salmonella enterica enterica serovar Typhi
auauuuuguuuuaaauuca

SEQ ID NO: 3607598 - RNA, 10 nt, Salmonella enterica enterica serovar Typhi
auauuuuuaa

SEQ ID NO: 3607599 - RNA, 21 nt, Salmonella enterica enterica serovar Typhi
auauuuuuaagguauugauuu

SEQ ID NO: 3607600 - RNA, 20 nt, Salmonella enterica enterica serovar Typhi
auauuuuuacgucccgguaa

SEQ ID NO: 3607601 - RNA, 18 nt, Salmonella enterica enterica serovar Typhi
auauuuuucauucgcgcu

SEQ ID NO: 3607602 - RNA, 14 nt, Salmonella enterica enterica serovar Typhi
auauuuuuucagga

SEQ ID NO: 3607603 - RNA, 23 nt, Salmonella enterica enterica serovar Typhi
aucaaaacuacgccaaugaacuc

SEQ ID NO: 3607604 - RNA, 15 nt, Salmonella enterica enterica serovar Typhi
aucaaaaucaucgcc

SEQ ID NO: 3607605 - RNA, 16 nt, Salmonella enterica enterica serovar Typhi
aucaaacauagagauc

SEQ ID NO: 3607606 - RNA, 18 nt, Salmonella enterica enterica serovar Typhi
aucaaaccaucccagguu

SEQ ID NO: 3607607 - RNA, 24 nt, Salmonella enterica enterica serovar Typhi
aucaaaccgauagcuaucacacau

SEQ ID NO: 3607608 - RNA, 14 nt, Salmonella enterica enterica serovar Typhi
aucaaacuucguua

SEQ ID NO: 3607609 - RNA, 23 nt, Salmonella enterica enterica serovar Typhi
aucaaacuugcccagcgccuucu

SEQ ID NO: 3607610 - RNA, 22 nt, Salmonella enterica enterica serovar Typhi
aucaaaggcgucgccgaauaaa

SEQ ID NO: 3607611 - RNA, 17 nt, Salmonella enterica enterica serovar Typhi
aucaaauaagacaugga

SEQ ID NO: 3607612 - RNA, 17 nt, Salmonella enterica enterica serovar Typhi
aucaaauaccuuuucau

SEQ ID NO: 3607613 - RNA, 15 nt, Salmonella enterica enterica serovar Typhi
aucaacaaugucgcc

SEQ ID NO: 3607614 - RNA, 23 nt, Salmonella enterica enterica serovar Typhi
aucaacaggcgauucggacucau

SEQ ID NO: 3607615 - RNA, 20 nt, Salmonella enterica enterica serovar Typhi
aucaacaucgcaaaauuccg

SEQ ID NO: 3607616 - RNA, 14 nt, Salmonella enterica enterica serovar Typhi
aucaaccaccuuca

SEQ ID NO: 3607617 - RNA, 16 nt, Salmonella enterica enterica serovar Typhi
aucaaccaccuucacc

SEQ ID NO: 3607618 - RNA, 22 nt, Salmonella enterica enterica serovar Typhi
aucaacgaccaugguucccgcc

SEQ ID NO: 3607619 - RNA, 14 nt, Salmonella enterica enterica serovar Typhi
aucaacgccgccag

SEQ ID NO: 3607620 - RNA, 14 nt, Salmonella enterica enterica serovar Typhi
aucaacuccuccgg

SEQ ID NO: 3607621 - RNA, 13 nt, Salmonella enterica enterica serovar Typhi
aucaacugcgcca

SEQ ID NO: 3607622 - RNA, 15 nt, Salmonella enterica enterica serovar Typhi
aucaacugcgccaca

SEQ ID NO: 3607623 - RNA, 20 nt, Salmonella enterica enterica serovar Typhi
aucaacuucguucaguucca

SEQ ID NO: 3607624 - RNA, 13 nt, Salmonella enterica enterica serovar Typhi
aucaagaugcuac

SEQ ID NO: 3607625 - RNA, 17 nt, Salmonella enterica enterica serovar Typhi
aucaagcccacacauca

SEQ ID NO: 3607626 - RNA, 13 nt, Salmonella enterica enterica serovar Typhi
aucaagcccagcu

SEQ ID NO: 3607627 - RNA, 22 nt, Salmonella enterica enterica serovar Typhi
aucaagcgguagcguuauccag

SEQ ID NO: 3607628 - RNA, 20 nt, Salmonella enterica enterica serovar Typhi
aucaagcuuugcguaaaaaa

SEQ ID NO: 3607629 - RNA, 14 nt, Salmonella enterica enterica serovar Typhi
aucaauaaaauuau

SEQ ID NO: 3607630 - RNA, 17 nt, Salmonella enterica enterica serovar Typhi
aucaauaaaauuaucca

SEQ ID NO: 3607631 - RNA, 18 nt, Salmonella enterica enterica serovar Typhi
aucaauaagcgaauugcc

SEQ ID NO: 3607632 - RNA, 21 nt, Salmonella enterica enterica serovar Typhi
aucaauaagggucgcgcugua

SEQ ID NO: 3607633 - RNA, 19 nt, Salmonella enterica enterica serovar Typhi
aucaauacagagauauuaa

SEQ ID NO: 3607634 - RNA, 14 nt, Salmonella enterica enterica serovar Typhi
aucaauagauuauu

SEQ ID NO: 3607635 - RNA, 18 nt, Salmonella enterica enterica serovar Typhi
aucaaucaccucuucccc

SEQ ID NO: 3607636 - RNA, 13 nt, Salmonella enterica enterica serovar Typhi
aucaaucaccuua

SEQ ID NO: 3607637 - RNA, 16 nt, Salmonella enterica enterica serovar Typhi
aucaaucuacuguuau

SEQ ID NO: 3607638 - RNA, 12 nt, Salmonella enterica enterica serovar Typhi
aucaaugcccag

SEQ ID NO: 3607639 - RNA, 20 nt, Salmonella enterica enterica serovar Typhi
aucaaugcccagcgcaauca

SEQ ID NO: 3607640 - RNA, 21 nt, Salmonella enterica enterica serovar Typhi
aucaaugcccagcgcaaucac

SEQ ID NO: 3607641 - RNA, 22 nt, Salmonella enterica enterica serovar Typhi
aucaaugcccagcgcaaucacg

SEQ ID NO: 3607642 - RNA, 21 nt, Salmonella enterica enterica serovar Typhi
aucaaugggauagugccugcc

SEQ ID NO: 3607643 - RNA, 19 nt, Salmonella enterica enterica serovar Typhi
aucaauggugaauuugcug

SEQ ID NO: 3607644 - RNA, 20 nt, Salmonella enterica enterica serovar Typhi
aucaauguauuguucaugca

SEQ ID NO: 3607645 - RNA, 23 nt, Salmonella enterica enterica serovar Typhi
aucaaugucugauggcgcugcgc

SEQ ID NO: 3607646 - RNA, 20 nt, Salmonella enterica enterica serovar Typhi
aucaauuccuuuuaauuuaa

SEQ ID NO: 3607647 - RNA, 18 nt, Salmonella enterica enterica serovar Typhi
aucaauucuuuaauuugu

SEQ ID NO: 3607648 - RNA, 19 nt, Salmonella enterica enterica serovar Typhi
aucaauugugugcacugca

SEQ ID NO: 3607649 - RNA, 19 nt, Salmonella enterica enterica serovar Typhi
aucaauuucauauuauuau

SEQ ID NO: 3607650 - RNA, 20 nt, Salmonella enterica enterica serovar Typhi
aucaauuucccuucaaucac

SEQ ID NO: 3607651 - RNA, 23 nt, Salmonella enterica enterica serovar Typhi
aucaauuucucuuuuauuauuuu

SEQ ID NO: 3607652 - RNA, 14 nt, Salmonella enterica enterica serovar Typhi
aucacaaauaacag

SEQ ID NO: 3607653 - RNA, 16 nt, Salmonella enterica enterica serovar Typhi
aucacaacgucauccc

SEQ ID NO: 3607654 - RNA, 19 nt, Salmonella enterica enterica serovar Typhi
aucacaacgucaucccgaa

SEQ ID NO: 3607655 - RNA, 19 nt, Salmonella enterica enterica serovar Typhi
aucacaagcuguuucuccg

SEQ ID NO: 3607656 - RNA, 14 nt, Salmonella enterica enterica serovar Typhi
aucacaaggaauga

SEQ ID NO: 3607657 - RNA, 20 nt, Salmonella enterica enterica serovar Typhi
aucacacauaucgccagcca

SEQ ID NO: 3607658 - RNA, 17 nt, Salmonella enterica enterica serovar Typhi
aucacacccgcacgccu

SEQ ID NO: 3607659 - RNA, 15 nt, Salmonella enterica enterica serovar Typhi
aucacagacagaugc

SEQ ID NO: 3607660 - RNA, 16 nt, Salmonella enterica enterica serovar Typhi
aucacagggggaacau

SEQ ID NO: 3607661 - RNA, 21 nt, Salmonella enterica enterica serovar Typhi
aucacaucauuaaagcgcuca

SEQ ID NO: 3607662 - RNA, 17 nt, Salmonella enterica enterica serovar Typhi
aucacauccgccagcgc

SEQ ID NO: 3607663 - RNA, 18 nt, Salmonella enterica enterica serovar Typhi
aucacaucgcgcagcagg

SEQ ID NO: 3607664 - RNA, 21 nt, Salmonella enterica enterica serovar Typhi
aucacaugcgggagcaaaaua

SEQ ID NO: 3607665 - RNA, 14 nt, Salmonella enterica enterica serovar Typhi
aucacauugcccca

SEQ ID NO: 3607666 - RNA, 12 nt, Salmonella enterica enterica serovar Typhi
aucaccagcgca

SEQ ID NO: 3607667 - RNA, 14 nt, Salmonella enterica enterica serovar Typhi
aucaccaggcaaug

SEQ ID NO: 3607668 - RNA, 20 nt, Salmonella enterica enterica serovar Typhi
aucaccauaccgacgaccau

SEQ ID NO: 3607669 - RNA, 14 nt, Salmonella enterica enterica serovar Typhi
aucaccaucacgau

SEQ ID NO: 3607670 - RNA, 21 nt, Salmonella enterica enterica serovar Typhi
aucaccaucguugccagcggc

SEQ ID NO: 3607671 - RNA, 15 nt, Salmonella enterica enterica serovar Typhi
aucaccauggcgcca

SEQ ID NO: 3607672 - RNA, 17 nt, Salmonella enterica enterica serovar Typhi
aucaccauucccagcgc

SEQ ID NO: 3607673 - RNA, 19 nt, Salmonella enterica enterica serovar Typhi
aucaccauucccagcgccc

SEQ ID NO: 3607674 - RNA, 22 nt, Salmonella enterica enterica serovar Typhi
aucacccaacguucaugucggc

SEQ ID NO: 3607675 - RNA, 18 nt, Salmonella enterica enterica serovar Typhi
aucacccgcauaugcggc

SEQ ID NO: 3607676 - RNA, 20 nt, Salmonella enterica enterica serovar Typhi
aucaccgcccaaugccccca

SEQ ID NO: 3607677 - RNA, 21 nt, Salmonella enterica enterica serovar Typhi
aucaccgcggcaaccagccca

SEQ ID NO: 3607678 - RNA, 15 nt, Salmonella enterica enterica serovar Typhi
aucaccggcauuuca

SEQ ID NO: 3607679 - RNA, 17 nt, Salmonella enterica enterica serovar Typhi
aucaccggcauuucacc

SEQ ID NO: 3607680 - RNA, 17 nt, Salmonella enterica enterica serovar Typhi
aucaccucuuucuccac

SEQ ID NO: 3607681 - RNA, 22 nt, Salmonella enterica enterica serovar Typhi
aucaccugaccgauauagccac

SEQ ID NO: 3607682 - RNA, 22 nt, Salmonella enterica enterica serovar Typhi
aucaccugauugauacgcgccc

SEQ ID NO: 3607683 - RNA, 15 nt, Salmonella enterica enterica serovar Typhi
aucaccugcaucacg

SEQ ID NO: 3607684 - RNA, 16 nt, Salmonella enterica enterica serovar Typhi
aucaccugcaucacgc

SEQ ID NO: 3607685 - RNA, 18 nt, Salmonella enterica enterica serovar Typhi
aucaccuggcagccgcgu

SEQ ID NO: 3607686 - RNA, 15 nt, Salmonella enterica enterica serovar Typhi
aucaccuggugcauu

SEQ ID NO: 3607687 - RNA, 17 nt, Salmonella enterica enterica serovar Typhi
aucacgcauaucccacu

SEQ ID NO: 3607688 - RNA, 13 nt, Salmonella enterica enterica serovar Typhi
aucacgcccagcg

SEQ ID NO: 3607689 - RNA, 15 nt, Salmonella enterica enterica serovar Typhi
aucacgcccagcgcg

SEQ ID NO: 3607690 - RNA, 23 nt, Salmonella enterica enterica serovar Typhi
aucacgcccgcagcaauagaaua

SEQ ID NO: 3607691 - RNA, 18 nt, Salmonella enterica enterica serovar Typhi
aucacgccguccagcacc

SEQ ID NO: 3607692 - RNA, 22 nt, Salmonella enterica enterica serovar Typhi
aucacgcuaagucaacucaugc

SEQ ID NO: 3607693 - RNA, 13 nt, Salmonella enterica enterica serovar Typhi
aucacgguaaacc

SEQ ID NO: 3607694 - RNA, 16 nt, Salmonella enterica enterica serovar Typhi
aucacgguaaaccugu

SEQ ID NO: 3607695 - RNA, 16 nt, Salmonella enterica enterica serovar Typhi
aucacgguacgcauca

SEQ ID NO: 3607696 - RNA, 15 nt, Salmonella enterica enterica serovar Typhi
aucacguccugauag

SEQ ID NO: 3607697 - RNA, 17 nt, Salmonella enterica enterica serovar Typhi
aucacguuccuuuacuu

SEQ ID NO: 3607698 - RNA, 20 nt, Salmonella enterica enterica serovar Typhi
aucacguuggggaauaaaua

SEQ ID NO: 3607699 - RNA, 22 nt, Salmonella enterica enterica serovar Typhi
aucacuaacugaccauauauga

SEQ ID NO: 3607700 - RNA, 15 nt, Salmonella enterica enterica serovar Typhi
aucacuaagaccagc

SEQ ID NO: 3607701 - RNA, 14 nt, Salmonella enterica enterica serovar Typhi
aucacuaauuugcg

SEQ ID NO: 3607702 - RNA, 13 nt, Salmonella enterica enterica serovar Typhi
aucacuaccgcca

SEQ ID NO: 3607703 - RNA, 16 nt, Salmonella enterica enterica serovar Typhi
aucaggcgugaugacu

SEQ ID NO: 3607704 - RNA, 17 nt, Salmonella enterica enterica serovar Typhi
aucaggcgugaugacuu

SEQ ID NO: 3607705 - RNA, 21 nt, Salmonella enterica enterica serovar Typhi
aucaggcguuacagacgcugc

SEQ ID NO: 3607706 - RNA, 21 nt, Salmonella enterica enterica serovar Typhi
aucaggcguugaccgcuucgc

SEQ ID NO: 3607707 - RNA, 20 nt, Salmonella enterica enterica serovar Typhi
aucagguaucccgccagcgg

SEQ ID NO: 3607708 - RNA, 17 nt, Salmonella enterica enterica serovar Typhi
aucaggucaugcgcgag

SEQ ID NO: 3607709 - RNA, 13 nt, Salmonella enterica enterica serovar Typhi
aucaggucgcuaa

SEQ ID NO: 3607710 - RNA, 14 nt, Salmonella enterica enterica serovar Typhi
aucagguuguccug

SEQ ID NO: 3607711 - RNA, 14 nt, Salmonella enterica enterica serovar Typhi
aucaguaacacaau

SEQ ID NO: 3607712 - RNA, 17 nt, Salmonella enterica enterica serovar Typhi
aucaguaacacaaucag

SEQ ID NO: 3607713 - RNA, 16 nt, Salmonella enterica enterica serovar Typhi
aucaguaacagaacaa

SEQ ID NO: 3607714 - RNA, 17 nt, Salmonella enterica enterica serovar Typhi
aucaguaauguccagau

SEQ ID NO: 3607715 - RNA, 18 nt, Salmonella enterica enterica serovar Typhi
aucaguccccacauuacg

SEQ ID NO: 3607716 - RNA, 18 nt, Salmonella enterica enterica serovar Typhi
aucagucucaaaggccug

SEQ ID NO: 3607717 - RNA, 18 nt, Salmonella enterica enterica serovar Typhi
aucagugaacacccugcc

SEQ ID NO: 3607718 - RNA, 17 nt, Salmonella enterica enterica serovar Typhi
aucagugagaagggcag

SEQ ID NO: 3607719 - RNA, 17 nt, Salmonella enterica enterica serovar Typhi
aucagugcaucuucacu

SEQ ID NO: 3607720 - RNA, 20 nt, Salmonella enterica enterica serovar Typhi
aucaguggcgccgcaaugcc

SEQ ID NO: 3607721 - RNA, 19 nt, Salmonella enterica enterica serovar Typhi
aucaguuccaacccuugcu

SEQ ID NO: 3607722 - RNA, 20 nt, Salmonella enterica enterica serovar Typhi
aucaguuccaaucucuuuug

SEQ ID NO: 3607723 - RNA, 12 nt, Salmonella enterica enterica serovar Typhi
aucauaaaucga

SEQ ID NO: 3607724 - RNA, 14 nt, Salmonella enterica enterica serovar Typhi
aucauaaucacuau

SEQ ID NO: 3607725 - RNA, 14 nt, Salmonella enterica enterica serovar Typhi
aucauagcccugau

SEQ ID NO: 3607726 - RNA, 11 nt, Salmonella enterica enterica serovar Typhi
aucauauccuc

SEQ ID NO: 3607727 - RNA, 18 nt, Salmonella enterica enterica serovar Typhi
aucauauucgcagcucug

SEQ ID NO: 3607728 - RNA, 14 nt, Salmonella enterica enterica serovar Typhi
aucaucacaauuag

SEQ ID NO: 3607729 - RNA, 18 nt, Salmonella enterica enterica serovar Typhi
aucaucaccguuuuccag

SEQ ID NO: 3607730 - RNA, 19 nt, Salmonella enterica enterica serovar Typhi
aucaucaccguuuuccagg

SEQ ID NO: 3607731 - RNA, 15 nt, Salmonella enterica enterica serovar Typhi
aucaucagaacgccu

SEQ ID NO: 3607732 - RNA, 17 nt, Salmonella enterica enterica serovar Typhi
aucaucaggguuauccu

SEQ ID NO: 3607733 - RNA, 23 nt, Salmonella enterica enterica serovar Typhi
aucaucaggguuauccuccagcc

SEQ ID NO: 3607734 - RNA, 16 nt, Salmonella enterica enterica serovar Typhi
aucaucauaucccggc

SEQ ID NO: 3607735 - RNA, 14 nt, Salmonella enterica enterica serovar Typhi
aucaucaucggcac

SEQ ID NO: 3607736 - RNA, 20 nt, Salmonella enterica enterica serovar Typhi
aucaucaucggcacagccag

SEQ ID NO: 3607737 - RNA, 12 nt, Salmonella enterica enterica serovar Typhi
aucauccagccc

SEQ ID NO: 3607738 - RNA, 20 nt, Salmonella enterica enterica serovar Typhi
aucauccccaccgcugaugg

SEQ ID NO: 3607739 - RNA, 14 nt, Salmonella enterica enterica serovar Typhi
aucauccccggcag

SEQ ID NO: 3607740 - RNA, 19 nt, Salmonella enterica enterica serovar Typhi
aucauccgggcauaaaaaa

SEQ ID NO: 3607741 - RNA, 20 nt, Salmonella enterica enterica serovar Typhi
aucauccgggcauaaaaaaa

SEQ ID NO: 3607742 - RNA, 23 nt, Salmonella enterica enterica serovar Typhi
aucauccuucgggcgauuuuugc

SEQ ID NO: 3607743 - RNA, 22 nt, Salmonella enterica enterica serovar Typhi
aucaucgaggccaccaaaaauu

SEQ ID NO: 3607744 - RNA, 22 nt, Salmonella enterica enterica serovar Typhi
aucaucgcauugagcaggggcu

SEQ ID NO: 3607745 - RNA, 22 nt, Salmonella enterica enterica serovar Typhi
aucaucgcgcugauauuuuuac

SEQ ID NO: 3607746 - RNA, 20 nt, Salmonella enterica enterica serovar Typhi
aucaucgcuugcccagcaua

SEQ ID NO: 3607747 - RNA, 16 nt, Salmonella enterica enterica serovar Typhi
aucaucggcacagcca

SEQ ID NO: 3607748 - RNA, 21 nt, Salmonella enterica enterica serovar Typhi
aucaucgguuacuccuuauuu

SEQ ID NO: 3607749 - RNA, 19 nt, Salmonella enterica enterica serovar Typhi
aucaucguaaaaucaacag

SEQ ID NO: 3607750 - RNA, 16 nt, Salmonella enterica enterica serovar Typhi
aucaucuauaauaccu

SEQ ID NO: 3607751 - RNA, 18 nt, Salmonella enterica enterica serovar Typhi
aucaucuauagacgcuga

SEQ ID NO: 3607752 - RNA, 16 nt, Salmonella enterica enterica serovar Typhi
aucaucucauaaaccg

SEQ ID NO: 3607753 - RNA, 12 nt, Salmonella enterica enterica serovar Typhi
aucaucuucacu

SEQ ID NO: 3607754 - RNA, 14 nt, Salmonella enterica enterica serovar Typhi
aucaucuucacuuc

SEQ ID NO: 3607755 - RNA, 16 nt, Salmonella enterica enterica serovar Typhi
aucaucuucacuucac

SEQ ID NO: 3607756 - RNA, 19 nt, Salmonella enterica enterica serovar Typhi
aucaucuucacuucacaaa

SEQ ID NO: 3607757 - RNA, 16 nt, Salmonella enterica enterica serovar Typhi
aucaugaaaaauauaa

SEQ ID NO: 3607758 - RNA, 20 nt, Salmonella enterica enterica serovar Typhi
aucaugaaaaauauaaaaag

SEQ ID NO: 3607759 - RNA, 15 nt, Salmonella enterica enterica serovar Typhi
aucaugaauaaucgu

SEQ ID NO: 3607760 - RNA, 17 nt, Salmonella enterica enterica serovar Typhi
aucaugacagauuuaau

SEQ ID NO: 3607761 - RNA, 16 nt, Salmonella enterica enterica serovar Typhi
aucaugcagccggcga

SEQ ID NO: 3607762 - RNA, 11 nt, Salmonella enterica enterica serovar Typhi
aucaugcccac

SEQ ID NO: 3607763 - RNA, 23 nt, Salmonella enterica enterica serovar Typhi
aucaugcccacaggcagggcgau

SEQ ID NO: 3607764 - RNA, 21 nt, Salmonella enterica enterica serovar Typhi
aucaugcguccgcccagaaag

SEQ ID NO: 3607765 - RNA, 16 nt, Salmonella enterica enterica serovar Typhi
aucaugcugaugacua

SEQ ID NO: 3607766 - RNA, 14 nt, Salmonella enterica enterica serovar Typhi
aucaugcugcaccg

SEQ ID NO: 3607767 - RNA, 19 nt, Salmonella enterica enterica serovar Typhi
aucaugcugcaccgcauca

SEQ ID NO: 3607768 - RNA, 13 nt, Salmonella enterica enterica serovar Typhi
aucaugcuugcaa

SEQ ID NO: 3607769 - RNA, 18 nt, Salmonella enterica enterica serovar Typhi
aucauggacagauuucca

SEQ ID NO: 3607770 - RNA, 14 nt, Salmonella enterica enterica serovar Typhi
aucauggcgaaucc

SEQ ID NO: 3607771 - RNA, 19 nt, Salmonella enterica enterica serovar Typhi
aucaugggcucaucaaaca

SEQ ID NO: 3607772 - RNA, 20 nt, Salmonella enterica enterica serovar Typhi
aucaugguugaaaaaagccg

SEQ ID NO: 3607773 - RNA, 21 nt, Salmonella enterica enterica serovar Typhi
aucaugguugacuuacaaaaa

SEQ ID NO: 3607774 - RNA, 16 nt, Salmonella enterica enterica serovar Typhi
aucaugucaaauucaa

SEQ ID NO: 3607775 - RNA, 17 nt, Salmonella enterica enterica serovar Typhi
aucaugucacccacgcc

SEQ ID NO: 3607776 - RNA, 20 nt, Salmonella enterica enterica serovar Typhi
aucauguuccggcagacggc

SEQ ID NO: 3607777 - RNA, 16 nt, Salmonella enterica enterica serovar Typhi
aucauguuuuucuccc

SEQ ID NO: 3607778 - RNA, 13 nt, Salmonella enterica enterica serovar Typhi
aucauuaauuuac

SEQ ID NO: 3607779 - RNA, 19 nt, Salmonella enterica enterica serovar Typhi
aucauuaauuuacugauaa

SEQ ID NO: 3607780 - RNA, 13 nt, Salmonella enterica enterica serovar Typhi
aucauuaccauag

SEQ ID NO: 3607781 - RNA, 22 nt, Salmonella enterica enterica serovar Typhi
aucauuaccuacgcgauaaaaa

SEQ ID NO: 3607782 - RNA, 23 nt, Salmonella enterica enterica serovar Typhi
aucauuauauagucuuaauuugc

SEQ ID NO: 3607783 - RNA, 15 nt, Salmonella enterica enterica serovar Typhi
aucauuauuccccuc

SEQ ID NO: 3607784 - RNA, 20 nt, Salmonella enterica enterica serovar Typhi
aucauucaacgcaucaaaua

SEQ ID NO: 3607785 - RNA, 12 nt, Salmonella enterica enterica serovar Typhi
aucauucaucuc

SEQ ID NO: 3607786 - RNA, 13 nt, Salmonella enterica enterica serovar Typhi
aucauucccgccc

SEQ ID NO: 3607787 - RNA, 16 nt, Salmonella enterica enterica serovar Typhi
aucauucccgcccagu

SEQ ID NO: 3607788 - RNA, 20 nt, Salmonella enterica enterica serovar Typhi
aucauucccgcccaguauuc

SEQ ID NO: 3607789 - RNA, 11 nt, Salmonella enterica enterica serovar Typhi
auccggcacug

SEQ ID NO: 3607790 - RNA, 12 nt, Salmonella enterica enterica serovar Typhi
auccggcacugu

SEQ ID NO: 3607791 - RNA, 20 nt, Salmonella enterica enterica serovar Typhi
auccggcauaagauuuacaa

SEQ ID NO: 3607792 - RNA, 13 nt, Salmonella enterica enterica serovar Typhi
auccggcauuuuu

SEQ ID NO: 3607793 - RNA, 21 nt, Salmonella enterica enterica serovar Typhi
auccggccuacagguugucgc

SEQ ID NO: 3607794 - RNA, 21 nt, Salmonella enterica enterica serovar Typhi
auccggccugcacaagaaaca

SEQ ID NO: 3607795 - RNA, 23 nt, Salmonella enterica enterica serovar Typhi
auccggccugcaggcaacguuac

SEQ ID NO: 3607796 - RNA, 14 nt, Salmonella enterica enterica serovar Typhi
auccggccuggcgc

SEQ ID NO: 3607797 - RNA, 20 nt, Salmonella enterica enterica serovar Typhi
auccggccuguaaggucuca

SEQ ID NO: 3607798 - RNA, 13 nt, Salmonella enterica enterica serovar Typhi
auccggcggcguc

SEQ ID NO: 3607799 - RNA, 22 nt, Salmonella enterica enterica serovar Typhi
auccggcuuacggcuauuccuc

SEQ ID NO: 3607800 - RNA, 23 nt, Salmonella enterica enterica serovar Typhi
auccgggaaauggcaauggcggc

SEQ ID NO: 3607801 - RNA, 12 nt, Salmonella enterica enterica serovar Typhi
auccgguaaacg

SEQ ID NO: 3607802 - RNA, 21 nt, Salmonella enterica enterica serovar Typhi
auccgguaaacgcuccggcag

SEQ ID NO: 3607803 - RNA, 23 nt, Salmonella enterica enterica serovar Typhi
auccguacauaacagcagcagac

SEQ ID NO: 3607804 - RNA, 14 nt, Salmonella enterica enterica serovar Typhi
auccguccucuuuc

SEQ ID NO: 3607805 - RNA, 15 nt, Salmonella enterica enterica serovar Typhi
auccguccucuuucc

SEQ ID NO: 3607806 - RNA, 14 nt, Salmonella enterica enterica serovar Typhi
auccgugaccugcu

SEQ ID NO: 3607807 - RNA, 16 nt, Salmonella enterica enterica serovar Typhi
auccguuucagaaaga

SEQ ID NO: 3607808 - RNA, 18 nt, Salmonella enterica enterica serovar Typhi
auccguuuccgcaauaag

SEQ ID NO: 3607809 - RNA, 16 nt, Salmonella enterica enterica serovar Typhi
auccuaaaucugccau

SEQ ID NO: 3607810 - RNA, 16 nt, Salmonella enterica enterica serovar Typhi
auccucauacagcccg

SEQ ID NO: 3607811 - RNA, 19 nt, Salmonella enterica enterica serovar Typhi
auccucauuaguucaaguu

SEQ ID NO: 3607812 - RNA, 19 nt, Salmonella enterica enterica serovar Typhi
auccuccauaaauaacauu

SEQ ID NO: 3607813 - RNA, 21 nt, Salmonella enterica enterica serovar Typhi
auccuccggcgcggcgcgcau

SEQ ID NO: 3607814 - RNA, 12 nt, Salmonella enterica enterica serovar Typhi
auccucgaugaa

SEQ ID NO: 3607815 - RNA, 21 nt, Salmonella enterica enterica serovar Typhi
auccucuauuuuuuauauucg

SEQ ID NO: 3607816 - RNA, 18 nt, Salmonella enterica enterica serovar Typhi
auccucuuggguuauuuc

SEQ ID NO: 3607817 - RNA, 20 nt, Salmonella enterica enterica serovar Typhi
auccucuuggguuauuucga

SEQ ID NO: 3607818 - RNA, 22 nt, Salmonella enterica enterica serovar Typhi
auccugaagacaugcuguugaa

SEQ ID NO: 3607819 - RNA, 15 nt, Salmonella enterica enterica serovar Typhi
auccugacaggccgg

SEQ ID NO: 3607820 - RNA, 17 nt, Salmonella enterica enterica serovar Typhi
auccugaguauaaaacu

SEQ ID NO: 3607821 - RNA, 22 nt, Salmonella enterica enterica serovar Typhi
auccugauccugcaacagcacc

SEQ ID NO: 3607822 - RNA, 13 nt, Salmonella enterica enterica serovar Typhi
auccugauuauua

SEQ ID NO: 3607823 - RNA, 21 nt, Salmonella enterica enterica serovar Typhi
auccugauuuuacugacuauc

SEQ ID NO: 3607824 - RNA, 16 nt, Salmonella enterica enterica serovar Typhi
auccugcaaauagcgc

SEQ ID NO: 3607825 - RNA, 13 nt, Salmonella enterica enterica serovar Typhi
auccugcacccgc

SEQ ID NO: 3607826 - RNA, 21 nt, Salmonella enterica enterica serovar Typhi
auccugcaccgccugcggcau

SEQ ID NO: 3607827 - RNA, 17 nt, Salmonella enterica enterica serovar Typhi
auccugcaggguaauua

SEQ ID NO: 3607828 - RNA, 21 nt, Salmonella enterica enterica serovar Typhi
auccugcgccauugcgggagc

SEQ ID NO: 3607829 - RNA, 20 nt, Salmonella enterica enterica serovar Typhi
auccugcgggaugcguaauc

SEQ ID NO: 3607830 - RNA, 21 nt, Salmonella enterica enterica serovar Typhi
auccugcggguucaucgccac

SEQ ID NO: 3607831 - RNA, 19 nt, Salmonella enterica enterica serovar Typhi
auccugcucaucgacagaa

SEQ ID NO: 3607832 - RNA, 17 nt, Salmonella enterica enterica serovar Typhi
auccugcuugccugugc

SEQ ID NO: 3607833 - RNA, 21 nt, Salmonella enterica enterica serovar Typhi
auccuguccggcguaccauuu

SEQ ID NO: 3607834 - RNA, 13 nt, Salmonella enterica enterica serovar Typhi
auccuguucaaac

SEQ ID NO: 3607835 - RNA, 18 nt, Salmonella enterica enterica serovar Typhi
auccuguucaaacaucag

SEQ ID NO: 3607836 - RNA, 21 nt, Salmonella enterica enterica serovar Typhi
auccuucaaucgguacgccaa

SEQ ID NO: 3607837 - RNA, 22 nt, Salmonella enterica enterica serovar Typhi
auccuucauucagaucaaaaau

SEQ ID NO: 3607838 - RNA, 14 nt, Salmonella enterica enterica serovar Typhi
auccuuccagcccg

SEQ ID NO: 3607839 - RNA, 17 nt, Salmonella enterica enterica serovar Typhi
auccuuccagcccguuc

SEQ ID NO: 3607840 - RNA, 21 nt, Salmonella enterica enterica serovar Typhi
auccuucuaccuucaccccca

SEQ ID NO: 3607841 - RNA, 16 nt, Salmonella enterica enterica serovar Typhi
auccuucuuccauucc

SEQ ID NO: 3607842 - RNA, 16 nt, Salmonella enterica enterica serovar Typhi
auccuugcacgccaaa

SEQ ID NO: 3607843 - RNA, 17 nt, Salmonella enterica enterica serovar Typhi
auccuuuaauuaaucca

SEQ ID NO: 3607844 - RNA, 18 nt, Salmonella enterica enterica serovar Typhi
auccuuuuucugcgccag

SEQ ID NO: 3607845 - RNA, 16 nt, Salmonella enterica enterica serovar Typhi
aucgaaagagcaaaua

SEQ ID NO: 3607846 - RNA, 19 nt, Salmonella enterica enterica serovar Typhi
aucgaacauucuuaugcaa

SEQ ID NO: 3607847 - RNA, 21 nt, Salmonella enterica enterica serovar Typhi
aucgaacgcuuccgggcucau

SEQ ID NO: 3607848 - RNA, 22 nt, Salmonella enterica enterica serovar Typhi
aucgaaggcaucuucagacagu

SEQ ID NO: 3607849 - RNA, 12 nt, Salmonella enterica enterica serovar Typhi
aucgaaggucag

SEQ ID NO: 3607850 - RNA, 16 nt, Salmonella enterica enterica serovar Typhi
aucgaauccagcaggc

SEQ ID NO: 3607851 - RNA, 22 nt, Salmonella enterica enterica serovar Typhi
aucgaaucguucgccagugaca

SEQ ID NO: 3607852 - RNA, 18 nt, Salmonella enterica enterica serovar Typhi
aucgacaaaacacggcua

SEQ ID NO: 3607853 - RNA, 15 nt, Salmonella enterica enterica serovar Typhi
aucgacaaaccacug

SEQ ID NO: 3607854 - RNA, 22 nt, Salmonella enterica enterica serovar Typhi
aucgacagggguguuacgccau

SEQ ID NO: 3607855 - RNA, 18 nt, Salmonella enterica enterica serovar Typhi
aucgacaguggcuuuaac

SEQ ID NO: 3607856 - RNA, 23 nt, Salmonella enterica enterica serovar Typhi
aucgaccauacuaaugcugccca

SEQ ID NO: 3607857 - RNA, 22 nt, Salmonella enterica enterica serovar Typhi
aucgacccccaccucaaucacc

SEQ ID NO: 3607858 - RNA, 20 nt, Salmonella enterica enterica serovar Typhi
aucgacgauaacaagccggc

SEQ ID NO: 3607859 - RNA, 15 nt, Salmonella enterica enterica serovar Typhi
aucgagaagccauca

SEQ ID NO: 3607860 - RNA, 11 nt, Salmonella enterica enterica serovar Typhi
aucgagauaag

SEQ ID NO: 3607861 - RNA, 15 nt, Salmonella enterica enterica serovar Typhi
aucgagaucagacuu

SEQ ID NO: 3607862 - RNA, 17 nt, Salmonella enterica enterica serovar Typhi
aucgaggccauauuuaa

SEQ ID NO: 3607863 - RNA, 21 nt, Salmonella enterica enterica serovar Typhi
aucgagugucaauaagccaga

SEQ ID NO: 3607864 - RNA, 20 nt, Salmonella enterica enterica serovar Typhi
aucgauauaucgcgucauca

SEQ ID NO: 3607865 - RNA, 21 nt, Salmonella enterica enterica serovar Typhi
aucgauccacuucccauucuc

SEQ ID NO: 3607866 - RNA, 21 nt, Salmonella enterica enterica serovar Typhi
aucgauggcagucgcaucaug

SEQ ID NO: 3607867 - RNA, 21 nt, Salmonella enterica enterica serovar Typhi
aucgcacagagaucgugcauc

SEQ ID NO: 3607868 - RNA, 21 nt, Salmonella enterica enterica serovar Typhi
aucgcacuggcgccugcgccu

SEQ ID NO: 3607869 - RNA, 22 nt, Salmonella enterica enterica serovar Typhi
aucgcagaaauauuuugccugc

SEQ ID NO: 3607870 - RNA, 20 nt, Salmonella enterica enterica serovar Typhi
aucgcagagcguaauuccgc

SEQ ID NO: 3607871 - RNA, 21 nt, Salmonella enterica enterica serovar Typhi
aucgcagauuccgaacucaug

SEQ ID NO: 3607872 - RNA, 21 nt, Salmonella enterica enterica serovar Typhi
aucgcagucagccuugaccgc

SEQ ID NO: 3607873 - RNA, 18 nt, Salmonella enterica enterica serovar Typhi
aucgcauaaauauccggg

SEQ ID NO: 3607874 - RNA, 22 nt, Salmonella enterica enterica serovar Typhi
aucggacgguuuugcgccaucc

SEQ ID NO: 3607875 - RNA, 15 nt, Salmonella enterica enterica serovar Typhi
aucggaguccagcaa

SEQ ID NO: 3607876 - RNA, 15 nt, Salmonella enterica enterica serovar Typhi
aucggauagaugaag

SEQ ID NO: 3607877 - RNA, 13 nt, Salmonella enterica enterica serovar Typhi
aucggauccaucg

SEQ ID NO: 3607878 - RNA, 17 nt, Salmonella enterica enterica serovar Typhi
aucggcaaacgccgccu

SEQ ID NO: 3607879 - RNA, 19 nt, Salmonella enterica enterica serovar Typhi
aucggcaaacgccgccugg

SEQ ID NO: 3607880 - RNA, 15 nt, Salmonella enterica enterica serovar Typhi
aucggcaagcaucug

SEQ ID NO: 3607881 - RNA, 18 nt, Salmonella enterica enterica serovar Typhi
aucggcacgcgaucgcga

SEQ ID NO: 3607882 - RNA, 22 nt, Salmonella enterica enterica serovar Typhi
aucggcaucuuuaaccgccugc

SEQ ID NO: 3607883 - RNA, 20 nt, Salmonella enterica enterica serovar Typhi
aucggccagauaguggcuga

SEQ ID NO: 3607884 - RNA, 18 nt, Salmonella enterica enterica serovar Typhi
aucggccagcgaaaacca

SEQ ID NO: 3607885 - RNA, 15 nt, Salmonella enterica enterica serovar Typhi
aucggcgagcggcua

SEQ ID NO: 3607886 - RNA, 22 nt, Salmonella enterica enterica serovar Typhi
aucggcgcuacggcguuucacu

SEQ ID NO: 3607887 - RNA, 14 nt, Salmonella enterica enterica serovar Typhi
aucggcguaccgca

SEQ ID NO: 3607888 - RNA, 16 nt, Salmonella enterica enterica serovar Typhi
aucggcguguuucauc

SEQ ID NO: 3607889 - RNA, 20 nt, Salmonella enterica enterica serovar Typhi
aucggcguugccuggccucc

SEQ ID NO: 3607890 - RNA, 16 nt, Salmonella enterica enterica serovar Typhi
aucggcucagcaauca

SEQ ID NO: 3607891 - RNA, 17 nt, Salmonella enterica enterica serovar Typhi
aucggcuuauaaaacgc

SEQ ID NO: 3607892 - RNA, 16 nt, Salmonella enterica enterica serovar Typhi
aucgggaaucaucgag

SEQ ID NO: 3607893 - RNA, 22 nt, Salmonella enterica enterica serovar Typhi
aucgggacaaucaccaucccau

SEQ ID NO: 3607894 - RNA, 21 nt, Salmonella enterica enterica serovar Typhi
aucgggaucagaaauucgcag

SEQ ID NO: 3607895 - RNA, 16 nt, Salmonella enterica enterica serovar Typhi
aucgggcaauccauua

SEQ ID NO: 3607896 - RNA, 20 nt, Salmonella enterica enterica serovar Typhi
aucgggcgggcauuauacgc

SEQ ID NO: 3607897 - RNA, 18 nt, Salmonella enterica enterica serovar Typhi
aucgggcuguugaauauc

SEQ ID NO: 3607898 - RNA, 19 nt, Salmonella enterica enterica serovar Typhi
aucggguauguuuuagcag

SEQ ID NO: 3607899 - RNA, 20 nt, Salmonella enterica enterica serovar Typhi
aucgguaaaggucgccgcau

SEQ ID NO: 3607900 - RNA, 17 nt, Salmonella enterica enterica serovar Typhi
aucgguaggccggauaa

SEQ ID NO: 3607901 - RNA, 20 nt, Salmonella enterica enterica serovar Typhi
aucggucugcuucagccacu

SEQ ID NO: 3607902 - RNA, 19 nt, Salmonella enterica enterica serovar Typhi
aucggugauccagcaaucg

SEQ ID NO: 3607903 - RNA, 16 nt, Salmonella enterica enterica serovar Typhi
aucgguguacaucgcg

SEQ ID NO: 3607904 - RNA, 18 nt, Salmonella enterica enterica serovar Typhi
aucgguguacaucgcgcu

SEQ ID NO: 3607905 - RNA, 14 nt, Salmonella enterica enterica serovar Typhi
aucgguucucugcc

SEQ ID NO: 3607906 - RNA, 16 nt, Salmonella enterica enterica serovar Typhi
aucgguucucugccau

SEQ ID NO: 3607907 - RNA, 14 nt, Salmonella enterica enterica serovar Typhi
aucgguuucgcggc

SEQ ID NO: 3607908 - RNA, 19 nt, Salmonella enterica enterica serovar Typhi
aucgguuugagcaccacgc

SEQ ID NO: 3607909 - RNA, 13 nt, Salmonella enterica enterica serovar Typhi
aucguaaaucaaa

SEQ ID NO: 3607910 - RNA, 14 nt, Salmonella enterica enterica serovar Typhi
aucguaagccaccg

SEQ ID NO: 3607911 - RNA, 22 nt, Salmonella enterica enterica serovar Typhi
aucguaaugauuacggaacaaa

SEQ ID NO: 3607912 - RNA, 16 nt, Salmonella enterica enterica serovar Typhi
aucguaccaauaccca

SEQ ID NO: 3607913 - RNA, 22 nt, Salmonella enterica enterica serovar Typhi
aucguaccaauacccagcgcca

SEQ ID NO: 3607914 - RNA, 20 nt, Salmonella enterica enterica serovar Typhi
aucguagacuaagguuuugu

SEQ ID NO: 3607915 - RNA, 22 nt, Salmonella enterica enterica serovar Typhi
aucguagcgugcgcaauauggu

SEQ ID NO: 3607916 - RNA, 16 nt, Salmonella enterica enterica serovar Typhi
aucguauccagcggca

SEQ ID NO: 3607917 - RNA, 21 nt, Salmonella enterica enterica serovar Typhi
aucguaugcgccugucuuaaa

SEQ ID NO: 3607918 - RNA, 23 nt, Salmonella enterica enterica serovar Typhi
aucgucaaaaccaaacagcgaca

SEQ ID NO: 3607919 - RNA, 16 nt, Salmonella enterica enterica serovar Typhi
aucgucaccaggaugc

SEQ ID NO: 3607920 - RNA, 18 nt, Salmonella enterica enterica serovar Typhi
aucgucaccaggaugcca

SEQ ID NO: 3607921 - RNA, 23 nt, Salmonella enterica enterica serovar Typhi
aucgucacccuauuuugcgccug

SEQ ID NO: 3607922 - RNA, 22 nt, Salmonella enterica enterica serovar Typhi
aucgucaucggucaguuugccc

SEQ ID NO: 3607923 - RNA, 22 nt, Salmonella enterica enterica serovar Typhi
aucgucauugaccggaaaaaaa

SEQ ID NO: 3607924 - RNA, 13 nt, Salmonella enterica enterica serovar Typhi
aucguccagccau

SEQ ID NO: 3607925 - RNA, 16 nt, Salmonella enterica enterica serovar Typhi
aucguccggcaucgug

SEQ ID NO: 3607926 - RNA, 23 nt, Salmonella enterica enterica serovar Typhi
aucgucgaggaagcugcgcagca

SEQ ID NO: 3607927 - RNA, 16 nt, Salmonella enterica enterica serovar Typhi
aucgucgccagaccca

SEQ ID NO: 3607928 - RNA, 16 nt, Salmonella enterica enterica serovar Typhi
aucgucgcgaucgcgc

SEQ ID NO: 3607929 - RNA, 22 nt, Salmonella enterica enterica serovar Typhi
aucgucggacaacguaccggca

SEQ ID NO: 3607930 - RNA, 21 nt, Salmonella enterica enterica serovar Typhi
aucgucggcgauugucaucau

SEQ ID NO: 3607931 - RNA, 16 nt, Salmonella enterica enterica serovar Typhi
aucgucgggauaagcg

SEQ ID NO: 3607932 - RNA, 16 nt, Salmonella enterica enterica serovar Typhi
aucgucgugucucaga

SEQ ID NO: 3607933 - RNA, 16 nt, Salmonella enterica enterica serovar Typhi
aucgucguuccgccag

SEQ ID NO: 3607934 - RNA, 19 nt, Salmonella enterica enterica serovar Typhi
aucgucguuccgccaggcg

SEQ ID NO: 3607935 - RNA, 13 nt, Salmonella enterica enterica serovar Typhi
aucgucguugcug

SEQ ID NO: 3607936 - RNA, 16 nt, Salmonella enterica enterica serovar Typhi
aucgugaccaccgcca

SEQ ID NO: 3607937 - RNA, 18 nt, Salmonella enterica enterica serovar Typhi
aucgugaccaccgccaua

SEQ ID NO: 3607938 - RNA, 21 nt, Salmonella enterica enterica serovar Typhi
aucgugauaaagcugacgcgc

SEQ ID NO: 3607939 - RNA, 18 nt, Salmonella enterica enterica serovar Typhi
aucgugauaaauugcuga

SEQ ID NO: 3607940 - RNA, 23 nt, Salmonella enterica enterica serovar Typhi
aucgugcaagcccaacuauuuua

SEQ ID NO: 3607941 - RNA, 16 nt, Salmonella enterica enterica serovar Typhi
aucgugccaugaccau

SEQ ID NO: 3607942 - RNA, 23 nt, Salmonella enterica enterica serovar Typhi
aucgugcgcguaugauuuucuua

SEQ ID NO: 3607943 - RNA, 16 nt, Salmonella enterica enterica serovar Typhi
aucgugguuggcauau

SEQ ID NO: 3607944 - RNA, 15 nt, Salmonella enterica enterica serovar Typhi
aucguguugcagccc

SEQ ID NO: 3607945 - RNA, 14 nt, Salmonella enterica enterica serovar Typhi
aucguuauauauac

SEQ ID NO: 3607946 - RNA, 20 nt, Salmonella enterica enterica serovar Typhi
aucguuaucauuaucgccaa

SEQ ID NO: 3607947 - RNA, 18 nt, Salmonella enterica enterica serovar Typhi
aucguuauccagcagcca

SEQ ID NO: 3607948 - RNA, 22 nt, Salmonella enterica enterica serovar Typhi
aucguucgcccuucaucuucca

SEQ ID NO: 3607949 - RNA, 17 nt, Salmonella enterica enterica serovar Typhi
aucguugccagcggcca

SEQ ID NO: 3607950 - RNA, 17 nt, Salmonella enterica enterica serovar Typhi
aucguugcgcgcaauca

SEQ ID NO: 3607951 - RNA, 21 nt, Salmonella enterica enterica serovar Typhi
aucguuuacguuaucauucac

SEQ ID NO: 3607952 - RNA, 15 nt, Salmonella enterica enterica serovar Typhi
aucguuuccagcauc

SEQ ID NO: 3607953 - RNA, 16 nt, Salmonella enterica enterica serovar Typhi
aucguuugcaguuccg

SEQ ID NO: 3607954 - RNA, 21 nt, Salmonella enterica enterica serovar Typhi
aucguuuuaucucuuuugcuu

SEQ ID NO: 3607955 - RNA, 12 nt, Salmonella enterica enterica serovar Typhi
aucguuuuucuu

SEQ ID NO: 3607956 - RNA, 18 nt, Salmonella enterica enterica serovar Typhi
aucuacaaacgcggacau

SEQ ID NO: 3607957 - RNA, 20 nt, Salmonella enterica enterica serovar Typhi
aucuaccuucacgcagugcg

SEQ ID NO: 3607958 - RNA, 17 nt, Salmonella enterica enterica serovar Typhi
aucuacgcuauuuccag

SEQ ID NO: 3607959 - RNA, 17 nt, Salmonella enterica enterica serovar Typhi
aucuguaauuauaaaua

SEQ ID NO: 3607960 - RNA, 20 nt, Salmonella enterica enterica serovar Typhi
aucuguaggcccgguaagcg

SEQ ID NO: 3607961 - RNA, 15 nt, Salmonella enterica enterica serovar Typhi
aucuguauaaauaac

SEQ ID NO: 3607962 - RNA, 20 nt, Salmonella enterica enterica serovar Typhi
aucugucccagccuuccugg

SEQ ID NO: 3607963 - RNA, 14 nt, Salmonella enterica enterica serovar Typhi
aucugucugcugua

SEQ ID NO: 3607964 - RNA, 17 nt, Salmonella enterica enterica serovar Typhi
aucugugccagcccaau

SEQ ID NO: 3607965 - RNA, 18 nt, Salmonella enterica enterica serovar Typhi
aucugugccagcccaaua

SEQ ID NO: 3607966 - RNA, 15 nt, Salmonella enterica enterica serovar Typhi
aucuguucaaaaaca

SEQ ID NO: 3607967 - RNA, 21 nt, Salmonella enterica enterica serovar Typhi
aucuguuccacagaucuaucu

SEQ ID NO: 3607968 - RNA, 22 nt, Salmonella enterica enterica serovar Typhi
aucuguuccacagaucuaucug

SEQ ID NO: 3607969 - RNA, 16 nt, Salmonella enterica enterica serovar Typhi
aucuguucguugcugu

SEQ ID NO: 3607970 - RNA, 16 nt, Salmonella enterica enterica serovar Typhi
aucuguugcgcaagca

SEQ ID NO: 3607971 - RNA, 14 nt, Salmonella enterica enterica serovar Typhi
aucuguugcgccag

SEQ ID NO: 3607972 - RNA, 14 nt, Salmonella enterica enterica serovar Typhi
aucuguuugagaaa

SEQ ID NO: 3607973 - RNA, 18 nt, Salmonella enterica enterica serovar Typhi
aucuguuugagaaaaaca

SEQ ID NO: 3607974 - RNA, 15 nt, Salmonella enterica enterica serovar Typhi
aucuguuuuagcaug

SEQ ID NO: 3607975 - RNA, 21 nt, Salmonella enterica enterica serovar Typhi
aucuucacuguuaucgccauu

SEQ ID NO: 3607976 - RNA, 12 nt, Salmonella enterica enterica serovar Typhi
aucuucaguaag

SEQ ID NO: 3607977 - RNA, 22 nt, Salmonella enterica enterica serovar Typhi
aucuucauaaauagccagcauc

SEQ ID NO: 3607978 - RNA, 14 nt, Salmonella enterica enterica serovar Typhi
aucuucaucccauc

SEQ ID NO: 3607979 - RNA, 20 nt, Salmonella enterica enterica serovar Typhi
aucuuccaacuguacgccac

SEQ ID NO: 3607980 - RNA, 17 nt, Salmonella enterica enterica serovar Typhi
aucuuccacgguaaaac

SEQ ID NO: 3607981 - RNA, 15 nt, Salmonella enterica enterica serovar Typhi
aucuuccagguagug

SEQ ID NO: 3607982 - RNA, 14 nt, Salmonella enterica enterica serovar Typhi
aucuuccaguugcu

SEQ ID NO: 3607983 - RNA, 13 nt, Salmonella enterica enterica serovar Typhi
aucuucccaccgc

SEQ ID NO: 3607984 - RNA, 13 nt, Salmonella enterica enterica serovar Typhi
aucuucccgcaga

SEQ ID NO: 3607985 - RNA, 12 nt, Salmonella enterica enterica serovar Typhi
aucuuccgccac

SEQ ID NO: 3607986 - RNA, 21 nt, Salmonella enterica enterica serovar Typhi
aucuuccucacagccuugcca

SEQ ID NO: 3607987 - RNA, 13 nt, Salmonella enterica enterica serovar Typhi
aucuucgauaaga

SEQ ID NO: 3607988 - RNA, 22 nt, Salmonella enterica enterica serovar Typhi
aucuucgcaguagauucuaucu

SEQ ID NO: 3607989 - RNA, 21 nt, Salmonella enterica enterica serovar Typhi
aucuucgccguauucuuaccc

SEQ ID NO: 3607990 - RNA, 21 nt, Salmonella enterica enterica serovar Typhi
aucuucgccguguucuuaccc

SEQ ID NO: 3607991 - RNA, 22 nt, Salmonella enterica enterica serovar Typhi
aucuucggcgggaucuccagaa

SEQ ID NO: 3607992 - RNA, 15 nt, Salmonella enterica enterica serovar Typhi
aucuucuacaaugcg

SEQ ID NO: 3607993 - RNA, 18 nt, Salmonella enterica enterica serovar Typhi
aucuucuacaaugcggua

SEQ ID NO: 3607994 - RNA, 19 nt, Salmonella enterica enterica serovar Typhi
aucuucuacaugcccuucu

SEQ ID NO: 3607995 - RNA, 13 nt, Salmonella enterica enterica serovar Typhi
aucuucugcugcu

SEQ ID NO: 3607996 - RNA, 17 nt, Salmonella enterica enterica serovar Typhi
aucuucugcugcucccu

SEQ ID NO: 3607997 - RNA, 11 nt, Salmonella enterica enterica serovar Typhi
aucuucuuccg

SEQ ID NO: 3607998 - RNA, 17 nt, Salmonella enterica enterica serovar Typhi
aucuugaaugauuuugu

SEQ ID NO: 3607999 - RNA, 17 nt, Salmonella enterica enterica serovar Typhi
aucuugauaucaucauc

SEQ ID NO: 3608000 - RNA, 14 nt, Salmonella enterica enterica serovar Typhi
aucuugcguuaugu

SEQ ID NO: 3608001 - RNA, 17 nt, Salmonella enterica enterica serovar Typhi
aucuugcuuuauuuuua

SEQ ID NO: 3608002 - RNA, 12 nt, Salmonella enterica enterica serovar Typhi
aucuugggaaua

SEQ ID NO: 3608003 - RNA, 16 nt, Salmonella enterica enterica serovar Typhi
aucuuguccucaucau

SEQ ID NO: 3608004 - RNA, 14 nt, Salmonella enterica enterica serovar Typhi
aucuugugaguaau

SEQ ID NO: 3608005 - RNA, 17 nt, Salmonella enterica enterica serovar Typhi
aucuuuaccaaugugca

SEQ ID NO: 3608006 - RNA, 20 nt, Salmonella enterica enterica serovar Typhi
aucuuuaugucaguaauaua

SEQ ID NO: 3608007 - RNA, 18 nt, Salmonella enterica enterica serovar Typhi
aucuuucagcgccggaaa

SEQ ID NO: 3608008 - RNA, 14 nt, Salmonella enterica enterica serovar Typhi
aucuuucuccuggu

SEQ ID NO: 3608009 - RNA, 23 nt, Salmonella enterica enterica serovar Typhi
aucuuucuccugguuuuuccauu

SEQ ID NO: 3608010 - RNA, 12 nt, Salmonella enterica enterica serovar Typhi
aucuuucuuuuu

SEQ ID NO: 3608011 - RNA, 16 nt, Salmonella enterica enterica serovar Typhi
aucuuugagcagauaa

SEQ ID NO: 3608012 - RNA, 16 nt, Salmonella enterica enterica serovar Typhi
aucuuugccacgucga

SEQ ID NO: 3608013 - RNA, 14 nt, Salmonella enterica enterica serovar Typhi
aucuuugccgcaaa

SEQ ID NO: 3608014 - RNA, 14 nt, Salmonella enterica enterica serovar Typhi
aucuuuguucuguu

SEQ ID NO: 3608015 - RNA, 19 nt, Salmonella enterica enterica serovar Typhi
aucuuuuaaaaucagauug

SEQ ID NO: 3608016 - RNA, 18 nt, Salmonella enterica enterica serovar Typhi
aucuuuugcgccuuccag

SEQ ID NO: 3608017 - RNA, 11 nt, Salmonella enterica enterica serovar Typhi
aucuuuuuccc

SEQ ID NO: 3608018 - RNA, 15 nt, Salmonella enterica enterica serovar Typhi
aucuuuuugcuccug

SEQ ID NO: 3608019 - RNA, 10 nt, Salmonella enterica enterica serovar Typhi
augaaaaaaa

SEQ ID NO: 3608020 - RNA, 17 nt, Salmonella enterica enterica serovar Typhi
augaaaaaaguuauuuu

SEQ ID NO: 3608021 - RNA, 15 nt, Salmonella enterica enterica serovar Typhi
augaaaaaucggcaa

SEQ ID NO: 3608022 - RNA, 12 nt, Salmonella enterica enterica serovar Typhi
augaaaacucgg

SEQ ID NO: 3608023 - RNA, 20 nt, Salmonella enterica enterica serovar Typhi
augaaaauaauuuuuaucau

SEQ ID NO: 3608024 - RNA, 20 nt, Salmonella enterica enterica serovar Typhi
augaaacauauauauccgcu

SEQ ID NO: 3608025 - RNA, 13 nt, Salmonella enterica enterica serovar Typhi
augaaaccccaaa

SEQ ID NO: 3608026 - RNA, 23 nt, Salmonella enterica enterica serovar Typhi
augaaacgguuaaaaacagccag

SEQ ID NO: 3608027 - RNA, 19 nt, Salmonella enterica enterica serovar Typhi
augaaaugagaccaauaag

SEQ ID NO: 3608028 - RNA, 21 nt, Salmonella enterica enterica serovar Typhi
augaaauucuugcccgcugag

SEQ ID NO: 3608029 - RNA, 22 nt, Salmonella enterica enterica serovar Typhi
augaacaugacgccgaaauaaa

SEQ ID NO: 3608030 - RNA, 19 nt, Salmonella enterica enterica serovar Typhi
augaacccucgaaugugaa

SEQ ID NO: 3608031 - RNA, 11 nt, Salmonella enterica enterica serovar Typhi
augaaccggga

SEQ ID NO: 3608032 - RNA, 16 nt, Salmonella enterica enterica serovar Typhi
augaacguuaucggca

SEQ ID NO: 3608033 - RNA, 22 nt, Salmonella enterica enterica serovar Typhi
augaacguuuugugucaaaaag

SEQ ID NO: 3608034 - RNA, 15 nt, Salmonella enterica enterica serovar Typhi
augaacucaauccau

SEQ ID NO: 3608035 - RNA, 20 nt, Salmonella enterica enterica serovar Typhi
augaacucuaugcaaaagaa

SEQ ID NO: 3608036 - RNA, 21 nt, Salmonella enterica enterica serovar Typhi
augaacucuaugcaaaagaaa

SEQ ID NO: 3608037 - RNA, 16 nt, Salmonella enterica enterica serovar Typhi
augaacugcaucagaa

SEQ ID NO: 3608038 - RNA, 20 nt, Salmonella enterica enterica serovar Typhi
augaacuuacacuuaccuga

SEQ ID NO: 3608039 - RNA, 14 nt, Salmonella enterica enterica serovar Typhi
augaagaaaauacu

SEQ ID NO: 3608040 - RNA, 23 nt, Salmonella enterica enterica serovar Typhi
augaagacguucuaucagguauc

SEQ ID NO: 3608041 - RNA, 15 nt, Salmonella enterica enterica serovar Typhi
augaagcauaaaaag

SEQ ID NO: 3608042 - RNA, 23 nt, Salmonella enterica enterica serovar Typhi
augaagcugcagggauaugcuga

SEQ ID NO: 3608043 - RNA, 18 nt, Salmonella enterica enterica serovar Typhi
augaagcuggagccacau

SEQ ID NO: 3608044 - RNA, 21 nt, Salmonella enterica enterica serovar Typhi
augaaggguauauaaaucaaa

SEQ ID NO: 3608045 - RNA, 14 nt, Salmonella enterica enterica serovar Typhi
augaugaaaaagaa

SEQ ID NO: 3608046 - RNA, 19 nt, Salmonella enterica enterica serovar Typhi
augaugagauacgucauca

SEQ ID NO: 3608047 - RNA, 21 nt, Salmonella enterica enterica serovar Typhi
augaugagaugcaggccaagc

SEQ ID NO: 3608048 - RNA, 15 nt, Salmonella enterica enterica serovar Typhi
augaugagcgccaua

SEQ ID NO: 3608049 - RNA, 15 nt, Salmonella enterica enterica serovar Typhi
augaugauugccgga

SEQ ID NO: 3608050 - RNA, 16 nt, Salmonella enterica enterica serovar Typhi
augaugcauuugauuu

SEQ ID NO: 3608051 - RNA, 18 nt, Salmonella enterica enterica serovar Typhi
augaugccaggaccaggu

SEQ ID NO: 3608052 - RNA, 17 nt, Salmonella enterica enterica serovar Typhi
augaugcgcuguaaaug

SEQ ID NO: 3608053 - RNA, 23 nt, Salmonella enterica enterica serovar Typhi
augaugggcgcacagcgccauga

SEQ ID NO: 3608054 - RNA, 17 nt, Salmonella enterica enterica serovar Typhi
augauggggucacaggu

SEQ ID NO: 3608055 - RNA, 20 nt, Salmonella enterica enterica serovar Typhi
augauggggucacagguucg

SEQ ID NO: 3608056 - RNA, 14 nt, Salmonella enterica enterica serovar Typhi
augauggugagagc

SEQ ID NO: 3608057 - RNA, 23 nt, Salmonella enterica enterica serovar Typhi
augauguccgccuugaggcguuu

SEQ ID NO: 3608058 - RNA, 20 nt, Salmonella enterica enterica serovar Typhi
augauguucauccauauauc

SEQ ID NO: 3608059 - RNA, 14 nt, Salmonella enterica enterica serovar Typhi
augauuaaaauaaa

SEQ ID NO: 3608060 - RNA, 15 nt, Salmonella enterica enterica serovar Typhi
augauuaaaauaaau

SEQ ID NO: 3608061 - RNA, 15 nt, Salmonella enterica enterica serovar Typhi
augauuaauuguacc

SEQ ID NO: 3608062 - RNA, 15 nt, Salmonella enterica enterica serovar Typhi
augauuacggaacaa

SEQ ID NO: 3608063 - RNA, 15 nt, Salmonella enterica enterica serovar Typhi
augauuauuguuaaa

SEQ ID NO: 3608064 - RNA, 17 nt, Salmonella enterica enterica serovar Typhi
augauucaaucggcgau

SEQ ID NO: 3608065 - RNA, 15 nt, Salmonella enterica enterica serovar Typhi
augauugagcguuuc

SEQ ID NO: 3608066 - RNA, 24 nt, Salmonella enterica enterica serovar Typhi
augauugcuggcagaugaacauaa

SEQ ID NO: 3608067 - RNA, 13 nt, Salmonella enterica enterica serovar Typhi
augauuuaaaaaa

SEQ ID NO: 3608068 - RNA, 21 nt, Salmonella enterica enterica serovar Typhi
augauuugcaaccgcucuuuu

SEQ ID NO: 3608069 - RNA, 13 nt, Salmonella enterica enterica serovar Typhi
augcaaaagaaaa

SEQ ID NO: 3608070 - RNA, 15 nt, Salmonella enterica enterica serovar Typhi
augcaaaagaaaaaa

SEQ ID NO: 3608071 - RNA, 16 nt, Salmonella enterica enterica serovar Typhi
augcaaaagaaaaaac

SEQ ID NO: 3608072 - RNA, 14 nt, Salmonella enterica enterica serovar Typhi
augcaaccccugac

SEQ ID NO: 3608073 - RNA, 23 nt, Salmonella enterica enterica serovar Typhi
augcaaucucuuccgcccagaua

SEQ ID NO: 3608074 - RNA, 19 nt, Salmonella enterica enterica serovar Typhi
augcaauuccgcuuucuuc

SEQ ID NO: 3608075 - RNA, 19 nt, Salmonella enterica enterica serovar Typhi
augcacaauacgccgagca

SEQ ID NO: 3608076 - RNA, 13 nt, Salmonella enterica enterica serovar Typhi
augcacacgcagc

SEQ ID NO: 3608077 - RNA, 16 nt, Salmonella enterica enterica serovar Typhi
augcaccagucccagc

SEQ ID NO: 3608078 - RNA, 15 nt, Salmonella enterica enterica serovar Typhi
augcaccucgccaaa

SEQ ID NO: 3608079 - RNA, 16 nt, Salmonella enterica enterica serovar Typhi
augcaccucuuuaugc

SEQ ID NO: 3608080 - RNA, 18 nt, Salmonella enterica enterica serovar Typhi
augcacgcgcggcgccag

SEQ ID NO: 3608081 - RNA, 20 nt, Salmonella enterica enterica serovar Typhi
augcacgcuuuuuugcuggc

SEQ ID NO: 3608082 - RNA, 17 nt, Salmonella enterica enterica serovar Typhi
augcacuacgaaaagag

SEQ ID NO: 3608083 - RNA, 18 nt, Salmonella enterica enterica serovar Typhi
augcacugcaauuucugc

SEQ ID NO: 3608084 - RNA, 14 nt, Salmonella enterica enterica serovar Typhi
augcagaccucugc

SEQ ID NO: 3608085 - RNA, 23 nt, Salmonella enterica enterica serovar Typhi
augcagcaccagauauuuuuccg

SEQ ID NO: 3608086 - RNA, 12 nt, Salmonella enterica enterica serovar Typhi
augcagcagcca

SEQ ID NO: 3608087 - RNA, 13 nt, Salmonella enterica enterica serovar Typhi
augcagcagccag

SEQ ID NO: 3608088 - RNA, 23 nt, Salmonella enterica enterica serovar Typhi
augcagcaucaugucacccacgc

SEQ ID NO: 3608089 - RNA, 13 nt, Salmonella enterica enterica serovar Typhi
augcagccaggcc

SEQ ID NO: 3608090 - RNA, 18 nt, Salmonella enterica enterica serovar Typhi
augcaggcauaaaaaaga

SEQ ID NO: 3608091 - RNA, 20 nt, Salmonella enterica enterica serovar Typhi
augcaggccaagcagcgcca

SEQ ID NO: 3608092 - RNA, 13 nt, Salmonella enterica enterica serovar Typhi
augcaguucauca

SEQ ID NO: 3608093 - RNA, 17 nt, Salmonella enterica enterica serovar Typhi
augcaguucaucauccu

SEQ ID NO: 3608094 - RNA, 23 nt, Salmonella enterica enterica serovar Typhi
augcaguucuucgccguuaucgg

SEQ ID NO: 3608095 - RNA, 13 nt, Salmonella enterica enterica serovar Typhi
augcauaaaaaaa

SEQ ID NO: 3608096 - RNA, 14 nt, Salmonella enterica enterica serovar Typhi
augcauaaaaaaac

SEQ ID NO: 3608097 - RNA, 15 nt, Salmonella enterica enterica serovar Typhi
augcauaaaaaaacg

SEQ ID NO: 3608098 - RNA, 13 nt, Salmonella enterica enterica serovar Typhi
augcauaaucgcc

SEQ ID NO: 3608099 - RNA, 14 nt, Salmonella enterica enterica serovar Typhi
augcauaaugcagc

SEQ ID NO: 3608100 - RNA, 15 nt, Salmonella enterica enterica serovar Typhi
augcauaugaaugau

SEQ ID NO: 3608101 - RNA, 15 nt, Salmonella enterica enterica serovar Typhi
augcauaugcacagc

SEQ ID NO: 3608102 - RNA, 19 nt, Salmonella enterica enterica serovar Typhi
augcauaugcacagcgcua

SEQ ID NO: 3608103 - RNA, 12 nt, Salmonella enterica enterica serovar Typhi
augcauuugauu

SEQ ID NO: 3608104 - RNA, 14 nt, Salmonella enterica enterica serovar Typhi
augcauuugauuug

SEQ ID NO: 3608105 - RNA, 18 nt, Salmonella enterica enterica serovar Typhi
augccaaacaucgcucgc

SEQ ID NO: 3608106 - RNA, 14 nt, Salmonella enterica enterica serovar Typhi
augccaagcggcau

SEQ ID NO: 3608107 - RNA, 21 nt, Salmonella enterica enterica serovar Typhi
augccaaguaauaaagagaac

SEQ ID NO: 3608108 - RNA, 20 nt, Salmonella enterica enterica serovar Typhi
augccacaacagaagcggcc

SEQ ID NO: 3608109 - RNA, 21 nt, Salmonella enterica enterica serovar Typhi
augccacacccugagcgccgc

SEQ ID NO: 3608110 - RNA, 14 nt, Salmonella enterica enterica serovar Typhi
augccaccagcgcc

SEQ ID NO: 3608111 - RNA, 21 nt, Salmonella enterica enterica serovar Typhi
augccacgccccuaaggcagc

SEQ ID NO: 3608112 - RNA, 16 nt, Salmonella enterica enterica serovar Typhi
augccacggcugaggc

SEQ ID NO: 3608113 - RNA, 16 nt, Salmonella enterica enterica serovar Typhi
augccacuauagauga

SEQ ID NO: 3608114 - RNA, 23 nt, Salmonella enterica enterica serovar Typhi
augccacugcccucaaguuaugu

SEQ ID NO: 3608115 - RNA, 13 nt, Salmonella enterica enterica serovar Typhi
augccagauauuu

SEQ ID NO: 3608116 - RNA, 20 nt, Salmonella enterica enterica serovar Typhi
augccauaaucgauauaauu

SEQ ID NO: 3608117 - RNA, 12 nt, Salmonella enterica enterica serovar Typhi
augcccaaaaua

SEQ ID NO: 3608118 - RNA, 18 nt, Salmonella enterica enterica serovar Typhi
augcccaauagcgcugag

SEQ ID NO: 3608119 - RNA, 22 nt, Salmonella enterica enterica serovar Typhi
augcccaccgcgcgcgcggcau

SEQ ID NO: 3608120 - RNA, 17 nt, Salmonella enterica enterica serovar Typhi
augcccagcgccgucau

SEQ ID NO: 3608121 - RNA, 14 nt, Salmonella enterica enterica serovar Typhi
augcccauaaagaa

SEQ ID NO: 3608122 - RNA, 15 nt, Salmonella enterica enterica serovar Typhi
augcccauaaagaaa

SEQ ID NO: 3608123 - RNA, 17 nt, Salmonella enterica enterica serovar Typhi
augcccccgcgcaggcg

SEQ ID NO: 3608124 - RNA, 17 nt, Salmonella enterica enterica serovar Typhi
augccccgacaucagau

SEQ ID NO: 3608125 - RNA, 17 nt, Salmonella enterica enterica serovar Typhi
augcccgauggcgcugc

SEQ ID NO: 3608126 - RNA, 22 nt, Salmonella enterica enterica serovar Typhi
augcccgcgagagauuaagcga

SEQ ID NO: 3608127 - RNA, 23 nt, Salmonella enterica enterica serovar Typhi
augcccggaugauuaucaucuau

SEQ ID NO: 3608128 - RNA, 19 nt, Salmonella enterica enterica serovar Typhi
augcccgguaagaaugcgc

SEQ ID NO: 3608129 - RNA, 12 nt, Salmonella enterica enterica serovar Typhi
augccgaccaau

SEQ ID NO: 3608130 - RNA, 23 nt, Salmonella enterica enterica serovar Typhi
augccgauaauaaacgcgccaag

SEQ ID NO: 3608131 - RNA, 17 nt, Salmonella enterica enterica serovar Typhi
augcuauccgccgccag

SEQ ID NO: 3608132 - RNA, 19 nt, Salmonella enterica enterica serovar Typhi
augcuaucgcggauaagcc

SEQ ID NO: 3608133 - RNA, 22 nt, Salmonella enterica enterica serovar Typhi
augcuaucgguaguguuaucgc

SEQ ID NO: 3608134 - RNA, 23 nt, Salmonella enterica enterica serovar Typhi
augcuaucgguaguguuaucgcc

SEQ ID NO: 3608135 - RNA, 14 nt, Salmonella enterica enterica serovar Typhi
augcuauucagcag

SEQ ID NO: 3608136 - RNA, 12 nt, Salmonella enterica enterica serovar Typhi
augcucaaccag

SEQ ID NO: 3608137 - RNA, 17 nt, Salmonella enterica enterica serovar Typhi
augcucauuuugauaaa

SEQ ID NO: 3608138 - RNA, 17 nt, Salmonella enterica enterica serovar Typhi
augcuccaauaaauauu

SEQ ID NO: 3608139 - RNA, 22 nt, Salmonella enterica enterica serovar Typhi
augcucgccgucggcagacugg

SEQ ID NO: 3608140 - RNA, 21 nt, Salmonella enterica enterica serovar Typhi
augcucuccuggcauggcucg

SEQ ID NO: 3608141 - RNA, 20 nt, Salmonella enterica enterica serovar Typhi
augcucugcugugccaguac

SEQ ID NO: 3608142 - RNA, 13 nt, Salmonella enterica enterica serovar Typhi
augcugaauagcc

SEQ ID NO: 3608143 - RNA, 15 nt, Salmonella enterica enterica serovar Typhi
augcugaauagccag

SEQ ID NO: 3608144 - RNA, 20 nt, Salmonella enterica enterica serovar Typhi
augcugaauagccagccccc

SEQ ID NO: 3608145 - RNA, 19 nt, Salmonella enterica enterica serovar Typhi
augcugacgcguuuuuuca

SEQ ID NO: 3608146 - RNA, 15 nt, Salmonella enterica enterica serovar Typhi
augcugauacaaagc

SEQ ID NO: 3608147 - RNA, 21 nt, Salmonella enterica enterica serovar Typhi
augcugauuaaugauuugcuu

SEQ ID NO: 3608148 - RNA, 16 nt, Salmonella enterica enterica serovar Typhi
augcugcaucuuacug

SEQ ID NO: 3608149 - RNA, 15 nt, Salmonella enterica enterica serovar Typhi
augcugcucgaagau

SEQ ID NO: 3608150 - RNA, 12 nt, Salmonella enterica enterica serovar Typhi
augcuggugcau

SEQ ID NO: 3608151 - RNA, 21 nt, Salmonella enterica enterica serovar Typhi
augcugucgccggaaaaaaug

SEQ ID NO: 3608152 - RNA, 21 nt, Salmonella enterica enterica serovar Typhi
augcugugugaccagcaguuc

SEQ ID NO: 3608153 - RNA, 23 nt, Salmonella enterica enterica serovar Typhi
augcuguuaccguaagcgggaug

SEQ ID NO: 3608154 - RNA, 22 nt, Salmonella enterica enterica serovar Typhi
augcuuccagccguuuaaucuc

SEQ ID NO: 3608155 - RNA, 20 nt, Salmonella enterica enterica serovar Typhi
augcuugcuuugcggcauaa

SEQ ID NO: 3608156 - RNA, 14 nt, Salmonella enterica enterica serovar Typhi
augcuuuaaaugcc

SEQ ID NO: 3608157 - RNA, 15 nt, Salmonella enterica enterica serovar Typhi
augcuuuaaaugccu

SEQ ID NO: 3608158 - RNA, 17 nt, Salmonella enterica enterica serovar Typhi
augcuuuaaaugccugu

SEQ ID NO: 3608159 - RNA, 17 nt, Salmonella enterica enterica serovar Typhi
augcuuucaauacucca

SEQ ID NO: 3608160 - RNA, 18 nt, Salmonella enterica enterica serovar Typhi
augcuuucgcgauaauca

SEQ ID NO: 3608161 - RNA, 21 nt, Salmonella enterica enterica serovar Typhi
augcuuucgcgauaaucaacu

SEQ ID NO: 3608162 - RNA, 15 nt, Salmonella enterica enterica serovar Typhi
auggaaaauaauaau

SEQ ID NO: 3608163 - RNA, 22 nt, Salmonella enterica enterica serovar Typhi
auggaacucugcgacgccaggc

SEQ ID NO: 3608164 - RNA, 15 nt, Salmonella enterica enterica serovar Typhi
auggacaaaaaagga

SEQ ID NO: 3608165 - RNA, 18 nt, Salmonella enterica enterica serovar Typhi
auggacaccggaagugaa

SEQ ID NO: 3608166 - RNA, 17 nt, Salmonella enterica enterica serovar Typhi
auggacgggauacggcg

SEQ ID NO: 3608167 - RNA, 23 nt, Salmonella enterica enterica serovar Typhi
auggacgggauacggcgagacca

SEQ ID NO: 3608168 - RNA, 13 nt, Salmonella enterica enterica serovar Typhi
auggacuuccgca

SEQ ID NO: 3608169 - RNA, 14 nt, Salmonella enterica enterica serovar Typhi
auggagaugaaaau

SEQ ID NO: 3608170 - RNA, 16 nt, Salmonella enterica enterica serovar Typhi
auggauaacauguggc

SEQ ID NO: 3608171 - RNA, 18 nt, Salmonella enterica enterica serovar Typhi
auggauaacgaaaagggu

SEQ ID NO: 3608172 - RNA, 16 nt, Salmonella enterica enterica serovar Typhi
auggauagucaugaaa

SEQ ID NO: 3608173 - RNA, 23 nt, Salmonella enterica enterica serovar Typhi
auggaugagucuugcgcguccgc

SEQ ID NO: 3608174 - RNA, 18 nt, Salmonella enterica enterica serovar Typhi
auggcaaaaacagccggu

SEQ ID NO: 3608175 - RNA, 21 nt, Salmonella enterica enterica serovar Typhi
auggcaaaagacauccccgcc

SEQ ID NO: 3608176 - RNA, 21 nt, Salmonella enterica enterica serovar Typhi
auggcaaagucgaacgacuga

SEQ ID NO: 3608177 - RNA, 17 nt, Salmonella enterica enterica serovar Typhi
auggcacaucaggcaaa

SEQ ID NO: 3608178 - RNA, 11 nt, Salmonella enterica enterica serovar Typhi
auggcacugcg

SEQ ID NO: 3608179 - RNA, 14 nt, Salmonella enterica enterica serovar Typhi
auggcauaacgcug

SEQ ID NO: 3608180 - RNA, 16 nt, Salmonella enterica enterica serovar Typhi
auggccagcaccagca

SEQ ID NO: 3608181 - RNA, 12 nt, Salmonella enterica enterica serovar Typhi
auggccagcccc

SEQ ID NO: 3608182 - RNA, 16 nt, Salmonella enterica enterica serovar Typhi
auggcccaaaagguag

SEQ ID NO: 3608183 - RNA, 14 nt, Salmonella enterica enterica serovar Typhi
auggccgcagcgcc

SEQ ID NO: 3608184 - RNA, 13 nt, Salmonella enterica enterica serovar Typhi
auggccuggagcg

SEQ ID NO: 3608185 - RNA, 21 nt, Salmonella enterica enterica serovar Typhi
auggccuggcggaugaugcgu

SEQ ID NO: 3608186 - RNA, 20 nt, Salmonella enterica enterica serovar Typhi
auggccuucaaucagcacgc

SEQ ID NO: 3608187 - RNA, 18 nt, Salmonella enterica enterica serovar Typhi
auggcgacgacgcuguuu

SEQ ID NO: 3608188 - RNA, 18 nt, Salmonella enterica enterica serovar Typhi
auggcgacgaucagcgcc

SEQ ID NO: 3608189 - RNA, 13 nt, Salmonella enterica enterica serovar Typhi
auggcgaucagcg

SEQ ID NO: 3608190 - RNA, 15 nt, Salmonella enterica enterica serovar Typhi
auggcgaucagcgcc

SEQ ID NO: 3608191 - RNA, 14 nt, Salmonella enterica enterica serovar Typhi
auggcgauuaacgc

SEQ ID NO: 3608192 - RNA, 20 nt, Salmonella enterica enterica serovar Typhi
auggcgcuacgcuuauccgg

SEQ ID NO: 3608193 - RNA, 16 nt, Salmonella enterica enterica serovar Typhi
auggcgcucuuuucca

SEQ ID NO: 3608194 - RNA, 22 nt, Salmonella enterica enterica serovar Typhi
auggcgcugucggcgcccagcu

SEQ ID NO: 3608195 - RNA, 19 nt, Salmonella enterica enterica serovar Typhi
auggcggauuccaguagcg

SEQ ID NO: 3608196 - RNA, 22 nt, Salmonella enterica enterica serovar Typhi
auggcggauuccaguagcgcgc

SEQ ID NO: 3608197 - RNA, 24 nt, Salmonella enterica enterica serovar Typhi
auggcggcgaaaugccuuauccgg

SEQ ID NO: 3608198 - RNA, 21 nt, Salmonella enterica enterica serovar Typhi
auggcggcgucgccuguccgg

SEQ ID NO: 3608199 - RNA, 19 nt, Salmonella enterica enterica serovar Typhi
auggcggcuaacgccugau

SEQ ID NO: 3608200 - RNA, 16 nt, Salmonella enterica enterica serovar Typhi
auggcggcugcgccuu

SEQ ID NO: 3608201 - RNA, 21 nt, Salmonella enterica enterica serovar Typhi
auggcggcuuggcuguagaua

SEQ ID NO: 3608202 - RNA, 22 nt, Salmonella enterica enterica serovar Typhi
auggcgggcgcagguuuuacuu

SEQ ID NO: 3608203 - RNA, 20 nt, Salmonella enterica enterica serovar Typhi
auggcgguauaacugccuua

SEQ ID NO: 3608204 - RNA, 19 nt, Salmonella enterica enterica serovar Typhi
auggcggucaacgcggcua

SEQ ID NO: 3608205 - RNA, 20 nt, Salmonella enterica enterica serovar Typhi
auggcggucgccauauguuc

SEQ ID NO: 3608206 - RNA, 20 nt, Salmonella enterica enterica serovar Typhi
auggcggugcuuaaccggga

SEQ ID NO: 3608207 - RNA, 16 nt, Salmonella enterica enterica serovar Typhi
auggcucagauugaac

SEQ ID NO: 3608208 - RNA, 17 nt, Salmonella enterica enterica serovar Typhi
auggcugagaaucaccu

SEQ ID NO: 3608209 - RNA, 18 nt, Salmonella enterica enterica serovar Typhi
auggcugauggcgaaaau

SEQ ID NO: 3608210 - RNA, 22 nt, Salmonella enterica enterica serovar Typhi
auggcugcacccggagagaaac

SEQ ID NO: 3608211 - RNA, 23 nt, Salmonella enterica enterica serovar Typhi
auggcugcgauaaugaagcauaa

SEQ ID NO: 3608212 - RNA, 17 nt, Salmonella enterica enterica serovar Typhi
augggaggauacuguuu

SEQ ID NO: 3608213 - RNA, 19 nt, Salmonella enterica enterica serovar Typhi
augggauaacgcagaagac

SEQ ID NO: 3608214 - RNA, 18 nt, Salmonella enterica enterica serovar Typhi
augggauacgccagcaga

SEQ ID NO: 3608215 - RNA, 20 nt, Salmonella enterica enterica serovar Typhi
augggauagugccugccguc

SEQ ID NO: 3608216 - RNA, 15 nt, Salmonella enterica enterica serovar Typhi
augugacaaucacuc

SEQ ID NO: 3608217 - RNA, 22 nt, Salmonella enterica enterica serovar Typhi
augugagcaucggcgauuaagu

SEQ ID NO: 3608218 - RNA, 14 nt, Salmonella enterica enterica serovar Typhi
augugagcgcaucc

SEQ ID NO: 3608219 - RNA, 19 nt, Salmonella enterica enterica serovar Typhi
augugaugccgucaguuau

SEQ ID NO: 3608220 - RNA, 21 nt, Salmonella enterica enterica serovar Typhi
augugcaaucacacuacacga

SEQ ID NO: 3608221 - RNA, 17 nt, Salmonella enterica enterica serovar Typhi
augugccacuccgccag

SEQ ID NO: 3608222 - RNA, 13 nt, Salmonella enterica enterica serovar Typhi
augugcgccagcc

SEQ ID NO: 3608223 - RNA, 14 nt, Salmonella enterica enterica serovar Typhi
augugcgccagccu

SEQ ID NO: 3608224 - RNA, 23 nt, Salmonella enterica enterica serovar Typhi
augugcggagaagacgccgccgc

SEQ ID NO: 3608225 - RNA, 16 nt, Salmonella enterica enterica serovar Typhi
augugcuuucaucgcc

SEQ ID NO: 3608226 - RNA, 20 nt, Salmonella enterica enterica serovar Typhi
augugguaaccgaacugggu

SEQ ID NO: 3608227 - RNA, 21 nt, Salmonella enterica enterica serovar Typhi
auguguaauguuuucugccag

SEQ ID NO: 3608228 - RNA, 22 nt, Salmonella enterica enterica serovar Typhi
augugucuauuuauugaagaug

SEQ ID NO: 3608229 - RNA, 14 nt, Salmonella enterica enterica serovar Typhi
auguguuucagcag

SEQ ID NO: 3608230 - RNA, 22 nt, Salmonella enterica enterica serovar Typhi
auguuaaauacgccgccagcaa

SEQ ID NO: 3608231 - RNA, 17 nt, Salmonella enterica enterica serovar Typhi
auguuaacuacuuuaca

SEQ ID NO: 3608232 - RNA, 22 nt, Salmonella enterica enterica serovar Typhi
auguuaauaccagcgccaauca

SEQ ID NO: 3608233 - RNA, 16 nt, Salmonella enterica enterica serovar Typhi
auguuagaaucuauua

SEQ ID NO: 3608234 - RNA, 18 nt, Salmonella enterica enterica serovar Typhi
auguuagcauuauuuuua

SEQ ID NO: 3608235 - RNA, 17 nt, Salmonella enterica enterica serovar Typhi
auguuagcuucacuucg

SEQ ID NO: 3608236 - RNA, 16 nt, Salmonella enterica enterica serovar Typhi
auguuaggguagaaaa

SEQ ID NO: 3608237 - RNA, 17 nt, Salmonella enterica enterica serovar Typhi
auguucaauaucaaauu

SEQ ID NO: 3608238 - RNA, 19 nt, Salmonella enterica enterica serovar Typhi
auguucaguaggacaaaaa

SEQ ID NO: 3608239 - RNA, 17 nt, Salmonella enterica enterica serovar Typhi
auguucauaccggauau

SEQ ID NO: 3608240 - RNA, 19 nt, Salmonella enterica enterica serovar Typhi
auguucaugaaccacgcca

SEQ ID NO: 3608241 - RNA, 18 nt, Salmonella enterica enterica serovar Typhi
auguuccuggauagauuu

SEQ ID NO: 3608242 - RNA, 19 nt, Salmonella enterica enterica serovar Typhi
auguucgcuucugccgcca

SEQ ID NO: 3608243 - RNA, 14 nt, Salmonella enterica enterica serovar Typhi
auguucuaacagau

SEQ ID NO: 3608244 - RNA, 15 nt, Salmonella enterica enterica serovar Typhi
auguucuaucuuuca

SEQ ID NO: 3608245 - RNA, 17 nt, Salmonella enterica enterica serovar Typhi
auguucuugccgccauc

SEQ ID NO: 3608246 - RNA, 13 nt, Salmonella enterica enterica serovar Typhi
auguucuuucgcc

SEQ ID NO: 3608247 - RNA, 14 nt, Salmonella enterica enterica serovar Typhi
auguugaaccguca

SEQ ID NO: 3608248 - RNA, 18 nt, Salmonella enterica enterica serovar Typhi
auguugauacagaaaacc

SEQ ID NO: 3608249 - RNA, 17 nt, Salmonella enterica enterica serovar Typhi
auguugccggauagcuc

SEQ ID NO: 3608250 - RNA, 13 nt, Salmonella enterica enterica serovar Typhi
auguugcugcauc

SEQ ID NO: 3608251 - RNA, 14 nt, Salmonella enterica enterica serovar Typhi
auguugcugcaucu

SEQ ID NO: 3608252 - RNA, 17 nt, Salmonella enterica enterica serovar Typhi
auguuggauuauacauu

SEQ ID NO: 3608253 - RNA, 14 nt, Salmonella enterica enterica serovar Typhi
auguuuaccaucgc

SEQ ID NO: 3608254 - RNA, 15 nt, Salmonella enterica enterica serovar Typhi
auguuugccacgcca

SEQ ID NO: 3608255 - RNA, 15 nt, Salmonella enterica enterica serovar Typhi
auguuugcugauaag

SEQ ID NO: 3608256 - RNA, 16 nt, Salmonella enterica enterica serovar Typhi
auguuuugucguucac

SEQ ID NO: 3608257 - RNA, 18 nt, Salmonella enterica enterica serovar Typhi
auguuuuuaucagcuugc

SEQ ID NO: 3608258 - RNA, 19 nt, Salmonella enterica enterica serovar Typhi
auuaaaaaaggcagaagaa

SEQ ID NO: 3608259 - RNA, 12 nt, Salmonella enterica enterica serovar Typhi
auuaaaaauacc

SEQ ID NO: 3608260 - RNA, 21 nt, Salmonella enterica enterica serovar Typhi
auuaaaaauaccccaggggca

SEQ ID NO: 3608261 - RNA, 19 nt, Salmonella enterica enterica serovar Typhi
auuaaaacgagucagcguu

SEQ ID NO: 3608262 - RNA, 17 nt, Salmonella enterica enterica serovar Typhi
auuaaaagaccccauuu

SEQ ID NO: 3608263 - RNA, 17 nt, Salmonella enterica enterica serovar Typhi
auuaaaauaaaugaggc

SEQ ID NO: 3608264 - RNA, 16 nt, Salmonella enterica enterica serovar Typhi
auuaaacuuucaugaa

SEQ ID NO: 3608265 - RNA, 12 nt, Salmonella enterica enterica serovar Typhi
auuaaagccacg

SEQ ID NO: 3608266 - RNA, 15 nt, Salmonella enterica enterica serovar Typhi
auuaaaucaucauaa

SEQ ID NO: 3608267 - RNA, 17 nt, Salmonella enterica enterica serovar Typhi
auuaaaucaucauaauc

SEQ ID NO: 3608268 - RNA, 16 nt, Salmonella enterica enterica serovar Typhi
auuaaaugcuugcuuu

SEQ ID NO: 3608269 - RNA, 13 nt, Salmonella enterica enterica serovar Typhi
auuaacaaaucau

SEQ ID NO: 3608270 - RNA, 23 nt, Salmonella enterica enterica serovar Typhi
auuaacacacaaucgguuaugcg

SEQ ID NO: 3608271 - RNA, 12 nt, Salmonella enterica enterica serovar Typhi
auuaacagcgcc

SEQ ID NO: 3608272 - RNA, 23 nt, Salmonella enterica enterica serovar Typhi
auuaacagcgcgaccaggaaacc

SEQ ID NO: 3608273 - RNA, 23 nt, Salmonella enterica enterica serovar Typhi
auuaacagcuucaugcgccgcga

SEQ ID NO: 3608274 - RNA, 19 nt, Salmonella enterica enterica serovar Typhi
auuaacagucuaucgcugc

SEQ ID NO: 3608275 - RNA, 11 nt, Salmonella enterica enterica serovar Typhi
auuaacaucag

SEQ ID NO: 3608276 - RNA, 20 nt, Salmonella enterica enterica serovar Typhi
auuaacauuuaagaaacaau

SEQ ID NO: 3608277 - RNA, 16 nt, Salmonella enterica enterica serovar Typhi
auuaacgacaaaaaua

SEQ ID NO: 3608278 - RNA, 23 nt, Salmonella enterica enterica serovar Typhi
auuaacgcagaauauuuuucuca

SEQ ID NO: 3608279 - RNA, 21 nt, Salmonella enterica enterica serovar Typhi
auuaacgccgcgaggaucugc

SEQ ID NO: 3608280 - RNA, 12 nt, Salmonella enterica enterica serovar Typhi
auuaacgcgaaa

SEQ ID NO: 3608281 - RNA, 14 nt, Salmonella enterica enterica serovar Typhi
auuaacuccggacg

SEQ ID NO: 3608282 - RNA, 17 nt, Salmonella enterica enterica serovar Typhi
auuaagcgaauccagcg

SEQ ID NO: 3608283 - RNA, 22 nt, Salmonella enterica enterica serovar Typhi
auuaagcggauuuuuucgcuuu

SEQ ID NO: 3608284 - RNA, 23 nt, Salmonella enterica enterica serovar Typhi
auuaaggcguuaucuugacauga

SEQ ID NO: 3608285 - RNA, 17 nt, Salmonella enterica enterica serovar Typhi
auuaagggacgguaaau

SEQ ID NO: 3608286 - RNA, 16 nt, Salmonella enterica enterica serovar Typhi
auuaaguuuuuuuaaa

SEQ ID NO: 3608287 - RNA, 18 nt, Salmonella enterica enterica serovar Typhi
auuaaguuuuuuuaaaaa

SEQ ID NO: 3608288 - RNA, 12 nt, Salmonella enterica enterica serovar Typhi
auuaauaaaauc

SEQ ID NO: 3608289 - RNA, 16 nt, Salmonella enterica enterica serovar Typhi
auuaauaaaauuuuug

SEQ ID NO: 3608290 - RNA, 23 nt, Salmonella enterica enterica serovar Typhi
auuaauaaccccagcugcggcau

SEQ ID NO: 3608291 - RNA, 16 nt, Salmonella enterica enterica serovar Typhi
auuaauacaucacuuu

SEQ ID NO: 3608292 - RNA, 14 nt, Salmonella enterica enterica serovar Typhi
auuaauaucagccc

SEQ ID NO: 3608293 - RNA, 19 nt, Salmonella enterica enterica serovar Typhi
auuaauaugcgcaaucacc

SEQ ID NO: 3608294 - RNA, 16 nt, Salmonella enterica enterica serovar Typhi
auuaauauuuaacaca

SEQ ID NO: 3608295 - RNA, 18 nt, Salmonella enterica enterica serovar Typhi
auuaauauuuaacacauu

SEQ ID NO: 3608296 - RNA, 21 nt, Salmonella enterica enterica serovar Typhi
auuaauccccggcgaaagaaa

SEQ ID NO: 3608297 - RNA, 16 nt, Salmonella enterica enterica serovar Typhi
auuaaucccgccaucg

SEQ ID NO: 3608298 - RNA, 12 nt, Salmonella enterica enterica serovar Typhi
auuaaucgccag

SEQ ID NO: 3608299 - RNA, 18 nt, Salmonella enterica enterica serovar Typhi
auuaaucugucgaugcgg

SEQ ID NO: 3608300 - RNA, 17 nt, Salmonella enterica enterica serovar Typhi
auuaaucuuauccagcg

SEQ ID NO: 3608301 - RNA, 15 nt, Salmonella enterica enterica serovar Typhi
auuaaugauuaaaau

SEQ ID NO: 3608302 - RNA, 16 nt, Salmonella enterica enterica serovar Typhi
auuaaugauuugcuuu

SEQ ID NO: 3608303 - RNA, 21 nt, Salmonella enterica enterica serovar Typhi
auuaaugcuccaauaaauauu

SEQ ID NO: 3608304 - RNA, 19 nt, Salmonella enterica enterica serovar Typhi
auuaauggcgcaauguccc

SEQ ID NO: 3608305 - RNA, 16 nt, Salmonella enterica enterica serovar Typhi
auuaaugucguccaug

SEQ ID NO: 3608306 - RNA, 19 nt, Salmonella enterica enterica serovar Typhi
auuaauucuuuuaacauaa

SEQ ID NO: 3608307 - RNA, 15 nt, Salmonella enterica enterica serovar Typhi
auuaauugcuuugca

SEQ ID NO: 3608308 - RNA, 17 nt, Salmonella enterica enterica serovar Typhi
auuaauuuacugauaaa

SEQ ID NO: 3608309 - RNA, 14 nt, Salmonella enterica enterica serovar Typhi
auuacaaaaauaga

SEQ ID NO: 3608310 - RNA, 16 nt, Salmonella enterica enterica serovar Typhi
auuacaaaaugugcaa

SEQ ID NO: 3608311 - RNA, 18 nt, Salmonella enterica enterica serovar Typhi
auuacaacauguccuaca

SEQ ID NO: 3608312 - RNA, 21 nt, Salmonella enterica enterica serovar Typhi
auuacaacgccugaugacgcu

SEQ ID NO: 3608313 - RNA, 23 nt, Salmonella enterica enterica serovar Typhi
auuacaacguucggucauggaua

SEQ ID NO: 3608314 - RNA, 18 nt, Salmonella enterica enterica serovar Typhi
auuacaaguaauaaaaua

SEQ ID NO: 3608315 - RNA, 23 nt, Salmonella enterica enterica serovar Typhi
auuacagacagucuggauauaaa

SEQ ID NO: 3608316 - RNA, 16 nt, Salmonella enterica enterica serovar Typhi
auuacagauauccacc

SEQ ID NO: 3608317 - RNA, 13 nt, Salmonella enterica enterica serovar Typhi
auuacagccgcga

SEQ ID NO: 3608318 - RNA, 16 nt, Salmonella enterica enterica serovar Typhi
auuacagcguguucau

SEQ ID NO: 3608319 - RNA, 18 nt, Salmonella enterica enterica serovar Typhi
auuacagguguuaaucau

SEQ ID NO: 3608320 - RNA, 20 nt, Salmonella enterica enterica serovar Typhi
auuacaugccguuaauaaug

SEQ ID NO: 3608321 - RNA, 10 nt, Salmonella enterica enterica serovar Typhi
auuaccagua

SEQ ID NO: 3608322 - RNA, 15 nt, Salmonella enterica enterica serovar Typhi
auuaccauuccucac

SEQ ID NO: 3608323 - RNA, 20 nt, Salmonella enterica enterica serovar Typhi
auuacccaacaccagacuga

SEQ ID NO: 3608324 - RNA, 15 nt, Salmonella enterica enterica serovar Typhi
auuacccaauaauga

SEQ ID NO: 3608325 - RNA, 16 nt, Salmonella enterica enterica serovar Typhi
auuaccccgugguggg

SEQ ID NO: 3608326 - RNA, 14 nt, Salmonella enterica enterica serovar Typhi
auuaccgcuauuca

SEQ ID NO: 3608327 - RNA, 20 nt, Salmonella enterica enterica serovar Typhi
auuaccgcucguuaauccaa

SEQ ID NO: 3608328 - RNA, 15 nt, Salmonella enterica enterica serovar Typhi
auuaccggacggucg

SEQ ID NO: 3608329 - RNA, 16 nt, Salmonella enterica enterica serovar Typhi
auuaccggcugccgau

SEQ ID NO: 3608330 - RNA, 23 nt, Salmonella enterica enterica serovar Typhi
auuaccgggauuuccauauuaac

SEQ ID NO: 3608331 - RNA, 18 nt, Salmonella enterica enterica serovar Typhi
auuacgacccacaaugag

SEQ ID NO: 3608332 - RNA, 22 nt, Salmonella enterica enterica serovar Typhi
auuacgacugcacccaucuuua

SEQ ID NO: 3608333 - RNA, 14 nt, Salmonella enterica enterica serovar Typhi
auuacgcaugguca

SEQ ID NO: 3608334 - RNA, 20 nt, Salmonella enterica enterica serovar Typhi
auuacgcccauuaugccgca

SEQ ID NO: 3608335 - RNA, 11 nt, Salmonella enterica enterica serovar Typhi
auuacgcgccu

SEQ ID NO: 3608336 - RNA, 15 nt, Salmonella enterica enterica serovar Typhi
auuacggguaaugau

SEQ ID NO: 3608337 - RNA, 22 nt, Salmonella enterica enterica serovar Typhi
auuacguguaguuauaaauuua

SEQ ID NO: 3608338 - RNA, 21 nt, Salmonella enterica enterica serovar Typhi
auuacguuggggauaaccaga

SEQ ID NO: 3608339 - RNA, 17 nt, Salmonella enterica enterica serovar Typhi
auuacguuuucccugag

SEQ ID NO: 3608340 - RNA, 21 nt, Salmonella enterica enterica serovar Typhi
auuacucguccuucacguuau

SEQ ID NO: 3608341 - RNA, 12 nt, Salmonella enterica enterica serovar Typhi
auuacugauaaa

SEQ ID NO: 3608342 - RNA, 14 nt, Salmonella enterica enterica serovar Typhi
auuacuuauauuua

SEQ ID NO: 3608343 - RNA, 16 nt, Salmonella enterica enterica serovar Typhi
auuacuuauauuuauu

SEQ ID NO: 3608344 - RNA, 14 nt, Salmonella enterica enterica serovar Typhi
auuagaaacccaua

SEQ ID NO: 3608345 - RNA, 18 nt, Salmonella enterica enterica serovar Typhi
auuagacaagcaguucug

SEQ ID NO: 3608346 - RNA, 18 nt, Salmonella enterica enterica serovar Typhi
auuagagccgauauccgg

SEQ ID NO: 3608347 - RNA, 21 nt, Salmonella enterica enterica serovar Typhi
auuagaggucagaauaacuca

SEQ ID NO: 3608348 - RNA, 19 nt, Salmonella enterica enterica serovar Typhi
auuagaugcgaauaagcug

SEQ ID NO: 3608349 - RNA, 21 nt, Salmonella enterica enterica serovar Typhi
auuagcaauugccauaaaaac

SEQ ID NO: 3608350 - RNA, 14 nt, Salmonella enterica enterica serovar Typhi
auuagcauccagca

SEQ ID NO: 3608351 - RNA, 19 nt, Salmonella enterica enterica serovar Typhi
auuagcauccagcacgagc

SEQ ID NO: 3608352 - RNA, 12 nt, Salmonella enterica enterica serovar Typhi
auuagccgccag

SEQ ID NO: 3608353 - RNA, 14 nt, Salmonella enterica enterica serovar Typhi
auuagccgccaucc

SEQ ID NO: 3608354 - RNA, 13 nt, Salmonella enterica enterica serovar Typhi
auuagcgccaccg

SEQ ID NO: 3608355 - RNA, 20 nt, Salmonella enterica enterica serovar Typhi
auuaggcguaaaauugccgc

SEQ ID NO: 3608356 - RNA, 19 nt, Salmonella enterica enterica serovar Typhi
auuaggcguaauuauuaca

SEQ ID NO: 3608357 - RNA, 20 nt, Salmonella enterica enterica serovar Typhi
auuaggcuuuucauucagcg

SEQ ID NO: 3608358 - RNA, 15 nt, Salmonella enterica enterica serovar Typhi
auuagggugcaguga

SEQ ID NO: 3608359 - RNA, 13 nt, Salmonella enterica enterica serovar Typhi
auuaguaauauca

SEQ ID NO: 3608360 - RNA, 14 nt, Salmonella enterica enterica serovar Typhi
auuaguaauaucag

SEQ ID NO: 3608361 - RNA, 14 nt, Salmonella enterica enterica serovar Typhi
auuagucagcaaca

SEQ ID NO: 3608362 - RNA, 20 nt, Salmonella enterica enterica serovar Typhi
auuaguucaaguuuagaaaa

SEQ ID NO: 3608363 - RNA, 17 nt, Salmonella enterica enterica serovar Typhi
auuauauugcguaaaaa

SEQ ID NO: 3608364 - RNA, 14 nt, Salmonella enterica enterica serovar Typhi
auuaucaaaaguga

SEQ ID NO: 3608365 - RNA, 15 nt, Salmonella enterica enterica serovar Typhi
auuaucaaaagugau

SEQ ID NO: 3608366 - RNA, 20 nt, Salmonella enterica enterica serovar Typhi
auuaucaauuucauauuauu

SEQ ID NO: 3608367 - RNA, 11 nt, Salmonella enterica enterica serovar Typhi
auuaucaccau

SEQ ID NO: 3608368 - RNA, 20 nt, Salmonella enterica enterica serovar Typhi
auuaucauaaugucccugcc

SEQ ID NO: 3608369 - RNA, 18 nt, Salmonella enterica enterica serovar Typhi
auuauccacaaacuccag

SEQ ID NO: 3608370 - RNA, 17 nt, Salmonella enterica enterica serovar Typhi
auuauccuuuaauuaau

SEQ ID NO: 3608371 - RNA, 16 nt, Salmonella enterica enterica serovar Typhi
auuaucguaugcagcg

SEQ ID NO: 3608372 - RNA, 18 nt, Salmonella enterica enterica serovar Typhi
auuaucuuuauugaaaag

SEQ ID NO: 3608373 - RNA, 16 nt, Salmonella enterica enterica serovar Typhi
auuaugccugucauca

SEQ ID NO: 3608374 - RNA, 18 nt, Salmonella enterica enterica serovar Typhi
auuaugccugucaucauc

SEQ ID NO: 3608375 - RNA, 16 nt, Salmonella enterica enterica serovar Typhi
auuaugcggaccgaua

SEQ ID NO: 3608376 - RNA, 21 nt, Salmonella enterica enterica serovar Typhi
auuaugcugcucgaagaugag

SEQ ID NO: 3608377 - RNA, 16 nt, Salmonella enterica enterica serovar Typhi
auuaugcuggccugca

SEQ ID NO: 3608378 - RNA, 13 nt, Salmonella enterica enterica serovar Typhi
auuauuacaauaa

SEQ ID NO: 3608379 - RNA, 22 nt, Salmonella enterica enterica serovar Typhi
auuauucaccuggauuccucca

SEQ ID NO: 3608380 - RNA, 16 nt, Salmonella enterica enterica serovar Typhi
auuauucaggccuccu

SEQ ID NO: 3608381 - RNA, 20 nt, Salmonella enterica enterica serovar Typhi
auuauucggcgacuggaaca

SEQ ID NO: 3608382 - RNA, 14 nt, Salmonella enterica enterica serovar Typhi
auuauugacauuca

SEQ ID NO: 3608383 - RNA, 15 nt, Salmonella enterica enterica serovar Typhi
auuauugcguugcuu

SEQ ID NO: 3608384 - RNA, 21 nt, Salmonella enterica enterica serovar Typhi
auuauuggcuuuguaaauauu

SEQ ID NO: 3608385 - RNA, 15 nt, Salmonella enterica enterica serovar Typhi
auuauuggucaguag

SEQ ID NO: 3608386 - RNA, 22 nt, Salmonella enterica enterica serovar Typhi
auuauugucuuuguugccuucg

SEQ ID NO: 3608387 - RNA, 14 nt, Salmonella enterica enterica serovar Typhi
auuauuguuaaaaa

SEQ ID NO: 3608388 - RNA, 15 nt, Salmonella enterica enterica serovar Typhi
auuccgcuuccagaa

SEQ ID NO: 3608389 - RNA, 22 nt, Salmonella enterica enterica serovar Typhi
auuccgcuuccagaauucguac

SEQ ID NO: 3608390 - RNA, 21 nt, Salmonella enterica enterica serovar Typhi
auuccgcuuucuucccggcag

SEQ ID NO: 3608391 - RNA, 13 nt, Salmonella enterica enterica serovar Typhi
auuccggcacaac

SEQ ID NO: 3608392 - RNA, 14 nt, Salmonella enterica enterica serovar Typhi
auuccggcacaacc

SEQ ID NO: 3608393 - RNA, 20 nt, Salmonella enterica enterica serovar Typhi
auuccggcaucguacgggca

SEQ ID NO: 3608394 - RNA, 16 nt, Salmonella enterica enterica serovar Typhi
auuccguuugcgccgg

SEQ ID NO: 3608395 - RNA, 20 nt, Salmonella enterica enterica serovar Typhi
auuccuccgccgaucagcac

SEQ ID NO: 3608396 - RNA, 17 nt, Salmonella enterica enterica serovar Typhi
auuccucgaucgccugg

SEQ ID NO: 3608397 - RNA, 18 nt, Salmonella enterica enterica serovar Typhi
auuccucgaucgccuggc

SEQ ID NO: 3608398 - RNA, 16 nt, Salmonella enterica enterica serovar Typhi
auuccugacgcacagu

SEQ ID NO: 3608399 - RNA, 14 nt, Salmonella enterica enterica serovar Typhi
auuccugacugcgc

SEQ ID NO: 3608400 - RNA, 14 nt, Salmonella enterica enterica serovar Typhi
auuccugaguuuau

SEQ ID NO: 3608401 - RNA, 14 nt, Salmonella enterica enterica serovar Typhi
auuccugcauguuu

SEQ ID NO: 3608402 - RNA, 14 nt, Salmonella enterica enterica serovar Typhi
auuccugccgccgc

SEQ ID NO: 3608403 - RNA, 20 nt, Salmonella enterica enterica serovar Typhi
auuccuggcguaugcuuuca

SEQ ID NO: 3608404 - RNA, 13 nt, Salmonella enterica enterica serovar Typhi
auuccuuaucaca

SEQ ID NO: 3608405 - RNA, 12 nt, Salmonella enterica enterica serovar Typhi
auuccuucggug

SEQ ID NO: 3608406 - RNA, 17 nt, Salmonella enterica enterica serovar Typhi
auuccuuguccgaugca

SEQ ID NO: 3608407 - RNA, 20 nt, Salmonella enterica enterica serovar Typhi
auuccuuuuuccgccaccug

SEQ ID NO: 3608408 - RNA, 21 nt, Salmonella enterica enterica serovar Typhi
auuccuuuuuccgccaccugu

SEQ ID NO: 3608409 - RNA, 14 nt, Salmonella enterica enterica serovar Typhi
auucgacaguuccc

SEQ ID NO: 3608410 - RNA, 19 nt, Salmonella enterica enterica serovar Typhi
auucgacaguucccggcaa

SEQ ID NO: 3608411 - RNA, 22 nt, Salmonella enterica enterica serovar Typhi
auucgacaguucccggcaacag

SEQ ID NO: 3608412 - RNA, 18 nt, Salmonella enterica enterica serovar Typhi
auucgaucuguguacuuu

SEQ ID NO: 3608413 - RNA, 19 nt, Salmonella enterica enterica serovar Typhi
auucgcagcagacguucgc

SEQ ID NO: 3608414 - RNA, 18 nt, Salmonella enterica enterica serovar Typhi
auucgccaguaaggggau

SEQ ID NO: 3608415 - RNA, 18 nt, Salmonella enterica enterica serovar Typhi
auucgccccacacggcca

SEQ ID NO: 3608416 - RNA, 15 nt, Salmonella enterica enterica serovar Typhi
auucgccguucuguu

SEQ ID NO: 3608417 - RNA, 20 nt, Salmonella enterica enterica serovar Typhi
auucgccuuucacgcguuca

SEQ ID NO: 3608418 - RNA, 20 nt, Salmonella enterica enterica serovar Typhi
auucgcgcuaaaugacaaau

SEQ ID NO: 3608419 - RNA, 23 nt, Salmonella enterica enterica serovar Typhi
auucgcgcuaaaugacaaauaga

SEQ ID NO: 3608420 - RNA, 23 nt, Salmonella enterica enterica serovar Typhi
auucgcgcuaucgcuaaagacgu

SEQ ID NO: 3608421 - RNA, 18 nt, Salmonella enterica enterica serovar Typhi
auucgcugacaucgugua

SEQ ID NO: 3608422 - RNA, 17 nt, Salmonella enterica enterica serovar Typhi
auucgcuuguuucacug

SEQ ID NO: 3608423 - RNA, 17 nt, Salmonella enterica enterica serovar Typhi
auucggcgcuucgcagc

SEQ ID NO: 3608424 - RNA, 23 nt, Salmonella enterica enterica serovar Typhi
auucgggacaaacccccagccau

SEQ ID NO: 3608425 - RNA, 21 nt, Salmonella enterica enterica serovar Typhi
auucgguaagcuuauccugcc

SEQ ID NO: 3608426 - RNA, 21 nt, Salmonella enterica enterica serovar Typhi
auucgguagcuguaccagauc

SEQ ID NO: 3608427 - RNA, 15 nt, Salmonella enterica enterica serovar Typhi
auucgguggaaaccg

SEQ ID NO: 3608428 - RNA, 14 nt, Salmonella enterica enterica serovar Typhi
auucguaacaugcu

SEQ ID NO: 3608429 - RNA, 15 nt, Salmonella enterica enterica serovar Typhi
auucgucaauaccua

SEQ ID NO: 3608430 - RNA, 16 nt, Salmonella enterica enterica serovar Typhi
auucgucaccgaauag

SEQ ID NO: 3608431 - RNA, 15 nt, Salmonella enterica enterica serovar Typhi
auucgucuucaucuu

SEQ ID NO: 3608432 - RNA, 14 nt, Salmonella enterica enterica serovar Typhi
auucgugauccacc

SEQ ID NO: 3608433 - RNA, 17 nt, Salmonella enterica enterica serovar Typhi
auucuaaaaguaagcua

SEQ ID NO: 3608434 - RNA, 13 nt, Salmonella enterica enterica serovar Typhi
auucuaaggccgc

SEQ ID NO: 3608435 - RNA, 22 nt, Salmonella enterica enterica serovar Typhi
auucuacaguuugucaucaguc

SEQ ID NO: 3608436 - RNA, 23 nt, Salmonella enterica enterica serovar Typhi
auucucacagaaucaucaggcua

SEQ ID NO: 3608437 - RNA, 19 nt, Salmonella enterica enterica serovar Typhi
auucucaucagaccgugaa

SEQ ID NO: 3608438 - RNA, 14 nt, Salmonella enterica enterica serovar Typhi
auucucccaaauuu

SEQ ID NO: 3608439 - RNA, 17 nt, Salmonella enterica enterica serovar Typhi
auucucccaaauuuuuu

SEQ ID NO: 3608440 - RNA, 19 nt, Salmonella enterica enterica serovar Typhi
auucucugcccccgagcca

SEQ ID NO: 3608441 - RNA, 14 nt, Salmonella enterica enterica serovar Typhi
auucucuucuacca

SEQ ID NO: 3608442 - RNA, 20 nt, Salmonella enterica enterica serovar Typhi
auucucuucuaccacgcugc

SEQ ID NO: 3608443 - RNA, 21 nt, Salmonella enterica enterica serovar Typhi
auucugauuuuacuaaugaau

SEQ ID NO: 3608444 - RNA, 12 nt, Salmonella enterica enterica serovar Typhi
auucugcagcga

SEQ ID NO: 3608445 - RNA, 16 nt, Salmonella enterica enterica serovar Typhi
auucugcgaaagccuc

SEQ ID NO: 3608446 - RNA, 20 nt, Salmonella enterica enterica serovar Typhi
auucugcugaaaaagaacaa

SEQ ID NO: 3608447 - RNA, 16 nt, Salmonella enterica enterica serovar Typhi
auucugcugaugcugg

SEQ ID NO: 3608448 - RNA, 18 nt, Salmonella enterica enterica serovar Typhi
auucugcuuaccagaccg

SEQ ID NO: 3608449 - RNA, 22 nt, Salmonella enterica enterica serovar Typhi
auucugcuuccagaauucguac

SEQ ID NO: 3608450 - RNA, 16 nt, Salmonella enterica enterica serovar Typhi
auucuggaaucaauuu

SEQ ID NO: 3608451 - RNA, 19 nt, Salmonella enterica enterica serovar Typhi
auucugggcuuacuuucca

SEQ ID NO: 3608452 - RNA, 15 nt, Salmonella enterica enterica serovar Typhi
auucugucagaaauc

SEQ ID NO: 3608453 - RNA, 23 nt, Salmonella enterica enterica serovar Typhi
auucuguggggcuuaacccacga

SEQ ID NO: 3608454 - RNA, 17 nt, Salmonella enterica enterica serovar Typhi
auucuguguuuuuucgu

SEQ ID NO: 3608455 - RNA, 17 nt, Salmonella enterica enterica serovar Typhi
auucuguuugucuuuau

SEQ ID NO: 3608456 - RNA, 18 nt, Salmonella enterica enterica serovar Typhi
auucuuaacccacaagaa

SEQ ID NO: 3608457 - RNA, 19 nt, Salmonella enterica enterica serovar Typhi
auucuuaacccacaagaaa

SEQ ID NO: 3608458 - RNA, 20 nt, Salmonella enterica enterica serovar Typhi
auucuuaacccacaagaaau

SEQ ID NO: 3608459 - RNA, 18 nt, Salmonella enterica enterica serovar Typhi
auucuucgaaugucucaa

SEQ ID NO: 3608460 - RNA, 15 nt, Salmonella enterica enterica serovar Typhi
auucuucgucagaug

SEQ ID NO: 3608461 - RNA, 15 nt, Salmonella enterica enterica serovar Typhi
auucuucuuagaaua

SEQ ID NO: 3608462 - RNA, 23 nt, Salmonella enterica enterica serovar Typhi
auucuugcccuauaauaacaagc

SEQ ID NO: 3608463 - RNA, 19 nt, Salmonella enterica enterica serovar Typhi
auucuuuuacgaucgccac

SEQ ID NO: 3608464 - RNA, 15 nt, Salmonella enterica enterica serovar Typhi
auugaaacgcaucac

SEQ ID NO: 3608465 - RNA, 18 nt, Salmonella enterica enterica serovar Typhi
auugaaauuaaucaggca

SEQ ID NO: 3608466 - RNA, 14 nt, Salmonella enterica enterica serovar Typhi
auugaacauuuuuu

SEQ ID NO: 3608467 - RNA, 21 nt, Salmonella enterica enterica serovar Typhi
auugaacgcuggcggcaggcc

SEQ ID NO: 3608468 - RNA, 17 nt, Salmonella enterica enterica serovar Typhi
auugaacggcucaaaau

SEQ ID NO: 3608469 - RNA, 23 nt, Salmonella enterica enterica serovar Typhi
auugaagcgauauucgguaagcu

SEQ ID NO: 3608470 - RNA, 12 nt, Salmonella enterica enterica serovar Typhi
auugaagugcga

SEQ ID NO: 3608471 - RNA, 23 nt, Salmonella enterica enterica serovar Typhi
auugaauauuugcgcaguuuaaa

SEQ ID NO: 3608472 - RNA, 20 nt, Salmonella enterica enterica serovar Typhi
auugaauuugacgacaugca

SEQ ID NO: 3608473 - RNA, 13 nt, Salmonella enterica enterica serovar Typhi
auuguaugcaaga

SEQ ID NO: 3608474 - RNA, 18 nt, Salmonella enterica enterica serovar Typhi
auugucaccgggcgcugg

SEQ ID NO: 3608475 - RNA, 18 nt, Salmonella enterica enterica serovar Typhi
auugucaccguaauauaa

SEQ ID NO: 3608476 - RNA, 18 nt, Salmonella enterica enterica serovar Typhi
auugucaucauucgcgaa

SEQ ID NO: 3608477 - RNA, 20 nt, Salmonella enterica enterica serovar Typhi
auugucaugcuaaaacagau

SEQ ID NO: 3608478 - RNA, 20 nt, Salmonella enterica enterica serovar Typhi
auuguccacggggcggcaau

SEQ ID NO: 3608479 - RNA, 15 nt, Salmonella enterica enterica serovar Typhi
auugucgaauuccgc

SEQ ID NO: 3608480 - RNA, 18 nt, Salmonella enterica enterica serovar Typhi
auugucugcgcugggccg

SEQ ID NO: 3608481 - RNA, 13 nt, Salmonella enterica enterica serovar Typhi
auugugaaauucg

SEQ ID NO: 3608482 - RNA, 16 nt, Salmonella enterica enterica serovar Typhi
auugugagaaaagcag

SEQ ID NO: 3608483 - RNA, 15 nt, Salmonella enterica enterica serovar Typhi
auugugauuccaguu

SEQ ID NO: 3608484 - RNA, 15 nt, Salmonella enterica enterica serovar Typhi
auuguggaaauaaga

SEQ ID NO: 3608485 - RNA, 13 nt, Salmonella enterica enterica serovar Typhi
auuguuaaaaaga

SEQ ID NO: 3608486 - RNA, 18 nt, Salmonella enterica enterica serovar Typhi
auuguuacugguuuuuuc

SEQ ID NO: 3608487 - RNA, 13 nt, Salmonella enterica enterica serovar Typhi
auuguuccagguu

SEQ ID NO: 3608488 - RNA, 13 nt, Salmonella enterica enterica serovar Typhi
auuguugccccgc

SEQ ID NO: 3608489 - RNA, 14 nt, Salmonella enterica enterica serovar Typhi
auuguugcgccaug

SEQ ID NO: 3608490 - RNA, 16 nt, Salmonella enterica enterica serovar Typhi
auuguuuaacguuuca

SEQ ID NO: 3608491 - RNA, 15 nt, Salmonella enterica enterica serovar Typhi
auuguuuggugcuga

SEQ ID NO: 3608492 - RNA, 19 nt, Salmonella enterica enterica serovar Typhi
auuguuuuacuuuuuuaaa

SEQ ID NO: 3608493 - RNA, 13 nt, Salmonella enterica enterica serovar Typhi
auuguuuucuauu

SEQ ID NO: 3608494 - RNA, 13 nt, Salmonella enterica enterica serovar Typhi
auuuaaaauucca

SEQ ID NO: 3608495 - RNA, 18 nt, Salmonella enterica enterica serovar Typhi
auuuaaacgggguaaacu

SEQ ID NO: 3608496 - RNA, 18 nt, Salmonella enterica enterica serovar Typhi
auuuaaagauagcugcuu

SEQ ID NO: 3608497 - RNA, 15 nt, Salmonella enterica enterica serovar Typhi
auuuaaauagcaauu

SEQ ID NO: 3608498 - RNA, 20 nt, Salmonella enterica enterica serovar Typhi
auuuaaauagcaauuauauu

SEQ ID NO: 3608499 - RNA, 19 nt, Salmonella enterica enterica serovar Typhi
auuuaacccugguuugcug

SEQ ID NO: 3608500 - RNA, 20 nt, Salmonella enterica enterica serovar Typhi
auuuaacgaguugaauaacg

SEQ ID NO: 3608501 - RNA, 13 nt, Salmonella enterica enterica serovar Typhi
auuuaauacauca

SEQ ID NO: 3608502 - RNA, 17 nt, Salmonella enterica enterica serovar Typhi
auuuaauauaugaacca

SEQ ID NO: 3608503 - RNA, 21 nt, Salmonella enterica enterica serovar Typhi
auuuaaugaaccgggagauaa

SEQ ID NO: 3608504 - RNA, 13 nt, Salmonella enterica enterica serovar Typhi
auuuaauguuuca

SEQ ID NO: 3608505 - RNA, 22 nt, Salmonella enterica enterica serovar Typhi
auuuacaaaaaagauaaccauu

SEQ ID NO: 3608506 - RNA, 21 nt, Salmonella enterica enterica serovar Typhi
auuuacaaaugaccucaagaa

SEQ ID NO: 3608507 - RNA, 22 nt, Salmonella enterica enterica serovar Typhi
auuuacaaaugaccucaagaau

SEQ ID NO: 3608508 - RNA, 11 nt, Salmonella enterica enterica serovar Typhi
auuuaccagug

SEQ ID NO: 3608509 - RNA, 15 nt, Salmonella enterica enterica serovar Typhi
auuuacgcagcccca

SEQ ID NO: 3608510 - RNA, 15 nt, Salmonella enterica enterica serovar Typhi
auuuacuccaaaaau

SEQ ID NO: 3608511 - RNA, 14 nt, Salmonella enterica enterica serovar Typhi
auuuacugaauaaa

SEQ ID NO: 3608512 - RNA, 17 nt, Salmonella enterica enterica serovar Typhi
auuuacugugauccacc

SEQ ID NO: 3608513 - RNA, 23 nt, Salmonella enterica enterica serovar Typhi
auuuagcuauuccaaaauaauaa

SEQ ID NO: 3608514 - RNA, 15 nt, Salmonella enterica enterica serovar Typhi
auuuaggucuuguca

SEQ ID NO: 3608515 - RNA, 13 nt, Salmonella enterica enterica serovar Typhi
auuuauaacguau

SEQ ID NO: 3608516 - RNA, 15 nt, Salmonella enterica enterica serovar Typhi
auuuauagagcagca

SEQ ID NO: 3608517 - RNA, 14 nt, Salmonella enterica enterica serovar Typhi
auuuaucagacaau

SEQ ID NO: 3608518 - RNA, 23 nt, Salmonella enterica enterica serovar Typhi
auuuauccaccgccagacgcccc

SEQ ID NO: 3608519 - RNA, 19 nt, Salmonella enterica enterica serovar Typhi
auuuauccacgccgcuauc

SEQ ID NO: 3608520 - RNA, 13 nt, Salmonella enterica enterica serovar Typhi
auuuauccaguaa

SEQ ID NO: 3608521 - RNA, 20 nt, Salmonella enterica enterica serovar Typhi
auuuauccauguuuguuuaa

SEQ ID NO: 3608522 - RNA, 19 nt, Salmonella enterica enterica serovar Typhi
auuuaucccgugguggggu

SEQ ID NO: 3608523 - RNA, 18 nt, Salmonella enterica enterica serovar Typhi
auuuaucuuccggcauca

SEQ ID NO: 3608524 - RNA, 16 nt, Salmonella enterica enterica serovar Typhi
auuuaugcgcugggca

SEQ ID NO: 3608525 - RNA, 12 nt, Salmonella enterica enterica serovar Typhi
auuuauucuauu

SEQ ID NO: 3608526 - RNA, 23 nt, Salmonella enterica enterica serovar Typhi
auuuauuugcauuguacuuuuaa

SEQ ID NO: 3608527 - RNA, 22 nt, Salmonella enterica enterica serovar Typhi
auuuauuuuuaguaacuuacaa

SEQ ID NO: 3608528 - RNA, 23 nt, Salmonella enterica enterica serovar Typhi
auuuauuuuuugggcgcuuagaa

SEQ ID NO: 3608529 - RNA, 22 nt, Salmonella enterica enterica serovar Typhi
auuucaaacguuucaagaugcc

SEQ ID NO: 3608530 - RNA, 15 nt, Salmonella enterica enterica serovar Typhi
auuucaacccggcau

SEQ ID NO: 3608531 - RNA, 22 nt, Salmonella enterica enterica serovar Typhi
auuucaauaauauguuccacaa

SEQ ID NO: 3608532 - RNA, 17 nt, Salmonella enterica enterica serovar Typhi
auuucaauaaucccuuc

SEQ ID NO: 3608533 - RNA, 17 nt, Salmonella enterica enterica serovar Typhi
auuucaaucaucauauc

SEQ ID NO: 3608534 - RNA, 14 nt, Salmonella enterica enterica serovar Typhi
auuucaauguaauu

SEQ ID NO: 3608535 - RNA, 14 nt, Salmonella enterica enterica serovar Typhi
auuucacaaauuaa

SEQ ID NO: 3608536 - RNA, 18 nt, Salmonella enterica enterica serovar Typhi
auuucaccgucaauaacg

SEQ ID NO: 3608537 - RNA, 17 nt, Salmonella enterica enterica serovar Typhi
auuucaccuuuggcuuc

SEQ ID NO: 3608538 - RNA, 15 nt, Salmonella enterica enterica serovar Typhi
auuucacgaauaucg

SEQ ID NO: 3608539 - RNA, 16 nt, Salmonella enterica enterica serovar Typhi
auuucacgcagcacgu

SEQ ID NO: 3608540 - RNA, 22 nt, Salmonella enterica enterica serovar Typhi
auuucacgcuucacgucagcga

SEQ ID NO: 3608541 - RNA, 23 nt, Salmonella enterica enterica serovar Typhi
auuucacgucacguucauccugg

SEQ ID NO: 3608542 - RNA, 18 nt, Salmonella enterica enterica serovar Typhi
auuucacguuucaucucu

SEQ ID NO: 3608543 - RNA, 23 nt, Salmonella enterica enterica serovar Typhi
auuucacuggccguuuucccggc

SEQ ID NO: 3608544 - RNA, 16 nt, Salmonella enterica enterica serovar Typhi
auuucacuuaucccug

SEQ ID NO: 3608545 - RNA, 14 nt, Salmonella enterica enterica serovar Typhi
auuucacuucauca

SEQ ID NO: 3608546 - RNA, 15 nt, Salmonella enterica enterica serovar Typhi
auuucacuucaucau

SEQ ID NO: 3608547 - RNA, 15 nt, Salmonella enterica enterica serovar Typhi
auuucagcacgcuua

SEQ ID NO: 3608548 - RNA, 16 nt, Salmonella enterica enterica serovar Typhi
auuucagcauccuccg

SEQ ID NO: 3608549 - RNA, 14 nt, Salmonella enterica enterica serovar Typhi
auuucagcgcagaa

SEQ ID NO: 3608550 - RNA, 16 nt, Salmonella enterica enterica serovar Typhi
auuucaggaauacauu

SEQ ID NO: 3608551 - RNA, 15 nt, Salmonella enterica enterica serovar Typhi
auuucaggcauuuua

SEQ ID NO: 3608552 - RNA, 18 nt, Salmonella enterica enterica serovar Typhi
auuucagggaaaagaagu

SEQ ID NO: 3608553 - RNA, 20 nt, Salmonella enterica enterica serovar Typhi
auuucaguacagccaaaaau

SEQ ID NO: 3608554 - RNA, 21 nt, Salmonella enterica enterica serovar Typhi
auuucaguacagccaaaaaua

SEQ ID NO: 3608555 - RNA, 18 nt, Salmonella enterica enterica serovar Typhi
auuucaugcgcagcauga

SEQ ID NO: 3608556 - RNA, 14 nt, Salmonella enterica enterica serovar Typhi
auuucauucagacc

SEQ ID NO: 3608557 - RNA, 14 nt, Salmonella enterica enterica serovar Typhi
auuuccagcgggcg

SEQ ID NO: 3608558 - RNA, 17 nt, Salmonella enterica enterica serovar Typhi
auuuccagugccaguua

SEQ ID NO: 3608559 - RNA, 20 nt, Salmonella enterica enterica serovar Typhi
auuuuauuuuucaaugccau

SEQ ID NO: 3608560 - RNA, 13 nt, Salmonella enterica enterica serovar Typhi
auuuucaaaaaca

SEQ ID NO: 3608561 - RNA, 19 nt, Salmonella enterica enterica serovar Typhi
auuuucaacggcaucaaua

SEQ ID NO: 3608562 - RNA, 22 nt, Salmonella enterica enterica serovar Typhi
auuuucaacggcaucaauaauu

SEQ ID NO: 3608563 - RNA, 17 nt, Salmonella enterica enterica serovar Typhi
auuuucaaugcacgcca

SEQ ID NO: 3608564 - RNA, 21 nt, Salmonella enterica enterica serovar Typhi
auuuucaccuggaugcugccu

SEQ ID NO: 3608565 - RNA, 22 nt, Salmonella enterica enterica serovar Typhi
auuuucacgccauugccaggac

SEQ ID NO: 3608566 - RNA, 22 nt, Salmonella enterica enterica serovar Typhi
auuuucacgcucgaguucuuca

SEQ ID NO: 3608567 - RNA, 22 nt, Salmonella enterica enterica serovar Typhi
auuuucagaggucaggauuuuc

SEQ ID NO: 3608568 - RNA, 20 nt, Salmonella enterica enterica serovar Typhi
auuuucagcuucagucauaa

SEQ ID NO: 3608569 - RNA, 14 nt, Salmonella enterica enterica serovar Typhi
auuuucaguuuuac

SEQ ID NO: 3608570 - RNA, 18 nt, Salmonella enterica enterica serovar Typhi
auuuucauacuauuuccu

SEQ ID NO: 3608571 - RNA, 21 nt, Salmonella enterica enterica serovar Typhi
auuuucaucaagccauugcgc

SEQ ID NO: 3608572 - RNA, 21 nt, Salmonella enterica enterica serovar Typhi
auuuucaucauaucugauaaa

SEQ ID NO: 3608573 - RNA, 19 nt, Salmonella enterica enterica serovar Typhi
auuuucaugauauucuguc

SEQ ID NO: 3608574 - RNA, 23 nt, Salmonella enterica enterica serovar Typhi
auuuucaugguaucccacaugag

SEQ ID NO: 3608575 - RNA, 16 nt, Salmonella enterica enterica serovar Typhi
auuuuccaggccgcca

SEQ ID NO: 3608576 - RNA, 15 nt, Salmonella enterica enterica serovar Typhi
auuuuccccagaauc

SEQ ID NO: 3608577 - RNA, 19 nt, Salmonella enterica enterica serovar Typhi
auuuucggcaucagcagga

SEQ ID NO: 3608578 - RNA, 14 nt, Salmonella enterica enterica serovar Typhi
auuuucguaaaaua

SEQ ID NO: 3608579 - RNA, 19 nt, Salmonella enterica enterica serovar Typhi
auuuucucguguagccagu

SEQ ID NO: 3608580 - RNA, 20 nt, Salmonella enterica enterica serovar Typhi
auuuucucguguagccagua

SEQ ID NO: 3608581 - RNA, 16 nt, Salmonella enterica enterica serovar Typhi
auuuucuguaauucuc

SEQ ID NO: 3608582 - RNA, 17 nt, Salmonella enterica enterica serovar Typhi
auuuucuucuggccauu

SEQ ID NO: 3608583 - RNA, 15 nt, Salmonella enterica enterica serovar Typhi
auuuucuuucaucaa

SEQ ID NO: 3608584 - RNA, 17 nt, Salmonella enterica enterica serovar Typhi
auuuucuuucaucaaac

SEQ ID NO: 3608585 - RNA, 18 nt, Salmonella enterica enterica serovar Typhi
auuuucuuucaucaaacg

SEQ ID NO: 3608586 - RNA, 18 nt, Salmonella enterica enterica serovar Typhi
auuuugcaccaucaacgc

SEQ ID NO: 3608587 - RNA, 16 nt, Salmonella enterica enterica serovar Typhi
auuuugcacuguuuuu

SEQ ID NO: 3608588 - RNA, 21 nt, Salmonella enterica enterica serovar Typhi
auuuugcacuuuugccaggcg

SEQ ID NO: 3608589 - RNA, 12 nt, Salmonella enterica enterica serovar Typhi
auuuugcgccua

SEQ ID NO: 3608590 - RNA, 15 nt, Salmonella enterica enterica serovar Typhi
auuuugcgguuuuaa

SEQ ID NO: 3608591 - RNA, 13 nt, Salmonella enterica enterica serovar Typhi
auuuugcuuggcc

SEQ ID NO: 3608592 - RNA, 19 nt, Salmonella enterica enterica serovar Typhi
auuuuggacggcgucacca

SEQ ID NO: 3608593 - RNA, 21 nt, Salmonella enterica enterica serovar Typhi
auuuuggggaaaauaccggua

SEQ ID NO: 3608594 - RNA, 20 nt, Salmonella enterica enterica serovar Typhi
auuuugguuacuauuuuuca

SEQ ID NO: 3608595 - RNA, 22 nt, Salmonella enterica enterica serovar Typhi
auuuuguggcggauacgcuucc

SEQ ID NO: 3608596 - RNA, 18 nt, Salmonella enterica enterica serovar Typhi
auuuuguugcuccagcau

SEQ ID NO: 3608597 - RNA, 22 nt, Salmonella enterica enterica serovar Typhi
auuuuguugcuccagcaucaca

SEQ ID NO: 3608598 - RNA, 24 nt, Salmonella enterica enterica serovar Typhi
auuuuguugcuccagcaucacauc

SEQ ID NO: 3608599 - RNA, 20 nt, Salmonella enterica enterica serovar Typhi
auuuuuaagguauugauuuu

SEQ ID NO: 3608600 - RNA, 19 nt, Salmonella enterica enterica serovar Typhi
auuuuuaccgcauuauaaa

SEQ ID NO: 3608601 - RNA, 16 nt, Salmonella enterica enterica serovar Typhi
auuuuuauauuccgca

SEQ ID NO: 3608602 - RNA, 13 nt, Salmonella enterica enterica serovar Typhi
auuuuucacaugc

SEQ ID NO: 3608603 - RNA, 13 nt, Salmonella enterica enterica serovar Typhi
auuuuuccagcau

SEQ ID NO: 3608604 - RNA, 18 nt, Salmonella enterica enterica serovar Typhi
auuuuucccuggccggaa

SEQ ID NO: 3608605 - RNA, 20 nt, Salmonella enterica enterica serovar Typhi
auuuuuccggcgucaaaaau

SEQ ID NO: 3608606 - RNA, 15 nt, Salmonella enterica enterica serovar Typhi
auuuuucgaucuucu

SEQ ID NO: 3608607 - RNA, 16 nt, Salmonella enterica enterica serovar Typhi
auuuuucgaucuucuc

SEQ ID NO: 3608608 - RNA, 17 nt, Salmonella enterica enterica serovar Typhi
auuuuucgaucuucucc

SEQ ID NO: 3608609 - RNA, 18 nt, Salmonella enterica enterica serovar Typhi
auuuuucucccagcagac

SEQ ID NO: 3608610 - RNA, 14 nt, Salmonella enterica enterica serovar Typhi
auuuuucugcgcca

SEQ ID NO: 3608611 - RNA, 14 nt, Salmonella enterica enterica serovar Typhi
auuuuugccauuau

SEQ ID NO: 3608612 - RNA, 19 nt, Salmonella enterica enterica serovar Typhi
auuuuuuauauucgcucau

SEQ ID NO: 3608613 - RNA, 13 nt, Salmonella enterica enterica serovar Typhi
auuuuuuuacauu

SEQ ID NO: 3608614 - RNA, 13 nt, Salmonella enterica enterica serovar Typhi
auuuuuuuugccu

SEQ ID NO: 3608615 - RNA, 16 nt, Salmonella enterica enterica serovar Typhi
caaaaaaaaaccggca

SEQ ID NO: 3608616 - RNA, 13 nt, Salmonella enterica enterica serovar Typhi
caaaaaaaaccag

SEQ ID NO: 3608617 - RNA, 13 nt, Salmonella enterica enterica serovar Typhi
caaaaaagagaag

SEQ ID NO: 3608618 - RNA, 18 nt, Salmonella enterica enterica serovar Typhi
caaaaaaggaaaaugacg

SEQ ID NO: 3608619 - RNA, 13 nt, Salmonella enterica enterica serovar Typhi
caaaaaaucagca

SEQ ID NO: 3608620 - RNA, 16 nt, Salmonella enterica enterica serovar Typhi
caaaaaaucagcaauc

SEQ ID NO: 3608621 - RNA, 10 nt, Salmonella enterica enterica serovar Typhi
caaaaacaag

SEQ ID NO: 3608622 - RNA, 20 nt, Salmonella enterica enterica serovar Typhi
caaaaacauccacauaggcg

SEQ ID NO: 3608623 - RNA, 13 nt, Salmonella enterica enterica serovar Typhi
caaaaacgccaga

SEQ ID NO: 3608624 - RNA, 23 nt, Salmonella enterica enterica serovar Typhi
caaaaacggcuuuaauaccccug

SEQ ID NO: 3608625 - RNA, 21 nt, Salmonella enterica enterica serovar Typhi
caaaaacguuaggcgcaaagg

SEQ ID NO: 3608626 - RNA, 23 nt, Salmonella enterica enterica serovar Typhi
caaaaacguuaggcgcaaaggca

SEQ ID NO: 3608627 - RNA, 18 nt, Salmonella enterica enterica serovar Typhi
caaaaagccuugcugaau

SEQ ID NO: 3608628 - RNA, 20 nt, Salmonella enterica enterica serovar Typhi
caaaaaguaguuccagcaua

SEQ ID NO: 3608629 - RNA, 12 nt, Salmonella enterica enterica serovar Typhi
caaaaauaauuc

SEQ ID NO: 3608630 - RNA, 18 nt, Salmonella enterica enterica serovar Typhi
caaaaauagcauuaagcu

SEQ ID NO: 3608631 - RNA, 14 nt, Salmonella enterica enterica serovar Typhi
caaaaaucaccaca

SEQ ID NO: 3608632 - RNA, 16 nt, Salmonella enterica enterica serovar Typhi
caaaaaucgucaucag

SEQ ID NO: 3608633 - RNA, 14 nt, Salmonella enterica enterica serovar Typhi
caaaaaugaucacu

SEQ ID NO: 3608634 - RNA, 21 nt, Salmonella enterica enterica serovar Typhi
caaaaaugauguguuucagca

SEQ ID NO: 3608635 - RNA, 23 nt, Salmonella enterica enterica serovar Typhi
caaaaauggcuucggcaauuucc

SEQ ID NO: 3608636 - RNA, 15 nt, Salmonella enterica enterica serovar Typhi
caaaaauuugcgcga

SEQ ID NO: 3608637 - RNA, 21 nt, Salmonella enterica enterica serovar Typhi
caaaacaccgcucaauaucau

SEQ ID NO: 3608638 - RNA, 15 nt, Salmonella enterica enterica serovar Typhi
caaaaccacagugac

SEQ ID NO: 3608639 - RNA, 15 nt, Salmonella enterica enterica serovar Typhi
caaaacccaccagca

SEQ ID NO: 3608640 - RNA, 18 nt, Salmonella enterica enterica serovar Typhi
caaaacccaccagcaggg

SEQ ID NO: 3608641 - RNA, 20 nt, Salmonella enterica enterica serovar Typhi
caaaacccagaaucaguaac

SEQ ID NO: 3608642 - RNA, 19 nt, Salmonella enterica enterica serovar Typhi
caaaaccuucauaaauacg

SEQ ID NO: 3608643 - RNA, 14 nt, Salmonella enterica enterica serovar Typhi
caaaacggaauguu

SEQ ID NO: 3608644 - RNA, 14 nt, Salmonella enterica enterica serovar Typhi
caaacuauuuuuag

SEQ ID NO: 3608645 - RNA, 15 nt, Salmonella enterica enterica serovar Typhi
caaacuauuuuuagc

SEQ ID NO: 3608646 - RNA, 18 nt, Salmonella enterica enterica serovar Typhi
caaacucacguuccccag

SEQ ID NO: 3608647 - RNA, 23 nt, Salmonella enterica enterica serovar Typhi
caaacucacguuccccagcaccg

SEQ ID NO: 3608648 - RNA, 12 nt, Salmonella enterica enterica serovar Typhi
caaacucagcgg

SEQ ID NO: 3608649 - RNA, 13 nt, Salmonella enterica enterica serovar Typhi
caaacucagcggc

SEQ ID NO: 3608650 - RNA, 12 nt, Salmonella enterica enterica serovar Typhi
caaacuccagcu

SEQ ID NO: 3608651 - RNA, 22 nt, Salmonella enterica enterica serovar Typhi
caaacuccgcgcuggcaauaaa

SEQ ID NO: 3608652 - RNA, 22 nt, Salmonella enterica enterica serovar Typhi
caaacucgcugccgaccuggcu

SEQ ID NO: 3608653 - RNA, 19 nt, Salmonella enterica enterica serovar Typhi
caaacucuuuuucaauaaa

SEQ ID NO: 3608654 - RNA, 17 nt, Salmonella enterica enterica serovar Typhi
caaacugauaagggccu

SEQ ID NO: 3608655 - RNA, 23 nt, Salmonella enterica enterica serovar Typhi
caaacugaucgaggacggccuga

SEQ ID NO: 3608656 - RNA, 14 nt, Salmonella enterica enterica serovar Typhi
caaacugcgcgccc

SEQ ID NO: 3608657 - RNA, 19 nt, Salmonella enterica enterica serovar Typhi
caaacugcgcgcccgccuc

SEQ ID NO: 3608658 - RNA, 22 nt, Salmonella enterica enterica serovar Typhi
caaacugcucguaaagcaucag

SEQ ID NO: 3608659 - RNA, 18 nt, Salmonella enterica enterica serovar Typhi
caaacuggcaaauaaaau

SEQ ID NO: 3608660 - RNA, 15 nt, Salmonella enterica enterica serovar Typhi
caaacuggccacagc

SEQ ID NO: 3608661 - RNA, 13 nt, Salmonella enterica enterica serovar Typhi
caaacuuccacac

SEQ ID NO: 3608662 - RNA, 14 nt, Salmonella enterica enterica serovar Typhi
caaacuuuccguug

SEQ ID NO: 3608663 - RNA, 18 nt, Salmonella enterica enterica serovar Typhi
caaacuuugcgccauuuc

SEQ ID NO: 3608664 - RNA, 17 nt, Salmonella enterica enterica serovar Typhi
caaagaagaauccaggg

SEQ ID NO: 3608665 - RNA, 15 nt, Salmonella enterica enterica serovar Typhi
caaagacaccccagc

SEQ ID NO: 3608666 - RNA, 17 nt, Salmonella enterica enterica serovar Typhi
caaagacaccccagccu

SEQ ID NO: 3608667 - RNA, 17 nt, Salmonella enterica enterica serovar Typhi
caaagauaaucugaaua

SEQ ID NO: 3608668 - RNA, 15 nt, Salmonella enterica enterica serovar Typhi
caaagauuagcccca

SEQ ID NO: 3608669 - RNA, 19 nt, Salmonella enterica enterica serovar Typhi
caaagcaauaccacgcccg

SEQ ID NO: 3608670 - RNA, 15 nt, Salmonella enterica enterica serovar Typhi
caaagcacugcugcu

SEQ ID NO: 3608671 - RNA, 22 nt, Salmonella enterica enterica serovar Typhi
caaagcacugcugcugaaagaa

SEQ ID NO: 3608672 - RNA, 23 nt, Salmonella enterica enterica serovar Typhi
caaagcacugcugcugaaagaag

SEQ ID NO: 3608673 - RNA, 15 nt, Salmonella enterica enterica serovar Typhi
caaagcagcugcugg

SEQ ID NO: 3608674 - RNA, 13 nt, Salmonella enterica enterica serovar Typhi
caaagccaggccg

SEQ ID NO: 3608675 - RNA, 16 nt, Salmonella enterica enterica serovar Typhi
caaagccaggccgcca

SEQ ID NO: 3608676 - RNA, 15 nt, Salmonella enterica enterica serovar Typhi
caaagcccacgcccu

SEQ ID NO: 3608677 - RNA, 16 nt, Salmonella enterica enterica serovar Typhi
caaagcccaucagcgc

SEQ ID NO: 3608678 - RNA, 17 nt, Salmonella enterica enterica serovar Typhi
caaagcccaucagcgcc

SEQ ID NO: 3608679 - RNA, 16 nt, Salmonella enterica enterica serovar Typhi
caaagcgccagauaug

SEQ ID NO: 3608680 - RNA, 16 nt, Salmonella enterica enterica serovar Typhi
caaagcgguaaaucgc

SEQ ID NO: 3608681 - RNA, 21 nt, Salmonella enterica enterica serovar Typhi
caaagcgguauaacggccaga

SEQ ID NO: 3608682 - RNA, 22 nt, Salmonella enterica enterica serovar Typhi
caaagcguucugaacuguaacc

SEQ ID NO: 3608683 - RNA, 20 nt, Salmonella enterica enterica serovar Typhi
caaaggaauuacgggcgaua

SEQ ID NO: 3608684 - RNA, 20 nt, Salmonella enterica enterica serovar Typhi
caaaggcauggcagguaucg

SEQ ID NO: 3608685 - RNA, 15 nt, Salmonella enterica enterica serovar Typhi
caaagggcaccuggg

SEQ ID NO: 3608686 - RNA, 24 nt, Salmonella enterica enterica serovar Typhi
caaagguguuauuucucuugcaga

SEQ ID NO: 3608687 - RNA, 23 nt, Salmonella enterica enterica serovar Typhi
caaagguuuguuuaauuuuguug

SEQ ID NO: 3608688 - RNA, 15 nt, Salmonella enterica enterica serovar Typhi
caaagucuuuuguau

SEQ ID NO: 3608689 - RNA, 18 nt, Salmonella enterica enterica serovar Typhi
caaagugcgcccuuuuuu

SEQ ID NO: 3608690 - RNA, 23 nt, Salmonella enterica enterica serovar Typhi
caaagugguuccaggcgcgcacc

SEQ ID NO: 3608691 - RNA, 17 nt, Salmonella enterica enterica serovar Typhi
caaaguuaaucagcgcc

SEQ ID NO: 3608692 - RNA, 19 nt, Salmonella enterica enterica serovar Typhi
caaaguuaccggcauuaau

SEQ ID NO: 3608693 - RNA, 15 nt, Salmonella enterica enterica serovar Typhi
caaaguugcaucaag

SEQ ID NO: 3608694 - RNA, 18 nt, Salmonella enterica enterica serovar Typhi
caaaguugcccgaugcgc

SEQ ID NO: 3608695 - RNA, 17 nt, Salmonella enterica enterica serovar Typhi
caaauaaagccagauac

SEQ ID NO: 3608696 - RNA, 17 nt, Salmonella enterica enterica serovar Typhi
caaauaaauccaugaga

SEQ ID NO: 3608697 - RNA, 21 nt, Salmonella enterica enterica serovar Typhi
caaauaagguggcuaacccgc

SEQ ID NO: 3608698 - RNA, 14 nt, Salmonella enterica enterica serovar Typhi
caaauacagaugcu

SEQ ID NO: 3608699 - RNA, 18 nt, Salmonella enterica enterica serovar Typhi
caaauaccggacagacuu

SEQ ID NO: 3608700 - RNA, 17 nt, Salmonella enterica enterica serovar Typhi
caaauacggaccuggcg

SEQ ID NO: 3608701 - RNA, 15 nt, Salmonella enterica enterica serovar Typhi
caaauacugcuuuuc

SEQ ID NO: 3608702 - RNA, 21 nt, Salmonella enterica enterica serovar Typhi
caaauacugcuuuuccggcag

SEQ ID NO: 3608703 - RNA, 19 nt, Salmonella enterica enterica serovar Typhi
caaauagagaaaauaacaa

SEQ ID NO: 3608704 - RNA, 21 nt, Salmonella enterica enterica serovar Typhi
caaauagccguuaccgccgag

SEQ ID NO: 3608705 - RNA, 19 nt, Salmonella enterica enterica serovar Typhi
caaauagcguguguuuucc

SEQ ID NO: 3608706 - RNA, 18 nt, Salmonella enterica enterica serovar Typhi
caaauauauugaaaaggg

SEQ ID NO: 3608707 - RNA, 20 nt, Salmonella enterica enterica serovar Typhi
caaauauccuaccacgccgc

SEQ ID NO: 3608708 - RNA, 17 nt, Salmonella enterica enterica serovar Typhi
caaaucaccacauggcc

SEQ ID NO: 3608709 - RNA, 15 nt, Salmonella enterica enterica serovar Typhi
caaaucagacgcuuc

SEQ ID NO: 3608710 - RNA, 13 nt, Salmonella enterica enterica serovar Typhi
caaaucagcagga

SEQ ID NO: 3608711 - RNA, 15 nt, Salmonella enterica enterica serovar Typhi
caaaucaggaaauaa

SEQ ID NO: 3608712 - RNA, 21 nt, Salmonella enterica enterica serovar Typhi
caaaucaggaaauaaucgagu

SEQ ID NO: 3608713 - RNA, 21 nt, Salmonella enterica enterica serovar Typhi
caaauccacuggucgucugaa

SEQ ID NO: 3608714 - RNA, 20 nt, Salmonella enterica enterica serovar Typhi
caaaucccugaucggccaga

SEQ ID NO: 3608715 - RNA, 21 nt, Salmonella enterica enterica serovar Typhi
caaauccgcauuucgcccucg

SEQ ID NO: 3608716 - RNA, 15 nt, Salmonella enterica enterica serovar Typhi
caaaucgacagccag

SEQ ID NO: 3608717 - RNA, 16 nt, Salmonella enterica enterica serovar Typhi
caaaucgcccaucaca

SEQ ID NO: 3608718 - RNA, 18 nt, Salmonella enterica enterica serovar Typhi
caaaucgcgguaaaaagc

SEQ ID NO: 3608719 - RNA, 14 nt, Salmonella enterica enterica serovar Typhi
caaaucguuuucua

SEQ ID NO: 3608720 - RNA, 20 nt, Salmonella enterica enterica serovar Typhi
caaaucugccgggagcagau

SEQ ID NO: 3608721 - RNA, 21 nt, Salmonella enterica enterica serovar Typhi
caaaucugccgucaucgacuu

SEQ ID NO: 3608722 - RNA, 22 nt, Salmonella enterica enterica serovar Typhi
caaaucuggugauaaagcagac

SEQ ID NO: 3608723 - RNA, 14 nt, Salmonella enterica enterica serovar Typhi
caaaugaagucugg

SEQ ID NO: 3608724 - RNA, 14 nt, Salmonella enterica enterica serovar Typhi
caaaugaccagauc

SEQ ID NO: 3608725 - RNA, 17 nt, Salmonella enterica enterica serovar Typhi
caaaugaucguuuuuug

SEQ ID NO: 3608726 - RNA, 14 nt, Salmonella enterica enterica serovar Typhi
caaaugcccagcuc

SEQ ID NO: 3608727 - RNA, 22 nt, Salmonella enterica enterica serovar Typhi
caaaugcgauaaccugcuguga

SEQ ID NO: 3608728 - RNA, 20 nt, Salmonella enterica enterica serovar Typhi
caaaugggaucuucaaugaa

SEQ ID NO: 3608729 - RNA, 22 nt, Salmonella enterica enterica serovar Typhi
caaccgccagucacccugcccu

SEQ ID NO: 3608730 - RNA, 18 nt, Salmonella enterica enterica serovar Typhi
caaccgcgccaaagauaa

SEQ ID NO: 3608731 - RNA, 14 nt, Salmonella enterica enterica serovar Typhi
caaccgcgcggcgu

SEQ ID NO: 3608732 - RNA, 15 nt, Salmonella enterica enterica serovar Typhi
caaccgcucuccgca

SEQ ID NO: 3608733 - RNA, 19 nt, Salmonella enterica enterica serovar Typhi
caaccggaaucgggucagg

SEQ ID NO: 3608734 - RNA, 21 nt, Salmonella enterica enterica serovar Typhi
caaccggcuccggguugccug

SEQ ID NO: 3608735 - RNA, 19 nt, Salmonella enterica enterica serovar Typhi
caaccgguaucaaacccuu

SEQ ID NO: 3608736 - RNA, 16 nt, Salmonella enterica enterica serovar Typhi
caaccgugagcgcgcc

SEQ ID NO: 3608737 - RNA, 19 nt, Salmonella enterica enterica serovar Typhi
caaccgugucugcugaucg

SEQ ID NO: 3608738 - RNA, 19 nt, Salmonella enterica enterica serovar Typhi
caaccguuggggaaaauau

SEQ ID NO: 3608739 - RNA, 15 nt, Salmonella enterica enterica serovar Typhi
caaccguuucuuuuu

SEQ ID NO: 3608740 - RNA, 16 nt, Salmonella enterica enterica serovar Typhi
caaccguuucuuuuuc

SEQ ID NO: 3608741 - RNA, 17 nt, Salmonella enterica enterica serovar Typhi
caaccuccacgcccagc

SEQ ID NO: 3608742 - RNA, 17 nt, Salmonella enterica enterica serovar Typhi
caaccucggcuugcuuc

SEQ ID NO: 3608743 - RNA, 19 nt, Salmonella enterica enterica serovar Typhi
caaccugccgaugaaagag

SEQ ID NO: 3608744 - RNA, 20 nt, Salmonella enterica enterica serovar Typhi
caaccugccgaugaaagagc

SEQ ID NO: 3608745 - RNA, 22 nt, Salmonella enterica enterica serovar Typhi
caaccugcgcagaauuuguuua

SEQ ID NO: 3608746 - RNA, 15 nt, Salmonella enterica enterica serovar Typhi
caaccugcgcugacg

SEQ ID NO: 3608747 - RNA, 18 nt, Salmonella enterica enterica serovar Typhi
caacgaagagaccugugu

SEQ ID NO: 3608748 - RNA, 23 nt, Salmonella enterica enterica serovar Typhi
caacgacccgaagggcgaagcgc

SEQ ID NO: 3608749 - RNA, 20 nt, Salmonella enterica enterica serovar Typhi
caacgaccggcgcagcgccc

SEQ ID NO: 3608750 - RNA, 23 nt, Salmonella enterica enterica serovar Typhi
caacgaccgucgugccugcggua

SEQ ID NO: 3608751 - RNA, 21 nt, Salmonella enterica enterica serovar Typhi
caacgaggugaauaaauccuu

SEQ ID NO: 3608752 - RNA, 22 nt, Salmonella enterica enterica serovar Typhi
caacgcaaugcgauaagcgucu

SEQ ID NO: 3608753 - RNA, 23 nt, Salmonella enterica enterica serovar Typhi
caacgcaaugcgauaagcgucuu

SEQ ID NO: 3608754 - RNA, 20 nt, Salmonella enterica enterica serovar Typhi
caacgcacuguaacgcacug

SEQ ID NO: 3608755 - RNA, 20 nt, Salmonella enterica enterica serovar Typhi
caacgcagacaacguccugc

SEQ ID NO: 3608756 - RNA, 19 nt, Salmonella enterica enterica serovar Typhi
caacgcaggcuggagagcg

SEQ ID NO: 3608757 - RNA, 15 nt, Salmonella enterica enterica serovar Typhi
caacgcauaaaaacg

SEQ ID NO: 3608758 - RNA, 14 nt, Salmonella enterica enterica serovar Typhi
caacgcaucaaaua

SEQ ID NO: 3608759 - RNA, 18 nt, Salmonella enterica enterica serovar Typhi
caacgcaucgcugcgcuu

SEQ ID NO: 3608760 - RNA, 17 nt, Salmonella enterica enterica serovar Typhi
caacgccaagcgcggca

SEQ ID NO: 3608761 - RNA, 19 nt, Salmonella enterica enterica serovar Typhi
caacgccaagcgcggcagc

SEQ ID NO: 3608762 - RNA, 12 nt, Salmonella enterica enterica serovar Typhi
caacgccacugc

SEQ ID NO: 3608763 - RNA, 19 nt, Salmonella enterica enterica serovar Typhi
caacgccaucagcaaaaua

SEQ ID NO: 3608764 - RNA, 17 nt, Salmonella enterica enterica serovar Typhi
caacgccaucagccgcg

SEQ ID NO: 3608765 - RNA, 18 nt, Salmonella enterica enterica serovar Typhi
caacgccgccgacaugac

SEQ ID NO: 3608766 - RNA, 14 nt, Salmonella enterica enterica serovar Typhi
caacgccgccuggc

SEQ ID NO: 3608767 - RNA, 17 nt, Salmonella enterica enterica serovar Typhi
caacgccuucguccgga

SEQ ID NO: 3608768 - RNA, 21 nt, Salmonella enterica enterica serovar Typhi
caacgcgaguauucgcgcccu

SEQ ID NO: 3608769 - RNA, 17 nt, Salmonella enterica enterica serovar Typhi
caacgcgcaucaacgcc

SEQ ID NO: 3608770 - RNA, 14 nt, Salmonella enterica enterica serovar Typhi
caacgcgccgccaa

SEQ ID NO: 3608771 - RNA, 13 nt, Salmonella enterica enterica serovar Typhi
caacgcucagacc

SEQ ID NO: 3608772 - RNA, 17 nt, Salmonella enterica enterica serovar Typhi
caacgcucagaccgauc

SEQ ID NO: 3608773 - RNA, 13 nt, Salmonella enterica enterica serovar Typhi
caacgcuccagca

SEQ ID NO: 3608774 - RNA, 15 nt, Salmonella enterica enterica serovar Typhi
caacgcuuccaccuc

SEQ ID NO: 3608775 - RNA, 20 nt, Salmonella enterica enterica serovar Typhi
caacgcuucuggcguaaugc

SEQ ID NO: 3608776 - RNA, 16 nt, Salmonella enterica enterica serovar Typhi
caacggcacaacggcc

SEQ ID NO: 3608777 - RNA, 20 nt, Salmonella enterica enterica serovar Typhi
caacggccagcaaaaucacc

SEQ ID NO: 3608778 - RNA, 16 nt, Salmonella enterica enterica serovar Typhi
caacggcccgaagggu

SEQ ID NO: 3608779 - RNA, 13 nt, Salmonella enterica enterica serovar Typhi
caacggcggauga

SEQ ID NO: 3608780 - RNA, 21 nt, Salmonella enterica enterica serovar Typhi
caacgggcuuuuagccgcgcc

SEQ ID NO: 3608781 - RNA, 18 nt, Salmonella enterica enterica serovar Typhi
caacggucggucuuuuug

SEQ ID NO: 3608782 - RNA, 16 nt, Salmonella enterica enterica serovar Typhi
caacguaaauagagaa

SEQ ID NO: 3608783 - RNA, 15 nt, Salmonella enterica enterica serovar Typhi
caacgucaagacgcu

SEQ ID NO: 3608784 - RNA, 15 nt, Salmonella enterica enterica serovar Typhi
caacgucaucaugaa

SEQ ID NO: 3608785 - RNA, 12 nt, Salmonella enterica enterica serovar Typhi
caacgucauccc

SEQ ID NO: 3608786 - RNA, 22 nt, Salmonella enterica enterica serovar Typhi
caacguccccguuugcaguccg

SEQ ID NO: 3608787 - RNA, 21 nt, Salmonella enterica enterica serovar Typhi
caacgucgacagacgcaucuu

SEQ ID NO: 3608788 - RNA, 20 nt, Salmonella enterica enterica serovar Typhi
caacgucgugccagugaugc

SEQ ID NO: 3608789 - RNA, 15 nt, Salmonella enterica enterica serovar Typhi
caacgugcagauggu

SEQ ID NO: 3608790 - RNA, 18 nt, Salmonella enterica enterica serovar Typhi
caacguuucuuucaucag

SEQ ID NO: 3608791 - RNA, 19 nt, Salmonella enterica enterica serovar Typhi
caacguuucuuucaucaga

SEQ ID NO: 3608792 - RNA, 17 nt, Salmonella enterica enterica serovar Typhi
caacguuuguaacagca

SEQ ID NO: 3608793 - RNA, 21 nt, Salmonella enterica enterica serovar Typhi
caacguuuguaacagcaggac

SEQ ID NO: 3608794 - RNA, 22 nt, Salmonella enterica enterica serovar Typhi
caacuacucguaaucuaaaauu

SEQ ID NO: 3608795 - RNA, 18 nt, Salmonella enterica enterica serovar Typhi
caacuauuaauucuuuua

SEQ ID NO: 3608796 - RNA, 13 nt, Salmonella enterica enterica serovar Typhi
caacucagcaaua

SEQ ID NO: 3608797 - RNA, 15 nt, Salmonella enterica enterica serovar Typhi
caacucauccaccuu

SEQ ID NO: 3608798 - RNA, 21 nt, Salmonella enterica enterica serovar Typhi
caacucgaauuauuuaggguu

SEQ ID NO: 3608799 - RNA, 22 nt, Salmonella enterica enterica serovar Typhi
caacucgcacaguacaccugca

SEQ ID NO: 3608800 - RNA, 13 nt, Salmonella enterica enterica serovar Typhi
caacucgcacuga

SEQ ID NO: 3608801 - RNA, 22 nt, Salmonella enterica enterica serovar Typhi
caacucgccgguuuuuuuacuc

SEQ ID NO: 3608802 - RNA, 20 nt, Salmonella enterica enterica serovar Typhi
caacucugugcguucgcgaa

SEQ ID NO: 3608803 - RNA, 19 nt, Salmonella enterica enterica serovar Typhi
caacucuuuacccagcggg

SEQ ID NO: 3608804 - RNA, 21 nt, Salmonella enterica enterica serovar Typhi
caacucuuuacccagcgggug

SEQ ID NO: 3608805 - RNA, 18 nt, Salmonella enterica enterica serovar Typhi
caacugauuaaucugccg

SEQ ID NO: 3608806 - RNA, 16 nt, Salmonella enterica enterica serovar Typhi
caacugcgccugaaga

SEQ ID NO: 3608807 - RNA, 19 nt, Salmonella enterica enterica serovar Typhi
caacugcugcgcgugcugu

SEQ ID NO: 3608808 - RNA, 20 nt, Salmonella enterica enterica serovar Typhi
caacugcugcgcgugcugua

SEQ ID NO: 3608809 - RNA, 12 nt, Salmonella enterica enterica serovar Typhi
caacuggaagcg

SEQ ID NO: 3608810 - RNA, 15 nt, Salmonella enterica enterica serovar Typhi
caacugggcuugcau

SEQ ID NO: 3608811 - RNA, 17 nt, Salmonella enterica enterica serovar Typhi
caacuguacgccacggc

SEQ ID NO: 3608812 - RNA, 17 nt, Salmonella enterica enterica serovar Typhi
caacuguucuucgguuu

SEQ ID NO: 3608813 - RNA, 22 nt, Salmonella enterica enterica serovar Typhi
caacuguuuuaccaaaucaaua

SEQ ID NO: 3608814 - RNA, 12 nt, Salmonella enterica enterica serovar Typhi
caaguuuauccg

SEQ ID NO: 3608815 - RNA, 21 nt, Salmonella enterica enterica serovar Typhi
caaguuuggcaaucaaaucca

SEQ ID NO: 3608816 - RNA, 20 nt, Salmonella enterica enterica serovar Typhi
caauaaaaauaucauuaaau

SEQ ID NO: 3608817 - RNA, 16 nt, Salmonella enterica enterica serovar Typhi
caauaaaauuauccag

SEQ ID NO: 3608818 - RNA, 14 nt, Salmonella enterica enterica serovar Typhi
caauaaacagcucc

SEQ ID NO: 3608819 - RNA, 16 nt, Salmonella enterica enterica serovar Typhi
caauaaacgccagguu

SEQ ID NO: 3608820 - RNA, 13 nt, Salmonella enterica enterica serovar Typhi
caauaaacuggag

SEQ ID NO: 3608821 - RNA, 12 nt, Salmonella enterica enterica serovar Typhi
caauaaacuggc

SEQ ID NO: 3608822 - RNA, 13 nt, Salmonella enterica enterica serovar Typhi
caauaaagcaggg

SEQ ID NO: 3608823 - RNA, 19 nt, Salmonella enterica enterica serovar Typhi
caauaacagccagcgggcg

SEQ ID NO: 3608824 - RNA, 19 nt, Salmonella enterica enterica serovar Typhi
caauaacgcauucaccuuc

SEQ ID NO: 3608825 - RNA, 17 nt, Salmonella enterica enterica serovar Typhi
caauaacucaauagcgg

SEQ ID NO: 3608826 - RNA, 17 nt, Salmonella enterica enterica serovar Typhi
caauaagcgguaauaau

SEQ ID NO: 3608827 - RNA, 17 nt, Salmonella enterica enterica serovar Typhi
caauaagugauccauac

SEQ ID NO: 3608828 - RNA, 21 nt, Salmonella enterica enterica serovar Typhi
caauaaguuagcuuuuuuaug

SEQ ID NO: 3608829 - RNA, 21 nt, Salmonella enterica enterica serovar Typhi
caauaauauguuccacaauca

SEQ ID NO: 3608830 - RNA, 19 nt, Salmonella enterica enterica serovar Typhi
caauaaucccuucuuuuac

SEQ ID NO: 3608831 - RNA, 18 nt, Salmonella enterica enterica serovar Typhi
caauaaugccgccgucgc

SEQ ID NO: 3608832 - RNA, 19 nt, Salmonella enterica enterica serovar Typhi
caauaauggagaugaaaau

SEQ ID NO: 3608833 - RNA, 14 nt, Salmonella enterica enterica serovar Typhi
caauaauggcgcga

SEQ ID NO: 3608834 - RNA, 22 nt, Salmonella enterica enterica serovar Typhi
caauaauuuuaccauucagcuu

SEQ ID NO: 3608835 - RNA, 22 nt, Salmonella enterica enterica serovar Typhi
caauacagcccgccagcaccag

SEQ ID NO: 3608836 - RNA, 18 nt, Salmonella enterica enterica serovar Typhi
caauaccacaaccggaau

SEQ ID NO: 3608837 - RNA, 14 nt, Salmonella enterica enterica serovar Typhi
caauacccagcgcc

SEQ ID NO: 3608838 - RNA, 23 nt, Salmonella enterica enterica serovar Typhi
caauaccuguaaacgcuucugcg

SEQ ID NO: 3608839 - RNA, 19 nt, Salmonella enterica enterica serovar Typhi
caauacgaucggcuggaau

SEQ ID NO: 3608840 - RNA, 23 nt, Salmonella enterica enterica serovar Typhi
caauacgcgucagccuaccgcuu

SEQ ID NO: 3608841 - RNA, 23 nt, Salmonella enterica enterica serovar Typhi
caauacucacuaucacacuggcg

SEQ ID NO: 3608842 - RNA, 20 nt, Salmonella enterica enterica serovar Typhi
caauacuccacaguucaaug

SEQ ID NO: 3608843 - RNA, 22 nt, Salmonella enterica enterica serovar Typhi
caauacuggaccccagauaaua

SEQ ID NO: 3608844 - RNA, 22 nt, Salmonella enterica enterica serovar Typhi
caauacuuuuugacuccugaca

SEQ ID NO: 3608845 - RNA, 15 nt, Salmonella enterica enterica serovar Typhi
caauagaccagcggc

SEQ ID NO: 3608846 - RNA, 20 nt, Salmonella enterica enterica serovar Typhi
caauagaccugaaaucagcc

SEQ ID NO: 3608847 - RNA, 21 nt, Salmonella enterica enterica serovar Typhi
caauagaccugaaaucagccu

SEQ ID NO: 3608848 - RNA, 16 nt, Salmonella enterica enterica serovar Typhi
caauagacuucacuuu

SEQ ID NO: 3608849 - RNA, 20 nt, Salmonella enterica enterica serovar Typhi
caauagagagcgacagcccg

SEQ ID NO: 3608850 - RNA, 21 nt, Salmonella enterica enterica serovar Typhi
caauagagugcgauuugacau

SEQ ID NO: 3608851 - RNA, 20 nt, Salmonella enterica enterica serovar Typhi
caauagcagcuucacgcgcu

SEQ ID NO: 3608852 - RNA, 19 nt, Salmonella enterica enterica serovar Typhi
caauagccaauaacgucug

SEQ ID NO: 3608853 - RNA, 16 nt, Salmonella enterica enterica serovar Typhi
caauagcgagaggcaa

SEQ ID NO: 3608854 - RNA, 18 nt, Salmonella enterica enterica serovar Typhi
caauagcgagaggcaauu

SEQ ID NO: 3608855 - RNA, 15 nt, Salmonella enterica enterica serovar Typhi
caauagcgcuaaaca

SEQ ID NO: 3608856 - RNA, 21 nt, Salmonella enterica enterica serovar Typhi
caauagcgcuaaacagcgccg

SEQ ID NO: 3608857 - RNA, 19 nt, Salmonella enterica enterica serovar Typhi
caauagguugaaagaggaa

SEQ ID NO: 3608858 - RNA, 14 nt, Salmonella enterica enterica serovar Typhi
caauaguauccaua

SEQ ID NO: 3608859 - RNA, 23 nt, Salmonella enterica enterica serovar Typhi
caauaguuaauguugaaccguca

SEQ ID NO: 3608860 - RNA, 16 nt, Salmonella enterica enterica serovar Typhi
caauauagccguggcu

SEQ ID NO: 3608861 - RNA, 21 nt, Salmonella enterica enterica serovar Typhi
caauauaguugagccauucca

SEQ ID NO: 3608862 - RNA, 18 nt, Salmonella enterica enterica serovar Typhi
caauaucaacgaccgucg

SEQ ID NO: 3608863 - RNA, 21 nt, Salmonella enterica enterica serovar Typhi
caauaucagccauuaaccaga

SEQ ID NO: 3608864 - RNA, 17 nt, Salmonella enterica enterica serovar Typhi
caauauccgccccgcug

SEQ ID NO: 3608865 - RNA, 20 nt, Salmonella enterica enterica serovar Typhi
caauauccgccccgcuggcu

SEQ ID NO: 3608866 - RNA, 13 nt, Salmonella enterica enterica serovar Typhi
caauauccuccgg

SEQ ID NO: 3608867 - RNA, 19 nt, Salmonella enterica enterica serovar Typhi
caauaucgcggcaaagaaa

SEQ ID NO: 3608868 - RNA, 16 nt, Salmonella enterica enterica serovar Typhi
caauaucguugccgcc

SEQ ID NO: 3608869 - RNA, 12 nt, Salmonella enterica enterica serovar Typhi
caauaugcuguu

SEQ ID NO: 3608870 - RNA, 21 nt, Salmonella enterica enterica serovar Typhi
caauaugcuguuuauggcgcu

SEQ ID NO: 3608871 - RNA, 22 nt, Salmonella enterica enterica serovar Typhi
caauaugguauucgugcaucag

SEQ ID NO: 3608872 - RNA, 22 nt, Salmonella enterica enterica serovar Typhi
caauaugguuauccagcaggua

SEQ ID NO: 3608873 - RNA, 18 nt, Salmonella enterica enterica serovar Typhi
caauaugucuuaaacagc

SEQ ID NO: 3608874 - RNA, 15 nt, Salmonella enterica enterica serovar Typhi
caauauguuuaaaga

SEQ ID NO: 3608875 - RNA, 20 nt, Salmonella enterica enterica serovar Typhi
caauauuaaugcugcguuua

SEQ ID NO: 3608876 - RNA, 20 nt, Salmonella enterica enterica serovar Typhi
caauauuacaaagcaguaaa

SEQ ID NO: 3608877 - RNA, 20 nt, Salmonella enterica enterica serovar Typhi
caauauucacgcgaauuccu

SEQ ID NO: 3608878 - RNA, 20 nt, Salmonella enterica enterica serovar Typhi
caauauuccgaaagaaagac

SEQ ID NO: 3608879 - RNA, 12 nt, Salmonella enterica enterica serovar Typhi
caauauuccugg

SEQ ID NO: 3608880 - RNA, 12 nt, Salmonella enterica enterica serovar Typhi
caauauuuuucc

SEQ ID NO: 3608881 - RNA, 13 nt, Salmonella enterica enterica serovar Typhi
caauauuuuuccg

SEQ ID NO: 3608882 - RNA, 21 nt, Salmonella enterica enterica serovar Typhi
caaucaccugaugcccauacg

SEQ ID NO: 3608883 - RNA, 19 nt, Salmonella enterica enterica serovar Typhi
caaucacguuauagccgcc

SEQ ID NO: 3608884 - RNA, 21 nt, Salmonella enterica enterica serovar Typhi
caaucacguuuugcagcgcca

SEQ ID NO: 3608885 - RNA, 15 nt, Salmonella enterica enterica serovar Typhi
caaucacucucuugu

SEQ ID NO: 3608886 - RNA, 22 nt, Salmonella enterica enterica serovar Typhi
caaucacugaugccacacccug

SEQ ID NO: 3608887 - RNA, 22 nt, Salmonella enterica enterica serovar Typhi
caaucacuuuugcgacccacaa

SEQ ID NO: 3608888 - RNA, 14 nt, Salmonella enterica enterica serovar Typhi
caaucagcaccauu

SEQ ID NO: 3608889 - RNA, 19 nt, Salmonella enterica enterica serovar Typhi
caaucagguauuuccugcu

SEQ ID NO: 3608890 - RNA, 15 nt, Salmonella enterica enterica serovar Typhi
caaucaguacgcgcg

SEQ ID NO: 3608891 - RNA, 20 nt, Salmonella enterica enterica serovar Typhi
caaucaguacgcgcgcggcg

SEQ ID NO: 3608892 - RNA, 15 nt, Salmonella enterica enterica serovar Typhi
caaucaguuccaauc

SEQ ID NO: 3608893 - RNA, 17 nt, Salmonella enterica enterica serovar Typhi
caaucaguucucgcgcc

SEQ ID NO: 3608894 - RNA, 18 nt, Salmonella enterica enterica serovar Typhi
caaucauaaacgccugac

SEQ ID NO: 3608895 - RNA, 13 nt, Salmonella enterica enterica serovar Typhi
caaucauaauaaa

SEQ ID NO: 3608896 - RNA, 21 nt, Salmonella enterica enterica serovar Typhi
caaucaucagaccgauaaaua

SEQ ID NO: 3608897 - RNA, 20 nt, Salmonella enterica enterica serovar Typhi
caaucauugugguuucccug

SEQ ID NO: 3608898 - RNA, 17 nt, Salmonella enterica enterica serovar Typhi
caauccacggguuacaa

SEQ ID NO: 3608899 - RNA, 16 nt, Salmonella enterica enterica serovar Typhi
caauuucuuuguuaga

SEQ ID NO: 3608900 - RNA, 13 nt, Salmonella enterica enterica serovar Typhi
caauuugaaaagg

SEQ ID NO: 3608901 - RNA, 17 nt, Salmonella enterica enterica serovar Typhi
caauuugcccagcgcug

SEQ ID NO: 3608902 - RNA, 22 nt, Salmonella enterica enterica serovar Typhi
caauuugguuagggaucaucuu

SEQ ID NO: 3608903 - RNA, 23 nt, Salmonella enterica enterica serovar Typhi
caauuugugagauaaaaaagcug

SEQ ID NO: 3608904 - RNA, 15 nt, Salmonella enterica enterica serovar Typhi
caauuuuaagaauau

SEQ ID NO: 3608905 - RNA, 18 nt, Salmonella enterica enterica serovar Typhi
caauuuuacagccucucu

SEQ ID NO: 3608906 - RNA, 13 nt, Salmonella enterica enterica serovar Typhi
caauuuucuucau

SEQ ID NO: 3608907 - RNA, 19 nt, Salmonella enterica enterica serovar Typhi
caauuuugauaagagaaaa

SEQ ID NO: 3608908 - RNA, 18 nt, Salmonella enterica enterica serovar Typhi
caauuuugccgcaucgau

SEQ ID NO: 3608909 - RNA, 21 nt, Salmonella enterica enterica serovar Typhi
caauuuuuacaaauuuaaaca

SEQ ID NO: 3608910 - RNA, 16 nt, Salmonella enterica enterica serovar Typhi
cacaaaacccgcagcc

SEQ ID NO: 3608911 - RNA, 20 nt, Salmonella enterica enterica serovar Typhi
cacaaaaggauacagcgccg

SEQ ID NO: 3608912 - RNA, 21 nt, Salmonella enterica enterica serovar Typhi
cacaaacuccagacgaugaua

SEQ ID NO: 3608913 - RNA, 14 nt, Salmonella enterica enterica serovar Typhi
cacaaagaauucuu

SEQ ID NO: 3608914 - RNA, 17 nt, Salmonella enterica enterica serovar Typhi
cacaaagacgaauaagg

SEQ ID NO: 3608915 - RNA, 16 nt, Salmonella enterica enterica serovar Typhi
cacaaaggccagcagc

SEQ ID NO: 3608916 - RNA, 18 nt, Salmonella enterica enterica serovar Typhi
cacaaaucuguuaucugg

SEQ ID NO: 3608917 - RNA, 22 nt, Salmonella enterica enterica serovar Typhi
cacaaaucuguuaucuggaugu

SEQ ID NO: 3608918 - RNA, 19 nt, Salmonella enterica enterica serovar Typhi
cacaaauuucgagcagaac

SEQ ID NO: 3608919 - RNA, 21 nt, Salmonella enterica enterica serovar Typhi
cacaaauuugaauaaaacggg

SEQ ID NO: 3608920 - RNA, 17 nt, Salmonella enterica enterica serovar Typhi
cacaaauuuugauaaaa

SEQ ID NO: 3608921 - RNA, 16 nt, Salmonella enterica enterica serovar Typhi
cacaacacggcggcua

SEQ ID NO: 3608922 - RNA, 17 nt, Salmonella enterica enterica serovar Typhi
cacaacagaagcggccu

SEQ ID NO: 3608923 - RNA, 21 nt, Salmonella enterica enterica serovar Typhi
cacaacauuccgcuuccagaa

SEQ ID NO: 3608924 - RNA, 13 nt, Salmonella enterica enterica serovar Typhi
cacaacccaaagg

SEQ ID NO: 3608925 - RNA, 16 nt, Salmonella enterica enterica serovar Typhi
cacaacccaaaggcca

SEQ ID NO: 3608926 - RNA, 17 nt, Salmonella enterica enterica serovar Typhi
cacaaccggcuggcuau

SEQ ID NO: 3608927 - RNA, 14 nt, Salmonella enterica enterica serovar Typhi
cacaacgcauuggc

SEQ ID NO: 3608928 - RNA, 16 nt, Salmonella enterica enterica serovar Typhi
cacaacgcgaguauuc

SEQ ID NO: 3608929 - RNA, 14 nt, Salmonella enterica enterica serovar Typhi
cacaacgucauccc

SEQ ID NO: 3608930 - RNA, 19 nt, Salmonella enterica enterica serovar Typhi
cacaagagcagcaacccug

SEQ ID NO: 3608931 - RNA, 17 nt, Salmonella enterica enterica serovar Typhi
cacaagccccacgcccg

SEQ ID NO: 3608932 - RNA, 15 nt, Salmonella enterica enterica serovar Typhi
cacaagcuguuucuc

SEQ ID NO: 3608933 - RNA, 17 nt, Salmonella enterica enterica serovar Typhi
cacaagcuguuucuccg

SEQ ID NO: 3608934 - RNA, 15 nt, Salmonella enterica enterica serovar Typhi
cacaaguuuauccgg

SEQ ID NO: 3608935 - RNA, 18 nt, Salmonella enterica enterica serovar Typhi
cacaaguuuauccggcac

SEQ ID NO: 3608936 - RNA, 20 nt, Salmonella enterica enterica serovar Typhi
cacaauaugguuauccagca

SEQ ID NO: 3608937 - RNA, 12 nt, Salmonella enterica enterica serovar Typhi
cacaaucagcca

SEQ ID NO: 3608938 - RNA, 18 nt, Salmonella enterica enterica serovar Typhi
cacaaucagccacggcaa

SEQ ID NO: 3608939 - RNA, 20 nt, Salmonella enterica enterica serovar Typhi
cacaaucgccgugaucccaa

SEQ ID NO: 3608940 - RNA, 20 nt, Salmonella enterica enterica serovar Typhi
cacaaucgcgccugccagga

SEQ ID NO: 3608941 - RNA, 19 nt, Salmonella enterica enterica serovar Typhi
cacaaucgucgugccuucc

SEQ ID NO: 3608942 - RNA, 19 nt, Salmonella enterica enterica serovar Typhi
cacaaucuccagaccgcug

SEQ ID NO: 3608943 - RNA, 22 nt, Salmonella enterica enterica serovar Typhi
cacaaugcgacuuaucagaacu

SEQ ID NO: 3608944 - RNA, 21 nt, Salmonella enterica enterica serovar Typhi
cacaaugguugccuggugucc

SEQ ID NO: 3608945 - RNA, 22 nt, Salmonella enterica enterica serovar Typhi
cacaauguuuuuguaccaggcc

SEQ ID NO: 3608946 - RNA, 20 nt, Salmonella enterica enterica serovar Typhi
cacaauuccggcccaggcca

SEQ ID NO: 3608947 - RNA, 19 nt, Salmonella enterica enterica serovar Typhi
cacacaaucgguuaugcga

SEQ ID NO: 3608948 - RNA, 20 nt, Salmonella enterica enterica serovar Typhi
cacacagcagaaagcaacag

SEQ ID NO: 3608949 - RNA, 18 nt, Salmonella enterica enterica serovar Typhi
cacacauaagcacaccau

SEQ ID NO: 3608950 - RNA, 19 nt, Salmonella enterica enterica serovar Typhi
cacacauaucgccagccau

SEQ ID NO: 3608951 - RNA, 14 nt, Salmonella enterica enterica serovar Typhi
cacacaucacaauc

SEQ ID NO: 3608952 - RNA, 13 nt, Salmonella enterica enterica serovar Typhi
cacacaugcaaaa

SEQ ID NO: 3608953 - RNA, 15 nt, Salmonella enterica enterica serovar Typhi
cacaccauuucacaa

SEQ ID NO: 3608954 - RNA, 18 nt, Salmonella enterica enterica serovar Typhi
cacaccauuucacaaauu

SEQ ID NO: 3608955 - RNA, 17 nt, Salmonella enterica enterica serovar Typhi
cacacccgcacgccugg

SEQ ID NO: 3608956 - RNA, 21 nt, Salmonella enterica enterica serovar Typhi
cacaccggguucguaauaagg

SEQ ID NO: 3608957 - RNA, 22 nt, Salmonella enterica enterica serovar Typhi
cacaccugaugguuauuuucag

SEQ ID NO: 3608958 - RNA, 15 nt, Salmonella enterica enterica serovar Typhi
cacacggccaccaua

SEQ ID NO: 3608959 - RNA, 16 nt, Salmonella enterica enterica serovar Typhi
cacacgucugagcagg

SEQ ID NO: 3608960 - RNA, 22 nt, Salmonella enterica enterica serovar Typhi
cacacucggugcauuugucgcu

SEQ ID NO: 3608961 - RNA, 15 nt, Salmonella enterica enterica serovar Typhi
cacacuuucugcuuu

SEQ ID NO: 3608962 - RNA, 20 nt, Salmonella enterica enterica serovar Typhi
cacagaaaaaccaaaaaaua

SEQ ID NO: 3608963 - RNA, 21 nt, Salmonella enterica enterica serovar Typhi
cacagaaaaaccaaaaaauau

SEQ ID NO: 3608964 - RNA, 13 nt, Salmonella enterica enterica serovar Typhi
cacagaagcgccu

SEQ ID NO: 3608965 - RNA, 16 nt, Salmonella enterica enterica serovar Typhi
cacagacagaugcagg

SEQ ID NO: 3608966 - RNA, 19 nt, Salmonella enterica enterica serovar Typhi
cacagacccaguacaaaca

SEQ ID NO: 3608967 - RNA, 20 nt, Salmonella enterica enterica serovar Typhi
cacagagaucgugcauccgg

SEQ ID NO: 3608968 - RNA, 19 nt, Salmonella enterica enterica serovar Typhi
cacagcaccauguugacca

SEQ ID NO: 3608969 - RNA, 21 nt, Salmonella enterica enterica serovar Typhi
cacagcaccauguugaccagg

SEQ ID NO: 3608970 - RNA, 20 nt, Salmonella enterica enterica serovar Typhi
cacagcacuaacgaggccac

SEQ ID NO: 3608971 - RNA, 15 nt, Salmonella enterica enterica serovar Typhi
cacagccacacugcu

SEQ ID NO: 3608972 - RNA, 15 nt, Salmonella enterica enterica serovar Typhi
cacagccagcacgag

SEQ ID NO: 3608973 - RNA, 20 nt, Salmonella enterica enterica serovar Typhi
cacagccaucuucugcguca

SEQ ID NO: 3608974 - RNA, 16 nt, Salmonella enterica enterica serovar Typhi
cacagccccagcacca

SEQ ID NO: 3608975 - RNA, 19 nt, Salmonella enterica enterica serovar Typhi
cacagccgcauuuuuucuu

SEQ ID NO: 3608976 - RNA, 13 nt, Salmonella enterica enterica serovar Typhi
cacagccuuauaa

SEQ ID NO: 3608977 - RNA, 16 nt, Salmonella enterica enterica serovar Typhi
cacagcgccagacacu

SEQ ID NO: 3608978 - RNA, 14 nt, Salmonella enterica enterica serovar Typhi
cacagcgcgcgaca

SEQ ID NO: 3608979 - RNA, 15 nt, Salmonella enterica enterica serovar Typhi
cacagcgcuaucagg

SEQ ID NO: 3608980 - RNA, 14 nt, Salmonella enterica enterica serovar Typhi
cacagcggaauaga

SEQ ID NO: 3608981 - RNA, 21 nt, Salmonella enterica enterica serovar Typhi
cacagcguacaauggcaggca

SEQ ID NO: 3608982 - RNA, 23 nt, Salmonella enterica enterica serovar Typhi
cacagcguaggccaggcauccgg

SEQ ID NO: 3608983 - RNA, 13 nt, Salmonella enterica enterica serovar Typhi
cacaggaaccggu

SEQ ID NO: 3608984 - RNA, 15 nt, Salmonella enterica enterica serovar Typhi
caccagaaucgccag

SEQ ID NO: 3608985 - RNA, 17 nt, Salmonella enterica enterica serovar Typhi
caccagaaucgccagca

SEQ ID NO: 3608986 - RNA, 20 nt, Salmonella enterica enterica serovar Typhi
caccagaaucgccagcaucg

SEQ ID NO: 3608987 - RNA, 12 nt, Salmonella enterica enterica serovar Typhi
caccagacgcug

SEQ ID NO: 3608988 - RNA, 20 nt, Salmonella enterica enterica serovar Typhi
caccagacuaaaacgugcug

SEQ ID NO: 3608989 - RNA, 14 nt, Salmonella enterica enterica serovar Typhi
caccagaucggcau

SEQ ID NO: 3608990 - RNA, 16 nt, Salmonella enterica enterica serovar Typhi
caccagcacagcccag

SEQ ID NO: 3608991 - RNA, 18 nt, Salmonella enterica enterica serovar Typhi
caccagcacgaugcauau

SEQ ID NO: 3608992 - RNA, 19 nt, Salmonella enterica enterica serovar Typhi
caccagcagggcaugauua

SEQ ID NO: 3608993 - RNA, 13 nt, Salmonella enterica enterica serovar Typhi
caccagcaucacg

SEQ ID NO: 3608994 - RNA, 13 nt, Salmonella enterica enterica serovar Typhi
caccagcccaacg

SEQ ID NO: 3608995 - RNA, 12 nt, Salmonella enterica enterica serovar Typhi
caccagcccauc

SEQ ID NO: 3608996 - RNA, 14 nt, Salmonella enterica enterica serovar Typhi
caccagccguucac

SEQ ID NO: 3608997 - RNA, 12 nt, Salmonella enterica enterica serovar Typhi
caccagcgaucc

SEQ ID NO: 3608998 - RNA, 21 nt, Salmonella enterica enterica serovar Typhi
caccagcgauuuuuacgccau

SEQ ID NO: 3608999 - RNA, 11 nt, Salmonella enterica enterica serovar Typhi
caccagcgcca

SEQ ID NO: 3609000 - RNA, 13 nt, Salmonella enterica enterica serovar Typhi
caccagcgccaga

SEQ ID NO: 3609001 - RNA, 13 nt, Salmonella enterica enterica serovar Typhi
caccagcgcgccg

SEQ ID NO: 3609002 - RNA, 19 nt, Salmonella enterica enterica serovar Typhi
caccagcgcgccgccgccc

SEQ ID NO: 3609003 - RNA, 15 nt, Salmonella enterica enterica serovar Typhi
caccagcgcggcaca

SEQ ID NO: 3609004 - RNA, 18 nt, Salmonella enterica enterica serovar Typhi
caccagcggaauccccgc

SEQ ID NO: 3609005 - RNA, 15 nt, Salmonella enterica enterica serovar Typhi
caccagcgucgcaug

SEQ ID NO: 3609006 - RNA, 16 nt, Salmonella enterica enterica serovar Typhi
caccagcgucgcaugg

SEQ ID NO: 3609007 - RNA, 20 nt, Salmonella enterica enterica serovar Typhi
caccagcuuaucgggaugau

SEQ ID NO: 3609008 - RNA, 15 nt, Salmonella enterica enterica serovar Typhi
caccagcuuaucuga

SEQ ID NO: 3609009 - RNA, 21 nt, Salmonella enterica enterica serovar Typhi
caccaggaaugcggccauccu

SEQ ID NO: 3609010 - RNA, 20 nt, Salmonella enterica enterica serovar Typhi
caccaggcguaagaucccag

SEQ ID NO: 3609011 - RNA, 17 nt, Salmonella enterica enterica serovar Typhi
caccagggauuuugcuu

SEQ ID NO: 3609012 - RNA, 17 nt, Salmonella enterica enterica serovar Typhi
caccagguucagcaacg

SEQ ID NO: 3609013 - RNA, 21 nt, Salmonella enterica enterica serovar Typhi
caccaguaaccgccacagcau

SEQ ID NO: 3609014 - RNA, 19 nt, Salmonella enterica enterica serovar Typhi
caccaguagcgcgacgcca

SEQ ID NO: 3609015 - RNA, 15 nt, Salmonella enterica enterica serovar Typhi
caccagucccagccc

SEQ ID NO: 3609016 - RNA, 18 nt, Salmonella enterica enterica serovar Typhi
caccagucgaccgcagac

SEQ ID NO: 3609017 - RNA, 20 nt, Salmonella enterica enterica serovar Typhi
caccagugauuggcuggaca

SEQ ID NO: 3609018 - RNA, 20 nt, Salmonella enterica enterica serovar Typhi
caccauaaagcgaauaauua

SEQ ID NO: 3609019 - RNA, 22 nt, Salmonella enterica enterica serovar Typhi
caccauaauuaccggcacaccg

SEQ ID NO: 3609020 - RNA, 17 nt, Salmonella enterica enterica serovar Typhi
caccauaucgcagacca

SEQ ID NO: 3609021 - RNA, 14 nt, Salmonella enterica enterica serovar Typhi
caccauaucuucca

SEQ ID NO: 3609022 - RNA, 14 nt, Salmonella enterica enterica serovar Typhi
caccauaucuuuca

SEQ ID NO: 3609023 - RNA, 19 nt, Salmonella enterica enterica serovar Typhi
caccaucaugcaagagucc

SEQ ID NO: 3609024 - RNA, 23 nt, Salmonella enterica enterica serovar Typhi
caccauccggcgcugcgcggcgu

SEQ ID NO: 3609025 - RNA, 19 nt, Salmonella enterica enterica serovar Typhi
caccaucgucgccagaccc

SEQ ID NO: 3609026 - RNA, 20 nt, Salmonella enterica enterica serovar Typhi
caccaucguugccagcggcc

SEQ ID NO: 3609027 - RNA, 16 nt, Salmonella enterica enterica serovar Typhi
caccaucuuuuccggc

SEQ ID NO: 3609028 - RNA, 19 nt, Salmonella enterica enterica serovar Typhi
caccaucuuuuccggcagg

SEQ ID NO: 3609029 - RNA, 13 nt, Salmonella enterica enterica serovar Typhi
caccaucuuuuug

SEQ ID NO: 3609030 - RNA, 15 nt, Salmonella enterica enterica serovar Typhi
caccaucuuuuugcu

SEQ ID NO: 3609031 - RNA, 14 nt, Salmonella enterica enterica serovar Typhi
caccaugcaaaaug

SEQ ID NO: 3609032 - RNA, 18 nt, Salmonella enterica enterica serovar Typhi
caccauguggcgcggccu

SEQ ID NO: 3609033 - RNA, 15 nt, Salmonella enterica enterica serovar Typhi
caccauguugcgcag

SEQ ID NO: 3609034 - RNA, 16 nt, Salmonella enterica enterica serovar Typhi
caccauuaucgcuccg

SEQ ID NO: 3609035 - RNA, 16 nt, Salmonella enterica enterica serovar Typhi
caccauucccagcgcc

SEQ ID NO: 3609036 - RNA, 12 nt, Salmonella enterica enterica serovar Typhi
caccauucuuca

SEQ ID NO: 3609037 - RNA, 14 nt, Salmonella enterica enterica serovar Typhi
caccauuucacaaa

SEQ ID NO: 3609038 - RNA, 15 nt, Salmonella enterica enterica serovar Typhi
cacccaauaaauaau

SEQ ID NO: 3609039 - RNA, 14 nt, Salmonella enterica enterica serovar Typhi
cacccacugcacau

SEQ ID NO: 3609040 - RNA, 18 nt, Salmonella enterica enterica serovar Typhi
cacccauagauaccuucu

SEQ ID NO: 3609041 - RNA, 19 nt, Salmonella enterica enterica serovar Typhi
cacccaucgcgacaucgcc

SEQ ID NO: 3609042 - RNA, 16 nt, Salmonella enterica enterica serovar Typhi
cacccauugaacccga

SEQ ID NO: 3609043 - RNA, 22 nt, Salmonella enterica enterica serovar Typhi
cacccauugaacccgaccgucu

SEQ ID NO: 3609044 - RNA, 20 nt, Salmonella enterica enterica serovar Typhi
cacccauuuuauccucuuca

SEQ ID NO: 3609045 - RNA, 21 nt, Salmonella enterica enterica serovar Typhi
cacccauuuuauccucuucaa

SEQ ID NO: 3609046 - RNA, 21 nt, Salmonella enterica enterica serovar Typhi
caccccaaaucucccccggca

SEQ ID NO: 3609047 - RNA, 11 nt, Salmonella enterica enterica serovar Typhi
caccccagccu

SEQ ID NO: 3609048 - RNA, 14 nt, Salmonella enterica enterica serovar Typhi
cacccccaucgccc

SEQ ID NO: 3609049 - RNA, 18 nt, Salmonella enterica enterica serovar Typhi
cacccgaaagucaaaaua

SEQ ID NO: 3609050 - RNA, 18 nt, Salmonella enterica enterica serovar Typhi
cacccgauaaaaucaucg

SEQ ID NO: 3609051 - RNA, 19 nt, Salmonella enterica enterica serovar Typhi
cacccgcacuaccagcucg

SEQ ID NO: 3609052 - RNA, 12 nt, Salmonella enterica enterica serovar Typhi
cacccgccggca

SEQ ID NO: 3609053 - RNA, 13 nt, Salmonella enterica enterica serovar Typhi
cacccgccuuacc

SEQ ID NO: 3609054 - RNA, 17 nt, Salmonella enterica enterica serovar Typhi
cacccgcucgcugcauu

SEQ ID NO: 3609055 - RNA, 18 nt, Salmonella enterica enterica serovar Typhi
cacccggcugacugccgu

SEQ ID NO: 3609056 - RNA, 13 nt, Salmonella enterica enterica serovar Typhi
cacccuauaagcu

SEQ ID NO: 3609057 - RNA, 19 nt, Salmonella enterica enterica serovar Typhi
cacccuauuuugcgccugg

SEQ ID NO: 3609058 - RNA, 20 nt, Salmonella enterica enterica serovar Typhi
cacccuauuuugcgccuggg

SEQ ID NO: 3609059 - RNA, 11 nt, Salmonella enterica enterica serovar Typhi
cacccucugcg

SEQ ID NO: 3609060 - RNA, 12 nt, Salmonella enterica enterica serovar Typhi
cacccugccccg

SEQ ID NO: 3609061 - RNA, 22 nt, Salmonella enterica enterica serovar Typhi
cacccuucuucuggcucagacc

SEQ ID NO: 3609062 - RNA, 13 nt, Salmonella enterica enterica serovar Typhi
caccgacacaaau

SEQ ID NO: 3609063 - RNA, 14 nt, Salmonella enterica enterica serovar Typhi
caccgaggguuugu

SEQ ID NO: 3609064 - RNA, 22 nt, Salmonella enterica enterica serovar Typhi
caccgauacaggacugacugcu

SEQ ID NO: 3609065 - RNA, 23 nt, Salmonella enterica enterica serovar Typhi
caccgauuucaucgcugaauuug

SEQ ID NO: 3609066 - RNA, 16 nt, Salmonella enterica enterica serovar Typhi
caccgcauagacgugc

SEQ ID NO: 3609067 - RNA, 15 nt, Salmonella enterica enterica serovar Typhi
caccgcauccgcauc

SEQ ID NO: 3609068 - RNA, 15 nt, Salmonella enterica enterica serovar Typhi
caccgccacuuccgc

SEQ ID NO: 3609069 - RNA, 13 nt, Salmonella enterica enterica serovar Typhi
caccgccagacgc

SEQ ID NO: 3609070 - RNA, 12 nt, Salmonella enterica enterica serovar Typhi
caccuugcugcg

SEQ ID NO: 3609071 - RNA, 23 nt, Salmonella enterica enterica serovar Typhi
caccuuuacuuaauucugcugcc

SEQ ID NO: 3609072 - RNA, 15 nt, Salmonella enterica enterica serovar Typhi
caccuuucugccagg

SEQ ID NO: 3609073 - RNA, 21 nt, Salmonella enterica enterica serovar Typhi
caccuuugaaaaucacaucgc

SEQ ID NO: 3609074 - RNA, 22 nt, Salmonella enterica enterica serovar Typhi
caccuuugaacgucgcugauag

SEQ ID NO: 3609075 - RNA, 18 nt, Salmonella enterica enterica serovar Typhi
caccuuuuuauuuacugc

SEQ ID NO: 3609076 - RNA, 20 nt, Salmonella enterica enterica serovar Typhi
caccuuuuuauuuacugccg

SEQ ID NO: 3609077 - RNA, 21 nt, Salmonella enterica enterica serovar Typhi
caccuuuuuauuuacugccgu

SEQ ID NO: 3609078 - RNA, 13 nt, Salmonella enterica enterica serovar Typhi
cacgaaaaauaaa

SEQ ID NO: 3609079 - RNA, 17 nt, Salmonella enterica enterica serovar Typhi
cacgaaaaauaaaaaaa

SEQ ID NO: 3609080 - RNA, 21 nt, Salmonella enterica enterica serovar Typhi
cacgaaauaacgcacuaccag

SEQ ID NO: 3609081 - RNA, 17 nt, Salmonella enterica enterica serovar Typhi
cacgaacgauauaaaaa

SEQ ID NO: 3609082 - RNA, 15 nt, Salmonella enterica enterica serovar Typhi
cacgaagcuccagua

SEQ ID NO: 3609083 - RNA, 13 nt, Salmonella enterica enterica serovar Typhi
cacgaaucaggau

SEQ ID NO: 3609084 - RNA, 13 nt, Salmonella enterica enterica serovar Typhi
cacgaaugucgcg

SEQ ID NO: 3609085 - RNA, 18 nt, Salmonella enterica enterica serovar Typhi
cacgaaugucgcgucagg

SEQ ID NO: 3609086 - RNA, 15 nt, Salmonella enterica enterica serovar Typhi
cacgacagugcuaua

SEQ ID NO: 3609087 - RNA, 13 nt, Salmonella enterica enterica serovar Typhi
cacgacgccgccg

SEQ ID NO: 3609088 - RNA, 19 nt, Salmonella enterica enterica serovar Typhi
cacgacgcucauuaacgac

SEQ ID NO: 3609089 - RNA, 15 nt, Salmonella enterica enterica serovar Typhi
cacgacuuucaccag

SEQ ID NO: 3609090 - RNA, 13 nt, Salmonella enterica enterica serovar Typhi
cacgagugauccc

SEQ ID NO: 3609091 - RNA, 21 nt, Salmonella enterica enterica serovar Typhi
cacgauaaccagaucggcuau

SEQ ID NO: 3609092 - RNA, 17 nt, Salmonella enterica enterica serovar Typhi
cacgauacgccccugcu

SEQ ID NO: 3609093 - RNA, 24 nt, Salmonella enterica enterica serovar Typhi
cacgauagacagcaccaucaugca

SEQ ID NO: 3609094 - RNA, 11 nt, Salmonella enterica enterica serovar Typhi
cacgaucaucg

SEQ ID NO: 3609095 - RNA, 20 nt, Salmonella enterica enterica serovar Typhi
cacgaucgagucaggcgcca

SEQ ID NO: 3609096 - RNA, 15 nt, Salmonella enterica enterica serovar Typhi
cacgaugcauaugca

SEQ ID NO: 3609097 - RNA, 12 nt, Salmonella enterica enterica serovar Typhi
cacgauggcaaa

SEQ ID NO: 3609098 - RNA, 16 nt, Salmonella enterica enterica serovar Typhi
cacgcaaaauggccug

SEQ ID NO: 3609099 - RNA, 14 nt, Salmonella enterica enterica serovar Typhi
cacgcaacaggccg

SEQ ID NO: 3609100 - RNA, 15 nt, Salmonella enterica enterica serovar Typhi
cacgcaaugccugac

SEQ ID NO: 3609101 - RNA, 22 nt, Salmonella enterica enterica serovar Typhi
cacgcaaugccugaccaacguc

SEQ ID NO: 3609102 - RNA, 22 nt, Salmonella enterica enterica serovar Typhi
cacgcacaucccgaauacgcug

SEQ ID NO: 3609103 - RNA, 19 nt, Salmonella enterica enterica serovar Typhi
cacgcacgacagugcuaua

SEQ ID NO: 3609104 - RNA, 24 nt, Salmonella enterica enterica serovar Typhi
cacgcagacgccgcgguugacggc

SEQ ID NO: 3609105 - RNA, 20 nt, Salmonella enterica enterica serovar Typhi
cacgcagauaucuuccagcg

SEQ ID NO: 3609106 - RNA, 13 nt, Salmonella enterica enterica serovar Typhi
cacgcagccaugu

SEQ ID NO: 3609107 - RNA, 24 nt, Salmonella enterica enterica serovar Typhi
cacgcagcgcagaccgagcgcaug

SEQ ID NO: 3609108 - RNA, 21 nt, Salmonella enterica enterica serovar Typhi
cacgcagcgcauccaccagac

SEQ ID NO: 3609109 - RNA, 21 nt, Salmonella enterica enterica serovar Typhi
cacgcagcgccuuaucgagug

SEQ ID NO: 3609110 - RNA, 15 nt, Salmonella enterica enterica serovar Typhi
cacgcaguccaacaa

SEQ ID NO: 3609111 - RNA, 23 nt, Salmonella enterica enterica serovar Typhi
cacgcaucgggucgcgcgccgca

SEQ ID NO: 3609112 - RNA, 18 nt, Salmonella enterica enterica serovar Typhi
cacgcauucuuuuuucuc

SEQ ID NO: 3609113 - RNA, 21 nt, Salmonella enterica enterica serovar Typhi
cacgccacaguauuccggcau

SEQ ID NO: 3609114 - RNA, 11 nt, Salmonella enterica enterica serovar Typhi
cacgccaccgg

SEQ ID NO: 3609115 - RNA, 15 nt, Salmonella enterica enterica serovar Typhi
cacgccagauaaauc

SEQ ID NO: 3609116 - RNA, 13 nt, Salmonella enterica enterica serovar Typhi
cacgccagcagcu

SEQ ID NO: 3609117 - RNA, 12 nt, Salmonella enterica enterica serovar Typhi
cacgccagcggu

SEQ ID NO: 3609118 - RNA, 20 nt, Salmonella enterica enterica serovar Typhi
cacgccaucgacaaaggcaa

SEQ ID NO: 3609119 - RNA, 17 nt, Salmonella enterica enterica serovar Typhi
cacgccauggccgcagc

SEQ ID NO: 3609120 - RNA, 20 nt, Salmonella enterica enterica serovar Typhi
cacgccauggccgcagcccg

SEQ ID NO: 3609121 - RNA, 11 nt, Salmonella enterica enterica serovar Typhi
cacgcccagcg

SEQ ID NO: 3609122 - RNA, 17 nt, Salmonella enterica enterica serovar Typhi
cacgccccuaaggcagc

SEQ ID NO: 3609123 - RNA, 13 nt, Salmonella enterica enterica serovar Typhi
cacgcccgcagca

SEQ ID NO: 3609124 - RNA, 15 nt, Salmonella enterica enterica serovar Typhi
cacgcccugaagggc

SEQ ID NO: 3609125 - RNA, 17 nt, Salmonella enterica enterica serovar Typhi
cacgccgcacacagcag

SEQ ID NO: 3609126 - RNA, 14 nt, Salmonella enterica enterica serovar Typhi
cacgccgccaaagc

SEQ ID NO: 3609127 - RNA, 19 nt, Salmonella enterica enterica serovar Typhi
cacgccgccauccggcacu

SEQ ID NO: 3609128 - RNA, 18 nt, Salmonella enterica enterica serovar Typhi
cacgccgcccgccugagc

SEQ ID NO: 3609129 - RNA, 16 nt, Salmonella enterica enterica serovar Typhi
cacgccgccgccgacc

SEQ ID NO: 3609130 - RNA, 12 nt, Salmonella enterica enterica serovar Typhi
cacgccgcgcug

SEQ ID NO: 3609131 - RNA, 16 nt, Salmonella enterica enterica serovar Typhi
cacgccgcuacugccg

SEQ ID NO: 3609132 - RNA, 19 nt, Salmonella enterica enterica serovar Typhi
cacgccgcuaucgaccagc

SEQ ID NO: 3609133 - RNA, 21 nt, Salmonella enterica enterica serovar Typhi
cacgccgcuaucgaccagcac

SEQ ID NO: 3609134 - RNA, 23 nt, Salmonella enterica enterica serovar Typhi
cacgccgcuaucgaccagcaccu

SEQ ID NO: 3609135 - RNA, 14 nt, Salmonella enterica enterica serovar Typhi
cacgccgcuccaca

SEQ ID NO: 3609136 - RNA, 16 nt, Salmonella enterica enterica serovar Typhi
cacgccgcuccacagc

SEQ ID NO: 3609137 - RNA, 18 nt, Salmonella enterica enterica serovar Typhi
cacgccggaaagaauaau

SEQ ID NO: 3609138 - RNA, 21 nt, Salmonella enterica enterica serovar Typhi
cacgccggaaucgcgauccag

SEQ ID NO: 3609139 - RNA, 14 nt, Salmonella enterica enterica serovar Typhi
cacgccguagcugc

SEQ ID NO: 3609140 - RNA, 21 nt, Salmonella enterica enterica serovar Typhi
cacgccguagcugcgcgccgc

SEQ ID NO: 3609141 - RNA, 20 nt, Salmonella enterica enterica serovar Typhi
cacgccgugaauuucugcug

SEQ ID NO: 3609142 - RNA, 21 nt, Salmonella enterica enterica serovar Typhi
cacgccgugaauuucugcugc

SEQ ID NO: 3609143 - RNA, 17 nt, Salmonella enterica enterica serovar Typhi
cacgccuaaugaagcgc

SEQ ID NO: 3609144 - RNA, 22 nt, Salmonella enterica enterica serovar Typhi
cacgccucuggcguacgcagau

SEQ ID NO: 3609145 - RNA, 14 nt, Salmonella enterica enterica serovar Typhi
cacgccugcuucac

SEQ ID NO: 3609146 - RNA, 13 nt, Salmonella enterica enterica serovar Typhi
cacgccuuccucc

SEQ ID NO: 3609147 - RNA, 13 nt, Salmonella enterica enterica serovar Typhi
cacgcgaauagcc

SEQ ID NO: 3609148 - RNA, 17 nt, Salmonella enterica enterica serovar Typhi
cacgcgaauagccagac

SEQ ID NO: 3609149 - RNA, 22 nt, Salmonella enterica enterica serovar Typhi
cacgcgaauagccagacagccc

SEQ ID NO: 3609150 - RNA, 14 nt, Salmonella enterica enterica serovar Typhi
cacgcgacgccagc

SEQ ID NO: 3609151 - RNA, 14 nt, Salmonella enterica enterica serovar Typhi
cacgcgacgcgcca

SEQ ID NO: 3609152 - RNA, 16 nt, Salmonella enterica enterica serovar Typhi
cacgcgacggcccaac

SEQ ID NO: 3609153 - RNA, 18 nt, Salmonella enterica enterica serovar Typhi
cacgcgaugagcugcgau

SEQ ID NO: 3609154 - RNA, 19 nt, Salmonella enterica enterica serovar Typhi
cacgcgaugcaaccccuga

SEQ ID NO: 3609155 - RNA, 16 nt, Salmonella enterica enterica serovar Typhi
cacgcgccagcaccac

SEQ ID NO: 3609156 - RNA, 16 nt, Salmonella enterica enterica serovar Typhi
cacucacaaaacuauu

SEQ ID NO: 3609157 - RNA, 19 nt, Salmonella enterica enterica serovar Typhi
cacucacaaaacuauuuuc

SEQ ID NO: 3609158 - RNA, 14 nt, Salmonella enterica enterica serovar Typhi
cacucagaaaauua

SEQ ID NO: 3609159 - RNA, 18 nt, Salmonella enterica enterica serovar Typhi
cacucagaaaauuauuuu

SEQ ID NO: 3609160 - RNA, 21 nt, Salmonella enterica enterica serovar Typhi
cacucagaaaauuauuuuaaa

SEQ ID NO: 3609161 - RNA, 15 nt, Salmonella enterica enterica serovar Typhi
cacucauccagacca

SEQ ID NO: 3609162 - RNA, 14 nt, Salmonella enterica enterica serovar Typhi
cacucauccagcaa

SEQ ID NO: 3609163 - RNA, 16 nt, Salmonella enterica enterica serovar Typhi
cacucauccagcaaaa

SEQ ID NO: 3609164 - RNA, 16 nt, Salmonella enterica enterica serovar Typhi
cacuccaauauacuga

SEQ ID NO: 3609165 - RNA, 15 nt, Salmonella enterica enterica serovar Typhi
cacuccccagaauga

SEQ ID NO: 3609166 - RNA, 11 nt, Salmonella enterica enterica serovar Typhi
cacuccggcau

SEQ ID NO: 3609167 - RNA, 15 nt, Salmonella enterica enterica serovar Typhi
cacuccuaagagaaa

SEQ ID NO: 3609168 - RNA, 17 nt, Salmonella enterica enterica serovar Typhi
cacuccuaagagaaaac

SEQ ID NO: 3609169 - RNA, 22 nt, Salmonella enterica enterica serovar Typhi
cacucguaacgcauauccagca

SEQ ID NO: 3609170 - RNA, 16 nt, Salmonella enterica enterica serovar Typhi
cacucucuuguauuac

SEQ ID NO: 3609171 - RNA, 17 nt, Salmonella enterica enterica serovar Typhi
cacucugggauuugcga

SEQ ID NO: 3609172 - RNA, 22 nt, Salmonella enterica enterica serovar Typhi
cacucuuuggacggcaucagga

SEQ ID NO: 3609173 - RNA, 14 nt, Salmonella enterica enterica serovar Typhi
cacucuuuuuggcu

SEQ ID NO: 3609174 - RNA, 14 nt, Salmonella enterica enterica serovar Typhi
cacugaaccugccu

SEQ ID NO: 3609175 - RNA, 14 nt, Salmonella enterica enterica serovar Typhi
cacugaagaggaga

SEQ ID NO: 3609176 - RNA, 19 nt, Salmonella enterica enterica serovar Typhi
cacugaagccuggugccca

SEQ ID NO: 3609177 - RNA, 19 nt, Salmonella enterica enterica serovar Typhi
cacugaauuacugcguaaa

SEQ ID NO: 3609178 - RNA, 20 nt, Salmonella enterica enterica serovar Typhi
cacugaauuacugcguaaac

SEQ ID NO: 3609179 - RNA, 16 nt, Salmonella enterica enterica serovar Typhi
cacugacgaaaaccgu

SEQ ID NO: 3609180 - RNA, 18 nt, Salmonella enterica enterica serovar Typhi
cacugacuauccacagcg

SEQ ID NO: 3609181 - RNA, 21 nt, Salmonella enterica enterica serovar Typhi
cacugacucuuccgggcgcga

SEQ ID NO: 3609182 - RNA, 18 nt, Salmonella enterica enterica serovar Typhi
cacugagcugugauaaaa

SEQ ID NO: 3609183 - RNA, 17 nt, Salmonella enterica enterica serovar Typhi
cacugagcuucaccgcc

SEQ ID NO: 3609184 - RNA, 20 nt, Salmonella enterica enterica serovar Typhi
cacugagcuucaccgccaga

SEQ ID NO: 3609185 - RNA, 18 nt, Salmonella enterica enterica serovar Typhi
cacugauaccccagcgau

SEQ ID NO: 3609186 - RNA, 15 nt, Salmonella enterica enterica serovar Typhi
cacugauagccgcca

SEQ ID NO: 3609187 - RNA, 18 nt, Salmonella enterica enterica serovar Typhi
cacugauaguccaucacc

SEQ ID NO: 3609188 - RNA, 15 nt, Salmonella enterica enterica serovar Typhi
cacugaugccacacc

SEQ ID NO: 3609189 - RNA, 14 nt, Salmonella enterica enterica serovar Typhi
cacugcacaucccg

SEQ ID NO: 3609190 - RNA, 12 nt, Salmonella enterica enterica serovar Typhi
cacugccaccgc

SEQ ID NO: 3609191 - RNA, 14 nt, Salmonella enterica enterica serovar Typhi
cacugcccuggaag

SEQ ID NO: 3609192 - RNA, 22 nt, Salmonella enterica enterica serovar Typhi
cacugcccuggaagaacuggau

SEQ ID NO: 3609193 - RNA, 22 nt, Salmonella enterica enterica serovar Typhi
cacugccgacgcccucaauauc

SEQ ID NO: 3609194 - RNA, 12 nt, Salmonella enterica enterica serovar Typhi
cacugccgccac

SEQ ID NO: 3609195 - RNA, 23 nt, Salmonella enterica enterica serovar Typhi
cacugcgaacgcaucaaagccac

SEQ ID NO: 3609196 - RNA, 12 nt, Salmonella enterica enterica serovar Typhi
cacugcgccgcc

SEQ ID NO: 3609197 - RNA, 21 nt, Salmonella enterica enterica serovar Typhi
cacugcggagguuucuuuuuc

SEQ ID NO: 3609198 - RNA, 23 nt, Salmonella enterica enterica serovar Typhi
cacugcucguuaaauccucccau

SEQ ID NO: 3609199 - RNA, 21 nt, Salmonella enterica enterica serovar Typhi
cacuggaugacgcuguucaaa

SEQ ID NO: 3609200 - RNA, 23 nt, Salmonella enterica enterica serovar Typhi
cacuggcagccucguccugcaau

SEQ ID NO: 3609201 - RNA, 14 nt, Salmonella enterica enterica serovar Typhi
cacuggcccccugu

SEQ ID NO: 3609202 - RNA, 20 nt, Salmonella enterica enterica serovar Typhi
cacuggccucccaguucccc

SEQ ID NO: 3609203 - RNA, 23 nt, Salmonella enterica enterica serovar Typhi
cacuggcgagcggcaccggacau

SEQ ID NO: 3609204 - RNA, 20 nt, Salmonella enterica enterica serovar Typhi
cacuggcguagucucccucc

SEQ ID NO: 3609205 - RNA, 13 nt, Salmonella enterica enterica serovar Typhi
cacuguaaaaggg

SEQ ID NO: 3609206 - RNA, 14 nt, Salmonella enterica enterica serovar Typhi
cacuguaaaaggga

SEQ ID NO: 3609207 - RNA, 17 nt, Salmonella enterica enterica serovar Typhi
cacuguggugugccugc

SEQ ID NO: 3609208 - RNA, 19 nt, Salmonella enterica enterica serovar Typhi
cacuguucaaucaucacga

SEQ ID NO: 3609209 - RNA, 20 nt, Salmonella enterica enterica serovar Typhi
cacuguucguccauaaaggc

SEQ ID NO: 3609210 - RNA, 14 nt, Salmonella enterica enterica serovar Typhi
cacuguugcaucuu

SEQ ID NO: 3609211 - RNA, 23 nt, Salmonella enterica enterica serovar Typhi
cacuuaauacucgccccguuccu

SEQ ID NO: 3609212 - RNA, 22 nt, Salmonella enterica enterica serovar Typhi
cacuuacuuucuugccacuggc

SEQ ID NO: 3609213 - RNA, 18 nt, Salmonella enterica enterica serovar Typhi
cacuuaggcagccaggca

SEQ ID NO: 3609214 - RNA, 11 nt, Salmonella enterica enterica serovar Typhi
cacuuaugguc

SEQ ID NO: 3609215 - RNA, 21 nt, Salmonella enterica enterica serovar Typhi
cacuucaauguuagcauuauu

SEQ ID NO: 3609216 - RNA, 19 nt, Salmonella enterica enterica serovar Typhi
cacuucacacgaacuuuau

SEQ ID NO: 3609217 - RNA, 13 nt, Salmonella enterica enterica serovar Typhi
cacuucauccgga

SEQ ID NO: 3609218 - RNA, 13 nt, Salmonella enterica enterica serovar Typhi
cacuucauccggc

SEQ ID NO: 3609219 - RNA, 16 nt, Salmonella enterica enterica serovar Typhi
cacuuccagccacggc

SEQ ID NO: 3609220 - RNA, 15 nt, Salmonella enterica enterica serovar Typhi
cacuuccauccaugu

SEQ ID NO: 3609221 - RNA, 13 nt, Salmonella enterica enterica serovar Typhi
cacuuccccugcc

SEQ ID NO: 3609222 - RNA, 15 nt, Salmonella enterica enterica serovar Typhi
cacuuccgccaccac

SEQ ID NO: 3609223 - RNA, 18 nt, Salmonella enterica enterica serovar Typhi
cacuuccgccaccacgcc

SEQ ID NO: 3609224 - RNA, 15 nt, Salmonella enterica enterica serovar Typhi
cacuuccgccucgcc

SEQ ID NO: 3609225 - RNA, 22 nt, Salmonella enterica enterica serovar Typhi
cacuuccgguguccauguugcc

SEQ ID NO: 3609226 - RNA, 13 nt, Salmonella enterica enterica serovar Typhi
cacuucgauaaac

SEQ ID NO: 3609227 - RNA, 17 nt, Salmonella enterica enterica serovar Typhi
cacuucgcgcauugcga

SEQ ID NO: 3609228 - RNA, 21 nt, Salmonella enterica enterica serovar Typhi
cacuucgcugauaccgcccuc

SEQ ID NO: 3609229 - RNA, 23 nt, Salmonella enterica enterica serovar Typhi
cacuucugaguucggcauggggu

SEQ ID NO: 3609230 - RNA, 22 nt, Salmonella enterica enterica serovar Typhi
cacuucuuucacugucaugguu

SEQ ID NO: 3609231 - RNA, 14 nt, Salmonella enterica enterica serovar Typhi
cacuugagaaauua

SEQ ID NO: 3609232 - RNA, 21 nt, Salmonella enterica enterica serovar Typhi
cacuugagaaauuauuuuaaa

SEQ ID NO: 3609233 - RNA, 21 nt, Salmonella enterica enterica serovar Typhi
cacuugccgaguggaaucagc

SEQ ID NO: 3609234 - RNA, 22 nt, Salmonella enterica enterica serovar Typhi
cacuugccgaguggaaucagcc

SEQ ID NO: 3609235 - RNA, 17 nt, Salmonella enterica enterica serovar Typhi
cacuuuaaagcccagca

SEQ ID NO: 3609236 - RNA, 22 nt, Salmonella enterica enterica serovar Typhi
cacuuuaccaggcauaauggaa

SEQ ID NO: 3609237 - RNA, 19 nt, Salmonella enterica enterica serovar Typhi
cacuuuacugaauaacagc

SEQ ID NO: 3609238 - RNA, 20 nt, Salmonella enterica enterica serovar Typhi
cacuuuacugaauaacagca

SEQ ID NO: 3609239 - RNA, 17 nt, Salmonella enterica enterica serovar Typhi
cacuuucagaccacuau

SEQ ID NO: 3609240 - RNA, 13 nt, Salmonella enterica enterica serovar Typhi
cacuuucaucagc

SEQ ID NO: 3609241 - RNA, 13 nt, Salmonella enterica enterica serovar Typhi
cagacagccgauc

SEQ ID NO: 3609242 - RNA, 21 nt, Salmonella enterica enterica serovar Typhi
cagacagccgaucaggccgca

SEQ ID NO: 3609243 - RNA, 15 nt, Salmonella enterica enterica serovar Typhi
cagacaggugaacau

SEQ ID NO: 3609244 - RNA, 20 nt, Salmonella enterica enterica serovar Typhi
cagacagucuggauauaaac

SEQ ID NO: 3609245 - RNA, 20 nt, Salmonella enterica enterica serovar Typhi
cagacauauacucuucgcca

SEQ ID NO: 3609246 - RNA, 17 nt, Salmonella enterica enterica serovar Typhi
cagacauauuuucucug

SEQ ID NO: 3609247 - RNA, 14 nt, Salmonella enterica enterica serovar Typhi
cagacaucgcgcca

SEQ ID NO: 3609248 - RNA, 18 nt, Salmonella enterica enterica serovar Typhi
cagacaucggagauuuca

SEQ ID NO: 3609249 - RNA, 23 nt, Salmonella enterica enterica serovar Typhi
cagacaucggagauuucauccuc

SEQ ID NO: 3609250 - RNA, 13 nt, Salmonella enterica enterica serovar Typhi
cagacaugaccgc

SEQ ID NO: 3609251 - RNA, 14 nt, Salmonella enterica enterica serovar Typhi
cagacaugcacaug

SEQ ID NO: 3609252 - RNA, 20 nt, Salmonella enterica enterica serovar Typhi
cagacaugcagcacuuuuga

SEQ ID NO: 3609253 - RNA, 16 nt, Salmonella enterica enterica serovar Typhi
cagacauggcaauggc

SEQ ID NO: 3609254 - RNA, 15 nt, Salmonella enterica enterica serovar Typhi
cagacauucgcgcac

SEQ ID NO: 3609255 - RNA, 22 nt, Salmonella enterica enterica serovar Typhi
cagacauuuugaguugccgauc

SEQ ID NO: 3609256 - RNA, 17 nt, Salmonella enterica enterica serovar Typhi
cagaccaaagucaaacu

SEQ ID NO: 3609257 - RNA, 18 nt, Salmonella enterica enterica serovar Typhi
cagaccaaagucaaacug

SEQ ID NO: 3609258 - RNA, 13 nt, Salmonella enterica enterica serovar Typhi
cagaccaauagag

SEQ ID NO: 3609259 - RNA, 18 nt, Salmonella enterica enterica serovar Typhi
cagaccaauagagagcga

SEQ ID NO: 3609260 - RNA, 13 nt, Salmonella enterica enterica serovar Typhi
cagaccaccagcg

SEQ ID NO: 3609261 - RNA, 19 nt, Salmonella enterica enterica serovar Typhi
cagaccaccccacaguaau

SEQ ID NO: 3609262 - RNA, 17 nt, Salmonella enterica enterica serovar Typhi
cagaccacgaaucagga

SEQ ID NO: 3609263 - RNA, 20 nt, Salmonella enterica enterica serovar Typhi
cagaccacgaaucaggauau

SEQ ID NO: 3609264 - RNA, 13 nt, Salmonella enterica enterica serovar Typhi
cagacccacagcc

SEQ ID NO: 3609265 - RNA, 13 nt, Salmonella enterica enterica serovar Typhi
cagacccgcaaua

SEQ ID NO: 3609266 - RNA, 19 nt, Salmonella enterica enterica serovar Typhi
cagacccgcauacaggaag

SEQ ID NO: 3609267 - RNA, 17 nt, Salmonella enterica enterica serovar Typhi
cagaccgcugcggaaca

SEQ ID NO: 3609268 - RNA, 20 nt, Salmonella enterica enterica serovar Typhi
cagaccgcuuaacuccggcg

SEQ ID NO: 3609269 - RNA, 15 nt, Salmonella enterica enterica serovar Typhi
cagaccggagcgugc

SEQ ID NO: 3609270 - RNA, 18 nt, Salmonella enterica enterica serovar Typhi
cagaccggagcgugcuuc

SEQ ID NO: 3609271 - RNA, 16 nt, Salmonella enterica enterica serovar Typhi
cagaccggcaaaaauu

SEQ ID NO: 3609272 - RNA, 14 nt, Salmonella enterica enterica serovar Typhi
cagaccggcagccu

SEQ ID NO: 3609273 - RNA, 20 nt, Salmonella enterica enterica serovar Typhi
cagaccggcaucucaucuug

SEQ ID NO: 3609274 - RNA, 17 nt, Salmonella enterica enterica serovar Typhi
cagaccgucaugacguc

SEQ ID NO: 3609275 - RNA, 21 nt, Salmonella enterica enterica serovar Typhi
cagaccuuaucgcagucagcc

SEQ ID NO: 3609276 - RNA, 23 nt, Salmonella enterica enterica serovar Typhi
cagaccuuuauaagguuagccag

SEQ ID NO: 3609277 - RNA, 16 nt, Salmonella enterica enterica serovar Typhi
cagacgaacggccuga

SEQ ID NO: 3609278 - RNA, 14 nt, Salmonella enterica enterica serovar Typhi
cagacgaugaauuc

SEQ ID NO: 3609279 - RNA, 20 nt, Salmonella enterica enterica serovar Typhi
cagacgcaucaggaaccaca

SEQ ID NO: 3609280 - RNA, 17 nt, Salmonella enterica enterica serovar Typhi
cagacgcaucuuuuucc

SEQ ID NO: 3609281 - RNA, 20 nt, Salmonella enterica enterica serovar Typhi
cagacgccgcgcugcggcgu

SEQ ID NO: 3609282 - RNA, 14 nt, Salmonella enterica enterica serovar Typhi
cagacgcgcagcac

SEQ ID NO: 3609283 - RNA, 15 nt, Salmonella enterica enterica serovar Typhi
cagacgcgcagcacc

SEQ ID NO: 3609284 - RNA, 19 nt, Salmonella enterica enterica serovar Typhi
cagacgcuccgcaguaauc

SEQ ID NO: 3609285 - RNA, 16 nt, Salmonella enterica enterica serovar Typhi
cagacgcugcuucacg

SEQ ID NO: 3609286 - RNA, 14 nt, Salmonella enterica enterica serovar Typhi
cagacgcugguugu

SEQ ID NO: 3609287 - RNA, 16 nt, Salmonella enterica enterica serovar Typhi
cagacggcgaaucaau

SEQ ID NO: 3609288 - RNA, 18 nt, Salmonella enterica enterica serovar Typhi
cagacggcuccagcgcca

SEQ ID NO: 3609289 - RNA, 21 nt, Salmonella enterica enterica serovar Typhi
cagacggcuccagcgccagcu

SEQ ID NO: 3609290 - RNA, 15 nt, Salmonella enterica enterica serovar Typhi
cagacgguuaagccg

SEQ ID NO: 3609291 - RNA, 20 nt, Salmonella enterica enterica serovar Typhi
cagacguucgcgaugcagca

SEQ ID NO: 3609292 - RNA, 18 nt, Salmonella enterica enterica serovar Typhi
cagacuaaaaagcgcguc

SEQ ID NO: 3609293 - RNA, 18 nt, Salmonella enterica enterica serovar Typhi
cagacuacggaaacugua

SEQ ID NO: 3609294 - RNA, 12 nt, Salmonella enterica enterica serovar Typhi
cagacuaucuuc

SEQ ID NO: 3609295 - RNA, 17 nt, Salmonella enterica enterica serovar Typhi
cagacucgcucccuucc

SEQ ID NO: 3609296 - RNA, 20 nt, Salmonella enterica enterica serovar Typhi
cagacucgcucccuuccccc

SEQ ID NO: 3609297 - RNA, 15 nt, Salmonella enterica enterica serovar Typhi
cagacucgcuucacg

SEQ ID NO: 3609298 - RNA, 15 nt, Salmonella enterica enterica serovar Typhi
cagacugcacuuccu

SEQ ID NO: 3609299 - RNA, 16 nt, Salmonella enterica enterica serovar Typhi
cagacugguauagccu

SEQ ID NO: 3609300 - RNA, 20 nt, Salmonella enterica enterica serovar Typhi
cagacugguauagccuuuuu

SEQ ID NO: 3609301 - RNA, 18 nt, Salmonella enterica enterica serovar Typhi
cagacuguaaaucugccg

SEQ ID NO: 3609302 - RNA, 16 nt, Salmonella enterica enterica serovar Typhi
cagacuguaugugcuc

SEQ ID NO: 3609303 - RNA, 17 nt, Salmonella enterica enterica serovar Typhi
cagacuuagggcggaga

SEQ ID NO: 3609304 - RNA, 17 nt, Salmonella enterica enterica serovar Typhi
cagacuucauuuuccac

SEQ ID NO: 3609305 - RNA, 21 nt, Salmonella enterica enterica serovar Typhi
cagagagcguuucuacgccau

SEQ ID NO: 3609306 - RNA, 22 nt, Salmonella enterica enterica serovar Typhi
cagagagcguuucuacgccaug

SEQ ID NO: 3609307 - RNA, 15 nt, Salmonella enterica enterica serovar Typhi
cagagagggaaaaaa

SEQ ID NO: 3609308 - RNA, 16 nt, Salmonella enterica enterica serovar Typhi
cagagagggaaaaaaa

SEQ ID NO: 3609309 - RNA, 18 nt, Salmonella enterica enterica serovar Typhi
cagagagggaaaaaaauc

SEQ ID NO: 3609310 - RNA, 17 nt, Salmonella enterica enterica serovar Typhi
cagagauaauuuuccca

SEQ ID NO: 3609311 - RNA, 17 nt, Salmonella enterica enterica serovar Typhi
cagagauccacauuggu

SEQ ID NO: 3609312 - RNA, 19 nt, Salmonella enterica enterica serovar Typhi
cagagauccacauugguuu

SEQ ID NO: 3609313 - RNA, 12 nt, Salmonella enterica enterica serovar Typhi
cagagcaacgag

SEQ ID NO: 3609314 - RNA, 21 nt, Salmonella enterica enterica serovar Typhi
cagagcaacgagaacccacuu

SEQ ID NO: 3609315 - RNA, 16 nt, Salmonella enterica enterica serovar Typhi
cagagcaucuaccgca

SEQ ID NO: 3609316 - RNA, 21 nt, Salmonella enterica enterica serovar Typhi
cagagcaucuaccgcauacug

SEQ ID NO: 3609317 - RNA, 19 nt, Salmonella enterica enterica serovar Typhi
cagagccaaacacuucccc

SEQ ID NO: 3609318 - RNA, 16 nt, Salmonella enterica enterica serovar Typhi
cagagcgauaaagaac

SEQ ID NO: 3609319 - RNA, 16 nt, Salmonella enterica enterica serovar Typhi
cagagcggggaaacuc

SEQ ID NO: 3609320 - RNA, 17 nt, Salmonella enterica enterica serovar Typhi
cagagcucgucaaaaau

SEQ ID NO: 3609321 - RNA, 18 nt, Salmonella enterica enterica serovar Typhi
cagagcucgucaaaaauc

SEQ ID NO: 3609322 - RNA, 12 nt, Salmonella enterica enterica serovar Typhi
cagaggaaaacg

SEQ ID NO: 3609323 - RNA, 15 nt, Salmonella enterica enterica serovar Typhi
cagaggacauuaaag

SEQ ID NO: 3609324 - RNA, 19 nt, Salmonella enterica enterica serovar Typhi
cagaggaucuggacgccaa

SEQ ID NO: 3609325 - RNA, 20 nt, Salmonella enterica enterica serovar Typhi
cagaggaucuggacgccaau

SEQ ID NO: 3609326 - RNA, 15 nt, Salmonella enterica enterica serovar Typhi
cagaggccugaaugc

SEQ ID NO: 3609327 - RNA, 14 nt, Salmonella enterica enterica serovar Typhi
cagauugagacaaa

SEQ ID NO: 3609328 - RNA, 22 nt, Salmonella enterica enterica serovar Typhi
cagauugauacggguaaucaga

SEQ ID NO: 3609329 - RNA, 17 nt, Salmonella enterica enterica serovar Typhi
cagauugccacaggacc

SEQ ID NO: 3609330 - RNA, 13 nt, Salmonella enterica enterica serovar Typhi
cagauuguugccg

SEQ ID NO: 3609331 - RNA, 17 nt, Salmonella enterica enterica serovar Typhi
cagauuguugccgucuu

SEQ ID NO: 3609332 - RNA, 15 nt, Salmonella enterica enterica serovar Typhi
cagauuuagguucug

SEQ ID NO: 3609333 - RNA, 22 nt, Salmonella enterica enterica serovar Typhi
cagauuuucauuuagcgccugu

SEQ ID NO: 3609334 - RNA, 15 nt, Salmonella enterica enterica serovar Typhi
cagauuuucuuuaau

SEQ ID NO: 3609335 - RNA, 22 nt, Salmonella enterica enterica serovar Typhi
cagauuuuuaauguccagcagu

SEQ ID NO: 3609336 - RNA, 23 nt, Salmonella enterica enterica serovar Typhi
cagauuuuuaauguccagcagug

SEQ ID NO: 3609337 - RNA, 18 nt, Salmonella enterica enterica serovar Typhi
cagcaaaauaccggcagc

SEQ ID NO: 3609338 - RNA, 19 nt, Salmonella enterica enterica serovar Typhi
cagcaaaauaccggcagcg

SEQ ID NO: 3609339 - RNA, 22 nt, Salmonella enterica enterica serovar Typhi
cagcaaaaucacgcacacgucu

SEQ ID NO: 3609340 - RNA, 12 nt, Salmonella enterica enterica serovar Typhi
cagcaaaauggc

SEQ ID NO: 3609341 - RNA, 21 nt, Salmonella enterica enterica serovar Typhi
cagcaaaauggcaauugcgcc

SEQ ID NO: 3609342 - RNA, 15 nt, Salmonella enterica enterica serovar Typhi
cagcaaacauccccg

SEQ ID NO: 3609343 - RNA, 18 nt, Salmonella enterica enterica serovar Typhi
cagcaaaccgauaaucac

SEQ ID NO: 3609344 - RNA, 20 nt, Salmonella enterica enterica serovar Typhi
cagcaaacgccauagcaucg

SEQ ID NO: 3609345 - RNA, 21 nt, Salmonella enterica enterica serovar Typhi
cagcaaacgccauagcaucga

SEQ ID NO: 3609346 - RNA, 22 nt, Salmonella enterica enterica serovar Typhi
cagcaaacgccauagcaucgac

SEQ ID NO: 3609347 - RNA, 11 nt, Salmonella enterica enterica serovar Typhi
cagcaaauaau

SEQ ID NO: 3609348 - RNA, 14 nt, Salmonella enterica enterica serovar Typhi
cagcaaaucagcua

SEQ ID NO: 3609349 - RNA, 20 nt, Salmonella enterica enterica serovar Typhi
cagcaacagugggcuaugaa

SEQ ID NO: 3609350 - RNA, 21 nt, Salmonella enterica enterica serovar Typhi
cagcaacagugggcuaugaag

SEQ ID NO: 3609351 - RNA, 17 nt, Salmonella enterica enterica serovar Typhi
cagcaacaguugcugga

SEQ ID NO: 3609352 - RNA, 17 nt, Salmonella enterica enterica serovar Typhi
cagcaaccccugagugc

SEQ ID NO: 3609353 - RNA, 13 nt, Salmonella enterica enterica serovar Typhi
cagcaacccugcc

SEQ ID NO: 3609354 - RNA, 17 nt, Salmonella enterica enterica serovar Typhi
cagcaacgccuccagcg

SEQ ID NO: 3609355 - RNA, 13 nt, Salmonella enterica enterica serovar Typhi
cagcaacgcgcca

SEQ ID NO: 3609356 - RNA, 19 nt, Salmonella enterica enterica serovar Typhi
cagcaacggaagcugacca

SEQ ID NO: 3609357 - RNA, 14 nt, Salmonella enterica enterica serovar Typhi
cagcaacggcugau

SEQ ID NO: 3609358 - RNA, 17 nt, Salmonella enterica enterica serovar Typhi
cagcaacggcugauggc

SEQ ID NO: 3609359 - RNA, 18 nt, Salmonella enterica enterica serovar Typhi
cagcaacugcgcgcgggu

SEQ ID NO: 3609360 - RNA, 23 nt, Salmonella enterica enterica serovar Typhi
cagcaacugcugcgcgugcugua

SEQ ID NO: 3609361 - RNA, 15 nt, Salmonella enterica enterica serovar Typhi
cagcaagcggcuguc

SEQ ID NO: 3609362 - RNA, 17 nt, Salmonella enterica enterica serovar Typhi
cagcaaggcugccgcca

SEQ ID NO: 3609363 - RNA, 19 nt, Salmonella enterica enterica serovar Typhi
cagcaaguauuggcugccg

SEQ ID NO: 3609364 - RNA, 23 nt, Salmonella enterica enterica serovar Typhi
cagcaagucgcgggcgcuaaacc

SEQ ID NO: 3609365 - RNA, 22 nt, Salmonella enterica enterica serovar Typhi
cagcaauaacaccggcggcgcc

SEQ ID NO: 3609366 - RNA, 13 nt, Salmonella enterica enterica serovar Typhi
cagcaauacccag

SEQ ID NO: 3609367 - RNA, 20 nt, Salmonella enterica enterica serovar Typhi
cagcaauaguggacacacaa

SEQ ID NO: 3609368 - RNA, 15 nt, Salmonella enterica enterica serovar Typhi
cagcaauauaugagc

SEQ ID NO: 3609369 - RNA, 20 nt, Salmonella enterica enterica serovar Typhi
cagcaaucacuuccgccucg

SEQ ID NO: 3609370 - RNA, 18 nt, Salmonella enterica enterica serovar Typhi
cagcaaugagacaacggc

SEQ ID NO: 3609371 - RNA, 13 nt, Salmonella enterica enterica serovar Typhi
cagcaaugauaac

SEQ ID NO: 3609372 - RNA, 15 nt, Salmonella enterica enterica serovar Typhi
cagcaaugcccaaaa

SEQ ID NO: 3609373 - RNA, 20 nt, Salmonella enterica enterica serovar Typhi
cagcaauguuaaauucagca

SEQ ID NO: 3609374 - RNA, 14 nt, Salmonella enterica enterica serovar Typhi
cagcaauuccgcca

SEQ ID NO: 3609375 - RNA, 20 nt, Salmonella enterica enterica serovar Typhi
cagcaauuccgccaucucau

SEQ ID NO: 3609376 - RNA, 22 nt, Salmonella enterica enterica serovar Typhi
cagcaauuucucgcccgccaga

SEQ ID NO: 3609377 - RNA, 22 nt, Salmonella enterica enterica serovar Typhi
cagcacaauaccuucugcgccc

SEQ ID NO: 3609378 - RNA, 14 nt, Salmonella enterica enterica serovar Typhi
cagcacaaucagcg

SEQ ID NO: 3609379 - RNA, 21 nt, Salmonella enterica enterica serovar Typhi
cagcacaaucccggcgccgau

SEQ ID NO: 3609380 - RNA, 17 nt, Salmonella enterica enterica serovar Typhi
cagcacacgccugaauu

SEQ ID NO: 3609381 - RNA, 15 nt, Salmonella enterica enterica serovar Typhi
cagcacacuacacag

SEQ ID NO: 3609382 - RNA, 16 nt, Salmonella enterica enterica serovar Typhi
cagcacauagaagcuc

SEQ ID NO: 3609383 - RNA, 17 nt, Salmonella enterica enterica serovar Typhi
cagcacauagccuaaug

SEQ ID NO: 3609384 - RNA, 19 nt, Salmonella enterica enterica serovar Typhi
cagcacauucagcagcgcc

SEQ ID NO: 3609385 - RNA, 13 nt, Salmonella enterica enterica serovar Typhi
cagcaccacgccc

SEQ ID NO: 3609386 - RNA, 12 nt, Salmonella enterica enterica serovar Typhi
cagcaccagcau

SEQ ID NO: 3609387 - RNA, 13 nt, Salmonella enterica enterica serovar Typhi
cagcaccagcauu

SEQ ID NO: 3609388 - RNA, 15 nt, Salmonella enterica enterica serovar Typhi
cagcaccagcauuag

SEQ ID NO: 3609389 - RNA, 21 nt, Salmonella enterica enterica serovar Typhi
cagcaccaguugcgucagcgu

SEQ ID NO: 3609390 - RNA, 17 nt, Salmonella enterica enterica serovar Typhi
cagcaccaucuuuuccg

SEQ ID NO: 3609391 - RNA, 13 nt, Salmonella enterica enterica serovar Typhi
cagcacccaggca

SEQ ID NO: 3609392 - RNA, 12 nt, Salmonella enterica enterica serovar Typhi
cagcaccgccgc

SEQ ID NO: 3609393 - RNA, 14 nt, Salmonella enterica enterica serovar Typhi
cagcaccgccggga

SEQ ID NO: 3609394 - RNA, 15 nt, Salmonella enterica enterica serovar Typhi
cagcaccgcuggcga

SEQ ID NO: 3609395 - RNA, 13 nt, Salmonella enterica enterica serovar Typhi
cagcaccuccagc

SEQ ID NO: 3609396 - RNA, 14 nt, Salmonella enterica enterica serovar Typhi
cagcaccuccagcg

SEQ ID NO: 3609397 - RNA, 15 nt, Salmonella enterica enterica serovar Typhi
cagcaccuccagcgc

SEQ ID NO: 3609398 - RNA, 16 nt, Salmonella enterica enterica serovar Typhi
cagcaccuccagcgcc

SEQ ID NO: 3609399 - RNA, 21 nt, Salmonella enterica enterica serovar Typhi
cagcaccucgcugcugcuuuu

SEQ ID NO: 3609400 - RNA, 15 nt, Salmonella enterica enterica serovar Typhi
cagcacgacagagau

SEQ ID NO: 3609401 - RNA, 19 nt, Salmonella enterica enterica serovar Typhi
cagcacgacagagaucagg

SEQ ID NO: 3609402 - RNA, 19 nt, Salmonella enterica enterica serovar Typhi
cagcacgccgcccgccuga

SEQ ID NO: 3609403 - RNA, 18 nt, Salmonella enterica enterica serovar Typhi
cagcacgccggaaagaau

SEQ ID NO: 3609404 - RNA, 17 nt, Salmonella enterica enterica serovar Typhi
cagcacgcgcugcgccg

SEQ ID NO: 3609405 - RNA, 19 nt, Salmonella enterica enterica serovar Typhi
cagcacgcgcugcgccgca

SEQ ID NO: 3609406 - RNA, 15 nt, Salmonella enterica enterica serovar Typhi
cagcacgcucaaaua

SEQ ID NO: 3609407 - RNA, 17 nt, Salmonella enterica enterica serovar Typhi
cagcacgcuuacccagc

SEQ ID NO: 3609408 - RNA, 18 nt, Salmonella enterica enterica serovar Typhi
cagcacguuaccggcggu

SEQ ID NO: 3609409 - RNA, 13 nt, Salmonella enterica enterica serovar Typhi
cagcacuaacagc

SEQ ID NO: 3609410 - RNA, 15 nt, Salmonella enterica enterica serovar Typhi
cagcagaaaaccggu

SEQ ID NO: 3609411 - RNA, 16 nt, Salmonella enterica enterica serovar Typhi
cagcagaaagcaacag

SEQ ID NO: 3609412 - RNA, 12 nt, Salmonella enterica enterica serovar Typhi
cagcagaauaac

SEQ ID NO: 3609413 - RNA, 21 nt, Salmonella enterica enterica serovar Typhi
cagccaaucauaaacgccuga

SEQ ID NO: 3609414 - RNA, 19 nt, Salmonella enterica enterica serovar Typhi
cagccacaagagcagcaac

SEQ ID NO: 3609415 - RNA, 15 nt, Salmonella enterica enterica serovar Typhi
cagccacacacuguu

SEQ ID NO: 3609416 - RNA, 17 nt, Salmonella enterica enterica serovar Typhi
cagccacaugccuucuu

SEQ ID NO: 3609417 - RNA, 19 nt, Salmonella enterica enterica serovar Typhi
cagccacauuguaugcaag

SEQ ID NO: 3609418 - RNA, 12 nt, Salmonella enterica enterica serovar Typhi
cagccacccacu

SEQ ID NO: 3609419 - RNA, 12 nt, Salmonella enterica enterica serovar Typhi
cagccacucccg

SEQ ID NO: 3609420 - RNA, 17 nt, Salmonella enterica enterica serovar Typhi
cagccacuucuuccagc

SEQ ID NO: 3609421 - RNA, 14 nt, Salmonella enterica enterica serovar Typhi
cagccagacgccag

SEQ ID NO: 3609422 - RNA, 19 nt, Salmonella enterica enterica serovar Typhi
cagccagacgccagccacu

SEQ ID NO: 3609423 - RNA, 12 nt, Salmonella enterica enterica serovar Typhi
cagccagcagcg

SEQ ID NO: 3609424 - RNA, 12 nt, Salmonella enterica enterica serovar Typhi
cagccagcagcu

SEQ ID NO: 3609425 - RNA, 21 nt, Salmonella enterica enterica serovar Typhi
cagccagcauuuccagcuggu

SEQ ID NO: 3609426 - RNA, 14 nt, Salmonella enterica enterica serovar Typhi
cagccagccgccaa

SEQ ID NO: 3609427 - RNA, 18 nt, Salmonella enterica enterica serovar Typhi
cagccaggcaaagcccca

SEQ ID NO: 3609428 - RNA, 16 nt, Salmonella enterica enterica serovar Typhi
cagccaggccagcgcu

SEQ ID NO: 3609429 - RNA, 17 nt, Salmonella enterica enterica serovar Typhi
cagccaggcggcaaagu

SEQ ID NO: 3609430 - RNA, 23 nt, Salmonella enterica enterica serovar Typhi
cagccagggaucaagcaaugcca

SEQ ID NO: 3609431 - RNA, 14 nt, Salmonella enterica enterica serovar Typhi
cagccaggucugca

SEQ ID NO: 3609432 - RNA, 17 nt, Salmonella enterica enterica serovar Typhi
cagccaggucugcacca

SEQ ID NO: 3609433 - RNA, 17 nt, Salmonella enterica enterica serovar Typhi
cagccagguugccagaa

SEQ ID NO: 3609434 - RNA, 18 nt, Salmonella enterica enterica serovar Typhi
cagccagguuuugcucug

SEQ ID NO: 3609435 - RNA, 23 nt, Salmonella enterica enterica serovar Typhi
cagccagucgccaggcaagguua

SEQ ID NO: 3609436 - RNA, 21 nt, Salmonella enterica enterica serovar Typhi
cagccaguuagcgaucgcgcc

SEQ ID NO: 3609437 - RNA, 18 nt, Salmonella enterica enterica serovar Typhi
cagccauaaucaguacug

SEQ ID NO: 3609438 - RNA, 23 nt, Salmonella enterica enterica serovar Typhi
cagccauaaucaguacugcgccc

SEQ ID NO: 3609439 - RNA, 15 nt, Salmonella enterica enterica serovar Typhi
cagccauagcgcgcc

SEQ ID NO: 3609440 - RNA, 13 nt, Salmonella enterica enterica serovar Typhi
cagccauccgacg

SEQ ID NO: 3609441 - RNA, 17 nt, Salmonella enterica enterica serovar Typhi
cagccaugccauauggc

SEQ ID NO: 3609442 - RNA, 23 nt, Salmonella enterica enterica serovar Typhi
cagccauggcccaaaagguagcg

SEQ ID NO: 3609443 - RNA, 15 nt, Salmonella enterica enterica serovar Typhi
cagccauucaccacu

SEQ ID NO: 3609444 - RNA, 17 nt, Salmonella enterica enterica serovar Typhi
cagccauucaccacugg

SEQ ID NO: 3609445 - RNA, 16 nt, Salmonella enterica enterica serovar Typhi
cagcccagguuaccaa

SEQ ID NO: 3609446 - RNA, 19 nt, Salmonella enterica enterica serovar Typhi
cagcccauagcuacgaccg

SEQ ID NO: 3609447 - RNA, 19 nt, Salmonella enterica enterica serovar Typhi
cagcccaucuuucgccagc

SEQ ID NO: 3609448 - RNA, 12 nt, Salmonella enterica enterica serovar Typhi
cagcccaugaag

SEQ ID NO: 3609449 - RNA, 22 nt, Salmonella enterica enterica serovar Typhi
cagcccaugaaggagcaaugag

SEQ ID NO: 3609450 - RNA, 22 nt, Salmonella enterica enterica serovar Typhi
cagccccagcaccaacgccgcu

SEQ ID NO: 3609451 - RNA, 16 nt, Salmonella enterica enterica serovar Typhi
cagccccagcaccaga

SEQ ID NO: 3609452 - RNA, 16 nt, Salmonella enterica enterica serovar Typhi
cagccccagcgccagc

SEQ ID NO: 3609453 - RNA, 22 nt, Salmonella enterica enterica serovar Typhi
cagcccccaguuuuugaacaua

SEQ ID NO: 3609454 - RNA, 17 nt, Salmonella enterica enterica serovar Typhi
cagccccgggcgacacg

SEQ ID NO: 3609455 - RNA, 20 nt, Salmonella enterica enterica serovar Typhi
cagccccugaaauaacagac

SEQ ID NO: 3609456 - RNA, 17 nt, Salmonella enterica enterica serovar Typhi
cagccccuucgcugucc

SEQ ID NO: 3609457 - RNA, 16 nt, Salmonella enterica enterica serovar Typhi
cagcccgauacccgcc

SEQ ID NO: 3609458 - RNA, 16 nt, Salmonella enterica enterica serovar Typhi
cagcccgaucaucucc

SEQ ID NO: 3609459 - RNA, 22 nt, Salmonella enterica enterica serovar Typhi
cagcccgaucggcuggcauuuu

SEQ ID NO: 3609460 - RNA, 20 nt, Salmonella enterica enterica serovar Typhi
cagcccgccagcaccaggcu

SEQ ID NO: 3609461 - RNA, 14 nt, Salmonella enterica enterica serovar Typhi
cagcccgccgcccu

SEQ ID NO: 3609462 - RNA, 17 nt, Salmonella enterica enterica serovar Typhi
cagcccgcucguuucaa

SEQ ID NO: 3609463 - RNA, 18 nt, Salmonella enterica enterica serovar Typhi
cagcccggacaucauccc

SEQ ID NO: 3609464 - RNA, 19 nt, Salmonella enterica enterica serovar Typhi
cagcccguagauaagcgcc

SEQ ID NO: 3609465 - RNA, 18 nt, Salmonella enterica enterica serovar Typhi
cagcccgucggcgucugc

SEQ ID NO: 3609466 - RNA, 23 nt, Salmonella enterica enterica serovar Typhi
cagcccgucggcgucugcgcgcu

SEQ ID NO: 3609467 - RNA, 19 nt, Salmonella enterica enterica serovar Typhi
cagcccguucucgccgcgu

SEQ ID NO: 3609468 - RNA, 19 nt, Salmonella enterica enterica serovar Typhi
cagcccguucugugcgccg

SEQ ID NO: 3609469 - RNA, 20 nt, Salmonella enterica enterica serovar Typhi
cagcccucgguacugcgggu

SEQ ID NO: 3609470 - RNA, 13 nt, Salmonella enterica enterica serovar Typhi
cagcccugugccg

SEQ ID NO: 3609471 - RNA, 23 nt, Salmonella enterica enterica serovar Typhi
cagcccuuucaggaauuuaucaa

SEQ ID NO: 3609472 - RNA, 16 nt, Salmonella enterica enterica serovar Typhi
cagcccuuugagaaaa

SEQ ID NO: 3609473 - RNA, 21 nt, Salmonella enterica enterica serovar Typhi
cagccgacgcauuucuccuga

SEQ ID NO: 3609474 - RNA, 21 nt, Salmonella enterica enterica serovar Typhi
cagccgacuauuccgcaaacg

SEQ ID NO: 3609475 - RNA, 22 nt, Salmonella enterica enterica serovar Typhi
cagccgagcgguaagagccaga

SEQ ID NO: 3609476 - RNA, 16 nt, Salmonella enterica enterica serovar Typhi
cagccgauaacucuuc

SEQ ID NO: 3609477 - RNA, 22 nt, Salmonella enterica enterica serovar Typhi
cagccgauagcaccucgcaaua

SEQ ID NO: 3609478 - RNA, 17 nt, Salmonella enterica enterica serovar Typhi
cagccgaucaucacgaa

SEQ ID NO: 3609479 - RNA, 17 nt, Salmonella enterica enterica serovar Typhi
cagccgaucuauuucau

SEQ ID NO: 3609480 - RNA, 20 nt, Salmonella enterica enterica serovar Typhi
cagccgaucuauuucauaau

SEQ ID NO: 3609481 - RNA, 17 nt, Salmonella enterica enterica serovar Typhi
cagccgauuucauacca

SEQ ID NO: 3609482 - RNA, 14 nt, Salmonella enterica enterica serovar Typhi
cagccgcauuuuuu

SEQ ID NO: 3609483 - RNA, 13 nt, Salmonella enterica enterica serovar Typhi
cagccgccaaaaa

SEQ ID NO: 3609484 - RNA, 12 nt, Salmonella enterica enterica serovar Typhi
cagccgccacca

SEQ ID NO: 3609485 - RNA, 13 nt, Salmonella enterica enterica serovar Typhi
cagccgccauccg

SEQ ID NO: 3609486 - RNA, 15 nt, Salmonella enterica enterica serovar Typhi
cagccgccaucgcug

SEQ ID NO: 3609487 - RNA, 21 nt, Salmonella enterica enterica serovar Typhi
cagccgcggcgcuuucgccac

SEQ ID NO: 3609488 - RNA, 16 nt, Salmonella enterica enterica serovar Typhi
cagccgggcaggaaaa

SEQ ID NO: 3609489 - RNA, 17 nt, Salmonella enterica enterica serovar Typhi
cagccgguauccagcgc

SEQ ID NO: 3609490 - RNA, 19 nt, Salmonella enterica enterica serovar Typhi
cagccgguuuauccgcaac

SEQ ID NO: 3609491 - RNA, 21 nt, Salmonella enterica enterica serovar Typhi
cagccguaucuuccgguguga

SEQ ID NO: 3609492 - RNA, 23 nt, Salmonella enterica enterica serovar Typhi
cagccgucaaacaucgcgcucca

SEQ ID NO: 3609493 - RNA, 16 nt, Salmonella enterica enterica serovar Typhi
cagccgucaugauguu

SEQ ID NO: 3609494 - RNA, 21 nt, Salmonella enterica enterica serovar Typhi
cagccgucgugauagccauac

SEQ ID NO: 3609495 - RNA, 17 nt, Salmonella enterica enterica serovar Typhi
cagccguuacuuccccc

SEQ ID NO: 3609496 - RNA, 13 nt, Salmonella enterica enterica serovar Typhi
cagccuaccgcuu

SEQ ID NO: 3609497 - RNA, 15 nt, Salmonella enterica enterica serovar Typhi
cagccuaccugccgc

SEQ ID NO: 3609498 - RNA, 15 nt, Salmonella enterica enterica serovar Typhi
cagcgccgcgcaagc

SEQ ID NO: 3609499 - RNA, 16 nt, Salmonella enterica enterica serovar Typhi
cagcgccgcgggcugg

SEQ ID NO: 3609500 - RNA, 20 nt, Salmonella enterica enterica serovar Typhi
cagcgccggauaauccagac

SEQ ID NO: 3609501 - RNA, 21 nt, Salmonella enterica enterica serovar Typhi
cagcgccggaucgggcuucca

SEQ ID NO: 3609502 - RNA, 15 nt, Salmonella enterica enterica serovar Typhi
cagcgccggcagcag

SEQ ID NO: 3609503 - RNA, 18 nt, Salmonella enterica enterica serovar Typhi
cagcgccgucgccaucac

SEQ ID NO: 3609504 - RNA, 20 nt, Salmonella enterica enterica serovar Typhi
cagcgccgucgccaucacca

SEQ ID NO: 3609505 - RNA, 24 nt, Salmonella enterica enterica serovar Typhi
cagcgccucuucuaaaucauacca

SEQ ID NO: 3609506 - RNA, 13 nt, Salmonella enterica enterica serovar Typhi
cagcgccugcgcu

SEQ ID NO: 3609507 - RNA, 14 nt, Salmonella enterica enterica serovar Typhi
cagcgcgacauaga

SEQ ID NO: 3609508 - RNA, 20 nt, Salmonella enterica enterica serovar Typhi
cagcgcgauacgcagcaccg

SEQ ID NO: 3609509 - RNA, 19 nt, Salmonella enterica enterica serovar Typhi
cagcgcgauacgcgacggc

SEQ ID NO: 3609510 - RNA, 15 nt, Salmonella enterica enterica serovar Typhi
cagcgcgcaaaaacc

SEQ ID NO: 3609511 - RNA, 19 nt, Salmonella enterica enterica serovar Typhi
cagcgcgccaaaguuaauc

SEQ ID NO: 3609512 - RNA, 21 nt, Salmonella enterica enterica serovar Typhi
cagcgcgccaauggccgcccc

SEQ ID NO: 3609513 - RNA, 19 nt, Salmonella enterica enterica serovar Typhi
cagcgcgcccgccaccagc

SEQ ID NO: 3609514 - RNA, 12 nt, Salmonella enterica enterica serovar Typhi
cagcgcgccgca

SEQ ID NO: 3609515 - RNA, 14 nt, Salmonella enterica enterica serovar Typhi
cagcgcgccgcagc

SEQ ID NO: 3609516 - RNA, 18 nt, Salmonella enterica enterica serovar Typhi
cagcgcgccgccaacgcc

SEQ ID NO: 3609517 - RNA, 13 nt, Salmonella enterica enterica serovar Typhi
cagcgcgccgccc

SEQ ID NO: 3609518 - RNA, 12 nt, Salmonella enterica enterica serovar Typhi
cagcgcgccgcg

SEQ ID NO: 3609519 - RNA, 15 nt, Salmonella enterica enterica serovar Typhi
cagcgcgcgacccag

SEQ ID NO: 3609520 - RNA, 12 nt, Salmonella enterica enterica serovar Typhi
cagcgcgcggcu

SEQ ID NO: 3609521 - RNA, 14 nt, Salmonella enterica enterica serovar Typhi
cagcgcgcguaacc

SEQ ID NO: 3609522 - RNA, 17 nt, Salmonella enterica enterica serovar Typhi
cagcgcgcuccagacca

SEQ ID NO: 3609523 - RNA, 19 nt, Salmonella enterica enterica serovar Typhi
cagcgcggaagccacguuc

SEQ ID NO: 3609524 - RNA, 14 nt, Salmonella enterica enterica serovar Typhi
cagcgcggcaagga

SEQ ID NO: 3609525 - RNA, 13 nt, Salmonella enterica enterica serovar Typhi
cagcgcggcagcc

SEQ ID NO: 3609526 - RNA, 23 nt, Salmonella enterica enterica serovar Typhi
cagcgcggguucuuuccacaauc

SEQ ID NO: 3609527 - RNA, 18 nt, Salmonella enterica enterica serovar Typhi
cagcgcguccaauagccc

SEQ ID NO: 3609528 - RNA, 20 nt, Salmonella enterica enterica serovar Typhi
cagcgcguccaauagccccu

SEQ ID NO: 3609529 - RNA, 12 nt, Salmonella enterica enterica serovar Typhi
cagcgcguccuu

SEQ ID NO: 3609530 - RNA, 14 nt, Salmonella enterica enterica serovar Typhi
cagcgcgucgacca

SEQ ID NO: 3609531 - RNA, 15 nt, Salmonella enterica enterica serovar Typhi
cagcgcgucggccgg

SEQ ID NO: 3609532 - RNA, 17 nt, Salmonella enterica enterica serovar Typhi
cagcgcguugggcguga

SEQ ID NO: 3609533 - RNA, 17 nt, Salmonella enterica enterica serovar Typhi
cagcgcuaucaggaaga

SEQ ID NO: 3609534 - RNA, 20 nt, Salmonella enterica enterica serovar Typhi
cagcgcuaucaggcacugaa

SEQ ID NO: 3609535 - RNA, 15 nt, Salmonella enterica enterica serovar Typhi
cagcgcuauccggcc

SEQ ID NO: 3609536 - RNA, 18 nt, Salmonella enterica enterica serovar Typhi
cagcgcuccaccaaccag

SEQ ID NO: 3609537 - RNA, 19 nt, Salmonella enterica enterica serovar Typhi
cagcgcuccccacauauuc

SEQ ID NO: 3609538 - RNA, 15 nt, Salmonella enterica enterica serovar Typhi
cagcgcuccgacaaa

SEQ ID NO: 3609539 - RNA, 23 nt, Salmonella enterica enterica serovar Typhi
cagcgcuccgggguucuuuuuaa

SEQ ID NO: 3609540 - RNA, 16 nt, Salmonella enterica enterica serovar Typhi
cagcgcucugcaaugu

SEQ ID NO: 3609541 - RNA, 21 nt, Salmonella enterica enterica serovar Typhi
cagcgcugcauuugcugccgu

SEQ ID NO: 3609542 - RNA, 12 nt, Salmonella enterica enterica serovar Typhi
cagcgcugcugu

SEQ ID NO: 3609543 - RNA, 22 nt, Salmonella enterica enterica serovar Typhi
cagcgcugcuguaacagacgca

SEQ ID NO: 3609544 - RNA, 18 nt, Salmonella enterica enterica serovar Typhi
cagcgcugucagugaaaa

SEQ ID NO: 3609545 - RNA, 14 nt, Salmonella enterica enterica serovar Typhi
cagcgcuuagcggc

SEQ ID NO: 3609546 - RNA, 20 nt, Salmonella enterica enterica serovar Typhi
cagcgcuugccgcagcgcag

SEQ ID NO: 3609547 - RNA, 18 nt, Salmonella enterica enterica serovar Typhi
cagcgcuugugccugcug

SEQ ID NO: 3609548 - RNA, 20 nt, Salmonella enterica enterica serovar Typhi
cagcgcuugugccugcugcg

SEQ ID NO: 3609549 - RNA, 20 nt, Salmonella enterica enterica serovar Typhi
cagcgcuuucaccgcgucgu

SEQ ID NO: 3609550 - RNA, 23 nt, Salmonella enterica enterica serovar Typhi
cagcgcuuugccgcugcugccuu

SEQ ID NO: 3609551 - RNA, 16 nt, Salmonella enterica enterica serovar Typhi
cagcgcuuuugccgcg

SEQ ID NO: 3609552 - RNA, 20 nt, Salmonella enterica enterica serovar Typhi
cagcgcuuuugccgcgccca

SEQ ID NO: 3609553 - RNA, 19 nt, Salmonella enterica enterica serovar Typhi
cagcggaaaauauucagca

SEQ ID NO: 3609554 - RNA, 20 nt, Salmonella enterica enterica serovar Typhi
cagcggaaagugaaggccag

SEQ ID NO: 3609555 - RNA, 13 nt, Salmonella enterica enterica serovar Typhi
cagcggaaucccc

SEQ ID NO: 3609556 - RNA, 17 nt, Salmonella enterica enterica serovar Typhi
cagcggacggcuaauau

SEQ ID NO: 3609557 - RNA, 18 nt, Salmonella enterica enterica serovar Typhi
cagcggagagacauuggu

SEQ ID NO: 3609558 - RNA, 14 nt, Salmonella enterica enterica serovar Typhi
cagcggagcgaaga

SEQ ID NO: 3609559 - RNA, 13 nt, Salmonella enterica enterica serovar Typhi
cagcggaugcucu

SEQ ID NO: 3609560 - RNA, 19 nt, Salmonella enterica enterica serovar Typhi
cagcggauuacgcgccugc

SEQ ID NO: 3609561 - RNA, 23 nt, Salmonella enterica enterica serovar Typhi
cagcggauugccauacacgcggc

SEQ ID NO: 3609562 - RNA, 23 nt, Salmonella enterica enterica serovar Typhi
cagcggcaaaggcauggcaggua

SEQ ID NO: 3609563 - RNA, 16 nt, Salmonella enterica enterica serovar Typhi
cagcggcagugaugaa

SEQ ID NO: 3609564 - RNA, 14 nt, Salmonella enterica enterica serovar Typhi
cagcggccagggca

SEQ ID NO: 3609565 - RNA, 14 nt, Salmonella enterica enterica serovar Typhi
cagcggcgcgcggu

SEQ ID NO: 3609566 - RNA, 15 nt, Salmonella enterica enterica serovar Typhi
cagcggcggaaugcu

SEQ ID NO: 3609567 - RNA, 13 nt, Salmonella enterica enterica serovar Typhi
cagcggcggcagu

SEQ ID NO: 3609568 - RNA, 11 nt, Salmonella enterica enterica serovar Typhi
cagcggcguug

SEQ ID NO: 3609569 - RNA, 23 nt, Salmonella enterica enterica serovar Typhi
cagcggcguuggcgauuuccagc

SEQ ID NO: 3609570 - RNA, 12 nt, Salmonella enterica enterica serovar Typhi
cagcgggaacau

SEQ ID NO: 3609571 - RNA, 17 nt, Salmonella enterica enterica serovar Typhi
cagcgggccgcugaugu

SEQ ID NO: 3609572 - RNA, 20 nt, Salmonella enterica enterica serovar Typhi
cagcgggcugucgcgaaagc

SEQ ID NO: 3609573 - RNA, 22 nt, Salmonella enterica enterica serovar Typhi
cagcgguuacuuuugaacauaa

SEQ ID NO: 3609574 - RNA, 18 nt, Salmonella enterica enterica serovar Typhi
cagcguaaaacuuuucug

SEQ ID NO: 3609575 - RNA, 11 nt, Salmonella enterica enterica serovar Typhi
cagcguaacga

SEQ ID NO: 3609576 - RNA, 19 nt, Salmonella enterica enterica serovar Typhi
cagcguaagucugauaaac

SEQ ID NO: 3609577 - RNA, 22 nt, Salmonella enterica enterica serovar Typhi
cagcguaaucggcaggccaacg

SEQ ID NO: 3609578 - RNA, 19 nt, Salmonella enterica enterica serovar Typhi
cagcguaaugcgccaggca

SEQ ID NO: 3609579 - RNA, 22 nt, Salmonella enterica enterica serovar Typhi
cagcguaaugcgccaggcagca

SEQ ID NO: 3609580 - RNA, 21 nt, Salmonella enterica enterica serovar Typhi
cagcguaauuguugccccgcu

SEQ ID NO: 3609581 - RNA, 18 nt, Salmonella enterica enterica serovar Typhi
cagcguacaauggcaggc

SEQ ID NO: 3609582 - RNA, 20 nt, Salmonella enterica enterica serovar Typhi
cagcguacaggcggaaauca

SEQ ID NO: 3609583 - RNA, 16 nt, Salmonella enterica enterica serovar Typhi
cagcguacaucuucca

SEQ ID NO: 3609584 - RNA, 20 nt, Salmonella enterica enterica serovar Typhi
cagcuucgcugcgcgggcgu

SEQ ID NO: 3609585 - RNA, 22 nt, Salmonella enterica enterica serovar Typhi
cagcuucgcugcgcgggcgucu

SEQ ID NO: 3609586 - RNA, 14 nt, Salmonella enterica enterica serovar Typhi
cagcuucgguccgg

SEQ ID NO: 3609587 - RNA, 20 nt, Salmonella enterica enterica serovar Typhi
cagcuucugauacugcuccg

SEQ ID NO: 3609588 - RNA, 14 nt, Salmonella enterica enterica serovar Typhi
cagcuugcuggccg

SEQ ID NO: 3609589 - RNA, 14 nt, Salmonella enterica enterica serovar Typhi
cagcuuggcggcuu

SEQ ID NO: 3609590 - RNA, 21 nt, Salmonella enterica enterica serovar Typhi
cagcuugguagcgcaacuggu

SEQ ID NO: 3609591 - RNA, 14 nt, Salmonella enterica enterica serovar Typhi
cagcuuguuuacgc

SEQ ID NO: 3609592 - RNA, 18 nt, Salmonella enterica enterica serovar Typhi
cagcuuguuuacgcccuc

SEQ ID NO: 3609593 - RNA, 19 nt, Salmonella enterica enterica serovar Typhi
cagcuuuaaugcuuuccag

SEQ ID NO: 3609594 - RNA, 19 nt, Salmonella enterica enterica serovar Typhi
cagcuuuucauuuguuccu

SEQ ID NO: 3609595 - RNA, 16 nt, Salmonella enterica enterica serovar Typhi
caggaaagagccgcgc

SEQ ID NO: 3609596 - RNA, 17 nt, Salmonella enterica enterica serovar Typhi
caggaaagagccgcgca

SEQ ID NO: 3609597 - RNA, 22 nt, Salmonella enterica enterica serovar Typhi
caggaaagagccgcgcagcgca

SEQ ID NO: 3609598 - RNA, 20 nt, Salmonella enterica enterica serovar Typhi
caggaaauccagcagaauaa

SEQ ID NO: 3609599 - RNA, 21 nt, Salmonella enterica enterica serovar Typhi
caggaaauccagcagaauaac

SEQ ID NO: 3609600 - RNA, 14 nt, Salmonella enterica enterica serovar Typhi
caggaacagauacu

SEQ ID NO: 3609601 - RNA, 16 nt, Salmonella enterica enterica serovar Typhi
caggaacagauacugg

SEQ ID NO: 3609602 - RNA, 20 nt, Salmonella enterica enterica serovar Typhi
caggaacagauacuggaagu

SEQ ID NO: 3609603 - RNA, 17 nt, Salmonella enterica enterica serovar Typhi
caggaacgcggcgccga

SEQ ID NO: 3609604 - RNA, 18 nt, Salmonella enterica enterica serovar Typhi
caggaacgcggcgccgaa

SEQ ID NO: 3609605 - RNA, 14 nt, Salmonella enterica enterica serovar Typhi
caggaacugacuga

SEQ ID NO: 3609606 - RNA, 20 nt, Salmonella enterica enterica serovar Typhi
caggaagaacacgccgccua

SEQ ID NO: 3609607 - RNA, 15 nt, Salmonella enterica enterica serovar Typhi
caggaagaguaucuc

SEQ ID NO: 3609608 - RNA, 14 nt, Salmonella enterica enterica serovar Typhi
caggaaggcgugca

SEQ ID NO: 3609609 - RNA, 15 nt, Salmonella enterica enterica serovar Typhi
caggaaggcgugcag

SEQ ID NO: 3609610 - RNA, 15 nt, Salmonella enterica enterica serovar Typhi
caggaauaaagguca

SEQ ID NO: 3609611 - RNA, 22 nt, Salmonella enterica enterica serovar Typhi
caggaaucgcguuaauuuuccc

SEQ ID NO: 3609612 - RNA, 15 nt, Salmonella enterica enterica serovar Typhi
caggaaugccacgau

SEQ ID NO: 3609613 - RNA, 20 nt, Salmonella enterica enterica serovar Typhi
caggaauuuaccggugcgga

SEQ ID NO: 3609614 - RNA, 13 nt, Salmonella enterica enterica serovar Typhi
caggacaaccccu

SEQ ID NO: 3609615 - RNA, 17 nt, Salmonella enterica enterica serovar Typhi
caggacaucaaaggcag

SEQ ID NO: 3609616 - RNA, 14 nt, Salmonella enterica enterica serovar Typhi
caggacaucaaucg

SEQ ID NO: 3609617 - RNA, 15 nt, Salmonella enterica enterica serovar Typhi
caggacgcacccugu

SEQ ID NO: 3609618 - RNA, 18 nt, Salmonella enterica enterica serovar Typhi
caggacgccagcgcggca

SEQ ID NO: 3609619 - RNA, 15 nt, Salmonella enterica enterica serovar Typhi
caggacgccagugaa

SEQ ID NO: 3609620 - RNA, 17 nt, Salmonella enterica enterica serovar Typhi
caggacgccagugaaag

SEQ ID NO: 3609621 - RNA, 15 nt, Salmonella enterica enterica serovar Typhi
caggacgcuccauca

SEQ ID NO: 3609622 - RNA, 17 nt, Salmonella enterica enterica serovar Typhi
caggacgguggucaucu

SEQ ID NO: 3609623 - RNA, 16 nt, Salmonella enterica enterica serovar Typhi
caggacuaacgccggu

SEQ ID NO: 3609624 - RNA, 13 nt, Salmonella enterica enterica serovar Typhi
caggacugacugc

SEQ ID NO: 3609625 - RNA, 14 nt, Salmonella enterica enterica serovar Typhi
caggagacuauucg

SEQ ID NO: 3609626 - RNA, 18 nt, Salmonella enterica enterica serovar Typhi
caggagaucggcgcaggu

SEQ ID NO: 3609627 - RNA, 14 nt, Salmonella enterica enterica serovar Typhi
caggagcauagaua

SEQ ID NO: 3609628 - RNA, 14 nt, Salmonella enterica enterica serovar Typhi
caggagccaccggc

SEQ ID NO: 3609629 - RNA, 18 nt, Salmonella enterica enterica serovar Typhi
caggagcggguagagcuu

SEQ ID NO: 3609630 - RNA, 14 nt, Salmonella enterica enterica serovar Typhi
caggaggccugaau

SEQ ID NO: 3609631 - RNA, 15 nt, Salmonella enterica enterica serovar Typhi
caggagugaacacgu

SEQ ID NO: 3609632 - RNA, 15 nt, Salmonella enterica enterica serovar Typhi
caggauaaaauccug

SEQ ID NO: 3609633 - RNA, 19 nt, Salmonella enterica enterica serovar Typhi
caggauaaagaccggcaca

SEQ ID NO: 3609634 - RNA, 15 nt, Salmonella enterica enterica serovar Typhi
caggauacagccgac

SEQ ID NO: 3609635 - RNA, 22 nt, Salmonella enterica enterica serovar Typhi
caggauaguacugaccagacag

SEQ ID NO: 3609636 - RNA, 19 nt, Salmonella enterica enterica serovar Typhi
caggauauacuucaucagg

SEQ ID NO: 3609637 - RNA, 16 nt, Salmonella enterica enterica serovar Typhi
caggaucaauucugau

SEQ ID NO: 3609638 - RNA, 15 nt, Salmonella enterica enterica serovar Typhi
caggaucagauauuc

SEQ ID NO: 3609639 - RNA, 21 nt, Salmonella enterica enterica serovar Typhi
caggaucagauauuccagcga

SEQ ID NO: 3609640 - RNA, 18 nt, Salmonella enterica enterica serovar Typhi
caggauccguaaccaguc

SEQ ID NO: 3609641 - RNA, 20 nt, Salmonella enterica enterica serovar Typhi
caggaucgggaucagcgcgc

SEQ ID NO: 3609642 - RNA, 13 nt, Salmonella enterica enterica serovar Typhi
caggaucuucauc

SEQ ID NO: 3609643 - RNA, 14 nt, Salmonella enterica enterica serovar Typhi
caggaucuucaucc

SEQ ID NO: 3609644 - RNA, 17 nt, Salmonella enterica enterica serovar Typhi
caggaucuucaucccau

SEQ ID NO: 3609645 - RNA, 14 nt, Salmonella enterica enterica serovar Typhi
caggaucuuuuuca

SEQ ID NO: 3609646 - RNA, 16 nt, Salmonella enterica enterica serovar Typhi
caggaugccaaccacc

SEQ ID NO: 3609647 - RNA, 21 nt, Salmonella enterica enterica serovar Typhi
caggaugccaaccaccgcgga

SEQ ID NO: 3609648 - RNA, 19 nt, Salmonella enterica enterica serovar Typhi
caggaugcuuuuuauaaag

SEQ ID NO: 3609649 - RNA, 20 nt, Salmonella enterica enterica serovar Typhi
caggauuauuacacacaguc

SEQ ID NO: 3609650 - RNA, 17 nt, Salmonella enterica enterica serovar Typhi
caggauucgaaccugcg

SEQ ID NO: 3609651 - RNA, 17 nt, Salmonella enterica enterica serovar Typhi
caggauuuacugagcgc

SEQ ID NO: 3609652 - RNA, 20 nt, Salmonella enterica enterica serovar Typhi
caggauuuucgcgaucuccg

SEQ ID NO: 3609653 - RNA, 15 nt, Salmonella enterica enterica serovar Typhi
caggcaaaccagcac

SEQ ID NO: 3609654 - RNA, 14 nt, Salmonella enterica enterica serovar Typhi
caggcaaagcccca

SEQ ID NO: 3609655 - RNA, 22 nt, Salmonella enterica enterica serovar Typhi
caggcaaaucaacauuauuaaa

SEQ ID NO: 3609656 - RNA, 20 nt, Salmonella enterica enterica serovar Typhi
caggcaaaugauuaucucca

SEQ ID NO: 3609657 - RNA, 17 nt, Salmonella enterica enterica serovar Typhi
caggcaagacgcaugac

SEQ ID NO: 3609658 - RNA, 17 nt, Salmonella enterica enterica serovar Typhi
caggcaaguuuaauucc

SEQ ID NO: 3609659 - RNA, 18 nt, Salmonella enterica enterica serovar Typhi
caggcacagaagcgccug

SEQ ID NO: 3609660 - RNA, 22 nt, Salmonella enterica enterica serovar Typhi
caggcaccuguaaccuuaaaag

SEQ ID NO: 3609661 - RNA, 16 nt, Salmonella enterica enterica serovar Typhi
caggcacgccugugcu

SEQ ID NO: 3609662 - RNA, 20 nt, Salmonella enterica enterica serovar Typhi
caggcacgggugccuguucu

SEQ ID NO: 3609663 - RNA, 17 nt, Salmonella enterica enterica serovar Typhi
caggcacgugcauaaaa

SEQ ID NO: 3609664 - RNA, 21 nt, Salmonella enterica enterica serovar Typhi
caggcacugaauuuacgccgu

SEQ ID NO: 3609665 - RNA, 23 nt, Salmonella enterica enterica serovar Typhi
caggcacuguggugugccugcgc

SEQ ID NO: 3609666 - RNA, 14 nt, Salmonella enterica enterica serovar Typhi
caggcacuugagaa

SEQ ID NO: 3609667 - RNA, 13 nt, Salmonella enterica enterica serovar Typhi
caggcagaaauaa

SEQ ID NO: 3609668 - RNA, 15 nt, Salmonella enterica enterica serovar Typhi
caggcagaaauaacu

SEQ ID NO: 3609669 - RNA, 16 nt, Salmonella enterica enterica serovar Typhi
caggcagauuaaucag

SEQ ID NO: 3609670 - RNA, 19 nt, Salmonella enterica enterica serovar Typhi
caggcugguggagagcagu

SEQ ID NO: 3609671 - RNA, 14 nt, Salmonella enterica enterica serovar Typhi
caggcugucugcca

SEQ ID NO: 3609672 - RNA, 14 nt, Salmonella enterica enterica serovar Typhi
caggcugugcaaca

SEQ ID NO: 3609673 - RNA, 23 nt, Salmonella enterica enterica serovar Typhi
caggcuguugaggaaauucugac

SEQ ID NO: 3609674 - RNA, 17 nt, Salmonella enterica enterica serovar Typhi
caggcuuaacacccgga

SEQ ID NO: 3609675 - RNA, 15 nt, Salmonella enterica enterica serovar Typhi
caggcuugccgcgcc

SEQ ID NO: 3609676 - RNA, 21 nt, Salmonella enterica enterica serovar Typhi
caggcuugccgcgccagacgc

SEQ ID NO: 3609677 - RNA, 21 nt, Salmonella enterica enterica serovar Typhi
caggcuuuaaauucagcaccc

SEQ ID NO: 3609678 - RNA, 21 nt, Salmonella enterica enterica serovar Typhi
caggcuuuucaggcuguggcu

SEQ ID NO: 3609679 - RNA, 18 nt, Salmonella enterica enterica serovar Typhi
cagggaaauggcgaacag

SEQ ID NO: 3609680 - RNA, 19 nt, Salmonella enterica enterica serovar Typhi
cagggaacguugcgccaug

SEQ ID NO: 3609681 - RNA, 19 nt, Salmonella enterica enterica serovar Typhi
cagggaauaugauuuaaaa

SEQ ID NO: 3609682 - RNA, 20 nt, Salmonella enterica enterica serovar Typhi
cagggacgauaggcgcguca

SEQ ID NO: 3609683 - RNA, 17 nt, Salmonella enterica enterica serovar Typhi
cagggacuauaggcaau

SEQ ID NO: 3609684 - RNA, 14 nt, Salmonella enterica enterica serovar Typhi
cagggacuuauuaa

SEQ ID NO: 3609685 - RNA, 20 nt, Salmonella enterica enterica serovar Typhi
cagggagacggccacccauc

SEQ ID NO: 3609686 - RNA, 17 nt, Salmonella enterica enterica serovar Typhi
cagggauaugcugaucu

SEQ ID NO: 3609687 - RNA, 22 nt, Salmonella enterica enterica serovar Typhi
cagggauauuccauacaguggc

SEQ ID NO: 3609688 - RNA, 13 nt, Salmonella enterica enterica serovar Typhi
cagggauccugua

SEQ ID NO: 3609689 - RNA, 19 nt, Salmonella enterica enterica serovar Typhi
cagggauccuguaacaacu

SEQ ID NO: 3609690 - RNA, 16 nt, Salmonella enterica enterica serovar Typhi
cagggauugauggcca

SEQ ID NO: 3609691 - RNA, 19 nt, Salmonella enterica enterica serovar Typhi
cagggauuuugcuuuuucg

SEQ ID NO: 3609692 - RNA, 21 nt, Salmonella enterica enterica serovar Typhi
cagggcaaauuaucccuuccu

SEQ ID NO: 3609693 - RNA, 16 nt, Salmonella enterica enterica serovar Typhi
cagggcaacggccagc

SEQ ID NO: 3609694 - RNA, 13 nt, Salmonella enterica enterica serovar Typhi
cagggcagcgagc

SEQ ID NO: 3609695 - RNA, 15 nt, Salmonella enterica enterica serovar Typhi
cagggcaucaugaug

SEQ ID NO: 3609696 - RNA, 16 nt, Salmonella enterica enterica serovar Typhi
cagggcaucccguccc

SEQ ID NO: 3609697 - RNA, 20 nt, Salmonella enterica enterica serovar Typhi
cagggcaucccgucccacca

SEQ ID NO: 3609698 - RNA, 18 nt, Salmonella enterica enterica serovar Typhi
cagggccgcgagaacuuc

SEQ ID NO: 3609699 - RNA, 23 nt, Salmonella enterica enterica serovar Typhi
cagggcgaacauuccgcccaaga

SEQ ID NO: 3609700 - RNA, 14 nt, Salmonella enterica enterica serovar Typhi
cagggcgauaauag

SEQ ID NO: 3609701 - RNA, 14 nt, Salmonella enterica enterica serovar Typhi
cagggcgauuuccg

SEQ ID NO: 3609702 - RNA, 23 nt, Salmonella enterica enterica serovar Typhi
cagggcgcggcgcaacuuuuucg

SEQ ID NO: 3609703 - RNA, 13 nt, Salmonella enterica enterica serovar Typhi
cagggcggaagca

SEQ ID NO: 3609704 - RNA, 16 nt, Salmonella enterica enterica serovar Typhi
cagggcggaagcagau

SEQ ID NO: 3609705 - RNA, 17 nt, Salmonella enterica enterica serovar Typhi
cagggcggccuccuggc

SEQ ID NO: 3609706 - RNA, 14 nt, Salmonella enterica enterica serovar Typhi
cagggcggcgcgcu

SEQ ID NO: 3609707 - RNA, 14 nt, Salmonella enterica enterica serovar Typhi
cagggcguaagcgc

SEQ ID NO: 3609708 - RNA, 17 nt, Salmonella enterica enterica serovar Typhi
cagggcgugacgcgcca

SEQ ID NO: 3609709 - RNA, 21 nt, Salmonella enterica enterica serovar Typhi
cagggcugcuggugcgccugu

SEQ ID NO: 3609710 - RNA, 17 nt, Salmonella enterica enterica serovar Typhi
cagggcuuauucaagca

SEQ ID NO: 3609711 - RNA, 14 nt, Salmonella enterica enterica serovar Typhi
cagggcuuuauuuu

SEQ ID NO: 3609712 - RNA, 15 nt, Salmonella enterica enterica serovar Typhi
cagggcuuuuuucuc

SEQ ID NO: 3609713 - RNA, 17 nt, Salmonella enterica enterica serovar Typhi
caggggauuagacuucc

SEQ ID NO: 3609714 - RNA, 13 nt, Salmonella enterica enterica serovar Typhi
caggggauucugc

SEQ ID NO: 3609715 - RNA, 18 nt, Salmonella enterica enterica serovar Typhi
caggggccacaggcggca

SEQ ID NO: 3609716 - RNA, 21 nt, Salmonella enterica enterica serovar Typhi
caggggcuauugaaaaagccg

SEQ ID NO: 3609717 - RNA, 19 nt, Salmonella enterica enterica serovar Typhi
caggggcuccugcgccgga

SEQ ID NO: 3609718 - RNA, 24 nt, Salmonella enterica enterica serovar Typhi
cagggggauagcgacggggcgcag

SEQ ID NO: 3609719 - RNA, 14 nt, Salmonella enterica enterica serovar Typhi
cagggguguccaga

SEQ ID NO: 3609720 - RNA, 17 nt, Salmonella enterica enterica serovar Typhi
cagggguguuacgccau

SEQ ID NO: 3609721 - RNA, 19 nt, Salmonella enterica enterica serovar Typhi
caggguaucauuaugggca

SEQ ID NO: 3609722 - RNA, 17 nt, Salmonella enterica enterica serovar Typhi
caggguaucuaacccgc

SEQ ID NO: 3609723 - RNA, 21 nt, Salmonella enterica enterica serovar Typhi
caggguaugucgguagcgcca

SEQ ID NO: 3609724 - RNA, 23 nt, Salmonella enterica enterica serovar Typhi
caggguuauuuccgcuggccggu

SEQ ID NO: 3609725 - RNA, 13 nt, Salmonella enterica enterica serovar Typhi
caggguucacugc

SEQ ID NO: 3609726 - RNA, 16 nt, Salmonella enterica enterica serovar Typhi
caggguucacugccag

SEQ ID NO: 3609727 - RNA, 18 nt, Salmonella enterica enterica serovar Typhi
caggguucgcguacgcau

SEQ ID NO: 3609728 - RNA, 14 nt, Salmonella enterica enterica serovar Typhi
caggguuuaaucac

SEQ ID NO: 3609729 - RNA, 13 nt, Salmonella enterica enterica serovar Typhi
caggguuugccag

SEQ ID NO: 3609730 - RNA, 23 nt, Salmonella enterica enterica serovar Typhi
cagguaaaccggucagguagcag

SEQ ID NO: 3609731 - RNA, 22 nt, Salmonella enterica enterica serovar Typhi
cagguaacauaucgacauaagu

SEQ ID NO: 3609732 - RNA, 20 nt, Salmonella enterica enterica serovar Typhi
cagguaacgacuacuuccag

SEQ ID NO: 3609733 - RNA, 22 nt, Salmonella enterica enterica serovar Typhi
cagguaacugcacaagccccac

SEQ ID NO: 3609734 - RNA, 20 nt, Salmonella enterica enterica serovar Typhi
cagguaagcuauuacaaaaa

SEQ ID NO: 3609735 - RNA, 19 nt, Salmonella enterica enterica serovar Typhi
cagguaauacaggguuugu

SEQ ID NO: 3609736 - RNA, 15 nt, Salmonella enterica enterica serovar Typhi
cagguaaucaucacc

SEQ ID NO: 3609737 - RNA, 15 nt, Salmonella enterica enterica serovar Typhi
cagguaccccgccac

SEQ ID NO: 3609738 - RNA, 17 nt, Salmonella enterica enterica serovar Typhi
cagguaccccgccaccg

SEQ ID NO: 3609739 - RNA, 20 nt, Salmonella enterica enterica serovar Typhi
cagguaccccgccaccgccg

SEQ ID NO: 3609740 - RNA, 19 nt, Salmonella enterica enterica serovar Typhi
cagguagcgccuuuacugg

SEQ ID NO: 3609741 - RNA, 13 nt, Salmonella enterica enterica serovar Typhi
cagguaucauaug

SEQ ID NO: 3609742 - RNA, 18 nt, Salmonella enterica enterica serovar Typhi
cagguaucauaugugccg

SEQ ID NO: 3609743 - RNA, 22 nt, Salmonella enterica enterica serovar Typhi
cagguauggugcucaggaucaa

SEQ ID NO: 3609744 - RNA, 13 nt, Salmonella enterica enterica serovar Typhi
cagguauuaaaua

SEQ ID NO: 3609745 - RNA, 18 nt, Salmonella enterica enterica serovar Typhi
cagguauuaaauacagag

SEQ ID NO: 3609746 - RNA, 16 nt, Salmonella enterica enterica serovar Typhi
cagguauuaauccugc

SEQ ID NO: 3609747 - RNA, 13 nt, Salmonella enterica enterica serovar Typhi
cagguauucuaac

SEQ ID NO: 3609748 - RNA, 20 nt, Salmonella enterica enterica serovar Typhi
cagguauuuagccacgccgu

SEQ ID NO: 3609749 - RNA, 24 nt, Salmonella enterica enterica serovar Typhi
cagguauuucgaggggcaggaagg

SEQ ID NO: 3609750 - RNA, 19 nt, Salmonella enterica enterica serovar Typhi
caggucaucaccuccagca

SEQ ID NO: 3609751 - RNA, 23 nt, Salmonella enterica enterica serovar Typhi
caggucgaugaggauauugguau

SEQ ID NO: 3609752 - RNA, 15 nt, Salmonella enterica enterica serovar Typhi
caggucgaugauuuu

SEQ ID NO: 3609753 - RNA, 18 nt, Salmonella enterica enterica serovar Typhi
caggucgcccagccauaa

SEQ ID NO: 3609754 - RNA, 21 nt, Salmonella enterica enterica serovar Typhi
caggucguccguugccaccca

SEQ ID NO: 3609755 - RNA, 22 nt, Salmonella enterica enterica serovar Typhi
caguacgucaacaaugcuuuca

SEQ ID NO: 3609756 - RNA, 13 nt, Salmonella enterica enterica serovar Typhi
caguacugcgccc

SEQ ID NO: 3609757 - RNA, 17 nt, Salmonella enterica enterica serovar Typhi
caguacuuucuuuugau

SEQ ID NO: 3609758 - RNA, 19 nt, Salmonella enterica enterica serovar Typhi
caguagaucgacauaagag

SEQ ID NO: 3609759 - RNA, 18 nt, Salmonella enterica enterica serovar Typhi
caguagauggcgcuaaaa

SEQ ID NO: 3609760 - RNA, 15 nt, Salmonella enterica enterica serovar Typhi
caguagcagacagcc

SEQ ID NO: 3609761 - RNA, 16 nt, Salmonella enterica enterica serovar Typhi
caguagcagacagccg

SEQ ID NO: 3609762 - RNA, 13 nt, Salmonella enterica enterica serovar Typhi
caguagcgcgccc

SEQ ID NO: 3609763 - RNA, 16 nt, Salmonella enterica enterica serovar Typhi
caguaggacaaaaaug

SEQ ID NO: 3609764 - RNA, 20 nt, Salmonella enterica enterica serovar Typhi
caguagucgcgccauuccgc

SEQ ID NO: 3609765 - RNA, 22 nt, Salmonella enterica enterica serovar Typhi
caguaguuaccguaaucaucgc

SEQ ID NO: 3609766 - RNA, 22 nt, Salmonella enterica enterica serovar Typhi
caguaguugaccugaucggcca

SEQ ID NO: 3609767 - RNA, 22 nt, Salmonella enterica enterica serovar Typhi
caguauccacgcggugcccugg

SEQ ID NO: 3609768 - RNA, 22 nt, Salmonella enterica enterica serovar Typhi
caguaugaucaugcccggcaaa

SEQ ID NO: 3609769 - RNA, 16 nt, Salmonella enterica enterica serovar Typhi
caguauugccgaugcc

SEQ ID NO: 3609770 - RNA, 20 nt, Salmonella enterica enterica serovar Typhi
caguauugccgaugccugcg

SEQ ID NO: 3609771 - RNA, 18 nt, Salmonella enterica enterica serovar Typhi
cagucacccugcccugca

SEQ ID NO: 3609772 - RNA, 14 nt, Salmonella enterica enterica serovar Typhi
cagucagccuugac

SEQ ID NO: 3609773 - RNA, 19 nt, Salmonella enterica enterica serovar Typhi
cagucagccuugaccgccu

SEQ ID NO: 3609774 - RNA, 16 nt, Salmonella enterica enterica serovar Typhi
cagucagcgcgagcgu

SEQ ID NO: 3609775 - RNA, 14 nt, Salmonella enterica enterica serovar Typhi
cagucaucgccgcu

SEQ ID NO: 3609776 - RNA, 14 nt, Salmonella enterica enterica serovar Typhi
cagucaugaaaucg

SEQ ID NO: 3609777 - RNA, 23 nt, Salmonella enterica enterica serovar Typhi
cagucaugaaaucgauuuguuua

SEQ ID NO: 3609778 - RNA, 13 nt, Salmonella enterica enterica serovar Typhi
cagucauuaauuc

SEQ ID NO: 3609779 - RNA, 23 nt, Salmonella enterica enterica serovar Typhi
cagucauuaauucccgcagccag

SEQ ID NO: 3609780 - RNA, 22 nt, Salmonella enterica enterica serovar Typhi
caguccagccgccgcgcggcag

SEQ ID NO: 3609781 - RNA, 23 nt, Salmonella enterica enterica serovar Typhi
caguccagcgcggguucuuucca

SEQ ID NO: 3609782 - RNA, 19 nt, Salmonella enterica enterica serovar Typhi
cagucccaaugcggaaacc

SEQ ID NO: 3609783 - RNA, 22 nt, Salmonella enterica enterica serovar Typhi
cagucccaaugcggaaaccagu

SEQ ID NO: 3609784 - RNA, 14 nt, Salmonella enterica enterica serovar Typhi
caguccccuuuuca

SEQ ID NO: 3609785 - RNA, 20 nt, Salmonella enterica enterica serovar Typhi
cagucccugaagaaaaggaa

SEQ ID NO: 3609786 - RNA, 24 nt, Salmonella enterica enterica serovar Typhi
cagucccugaagaaaaggaaugcc

SEQ ID NO: 3609787 - RNA, 16 nt, Salmonella enterica enterica serovar Typhi
caguccgcacgccugc

SEQ ID NO: 3609788 - RNA, 15 nt, Salmonella enterica enterica serovar Typhi
caguccgcccgccuc

SEQ ID NO: 3609789 - RNA, 19 nt, Salmonella enterica enterica serovar Typhi
caguccgcgcgcuuuuuug

SEQ ID NO: 3609790 - RNA, 22 nt, Salmonella enterica enterica serovar Typhi
caguccggaugucucagcgcau

SEQ ID NO: 3609791 - RNA, 23 nt, Salmonella enterica enterica serovar Typhi
caguccgguacgacgacccuuuu

SEQ ID NO: 3609792 - RNA, 21 nt, Salmonella enterica enterica serovar Typhi
caguccgguggcgaaaacgcu

SEQ ID NO: 3609793 - RNA, 16 nt, Salmonella enterica enterica serovar Typhi
caguccuccggcugaa

SEQ ID NO: 3609794 - RNA, 14 nt, Salmonella enterica enterica serovar Typhi
caguccucgcccac

SEQ ID NO: 3609795 - RNA, 17 nt, Salmonella enterica enterica serovar Typhi
caguccucgcccacuuc

SEQ ID NO: 3609796 - RNA, 14 nt, Salmonella enterica enterica serovar Typhi
caguccugucccug

SEQ ID NO: 3609797 - RNA, 23 nt, Salmonella enterica enterica serovar Typhi
cagucgaacauccuugcacgcca

SEQ ID NO: 3609798 - RNA, 19 nt, Salmonella enterica enterica serovar Typhi
cagucgacaguauagaaau

SEQ ID NO: 3609799 - RNA, 16 nt, Salmonella enterica enterica serovar Typhi
cagucgauguggccuu

SEQ ID NO: 3609800 - RNA, 20 nt, Salmonella enterica enterica serovar Typhi
cagucgauguggccuuccuc

SEQ ID NO: 3609801 - RNA, 13 nt, Salmonella enterica enterica serovar Typhi
cagucgcagccac

SEQ ID NO: 3609802 - RNA, 19 nt, Salmonella enterica enterica serovar Typhi
cagucgccagaaggcaggc

SEQ ID NO: 3609803 - RNA, 20 nt, Salmonella enterica enterica serovar Typhi
cagucgcgccgugcccagca

SEQ ID NO: 3609804 - RNA, 21 nt, Salmonella enterica enterica serovar Typhi
cagucggcaaagaccaauaaa

SEQ ID NO: 3609805 - RNA, 20 nt, Salmonella enterica enterica serovar Typhi
cagucgucauggcguaaauc

SEQ ID NO: 3609806 - RNA, 15 nt, Salmonella enterica enterica serovar Typhi
cagucgucuggcgcu

SEQ ID NO: 3609807 - RNA, 17 nt, Salmonella enterica enterica serovar Typhi
cagucguggcggauucu

SEQ ID NO: 3609808 - RNA, 14 nt, Salmonella enterica enterica serovar Typhi
cagucguuaucuga

SEQ ID NO: 3609809 - RNA, 16 nt, Salmonella enterica enterica serovar Typhi
cagucguugcgccugu

SEQ ID NO: 3609810 - RNA, 16 nt, Salmonella enterica enterica serovar Typhi
cagucguuuacgcgcu

SEQ ID NO: 3609811 - RNA, 16 nt, Salmonella enterica enterica serovar Typhi
cagucuaauuuauuaa

SEQ ID NO: 3609812 - RNA, 20 nt, Salmonella enterica enterica serovar Typhi
cagucuaauuuauuaacccu

SEQ ID NO: 3609813 - RNA, 21 nt, Salmonella enterica enterica serovar Typhi
cagucucaaaggccugcauca

SEQ ID NO: 3609814 - RNA, 16 nt, Salmonella enterica enterica serovar Typhi
cagucuggcggcagcc

SEQ ID NO: 3609815 - RNA, 22 nt, Salmonella enterica enterica serovar Typhi
cagucuggguuagcuguaucca

SEQ ID NO: 3609816 - RNA, 15 nt, Salmonella enterica enterica serovar Typhi
cagugaaaagcugga

SEQ ID NO: 3609817 - RNA, 14 nt, Salmonella enterica enterica serovar Typhi
cagugaacacccug

SEQ ID NO: 3609818 - RNA, 16 nt, Salmonella enterica enterica serovar Typhi
cagugaacacccugcc

SEQ ID NO: 3609819 - RNA, 17 nt, Salmonella enterica enterica serovar Typhi
cagugaacacccugccc

SEQ ID NO: 3609820 - RNA, 17 nt, Salmonella enterica enterica serovar Typhi
cagugaagaauggcgcc

SEQ ID NO: 3609821 - RNA, 22 nt, Salmonella enterica enterica serovar Typhi
cagugaauauccccugacagag

SEQ ID NO: 3609822 - RNA, 23 nt, Salmonella enterica enterica serovar Typhi
cagugacauuuaucuuccggcau

SEQ ID NO: 3609823 - RNA, 15 nt, Salmonella enterica enterica serovar Typhi
cagugaccagcauca

SEQ ID NO: 3609824 - RNA, 14 nt, Salmonella enterica enterica serovar Typhi
cagugacccgccgc

SEQ ID NO: 3609825 - RNA, 16 nt, Salmonella enterica enterica serovar Typhi
cagugacccgccgcca

SEQ ID NO: 3609826 - RNA, 15 nt, Salmonella enterica enterica serovar Typhi
cagugaguaacguua

SEQ ID NO: 3609827 - RNA, 20 nt, Salmonella enterica enterica serovar Typhi
cagugauccaucgguucucu

SEQ ID NO: 3609828 - RNA, 21 nt, Salmonella enterica enterica serovar Typhi
cagugaugaaucgcuauugag

SEQ ID NO: 3609829 - RNA, 15 nt, Salmonella enterica enterica serovar Typhi
cagugauuacaaaau

SEQ ID NO: 3609830 - RNA, 16 nt, Salmonella enterica enterica serovar Typhi
cagugauuaugcuccc

SEQ ID NO: 3609831 - RNA, 23 nt, Salmonella enterica enterica serovar Typhi
cagugauucgcgaaucgcuucac

SEQ ID NO: 3609832 - RNA, 16 nt, Salmonella enterica enterica serovar Typhi
cagugcagaaagugug

SEQ ID NO: 3609833 - RNA, 19 nt, Salmonella enterica enterica serovar Typhi
cagugcaggauuuguauca

SEQ ID NO: 3609834 - RNA, 23 nt, Salmonella enterica enterica serovar Typhi
cagugcaguauugcaccaggaag

SEQ ID NO: 3609835 - RNA, 15 nt, Salmonella enterica enterica serovar Typhi
cagugccaguccggu

SEQ ID NO: 3609836 - RNA, 21 nt, Salmonella enterica enterica serovar Typhi
cagugccaguccgguauaaaa

SEQ ID NO: 3609837 - RNA, 21 nt, Salmonella enterica enterica serovar Typhi
cagugcgaugcgaccgcgcca

SEQ ID NO: 3609838 - RNA, 23 nt, Salmonella enterica enterica serovar Typhi
cagugcgaugggcuucagauguu

SEQ ID NO: 3609839 - RNA, 22 nt, Salmonella enterica enterica serovar Typhi
cagugcgcauacuaccgcugcg

SEQ ID NO: 3609840 - RNA, 19 nt, Salmonella enterica enterica serovar Typhi
cauaaaccccgauaaacca

SEQ ID NO: 3609841 - RNA, 19 nt, Salmonella enterica enterica serovar Typhi
cauaaaccgccgcuuugau

SEQ ID NO: 3609842 - RNA, 16 nt, Salmonella enterica enterica serovar Typhi
cauaaagcgucuuaga

SEQ ID NO: 3609843 - RNA, 21 nt, Salmonella enterica enterica serovar Typhi
cauaaaggcuuuaaagcaggc

SEQ ID NO: 3609844 - RNA, 18 nt, Salmonella enterica enterica serovar Typhi
cauaaagucagacaagua

SEQ ID NO: 3609845 - RNA, 22 nt, Salmonella enterica enterica serovar Typhi
cauaaauaaugccguuuuagcg

SEQ ID NO: 3609846 - RNA, 20 nt, Salmonella enterica enterica serovar Typhi
cauaaauacaauucaacuca

SEQ ID NO: 3609847 - RNA, 16 nt, Salmonella enterica enterica serovar Typhi
cauaaauacguaacac

SEQ ID NO: 3609848 - RNA, 21 nt, Salmonella enterica enterica serovar Typhi
cauaaauagccgaccgccgau

SEQ ID NO: 3609849 - RNA, 17 nt, Salmonella enterica enterica serovar Typhi
cauaaauaucugcauug

SEQ ID NO: 3609850 - RNA, 21 nt, Salmonella enterica enterica serovar Typhi
cauaaauauuggcggcaaaga

SEQ ID NO: 3609851 - RNA, 19 nt, Salmonella enterica enterica serovar Typhi
cauaaaucauuacuuauau

SEQ ID NO: 3609852 - RNA, 21 nt, Salmonella enterica enterica serovar Typhi
cauaaaucauuacuuauauuu

SEQ ID NO: 3609853 - RNA, 21 nt, Salmonella enterica enterica serovar Typhi
cauaaaugcgaugaacaucga

SEQ ID NO: 3609854 - RNA, 22 nt, Salmonella enterica enterica serovar Typhi
cauaaaugcugucgcccauuga

SEQ ID NO: 3609855 - RNA, 17 nt, Salmonella enterica enterica serovar Typhi
cauaaauugcagcgacc

SEQ ID NO: 3609856 - RNA, 14 nt, Salmonella enterica enterica serovar Typhi
cauaacaacuauuu

SEQ ID NO: 3609857 - RNA, 22 nt, Salmonella enterica enterica serovar Typhi
cauaaccaaacgcgcauuuuau

SEQ ID NO: 3609858 - RNA, 22 nt, Salmonella enterica enterica serovar Typhi
cauaaccggcaaccaaagucca

SEQ ID NO: 3609859 - RNA, 16 nt, Salmonella enterica enterica serovar Typhi
cauaaccgugcggcgg

SEQ ID NO: 3609860 - RNA, 17 nt, Salmonella enterica enterica serovar Typhi
cauaacgaaauccgcgc

SEQ ID NO: 3609861 - RNA, 21 nt, Salmonella enterica enterica serovar Typhi
cauaacgaaauccgcgccgcc

SEQ ID NO: 3609862 - RNA, 18 nt, Salmonella enterica enterica serovar Typhi
cauaacgcacgcuaaagc

SEQ ID NO: 3609863 - RNA, 15 nt, Salmonella enterica enterica serovar Typhi
cauaacgccgaugcc

SEQ ID NO: 3609864 - RNA, 16 nt, Salmonella enterica enterica serovar Typhi
cauaacgccuuauucg

SEQ ID NO: 3609865 - RNA, 17 nt, Salmonella enterica enterica serovar Typhi
cauaacgcuguaccggc

SEQ ID NO: 3609866 - RNA, 18 nt, Salmonella enterica enterica serovar Typhi
cauaacggcuacgcagcg

SEQ ID NO: 3609867 - RNA, 14 nt, Salmonella enterica enterica serovar Typhi
cauaacgggaagcc

SEQ ID NO: 3609868 - RNA, 18 nt, Salmonella enterica enterica serovar Typhi
cauaacguuuccuuauau

SEQ ID NO: 3609869 - RNA, 20 nt, Salmonella enterica enterica serovar Typhi
cauaagagauggaaugagca

SEQ ID NO: 3609870 - RNA, 21 nt, Salmonella enterica enterica serovar Typhi
cauaagagauggaaugagcau

SEQ ID NO: 3609871 - RNA, 23 nt, Salmonella enterica enterica serovar Typhi
cauaagagauggaaugagcaucu

SEQ ID NO: 3609872 - RNA, 15 nt, Salmonella enterica enterica serovar Typhi
cauaagcaaacagug

SEQ ID NO: 3609873 - RNA, 15 nt, Salmonella enterica enterica serovar Typhi
cauaagcaaauccuc

SEQ ID NO: 3609874 - RNA, 21 nt, Salmonella enterica enterica serovar Typhi
cauaagcacaccauuucacaa

SEQ ID NO: 3609875 - RNA, 14 nt, Salmonella enterica enterica serovar Typhi
cauaagccaguccu

SEQ ID NO: 3609876 - RNA, 18 nt, Salmonella enterica enterica serovar Typhi
cauaagccaguccugcca

SEQ ID NO: 3609877 - RNA, 22 nt, Salmonella enterica enterica serovar Typhi
cauaagccgcguucugucgaua

SEQ ID NO: 3609878 - RNA, 15 nt, Salmonella enterica enterica serovar Typhi
cauaagcgcggcgga

SEQ ID NO: 3609879 - RNA, 21 nt, Salmonella enterica enterica serovar Typhi
cauaagcugcgacaacaaguc

SEQ ID NO: 3609880 - RNA, 19 nt, Salmonella enterica enterica serovar Typhi
cauaaggguaagcaauaug

SEQ ID NO: 3609881 - RNA, 22 nt, Salmonella enterica enterica serovar Typhi
cauaagugauacaugcuacagg

SEQ ID NO: 3609882 - RNA, 20 nt, Salmonella enterica enterica serovar Typhi
cauaauaaacugcauccccu

SEQ ID NO: 3609883 - RNA, 14 nt, Salmonella enterica enterica serovar Typhi
cauaauaaauaggc

SEQ ID NO: 3609884 - RNA, 17 nt, Salmonella enterica enterica serovar Typhi
cauaauaagcgcucagg

SEQ ID NO: 3609885 - RNA, 23 nt, Salmonella enterica enterica serovar Typhi
cauaauaagcgcucaggcagcca

SEQ ID NO: 3609886 - RNA, 14 nt, Salmonella enterica enterica serovar Typhi
cauaauaaugaaua

SEQ ID NO: 3609887 - RNA, 16 nt, Salmonella enterica enterica serovar Typhi
cauaauaaugacuaau

SEQ ID NO: 3609888 - RNA, 17 nt, Salmonella enterica enterica serovar Typhi
cauaauaaugacuaauu

SEQ ID NO: 3609889 - RNA, 20 nt, Salmonella enterica enterica serovar Typhi
cauaauaugcaacacgccga

SEQ ID NO: 3609890 - RNA, 21 nt, Salmonella enterica enterica serovar Typhi
cauaauauucauaacgccgau

SEQ ID NO: 3609891 - RNA, 19 nt, Salmonella enterica enterica serovar Typhi
cauaaucaguacugcgccc

SEQ ID NO: 3609892 - RNA, 15 nt, Salmonella enterica enterica serovar Typhi
cauaaucgauauaau

SEQ ID NO: 3609893 - RNA, 19 nt, Salmonella enterica enterica serovar Typhi
cauaaucgauauaauuuua

SEQ ID NO: 3609894 - RNA, 18 nt, Salmonella enterica enterica serovar Typhi
cauaaucgccgacuaauu

SEQ ID NO: 3609895 - RNA, 23 nt, Salmonella enterica enterica serovar Typhi
cauaaucgccgacuaauuauuuu

SEQ ID NO: 3609896 - RNA, 12 nt, Salmonella enterica enterica serovar Typhi
cauaaucgcgau

SEQ ID NO: 3609897 - RNA, 20 nt, Salmonella enterica enterica serovar Typhi
cauaaucggccaggauggcc

SEQ ID NO: 3609898 - RNA, 22 nt, Salmonella enterica enterica serovar Typhi
cauaaucugugauugaauucac

SEQ ID NO: 3609899 - RNA, 14 nt, Salmonella enterica enterica serovar Typhi
cauaaugaauacgc

SEQ ID NO: 3609900 - RNA, 16 nt, Salmonella enterica enterica serovar Typhi
cauaaugaauacgcuc

SEQ ID NO: 3609901 - RNA, 20 nt, Salmonella enterica enterica serovar Typhi
cauaaugacgauaaauaaga

SEQ ID NO: 3609902 - RNA, 21 nt, Salmonella enterica enterica serovar Typhi
cauaaugauggggucacaggu

SEQ ID NO: 3609903 - RNA, 19 nt, Salmonella enterica enterica serovar Typhi
cauaauggaacugccuggc

SEQ ID NO: 3609904 - RNA, 14 nt, Salmonella enterica enterica serovar Typhi
cauaauggcccagu

SEQ ID NO: 3609905 - RNA, 21 nt, Salmonella enterica enterica serovar Typhi
cauaauggcccaguguacugc

SEQ ID NO: 3609906 - RNA, 23 nt, Salmonella enterica enterica serovar Typhi
cauaauggcgacgccuucaguca

SEQ ID NO: 3609907 - RNA, 17 nt, Salmonella enterica enterica serovar Typhi
cauaaugguggaaugcc

SEQ ID NO: 3609908 - RNA, 20 nt, Salmonella enterica enterica serovar Typhi
cauaauugcugcccgccgcc

SEQ ID NO: 3609909 - RNA, 21 nt, Salmonella enterica enterica serovar Typhi
cauaauugcugcccgccgccg

SEQ ID NO: 3609910 - RNA, 17 nt, Salmonella enterica enterica serovar Typhi
cauaauuguucagcuac

SEQ ID NO: 3609911 - RNA, 15 nt, Salmonella enterica enterica serovar Typhi
cauaauuuuugccuu

SEQ ID NO: 3609912 - RNA, 16 nt, Salmonella enterica enterica serovar Typhi
cauaauuuuugccuuu

SEQ ID NO: 3609913 - RNA, 15 nt, Salmonella enterica enterica serovar Typhi
cauacaccggcgcca

SEQ ID NO: 3609914 - RNA, 14 nt, Salmonella enterica enterica serovar Typhi
cauacacgcggcga

SEQ ID NO: 3609915 - RNA, 14 nt, Salmonella enterica enterica serovar Typhi
cauacacugcauaa

SEQ ID NO: 3609916 - RNA, 15 nt, Salmonella enterica enterica serovar Typhi
cauacagcacuuccc

SEQ ID NO: 3609917 - RNA, 19 nt, Salmonella enterica enterica serovar Typhi
cauacagcgauaaccgccg

SEQ ID NO: 3609918 - RNA, 15 nt, Salmonella enterica enterica serovar Typhi
cauacagguuuuaau

SEQ ID NO: 3609919 - RNA, 16 nt, Salmonella enterica enterica serovar Typhi
cauacaguggccagac

SEQ ID NO: 3609920 - RNA, 14 nt, Salmonella enterica enterica serovar Typhi
cauacauaaauccg

SEQ ID NO: 3609921 - RNA, 17 nt, Salmonella enterica enterica serovar Typhi
cauacaugccugcgcca

SEQ ID NO: 3609922 - RNA, 18 nt, Salmonella enterica enterica serovar Typhi
cauacauuucgucaucgc

SEQ ID NO: 3609923 - RNA, 20 nt, Salmonella enterica enterica serovar Typhi
cauacauuuuuguaauaaaa

SEQ ID NO: 3609924 - RNA, 16 nt, Salmonella enterica enterica serovar Typhi
cauaccacaacagaau

SEQ ID NO: 3609925 - RNA, 13 nt, Salmonella enterica enterica serovar Typhi
cauauauuuacug

SEQ ID NO: 3609926 - RNA, 21 nt, Salmonella enterica enterica serovar Typhi
cauauauuuacugaauaaaua

SEQ ID NO: 3609927 - RNA, 14 nt, Salmonella enterica enterica serovar Typhi
cauaucaaucaacg

SEQ ID NO: 3609928 - RNA, 13 nt, Salmonella enterica enterica serovar Typhi
cauaucaguugcc

SEQ ID NO: 3609929 - RNA, 11 nt, Salmonella enterica enterica serovar Typhi
cauauccagcc

SEQ ID NO: 3609930 - RNA, 12 nt, Salmonella enterica enterica serovar Typhi
cauaucgacggu

SEQ ID NO: 3609931 - RNA, 16 nt, Salmonella enterica enterica serovar Typhi
cauaucgccagccaug

SEQ ID NO: 3609932 - RNA, 15 nt, Salmonella enterica enterica serovar Typhi
cauaucgcgcagcgu

SEQ ID NO: 3609933 - RNA, 23 nt, Salmonella enterica enterica serovar Typhi
cauaucgucaucggucaguuugc

SEQ ID NO: 3609934 - RNA, 13 nt, Salmonella enterica enterica serovar Typhi
cauaucugcgccg

SEQ ID NO: 3609935 - RNA, 15 nt, Salmonella enterica enterica serovar Typhi
cauaucugcgccgcc

SEQ ID NO: 3609936 - RNA, 21 nt, Salmonella enterica enterica serovar Typhi
cauaucuggauacccccuauc

SEQ ID NO: 3609937 - RNA, 23 nt, Salmonella enterica enterica serovar Typhi
cauaucuggcgaggcuuuguccu

SEQ ID NO: 3609938 - RNA, 14 nt, Salmonella enterica enterica serovar Typhi
cauaucuuccaggc

SEQ ID NO: 3609939 - RNA, 21 nt, Salmonella enterica enterica serovar Typhi
cauaucuucgcgcguggugcu

SEQ ID NO: 3609940 - RNA, 13 nt, Salmonella enterica enterica serovar Typhi
cauaugcgcggcg

SEQ ID NO: 3609941 - RNA, 14 nt, Salmonella enterica enterica serovar Typhi
cauaugcucuccug

SEQ ID NO: 3609942 - RNA, 18 nt, Salmonella enterica enterica serovar Typhi
cauauuaucgcgcugaau

SEQ ID NO: 3609943 - RNA, 20 nt, Salmonella enterica enterica serovar Typhi
cauauucauaucgaagccca

SEQ ID NO: 3609944 - RNA, 13 nt, Salmonella enterica enterica serovar Typhi
cauauucaugguu

SEQ ID NO: 3609945 - RNA, 20 nt, Salmonella enterica enterica serovar Typhi
cauauuccagaagcgcuuug

SEQ ID NO: 3609946 - RNA, 11 nt, Salmonella enterica enterica serovar Typhi
cauauuccugc

SEQ ID NO: 3609947 - RNA, 15 nt, Salmonella enterica enterica serovar Typhi
cauauucgccaccgc

SEQ ID NO: 3609948 - RNA, 16 nt, Salmonella enterica enterica serovar Typhi
cauauucgucuucauc

SEQ ID NO: 3609949 - RNA, 16 nt, Salmonella enterica enterica serovar Typhi
cauauucugcgaaagc

SEQ ID NO: 3609950 - RNA, 20 nt, Salmonella enterica enterica serovar Typhi
cauauucuuugcgccuuauu

SEQ ID NO: 3609951 - RNA, 22 nt, Salmonella enterica enterica serovar Typhi
cauauucuuugcgccuuauuca

SEQ ID NO: 3609952 - RNA, 14 nt, Salmonella enterica enterica serovar Typhi
cauauugccgcaca

SEQ ID NO: 3609953 - RNA, 20 nt, Salmonella enterica enterica serovar Typhi
cauauugcgacaacuagaau

SEQ ID NO: 3609954 - RNA, 20 nt, Salmonella enterica enterica serovar Typhi
cauauugcgcuucacuaacu

SEQ ID NO: 3609955 - RNA, 21 nt, Salmonella enterica enterica serovar Typhi
cauauuuucaacggcaucaau

SEQ ID NO: 3609956 - RNA, 15 nt, Salmonella enterica enterica serovar Typhi
cauauuuuucacaca

SEQ ID NO: 3609957 - RNA, 16 nt, Salmonella enterica enterica serovar Typhi
cauauuuuuucaggaa

SEQ ID NO: 3609958 - RNA, 18 nt, Salmonella enterica enterica serovar Typhi
caucaaaaucaucgccac

SEQ ID NO: 3609959 - RNA, 14 nt, Salmonella enterica enterica serovar Typhi
caucaaacagcggc

SEQ ID NO: 3609960 - RNA, 12 nt, Salmonella enterica enterica serovar Typhi
caucaaacgcag

SEQ ID NO: 3609961 - RNA, 19 nt, Salmonella enterica enterica serovar Typhi
caucaaacgcagcaaacgc

SEQ ID NO: 3609962 - RNA, 17 nt, Salmonella enterica enterica serovar Typhi
caucaaaguuauuuacc

SEQ ID NO: 3609963 - RNA, 15 nt, Salmonella enterica enterica serovar Typhi
caucaaauaauacgc

SEQ ID NO: 3609964 - RNA, 20 nt, Salmonella enterica enterica serovar Typhi
caucaaccaccaaaaagcca

SEQ ID NO: 3609965 - RNA, 14 nt, Salmonella enterica enterica serovar Typhi
caucaacguaaaua

SEQ ID NO: 3609966 - RNA, 22 nt, Salmonella enterica enterica serovar Typhi
caucaaguacagcuuaaucacc

SEQ ID NO: 3609967 - RNA, 22 nt, Salmonella enterica enterica serovar Typhi
caucaauaccugucggcaaauc

SEQ ID NO: 3609968 - RNA, 13 nt, Salmonella enterica enterica serovar Typhi
caucaauagcgcu

SEQ ID NO: 3609969 - RNA, 13 nt, Salmonella enterica enterica serovar Typhi
caucaaucaccuu

SEQ ID NO: 3609970 - RNA, 21 nt, Salmonella enterica enterica serovar Typhi
caucaaucacuacggguuuuu

SEQ ID NO: 3609971 - RNA, 16 nt, Salmonella enterica enterica serovar Typhi
caucaauccaacgaaa

SEQ ID NO: 3609972 - RNA, 20 nt, Salmonella enterica enterica serovar Typhi
caucaaucgcuaucugacag

SEQ ID NO: 3609973 - RNA, 19 nt, Salmonella enterica enterica serovar Typhi
caucaaugcccagcgcaau

SEQ ID NO: 3609974 - RNA, 22 nt, Salmonella enterica enterica serovar Typhi
caucaaugcccagcgcaaucac

SEQ ID NO: 3609975 - RNA, 19 nt, Salmonella enterica enterica serovar Typhi
caucaauggcgauuuuuag

SEQ ID NO: 3609976 - RNA, 16 nt, Salmonella enterica enterica serovar Typhi
caucaauuugaaaagg

SEQ ID NO: 3609977 - RNA, 18 nt, Salmonella enterica enterica serovar Typhi
caucaauuuugcgccuac

SEQ ID NO: 3609978 - RNA, 18 nt, Salmonella enterica enterica serovar Typhi
caucacagccacacugcu

SEQ ID NO: 3609979 - RNA, 19 nt, Salmonella enterica enterica serovar Typhi
caucacagccacacugcug

SEQ ID NO: 3609980 - RNA, 20 nt, Salmonella enterica enterica serovar Typhi
caucacagccacacugcugu

SEQ ID NO: 3609981 - RNA, 14 nt, Salmonella enterica enterica serovar Typhi
caucacaucgccgu

SEQ ID NO: 3609982 - RNA, 21 nt, Salmonella enterica enterica serovar Typhi
caucacaugcgggagcaaaau

SEQ ID NO: 3609983 - RNA, 18 nt, Salmonella enterica enterica serovar Typhi
caucaccaguugcgaagc

SEQ ID NO: 3609984 - RNA, 22 nt, Salmonella enterica enterica serovar Typhi
caucaccauaccgacgaccaua

SEQ ID NO: 3609985 - RNA, 23 nt, Salmonella enterica enterica serovar Typhi
caucaccaucguugccagcggcc

SEQ ID NO: 3609986 - RNA, 13 nt, Salmonella enterica enterica serovar Typhi
caucaccggcccc

SEQ ID NO: 3609987 - RNA, 16 nt, Salmonella enterica enterica serovar Typhi
caucaccguuuuccag

SEQ ID NO: 3609988 - RNA, 14 nt, Salmonella enterica enterica serovar Typhi
caucaccuccagca

SEQ ID NO: 3609989 - RNA, 16 nt, Salmonella enterica enterica serovar Typhi
caucaccuccagcacg

SEQ ID NO: 3609990 - RNA, 19 nt, Salmonella enterica enterica serovar Typhi
caucaccugaugucccauc

SEQ ID NO: 3609991 - RNA, 14 nt, Salmonella enterica enterica serovar Typhi
caucacgaaauaac

SEQ ID NO: 3609992 - RNA, 14 nt, Salmonella enterica enterica serovar Typhi
caucacguucaggc

SEQ ID NO: 3609993 - RNA, 19 nt, Salmonella enterica enterica serovar Typhi
caucacuaccauuuccggc

SEQ ID NO: 3609994 - RNA, 14 nt, Salmonella enterica enterica serovar Typhi
caucacucauaaug

SEQ ID NO: 3609995 - RNA, 18 nt, Salmonella enterica enterica serovar Typhi
caucacugaacccaaaca

SEQ ID NO: 3609996 - RNA, 13 nt, Salmonella enterica enterica serovar Typhi
caucacuuccauc

SEQ ID NO: 3609997 - RNA, 16 nt, Salmonella enterica enterica serovar Typhi
caucacuuccuguauc

SEQ ID NO: 3609998 - RNA, 21 nt, Salmonella enterica enterica serovar Typhi
caucacuuccuguaucacuga

SEQ ID NO: 3609999 - RNA, 21 nt, Salmonella enterica enterica serovar Typhi
caucacuuuaugaccauacug

SEQ ID NO: 3610000 - RNA, 16 nt, Salmonella enterica enterica serovar Typhi
caucagaagugccagu

SEQ ID NO: 3610001 - RNA, 21 nt, Salmonella enterica enterica serovar Typhi
caucagaccgagacccagcgc

SEQ ID NO: 3610002 - RNA, 16 nt, Salmonella enterica enterica serovar Typhi
caucagaccgauaaau

SEQ ID NO: 3610003 - RNA, 20 nt, Salmonella enterica enterica serovar Typhi
caucagacuacuuuuacccu

SEQ ID NO: 3610004 - RNA, 15 nt, Salmonella enterica enterica serovar Typhi
caucagacuguaugu

SEQ ID NO: 3610005 - RNA, 19 nt, Salmonella enterica enterica serovar Typhi
caucagauaaacagguaaa

SEQ ID NO: 3610006 - RNA, 16 nt, Salmonella enterica enterica serovar Typhi
caucagauucaacagg

SEQ ID NO: 3610007 - RNA, 14 nt, Salmonella enterica enterica serovar Typhi
caucagcaaaauac

SEQ ID NO: 3610008 - RNA, 19 nt, Salmonella enterica enterica serovar Typhi
caucagcaaaauaccggca

SEQ ID NO: 3610009 - RNA, 22 nt, Salmonella enterica enterica serovar Typhi
caucagcaaaauaccggcagcg

SEQ ID NO: 3610010 - RNA, 14 nt, Salmonella enterica enterica serovar Typhi
caucagcacaaaau

SEQ ID NO: 3610011 - RNA, 13 nt, Salmonella enterica enterica serovar Typhi
caucccauccggg

SEQ ID NO: 3610012 - RNA, 16 nt, Salmonella enterica enterica serovar Typhi
caucccauccgggcca

SEQ ID NO: 3610013 - RNA, 23 nt, Salmonella enterica enterica serovar Typhi
caucccauccgggccacucucca

SEQ ID NO: 3610014 - RNA, 16 nt, Salmonella enterica enterica serovar Typhi
cauccccaccgcugau

SEQ ID NO: 3610015 - RNA, 15 nt, Salmonella enterica enterica serovar Typhi
cauccccgccgagaa

SEQ ID NO: 3610016 - RNA, 15 nt, Salmonella enterica enterica serovar Typhi
caucccggcgacagc

SEQ ID NO: 3610017 - RNA, 22 nt, Salmonella enterica enterica serovar Typhi
caucccgguuugggcgcgaaac

SEQ ID NO: 3610018 - RNA, 16 nt, Salmonella enterica enterica serovar Typhi
caucccgucccaccac

SEQ ID NO: 3610019 - RNA, 20 nt, Salmonella enterica enterica serovar Typhi
caucccguuuucgucccagc

SEQ ID NO: 3610020 - RNA, 14 nt, Salmonella enterica enterica serovar Typhi
caucccugauuuau

SEQ ID NO: 3610021 - RNA, 17 nt, Salmonella enterica enterica serovar Typhi
cauccgacagggcguga

SEQ ID NO: 3610022 - RNA, 19 nt, Salmonella enterica enterica serovar Typhi
cauccgagcgaaucuuccc

SEQ ID NO: 3610023 - RNA, 19 nt, Salmonella enterica enterica serovar Typhi
cauccgcaagacacgcuuc

SEQ ID NO: 3610024 - RNA, 16 nt, Salmonella enterica enterica serovar Typhi
cauccgccagccgcca

SEQ ID NO: 3610025 - RNA, 17 nt, Salmonella enterica enterica serovar Typhi
cauccgccagccgccau

SEQ ID NO: 3610026 - RNA, 14 nt, Salmonella enterica enterica serovar Typhi
cauccgcgaugugu

SEQ ID NO: 3610027 - RNA, 15 nt, Salmonella enterica enterica serovar Typhi
cauccgcgcuuucug

SEQ ID NO: 3610028 - RNA, 15 nt, Salmonella enterica enterica serovar Typhi
cauccgcucccgcuu

SEQ ID NO: 3610029 - RNA, 15 nt, Salmonella enterica enterica serovar Typhi
cauccggcaaacuca

SEQ ID NO: 3610030 - RNA, 19 nt, Salmonella enterica enterica serovar Typhi
cauccggcaaacucagcgg

SEQ ID NO: 3610031 - RNA, 20 nt, Salmonella enterica enterica serovar Typhi
cauccggcaacuaucaugau

SEQ ID NO: 3610032 - RNA, 21 nt, Salmonella enterica enterica serovar Typhi
cauccggcacgccaucgccug

SEQ ID NO: 3610033 - RNA, 16 nt, Salmonella enterica enterica serovar Typhi
cauccggcacggucaa

SEQ ID NO: 3610034 - RNA, 18 nt, Salmonella enterica enterica serovar Typhi
cauccggcauuuaugcug

SEQ ID NO: 3610035 - RNA, 13 nt, Salmonella enterica enterica serovar Typhi
cauccggccagcg

SEQ ID NO: 3610036 - RNA, 22 nt, Salmonella enterica enterica serovar Typhi
cauccggccuggcgcaacguuu

SEQ ID NO: 3610037 - RNA, 14 nt, Salmonella enterica enterica serovar Typhi
cauccggccuguuc

SEQ ID NO: 3610038 - RNA, 22 nt, Salmonella enterica enterica serovar Typhi
cauccggcgauggugcggcgca

SEQ ID NO: 3610039 - RNA, 19 nt, Salmonella enterica enterica serovar Typhi
cauccggcguugcgccgcc

SEQ ID NO: 3610040 - RNA, 20 nt, Salmonella enterica enterica serovar Typhi
cauccgggaguuucaugcca

SEQ ID NO: 3610041 - RNA, 18 nt, Salmonella enterica enterica serovar Typhi
cauccggguuaaaccagc

SEQ ID NO: 3610042 - RNA, 14 nt, Salmonella enterica enterica serovar Typhi
cauccgucaggccc

SEQ ID NO: 3610043 - RNA, 13 nt, Salmonella enterica enterica serovar Typhi
cauccucauuuug

SEQ ID NO: 3610044 - RNA, 22 nt, Salmonella enterica enterica serovar Typhi
cauccucauuuuguugcuccag

SEQ ID NO: 3610045 - RNA, 22 nt, Salmonella enterica enterica serovar Typhi
cauccuccauccagguaacaua

SEQ ID NO: 3610046 - RNA, 13 nt, Salmonella enterica enterica serovar Typhi
cauccucuccuga

SEQ ID NO: 3610047 - RNA, 19 nt, Salmonella enterica enterica serovar Typhi
cauccucuuggguuauuuc

SEQ ID NO: 3610048 - RNA, 13 nt, Salmonella enterica enterica serovar Typhi
cauccucuuuccg

SEQ ID NO: 3610049 - RNA, 14 nt, Salmonella enterica enterica serovar Typhi
cauccugacaggcc

SEQ ID NO: 3610050 - RNA, 20 nt, Salmonella enterica enterica serovar Typhi
cauccugauuauuacaauaa

SEQ ID NO: 3610051 - RNA, 16 nt, Salmonella enterica enterica serovar Typhi
cauccugauuuuacug

SEQ ID NO: 3610052 - RNA, 17 nt, Salmonella enterica enterica serovar Typhi
cauccugcaacucaaaa

SEQ ID NO: 3610053 - RNA, 17 nt, Salmonella enterica enterica serovar Typhi
cauccugccgcaccagu

SEQ ID NO: 3610054 - RNA, 18 nt, Salmonella enterica enterica serovar Typhi
cauccugcggguucaucg

SEQ ID NO: 3610055 - RNA, 21 nt, Salmonella enterica enterica serovar Typhi
cauccugcggguucaucgcca

SEQ ID NO: 3610056 - RNA, 16 nt, Salmonella enterica enterica serovar Typhi
cauccuguaccaccac

SEQ ID NO: 3610057 - RNA, 23 nt, Salmonella enterica enterica serovar Typhi
cauccuuuacaauuucgcaaaca

SEQ ID NO: 3610058 - RNA, 23 nt, Salmonella enterica enterica serovar Typhi
caucgaauaaagacacugcugcu

SEQ ID NO: 3610059 - RNA, 21 nt, Salmonella enterica enterica serovar Typhi
caucgaaugucgauguucugu

SEQ ID NO: 3610060 - RNA, 23 nt, Salmonella enterica enterica serovar Typhi
caucgacaagcuaauccccagcg

SEQ ID NO: 3610061 - RNA, 15 nt, Salmonella enterica enterica serovar Typhi
caucgacagacuuca

SEQ ID NO: 3610062 - RNA, 14 nt, Salmonella enterica enterica serovar Typhi
caucgacagcgcca

SEQ ID NO: 3610063 - RNA, 19 nt, Salmonella enterica enterica serovar Typhi
caucgacgaaauggugugc

SEQ ID NO: 3610064 - RNA, 12 nt, Salmonella enterica enterica serovar Typhi
caucgacgccag

SEQ ID NO: 3610065 - RNA, 21 nt, Salmonella enterica enterica serovar Typhi
caucgacguucagcauaucca

SEQ ID NO: 3610066 - RNA, 18 nt, Salmonella enterica enterica serovar Typhi
caucgacuucgaagguuc

SEQ ID NO: 3610067 - RNA, 23 nt, Salmonella enterica enterica serovar Typhi
caucgagccaacguauaaaaugg

SEQ ID NO: 3610068 - RNA, 19 nt, Salmonella enterica enterica serovar Typhi
caucgagccugaaguaucg

SEQ ID NO: 3610069 - RNA, 14 nt, Salmonella enterica enterica serovar Typhi
caucgauggcgcca

SEQ ID NO: 3610070 - RNA, 18 nt, Salmonella enterica enterica serovar Typhi
caucgauuuccugaugac

SEQ ID NO: 3610071 - RNA, 14 nt, Salmonella enterica enterica serovar Typhi
caucgcaaaauucc

SEQ ID NO: 3610072 - RNA, 20 nt, Salmonella enterica enterica serovar Typhi
caucgcaaugccaccacacg

SEQ ID NO: 3610073 - RNA, 17 nt, Salmonella enterica enterica serovar Typhi
caucgcagauuccgaac

SEQ ID NO: 3610074 - RNA, 17 nt, Salmonella enterica enterica serovar Typhi
caucgcauauugcguau

SEQ ID NO: 3610075 - RNA, 18 nt, Salmonella enterica enterica serovar Typhi
caucgcauuaacguccau

SEQ ID NO: 3610076 - RNA, 19 nt, Salmonella enterica enterica serovar Typhi
caucgccacaugcggcagg

SEQ ID NO: 3610077 - RNA, 15 nt, Salmonella enterica enterica serovar Typhi
caucgccagauaaau

SEQ ID NO: 3610078 - RNA, 13 nt, Salmonella enterica enterica serovar Typhi
caucgccagccau

SEQ ID NO: 3610079 - RNA, 20 nt, Salmonella enterica enterica serovar Typhi
caucgccauccugcagccau

SEQ ID NO: 3610080 - RNA, 18 nt, Salmonella enterica enterica serovar Typhi
caucgccauuaaaagcca

SEQ ID NO: 3610081 - RNA, 15 nt, Salmonella enterica enterica serovar Typhi
caucgccgcggcgcu

SEQ ID NO: 3610082 - RNA, 18 nt, Salmonella enterica enterica serovar Typhi
caucgccgcggcgcuggc

SEQ ID NO: 3610083 - RNA, 20 nt, Salmonella enterica enterica serovar Typhi
caucgccggagccgccuggc

SEQ ID NO: 3610084 - RNA, 13 nt, Salmonella enterica enterica serovar Typhi
caucgccugauga

SEQ ID NO: 3610085 - RNA, 17 nt, Salmonella enterica enterica serovar Typhi
caucgccugaugaccgc

SEQ ID NO: 3610086 - RNA, 16 nt, Salmonella enterica enterica serovar Typhi
caucgccuuaacucuu

SEQ ID NO: 3610087 - RNA, 16 nt, Salmonella enterica enterica serovar Typhi
caucgcgacacccaau

SEQ ID NO: 3610088 - RNA, 22 nt, Salmonella enterica enterica serovar Typhi
caucgcgccaaacgggcaagcc

SEQ ID NO: 3610089 - RNA, 14 nt, Salmonella enterica enterica serovar Typhi
caucgcgccaugau

SEQ ID NO: 3610090 - RNA, 22 nt, Salmonella enterica enterica serovar Typhi
caucgcgccuccccugccggcg

SEQ ID NO: 3610091 - RNA, 16 nt, Salmonella enterica enterica serovar Typhi
caucgcggccagcaug

SEQ ID NO: 3610092 - RNA, 20 nt, Salmonella enterica enterica serovar Typhi
caucgcggucagcggcgcgc

SEQ ID NO: 3610093 - RNA, 15 nt, Salmonella enterica enterica serovar Typhi
caucgcgguuuuccg

SEQ ID NO: 3610094 - RNA, 22 nt, Salmonella enterica enterica serovar Typhi
caucgcuaaccggcggcgucug

SEQ ID NO: 3610095 - RNA, 22 nt, Salmonella enterica enterica serovar Typhi
caucgcuaaguugaacgguaaa

SEQ ID NO: 3610096 - RNA, 23 nt, Salmonella enterica enterica serovar Typhi
caugaauaucaaaccacgcugag

SEQ ID NO: 3610097 - RNA, 19 nt, Salmonella enterica enterica serovar Typhi
caugaaucaucacaauuag

SEQ ID NO: 3610098 - RNA, 18 nt, Salmonella enterica enterica serovar Typhi
caugaaugccccagcgcu

SEQ ID NO: 3610099 - RNA, 14 nt, Salmonella enterica enterica serovar Typhi
caugaauuucucgc

SEQ ID NO: 3610100 - RNA, 14 nt, Salmonella enterica enterica serovar Typhi
caugacauccauga

SEQ ID NO: 3610101 - RNA, 14 nt, Salmonella enterica enterica serovar Typhi
caugaccagcgccg

SEQ ID NO: 3610102 - RNA, 16 nt, Salmonella enterica enterica serovar Typhi
caugaccagcgccgcg

SEQ ID NO: 3610103 - RNA, 18 nt, Salmonella enterica enterica serovar Typhi
caugaccauccacgggcu

SEQ ID NO: 3610104 - RNA, 15 nt, Salmonella enterica enterica serovar Typhi
caugaccauucacac

SEQ ID NO: 3610105 - RNA, 17 nt, Salmonella enterica enterica serovar Typhi
caugaccugggcgccag

SEQ ID NO: 3610106 - RNA, 16 nt, Salmonella enterica enterica serovar Typhi
caugacgggggcgauc

SEQ ID NO: 3610107 - RNA, 22 nt, Salmonella enterica enterica serovar Typhi
caugacgucguuguccggcuga

SEQ ID NO: 3610108 - RNA, 23 nt, Salmonella enterica enterica serovar Typhi
caugacguuuugggaaaaccagu

SEQ ID NO: 3610109 - RNA, 21 nt, Salmonella enterica enterica serovar Typhi
caugacugguuuuucgccgac

SEQ ID NO: 3610110 - RNA, 18 nt, Salmonella enterica enterica serovar Typhi
caugacuuuuuucaaccu

SEQ ID NO: 3610111 - RNA, 17 nt, Salmonella enterica enterica serovar Typhi
caugaguaaugaccaca

SEQ ID NO: 3610112 - RNA, 23 nt, Salmonella enterica enterica serovar Typhi
caugagucgcgcgcgccagucau

SEQ ID NO: 3610113 - RNA, 18 nt, Salmonella enterica enterica serovar Typhi
caugauacccagcguccc

SEQ ID NO: 3610114 - RNA, 14 nt, Salmonella enterica enterica serovar Typhi
caugauauucuguc

SEQ ID NO: 3610115 - RNA, 16 nt, Salmonella enterica enterica serovar Typhi
caugaucauacugccg

SEQ ID NO: 3610116 - RNA, 14 nt, Salmonella enterica enterica serovar Typhi
caugaucgccgcca

SEQ ID NO: 3610117 - RNA, 23 nt, Salmonella enterica enterica serovar Typhi
caugaucuuuccuuuuucaggca

SEQ ID NO: 3610118 - RNA, 13 nt, Salmonella enterica enterica serovar Typhi
caugaugaagaua

SEQ ID NO: 3610119 - RNA, 15 nt, Salmonella enterica enterica serovar Typhi
caugaugagcgccau

SEQ ID NO: 3610120 - RNA, 17 nt, Salmonella enterica enterica serovar Typhi
caugaugagcgccauau

SEQ ID NO: 3610121 - RNA, 20 nt, Salmonella enterica enterica serovar Typhi
caugaugggcgcacagcgcc

SEQ ID NO: 3610122 - RNA, 17 nt, Salmonella enterica enterica serovar Typhi
caugauggugaacagaa

SEQ ID NO: 3610123 - RNA, 16 nt, Salmonella enterica enterica serovar Typhi
caugauuaaagccacg

SEQ ID NO: 3610124 - RNA, 22 nt, Salmonella enterica enterica serovar Typhi
caugauuaaagccacgucugau

SEQ ID NO: 3610125 - RNA, 22 nt, Salmonella enterica enterica serovar Typhi
caugauucuugcggauuaucgu

SEQ ID NO: 3610126 - RNA, 20 nt, Salmonella enterica enterica serovar Typhi
caugauuucuugagcggcau

SEQ ID NO: 3610127 - RNA, 12 nt, Salmonella enterica enterica serovar Typhi
caugcaaaaaag

SEQ ID NO: 3610128 - RNA, 17 nt, Salmonella enterica enterica serovar Typhi
caugcaaaaaagagggu

SEQ ID NO: 3610129 - RNA, 17 nt, Salmonella enterica enterica serovar Typhi
caugcaaaaaagcccau

SEQ ID NO: 3610130 - RNA, 23 nt, Salmonella enterica enterica serovar Typhi
caugcaaaaugcuucuucaaccu

SEQ ID NO: 3610131 - RNA, 20 nt, Salmonella enterica enterica serovar Typhi
caugcagccauagcgcgccg

SEQ ID NO: 3610132 - RNA, 15 nt, Salmonella enterica enterica serovar Typhi
caugcagcucaagcg

SEQ ID NO: 3610133 - RNA, 17 nt, Salmonella enterica enterica serovar Typhi
caugcagcucaagcgcc

SEQ ID NO: 3610134 - RNA, 18 nt, Salmonella enterica enterica serovar Typhi
caugcaucucuucaaaca

SEQ ID NO: 3610135 - RNA, 17 nt, Salmonella enterica enterica serovar Typhi
caugcauuaaugggcga

SEQ ID NO: 3610136 - RNA, 14 nt, Salmonella enterica enterica serovar Typhi
caugccaaaccaga

SEQ ID NO: 3610137 - RNA, 22 nt, Salmonella enterica enterica serovar Typhi
caugccacaacagaagcggccu

SEQ ID NO: 3610138 - RNA, 17 nt, Salmonella enterica enterica serovar Typhi
caugccagaagcaaauu

SEQ ID NO: 3610139 - RNA, 18 nt, Salmonella enterica enterica serovar Typhi
caugccaucauuaauuua

SEQ ID NO: 3610140 - RNA, 23 nt, Salmonella enterica enterica serovar Typhi
caugccaucauuaauuuacugau

SEQ ID NO: 3610141 - RNA, 14 nt, Salmonella enterica enterica serovar Typhi
caugccauugcuuu

SEQ ID NO: 3610142 - RNA, 18 nt, Salmonella enterica enterica serovar Typhi
caugcccacaggcagggc

SEQ ID NO: 3610143 - RNA, 18 nt, Salmonella enterica enterica serovar Typhi
caugcccaguucaaucaa

SEQ ID NO: 3610144 - RNA, 14 nt, Salmonella enterica enterica serovar Typhi
caugcccgccagcg

SEQ ID NO: 3610145 - RNA, 20 nt, Salmonella enterica enterica serovar Typhi
caugcccggauggcgucuga

SEQ ID NO: 3610146 - RNA, 17 nt, Salmonella enterica enterica serovar Typhi
caugcccggugauauug

SEQ ID NO: 3610147 - RNA, 21 nt, Salmonella enterica enterica serovar Typhi
caugcccgucugggagccgcu

SEQ ID NO: 3610148 - RNA, 14 nt, Salmonella enterica enterica serovar Typhi
caugccgccaaacu

SEQ ID NO: 3610149 - RNA, 15 nt, Salmonella enterica enterica serovar Typhi
caugccgccacuucg

SEQ ID NO: 3610150 - RNA, 14 nt, Salmonella enterica enterica serovar Typhi
caugccgcccaggc

SEQ ID NO: 3610151 - RNA, 21 nt, Salmonella enterica enterica serovar Typhi
caugccgccugccgcgccgcc

SEQ ID NO: 3610152 - RNA, 22 nt, Salmonella enterica enterica serovar Typhi
caugccggugcgagaaaaagca

SEQ ID NO: 3610153 - RNA, 15 nt, Salmonella enterica enterica serovar Typhi
caugccguaccguug

SEQ ID NO: 3610154 - RNA, 18 nt, Salmonella enterica enterica serovar Typhi
caugccguauuuaugcua

SEQ ID NO: 3610155 - RNA, 21 nt, Salmonella enterica enterica serovar Typhi
caugccuuuauuucaagcaau

SEQ ID NO: 3610156 - RNA, 21 nt, Salmonella enterica enterica serovar Typhi
caugcgaucgggcaauccauu

SEQ ID NO: 3610157 - RNA, 13 nt, Salmonella enterica enterica serovar Typhi
caugcgcuggacu

SEQ ID NO: 3610158 - RNA, 16 nt, Salmonella enterica enterica serovar Typhi
caugcggaaucacgca

SEQ ID NO: 3610159 - RNA, 21 nt, Salmonella enterica enterica serovar Typhi
caugcggaaucacgcauaucc

SEQ ID NO: 3610160 - RNA, 15 nt, Salmonella enterica enterica serovar Typhi
caugcgggagcuugg

SEQ ID NO: 3610161 - RNA, 17 nt, Salmonella enterica enterica serovar Typhi
caugcgggauggccgcc

SEQ ID NO: 3610162 - RNA, 22 nt, Salmonella enterica enterica serovar Typhi
caugcgggggaaucuuauuuuc

SEQ ID NO: 3610163 - RNA, 13 nt, Salmonella enterica enterica serovar Typhi
caugcuaaaacag

SEQ ID NO: 3610164 - RNA, 21 nt, Salmonella enterica enterica serovar Typhi
caugcuaaaacagauaacgaa

SEQ ID NO: 3610165 - RNA, 17 nt, Salmonella enterica enterica serovar Typhi
caugcuacaggcaaguu

SEQ ID NO: 3610166 - RNA, 19 nt, Salmonella enterica enterica serovar Typhi
caugcuacaggcaaguuua

SEQ ID NO: 3610167 - RNA, 15 nt, Salmonella enterica enterica serovar Typhi
caugcucauccaacu

SEQ ID NO: 3610168 - RNA, 19 nt, Salmonella enterica enterica serovar Typhi
caugcucauccaacugcgc

SEQ ID NO: 3610169 - RNA, 21 nt, Salmonella enterica enterica serovar Typhi
caugcugaccgaaccgcugua

SEQ ID NO: 3610170 - RNA, 16 nt, Salmonella enterica enterica serovar Typhi
caugcugccauuuuau

SEQ ID NO: 3610171 - RNA, 21 nt, Salmonella enterica enterica serovar Typhi
caugcuggauaccgaauuccg

SEQ ID NO: 3610172 - RNA, 12 nt, Salmonella enterica enterica serovar Typhi
caugcugguugg

SEQ ID NO: 3610173 - RNA, 20 nt, Salmonella enterica enterica serovar Typhi
caugcugugugaccagcagu

SEQ ID NO: 3610174 - RNA, 19 nt, Salmonella enterica enterica serovar Typhi
cauggaacauccucuccug

SEQ ID NO: 3610175 - RNA, 15 nt, Salmonella enterica enterica serovar Typhi
cauggagauccagua

SEQ ID NO: 3610176 - RNA, 20 nt, Salmonella enterica enterica serovar Typhi
cauggaguuccaguucaucu

SEQ ID NO: 3610177 - RNA, 20 nt, Salmonella enterica enterica serovar Typhi
cauggauagucaugaaaucu

SEQ ID NO: 3610178 - RNA, 22 nt, Salmonella enterica enterica serovar Typhi
cauggcaaaagacauccccgcc

SEQ ID NO: 3610179 - RNA, 17 nt, Salmonella enterica enterica serovar Typhi
cauggcagccccggcau

SEQ ID NO: 3610180 - RNA, 21 nt, Salmonella enterica enterica serovar Typhi
cauggccggucuuaugcugcc

SEQ ID NO: 3610181 - RNA, 14 nt, Salmonella enterica enterica serovar Typhi
cauuaugaugaguu

SEQ ID NO: 3610182 - RNA, 13 nt, Salmonella enterica enterica serovar Typhi
cauuauuccccuc

SEQ ID NO: 3610183 - RNA, 21 nt, Salmonella enterica enterica serovar Typhi
cauuauugcgaaauagcgcgg

SEQ ID NO: 3610184 - RNA, 17 nt, Salmonella enterica enterica serovar Typhi
cauuauuuuuaaauaac

SEQ ID NO: 3610185 - RNA, 18 nt, Salmonella enterica enterica serovar Typhi
cauuauuuuuaaauaacu

SEQ ID NO: 3610186 - RNA, 14 nt, Salmonella enterica enterica serovar Typhi
cauucaacgcauca

SEQ ID NO: 3610187 - RNA, 19 nt, Salmonella enterica enterica serovar Typhi
cauucaacgcaucaaauac

SEQ ID NO: 3610188 - RNA, 16 nt, Salmonella enterica enterica serovar Typhi
cauucaacgggcgaua

SEQ ID NO: 3610189 - RNA, 13 nt, Salmonella enterica enterica serovar Typhi
cauucacgccacc

SEQ ID NO: 3610190 - RNA, 15 nt, Salmonella enterica enterica serovar Typhi
cauucacgccaccau

SEQ ID NO: 3610191 - RNA, 16 nt, Salmonella enterica enterica serovar Typhi
cauucacgccaccauc

SEQ ID NO: 3610192 - RNA, 18 nt, Salmonella enterica enterica serovar Typhi
cauucagcggcugcgccu

SEQ ID NO: 3610193 - RNA, 20 nt, Salmonella enterica enterica serovar Typhi
cauucagcggcugcgccugc

SEQ ID NO: 3610194 - RNA, 18 nt, Salmonella enterica enterica serovar Typhi
cauucaggccucugcuuu

SEQ ID NO: 3610195 - RNA, 19 nt, Salmonella enterica enterica serovar Typhi
cauucagugaauuaugacc

SEQ ID NO: 3610196 - RNA, 14 nt, Salmonella enterica enterica serovar Typhi
cauucauaaaagau

SEQ ID NO: 3610197 - RNA, 18 nt, Salmonella enterica enterica serovar Typhi
cauucauaagcaaacagu

SEQ ID NO: 3610198 - RNA, 19 nt, Salmonella enterica enterica serovar Typhi
cauucauugucuuuuucuc

SEQ ID NO: 3610199 - RNA, 12 nt, Salmonella enterica enterica serovar Typhi
cauuccagaccc

SEQ ID NO: 3610200 - RNA, 20 nt, Salmonella enterica enterica serovar Typhi
cauuccaggugucacucauc

SEQ ID NO: 3610201 - RNA, 18 nt, Salmonella enterica enterica serovar Typhi
cauuccauuuuucgaucu

SEQ ID NO: 3610202 - RNA, 17 nt, Salmonella enterica enterica serovar Typhi
cauucccagccgagcgg

SEQ ID NO: 3610203 - RNA, 18 nt, Salmonella enterica enterica serovar Typhi
cauucccagcucuuucaa

SEQ ID NO: 3610204 - RNA, 17 nt, Salmonella enterica enterica serovar Typhi
cauuccugcguugacca

SEQ ID NO: 3610205 - RNA, 18 nt, Salmonella enterica enterica serovar Typhi
cauuccuuuagcuuccag

SEQ ID NO: 3610206 - RNA, 16 nt, Salmonella enterica enterica serovar Typhi
cauucgaauccuccug

SEQ ID NO: 3610207 - RNA, 15 nt, Salmonella enterica enterica serovar Typhi
cauucgauaaccgcc

SEQ ID NO: 3610208 - RNA, 20 nt, Salmonella enterica enterica serovar Typhi
cauucgaucuguguacuuuu

SEQ ID NO: 3610209 - RNA, 13 nt, Salmonella enterica enterica serovar Typhi
cauucgccccagc

SEQ ID NO: 3610210 - RNA, 15 nt, Salmonella enterica enterica serovar Typhi
cauucgccccagcau

SEQ ID NO: 3610211 - RNA, 18 nt, Salmonella enterica enterica serovar Typhi
cauucgcccgcaauguuu

SEQ ID NO: 3610212 - RNA, 16 nt, Salmonella enterica enterica serovar Typhi
cauucgcgcacggcgc

SEQ ID NO: 3610213 - RNA, 16 nt, Salmonella enterica enterica serovar Typhi
cauucgcgucauacuu

SEQ ID NO: 3610214 - RNA, 14 nt, Salmonella enterica enterica serovar Typhi
cauucgcuccucag

SEQ ID NO: 3610215 - RNA, 17 nt, Salmonella enterica enterica serovar Typhi
cauucgcuccucagcgc

SEQ ID NO: 3610216 - RNA, 14 nt, Salmonella enterica enterica serovar Typhi
cauucggcgaaaga

SEQ ID NO: 3610217 - RNA, 22 nt, Salmonella enterica enterica serovar Typhi
cauucgggacaaacccccagcc

SEQ ID NO: 3610218 - RNA, 23 nt, Salmonella enterica enterica serovar Typhi
cauucgggacaaacccccagcca

SEQ ID NO: 3610219 - RNA, 15 nt, Salmonella enterica enterica serovar Typhi
cauucgguaguucca

SEQ ID NO: 3610220 - RNA, 20 nt, Salmonella enterica enterica serovar Typhi
cauucguuuugcugauauga

SEQ ID NO: 3610221 - RNA, 20 nt, Salmonella enterica enterica serovar Typhi
cauucucuucuaccacgcug

SEQ ID NO: 3610222 - RNA, 20 nt, Salmonella enterica enterica serovar Typhi
cauucucuuucugcgccgca

SEQ ID NO: 3610223 - RNA, 15 nt, Salmonella enterica enterica serovar Typhi
cauucugcugaugcu

SEQ ID NO: 3610224 - RNA, 20 nt, Salmonella enterica enterica serovar Typhi
cauucugggaggugaaggau

SEQ ID NO: 3610225 - RNA, 19 nt, Salmonella enterica enterica serovar Typhi
cauucuuuaaaaugacuca

SEQ ID NO: 3610226 - RNA, 17 nt, Salmonella enterica enterica serovar Typhi
cauugaccggaaaaaaa

SEQ ID NO: 3610227 - RNA, 14 nt, Salmonella enterica enterica serovar Typhi
cauugacucaugaa

SEQ ID NO: 3610228 - RNA, 15 nt, Salmonella enterica enterica serovar Typhi
cauugagcauucuac

SEQ ID NO: 3610229 - RNA, 18 nt, Salmonella enterica enterica serovar Typhi
cauugaggcuacccagac

SEQ ID NO: 3610230 - RNA, 16 nt, Salmonella enterica enterica serovar Typhi
cauugaguaaauaaau

SEQ ID NO: 3610231 - RNA, 24 nt, Salmonella enterica enterica serovar Typhi
cauugaucauuggggaaccuggca

SEQ ID NO: 3610232 - RNA, 21 nt, Salmonella enterica enterica serovar Typhi
cauugaugaugaagcugcagg

SEQ ID NO: 3610233 - RNA, 20 nt, Salmonella enterica enterica serovar Typhi
cauugaugcaggcgccuggg

SEQ ID NO: 3610234 - RNA, 19 nt, Salmonella enterica enterica serovar Typhi
cauugaugccugcccaucu

SEQ ID NO: 3610235 - RNA, 15 nt, Salmonella enterica enterica serovar Typhi
cauugauuuccgcgc

SEQ ID NO: 3610236 - RNA, 18 nt, Salmonella enterica enterica serovar Typhi
cauugauuuccgcgcaau

SEQ ID NO: 3610237 - RNA, 16 nt, Salmonella enterica enterica serovar Typhi
cauugcagcauuacac

SEQ ID NO: 3610238 - RNA, 11 nt, Salmonella enterica enterica serovar Typhi
cauugcagcgg

SEQ ID NO: 3610239 - RNA, 23 nt, Salmonella enterica enterica serovar Typhi
cauugcauagaucuuugggccgg

SEQ ID NO: 3610240 - RNA, 13 nt, Salmonella enterica enterica serovar Typhi
cauugccacccau

SEQ ID NO: 3610241 - RNA, 20 nt, Salmonella enterica enterica serovar Typhi
cauugccauguuaauaccag

SEQ ID NO: 3610242 - RNA, 18 nt, Salmonella enterica enterica serovar Typhi
cauugccccagcccugcu

SEQ ID NO: 3610243 - RNA, 15 nt, Salmonella enterica enterica serovar Typhi
cauugccccucccug

SEQ ID NO: 3610244 - RNA, 12 nt, Salmonella enterica enterica serovar Typhi
cauugcccggcg

SEQ ID NO: 3610245 - RNA, 14 nt, Salmonella enterica enterica serovar Typhi
cauugccguaaauu

SEQ ID NO: 3610246 - RNA, 21 nt, Salmonella enterica enterica serovar Typhi
cauugccgucaaacgcuauca

SEQ ID NO: 3610247 - RNA, 17 nt, Salmonella enterica enterica serovar Typhi
cauugccguuaacugcu

SEQ ID NO: 3610248 - RNA, 17 nt, Salmonella enterica enterica serovar Typhi
cauugccuuccaggcgg

SEQ ID NO: 3610249 - RNA, 14 nt, Salmonella enterica enterica serovar Typhi
cauugcgagaaaaa

SEQ ID NO: 3610250 - RNA, 18 nt, Salmonella enterica enterica serovar Typhi
cauugcgagaaaaaacuc

SEQ ID NO: 3610251 - RNA, 16 nt, Salmonella enterica enterica serovar Typhi
cauugcgccccagcac

SEQ ID NO: 3610252 - RNA, 16 nt, Salmonella enterica enterica serovar Typhi
cauugcugucgacaau

SEQ ID NO: 3610253 - RNA, 14 nt, Salmonella enterica enterica serovar Typhi
cauugcuuucuuga

SEQ ID NO: 3610254 - RNA, 17 nt, Salmonella enterica enterica serovar Typhi
cauugcuuucuugaauc

SEQ ID NO: 3610255 - RNA, 23 nt, Salmonella enterica enterica serovar Typhi
cauugcuuuuggcaacggcagcc

SEQ ID NO: 3610256 - RNA, 19 nt, Salmonella enterica enterica serovar Typhi
cauuggaaaaccccauccc

SEQ ID NO: 3610257 - RNA, 20 nt, Salmonella enterica enterica serovar Typhi
cauuggaaaaccccaucccg

SEQ ID NO: 3610258 - RNA, 20 nt, Salmonella enterica enterica serovar Typhi
cauuggaagagacacgcuga

SEQ ID NO: 3610259 - RNA, 16 nt, Salmonella enterica enterica serovar Typhi
cauuggcaaaccccug

SEQ ID NO: 3610260 - RNA, 18 nt, Salmonella enterica enterica serovar Typhi
cauuggcgucugcuggcc

SEQ ID NO: 3610261 - RNA, 20 nt, Salmonella enterica enterica serovar Typhi
cauugggauggauaaauagg

SEQ ID NO: 3610262 - RNA, 17 nt, Salmonella enterica enterica serovar Typhi
cauuggggaaccuggca

SEQ ID NO: 3610263 - RNA, 18 nt, Salmonella enterica enterica serovar Typhi
cauuggggaaccuggcag

SEQ ID NO: 3610264 - RNA, 22 nt, Salmonella enterica enterica serovar Typhi
cauuggggggaaauuaaacugc

SEQ ID NO: 3610265 - RNA, 14 nt, Salmonella enterica enterica serovar Typhi
cauuguaaaaccga

SEQ ID NO: 3610266 - RNA, 20 nt, Salmonella enterica enterica serovar Typhi
cauuguacuuuuaaaucauc

SEQ ID NO: 3610267 - RNA, 13 nt, Salmonella enterica enterica serovar Typhi
ccaaaccagaccc

SEQ ID NO: 3610268 - RNA, 22 nt, Salmonella enterica enterica serovar Typhi
ccaaaccagacucaccccuucu

SEQ ID NO: 3610269 - RNA, 19 nt, Salmonella enterica enterica serovar Typhi
ccaaaccggcgaauagcgc

SEQ ID NO: 3610270 - RNA, 16 nt, Salmonella enterica enterica serovar Typhi
ccaaaccugccacagg

SEQ ID NO: 3610271 - RNA, 16 nt, Salmonella enterica enterica serovar Typhi
ccaaacgaauuuaaau

SEQ ID NO: 3610272 - RNA, 17 nt, Salmonella enterica enterica serovar Typhi
ccaaacgaauuuaaaua

SEQ ID NO: 3610273 - RNA, 20 nt, Salmonella enterica enterica serovar Typhi
ccaaacgacgcguuucacau

SEQ ID NO: 3610274 - RNA, 23 nt, Salmonella enterica enterica serovar Typhi
ccaaacgaugaccauaaaugaaa

SEQ ID NO: 3610275 - RNA, 12 nt, Salmonella enterica enterica serovar Typhi
ccaaacggcagc

SEQ ID NO: 3610276 - RNA, 19 nt, Salmonella enterica enterica serovar Typhi
ccaaacuccucacugcgua

SEQ ID NO: 3610277 - RNA, 18 nt, Salmonella enterica enterica serovar Typhi
ccaaacugcgcgccgccc

SEQ ID NO: 3610278 - RNA, 19 nt, Salmonella enterica enterica serovar Typhi
ccaaacuggcaaauaaaau

SEQ ID NO: 3610279 - RNA, 22 nt, Salmonella enterica enterica serovar Typhi
ccaaacuggcugugccaauaac

SEQ ID NO: 3610280 - RNA, 19 nt, Salmonella enterica enterica serovar Typhi
ccaaagcagcggaaaauau

SEQ ID NO: 3610281 - RNA, 14 nt, Salmonella enterica enterica serovar Typhi
ccaaagcagcugcu

SEQ ID NO: 3610282 - RNA, 18 nt, Salmonella enterica enterica serovar Typhi
ccaaagccaggccgccag

SEQ ID NO: 3610283 - RNA, 15 nt, Salmonella enterica enterica serovar Typhi
ccaaagcgcugcugc

SEQ ID NO: 3610284 - RNA, 16 nt, Salmonella enterica enterica serovar Typhi
ccaaagggagcagacu

SEQ ID NO: 3610285 - RNA, 13 nt, Salmonella enterica enterica serovar Typhi
ccaaagucauugc

SEQ ID NO: 3610286 - RNA, 15 nt, Salmonella enterica enterica serovar Typhi
ccaaaguccaacugu

SEQ ID NO: 3610287 - RNA, 19 nt, Salmonella enterica enterica serovar Typhi
ccaaagugguuccaggcgc

SEQ ID NO: 3610288 - RNA, 15 nt, Salmonella enterica enterica serovar Typhi
ccaaaguuaaucagc

SEQ ID NO: 3610289 - RNA, 17 nt, Salmonella enterica enterica serovar Typhi
ccaaaguuaaucagcgc

SEQ ID NO: 3610290 - RNA, 14 nt, Salmonella enterica enterica serovar Typhi
ccaaaguuuuuaaa

SEQ ID NO: 3610291 - RNA, 19 nt, Salmonella enterica enterica serovar Typhi
ccaaauaaaagccgccgug

SEQ ID NO: 3610292 - RNA, 22 nt, Salmonella enterica enterica serovar Typhi
ccaaauaggcgaggaaaacauu

SEQ ID NO: 3610293 - RNA, 19 nt, Salmonella enterica enterica serovar Typhi
ccaaauaguccagcaucca

SEQ ID NO: 3610294 - RNA, 12 nt, Salmonella enterica enterica serovar Typhi
ccaaauauuucu

SEQ ID NO: 3610295 - RNA, 13 nt, Salmonella enterica enterica serovar Typhi
ccaaaugcccagc

SEQ ID NO: 3610296 - RNA, 21 nt, Salmonella enterica enterica serovar Typhi
ccaaaugccugccguuuuuaa

SEQ ID NO: 3610297 - RNA, 15 nt, Salmonella enterica enterica serovar Typhi
ccaacaaaguggauu

SEQ ID NO: 3610298 - RNA, 17 nt, Salmonella enterica enterica serovar Typhi
ccaacaacaggccgccg

SEQ ID NO: 3610299 - RNA, 14 nt, Salmonella enterica enterica serovar Typhi
ccaacaacccauuc

SEQ ID NO: 3610300 - RNA, 19 nt, Salmonella enterica enterica serovar Typhi
ccaacaaggauauccgcca

SEQ ID NO: 3610301 - RNA, 15 nt, Salmonella enterica enterica serovar Typhi
ccaacaaugccacgc

SEQ ID NO: 3610302 - RNA, 19 nt, Salmonella enterica enterica serovar Typhi
ccaacaaugccacgccccu

SEQ ID NO: 3610303 - RNA, 20 nt, Salmonella enterica enterica serovar Typhi
ccaacaaugccacgccccua

SEQ ID NO: 3610304 - RNA, 16 nt, Salmonella enterica enterica serovar Typhi
ccaacaccagccgcau

SEQ ID NO: 3610305 - RNA, 18 nt, Salmonella enterica enterica serovar Typhi
ccaacagcaauguuucaa

SEQ ID NO: 3610306 - RNA, 13 nt, Salmonella enterica enterica serovar Typhi
ccaacagcugggu

SEQ ID NO: 3610307 - RNA, 17 nt, Salmonella enterica enterica serovar Typhi
ccaacagguuaaucagc

SEQ ID NO: 3610308 - RNA, 20 nt, Salmonella enterica enterica serovar Typhi
ccaacauaacgaaauccgcg

SEQ ID NO: 3610309 - RNA, 20 nt, Salmonella enterica enterica serovar Typhi
ccaacauagcggcaaggaaa

SEQ ID NO: 3610310 - RNA, 23 nt, Salmonella enterica enterica serovar Typhi
ccaacauagcuaaauaaaaauaa

SEQ ID NO: 3610311 - RNA, 19 nt, Salmonella enterica enterica serovar Typhi
ccaaccaucggcacacuuu

SEQ ID NO: 3610312 - RNA, 18 nt, Salmonella enterica enterica serovar Typhi
ccaacccacgcgccacgu

SEQ ID NO: 3610313 - RNA, 15 nt, Salmonella enterica enterica serovar Typhi
ccaaccgaacaauau

SEQ ID NO: 3610314 - RNA, 14 nt, Salmonella enterica enterica serovar Typhi
ccaaccgccacaau

SEQ ID NO: 3610315 - RNA, 11 nt, Salmonella enterica enterica serovar Typhi
ccaaccgccag

SEQ ID NO: 3610316 - RNA, 21 nt, Salmonella enterica enterica serovar Typhi
ccaaccggccccaucgccgua

SEQ ID NO: 3610317 - RNA, 15 nt, Salmonella enterica enterica serovar Typhi
ccaaccgugcuucac

SEQ ID NO: 3610318 - RNA, 20 nt, Salmonella enterica enterica serovar Typhi
ccaacgaaacucagcggccc

SEQ ID NO: 3610319 - RNA, 21 nt, Salmonella enterica enterica serovar Typhi
ccaacgaaacucagcggccca

SEQ ID NO: 3610320 - RNA, 21 nt, Salmonella enterica enterica serovar Typhi
ccaacgagaauaagaccaaua

SEQ ID NO: 3610321 - RNA, 13 nt, Salmonella enterica enterica serovar Typhi
ccaacgcaaugcg

SEQ ID NO: 3610322 - RNA, 18 nt, Salmonella enterica enterica serovar Typhi
ccaacgcaaugcgauaag

SEQ ID NO: 3610323 - RNA, 15 nt, Salmonella enterica enterica serovar Typhi
ccaacgccagcagcg

SEQ ID NO: 3610324 - RNA, 16 nt, Salmonella enterica enterica serovar Typhi
ccaacgccagcagcgc

SEQ ID NO: 3610325 - RNA, 15 nt, Salmonella enterica enterica serovar Typhi
ccaacgccggcaaca

SEQ ID NO: 3610326 - RNA, 16 nt, Salmonella enterica enterica serovar Typhi
ccaacgcgcuaccgug

SEQ ID NO: 3610327 - RNA, 15 nt, Salmonella enterica enterica serovar Typhi
ccaacggcgacgccc

SEQ ID NO: 3610328 - RNA, 15 nt, Salmonella enterica enterica serovar Typhi
ccaacgucagcaucu

SEQ ID NO: 3610329 - RNA, 15 nt, Salmonella enterica enterica serovar Typhi
ccaacugccaaacca

SEQ ID NO: 3610330 - RNA, 16 nt, Salmonella enterica enterica serovar Typhi
ccaacugccaaaccac

SEQ ID NO: 3610331 - RNA, 21 nt, Salmonella enterica enterica serovar Typhi
ccaacuuuuccuaauuuuuaa

SEQ ID NO: 3610332 - RNA, 12 nt, Salmonella enterica enterica serovar Typhi
ccaagaaugaaa

SEQ ID NO: 3610333 - RNA, 21 nt, Salmonella enterica enterica serovar Typhi
ccaagauaagaaguaaacaga

SEQ ID NO: 3610334 - RNA, 14 nt, Salmonella enterica enterica serovar Typhi
ccaagauccagcgg

SEQ ID NO: 3610335 - RNA, 18 nt, Salmonella enterica enterica serovar Typhi
ccaagauuuuucagacgc

SEQ ID NO: 3610336 - RNA, 13 nt, Salmonella enterica enterica serovar Typhi
ccaagcagcgcca

SEQ ID NO: 3610337 - RNA, 19 nt, Salmonella enterica enterica serovar Typhi
ccaagcggcaucucgccaa

SEQ ID NO: 3610338 - RNA, 16 nt, Salmonella enterica enterica serovar Typhi
ccaagcgucagcaugg

SEQ ID NO: 3610339 - RNA, 17 nt, Salmonella enterica enterica serovar Typhi
ccaagcgucagcauggu

SEQ ID NO: 3610340 - RNA, 20 nt, Salmonella enterica enterica serovar Typhi
ccaagcuguggaaacugugc

SEQ ID NO: 3610341 - RNA, 17 nt, Salmonella enterica enterica serovar Typhi
ccaaguaaauuugcugu

SEQ ID NO: 3610342 - RNA, 14 nt, Salmonella enterica enterica serovar Typhi
ccaauaaacgccag

SEQ ID NO: 3610343 - RNA, 15 nt, Salmonella enterica enterica serovar Typhi
ccaauaaacgccagg

SEQ ID NO: 3610344 - RNA, 19 nt, Salmonella enterica enterica serovar Typhi
ccaauaaugccgccgucgc

SEQ ID NO: 3610345 - RNA, 13 nt, Salmonella enterica enterica serovar Typhi
ccaauaauuuuag

SEQ ID NO: 3610346 - RNA, 14 nt, Salmonella enterica enterica serovar Typhi
ccaauaauuuuaga

SEQ ID NO: 3610347 - RNA, 20 nt, Salmonella enterica enterica serovar Typhi
ccaauacccagcgccaacgc

SEQ ID NO: 3610348 - RNA, 23 nt, Salmonella enterica enterica serovar Typhi
ccaauaccggcguaauugcgccu

SEQ ID NO: 3610349 - RNA, 19 nt, Salmonella enterica enterica serovar Typhi
ccaauacgaucggcuggaa

SEQ ID NO: 3610350 - RNA, 23 nt, Salmonella enterica enterica serovar Typhi
ccaauacgccagccuaucgccau

SEQ ID NO: 3610351 - RNA, 22 nt, Salmonella enterica enterica serovar Typhi
ccaauaguuuauugagauaauu

SEQ ID NO: 3610352 - RNA, 14 nt, Salmonella enterica enterica serovar Typhi
ccaauauccccagc

SEQ ID NO: 3610353 - RNA, 22 nt, Salmonella enterica enterica serovar Typhi
ccaccauaucgcagaccaucca

SEQ ID NO: 3610354 - RNA, 14 nt, Salmonella enterica enterica serovar Typhi
ccaccauccggcaa

SEQ ID NO: 3610355 - RNA, 21 nt, Salmonella enterica enterica serovar Typhi
ccaccaucgcauugccggcga

SEQ ID NO: 3610356 - RNA, 18 nt, Salmonella enterica enterica serovar Typhi
ccaccaucgucgccagac

SEQ ID NO: 3610357 - RNA, 18 nt, Salmonella enterica enterica serovar Typhi
ccaccauuacgcccccuc

SEQ ID NO: 3610358 - RNA, 16 nt, Salmonella enterica enterica serovar Typhi
ccacccauuuuccgcu

SEQ ID NO: 3610359 - RNA, 19 nt, Salmonella enterica enterica serovar Typhi
ccacccgcgcgcuuuccac

SEQ ID NO: 3610360 - RNA, 15 nt, Salmonella enterica enterica serovar Typhi
ccacccgcuaugaag

SEQ ID NO: 3610361 - RNA, 17 nt, Salmonella enterica enterica serovar Typhi
ccacccggcuuuuuuau

SEQ ID NO: 3610362 - RNA, 22 nt, Salmonella enterica enterica serovar Typhi
ccacccgggccggaagagcgca

SEQ ID NO: 3610363 - RNA, 11 nt, Salmonella enterica enterica serovar Typhi
ccaccgaauuc

SEQ ID NO: 3610364 - RNA, 18 nt, Salmonella enterica enterica serovar Typhi
ccaccgcauuuucagcuu

SEQ ID NO: 3610365 - RNA, 15 nt, Salmonella enterica enterica serovar Typhi
ccaccgccaaccgcc

SEQ ID NO: 3610366 - RNA, 16 nt, Salmonella enterica enterica serovar Typhi
ccaccgccaaccgccc

SEQ ID NO: 3610367 - RNA, 16 nt, Salmonella enterica enterica serovar Typhi
ccaccgccagacgccc

SEQ ID NO: 3610368 - RNA, 12 nt, Salmonella enterica enterica serovar Typhi
ccaccgccaguu

SEQ ID NO: 3610369 - RNA, 18 nt, Salmonella enterica enterica serovar Typhi
ccaccgccgccaccaaaa

SEQ ID NO: 3610370 - RNA, 12 nt, Salmonella enterica enterica serovar Typhi
ccaccgccgcug

SEQ ID NO: 3610371 - RNA, 12 nt, Salmonella enterica enterica serovar Typhi
ccaccgcugaug

SEQ ID NO: 3610372 - RNA, 22 nt, Salmonella enterica enterica serovar Typhi
ccaccgcugauggcguggcgca

SEQ ID NO: 3610373 - RNA, 20 nt, Salmonella enterica enterica serovar Typhi
ccaccggauggaucaucggc

SEQ ID NO: 3610374 - RNA, 24 nt, Salmonella enterica enterica serovar Typhi
ccaccgggcaacccggcuaaauga

SEQ ID NO: 3610375 - RNA, 21 nt, Salmonella enterica enterica serovar Typhi
ccaccguaugugcgccgugca

SEQ ID NO: 3610376 - RNA, 22 nt, Salmonella enterica enterica serovar Typhi
ccaccguaugugcgccgugcag

SEQ ID NO: 3610377 - RNA, 17 nt, Salmonella enterica enterica serovar Typhi
ccaccguuuaaucgccc

SEQ ID NO: 3610378 - RNA, 21 nt, Salmonella enterica enterica serovar Typhi
ccaccguuuaaucgcccugcg

SEQ ID NO: 3610379 - RNA, 18 nt, Salmonella enterica enterica serovar Typhi
ccaccucaagguagcgug

SEQ ID NO: 3610380 - RNA, 14 nt, Salmonella enterica enterica serovar Typhi
ccaccucaaucacc

SEQ ID NO: 3610381 - RNA, 17 nt, Salmonella enterica enterica serovar Typhi
ccaccucaaucaccguu

SEQ ID NO: 3610382 - RNA, 16 nt, Salmonella enterica enterica serovar Typhi
ccaccugaucgccaac

SEQ ID NO: 3610383 - RNA, 18 nt, Salmonella enterica enterica serovar Typhi
ccaccuggcccugcauca

SEQ ID NO: 3610384 - RNA, 18 nt, Salmonella enterica enterica serovar Typhi
ccaccuguucgccuucgu

SEQ ID NO: 3610385 - RNA, 18 nt, Salmonella enterica enterica serovar Typhi
ccaccuuaaacuugccgu

SEQ ID NO: 3610386 - RNA, 23 nt, Salmonella enterica enterica serovar Typhi
ccaccuuugaaaaucacaucgcc

SEQ ID NO: 3610387 - RNA, 15 nt, Salmonella enterica enterica serovar Typhi
ccacgaaaauuauuu

SEQ ID NO: 3610388 - RNA, 16 nt, Salmonella enterica enterica serovar Typhi
ccacgaaagucuguuc

SEQ ID NO: 3610389 - RNA, 20 nt, Salmonella enterica enterica serovar Typhi
ccacgaacgauauaaaaacc

SEQ ID NO: 3610390 - RNA, 22 nt, Salmonella enterica enterica serovar Typhi
ccacgaacgauauaaaaaccga

SEQ ID NO: 3610391 - RNA, 15 nt, Salmonella enterica enterica serovar Typhi
ccacgaaugccgaua

SEQ ID NO: 3610392 - RNA, 14 nt, Salmonella enterica enterica serovar Typhi
ccacgacauccgga

SEQ ID NO: 3610393 - RNA, 17 nt, Salmonella enterica enterica serovar Typhi
ccacgacggccggaccu

SEQ ID NO: 3610394 - RNA, 16 nt, Salmonella enterica enterica serovar Typhi
ccacgagaaauccaca

SEQ ID NO: 3610395 - RNA, 16 nt, Salmonella enterica enterica serovar Typhi
ccacgauacgccccug

SEQ ID NO: 3610396 - RNA, 22 nt, Salmonella enterica enterica serovar Typhi
ccacgauacgccccugcuggcg

SEQ ID NO: 3610397 - RNA, 21 nt, Salmonella enterica enterica serovar Typhi
ccacgauguaugccgaccgug

SEQ ID NO: 3610398 - RNA, 14 nt, Salmonella enterica enterica serovar Typhi
ccacgcaaaccgcu

SEQ ID NO: 3610399 - RNA, 18 nt, Salmonella enterica enterica serovar Typhi
ccacgcacgccggccccg

SEQ ID NO: 3610400 - RNA, 11 nt, Salmonella enterica enterica serovar Typhi
ccacgcagccg

SEQ ID NO: 3610401 - RNA, 22 nt, Salmonella enterica enterica serovar Typhi
ccacgcagcgcagaccgagcgc

SEQ ID NO: 3610402 - RNA, 22 nt, Salmonella enterica enterica serovar Typhi
ccacgccaaccaucggcacacu

SEQ ID NO: 3610403 - RNA, 22 nt, Salmonella enterica enterica serovar Typhi
ccacgccaacguccgccgucag

SEQ ID NO: 3610404 - RNA, 21 nt, Salmonella enterica enterica serovar Typhi
ccacgccaauacgggagagcg

SEQ ID NO: 3610405 - RNA, 15 nt, Salmonella enterica enterica serovar Typhi
ccacgccaccgccgc

SEQ ID NO: 3610406 - RNA, 18 nt, Salmonella enterica enterica serovar Typhi
ccacgccaccgccgccac

SEQ ID NO: 3610407 - RNA, 15 nt, Salmonella enterica enterica serovar Typhi
ccacgccaccgggcc

SEQ ID NO: 3610408 - RNA, 13 nt, Salmonella enterica enterica serovar Typhi
ccacgccaucauu

SEQ ID NO: 3610409 - RNA, 15 nt, Salmonella enterica enterica serovar Typhi
ccacgccaucgcggc

SEQ ID NO: 3610410 - RNA, 17 nt, Salmonella enterica enterica serovar Typhi
ccacgccauggccgcag

SEQ ID NO: 3610411 - RNA, 18 nt, Salmonella enterica enterica serovar Typhi
ccacgccccuaaggcagc

SEQ ID NO: 3610412 - RNA, 20 nt, Salmonella enterica enterica serovar Typhi
ccacgccgaccaccagcuug

SEQ ID NO: 3610413 - RNA, 16 nt, Salmonella enterica enterica serovar Typhi
ccacgccgaguaauuu

SEQ ID NO: 3610414 - RNA, 14 nt, Salmonella enterica enterica serovar Typhi
ccacgccgcaagga

SEQ ID NO: 3610415 - RNA, 14 nt, Salmonella enterica enterica serovar Typhi
ccacgccgccgcgu

SEQ ID NO: 3610416 - RNA, 18 nt, Salmonella enterica enterica serovar Typhi
ccacgccgcuaucgacca

SEQ ID NO: 3610417 - RNA, 22 nt, Salmonella enterica enterica serovar Typhi
ccacgccuaaacugauagacaa

SEQ ID NO: 3610418 - RNA, 18 nt, Salmonella enterica enterica serovar Typhi
ccacgcgaugcaaccccu

SEQ ID NO: 3610419 - RNA, 20 nt, Salmonella enterica enterica serovar Typhi
ccacgcgaugcaaccccuga

SEQ ID NO: 3610420 - RNA, 15 nt, Salmonella enterica enterica serovar Typhi
ccacgcgcaccaugu

SEQ ID NO: 3610421 - RNA, 19 nt, Salmonella enterica enterica serovar Typhi
ccacgcgcgucaggacggc

SEQ ID NO: 3610422 - RNA, 16 nt, Salmonella enterica enterica serovar Typhi
ccacgcggcaucaggc

SEQ ID NO: 3610423 - RNA, 19 nt, Salmonella enterica enterica serovar Typhi
ccacgcggcgugcgcugca

SEQ ID NO: 3610424 - RNA, 23 nt, Salmonella enterica enterica serovar Typhi
ccacgcgggcgguauuauccgcc

SEQ ID NO: 3610425 - RNA, 21 nt, Salmonella enterica enterica serovar Typhi
ccacgcguacgguuacaaccc

SEQ ID NO: 3610426 - RNA, 14 nt, Salmonella enterica enterica serovar Typhi
ccacgcucacuuuu

SEQ ID NO: 3610427 - RNA, 17 nt, Salmonella enterica enterica serovar Typhi
ccacgcucgcuggugcc

SEQ ID NO: 3610428 - RNA, 22 nt, Salmonella enterica enterica serovar Typhi
ccacgcugauacguaacaugac

SEQ ID NO: 3610429 - RNA, 15 nt, Salmonella enterica enterica serovar Typhi
ccacgcugccgccgc

SEQ ID NO: 3610430 - RNA, 14 nt, Salmonella enterica enterica serovar Typhi
ccacgcuuuuuuau

SEQ ID NO: 3610431 - RNA, 16 nt, Salmonella enterica enterica serovar Typhi
ccacgcuuuuuuauuu

SEQ ID NO: 3610432 - RNA, 15 nt, Salmonella enterica enterica serovar Typhi
ccacggaaugaaugu

SEQ ID NO: 3610433 - RNA, 19 nt, Salmonella enterica enterica serovar Typhi
ccacggauggccucugcca

SEQ ID NO: 3610434 - RNA, 21 nt, Salmonella enterica enterica serovar Typhi
ccacggccaacgcgcccucug

SEQ ID NO: 3610435 - RNA, 12 nt, Salmonella enterica enterica serovar Typhi
ccacggccagca

SEQ ID NO: 3610436 - RNA, 23 nt, Salmonella enterica enterica serovar Typhi
ccacggcguagcgagaaggcuuu

SEQ ID NO: 3610437 - RNA, 20 nt, Salmonella enterica enterica serovar Typhi
ccacggcguguugaaauccu

SEQ ID NO: 3610438 - RNA, 15 nt, Salmonella enterica enterica serovar Typhi
ccagacucgcucccu

SEQ ID NO: 3610439 - RNA, 16 nt, Salmonella enterica enterica serovar Typhi
ccagacuuuccagcac

SEQ ID NO: 3610440 - RNA, 18 nt, Salmonella enterica enterica serovar Typhi
ccagacuuuccagcacga

SEQ ID NO: 3610441 - RNA, 15 nt, Salmonella enterica enterica serovar Typhi
ccagagcgcgcuggc

SEQ ID NO: 3610442 - RNA, 18 nt, Salmonella enterica enterica serovar Typhi
ccagagcgcggccuuugc

SEQ ID NO: 3610443 - RNA, 20 nt, Salmonella enterica enterica serovar Typhi
ccagaggaucuggacgccaa

SEQ ID NO: 3610444 - RNA, 12 nt, Salmonella enterica enterica serovar Typhi
ccagauaauagc

SEQ ID NO: 3610445 - RNA, 16 nt, Salmonella enterica enterica serovar Typhi
ccagauaauccagcgu

SEQ ID NO: 3610446 - RNA, 18 nt, Salmonella enterica enterica serovar Typhi
ccagauaaugaucaacgc

SEQ ID NO: 3610447 - RNA, 20 nt, Salmonella enterica enterica serovar Typhi
ccagauaaugaucaacgcgg

SEQ ID NO: 3610448 - RNA, 21 nt, Salmonella enterica enterica serovar Typhi
ccagauacaaaucucagggug

SEQ ID NO: 3610449 - RNA, 13 nt, Salmonella enterica enterica serovar Typhi
ccagauacauggc

SEQ ID NO: 3610450 - RNA, 14 nt, Salmonella enterica enterica serovar Typhi
ccagauacauggcu

SEQ ID NO: 3610451 - RNA, 19 nt, Salmonella enterica enterica serovar Typhi
ccagauagaaccacgcaaa

SEQ ID NO: 3610452 - RNA, 14 nt, Salmonella enterica enterica serovar Typhi
ccagauagcgcugc

SEQ ID NO: 3610453 - RNA, 18 nt, Salmonella enterica enterica serovar Typhi
ccagauagcgcugcgcca

SEQ ID NO: 3610454 - RNA, 21 nt, Salmonella enterica enterica serovar Typhi
ccagauagcgcugcgccagau

SEQ ID NO: 3610455 - RNA, 22 nt, Salmonella enterica enterica serovar Typhi
ccagauaucgcguacaggaugu

SEQ ID NO: 3610456 - RNA, 22 nt, Salmonella enterica enterica serovar Typhi
ccagauaugaucgaaaaugcgc

SEQ ID NO: 3610457 - RNA, 13 nt, Salmonella enterica enterica serovar Typhi
ccagauauggcaa

SEQ ID NO: 3610458 - RNA, 17 nt, Salmonella enterica enterica serovar Typhi
ccagauauugccgacca

SEQ ID NO: 3610459 - RNA, 16 nt, Salmonella enterica enterica serovar Typhi
ccagaucgauauccgu

SEQ ID NO: 3610460 - RNA, 17 nt, Salmonella enterica enterica serovar Typhi
ccagaucgauauccgug

SEQ ID NO: 3610461 - RNA, 19 nt, Salmonella enterica enterica serovar Typhi
ccagaucggcaugauggcg

SEQ ID NO: 3610462 - RNA, 22 nt, Salmonella enterica enterica serovar Typhi
ccagaucguagccauguuccuc

SEQ ID NO: 3610463 - RNA, 12 nt, Salmonella enterica enterica serovar Typhi
ccagaugcgcca

SEQ ID NO: 3610464 - RNA, 16 nt, Salmonella enterica enterica serovar Typhi
ccagaugcgccaguac

SEQ ID NO: 3610465 - RNA, 16 nt, Salmonella enterica enterica serovar Typhi
ccagaugcgggcgauc

SEQ ID NO: 3610466 - RNA, 22 nt, Salmonella enterica enterica serovar Typhi
ccagauggcaagauuaaccagc

SEQ ID NO: 3610467 - RNA, 21 nt, Salmonella enterica enterica serovar Typhi
ccagauggcugcacccggaga

SEQ ID NO: 3610468 - RNA, 16 nt, Salmonella enterica enterica serovar Typhi
ccagaugucgcggaua

SEQ ID NO: 3610469 - RNA, 19 nt, Salmonella enterica enterica serovar Typhi
ccagauguugauacagaaa

SEQ ID NO: 3610470 - RNA, 13 nt, Salmonella enterica enterica serovar Typhi
ccagauuacgcau

SEQ ID NO: 3610471 - RNA, 17 nt, Salmonella enterica enterica serovar Typhi
ccagauuacugcccuga

SEQ ID NO: 3610472 - RNA, 17 nt, Salmonella enterica enterica serovar Typhi
ccagauuaucggccagc

SEQ ID NO: 3610473 - RNA, 19 nt, Salmonella enterica enterica serovar Typhi
ccagauuaucggccagcgc

SEQ ID NO: 3610474 - RNA, 22 nt, Salmonella enterica enterica serovar Typhi
ccagauuaucggccagcgccag

SEQ ID NO: 3610475 - RNA, 14 nt, Salmonella enterica enterica serovar Typhi
ccagauucuuaguc

SEQ ID NO: 3610476 - RNA, 20 nt, Salmonella enterica enterica serovar Typhi
ccagauuuuccaggccgcca

SEQ ID NO: 3610477 - RNA, 22 nt, Salmonella enterica enterica serovar Typhi
ccagauuuuccaggccgccagc

SEQ ID NO: 3610478 - RNA, 13 nt, Salmonella enterica enterica serovar Typhi
ccagcaaaauaau

SEQ ID NO: 3610479 - RNA, 14 nt, Salmonella enterica enterica serovar Typhi
ccagcaaaccggca

SEQ ID NO: 3610480 - RNA, 18 nt, Salmonella enterica enterica serovar Typhi
ccagcaaaccuuccgcca

SEQ ID NO: 3610481 - RNA, 20 nt, Salmonella enterica enterica serovar Typhi
ccagcaaaccuuccgccagg

SEQ ID NO: 3610482 - RNA, 23 nt, Salmonella enterica enterica serovar Typhi
ccagcaaaccuuccgccaggcgg

SEQ ID NO: 3610483 - RNA, 20 nt, Salmonella enterica enterica serovar Typhi
ccagcaacacuuugcgcugc

SEQ ID NO: 3610484 - RNA, 15 nt, Salmonella enterica enterica serovar Typhi
ccagcaacagcguac

SEQ ID NO: 3610485 - RNA, 19 nt, Salmonella enterica enterica serovar Typhi
ccagcaacagguaccccgc

SEQ ID NO: 3610486 - RNA, 21 nt, Salmonella enterica enterica serovar Typhi
ccagcaacagguaccccgcca

SEQ ID NO: 3610487 - RNA, 17 nt, Salmonella enterica enterica serovar Typhi
ccagcaacccaccugcc

SEQ ID NO: 3610488 - RNA, 20 nt, Salmonella enterica enterica serovar Typhi
ccagcaacgagcuuuuuucu

SEQ ID NO: 3610489 - RNA, 19 nt, Salmonella enterica enterica serovar Typhi
ccagcaagcggcgauugau

SEQ ID NO: 3610490 - RNA, 17 nt, Salmonella enterica enterica serovar Typhi
ccagcaaggagacgccc

SEQ ID NO: 3610491 - RNA, 23 nt, Salmonella enterica enterica serovar Typhi
ccagcaaggagacgcccgucacc

SEQ ID NO: 3610492 - RNA, 21 nt, Salmonella enterica enterica serovar Typhi
ccagcaauaacaccggcggcg

SEQ ID NO: 3610493 - RNA, 16 nt, Salmonella enterica enterica serovar Typhi
ccagcaaugccgccgc

SEQ ID NO: 3610494 - RNA, 18 nt, Salmonella enterica enterica serovar Typhi
ccagcaaugccgccgcca

SEQ ID NO: 3610495 - RNA, 19 nt, Salmonella enterica enterica serovar Typhi
ccagcacagguacaggccg

SEQ ID NO: 3610496 - RNA, 21 nt, Salmonella enterica enterica serovar Typhi
ccagcacagguacaggccgcc

SEQ ID NO: 3610497 - RNA, 12 nt, Salmonella enterica enterica serovar Typhi
ccagcacauuac

SEQ ID NO: 3610498 - RNA, 16 nt, Salmonella enterica enterica serovar Typhi
ccagcaccaacgccgc

SEQ ID NO: 3610499 - RNA, 12 nt, Salmonella enterica enterica serovar Typhi
ccagcaccagca

SEQ ID NO: 3610500 - RNA, 16 nt, Salmonella enterica enterica serovar Typhi
ccagcaccagcagcgc

SEQ ID NO: 3610501 - RNA, 15 nt, Salmonella enterica enterica serovar Typhi
ccagcaccagcagug

SEQ ID NO: 3610502 - RNA, 16 nt, Salmonella enterica enterica serovar Typhi
ccagcaccagcauuag

SEQ ID NO: 3610503 - RNA, 18 nt, Salmonella enterica enterica serovar Typhi
ccagcacggccuugaagu

SEQ ID NO: 3610504 - RNA, 14 nt, Salmonella enterica enterica serovar Typhi
ccagcacuaacagc

SEQ ID NO: 3610505 - RNA, 16 nt, Salmonella enterica enterica serovar Typhi
ccagcacuaacagcag

SEQ ID NO: 3610506 - RNA, 17 nt, Salmonella enterica enterica serovar Typhi
ccagcacuaacagcagc

SEQ ID NO: 3610507 - RNA, 20 nt, Salmonella enterica enterica serovar Typhi
ccagcacuaacagcagcagc

SEQ ID NO: 3610508 - RNA, 17 nt, Salmonella enterica enterica serovar Typhi
ccagcagacgcugcuuc

SEQ ID NO: 3610509 - RNA, 20 nt, Salmonella enterica enterica serovar Typhi
ccagcagacgcugcuucacg

SEQ ID NO: 3610510 - RNA, 19 nt, Salmonella enterica enterica serovar Typhi
ccagcagaugcaguucacc

SEQ ID NO: 3610511 - RNA, 21 nt, Salmonella enterica enterica serovar Typhi
ccagcagaugcaguucacccu

SEQ ID NO: 3610512 - RNA, 20 nt, Salmonella enterica enterica serovar Typhi
ccagcagauuuuuauccguc

SEQ ID NO: 3610513 - RNA, 9 nt, Salmonella enterica enterica serovar Typhi
ccagcagca

SEQ ID NO: 3610514 - RNA, 15 nt, Salmonella enterica enterica serovar Typhi
ccagcagcacuuccg

SEQ ID NO: 3610515 - RNA, 17 nt, Salmonella enterica enterica serovar Typhi
ccagcagcagcaccggc

SEQ ID NO: 3610516 - RNA, 13 nt, Salmonella enterica enterica serovar Typhi
ccagcagcagcuc

SEQ ID NO: 3610517 - RNA, 15 nt, Salmonella enterica enterica serovar Typhi
ccagcagcauaaaac

SEQ ID NO: 3610518 - RNA, 23 nt, Salmonella enterica enterica serovar Typhi
ccagcagcauaaaaccgccgccc

SEQ ID NO: 3610519 - RNA, 12 nt, Salmonella enterica enterica serovar Typhi
ccagcagccaca

SEQ ID NO: 3610520 - RNA, 15 nt, Salmonella enterica enterica serovar Typhi
ccagcagccacagga

SEQ ID NO: 3610521 - RNA, 21 nt, Salmonella enterica enterica serovar Typhi
ccagcagguggaucugaaucu

SEQ ID NO: 3610522 - RNA, 16 nt, Salmonella enterica enterica serovar Typhi
ccagcaguuccggcgu

SEQ ID NO: 3610523 - RNA, 14 nt, Salmonella enterica enterica serovar Typhi
ccagcauaaugagc

SEQ ID NO: 3610524 - RNA, 13 nt, Salmonella enterica enterica serovar Typhi
ccagcgccgccgc

SEQ ID NO: 3610525 - RNA, 12 nt, Salmonella enterica enterica serovar Typhi
ccagcgccgccu

SEQ ID NO: 3610526 - RNA, 12 nt, Salmonella enterica enterica serovar Typhi
ccagcgccgcga

SEQ ID NO: 3610527 - RNA, 12 nt, Salmonella enterica enterica serovar Typhi
ccagcgccggau

SEQ ID NO: 3610528 - RNA, 22 nt, Salmonella enterica enterica serovar Typhi
ccagcgccggauaauccagaca

SEQ ID NO: 3610529 - RNA, 19 nt, Salmonella enterica enterica serovar Typhi
ccagcgccgggauauccuc

SEQ ID NO: 3610530 - RNA, 14 nt, Salmonella enterica enterica serovar Typhi
ccagcgccugcgcu

SEQ ID NO: 3610531 - RNA, 20 nt, Salmonella enterica enterica serovar Typhi
ccagcgccugcgcugcaaua

SEQ ID NO: 3610532 - RNA, 21 nt, Salmonella enterica enterica serovar Typhi
ccagcgcgaauuugccccaga

SEQ ID NO: 3610533 - RNA, 13 nt, Salmonella enterica enterica serovar Typhi
ccagcgcgccguc

SEQ ID NO: 3610534 - RNA, 13 nt, Salmonella enterica enterica serovar Typhi
ccagcgcggcaca

SEQ ID NO: 3610535 - RNA, 20 nt, Salmonella enterica enterica serovar Typhi
ccagcgcgguggcgcacagu

SEQ ID NO: 3610536 - RNA, 18 nt, Salmonella enterica enterica serovar Typhi
ccagcgcguaaauaccuu

SEQ ID NO: 3610537 - RNA, 19 nt, Salmonella enterica enterica serovar Typhi
ccagcgcugagaugaccau

SEQ ID NO: 3610538 - RNA, 19 nt, Salmonella enterica enterica serovar Typhi
ccagcgcugucagugaaaa

SEQ ID NO: 3610539 - RNA, 17 nt, Salmonella enterica enterica serovar Typhi
ccagcgcuucuguuaaa

SEQ ID NO: 3610540 - RNA, 22 nt, Salmonella enterica enterica serovar Typhi
ccagcggaauauucgcuucuuc

SEQ ID NO: 3610541 - RNA, 19 nt, Salmonella enterica enterica serovar Typhi
ccagcggaauccccgccgc

SEQ ID NO: 3610542 - RNA, 21 nt, Salmonella enterica enterica serovar Typhi
ccagcggaauccccgccgcca

SEQ ID NO: 3610543 - RNA, 13 nt, Salmonella enterica enterica serovar Typhi
ccagcggccagcc

SEQ ID NO: 3610544 - RNA, 15 nt, Salmonella enterica enterica serovar Typhi
ccagcggccagccau

SEQ ID NO: 3610545 - RNA, 12 nt, Salmonella enterica enterica serovar Typhi
ccagcggccgcu

SEQ ID NO: 3610546 - RNA, 19 nt, Salmonella enterica enterica serovar Typhi
ccagcggcgacaguaacug

SEQ ID NO: 3610547 - RNA, 23 nt, Salmonella enterica enterica serovar Typhi
ccagcggcguuuuuuccugcugg

SEQ ID NO: 3610548 - RNA, 18 nt, Salmonella enterica enterica serovar Typhi
ccagcgggcgcaguccag

SEQ ID NO: 3610549 - RNA, 20 nt, Salmonella enterica enterica serovar Typhi
ccagcgguaugcaccucuuu

SEQ ID NO: 3610550 - RNA, 19 nt, Salmonella enterica enterica serovar Typhi
ccagcguagauucacugug

SEQ ID NO: 3610551 - RNA, 15 nt, Salmonella enterica enterica serovar Typhi
ccagcguagcuaaac

SEQ ID NO: 3610552 - RNA, 18 nt, Salmonella enterica enterica serovar Typhi
ccagcguauaauuaagcu

SEQ ID NO: 3610553 - RNA, 21 nt, Salmonella enterica enterica serovar Typhi
ccagcguauaauuaagcugcg

SEQ ID NO: 3610554 - RNA, 19 nt, Salmonella enterica enterica serovar Typhi
ccagcguaugauagcgagc

SEQ ID NO: 3610555 - RNA, 20 nt, Salmonella enterica enterica serovar Typhi
ccagcguaugauagcgagca

SEQ ID NO: 3610556 - RNA, 13 nt, Salmonella enterica enterica serovar Typhi
ccagcgucaucag

SEQ ID NO: 3610557 - RNA, 22 nt, Salmonella enterica enterica serovar Typhi
ccagcgucgucauagcguugau

SEQ ID NO: 3610558 - RNA, 16 nt, Salmonella enterica enterica serovar Typhi
ccagcgugacccagac

SEQ ID NO: 3610559 - RNA, 17 nt, Salmonella enterica enterica serovar Typhi
ccagcgugacccagaca

SEQ ID NO: 3610560 - RNA, 19 nt, Salmonella enterica enterica serovar Typhi
ccagcgugacccagacaaa

SEQ ID NO: 3610561 - RNA, 15 nt, Salmonella enterica enterica serovar Typhi
ccagcgugccgagca

SEQ ID NO: 3610562 - RNA, 16 nt, Salmonella enterica enterica serovar Typhi
ccagcguuagcgcaaa

SEQ ID NO: 3610563 - RNA, 18 nt, Salmonella enterica enterica serovar Typhi
ccagcguugaauaucgua

SEQ ID NO: 3610564 - RNA, 13 nt, Salmonella enterica enterica serovar Typhi
ccagcuaaaaacg

SEQ ID NO: 3610565 - RNA, 16 nt, Salmonella enterica enterica serovar Typhi
ccagcuacaccugggc

SEQ ID NO: 3610566 - RNA, 18 nt, Salmonella enterica enterica serovar Typhi
ccagcuacuggccacgga

SEQ ID NO: 3610567 - RNA, 22 nt, Salmonella enterica enterica serovar Typhi
ccagcucaaaugacgaauaccg

SEQ ID NO: 3610568 - RNA, 15 nt, Salmonella enterica enterica serovar Typhi
ccagcucaaccgcgc

SEQ ID NO: 3610569 - RNA, 14 nt, Salmonella enterica enterica serovar Typhi
ccagcucaacgccu

SEQ ID NO: 3610570 - RNA, 16 nt, Salmonella enterica enterica serovar Typhi
ccagcucaacgccuuu

SEQ ID NO: 3610571 - RNA, 14 nt, Salmonella enterica enterica serovar Typhi
ccagcucaccagcc

SEQ ID NO: 3610572 - RNA, 18 nt, Salmonella enterica enterica serovar Typhi
ccagcucaggguccccau

SEQ ID NO: 3610573 - RNA, 13 nt, Salmonella enterica enterica serovar Typhi
ccagcucauagga

SEQ ID NO: 3610574 - RNA, 14 nt, Salmonella enterica enterica serovar Typhi
ccagcucauuuuua

SEQ ID NO: 3610575 - RNA, 22 nt, Salmonella enterica enterica serovar Typhi
ccagcucauuuuuacagacacg

SEQ ID NO: 3610576 - RNA, 16 nt, Salmonella enterica enterica serovar Typhi
ccagcuccauccacca

SEQ ID NO: 3610577 - RNA, 15 nt, Salmonella enterica enterica serovar Typhi
ccagcucccgcguca

SEQ ID NO: 3610578 - RNA, 19 nt, Salmonella enterica enterica serovar Typhi
ccagcuccgcgcuuauuga

SEQ ID NO: 3610579 - RNA, 22 nt, Salmonella enterica enterica serovar Typhi
ccagcucgcgcaguuccagcgg

SEQ ID NO: 3610580 - RNA, 16 nt, Salmonella enterica enterica serovar Typhi
ccagcucgucuugugu

SEQ ID NO: 3610581 - RNA, 15 nt, Salmonella enterica enterica serovar Typhi
ccagcucguuauuuc

SEQ ID NO: 3610582 - RNA, 13 nt, Salmonella enterica enterica serovar Typhi
ccagcucugccgg

SEQ ID NO: 3610583 - RNA, 12 nt, Salmonella enterica enterica serovar Typhi
ccagcucuucuu

SEQ ID NO: 3610584 - RNA, 14 nt, Salmonella enterica enterica serovar Typhi
ccagcucuucuucg

SEQ ID NO: 3610585 - RNA, 15 nt, Salmonella enterica enterica serovar Typhi
ccagcucuucuucgc

SEQ ID NO: 3610586 - RNA, 12 nt, Salmonella enterica enterica serovar Typhi
ccagcugacgac

SEQ ID NO: 3610587 - RNA, 17 nt, Salmonella enterica enterica serovar Typhi
ccagcugacgacgccag

SEQ ID NO: 3610588 - RNA, 21 nt, Salmonella enterica enterica serovar Typhi
ccagcugacgacgccagcccu

SEQ ID NO: 3610589 - RNA, 16 nt, Salmonella enterica enterica serovar Typhi
ccagcugcgcgcuauu

SEQ ID NO: 3610590 - RNA, 20 nt, Salmonella enterica enterica serovar Typhi
ccagcugcgcgcuauuccag

SEQ ID NO: 3610591 - RNA, 12 nt, Salmonella enterica enterica serovar Typhi
ccagcuggcugg

SEQ ID NO: 3610592 - RNA, 18 nt, Salmonella enterica enterica serovar Typhi
ccagcuguuuaagcgccu

SEQ ID NO: 3610593 - RNA, 13 nt, Salmonella enterica enterica serovar Typhi
ccagcuuaucuga

SEQ ID NO: 3610594 - RNA, 14 nt, Salmonella enterica enterica serovar Typhi
ccagcuucgccccg

SEQ ID NO: 3610595 - RNA, 11 nt, Salmonella enterica enterica serovar Typhi
ccagcuugaau

SEQ ID NO: 3610596 - RNA, 18 nt, Salmonella enterica enterica serovar Typhi
ccagcuugccgucacagg

SEQ ID NO: 3610597 - RNA, 14 nt, Salmonella enterica enterica serovar Typhi
ccaggaacuaacuc

SEQ ID NO: 3610598 - RNA, 19 nt, Salmonella enterica enterica serovar Typhi
ccaggaagaguaucucucu

SEQ ID NO: 3610599 - RNA, 23 nt, Salmonella enterica enterica serovar Typhi
ccaggacaacgccgguacgcagc

SEQ ID NO: 3610600 - RNA, 15 nt, Salmonella enterica enterica serovar Typhi
ccaggagcaaaccga

SEQ ID NO: 3610601 - RNA, 19 nt, Salmonella enterica enterica serovar Typhi
ccaggaguuaaaccuggua

SEQ ID NO: 3610602 - RNA, 16 nt, Salmonella enterica enterica serovar Typhi
ccaggauaguacugac

SEQ ID NO: 3610603 - RNA, 13 nt, Salmonella enterica enterica serovar Typhi
ccaggauaucgcg

SEQ ID NO: 3610604 - RNA, 13 nt, Salmonella enterica enterica serovar Typhi
ccaggaucgccgc

SEQ ID NO: 3610605 - RNA, 15 nt, Salmonella enterica enterica serovar Typhi
ccaggaugccaacca

SEQ ID NO: 3610606 - RNA, 17 nt, Salmonella enterica enterica serovar Typhi
ccaggaugccaaccacc

SEQ ID NO: 3610607 - RNA, 15 nt, Salmonella enterica enterica serovar Typhi
ccaggauggccagca

SEQ ID NO: 3610608 - RNA, 20 nt, Salmonella enterica enterica serovar Typhi
ccaggauggccagcaccagc

SEQ ID NO: 3610609 - RNA, 21 nt, Salmonella enterica enterica serovar Typhi
ccaggcaaagauccaccagau

SEQ ID NO: 3610610 - RNA, 21 nt, Salmonella enterica enterica serovar Typhi
ccagucgcucuaacugaugug

SEQ ID NO: 3610611 - RNA, 17 nt, Salmonella enterica enterica serovar Typhi
ccagucggaaccggcaa

SEQ ID NO: 3610612 - RNA, 13 nt, Salmonella enterica enterica serovar Typhi
ccagucggacagc

SEQ ID NO: 3610613 - RNA, 23 nt, Salmonella enterica enterica serovar Typhi
ccagucggacagcgacacuccgc

SEQ ID NO: 3610614 - RNA, 15 nt, Salmonella enterica enterica serovar Typhi
ccagucgggcgugcc

SEQ ID NO: 3610615 - RNA, 17 nt, Salmonella enterica enterica serovar Typhi
ccagucuuccauuacaa

SEQ ID NO: 3610616 - RNA, 16 nt, Salmonella enterica enterica serovar Typhi
ccagucuuccugcggu

SEQ ID NO: 3610617 - RNA, 23 nt, Salmonella enterica enterica serovar Typhi
ccagugaaaguugguguuucuca

SEQ ID NO: 3610618 - RNA, 14 nt, Salmonella enterica enterica serovar Typhi
ccagugaauacugc

SEQ ID NO: 3610619 - RNA, 19 nt, Salmonella enterica enterica serovar Typhi
ccagugcagaaagugugau

SEQ ID NO: 3610620 - RNA, 13 nt, Salmonella enterica enterica serovar Typhi
ccagugccaagca

SEQ ID NO: 3610621 - RNA, 21 nt, Salmonella enterica enterica serovar Typhi
ccagugccaccagccggagcc

SEQ ID NO: 3610622 - RNA, 22 nt, Salmonella enterica enterica serovar Typhi
ccagugcccgaaagcaauacug

SEQ ID NO: 3610623 - RNA, 20 nt, Salmonella enterica enterica serovar Typhi
ccagugcgaugggcuucaga

SEQ ID NO: 3610624 - RNA, 22 nt, Salmonella enterica enterica serovar Typhi
ccagugcgcauacuaccgcugc

SEQ ID NO: 3610625 - RNA, 15 nt, Salmonella enterica enterica serovar Typhi
ccaguggaugcgcua

SEQ ID NO: 3610626 - RNA, 13 nt, Salmonella enterica enterica serovar Typhi
ccaguggcaaaau

SEQ ID NO: 3610627 - RNA, 13 nt, Salmonella enterica enterica serovar Typhi
ccaguggcgaaac

SEQ ID NO: 3610628 - RNA, 20 nt, Salmonella enterica enterica serovar Typhi
ccagugguuccauuccagaa

SEQ ID NO: 3610629 - RNA, 15 nt, Salmonella enterica enterica serovar Typhi
ccaguguacugccaa

SEQ ID NO: 3610630 - RNA, 15 nt, Salmonella enterica enterica serovar Typhi
ccaguguuguucucu

SEQ ID NO: 3610631 - RNA, 19 nt, Salmonella enterica enterica serovar Typhi
ccaguuaacagaaugcuga

SEQ ID NO: 3610632 - RNA, 20 nt, Salmonella enterica enterica serovar Typhi
ccaguuaaugccgacccacc

SEQ ID NO: 3610633 - RNA, 19 nt, Salmonella enterica enterica serovar Typhi
ccaguuagcgaucgcgccg

SEQ ID NO: 3610634 - RNA, 12 nt, Salmonella enterica enterica serovar Typhi
ccaguucacucc

SEQ ID NO: 3610635 - RNA, 22 nt, Salmonella enterica enterica serovar Typhi
ccaguucacuccuaagagaaaa

SEQ ID NO: 3610636 - RNA, 16 nt, Salmonella enterica enterica serovar Typhi
ccaguucauuaacauc

SEQ ID NO: 3610637 - RNA, 17 nt, Salmonella enterica enterica serovar Typhi
ccaguucauugauuaac

SEQ ID NO: 3610638 - RNA, 16 nt, Salmonella enterica enterica serovar Typhi
ccaguucccacagcuu

SEQ ID NO: 3610639 - RNA, 12 nt, Salmonella enterica enterica serovar Typhi
ccaguuccccau

SEQ ID NO: 3610640 - RNA, 17 nt, Salmonella enterica enterica serovar Typhi
ccaguucgucuuccgga

SEQ ID NO: 3610641 - RNA, 15 nt, Salmonella enterica enterica serovar Typhi
ccaguucucaaucgc

SEQ ID NO: 3610642 - RNA, 17 nt, Salmonella enterica enterica serovar Typhi
ccaguugcauacauaaa

SEQ ID NO: 3610643 - RNA, 18 nt, Salmonella enterica enterica serovar Typhi
ccaguugcauacauaaau

SEQ ID NO: 3610644 - RNA, 12 nt, Salmonella enterica enterica serovar Typhi
ccaguugcgcca

SEQ ID NO: 3610645 - RNA, 20 nt, Salmonella enterica enterica serovar Typhi
ccaguugcucauaacggcua

SEQ ID NO: 3610646 - RNA, 15 nt, Salmonella enterica enterica serovar Typhi
ccaguugcugcaucg

SEQ ID NO: 3610647 - RNA, 17 nt, Salmonella enterica enterica serovar Typhi
ccaguugcuuaccuugu

SEQ ID NO: 3610648 - RNA, 21 nt, Salmonella enterica enterica serovar Typhi
ccaguuguaacgccuggcgca

SEQ ID NO: 3610649 - RNA, 17 nt, Salmonella enterica enterica serovar Typhi
ccaguuguuccagcagc

SEQ ID NO: 3610650 - RNA, 18 nt, Salmonella enterica enterica serovar Typhi
ccaguuguuccagcagcu

SEQ ID NO: 3610651 - RNA, 20 nt, Salmonella enterica enterica serovar Typhi
ccaguuguuccgcgcugaug

SEQ ID NO: 3610652 - RNA, 14 nt, Salmonella enterica enterica serovar Typhi
ccaguuguuuauuc

SEQ ID NO: 3610653 - RNA, 22 nt, Salmonella enterica enterica serovar Typhi
ccaguuguuuauuccauucauc

SEQ ID NO: 3610654 - RNA, 14 nt, Salmonella enterica enterica serovar Typhi
ccaguuuacgcgua

SEQ ID NO: 3610655 - RNA, 15 nt, Salmonella enterica enterica serovar Typhi
ccaguuucaaugccc

SEQ ID NO: 3610656 - RNA, 18 nt, Salmonella enterica enterica serovar Typhi
ccaguuucaaugcccagg

SEQ ID NO: 3610657 - RNA, 21 nt, Salmonella enterica enterica serovar Typhi
ccaguuucucaaacacuucua

SEQ ID NO: 3610658 - RNA, 19 nt, Salmonella enterica enterica serovar Typhi
ccaguuucuucggcuucac

SEQ ID NO: 3610659 - RNA, 19 nt, Salmonella enterica enterica serovar Typhi
ccaguuugcguucacagca

SEQ ID NO: 3610660 - RNA, 20 nt, Salmonella enterica enterica serovar Typhi
ccaguuugcguucacagcac

SEQ ID NO: 3610661 - RNA, 21 nt, Salmonella enterica enterica serovar Typhi
ccaguuugcguucacagcacc

SEQ ID NO: 3610662 - RNA, 21 nt, Salmonella enterica enterica serovar Typhi
ccaguuuuugcauuauauuuu

SEQ ID NO: 3610663 - RNA, 20 nt, Salmonella enterica enterica serovar Typhi
ccauaaaauaaagucagcaa

SEQ ID NO: 3610664 - RNA, 12 nt, Salmonella enterica enterica serovar Typhi
ccauaaaaugau

SEQ ID NO: 3610665 - RNA, 13 nt, Salmonella enterica enterica serovar Typhi
ccauaaacaaaac

SEQ ID NO: 3610666 - RNA, 17 nt, Salmonella enterica enterica serovar Typhi
ccauaaagcgaauaauu

SEQ ID NO: 3610667 - RNA, 14 nt, Salmonella enterica enterica serovar Typhi
ccauaaaucauuac

SEQ ID NO: 3610668 - RNA, 23 nt, Salmonella enterica enterica serovar Typhi
ccauaaaucauuacuuauauuua

SEQ ID NO: 3610669 - RNA, 17 nt, Salmonella enterica enterica serovar Typhi
ccauaacaacuauuuuu

SEQ ID NO: 3610670 - RNA, 17 nt, Salmonella enterica enterica serovar Typhi
ccauaaucgauauaauu

SEQ ID NO: 3610671 - RNA, 18 nt, Salmonella enterica enterica serovar Typhi
ccauaaucgauauaauuu

SEQ ID NO: 3610672 - RNA, 12 nt, Salmonella enterica enterica serovar Typhi
ccauaaugacgc

SEQ ID NO: 3610673 - RNA, 17 nt, Salmonella enterica enterica serovar Typhi
ccauaaugauccacacc

SEQ ID NO: 3610674 - RNA, 23 nt, Salmonella enterica enterica serovar Typhi
ccauaauuuauccuccgaacagg

SEQ ID NO: 3610675 - RNA, 22 nt, Salmonella enterica enterica serovar Typhi
ccauaauuugauauuuaaucgc

SEQ ID NO: 3610676 - RNA, 13 nt, Salmonella enterica enterica serovar Typhi
ccauaauuuuccc

SEQ ID NO: 3610677 - RNA, 20 nt, Salmonella enterica enterica serovar Typhi
ccauacacugcauaaauauc

SEQ ID NO: 3610678 - RNA, 21 nt, Salmonella enterica enterica serovar Typhi
ccauacacugcauaaauaucu

SEQ ID NO: 3610679 - RNA, 18 nt, Salmonella enterica enterica serovar Typhi
ccauacagcccauaccac

SEQ ID NO: 3610680 - RNA, 21 nt, Salmonella enterica enterica serovar Typhi
ccauacauugaguaaauaaau

SEQ ID NO: 3610681 - RNA, 15 nt, Salmonella enterica enterica serovar Typhi
ccauaccccaucauc

SEQ ID NO: 3610682 - RNA, 16 nt, Salmonella enterica enterica serovar Typhi
ccauacccggcuccca

SEQ ID NO: 3610683 - RNA, 19 nt, Salmonella enterica enterica serovar Typhi
ccauaccggacuccaggca

SEQ ID NO: 3610684 - RNA, 16 nt, Salmonella enterica enterica serovar Typhi
ccauaccuaauagcga

SEQ ID NO: 3610685 - RNA, 19 nt, Salmonella enterica enterica serovar Typhi
ccauaccuaaugcccgcuu

SEQ ID NO: 3610686 - RNA, 22 nt, Salmonella enterica enterica serovar Typhi
ccauacgauucagguuuugcug

SEQ ID NO: 3610687 - RNA, 19 nt, Salmonella enterica enterica serovar Typhi
ccauacguuuuuauuaucu

SEQ ID NO: 3610688 - RNA, 18 nt, Salmonella enterica enterica serovar Typhi
ccauagaaaucagcaggu

SEQ ID NO: 3610689 - RNA, 14 nt, Salmonella enterica enterica serovar Typhi
ccauagacaguacg

SEQ ID NO: 3610690 - RNA, 20 nt, Salmonella enterica enterica serovar Typhi
ccauagauaccuucuucacu

SEQ ID NO: 3610691 - RNA, 23 nt, Salmonella enterica enterica serovar Typhi
ccauagcaucgacccuugcgacc

SEQ ID NO: 3610692 - RNA, 21 nt, Salmonella enterica enterica serovar Typhi
ccauagccaacacauaagcca

SEQ ID NO: 3610693 - RNA, 18 nt, Salmonella enterica enterica serovar Typhi
ccauagcccacuauuuuu

SEQ ID NO: 3610694 - RNA, 22 nt, Salmonella enterica enterica serovar Typhi
ccauagcgggcagcauugacca

SEQ ID NO: 3610695 - RNA, 23 nt, Salmonella enterica enterica serovar Typhi
ccaucgcggcgcaaaucgccauc

SEQ ID NO: 3610696 - RNA, 17 nt, Salmonella enterica enterica serovar Typhi
ccaucggcaaacgccgc

SEQ ID NO: 3610697 - RNA, 19 nt, Salmonella enterica enterica serovar Typhi
ccaucggcaaacgccgccu

SEQ ID NO: 3610698 - RNA, 21 nt, Salmonella enterica enterica serovar Typhi
ccaucggcacgucgucccagg

SEQ ID NO: 3610699 - RNA, 23 nt, Salmonella enterica enterica serovar Typhi
ccaucgguucucugccaucaucc

SEQ ID NO: 3610700 - RNA, 16 nt, Salmonella enterica enterica serovar Typhi
ccaucguaggcgcaaa

SEQ ID NO: 3610701 - RNA, 14 nt, Salmonella enterica enterica serovar Typhi
ccaucguccagcca

SEQ ID NO: 3610702 - RNA, 15 nt, Salmonella enterica enterica serovar Typhi
ccaucguccagccau

SEQ ID NO: 3610703 - RNA, 16 nt, Salmonella enterica enterica serovar Typhi
ccaucuccggcagcgu

SEQ ID NO: 3610704 - RNA, 14 nt, Salmonella enterica enterica serovar Typhi
ccaucucuuccgcg

SEQ ID NO: 3610705 - RNA, 21 nt, Salmonella enterica enterica serovar Typhi
ccaucuggcguugccugcuau

SEQ ID NO: 3610706 - RNA, 13 nt, Salmonella enterica enterica serovar Typhi
ccaucuucacgca

SEQ ID NO: 3610707 - RNA, 18 nt, Salmonella enterica enterica serovar Typhi
ccaucuuccucacagccu

SEQ ID NO: 3610708 - RNA, 16 nt, Salmonella enterica enterica serovar Typhi
ccaucuuuaccaaugu

SEQ ID NO: 3610709 - RNA, 16 nt, Salmonella enterica enterica serovar Typhi
ccaucuuucacccauu

SEQ ID NO: 3610710 - RNA, 13 nt, Salmonella enterica enterica serovar Typhi
ccaucuuucuuuu

SEQ ID NO: 3610711 - RNA, 17 nt, Salmonella enterica enterica serovar Typhi
ccaucuuucuuuucgcg

SEQ ID NO: 3610712 - RNA, 22 nt, Salmonella enterica enterica serovar Typhi
ccaucuuugcaccgcuaaaaaa

SEQ ID NO: 3610713 - RNA, 12 nt, Salmonella enterica enterica serovar Typhi
ccaugaaaaaaa

SEQ ID NO: 3610714 - RNA, 13 nt, Salmonella enterica enterica serovar Typhi
ccaugaaaaaaac

SEQ ID NO: 3610715 - RNA, 17 nt, Salmonella enterica enterica serovar Typhi
ccaugaacaccucauau

SEQ ID NO: 3610716 - RNA, 19 nt, Salmonella enterica enterica serovar Typhi
ccaugacgcagggcaauau

SEQ ID NO: 3610717 - RNA, 14 nt, Salmonella enterica enterica serovar Typhi
ccaugacguucaau

SEQ ID NO: 3610718 - RNA, 15 nt, Salmonella enterica enterica serovar Typhi
ccaugagcgaaacuc

SEQ ID NO: 3610719 - RNA, 16 nt, Salmonella enterica enterica serovar Typhi
ccaugaguucaauaug

SEQ ID NO: 3610720 - RNA, 14 nt, Salmonella enterica enterica serovar Typhi
ccaugauaauaauc

SEQ ID NO: 3610721 - RNA, 13 nt, Salmonella enterica enterica serovar Typhi
ccaugauaaucag

SEQ ID NO: 3610722 - RNA, 14 nt, Salmonella enterica enterica serovar Typhi
ccaugauaaucagc

SEQ ID NO: 3610723 - RNA, 22 nt, Salmonella enterica enterica serovar Typhi
ccaugaucgauagcgacggcgc

SEQ ID NO: 3610724 - RNA, 15 nt, Salmonella enterica enterica serovar Typhi
ccaugaucgccgcca

SEQ ID NO: 3610725 - RNA, 15 nt, Salmonella enterica enterica serovar Typhi
ccaugaugagcgcca

SEQ ID NO: 3610726 - RNA, 22 nt, Salmonella enterica enterica serovar Typhi
ccaugaugggcaagcguagucc

SEQ ID NO: 3610727 - RNA, 19 nt, Salmonella enterica enterica serovar Typhi
ccaugauucaucccgcugu

SEQ ID NO: 3610728 - RNA, 17 nt, Salmonella enterica enterica serovar Typhi
ccaugcaaaaugcuucu

SEQ ID NO: 3610729 - RNA, 16 nt, Salmonella enterica enterica serovar Typhi
ccaugcauaaugcagc

SEQ ID NO: 3610730 - RNA, 17 nt, Salmonella enterica enterica serovar Typhi
ccaugcauaaugcagcc

SEQ ID NO: 3610731 - RNA, 13 nt, Salmonella enterica enterica serovar Typhi
ccaugccagcagu

SEQ ID NO: 3610732 - RNA, 11 nt, Salmonella enterica enterica serovar Typhi
ccaugccuuug

SEQ ID NO: 3610733 - RNA, 21 nt, Salmonella enterica enterica serovar Typhi
ccaugcggcugaguucaggca

SEQ ID NO: 3610734 - RNA, 15 nt, Salmonella enterica enterica serovar Typhi
ccaugcuauucagca

SEQ ID NO: 3610735 - RNA, 14 nt, Salmonella enterica enterica serovar Typhi
ccaugcucauccaa

SEQ ID NO: 3610736 - RNA, 13 nt, Salmonella enterica enterica serovar Typhi
ccaugcuuucaau

SEQ ID NO: 3610737 - RNA, 16 nt, Salmonella enterica enterica serovar Typhi
ccaugcuuucaauaaa

SEQ ID NO: 3610738 - RNA, 19 nt, Salmonella enterica enterica serovar Typhi
ccauggaacauccucuccu

SEQ ID NO: 3610739 - RNA, 20 nt, Salmonella enterica enterica serovar Typhi
ccauggaacauccucuccug

SEQ ID NO: 3610740 - RNA, 16 nt, Salmonella enterica enterica serovar Typhi
ccauggcaggcagcac

SEQ ID NO: 3610741 - RNA, 17 nt, Salmonella enterica enterica serovar Typhi
ccauggcaggcagcaca

SEQ ID NO: 3610742 - RNA, 15 nt, Salmonella enterica enterica serovar Typhi
ccauggccgcagccc

SEQ ID NO: 3610743 - RNA, 18 nt, Salmonella enterica enterica serovar Typhi
ccauggccgcagcccgcc

SEQ ID NO: 3610744 - RNA, 23 nt, Salmonella enterica enterica serovar Typhi
ccaugguucacaauacagaacau

SEQ ID NO: 3610745 - RNA, 14 nt, Salmonella enterica enterica serovar Typhi
ccauguacuccuga

SEQ ID NO: 3610746 - RNA, 15 nt, Salmonella enterica enterica serovar Typhi
ccauguacuccugau

SEQ ID NO: 3610747 - RNA, 20 nt, Salmonella enterica enterica serovar Typhi
ccaugucuugcuaucaaacu

SEQ ID NO: 3610748 - RNA, 20 nt, Salmonella enterica enterica serovar Typhi
ccaugugacggcauguccgg

SEQ ID NO: 3610749 - RNA, 22 nt, Salmonella enterica enterica serovar Typhi
ccauguggccagcggccagcca

SEQ ID NO: 3610750 - RNA, 15 nt, Salmonella enterica enterica serovar Typhi
ccauguucauaaagu

SEQ ID NO: 3610751 - RNA, 22 nt, Salmonella enterica enterica serovar Typhi
ccauguugaucguaaaaugaaa

SEQ ID NO: 3610752 - RNA, 23 nt, Salmonella enterica enterica serovar Typhi
ccauguuuuauacucaaaaaauc

SEQ ID NO: 3610753 - RNA, 22 nt, Salmonella enterica enterica serovar Typhi
ccauuaacgccgcauagcggca

SEQ ID NO: 3610754 - RNA, 14 nt, Salmonella enterica enterica serovar Typhi
ccauuaagacaggu

SEQ ID NO: 3610755 - RNA, 15 nt, Salmonella enterica enterica serovar Typhi
ccauuaauacccaua

SEQ ID NO: 3610756 - RNA, 21 nt, Salmonella enterica enterica serovar Typhi
ccauuaauauagaguugugaa

SEQ ID NO: 3610757 - RNA, 14 nt, Salmonella enterica enterica serovar Typhi
ccauuacgcccccu

SEQ ID NO: 3610758 - RNA, 16 nt, Salmonella enterica enterica serovar Typhi
ccauuacuaacacguu

SEQ ID NO: 3610759 - RNA, 12 nt, Salmonella enterica enterica serovar Typhi
ccauuacucuca

SEQ ID NO: 3610760 - RNA, 12 nt, Salmonella enterica enterica serovar Typhi
ccauuagcgccu

SEQ ID NO: 3610761 - RNA, 17 nt, Salmonella enterica enterica serovar Typhi
ccauuaggcuauuuuau

SEQ ID NO: 3610762 - RNA, 18 nt, Salmonella enterica enterica serovar Typhi
ccauuaucgaucugagcg

SEQ ID NO: 3610763 - RNA, 17 nt, Salmonella enterica enterica serovar Typhi
ccauuaugcucaccgcg

SEQ ID NO: 3610764 - RNA, 17 nt, Salmonella enterica enterica serovar Typhi
ccauuauuguguucuca

SEQ ID NO: 3610765 - RNA, 15 nt, Salmonella enterica enterica serovar Typhi
ccauucaacacauuc

SEQ ID NO: 3610766 - RNA, 14 nt, Salmonella enterica enterica serovar Typhi
ccauucaaccagcc

SEQ ID NO: 3610767 - RNA, 13 nt, Salmonella enterica enterica serovar Typhi
ccauucccagccg

SEQ ID NO: 3610768 - RNA, 15 nt, Salmonella enterica enterica serovar Typhi
ccauucccagcgccc

SEQ ID NO: 3610769 - RNA, 21 nt, Salmonella enterica enterica serovar Typhi
ccauucccagcgcccccagca

SEQ ID NO: 3610770 - RNA, 17 nt, Salmonella enterica enterica serovar Typhi
ccauucccgauaaugac

SEQ ID NO: 3610771 - RNA, 20 nt, Salmonella enterica enterica serovar Typhi
ccauucccgauaaugaccga

SEQ ID NO: 3610772 - RNA, 14 nt, Salmonella enterica enterica serovar Typhi
ccauucccguaaaa

SEQ ID NO: 3610773 - RNA, 18 nt, Salmonella enterica enterica serovar Typhi
ccauucccguaaaagaag

SEQ ID NO: 3610774 - RNA, 22 nt, Salmonella enterica enterica serovar Typhi
ccauucgccagcccgaucaucu

SEQ ID NO: 3610775 - RNA, 16 nt, Salmonella enterica enterica serovar Typhi
ccauucggccugcggu

SEQ ID NO: 3610776 - RNA, 16 nt, Salmonella enterica enterica serovar Typhi
ccauugauaccaauaa

SEQ ID NO: 3610777 - RNA, 21 nt, Salmonella enterica enterica serovar Typhi
ccauugaugccugcccaucua

SEQ ID NO: 3610778 - RNA, 18 nt, Salmonella enterica enterica serovar Typhi
ccauugcaauaccggcug

SEQ ID NO: 3610779 - RNA, 15 nt, Salmonella enterica enterica serovar Typhi
ccauugccaguaccg

SEQ ID NO: 3610780 - RNA, 14 nt, Salmonella enterica enterica serovar Typhi
ccauugcguauuuc

SEQ ID NO: 3610781 - RNA, 14 nt, Salmonella enterica enterica serovar Typhi
cccagcaaaccggc

SEQ ID NO: 3610782 - RNA, 22 nt, Salmonella enterica enterica serovar Typhi
cccagcaaaucgcccaucacau

SEQ ID NO: 3610783 - RNA, 13 nt, Salmonella enterica enterica serovar Typhi
cccagcaccaacg

SEQ ID NO: 3610784 - RNA, 19 nt, Salmonella enterica enterica serovar Typhi
cccagcaccgaaacagcac

SEQ ID NO: 3610785 - RNA, 22 nt, Salmonella enterica enterica serovar Typhi
cccagcacuaacagcagcagca

SEQ ID NO: 3610786 - RNA, 14 nt, Salmonella enterica enterica serovar Typhi
cccagcagcagaua

SEQ ID NO: 3610787 - RNA, 15 nt, Salmonella enterica enterica serovar Typhi
cccagcagcagccgg

SEQ ID NO: 3610788 - RNA, 14 nt, Salmonella enterica enterica serovar Typhi
cccagcauauuaac

SEQ ID NO: 3610789 - RNA, 21 nt, Salmonella enterica enterica serovar Typhi
cccagcauauuuuccggcguc

SEQ ID NO: 3610790 - RNA, 17 nt, Salmonella enterica enterica serovar Typhi
cccagcaugagccagcc

SEQ ID NO: 3610791 - RNA, 13 nt, Salmonella enterica enterica serovar Typhi
cccagccacgcgu

SEQ ID NO: 3610792 - RNA, 13 nt, Salmonella enterica enterica serovar Typhi
cccagccagacgc

SEQ ID NO: 3610793 - RNA, 14 nt, Salmonella enterica enterica serovar Typhi
cccagccagacgcc

SEQ ID NO: 3610794 - RNA, 18 nt, Salmonella enterica enterica serovar Typhi
cccagccagacgccagcc

SEQ ID NO: 3610795 - RNA, 21 nt, Salmonella enterica enterica serovar Typhi
cccagccgugaauggucacau

SEQ ID NO: 3610796 - RNA, 14 nt, Salmonella enterica enterica serovar Typhi
cccagcgaacuggc

SEQ ID NO: 3610797 - RNA, 17 nt, Salmonella enterica enterica serovar Typhi
cccagcgaucccaguug

SEQ ID NO: 3610798 - RNA, 13 nt, Salmonella enterica enterica serovar Typhi
cccagcgccagcc

SEQ ID NO: 3610799 - RNA, 12 nt, Salmonella enterica enterica serovar Typhi
cccagcgccccc

SEQ ID NO: 3610800 - RNA, 14 nt, Salmonella enterica enterica serovar Typhi
cccagcgcccccag

SEQ ID NO: 3610801 - RNA, 22 nt, Salmonella enterica enterica serovar Typhi
cccagcgccgagaaaaucagug

SEQ ID NO: 3610802 - RNA, 21 nt, Salmonella enterica enterica serovar Typhi
cccagcgccggauaauccaga

SEQ ID NO: 3610803 - RNA, 16 nt, Salmonella enterica enterica serovar Typhi
cccagcgcgaccugca

SEQ ID NO: 3610804 - RNA, 17 nt, Salmonella enterica enterica serovar Typhi
cccagcgcgauacgcag

SEQ ID NO: 3610805 - RNA, 17 nt, Salmonella enterica enterica serovar Typhi
cccagcgcuccaccaac

SEQ ID NO: 3610806 - RNA, 15 nt, Salmonella enterica enterica serovar Typhi
cccagcgcuggcaga

SEQ ID NO: 3610807 - RNA, 19 nt, Salmonella enterica enterica serovar Typhi
cccagcuugcccagauccu

SEQ ID NO: 3610808 - RNA, 18 nt, Salmonella enterica enterica serovar Typhi
cccaggauaguacugacc

SEQ ID NO: 3610809 - RNA, 19 nt, Salmonella enterica enterica serovar Typhi
cccaggauaguacugacca

SEQ ID NO: 3610810 - RNA, 22 nt, Salmonella enterica enterica serovar Typhi
cccaggauaguacugaccagac

SEQ ID NO: 3610811 - RNA, 21 nt, Salmonella enterica enterica serovar Typhi
cccaggcaaaugauuaucucc

SEQ ID NO: 3610812 - RNA, 20 nt, Salmonella enterica enterica serovar Typhi
cccaggcauaaaaaaagcgc

SEQ ID NO: 3610813 - RNA, 13 nt, Salmonella enterica enterica serovar Typhi
cccaggccaaaac

SEQ ID NO: 3610814 - RNA, 22 nt, Salmonella enterica enterica serovar Typhi
cccaggccaaaaccacagugac

SEQ ID NO: 3610815 - RNA, 12 nt, Salmonella enterica enterica serovar Typhi
cccaggccgcca

SEQ ID NO: 3610816 - RNA, 21 nt, Salmonella enterica enterica serovar Typhi
cccaggccgccaccgccucgc

SEQ ID NO: 3610817 - RNA, 13 nt, Salmonella enterica enterica serovar Typhi
cccaggccggcau

SEQ ID NO: 3610818 - RNA, 12 nt, Salmonella enterica enterica serovar Typhi
cccaggcgcgca

SEQ ID NO: 3610819 - RNA, 19 nt, Salmonella enterica enterica serovar Typhi
cccaggcgcgcagcugcca

SEQ ID NO: 3610820 - RNA, 19 nt, Salmonella enterica enterica serovar Typhi
cccaggcggguagucccag

SEQ ID NO: 3610821 - RNA, 13 nt, Salmonella enterica enterica serovar Typhi
cccaggcguccag

SEQ ID NO: 3610822 - RNA, 20 nt, Salmonella enterica enterica serovar Typhi
cccaggggcauauauuauua

SEQ ID NO: 3610823 - RNA, 21 nt, Salmonella enterica enterica serovar Typhi
cccagguuugaggcuugcagc

SEQ ID NO: 3610824 - RNA, 16 nt, Salmonella enterica enterica serovar Typhi
cccaguaauccggcaa

SEQ ID NO: 3610825 - RNA, 13 nt, Salmonella enterica enterica serovar Typhi
cccaguagcagac

SEQ ID NO: 3610826 - RNA, 12 nt, Salmonella enterica enterica serovar Typhi
cccaguagccau

SEQ ID NO: 3610827 - RNA, 17 nt, Salmonella enterica enterica serovar Typhi
cccagugccaccagccg

SEQ ID NO: 3610828 - RNA, 18 nt, Salmonella enterica enterica serovar Typhi
cccagugccaccagccgg

SEQ ID NO: 3610829 - RNA, 14 nt, Salmonella enterica enterica serovar Typhi
cccaguggcaaaau

SEQ ID NO: 3610830 - RNA, 15 nt, Salmonella enterica enterica serovar Typhi
cccaguguacugcca

SEQ ID NO: 3610831 - RNA, 19 nt, Salmonella enterica enterica serovar Typhi
cccaguuauuaaguuuuac

SEQ ID NO: 3610832 - RNA, 22 nt, Salmonella enterica enterica serovar Typhi
cccaguugaucggccagcaagc

SEQ ID NO: 3610833 - RNA, 21 nt, Salmonella enterica enterica serovar Typhi
cccaguugguuguagcacagc

SEQ ID NO: 3610834 - RNA, 12 nt, Salmonella enterica enterica serovar Typhi
cccaguuuaccc

SEQ ID NO: 3610835 - RNA, 21 nt, Salmonella enterica enterica serovar Typhi
cccaguuucaucaucgccgau

SEQ ID NO: 3610836 - RNA, 18 nt, Salmonella enterica enterica serovar Typhi
cccaguuuuuuucugcca

SEQ ID NO: 3610837 - RNA, 23 nt, Salmonella enterica enterica serovar Typhi
cccauaauaaugacuaauuauua

SEQ ID NO: 3610838 - RNA, 19 nt, Salmonella enterica enterica serovar Typhi
cccauacccagguuugcgc

SEQ ID NO: 3610839 - RNA, 22 nt, Salmonella enterica enterica serovar Typhi
cccauagaugggccgaguaauc

SEQ ID NO: 3610840 - RNA, 15 nt, Salmonella enterica enterica serovar Typhi
cccauaguagcuaau

SEQ ID NO: 3610841 - RNA, 13 nt, Salmonella enterica enterica serovar Typhi
cccauauuccugc

SEQ ID NO: 3610842 - RNA, 21 nt, Salmonella enterica enterica serovar Typhi
cccauauucgucuucaucuuc

SEQ ID NO: 3610843 - RNA, 15 nt, Salmonella enterica enterica serovar Typhi
cccaucaccgccagu

SEQ ID NO: 3610844 - RNA, 18 nt, Salmonella enterica enterica serovar Typhi
cccaucacgcccuguaaa

SEQ ID NO: 3610845 - RNA, 15 nt, Salmonella enterica enterica serovar Typhi
cccaucagcgccagc

SEQ ID NO: 3610846 - RNA, 17 nt, Salmonella enterica enterica serovar Typhi
cccaucagcgccagccc

SEQ ID NO: 3610847 - RNA, 18 nt, Salmonella enterica enterica serovar Typhi
cccaucagggaaaaaugu

SEQ ID NO: 3610848 - RNA, 14 nt, Salmonella enterica enterica serovar Typhi
cccaucauugacuu

SEQ ID NO: 3610849 - RNA, 23 nt, Salmonella enterica enterica serovar Typhi
cccaucauugacuucaacgcagg

SEQ ID NO: 3610850 - RNA, 13 nt, Salmonella enterica enterica serovar Typhi
cccauccccauau

SEQ ID NO: 3610851 - RNA, 13 nt, Salmonella enterica enterica serovar Typhi
cccaucccggcaa

SEQ ID NO: 3610852 - RNA, 11 nt, Salmonella enterica enterica serovar Typhi
cccauccgcgc

SEQ ID NO: 3610853 - RNA, 17 nt, Salmonella enterica enterica serovar Typhi
cccauccgucaggaugg

SEQ ID NO: 3610854 - RNA, 14 nt, Salmonella enterica enterica serovar Typhi
cccaucgagccaac

SEQ ID NO: 3610855 - RNA, 16 nt, Salmonella enterica enterica serovar Typhi
cccaucgccacagcgg

SEQ ID NO: 3610856 - RNA, 14 nt, Salmonella enterica enterica serovar Typhi
cccaucgccguagg

SEQ ID NO: 3610857 - RNA, 20 nt, Salmonella enterica enterica serovar Typhi
cccaucgcuuugcagaaaau

SEQ ID NO: 3610858 - RNA, 21 nt, Salmonella enterica enterica serovar Typhi
cccaucgggccgcucagcauc

SEQ ID NO: 3610859 - RNA, 18 nt, Salmonella enterica enterica serovar Typhi
cccaucguaacgccgucg

SEQ ID NO: 3610860 - RNA, 13 nt, Salmonella enterica enterica serovar Typhi
cccaucuccagcc

SEQ ID NO: 3610861 - RNA, 20 nt, Salmonella enterica enterica serovar Typhi
cccaugagcgaaacuccagc

SEQ ID NO: 3610862 - RNA, 18 nt, Salmonella enterica enterica serovar Typhi
cccaugauggugaacaga

SEQ ID NO: 3610863 - RNA, 15 nt, Salmonella enterica enterica serovar Typhi
cccaugcaaccagug

SEQ ID NO: 3610864 - RNA, 23 nt, Salmonella enterica enterica serovar Typhi
cccaugcaccagucccagcccca

SEQ ID NO: 3610865 - RNA, 13 nt, Salmonella enterica enterica serovar Typhi
cccaugcuuccag

SEQ ID NO: 3610866 - RNA, 15 nt, Salmonella enterica enterica serovar Typhi
cccauggaugcgccg

SEQ ID NO: 3610867 - RNA, 18 nt, Salmonella enterica enterica serovar Typhi
ccccuuuuuugcuggcaa

SEQ ID NO: 3610868 - RNA, 19 nt, Salmonella enterica enterica serovar Typhi
cccgaaagucaucugccag

SEQ ID NO: 3610869 - RNA, 17 nt, Salmonella enterica enterica serovar Typhi
cccgaacaugccgccga

SEQ ID NO: 3610870 - RNA, 19 nt, Salmonella enterica enterica serovar Typhi
cccgacaaaaccguucuga

SEQ ID NO: 3610871 - RNA, 15 nt, Salmonella enterica enterica serovar Typhi
cccgacaccagccgu

SEQ ID NO: 3610872 - RNA, 18 nt, Salmonella enterica enterica serovar Typhi
cccgacaccagccguuca

SEQ ID NO: 3610873 - RNA, 16 nt, Salmonella enterica enterica serovar Typhi
cccgacgcuggcgcaa

SEQ ID NO: 3610874 - RNA, 19 nt, Salmonella enterica enterica serovar Typhi
cccgacuaccggcaccagc

SEQ ID NO: 3610875 - RNA, 14 nt, Salmonella enterica enterica serovar Typhi
cccgagcgacgccc

SEQ ID NO: 3610876 - RNA, 23 nt, Salmonella enterica enterica serovar Typhi
cccgauaaaaucaucgcgcugau

SEQ ID NO: 3610877 - RNA, 13 nt, Salmonella enterica enterica serovar Typhi
cccgauaaccgcg

SEQ ID NO: 3610878 - RNA, 18 nt, Salmonella enterica enterica serovar Typhi
cccgauaaccgcguucau

SEQ ID NO: 3610879 - RNA, 11 nt, Salmonella enterica enterica serovar Typhi
cccgauacccu

SEQ ID NO: 3610880 - RNA, 12 nt, Salmonella enterica enterica serovar Typhi
cccgauacgcgg

SEQ ID NO: 3610881 - RNA, 13 nt, Salmonella enterica enterica serovar Typhi
cccgauacgcgga

SEQ ID NO: 3610882 - RNA, 13 nt, Salmonella enterica enterica serovar Typhi
cccgauagcgccg

SEQ ID NO: 3610883 - RNA, 22 nt, Salmonella enterica enterica serovar Typhi
cccgauagugcaagcucaucgg

SEQ ID NO: 3610884 - RNA, 22 nt, Salmonella enterica enterica serovar Typhi
cccgauauaccacccgcuauga

SEQ ID NO: 3610885 - RNA, 15 nt, Salmonella enterica enterica serovar Typhi
cccgaugagcuugca

SEQ ID NO: 3610886 - RNA, 20 nt, Salmonella enterica enterica serovar Typhi
cccgauguccgucuuuucug

SEQ ID NO: 3610887 - RNA, 21 nt, Salmonella enterica enterica serovar Typhi
cccgaugucgccacgccgccc

SEQ ID NO: 3610888 - RNA, 15 nt, Salmonella enterica enterica serovar Typhi
cccgauucgcaugaa

SEQ ID NO: 3610889 - RNA, 20 nt, Salmonella enterica enterica serovar Typhi
cccgauucgcaugaauucaa

SEQ ID NO: 3610890 - RNA, 20 nt, Salmonella enterica enterica serovar Typhi
cccgauuuugucggaauuuc

SEQ ID NO: 3610891 - RNA, 11 nt, Salmonella enterica enterica serovar Typhi
cccgcaaaagc

SEQ ID NO: 3610892 - RNA, 15 nt, Salmonella enterica enterica serovar Typhi
cccgcaaaccagguc

SEQ ID NO: 3610893 - RNA, 17 nt, Salmonella enterica enterica serovar Typhi
cccgcaaaccaggucug

SEQ ID NO: 3610894 - RNA, 20 nt, Salmonella enterica enterica serovar Typhi
cccgcaaacuaauggcgcag

SEQ ID NO: 3610895 - RNA, 19 nt, Salmonella enterica enterica serovar Typhi
cccgcaaacuggccacagc

SEQ ID NO: 3610896 - RNA, 18 nt, Salmonella enterica enterica serovar Typhi
cccgcacaaacgcuuuuu

SEQ ID NO: 3610897 - RNA, 16 nt, Salmonella enterica enterica serovar Typhi
cccgcacgcgacgcgc

SEQ ID NO: 3610898 - RNA, 16 nt, Salmonella enterica enterica serovar Typhi
cccgcacgcuuucuuc

SEQ ID NO: 3610899 - RNA, 22 nt, Salmonella enterica enterica serovar Typhi
cccgcacuaccagcucgcgcag

SEQ ID NO: 3610900 - RNA, 13 nt, Salmonella enterica enterica serovar Typhi
cccgcaggccugg

SEQ ID NO: 3610901 - RNA, 17 nt, Salmonella enterica enterica serovar Typhi
cccgcauacaggaagcc

SEQ ID NO: 3610902 - RNA, 17 nt, Salmonella enterica enterica serovar Typhi
cccgcaucgccgcggcg

SEQ ID NO: 3610903 - RNA, 17 nt, Salmonella enterica enterica serovar Typhi
cccgcaugguaaacgca

SEQ ID NO: 3610904 - RNA, 16 nt, Salmonella enterica enterica serovar Typhi
cccgcauuuuaaacga

SEQ ID NO: 3610905 - RNA, 21 nt, Salmonella enterica enterica serovar Typhi
cccgccagaugcagcggcagu

SEQ ID NO: 3610906 - RNA, 12 nt, Salmonella enterica enterica serovar Typhi
cccgccagcaca

SEQ ID NO: 3610907 - RNA, 15 nt, Salmonella enterica enterica serovar Typhi
cccgccagcacagca

SEQ ID NO: 3610908 - RNA, 14 nt, Salmonella enterica enterica serovar Typhi
cccgccagcggcgc

SEQ ID NO: 3610909 - RNA, 13 nt, Salmonella enterica enterica serovar Typhi
cccgccaggguau

SEQ ID NO: 3610910 - RNA, 19 nt, Salmonella enterica enterica serovar Typhi
cccgccaucguccagccau

SEQ ID NO: 3610911 - RNA, 16 nt, Salmonella enterica enterica serovar Typhi
cccgcccugcccgcca

SEQ ID NO: 3610912 - RNA, 18 nt, Salmonella enterica enterica serovar Typhi
cccgccgaaggcaacgcc

SEQ ID NO: 3610913 - RNA, 22 nt, Salmonella enterica enterica serovar Typhi
cccgccgaaggcaacgccgcca

SEQ ID NO: 3610914 - RNA, 21 nt, Salmonella enterica enterica serovar Typhi
cccgccgagaauuucagcacg

SEQ ID NO: 3610915 - RNA, 15 nt, Salmonella enterica enterica serovar Typhi
cccgccgccaccaug

SEQ ID NO: 3610916 - RNA, 12 nt, Salmonella enterica enterica serovar Typhi
cccgccgccagc

SEQ ID NO: 3610917 - RNA, 17 nt, Salmonella enterica enterica serovar Typhi
cccgccgccagcaccgc

SEQ ID NO: 3610918 - RNA, 12 nt, Salmonella enterica enterica serovar Typhi
cccgccgccagu

SEQ ID NO: 3610919 - RNA, 11 nt, Salmonella enterica enterica serovar Typhi
cccgccgccau

SEQ ID NO: 3610920 - RNA, 12 nt, Salmonella enterica enterica serovar Typhi
cccgccgccauc

SEQ ID NO: 3610921 - RNA, 23 nt, Salmonella enterica enterica serovar Typhi
cccgccgcgauguuugcucgcca

SEQ ID NO: 3610922 - RNA, 15 nt, Salmonella enterica enterica serovar Typhi
cccgccgcgcggccc

SEQ ID NO: 3610923 - RNA, 23 nt, Salmonella enterica enterica serovar Typhi
cccgccgcggcgguuauccuccg

SEQ ID NO: 3610924 - RNA, 13 nt, Salmonella enterica enterica serovar Typhi
cccgccgcuggcg

SEQ ID NO: 3610925 - RNA, 19 nt, Salmonella enterica enterica serovar Typhi
cccgccgggcgucacccgc

SEQ ID NO: 3610926 - RNA, 23 nt, Salmonella enterica enterica serovar Typhi
cccgccgggcgucacccgccggc

SEQ ID NO: 3610927 - RNA, 14 nt, Salmonella enterica enterica serovar Typhi
cccgccuccgucac

SEQ ID NO: 3610928 - RNA, 20 nt, Salmonella enterica enterica serovar Typhi
cccgccucggucaguauuuc

SEQ ID NO: 3610929 - RNA, 12 nt, Salmonella enterica enterica serovar Typhi
cccgccugcugc

SEQ ID NO: 3610930 - RNA, 21 nt, Salmonella enterica enterica serovar Typhi
cccgcgauaaaaauccugcuc

SEQ ID NO: 3610931 - RNA, 22 nt, Salmonella enterica enterica serovar Typhi
cccgcgcagaaucacuucaucc

SEQ ID NO: 3610932 - RNA, 13 nt, Salmonella enterica enterica serovar Typhi
cccgcgcaggcgg

SEQ ID NO: 3610933 - RNA, 13 nt, Salmonella enterica enterica serovar Typhi
cccgcgcauccca

SEQ ID NO: 3610934 - RNA, 14 nt, Salmonella enterica enterica serovar Typhi
cccgcgccagcagg

SEQ ID NO: 3610935 - RNA, 18 nt, Salmonella enterica enterica serovar Typhi
cccgcggcgaucaccacg

SEQ ID NO: 3610936 - RNA, 20 nt, Salmonella enterica enterica serovar Typhi
cccgcggucauugagccgcu

SEQ ID NO: 3610937 - RNA, 23 nt, Salmonella enterica enterica serovar Typhi
cccgcgugcggacguagggcugc

SEQ ID NO: 3610938 - RNA, 14 nt, Salmonella enterica enterica serovar Typhi
cccgcguuggcggc

SEQ ID NO: 3610939 - RNA, 12 nt, Salmonella enterica enterica serovar Typhi
cccgcugagugg

SEQ ID NO: 3610940 - RNA, 12 nt, Salmonella enterica enterica serovar Typhi
cccgcuggcgcg

SEQ ID NO: 3610941 - RNA, 21 nt, Salmonella enterica enterica serovar Typhi
cccgcuggcgcggggaucggu

SEQ ID NO: 3610942 - RNA, 20 nt, Salmonella enterica enterica serovar Typhi
cccgcugucgggagccucuu

SEQ ID NO: 3610943 - RNA, 14 nt, Salmonella enterica enterica serovar Typhi
cccgcuuuaccgaa

SEQ ID NO: 3610944 - RNA, 17 nt, Salmonella enterica enterica serovar Typhi
cccggacaaggcgcgcc

SEQ ID NO: 3610945 - RNA, 21 nt, Salmonella enterica enterica serovar Typhi
cccggagagaaacaacaccgu

SEQ ID NO: 3610946 - RNA, 21 nt, Salmonella enterica enterica serovar Typhi
cccggagagagcaacuggcaa

SEQ ID NO: 3610947 - RNA, 19 nt, Salmonella enterica enterica serovar Typhi
cccggagcggugaaacugu

SEQ ID NO: 3610948 - RNA, 18 nt, Salmonella enterica enterica serovar Typhi
cccggagggguuuucgcc

SEQ ID NO: 3610949 - RNA, 14 nt, Salmonella enterica enterica serovar Typhi
cccggcaacugcgc

SEQ ID NO: 3610950 - RNA, 21 nt, Salmonella enterica enterica serovar Typhi
cccggcaauuaccgccagcgg

SEQ ID NO: 3610951 - RNA, 24 nt, Salmonella enterica enterica serovar Typhi
cccggcaauuaccgccagcggcgu

SEQ ID NO: 3610952 - RNA, 12 nt, Salmonella enterica enterica serovar Typhi
cccggcaggcau

SEQ ID NO: 3610953 - RNA, 22 nt, Salmonella enterica enterica serovar Typhi
cccucuuccaucagccaggcgg

SEQ ID NO: 3610954 - RNA, 21 nt, Salmonella enterica enterica serovar Typhi
cccucuucuucuuccgucagc

SEQ ID NO: 3610955 - RNA, 16 nt, Salmonella enterica enterica serovar Typhi
cccugaaaccguggaa

SEQ ID NO: 3610956 - RNA, 18 nt, Salmonella enterica enterica serovar Typhi
cccugaauuucaauaauc

SEQ ID NO: 3610957 - RNA, 19 nt, Salmonella enterica enterica serovar Typhi
cccugaccuuccauccaca

SEQ ID NO: 3610958 - RNA, 16 nt, Salmonella enterica enterica serovar Typhi
cccugagcccacagcg

SEQ ID NO: 3610959 - RNA, 15 nt, Salmonella enterica enterica serovar Typhi
cccugagucuugccu

SEQ ID NO: 3610960 - RNA, 21 nt, Salmonella enterica enterica serovar Typhi
cccugauauacaaaacccaua

SEQ ID NO: 3610961 - RNA, 23 nt, Salmonella enterica enterica serovar Typhi
cccugauggcgcgccacuucuuu

SEQ ID NO: 3610962 - RNA, 24 nt, Salmonella enterica enterica serovar Typhi
cccugcaaagcaaaaaucaccaca

SEQ ID NO: 3610963 - RNA, 14 nt, Salmonella enterica enterica serovar Typhi
cccugcaacgccug

SEQ ID NO: 3610964 - RNA, 15 nt, Salmonella enterica enterica serovar Typhi
cccugcaacgccugc

SEQ ID NO: 3610965 - RNA, 13 nt, Salmonella enterica enterica serovar Typhi
cccugcaucagcu

SEQ ID NO: 3610966 - RNA, 23 nt, Salmonella enterica enterica serovar Typhi
cccugccacaacggcaauuuuua

SEQ ID NO: 3610967 - RNA, 17 nt, Salmonella enterica enterica serovar Typhi
cccugccaguagauggc

SEQ ID NO: 3610968 - RNA, 13 nt, Salmonella enterica enterica serovar Typhi
cccugcccaugaa

SEQ ID NO: 3610969 - RNA, 14 nt, Salmonella enterica enterica serovar Typhi
cccugcccgccagg

SEQ ID NO: 3610970 - RNA, 15 nt, Salmonella enterica enterica serovar Typhi
cccugccggcggcag

SEQ ID NO: 3610971 - RNA, 20 nt, Salmonella enterica enterica serovar Typhi
cccugccgucucaaccagca

SEQ ID NO: 3610972 - RNA, 18 nt, Salmonella enterica enterica serovar Typhi
cccugcgaacagcgcucc

SEQ ID NO: 3610973 - RNA, 19 nt, Salmonella enterica enterica serovar Typhi
cccugcgaacagcgcucca

SEQ ID NO: 3610974 - RNA, 23 nt, Salmonella enterica enterica serovar Typhi
cccugcgaacagcgcuccacgcg

SEQ ID NO: 3610975 - RNA, 15 nt, Salmonella enterica enterica serovar Typhi
cccugcgcauacguc

SEQ ID NO: 3610976 - RNA, 20 nt, Salmonella enterica enterica serovar Typhi
cccugcgcggccugcgccag

SEQ ID NO: 3610977 - RNA, 17 nt, Salmonella enterica enterica serovar Typhi
cccugcgcuuucaacca

SEQ ID NO: 3610978 - RNA, 19 nt, Salmonella enterica enterica serovar Typhi
cccugcggaaccgcccauc

SEQ ID NO: 3610979 - RNA, 16 nt, Salmonella enterica enterica serovar Typhi
cccugcgguagcgccg

SEQ ID NO: 3610980 - RNA, 18 nt, Salmonella enterica enterica serovar Typhi
cccugcgguagcgccgau

SEQ ID NO: 3610981 - RNA, 17 nt, Salmonella enterica enterica serovar Typhi
cccugcuggcgcaugau

SEQ ID NO: 3610982 - RNA, 22 nt, Salmonella enterica enterica serovar Typhi
cccugcuugucgaucaucagac

SEQ ID NO: 3610983 - RNA, 22 nt, Salmonella enterica enterica serovar Typhi
cccuggauugugauuccaguug

SEQ ID NO: 3610984 - RNA, 18 nt, Salmonella enterica enterica serovar Typhi
cccuggccugcucaucag

SEQ ID NO: 3610985 - RNA, 19 nt, Salmonella enterica enterica serovar Typhi
cccuggcgcaguggcgggu

SEQ ID NO: 3610986 - RNA, 14 nt, Salmonella enterica enterica serovar Typhi
cccuggcgcgccag

SEQ ID NO: 3610987 - RNA, 15 nt, Salmonella enterica enterica serovar Typhi
cccuggcugguuaau

SEQ ID NO: 3610988 - RNA, 23 nt, Salmonella enterica enterica serovar Typhi
cccuguaacagaauuaacgcaga

SEQ ID NO: 3610989 - RNA, 14 nt, Salmonella enterica enterica serovar Typhi
cccuguccuccaug

SEQ ID NO: 3610990 - RNA, 20 nt, Salmonella enterica enterica serovar Typhi
cccuguggaaacuccagcgg

SEQ ID NO: 3610991 - RNA, 22 nt, Salmonella enterica enterica serovar Typhi
cccuguuauucagggcuuuauu

SEQ ID NO: 3610992 - RNA, 14 nt, Salmonella enterica enterica serovar Typhi
cccuguucaaaagc

SEQ ID NO: 3610993 - RNA, 14 nt, Salmonella enterica enterica serovar Typhi
cccuguucaaaaua

SEQ ID NO: 3610994 - RNA, 18 nt, Salmonella enterica enterica serovar Typhi
cccuguuccuguauuuga

SEQ ID NO: 3610995 - RNA, 15 nt, Salmonella enterica enterica serovar Typhi
cccuuaaagccgccc

SEQ ID NO: 3610996 - RNA, 13 nt, Salmonella enterica enterica serovar Typhi
cccuucaggaaua

SEQ ID NO: 3610997 - RNA, 16 nt, Salmonella enterica enterica serovar Typhi
cccuuccagacagcuu

SEQ ID NO: 3610998 - RNA, 21 nt, Salmonella enterica enterica serovar Typhi
cccuuccagcagccagccguu

SEQ ID NO: 3610999 - RNA, 14 nt, Salmonella enterica enterica serovar Typhi
cccuucccaggugg

SEQ ID NO: 3611000 - RNA, 23 nt, Salmonella enterica enterica serovar Typhi
cccuucccccagaaugccgccca

SEQ ID NO: 3611001 - RNA, 17 nt, Salmonella enterica enterica serovar Typhi
cccuuccccggcagccu

SEQ ID NO: 3611002 - RNA, 23 nt, Salmonella enterica enterica serovar Typhi
cccuuccgccaccagguucagca

SEQ ID NO: 3611003 - RNA, 18 nt, Salmonella enterica enterica serovar Typhi
cccuuccgccacggcuuu

SEQ ID NO: 3611004 - RNA, 15 nt, Salmonella enterica enterica serovar Typhi
cccuuccucuccccc

SEQ ID NO: 3611005 - RNA, 12 nt, Salmonella enterica enterica serovar Typhi
cccuucgcccuc

SEQ ID NO: 3611006 - RNA, 17 nt, Salmonella enterica enterica serovar Typhi
cccuucgcccucgccag

SEQ ID NO: 3611007 - RNA, 23 nt, Salmonella enterica enterica serovar Typhi
cccuucgcggaauuucaggaagc

SEQ ID NO: 3611008 - RNA, 23 nt, Salmonella enterica enterica serovar Typhi
cccuucgcuauccaucgccgcgc

SEQ ID NO: 3611009 - RNA, 16 nt, Salmonella enterica enterica serovar Typhi
cccuucgcuguccauu

SEQ ID NO: 3611010 - RNA, 17 nt, Salmonella enterica enterica serovar Typhi
cccuucucgcuaauauc

SEQ ID NO: 3611011 - RNA, 18 nt, Salmonella enterica enterica serovar Typhi
cccuucuucuggcucaga

SEQ ID NO: 3611012 - RNA, 19 nt, Salmonella enterica enterica serovar Typhi
cccuucuuuaucuucugcu

SEQ ID NO: 3611013 - RNA, 16 nt, Salmonella enterica enterica serovar Typhi
cccuugccgcuuccag

SEQ ID NO: 3611014 - RNA, 12 nt, Salmonella enterica enterica serovar Typhi
cccuugcgcguu

SEQ ID NO: 3611015 - RNA, 22 nt, Salmonella enterica enterica serovar Typhi
cccuuguacaggauauacuuca

SEQ ID NO: 3611016 - RNA, 18 nt, Salmonella enterica enterica serovar Typhi
cccuuguuauccuaaauc

SEQ ID NO: 3611017 - RNA, 16 nt, Salmonella enterica enterica serovar Typhi
cccuuuacacguucca

SEQ ID NO: 3611018 - RNA, 19 nt, Salmonella enterica enterica serovar Typhi
cccuuucaaaaaagagaag

SEQ ID NO: 3611019 - RNA, 15 nt, Salmonella enterica enterica serovar Typhi
cccuuuccuuauuaa

SEQ ID NO: 3611020 - RNA, 19 nt, Salmonella enterica enterica serovar Typhi
cccuuucgguucgccgcgc

SEQ ID NO: 3611021 - RNA, 16 nt, Salmonella enterica enterica serovar Typhi
cccuuuuucaauaagc

SEQ ID NO: 3611022 - RNA, 13 nt, Salmonella enterica enterica serovar Typhi
cccuuuuucaauu

SEQ ID NO: 3611023 - RNA, 20 nt, Salmonella enterica enterica serovar Typhi
ccgaaagccgguaaucgauc

SEQ ID NO: 3611024 - RNA, 17 nt, Salmonella enterica enterica serovar Typhi
ccgaaagcgaccuucuc

SEQ ID NO: 3611025 - RNA, 16 nt, Salmonella enterica enterica serovar Typhi
ccgaaaggaagcgggc

SEQ ID NO: 3611026 - RNA, 21 nt, Salmonella enterica enterica serovar Typhi
ccgaaaugaccaccgcaucgg

SEQ ID NO: 3611027 - RNA, 12 nt, Salmonella enterica enterica serovar Typhi
ccgaacacgcau

SEQ ID NO: 3611028 - RNA, 14 nt, Salmonella enterica enterica serovar Typhi
ccgaacaugccgcc

SEQ ID NO: 3611029 - RNA, 15 nt, Salmonella enterica enterica serovar Typhi
ccgaaggaagauagc

SEQ ID NO: 3611030 - RNA, 15 nt, Salmonella enterica enterica serovar Typhi
ccgaauaacgccagg

SEQ ID NO: 3611031 - RNA, 13 nt, Salmonella enterica enterica serovar Typhi
ccgaaucgccgcu

SEQ ID NO: 3611032 - RNA, 20 nt, Salmonella enterica enterica serovar Typhi
ccgaauuugaaaaaaacauc

SEQ ID NO: 3611033 - RNA, 13 nt, Salmonella enterica enterica serovar Typhi
ccgacaaccccaa

SEQ ID NO: 3611034 - RNA, 19 nt, Salmonella enterica enterica serovar Typhi
ccgacaauauucgccgcga

SEQ ID NO: 3611035 - RNA, 23 nt, Salmonella enterica enterica serovar Typhi
ccgacaauggcgacgaucagcgc

SEQ ID NO: 3611036 - RNA, 22 nt, Salmonella enterica enterica serovar Typhi
ccgacaauuuugauaagagaaa

SEQ ID NO: 3611037 - RNA, 17 nt, Salmonella enterica enterica serovar Typhi
ccgacacaguaaaaaaa

SEQ ID NO: 3611038 - RNA, 12 nt, Salmonella enterica enterica serovar Typhi
ccgaugccgccg

SEQ ID NO: 3611039 - RNA, 21 nt, Salmonella enterica enterica serovar Typhi
ccgaugcucagggcauccgcc

SEQ ID NO: 3611040 - RNA, 17 nt, Salmonella enterica enterica serovar Typhi
ccgauggacucccaggu

SEQ ID NO: 3611041 - RNA, 20 nt, Salmonella enterica enterica serovar Typhi
ccgaugucgccacgccgccc

SEQ ID NO: 3611042 - RNA, 23 nt, Salmonella enterica enterica serovar Typhi
ccgaugucgcuucgcuuaucugg

SEQ ID NO: 3611043 - RNA, 18 nt, Salmonella enterica enterica serovar Typhi
ccgauucugccaguucac

SEQ ID NO: 3611044 - RNA, 19 nt, Salmonella enterica enterica serovar Typhi
ccgauuggcaaaauagugc

SEQ ID NO: 3611045 - RNA, 14 nt, Salmonella enterica enterica serovar Typhi
ccgauuuugaacau

SEQ ID NO: 3611046 - RNA, 12 nt, Salmonella enterica enterica serovar Typhi
ccgauuuuucgg

SEQ ID NO: 3611047 - RNA, 21 nt, Salmonella enterica enterica serovar Typhi
ccgcaaaaccuucauaaauac

SEQ ID NO: 3611048 - RNA, 23 nt, Salmonella enterica enterica serovar Typhi
ccgcaaaaugaggacacaguaau

SEQ ID NO: 3611049 - RNA, 16 nt, Salmonella enterica enterica serovar Typhi
ccgcaaacagagcgcc

SEQ ID NO: 3611050 - RNA, 16 nt, Salmonella enterica enterica serovar Typhi
ccgcaaacagcacgcc

SEQ ID NO: 3611051 - RNA, 22 nt, Salmonella enterica enterica serovar Typhi
ccgcaaacagcacgcccugcca

SEQ ID NO: 3611052 - RNA, 15 nt, Salmonella enterica enterica serovar Typhi
ccgcaaacgccgaag

SEQ ID NO: 3611053 - RNA, 21 nt, Salmonella enterica enterica serovar Typhi
ccgcaaacggaauagcgccuu

SEQ ID NO: 3611054 - RNA, 15 nt, Salmonella enterica enterica serovar Typhi
ccgcaaacuggccac

SEQ ID NO: 3611055 - RNA, 21 nt, Salmonella enterica enterica serovar Typhi
ccgcaaacuggccacagcaaa

SEQ ID NO: 3611056 - RNA, 22 nt, Salmonella enterica enterica serovar Typhi
ccgcaaaguggguauauuugcc

SEQ ID NO: 3611057 - RNA, 20 nt, Salmonella enterica enterica serovar Typhi
ccgcaaauccacuggucguc

SEQ ID NO: 3611058 - RNA, 21 nt, Salmonella enterica enterica serovar Typhi
ccgcaaauucgucgccgccaa

SEQ ID NO: 3611059 - RNA, 17 nt, Salmonella enterica enterica serovar Typhi
ccgcaaccacggcgcag

SEQ ID NO: 3611060 - RNA, 12 nt, Salmonella enterica enterica serovar Typhi
ccgcaacgccag

SEQ ID NO: 3611061 - RNA, 18 nt, Salmonella enterica enterica serovar Typhi
ccgcaacggcuugugagc

SEQ ID NO: 3611062 - RNA, 16 nt, Salmonella enterica enterica serovar Typhi
ccgcaacucucgauau

SEQ ID NO: 3611063 - RNA, 23 nt, Salmonella enterica enterica serovar Typhi
ccgcaagaaacaggcugacaaag

SEQ ID NO: 3611064 - RNA, 22 nt, Salmonella enterica enterica serovar Typhi
ccgcaauaccaauuaccggcuu

SEQ ID NO: 3611065 - RNA, 13 nt, Salmonella enterica enterica serovar Typhi
ccgcaauccccug

SEQ ID NO: 3611066 - RNA, 17 nt, Salmonella enterica enterica serovar Typhi
ccgcaaugaccacaaau

SEQ ID NO: 3611067 - RNA, 18 nt, Salmonella enterica enterica serovar Typhi
ccgcaaugaccacaaauu

SEQ ID NO: 3611068 - RNA, 18 nt, Salmonella enterica enterica serovar Typhi
ccgcaauugguaauuaaa

SEQ ID NO: 3611069 - RNA, 14 nt, Salmonella enterica enterica serovar Typhi
ccgcacaaacgcuu

SEQ ID NO: 3611070 - RNA, 16 nt, Salmonella enterica enterica serovar Typhi
ccgcacacagcagaaa

SEQ ID NO: 3611071 - RNA, 15 nt, Salmonella enterica enterica serovar Typhi
ccgcacagacgucgg

SEQ ID NO: 3611072 - RNA, 23 nt, Salmonella enterica enterica serovar Typhi
ccgcacagacgucggcaccgaau

SEQ ID NO: 3611073 - RNA, 13 nt, Salmonella enterica enterica serovar Typhi
ccgcacagcacau

SEQ ID NO: 3611074 - RNA, 14 nt, Salmonella enterica enterica serovar Typhi
ccgcacauaaucac

SEQ ID NO: 3611075 - RNA, 17 nt, Salmonella enterica enterica serovar Typhi
ccgcaccuggguauucc

SEQ ID NO: 3611076 - RNA, 21 nt, Salmonella enterica enterica serovar Typhi
ccgcaccuggguauuccacug

SEQ ID NO: 3611077 - RNA, 22 nt, Salmonella enterica enterica serovar Typhi
ccgcaccuggguauuccacugg

SEQ ID NO: 3611078 - RNA, 23 nt, Salmonella enterica enterica serovar Typhi
ccgcacgcgaccagacacggugu

SEQ ID NO: 3611079 - RNA, 23 nt, Salmonella enterica enterica serovar Typhi
ccgcacgcgacgcgccagccagc

SEQ ID NO: 3611080 - RNA, 12 nt, Salmonella enterica enterica serovar Typhi
ccgcacgcgcgc

SEQ ID NO: 3611081 - RNA, 15 nt, Salmonella enterica enterica serovar Typhi
ccgcacgcgcgccca

SEQ ID NO: 3611082 - RNA, 16 nt, Salmonella enterica enterica serovar Typhi
ccgcacgguuagccgg

SEQ ID NO: 3611083 - RNA, 20 nt, Salmonella enterica enterica serovar Typhi
ccgcacgguuagccggaaga

SEQ ID NO: 3611084 - RNA, 19 nt, Salmonella enterica enterica serovar Typhi
ccgcagaccggaugauggc

SEQ ID NO: 3611085 - RNA, 19 nt, Salmonella enterica enterica serovar Typhi
ccgcagauccagcacggcc

SEQ ID NO: 3611086 - RNA, 23 nt, Salmonella enterica enterica serovar Typhi
ccgcagcaaucagguauuuccug

SEQ ID NO: 3611087 - RNA, 22 nt, Salmonella enterica enterica serovar Typhi
ccgcagccaacaacaggccgcc

SEQ ID NO: 3611088 - RNA, 12 nt, Salmonella enterica enterica serovar Typhi
ccgcagccagaa

SEQ ID NO: 3611089 - RNA, 14 nt, Salmonella enterica enterica serovar Typhi
ccgcagccagaaca

SEQ ID NO: 3611090 - RNA, 15 nt, Salmonella enterica enterica serovar Typhi
ccgcagccagaauca

SEQ ID NO: 3611091 - RNA, 16 nt, Salmonella enterica enterica serovar Typhi
ccgcagccgacgcauu

SEQ ID NO: 3611092 - RNA, 23 nt, Salmonella enterica enterica serovar Typhi
ccgcagcgccugcgccgcaggaa

SEQ ID NO: 3611093 - RNA, 15 nt, Salmonella enterica enterica serovar Typhi
ccgcagcgcggaagc

SEQ ID NO: 3611094 - RNA, 16 nt, Salmonella enterica enterica serovar Typhi
ccgcagcgcggccugc

SEQ ID NO: 3611095 - RNA, 11 nt, Salmonella enterica enterica serovar Typhi
ccgcaggacag

SEQ ID NO: 3611096 - RNA, 16 nt, Salmonella enterica enterica serovar Typhi
ccgcaggagagccaga

SEQ ID NO: 3611097 - RNA, 18 nt, Salmonella enterica enterica serovar Typhi
ccgcagugaagaauggcg

SEQ ID NO: 3611098 - RNA, 12 nt, Salmonella enterica enterica serovar Typhi
ccgcauacaucg

SEQ ID NO: 3611099 - RNA, 16 nt, Salmonella enterica enterica serovar Typhi
ccgcaucaaacuugcc

SEQ ID NO: 3611100 - RNA, 15 nt, Salmonella enterica enterica serovar Typhi
ccgcaucacggcagc

SEQ ID NO: 3611101 - RNA, 13 nt, Salmonella enterica enterica serovar Typhi
ccgcauccccaua

SEQ ID NO: 3611102 - RNA, 19 nt, Salmonella enterica enterica serovar Typhi
ccgcauccccauagacagu

SEQ ID NO: 3611103 - RNA, 14 nt, Salmonella enterica enterica serovar Typhi
ccgcaucgaccaua

SEQ ID NO: 3611104 - RNA, 15 nt, Salmonella enterica enterica serovar Typhi
ccgcaucgauacccu

SEQ ID NO: 3611105 - RNA, 17 nt, Salmonella enterica enterica serovar Typhi
ccgcaucgcccgcuccc

SEQ ID NO: 3611106 - RNA, 14 nt, Salmonella enterica enterica serovar Typhi
ccgcaucgccgcgg

SEQ ID NO: 3611107 - RNA, 13 nt, Salmonella enterica enterica serovar Typhi
ccgcaucggcauc

SEQ ID NO: 3611108 - RNA, 17 nt, Salmonella enterica enterica serovar Typhi
ccgcaucuucgcccggc

SEQ ID NO: 3611109 - RNA, 15 nt, Salmonella enterica enterica serovar Typhi
ccgcaugugcggcgc

SEQ ID NO: 3611110 - RNA, 16 nt, Salmonella enterica enterica serovar Typhi
ccgcauucuugccgca

SEQ ID NO: 3611111 - RNA, 17 nt, Salmonella enterica enterica serovar Typhi
ccgcauugagcaacccu

SEQ ID NO: 3611112 - RNA, 19 nt, Salmonella enterica enterica serovar Typhi
ccgcauuuaacaggacgcu

SEQ ID NO: 3611113 - RNA, 23 nt, Salmonella enterica enterica serovar Typhi
ccgcauuuaacaggacgcuccau

SEQ ID NO: 3611114 - RNA, 13 nt, Salmonella enterica enterica serovar Typhi
ccgcauuuucagc

SEQ ID NO: 3611115 - RNA, 16 nt, Salmonella enterica enterica serovar Typhi
ccgcauuuuuucuuca

SEQ ID NO: 3611116 - RNA, 20 nt, Salmonella enterica enterica serovar Typhi
ccgccaaaccggcgaauagc

SEQ ID NO: 3611117 - RNA, 24 nt, Salmonella enterica enterica serovar Typhi
ccgccaaacugcgcgccgcccugc

SEQ ID NO: 3611118 - RNA, 22 nt, Salmonella enterica enterica serovar Typhi
ccgccaaagcaaaccaucgucg

SEQ ID NO: 3611119 - RNA, 13 nt, Salmonella enterica enterica serovar Typhi
ccgccaacgccaa

SEQ ID NO: 3611120 - RNA, 15 nt, Salmonella enterica enterica serovar Typhi
ccgccaacgccaaca

SEQ ID NO: 3611121 - RNA, 18 nt, Salmonella enterica enterica serovar Typhi
ccgccaagcgcggacagc

SEQ ID NO: 3611122 - RNA, 13 nt, Salmonella enterica enterica serovar Typhi
ccgccaauaacca

SEQ ID NO: 3611123 - RNA, 16 nt, Salmonella enterica enterica serovar Typhi
ccgccaauaaccaccu

SEQ ID NO: 3611124 - RNA, 14 nt, Salmonella enterica enterica serovar Typhi
ccgccgccgggccg

SEQ ID NO: 3611125 - RNA, 16 nt, Salmonella enterica enterica serovar Typhi
ccgccgccgggccgcc

SEQ ID NO: 3611126 - RNA, 13 nt, Salmonella enterica enterica serovar Typhi
ccgccgcgaaaac

SEQ ID NO: 3611127 - RNA, 15 nt, Salmonella enterica enterica serovar Typhi
ccgccgcgcgucagc

SEQ ID NO: 3611128 - RNA, 14 nt, Salmonella enterica enterica serovar Typhi
ccgccgcggccagc

SEQ ID NO: 3611129 - RNA, 15 nt, Salmonella enterica enterica serovar Typhi
ccgccgcuggcuggc

SEQ ID NO: 3611130 - RNA, 23 nt, Salmonella enterica enterica serovar Typhi
ccgccgcuuuuuucagcggcagc

SEQ ID NO: 3611131 - RNA, 11 nt, Salmonella enterica enterica serovar Typhi
ccgccggaggg

SEQ ID NO: 3611132 - RNA, 15 nt, Salmonella enterica enterica serovar Typhi
ccgccgggcaacacg

SEQ ID NO: 3611133 - RNA, 17 nt, Salmonella enterica enterica serovar Typhi
ccgccgggcgucacccg

SEQ ID NO: 3611134 - RNA, 19 nt, Salmonella enterica enterica serovar Typhi
ccgccgguuuauccccgcu

SEQ ID NO: 3611135 - RNA, 14 nt, Salmonella enterica enterica serovar Typhi
ccgccgucaggcua

SEQ ID NO: 3611136 - RNA, 19 nt, Salmonella enterica enterica serovar Typhi
ccgccgucggcaauaaacu

SEQ ID NO: 3611137 - RNA, 23 nt, Salmonella enterica enterica serovar Typhi
ccgccgucgugccugacguccac

SEQ ID NO: 3611138 - RNA, 14 nt, Salmonella enterica enterica serovar Typhi
ccgccgugauaaau

SEQ ID NO: 3611139 - RNA, 20 nt, Salmonella enterica enterica serovar Typhi
ccgccgugauaaauacgcug

SEQ ID NO: 3611140 - RNA, 15 nt, Salmonella enterica enterica serovar Typhi
ccgccgugcucacua

SEQ ID NO: 3611141 - RNA, 16 nt, Salmonella enterica enterica serovar Typhi
ccgccuaacagcgccg

SEQ ID NO: 3611142 - RNA, 21 nt, Salmonella enterica enterica serovar Typhi
ccgccuaacagcgccgcgccg

SEQ ID NO: 3611143 - RNA, 15 nt, Salmonella enterica enterica serovar Typhi
ccgccuagcgucccg

SEQ ID NO: 3611144 - RNA, 12 nt, Salmonella enterica enterica serovar Typhi
ccgccucaaacg

SEQ ID NO: 3611145 - RNA, 20 nt, Salmonella enterica enterica serovar Typhi
ccgccucaauugccgccagc

SEQ ID NO: 3611146 - RNA, 12 nt, Salmonella enterica enterica serovar Typhi
ccgccuccagca

SEQ ID NO: 3611147 - RNA, 11 nt, Salmonella enterica enterica serovar Typhi
ccgccuccggg

SEQ ID NO: 3611148 - RNA, 13 nt, Salmonella enterica enterica serovar Typhi
ccgccuccuccgg

SEQ ID NO: 3611149 - RNA, 20 nt, Salmonella enterica enterica serovar Typhi
ccgccucgcgauccgccagc

SEQ ID NO: 3611150 - RNA, 19 nt, Salmonella enterica enterica serovar Typhi
ccgccugauuuaaugaacc

SEQ ID NO: 3611151 - RNA, 22 nt, Salmonella enterica enterica serovar Typhi
ccgccugccagauccaacacau

SEQ ID NO: 3611152 - RNA, 14 nt, Salmonella enterica enterica serovar Typhi
ccgccugccgauac

SEQ ID NO: 3611153 - RNA, 15 nt, Salmonella enterica enterica serovar Typhi
ccgccugccgcgccg

SEQ ID NO: 3611154 - RNA, 18 nt, Salmonella enterica enterica serovar Typhi
ccgccugcgccagcgccg

SEQ ID NO: 3611155 - RNA, 18 nt, Salmonella enterica enterica serovar Typhi
ccgccugcgguaaucgcc

SEQ ID NO: 3611156 - RNA, 19 nt, Salmonella enterica enterica serovar Typhi
ccgccuuaagaauguccau

SEQ ID NO: 3611157 - RNA, 13 nt, Salmonella enterica enterica serovar Typhi
ccgccuuaccgcg

SEQ ID NO: 3611158 - RNA, 17 nt, Salmonella enterica enterica serovar Typhi
ccgccuucagcgcgccc

SEQ ID NO: 3611159 - RNA, 19 nt, Salmonella enterica enterica serovar Typhi
ccgccuugcccguauugaa

SEQ ID NO: 3611160 - RNA, 18 nt, Salmonella enterica enterica serovar Typhi
ccgccuugcggcgccagg

SEQ ID NO: 3611161 - RNA, 18 nt, Salmonella enterica enterica serovar Typhi
ccgccuuuaagcaccgcu

SEQ ID NO: 3611162 - RNA, 17 nt, Salmonella enterica enterica serovar Typhi
ccgccuuugacgccggg

SEQ ID NO: 3611163 - RNA, 17 nt, Salmonella enterica enterica serovar Typhi
ccgcgaaccggaccagc

SEQ ID NO: 3611164 - RNA, 23 nt, Salmonella enterica enterica serovar Typhi
ccgcgacaaaaagcgcgccgaaa

SEQ ID NO: 3611165 - RNA, 16 nt, Salmonella enterica enterica serovar Typhi
ccgcgaccacgcauac

SEQ ID NO: 3611166 - RNA, 16 nt, Salmonella enterica enterica serovar Typhi
ccgcgauacggauagc

SEQ ID NO: 3611167 - RNA, 19 nt, Salmonella enterica enterica serovar Typhi
ccgcgauagaccacgccau

SEQ ID NO: 3611168 - RNA, 23 nt, Salmonella enterica enterica serovar Typhi
ccgcgauagaccacgccaucaac

SEQ ID NO: 3611169 - RNA, 23 nt, Salmonella enterica enterica serovar Typhi
ccgcgauagguugaauaaccaua

SEQ ID NO: 3611170 - RNA, 16 nt, Salmonella enterica enterica serovar Typhi
ccgcgaucgcggcaac

SEQ ID NO: 3611171 - RNA, 21 nt, Salmonella enterica enterica serovar Typhi
ccgcgaugcugcucuccacgc

SEQ ID NO: 3611172 - RNA, 21 nt, Salmonella enterica enterica serovar Typhi
ccgcgauguuugcucgccaua

SEQ ID NO: 3611173 - RNA, 16 nt, Salmonella enterica enterica serovar Typhi
ccgcgcaaagcaauac

SEQ ID NO: 3611174 - RNA, 18 nt, Salmonella enterica enterica serovar Typhi
ccgcgcaauaugcggcgc

SEQ ID NO: 3611175 - RNA, 16 nt, Salmonella enterica enterica serovar Typhi
ccgcgcagaaucacuu

SEQ ID NO: 3611176 - RNA, 21 nt, Salmonella enterica enterica serovar Typhi
ccgcgcagaaucacuucaucc

SEQ ID NO: 3611177 - RNA, 15 nt, Salmonella enterica enterica serovar Typhi
ccgcgcauggccaua

SEQ ID NO: 3611178 - RNA, 14 nt, Salmonella enterica enterica serovar Typhi
ccgcgcauguaacc

SEQ ID NO: 3611179 - RNA, 22 nt, Salmonella enterica enterica serovar Typhi
ccgcgccaaacguggcggcaga

SEQ ID NO: 3611180 - RNA, 14 nt, Salmonella enterica enterica serovar Typhi
ccgcgcccugcgga

SEQ ID NO: 3611181 - RNA, 12 nt, Salmonella enterica enterica serovar Typhi
ccgcgccgucgg

SEQ ID NO: 3611182 - RNA, 15 nt, Salmonella enterica enterica serovar Typhi
ccgcgccuaccagcg

SEQ ID NO: 3611183 - RNA, 17 nt, Salmonella enterica enterica serovar Typhi
ccgcgccuaccagcgcu

SEQ ID NO: 3611184 - RNA, 13 nt, Salmonella enterica enterica serovar Typhi
ccgcgcgaagagg

SEQ ID NO: 3611185 - RNA, 14 nt, Salmonella enterica enterica serovar Typhi
ccgcgcgccgccuc

SEQ ID NO: 3611186 - RNA, 16 nt, Salmonella enterica enterica serovar Typhi
ccgcgcgcgcggcauc

SEQ ID NO: 3611187 - RNA, 16 nt, Salmonella enterica enterica serovar Typhi
ccgcgcggcguucugc

SEQ ID NO: 3611188 - RNA, 18 nt, Salmonella enterica enterica serovar Typhi
ccgcgcuagugccgccag

SEQ ID NO: 3611189 - RNA, 22 nt, Salmonella enterica enterica serovar Typhi
ccgcgcuagugccgccaggcaa

SEQ ID NO: 3611190 - RNA, 14 nt, Salmonella enterica enterica serovar Typhi
ccgcgcucaacaca

SEQ ID NO: 3611191 - RNA, 15 nt, Salmonella enterica enterica serovar Typhi
ccgcgcuccaucaua

SEQ ID NO: 3611192 - RNA, 14 nt, Salmonella enterica enterica serovar Typhi
ccgcgcucuccggc

SEQ ID NO: 3611193 - RNA, 16 nt, Salmonella enterica enterica serovar Typhi
ccgcggacuuauuaac

SEQ ID NO: 3611194 - RNA, 18 nt, Salmonella enterica enterica serovar Typhi
ccgcggagaucgcucccg

SEQ ID NO: 3611195 - RNA, 15 nt, Salmonella enterica enterica serovar Typhi
ccgcggauagacgau

SEQ ID NO: 3611196 - RNA, 19 nt, Salmonella enterica enterica serovar Typhi
ccgcggcauuaauccgugc

SEQ ID NO: 3611197 - RNA, 17 nt, Salmonella enterica enterica serovar Typhi
ccgcggcgaucuccuga

SEQ ID NO: 3611198 - RNA, 21 nt, Salmonella enterica enterica serovar Typhi
ccgcggggaucgguuuauccc

SEQ ID NO: 3611199 - RNA, 23 nt, Salmonella enterica enterica serovar Typhi
ccgcggggaucgguuuauccccg

SEQ ID NO: 3611200 - RNA, 21 nt, Salmonella enterica enterica serovar Typhi
ccgcgguacgaaucgccgcgc

SEQ ID NO: 3611201 - RNA, 14 nt, Salmonella enterica enterica serovar Typhi
ccgcguaaucgcga

SEQ ID NO: 3611202 - RNA, 16 nt, Salmonella enterica enterica serovar Typhi
ccgcguaaucuucgcg

SEQ ID NO: 3611203 - RNA, 22 nt, Salmonella enterica enterica serovar Typhi
ccgcguaaucuucgcggcugcc

SEQ ID NO: 3611204 - RNA, 13 nt, Salmonella enterica enterica serovar Typhi
ccgcguaaugacu

SEQ ID NO: 3611205 - RNA, 19 nt, Salmonella enterica enterica serovar Typhi
ccgcguagcccagcgccgc

SEQ ID NO: 3611206 - RNA, 20 nt, Salmonella enterica enterica serovar Typhi
ccgcguagcccagcgccgca

SEQ ID NO: 3611207 - RNA, 21 nt, Salmonella enterica enterica serovar Typhi
ccgcguagcguuaucuguaau

SEQ ID NO: 3611208 - RNA, 19 nt, Salmonella enterica enterica serovar Typhi
ccgcguaucauugcgcucu

SEQ ID NO: 3611209 - RNA, 17 nt, Salmonella enterica enterica serovar Typhi
ccgcguauugcccucgg

SEQ ID NO: 3611210 - RNA, 20 nt, Salmonella enterica enterica serovar Typhi
ccggaagcgauugucggcgc

SEQ ID NO: 3611211 - RNA, 20 nt, Salmonella enterica enterica serovar Typhi
ccggaauggucgcgccaggg

SEQ ID NO: 3611212 - RNA, 15 nt, Salmonella enterica enterica serovar Typhi
ccggaauuugcuucu

SEQ ID NO: 3611213 - RNA, 14 nt, Salmonella enterica enterica serovar Typhi
ccggacaaggcggu

SEQ ID NO: 3611214 - RNA, 21 nt, Salmonella enterica enterica serovar Typhi
ccggacaaggcgguacgccgc

SEQ ID NO: 3611215 - RNA, 14 nt, Salmonella enterica enterica serovar Typhi
ccggacaucauccc

SEQ ID NO: 3611216 - RNA, 18 nt, Salmonella enterica enterica serovar Typhi
ccggacaucauccccggc

SEQ ID NO: 3611217 - RNA, 11 nt, Salmonella enterica enterica serovar Typhi
ccggaccuaau

SEQ ID NO: 3611218 - RNA, 22 nt, Salmonella enterica enterica serovar Typhi
ccggaccuaauagccagcccca

SEQ ID NO: 3611219 - RNA, 18 nt, Salmonella enterica enterica serovar Typhi
ccggacgaucaauaaaau

SEQ ID NO: 3611220 - RNA, 14 nt, Salmonella enterica enterica serovar Typhi
ccggacgcaccagc

SEQ ID NO: 3611221 - RNA, 14 nt, Salmonella enterica enterica serovar Typhi
ccggacgcccgucc

SEQ ID NO: 3611222 - RNA, 17 nt, Salmonella enterica enterica serovar Typhi
ccggacgccguccaggc

SEQ ID NO: 3611223 - RNA, 15 nt, Salmonella enterica enterica serovar Typhi
ccggagaccggcgaa

SEQ ID NO: 3611224 - RNA, 18 nt, Salmonella enterica enterica serovar Typhi
ccggagagcuugauaaau

SEQ ID NO: 3611225 - RNA, 19 nt, Salmonella enterica enterica serovar Typhi
ccggagaggcguucaugcc

SEQ ID NO: 3611226 - RNA, 22 nt, Salmonella enterica enterica serovar Typhi
ccggagaguucauaacgcacaa

SEQ ID NO: 3611227 - RNA, 17 nt, Salmonella enterica enterica serovar Typhi
ccggagccggucggcgc

SEQ ID NO: 3611228 - RNA, 17 nt, Salmonella enterica enterica serovar Typhi
ccggauaaccgcccgcg

SEQ ID NO: 3611229 - RNA, 19 nt, Salmonella enterica enterica serovar Typhi
ccggauaacgcgcuggaug

SEQ ID NO: 3611230 - RNA, 16 nt, Salmonella enterica enterica serovar Typhi
ccggauaacggcgcga

SEQ ID NO: 3611231 - RNA, 21 nt, Salmonella enterica enterica serovar Typhi
ccggauaagcauuagcgccau

SEQ ID NO: 3611232 - RNA, 20 nt, Salmonella enterica enterica serovar Typhi
ccggauaagcgcagcgccau

SEQ ID NO: 3611233 - RNA, 22 nt, Salmonella enterica enterica serovar Typhi
ccggauaagcgcagcgccauca

SEQ ID NO: 3611234 - RNA, 16 nt, Salmonella enterica enterica serovar Typhi
ccggauaagcggcagc

SEQ ID NO: 3611235 - RNA, 20 nt, Salmonella enterica enterica serovar Typhi
ccggauaagcguagcgccau

SEQ ID NO: 3611236 - RNA, 23 nt, Salmonella enterica enterica serovar Typhi
ccggauaaggcauuucgccgcca

SEQ ID NO: 3611237 - RNA, 21 nt, Salmonella enterica enterica serovar Typhi
ccggauaaggcgcuugcgcca

SEQ ID NO: 3611238 - RNA, 23 nt, Salmonella enterica enterica serovar Typhi
ccggauaaggcgcuugcgccgcc

SEQ ID NO: 3611239 - RNA, 21 nt, Salmonella enterica enterica serovar Typhi
ccggauaaggcgcuugugaua

SEQ ID NO: 3611240 - RNA, 22 nt, Salmonella enterica enterica serovar Typhi
ccggauaaggcggagccgccau

SEQ ID NO: 3611241 - RNA, 21 nt, Salmonella enterica enterica serovar Typhi
ccggauacucgacgcacucca

SEQ ID NO: 3611242 - RNA, 19 nt, Salmonella enterica enterica serovar Typhi
ccggauagcggcuucgcca

SEQ ID NO: 3611243 - RNA, 15 nt, Salmonella enterica enterica serovar Typhi
ccggaucaccggcau

SEQ ID NO: 3611244 - RNA, 12 nt, Salmonella enterica enterica serovar Typhi
ccggaucgaucc

SEQ ID NO: 3611245 - RNA, 18 nt, Salmonella enterica enterica serovar Typhi
ccggaucgaucccggcaa

SEQ ID NO: 3611246 - RNA, 17 nt, Salmonella enterica enterica serovar Typhi
ccggaucggucuggcgc

SEQ ID NO: 3611247 - RNA, 19 nt, Salmonella enterica enterica serovar Typhi
ccggaucggucuggcgcau

SEQ ID NO: 3611248 - RNA, 18 nt, Salmonella enterica enterica serovar Typhi
ccggaugacgcuucgcuu

SEQ ID NO: 3611249 - RNA, 22 nt, Salmonella enterica enterica serovar Typhi
ccggaugaggacauaaacgccu

SEQ ID NO: 3611250 - RNA, 16 nt, Salmonella enterica enterica serovar Typhi
ccggaugcaccaucuc

SEQ ID NO: 3611251 - RNA, 14 nt, Salmonella enterica enterica serovar Typhi
ccggaugcagucug

SEQ ID NO: 3611252 - RNA, 16 nt, Salmonella enterica enterica serovar Typhi
ccggaugcgccucauc

SEQ ID NO: 3611253 - RNA, 14 nt, Salmonella enterica enterica serovar Typhi
ccggauggcacugc

SEQ ID NO: 3611254 - RNA, 22 nt, Salmonella enterica enterica serovar Typhi
ccggauggcaguacagggcgau

SEQ ID NO: 3611255 - RNA, 18 nt, Salmonella enterica enterica serovar Typhi
ccggauggcgcugcgcuu

SEQ ID NO: 3611256 - RNA, 21 nt, Salmonella enterica enterica serovar Typhi
ccggauggcgguauaacugcc

SEQ ID NO: 3611257 - RNA, 23 nt, Salmonella enterica enterica serovar Typhi
ccggauggggcauuagccgccau

SEQ ID NO: 3611258 - RNA, 22 nt, Salmonella enterica enterica serovar Typhi
ccggauuaaggcguuugcgccg

SEQ ID NO: 3611259 - RNA, 15 nt, Salmonella enterica enterica serovar Typhi
ccggauugcccgcgg

SEQ ID NO: 3611260 - RNA, 15 nt, Salmonella enterica enterica serovar Typhi
ccggcaaaaaucagc

SEQ ID NO: 3611261 - RNA, 20 nt, Salmonella enterica enterica serovar Typhi
ccggcaaacccuuaacuggc

SEQ ID NO: 3611262 - RNA, 17 nt, Salmonella enterica enterica serovar Typhi
ccggcaaaccuaccggc

SEQ ID NO: 3611263 - RNA, 19 nt, Salmonella enterica enterica serovar Typhi
ccggcaaaccuaccggcau

SEQ ID NO: 3611264 - RNA, 17 nt, Salmonella enterica enterica serovar Typhi
ccggcaaacucagcggc

SEQ ID NO: 3611265 - RNA, 18 nt, Salmonella enterica enterica serovar Typhi
ccggcaaagaagcuuaca

SEQ ID NO: 3611266 - RNA, 23 nt, Salmonella enterica enterica serovar Typhi
ccggcaaaggaauuacgggcgau

SEQ ID NO: 3611267 - RNA, 13 nt, Salmonella enterica enterica serovar Typhi
ccggcaagcgcug

SEQ ID NO: 3611268 - RNA, 22 nt, Salmonella enterica enterica serovar Typhi
ccggcaauauuacggaaacggu

SEQ ID NO: 3611269 - RNA, 20 nt, Salmonella enterica enterica serovar Typhi
ccggcaaugauaucggccgg

SEQ ID NO: 3611270 - RNA, 16 nt, Salmonella enterica enterica serovar Typhi
ccggcacaaccuggcu

SEQ ID NO: 3611271 - RNA, 14 nt, Salmonella enterica enterica serovar Typhi
ccggcacacagaau

SEQ ID NO: 3611272 - RNA, 20 nt, Salmonella enterica enterica serovar Typhi
ccggcacaccggccauugcc

SEQ ID NO: 3611273 - RNA, 23 nt, Salmonella enterica enterica serovar Typhi
ccggcacauauuccggcgcuggc

SEQ ID NO: 3611274 - RNA, 16 nt, Salmonella enterica enterica serovar Typhi
ccggcacauccagcug

SEQ ID NO: 3611275 - RNA, 14 nt, Salmonella enterica enterica serovar Typhi
ccggcacgcgcagc

SEQ ID NO: 3611276 - RNA, 18 nt, Salmonella enterica enterica serovar Typhi
ccggcagacggcugggcu

SEQ ID NO: 3611277 - RNA, 23 nt, Salmonella enterica enterica serovar Typhi
ccggcagggucguacuaaagagc

SEQ ID NO: 3611278 - RNA, 19 nt, Salmonella enterica enterica serovar Typhi
ccggcagguagucauauuc

SEQ ID NO: 3611279 - RNA, 19 nt, Salmonella enterica enterica serovar Typhi
ccggcaucacaaaccagac

SEQ ID NO: 3611280 - RNA, 15 nt, Salmonella enterica enterica serovar Typhi
ccggcaucacgccgg

SEQ ID NO: 3611281 - RNA, 21 nt, Salmonella enterica enterica serovar Typhi
ccggcaucauucugcaggcgg

SEQ ID NO: 3611282 - RNA, 21 nt, Salmonella enterica enterica serovar Typhi
ccggcauuaugcaggcgucgg

SEQ ID NO: 3611283 - RNA, 17 nt, Salmonella enterica enterica serovar Typhi
ccggcauugaaacgcau

SEQ ID NO: 3611284 - RNA, 19 nt, Salmonella enterica enterica serovar Typhi
ccggcauuucaccgucaau

SEQ ID NO: 3611285 - RNA, 13 nt, Salmonella enterica enterica serovar Typhi
ccggcauuucacu

SEQ ID NO: 3611286 - RNA, 14 nt, Salmonella enterica enterica serovar Typhi
ccggccagcgccag

SEQ ID NO: 3611287 - RNA, 15 nt, Salmonella enterica enterica serovar Typhi
ccggccagcgccagc

SEQ ID NO: 3611288 - RNA, 22 nt, Salmonella enterica enterica serovar Typhi
ccggccauagcgugaggucauu

SEQ ID NO: 3611289 - RNA, 15 nt, Salmonella enterica enterica serovar Typhi
ccggcccccggccau

SEQ ID NO: 3611290 - RNA, 15 nt, Salmonella enterica enterica serovar Typhi
ccggccugacgcagc

SEQ ID NO: 3611291 - RNA, 13 nt, Salmonella enterica enterica serovar Typhi
ccggccugcaaac

SEQ ID NO: 3611292 - RNA, 15 nt, Salmonella enterica enterica serovar Typhi
ccggccuggcgcagc

SEQ ID NO: 3611293 - RNA, 19 nt, Salmonella enterica enterica serovar Typhi
ccggcgaaaccgauuuccu

SEQ ID NO: 3611294 - RNA, 15 nt, Salmonella enterica enterica serovar Typhi
ccggcgaaagcggac

SEQ ID NO: 3611295 - RNA, 14 nt, Salmonella enterica enterica serovar Typhi
ccggggaagcgcgc

SEQ ID NO: 3611296 - RNA, 16 nt, Salmonella enterica enterica serovar Typhi
ccggggaagcgcgcgc

SEQ ID NO: 3611297 - RNA, 18 nt, Salmonella enterica enterica serovar Typhi
ccggggaucguucugcug

SEQ ID NO: 3611298 - RNA, 13 nt, Salmonella enterica enterica serovar Typhi
ccggggcgcuggc

SEQ ID NO: 3611299 - RNA, 17 nt, Salmonella enterica enterica serovar Typhi
ccggggcuggcggcgau

SEQ ID NO: 3611300 - RNA, 19 nt, Salmonella enterica enterica serovar Typhi
ccggggugcagaacaucaa

SEQ ID NO: 3611301 - RNA, 20 nt, Salmonella enterica enterica serovar Typhi
ccgggguucgaauccccgcc

SEQ ID NO: 3611302 - RNA, 17 nt, Salmonella enterica enterica serovar Typhi
ccggguaaacgcagcgu

SEQ ID NO: 3611303 - RNA, 14 nt, Salmonella enterica enterica serovar Typhi
ccggguaauaaguu

SEQ ID NO: 3611304 - RNA, 21 nt, Salmonella enterica enterica serovar Typhi
ccggguaaugcugcagggccg

SEQ ID NO: 3611305 - RNA, 13 nt, Salmonella enterica enterica serovar Typhi
ccggguaggacau

SEQ ID NO: 3611306 - RNA, 23 nt, Salmonella enterica enterica serovar Typhi
ccggguaggacauagccgccacc

SEQ ID NO: 3611307 - RNA, 18 nt, Salmonella enterica enterica serovar Typhi
ccggguaucugggcggca

SEQ ID NO: 3611308 - RNA, 21 nt, Salmonella enterica enterica serovar Typhi
ccggguauuucugaaaaaccg

SEQ ID NO: 3611309 - RNA, 18 nt, Salmonella enterica enterica serovar Typhi
ccgggugcaaauccaucu

SEQ ID NO: 3611310 - RNA, 15 nt, Salmonella enterica enterica serovar Typhi
ccggguggcgcugug

SEQ ID NO: 3611311 - RNA, 14 nt, Salmonella enterica enterica serovar Typhi
ccggguuaaaucgc

SEQ ID NO: 3611312 - RNA, 15 nt, Salmonella enterica enterica serovar Typhi
ccggguucagcgaca

SEQ ID NO: 3611313 - RNA, 13 nt, Salmonella enterica enterica serovar Typhi
ccggguucugcgg

SEQ ID NO: 3611314 - RNA, 20 nt, Salmonella enterica enterica serovar Typhi
ccgguaaauccacaaccggc

SEQ ID NO: 3611315 - RNA, 15 nt, Salmonella enterica enterica serovar Typhi
ccgguaacguaaaua

SEQ ID NO: 3611316 - RNA, 20 nt, Salmonella enterica enterica serovar Typhi
ccgguaacguaaauacccag

SEQ ID NO: 3611317 - RNA, 22 nt, Salmonella enterica enterica serovar Typhi
ccgguaauaauuagcauccagc

SEQ ID NO: 3611318 - RNA, 19 nt, Salmonella enterica enterica serovar Typhi
ccgguacaccaacuaccaa

SEQ ID NO: 3611319 - RNA, 17 nt, Salmonella enterica enterica serovar Typhi
ccgguagcauccgcgau

SEQ ID NO: 3611320 - RNA, 15 nt, Salmonella enterica enterica serovar Typhi
ccgguagccagccaa

SEQ ID NO: 3611321 - RNA, 13 nt, Salmonella enterica enterica serovar Typhi
ccgguagcguggu

SEQ ID NO: 3611322 - RNA, 21 nt, Salmonella enterica enterica serovar Typhi
ccgguagguuaaauagcaggc

SEQ ID NO: 3611323 - RNA, 15 nt, Salmonella enterica enterica serovar Typhi
ccgguauagcgccuu

SEQ ID NO: 3611324 - RNA, 13 nt, Salmonella enterica enterica serovar Typhi
ccgguauccagcg

SEQ ID NO: 3611325 - RNA, 20 nt, Salmonella enterica enterica serovar Typhi
ccgguauccgcauucuaaau

SEQ ID NO: 3611326 - RNA, 18 nt, Salmonella enterica enterica serovar Typhi
ccgguauuuuucaccuca

SEQ ID NO: 3611327 - RNA, 14 nt, Salmonella enterica enterica serovar Typhi
ccgguauuuuuucu

SEQ ID NO: 3611328 - RNA, 14 nt, Salmonella enterica enterica serovar Typhi
ccggucaagcgcaa

SEQ ID NO: 3611329 - RNA, 15 nt, Salmonella enterica enterica serovar Typhi
ccggucagucccagc

SEQ ID NO: 3611330 - RNA, 22 nt, Salmonella enterica enterica serovar Typhi
ccggucaucgcggaaagcaaug

SEQ ID NO: 3611331 - RNA, 15 nt, Salmonella enterica enterica serovar Typhi
ccgguccgguggcgc

SEQ ID NO: 3611332 - RNA, 14 nt, Salmonella enterica enterica serovar Typhi
ccggucgcgccagc

SEQ ID NO: 3611333 - RNA, 15 nt, Salmonella enterica enterica serovar Typhi
ccggucggcgcguca

SEQ ID NO: 3611334 - RNA, 15 nt, Salmonella enterica enterica serovar Typhi
ccggucugcgcgccg

SEQ ID NO: 3611335 - RNA, 19 nt, Salmonella enterica enterica serovar Typhi
ccggugacaugaaaauaug

SEQ ID NO: 3611336 - RNA, 14 nt, Salmonella enterica enterica serovar Typhi
ccggugagcgccgc

SEQ ID NO: 3611337 - RNA, 20 nt, Salmonella enterica enterica serovar Typhi
ccggugauggugcagccccg

SEQ ID NO: 3611338 - RNA, 20 nt, Salmonella enterica enterica serovar Typhi
ccggugcagaccucugcaaa

SEQ ID NO: 3611339 - RNA, 19 nt, Salmonella enterica enterica serovar Typhi
ccggugccauuccagccgg

SEQ ID NO: 3611340 - RNA, 19 nt, Salmonella enterica enterica serovar Typhi
ccggugcgagaaaaagcaa

SEQ ID NO: 3611341 - RNA, 18 nt, Salmonella enterica enterica serovar Typhi
ccggugcgauucagcgca

SEQ ID NO: 3611342 - RNA, 13 nt, Salmonella enterica enterica serovar Typhi
ccggugcgcccca

SEQ ID NO: 3611343 - RNA, 14 nt, Salmonella enterica enterica serovar Typhi
ccggugcgccccag

SEQ ID NO: 3611344 - RNA, 16 nt, Salmonella enterica enterica serovar Typhi
ccggugcggagcaggc

SEQ ID NO: 3611345 - RNA, 14 nt, Salmonella enterica enterica serovar Typhi
ccgguggcgcuguc

SEQ ID NO: 3611346 - RNA, 15 nt, Salmonella enterica enterica serovar Typhi
ccgguguaaaaaaug

SEQ ID NO: 3611347 - RNA, 17 nt, Salmonella enterica enterica serovar Typhi
ccggugucaaagcgcca

SEQ ID NO: 3611348 - RNA, 22 nt, Salmonella enterica enterica serovar Typhi
ccgguuagcucaacgcaucgcu

SEQ ID NO: 3611349 - RNA, 16 nt, Salmonella enterica enterica serovar Typhi
ccgguuauaccgccau

SEQ ID NO: 3611350 - RNA, 19 nt, Salmonella enterica enterica serovar Typhi
ccgguuauaccgccauccg

SEQ ID NO: 3611351 - RNA, 13 nt, Salmonella enterica enterica serovar Typhi
ccgguucacccac

SEQ ID NO: 3611352 - RNA, 22 nt, Salmonella enterica enterica serovar Typhi
ccgguucggacgguaccugaag

SEQ ID NO: 3611353 - RNA, 12 nt, Salmonella enterica enterica serovar Typhi
ccgguugcgcug

SEQ ID NO: 3611354 - RNA, 12 nt, Salmonella enterica enterica serovar Typhi
ccgguugcugau

SEQ ID NO: 3611355 - RNA, 22 nt, Salmonella enterica enterica serovar Typhi
ccgguugcugauaacgugcgcg

SEQ ID NO: 3611356 - RNA, 12 nt, Salmonella enterica enterica serovar Typhi
ccgguuuauccc

SEQ ID NO: 3611357 - RNA, 14 nt, Salmonella enterica enterica serovar Typhi
ccgguuuauccccg

SEQ ID NO: 3611358 - RNA, 17 nt, Salmonella enterica enterica serovar Typhi
ccgguuucaauccaugu

SEQ ID NO: 3611359 - RNA, 20 nt, Salmonella enterica enterica serovar Typhi
ccgguuugggcgcgaaacug

SEQ ID NO: 3611360 - RNA, 16 nt, Salmonella enterica enterica serovar Typhi
ccgguuuuugcgcgcu

SEQ ID NO: 3611361 - RNA, 14 nt, Salmonella enterica enterica serovar Typhi
ccguaaaaugcugg

SEQ ID NO: 3611362 - RNA, 18 nt, Salmonella enterica enterica serovar Typhi
ccguaaacgccugcacca

SEQ ID NO: 3611363 - RNA, 14 nt, Salmonella enterica enterica serovar Typhi
ccguaaauuccuug

SEQ ID NO: 3611364 - RNA, 20 nt, Salmonella enterica enterica serovar Typhi
ccguaaggcgauucaacagg

SEQ ID NO: 3611365 - RNA, 14 nt, Salmonella enterica enterica serovar Typhi
ccguaauagcaaua

SEQ ID NO: 3611366 - RNA, 21 nt, Salmonella enterica enterica serovar Typhi
ccguaccgcggcgcugcagau

SEQ ID NO: 3611367 - RNA, 18 nt, Salmonella enterica enterica serovar Typhi
ccguacguauuaucccgc

SEQ ID NO: 3611368 - RNA, 14 nt, Salmonella enterica enterica serovar Typhi
ccguacucagaucg

SEQ ID NO: 3611369 - RNA, 21 nt, Salmonella enterica enterica serovar Typhi
ccguagauaagcgccacgucg

SEQ ID NO: 3611370 - RNA, 16 nt, Salmonella enterica enterica serovar Typhi
ccguagcucagcugga

SEQ ID NO: 3611371 - RNA, 16 nt, Salmonella enterica enterica serovar Typhi
ccguagcuccagaccu

SEQ ID NO: 3611372 - RNA, 16 nt, Salmonella enterica enterica serovar Typhi
ccguagcugcgcgccg

SEQ ID NO: 3611373 - RNA, 19 nt, Salmonella enterica enterica serovar Typhi
ccguaggccugauaagacg

SEQ ID NO: 3611374 - RNA, 14 nt, Salmonella enterica enterica serovar Typhi
ccguauccagaccc

SEQ ID NO: 3611375 - RNA, 15 nt, Salmonella enterica enterica serovar Typhi
ccguauccgccacca

SEQ ID NO: 3611376 - RNA, 17 nt, Salmonella enterica enterica serovar Typhi
ccguauccgccaccaug

SEQ ID NO: 3611377 - RNA, 19 nt, Salmonella enterica enterica serovar Typhi
ccguauccgccaccaugau

SEQ ID NO: 3611378 - RNA, 19 nt, Salmonella enterica enterica serovar Typhi
ccguaugacguggccagca

SEQ ID NO: 3611379 - RNA, 14 nt, Salmonella enterica enterica serovar Typhi
ccguauugccagau

SEQ ID NO: 3611380 - RNA, 18 nt, Salmonella enterica enterica serovar Typhi
ccguauuuuauuuuucaa

SEQ ID NO: 3611381 - RNA, 13 nt, Salmonella enterica enterica serovar Typhi
ccguucgcgguaa

SEQ ID NO: 3611382 - RNA, 17 nt, Salmonella enterica enterica serovar Typhi
ccguucugaccugcgca

SEQ ID NO: 3611383 - RNA, 16 nt, Salmonella enterica enterica serovar Typhi
ccguucuuccugggga

SEQ ID NO: 3611384 - RNA, 17 nt, Salmonella enterica enterica serovar Typhi
ccguuggcuuuaugcac

SEQ ID NO: 3611385 - RNA, 20 nt, Salmonella enterica enterica serovar Typhi
ccguugucacaggcuuggca

SEQ ID NO: 3611386 - RNA, 21 nt, Salmonella enterica enterica serovar Typhi
ccguugucuucaccuugcugc

SEQ ID NO: 3611387 - RNA, 16 nt, Salmonella enterica enterica serovar Typhi
ccguuguugcaccacc

SEQ ID NO: 3611388 - RNA, 17 nt, Salmonella enterica enterica serovar Typhi
ccguuguugucaauauc

SEQ ID NO: 3611389 - RNA, 17 nt, Salmonella enterica enterica serovar Typhi
ccguuuaaaagcggaua

SEQ ID NO: 3611390 - RNA, 14 nt, Salmonella enterica enterica serovar Typhi
ccguuucagaaaga

SEQ ID NO: 3611391 - RNA, 21 nt, Salmonella enterica enterica serovar Typhi
ccguuucagaaagagauuaga

SEQ ID NO: 3611392 - RNA, 15 nt, Salmonella enterica enterica serovar Typhi
ccguuugcagccaga

SEQ ID NO: 3611393 - RNA, 20 nt, Salmonella enterica enterica serovar Typhi
ccguuugcgccagcccggcg

SEQ ID NO: 3611394 - RNA, 17 nt, Salmonella enterica enterica serovar Typhi
ccguuuuagguucuuca

SEQ ID NO: 3611395 - RNA, 16 nt, Salmonella enterica enterica serovar Typhi
ccguuuuggcagcgcc

SEQ ID NO: 3611396 - RNA, 16 nt, Salmonella enterica enterica serovar Typhi
ccguuuuuaauuugcu

SEQ ID NO: 3611397 - RNA, 23 nt, Salmonella enterica enterica serovar Typhi
ccguuuuuuccagcgccgccaga

SEQ ID NO: 3611398 - RNA, 23 nt, Salmonella enterica enterica serovar Typhi
ccuaaaccaaacaccagaucauu

SEQ ID NO: 3611399 - RNA, 22 nt, Salmonella enterica enterica serovar Typhi
ccuaaaucugccaucagcaccu

SEQ ID NO: 3611400 - RNA, 15 nt, Salmonella enterica enterica serovar Typhi
ccuaacuggaaaaag

SEQ ID NO: 3611401 - RNA, 18 nt, Salmonella enterica enterica serovar Typhi
ccuaacuggaaaaagacc

SEQ ID NO: 3611402 - RNA, 21 nt, Salmonella enterica enterica serovar Typhi
ccuaaggucacgccggaaauc

SEQ ID NO: 3611403 - RNA, 15 nt, Salmonella enterica enterica serovar Typhi
ccuaauaaaauaacu

SEQ ID NO: 3611404 - RNA, 12 nt, Salmonella enterica enterica serovar Typhi
ccuaauuuuuaa

SEQ ID NO: 3611405 - RNA, 17 nt, Salmonella enterica enterica serovar Typhi
ccuacacaaaaucauuc

SEQ ID NO: 3611406 - RNA, 18 nt, Salmonella enterica enterica serovar Typhi
ccuacacaaaaucauucg

SEQ ID NO: 3611407 - RNA, 18 nt, Salmonella enterica enterica serovar Typhi
ccuacacauugagcgaga

SEQ ID NO: 3611408 - RNA, 18 nt, Salmonella enterica enterica serovar Typhi
ccuacagguugucgcaac

SEQ ID NO: 3611409 - RNA, 14 nt, Salmonella enterica enterica serovar Typhi
ccuaccaucgcgcg

SEQ ID NO: 3611410 - RNA, 13 nt, Salmonella enterica enterica serovar Typhi
ccuaccgaggcag

SEQ ID NO: 3611411 - RNA, 11 nt, Salmonella enterica enterica serovar Typhi
ccuaccgccau

SEQ ID NO: 3611412 - RNA, 18 nt, Salmonella enterica enterica serovar Typhi
ccuaccggcggcacccgu

SEQ ID NO: 3611413 - RNA, 15 nt, Salmonella enterica enterica serovar Typhi
ccuaccugccgccau

SEQ ID NO: 3611414 - RNA, 20 nt, Salmonella enterica enterica serovar Typhi
ccuacgcaggcuaacgcgcc

SEQ ID NO: 3611415 - RNA, 16 nt, Salmonella enterica enterica serovar Typhi
ccuacgcgcucacggc

SEQ ID NO: 3611416 - RNA, 13 nt, Salmonella enterica enterica serovar Typhi
ccuacgcuauccg

SEQ ID NO: 3611417 - RNA, 22 nt, Salmonella enterica enterica serovar Typhi
ccuacgcuuaccgggccugugu

SEQ ID NO: 3611418 - RNA, 18 nt, Salmonella enterica enterica serovar Typhi
ccuacucucgcaugggga

SEQ ID NO: 3611419 - RNA, 21 nt, Salmonella enterica enterica serovar Typhi
ccuacuguggugugccugcgu

SEQ ID NO: 3611420 - RNA, 16 nt, Salmonella enterica enterica serovar Typhi
ccuagcgucccggcaa

SEQ ID NO: 3611421 - RNA, 21 nt, Salmonella enterica enterica serovar Typhi
ccuagcgucccggcaauacug

SEQ ID NO: 3611422 - RNA, 16 nt, Salmonella enterica enterica serovar Typhi
ccuauaagcugccucu

SEQ ID NO: 3611423 - RNA, 14 nt, Salmonella enterica enterica serovar Typhi
ccuauaaugcgcca

SEQ ID NO: 3611424 - RNA, 17 nt, Salmonella enterica enterica serovar Typhi
ccuauauuaguguuaua

SEQ ID NO: 3611425 - RNA, 23 nt, Salmonella enterica enterica serovar Typhi
ccuaucaggaucaaaaucgcgcc

SEQ ID NO: 3611426 - RNA, 14 nt, Salmonella enterica enterica serovar Typhi
ccuauuaggcacua

SEQ ID NO: 3611427 - RNA, 23 nt, Salmonella enterica enterica serovar Typhi
ccuauuucaguacagccaaaaau

SEQ ID NO: 3611428 - RNA, 21 nt, Salmonella enterica enterica serovar Typhi
ccuauuugcuugugacggcaa

SEQ ID NO: 3611429 - RNA, 19 nt, Salmonella enterica enterica serovar Typhi
ccuauuuuaaauucccagc

SEQ ID NO: 3611430 - RNA, 15 nt, Salmonella enterica enterica serovar Typhi
ccuauuuuacaaaau

SEQ ID NO: 3611431 - RNA, 16 nt, Salmonella enterica enterica serovar Typhi
ccucaaaaccgggcag

SEQ ID NO: 3611432 - RNA, 14 nt, Salmonella enterica enterica serovar Typhi
ccucaaacaggcug

SEQ ID NO: 3611433 - RNA, 16 nt, Salmonella enterica enterica serovar Typhi
ccucaaacaggcuguc

SEQ ID NO: 3611434 - RNA, 22 nt, Salmonella enterica enterica serovar Typhi
ccucaacaaguccuucuucccc

SEQ ID NO: 3611435 - RNA, 17 nt, Salmonella enterica enterica serovar Typhi
ccucaacaucucuucgu

SEQ ID NO: 3611436 - RNA, 16 nt, Salmonella enterica enterica serovar Typhi
ccucaacgcccugcuc

SEQ ID NO: 3611437 - RNA, 23 nt, Salmonella enterica enterica serovar Typhi
ccucaacgcccugcucccacagc

SEQ ID NO: 3611438 - RNA, 17 nt, Salmonella enterica enterica serovar Typhi
ccucaagaauaucuuua

SEQ ID NO: 3611439 - RNA, 15 nt, Salmonella enterica enterica serovar Typhi
ccucacaaacggcau

SEQ ID NO: 3611440 - RNA, 16 nt, Salmonella enterica enterica serovar Typhi
ccucaccguccgccag

SEQ ID NO: 3611441 - RNA, 17 nt, Salmonella enterica enterica serovar Typhi
ccucaccucccccgccc

SEQ ID NO: 3611442 - RNA, 18 nt, Salmonella enterica enterica serovar Typhi
ccucacgcaaccagguca

SEQ ID NO: 3611443 - RNA, 22 nt, Salmonella enterica enterica serovar Typhi
ccucacgcuuaucgccaaacca

SEQ ID NO: 3611444 - RNA, 11 nt, Salmonella enterica enterica serovar Typhi
ccucacuccag

SEQ ID NO: 3611445 - RNA, 13 nt, Salmonella enterica enterica serovar Typhi
ccucacugccgac

SEQ ID NO: 3611446 - RNA, 18 nt, Salmonella enterica enterica serovar Typhi
ccucacugcguaaaaucg

SEQ ID NO: 3611447 - RNA, 17 nt, Salmonella enterica enterica serovar Typhi
ccucacuggagacggau

SEQ ID NO: 3611448 - RNA, 12 nt, Salmonella enterica enterica serovar Typhi
ccucagaauccg

SEQ ID NO: 3611449 - RNA, 17 nt, Salmonella enterica enterica serovar Typhi
ccucagcaaaaucacgc

SEQ ID NO: 3611450 - RNA, 20 nt, Salmonella enterica enterica serovar Typhi
ccucagguaaauccgccagu

SEQ ID NO: 3611451 - RNA, 19 nt, Salmonella enterica enterica serovar Typhi
ccucauacagcccgcgcag

SEQ ID NO: 3611452 - RNA, 13 nt, Salmonella enterica enterica serovar Typhi
ccucauauuugua

SEQ ID NO: 3611453 - RNA, 14 nt, Salmonella enterica enterica serovar Typhi
ccucauauuuguau

SEQ ID NO: 3611454 - RNA, 22 nt, Salmonella enterica enterica serovar Typhi
ccucauccccagcaucaugucc

SEQ ID NO: 3611455 - RNA, 18 nt, Salmonella enterica enterica serovar Typhi
ccucaucccggcuuaaau

SEQ ID NO: 3611456 - RNA, 22 nt, Salmonella enterica enterica serovar Typhi
ccucauccgcauagcgcaacgc

SEQ ID NO: 3611457 - RNA, 16 nt, Salmonella enterica enterica serovar Typhi
ccucaucgggacggcg

SEQ ID NO: 3611458 - RNA, 16 nt, Salmonella enterica enterica serovar Typhi
ccucaucugcuucaac

SEQ ID NO: 3611459 - RNA, 16 nt, Salmonella enterica enterica serovar Typhi
ccucauuaguucaagu

SEQ ID NO: 3611460 - RNA, 14 nt, Salmonella enterica enterica serovar Typhi
ccucauucagcggc

SEQ ID NO: 3611461 - RNA, 20 nt, Salmonella enterica enterica serovar Typhi
ccucauucagcggcugcgcc

SEQ ID NO: 3611462 - RNA, 16 nt, Salmonella enterica enterica serovar Typhi
ccucauuuuguugcuc

SEQ ID NO: 3611463 - RNA, 22 nt, Salmonella enterica enterica serovar Typhi
ccuccacgcccagcgccgagaa

SEQ ID NO: 3611464 - RNA, 14 nt, Salmonella enterica enterica serovar Typhi
ccuccagacuggcg

SEQ ID NO: 3611465 - RNA, 20 nt, Salmonella enterica enterica serovar Typhi
ccuccagccauaaugcaauc

SEQ ID NO: 3611466 - RNA, 14 nt, Salmonella enterica enterica serovar Typhi
ccuccauccaggua

SEQ ID NO: 3611467 - RNA, 15 nt, Salmonella enterica enterica serovar Typhi
ccugaaucgccgcac

SEQ ID NO: 3611468 - RNA, 19 nt, Salmonella enterica enterica serovar Typhi
ccugaaucgccgcacguaa

SEQ ID NO: 3611469 - RNA, 14 nt, Salmonella enterica enterica serovar Typhi
ccugacaauacugc

SEQ ID NO: 3611470 - RNA, 14 nt, Salmonella enterica enterica serovar Typhi
ccugacagaaauag

SEQ ID NO: 3611471 - RNA, 22 nt, Salmonella enterica enterica serovar Typhi
ccugacagagcucgucaaaaau

SEQ ID NO: 3611472 - RNA, 20 nt, Salmonella enterica enterica serovar Typhi
ccugacagcgcgcgaauauc

SEQ ID NO: 3611473 - RNA, 24 nt, Salmonella enterica enterica serovar Typhi
ccugaccaguuguuccgcgcugau

SEQ ID NO: 3611474 - RNA, 20 nt, Salmonella enterica enterica serovar Typhi
ccugaccgguaaauuucacu

SEQ ID NO: 3611475 - RNA, 15 nt, Salmonella enterica enterica serovar Typhi
ccugacgaauagcgc

SEQ ID NO: 3611476 - RNA, 18 nt, Salmonella enterica enterica serovar Typhi
ccugacgauaucgucacc

SEQ ID NO: 3611477 - RNA, 20 nt, Salmonella enterica enterica serovar Typhi
ccugacgccgcuguuuucac

SEQ ID NO: 3611478 - RNA, 19 nt, Salmonella enterica enterica serovar Typhi
ccugacgcugcgccuggau

SEQ ID NO: 3611479 - RNA, 13 nt, Salmonella enterica enterica serovar Typhi
ccugacggcagcc

SEQ ID NO: 3611480 - RNA, 21 nt, Salmonella enterica enterica serovar Typhi
ccugacuauugcugagcugac

SEQ ID NO: 3611481 - RNA, 20 nt, Salmonella enterica enterica serovar Typhi
ccugacugcgcgccugcgcu

SEQ ID NO: 3611482 - RNA, 19 nt, Salmonella enterica enterica serovar Typhi
ccugacuggcugagcucac

SEQ ID NO: 3611483 - RNA, 22 nt, Salmonella enterica enterica serovar Typhi
ccugacuguucacgcagcgcau

SEQ ID NO: 3611484 - RNA, 14 nt, Salmonella enterica enterica serovar Typhi
ccugagcccacagc

SEQ ID NO: 3611485 - RNA, 15 nt, Salmonella enterica enterica serovar Typhi
ccugagcccacagcg

SEQ ID NO: 3611486 - RNA, 18 nt, Salmonella enterica enterica serovar Typhi
ccugagcgcgaacuacac

SEQ ID NO: 3611487 - RNA, 19 nt, Salmonella enterica enterica serovar Typhi
ccugagcgcgcagcugggc

SEQ ID NO: 3611488 - RNA, 18 nt, Salmonella enterica enterica serovar Typhi
ccugaggaaaaagcgcac

SEQ ID NO: 3611489 - RNA, 20 nt, Salmonella enterica enterica serovar Typhi
ccugauaaacguagcgucau

SEQ ID NO: 3611490 - RNA, 20 nt, Salmonella enterica enterica serovar Typhi
ccugauaaccuauuuugcaa

SEQ ID NO: 3611491 - RNA, 19 nt, Salmonella enterica enterica serovar Typhi
ccugauaagcacaggccau

SEQ ID NO: 3611492 - RNA, 20 nt, Salmonella enterica enterica serovar Typhi
ccugauaagcgcagcgccau

SEQ ID NO: 3611493 - RNA, 19 nt, Salmonella enterica enterica serovar Typhi
ccugauaagcguagcgcca

SEQ ID NO: 3611494 - RNA, 20 nt, Salmonella enterica enterica serovar Typhi
ccugauaagcguagcgccau

SEQ ID NO: 3611495 - RNA, 22 nt, Salmonella enterica enterica serovar Typhi
ccugauaagguaaagccgccau

SEQ ID NO: 3611496 - RNA, 13 nt, Salmonella enterica enterica serovar Typhi
ccugauagcgcug

SEQ ID NO: 3611497 - RNA, 15 nt, Salmonella enterica enterica serovar Typhi
ccugauagcgcugug

SEQ ID NO: 3611498 - RNA, 15 nt, Salmonella enterica enterica serovar Typhi
ccugaucaaggcgca

SEQ ID NO: 3611499 - RNA, 12 nt, Salmonella enterica enterica serovar Typhi
ccugauccagcu

SEQ ID NO: 3611500 - RNA, 19 nt, Salmonella enterica enterica serovar Typhi
ccugauccagcucuucuuc

SEQ ID NO: 3611501 - RNA, 12 nt, Salmonella enterica enterica serovar Typhi
ccugaucgccaa

SEQ ID NO: 3611502 - RNA, 21 nt, Salmonella enterica enterica serovar Typhi
ccugaucgcgcagacaguggc

SEQ ID NO: 3611503 - RNA, 15 nt, Salmonella enterica enterica serovar Typhi
ccugaucggccagcg

SEQ ID NO: 3611504 - RNA, 21 nt, Salmonella enterica enterica serovar Typhi
ccugaucgugccaugaccauu

SEQ ID NO: 3611505 - RNA, 20 nt, Salmonella enterica enterica serovar Typhi
ccugaugacggcugguaagg

SEQ ID NO: 3611506 - RNA, 16 nt, Salmonella enterica enterica serovar Typhi
ccugaugauagcgcca

SEQ ID NO: 3611507 - RNA, 20 nt, Salmonella enterica enterica serovar Typhi
ccugaugauggaaaacgcgc

SEQ ID NO: 3611508 - RNA, 17 nt, Salmonella enterica enterica serovar Typhi
ccugaugcccauacggc

SEQ ID NO: 3611509 - RNA, 24 nt, Salmonella enterica enterica serovar Typhi
ccugaugcgcguuuagcgccagca

SEQ ID NO: 3611510 - RNA, 19 nt, Salmonella enterica enterica serovar Typhi
ccugaugcugcgcauccgc

SEQ ID NO: 3611511 - RNA, 12 nt, Salmonella enterica enterica serovar Typhi
ccugauggcgcg

SEQ ID NO: 3611512 - RNA, 17 nt, Salmonella enterica enterica serovar Typhi
ccugauggcgcugcgcu

SEQ ID NO: 3611513 - RNA, 21 nt, Salmonella enterica enterica serovar Typhi
ccugauggucgcucuggucga

SEQ ID NO: 3611514 - RNA, 17 nt, Salmonella enterica enterica serovar Typhi
ccugaugguuauuuuca

SEQ ID NO: 3611515 - RNA, 15 nt, Salmonella enterica enterica serovar Typhi
ccugaugugcuuuuu

SEQ ID NO: 3611516 - RNA, 20 nt, Salmonella enterica enterica serovar Typhi
ccugauugauacgcgcccga

SEQ ID NO: 3611517 - RNA, 21 nt, Salmonella enterica enterica serovar Typhi
ccugcaaaauaccgcccaucg

SEQ ID NO: 3611518 - RNA, 14 nt, Salmonella enterica enterica serovar Typhi
ccugcaaaccucuc

SEQ ID NO: 3611519 - RNA, 20 nt, Salmonella enterica enterica serovar Typhi
ccugcaaaccucucccccgc

SEQ ID NO: 3611520 - RNA, 21 nt, Salmonella enterica enterica serovar Typhi
ccugcaaacuauguacgccaa

SEQ ID NO: 3611521 - RNA, 22 nt, Salmonella enterica enterica serovar Typhi
ccugcaaagcaaaaaucaccac

SEQ ID NO: 3611522 - RNA, 14 nt, Salmonella enterica enterica serovar Typhi
ccugcaaauagcgc

SEQ ID NO: 3611523 - RNA, 15 nt, Salmonella enterica enterica serovar Typhi
ccugcaacagcacca

SEQ ID NO: 3611524 - RNA, 17 nt, Salmonella enterica enterica serovar Typhi
ccugcaacagcaccagc

SEQ ID NO: 3611525 - RNA, 20 nt, Salmonella enterica enterica serovar Typhi
ccugcaacgcuuuagugccg

SEQ ID NO: 3611526 - RNA, 20 nt, Salmonella enterica enterica serovar Typhi
ccugcaacucaaaauaacgc

SEQ ID NO: 3611527 - RNA, 22 nt, Salmonella enterica enterica serovar Typhi
ccugcaacuccugggcaaaaua

SEQ ID NO: 3611528 - RNA, 12 nt, Salmonella enterica enterica serovar Typhi
ccugcaauuccg

SEQ ID NO: 3611529 - RNA, 23 nt, Salmonella enterica enterica serovar Typhi
ccugcaauuccggcgaaaaaccg

SEQ ID NO: 3611530 - RNA, 16 nt, Salmonella enterica enterica serovar Typhi
ccugcacguuacccgc

SEQ ID NO: 3611531 - RNA, 23 nt, Salmonella enterica enterica serovar Typhi
ccugcacguuacccgccagucgg

SEQ ID NO: 3611532 - RNA, 14 nt, Salmonella enterica enterica serovar Typhi
ccugcagcgccaga

SEQ ID NO: 3611533 - RNA, 12 nt, Salmonella enterica enterica serovar Typhi
ccugcagggaau

SEQ ID NO: 3611534 - RNA, 22 nt, Salmonella enterica enterica serovar Typhi
ccugcagggaauaagcgcccau

SEQ ID NO: 3611535 - RNA, 23 nt, Salmonella enterica enterica serovar Typhi
ccugcauauauccuaacuuauua

SEQ ID NO: 3611536 - RNA, 16 nt, Salmonella enterica enterica serovar Typhi
ccugcauauuuuucau

SEQ ID NO: 3611537 - RNA, 14 nt, Salmonella enterica enterica serovar Typhi
ccugcaucaacagg

SEQ ID NO: 3611538 - RNA, 12 nt, Salmonella enterica enterica serovar Typhi
ccugcaucacgc

SEQ ID NO: 3611539 - RNA, 20 nt, Salmonella enterica enterica serovar Typhi
ccugcaucacgcccggcggu

SEQ ID NO: 3611540 - RNA, 19 nt, Salmonella enterica enterica serovar Typhi
ccugcaucgauuccccacc

SEQ ID NO: 3611541 - RNA, 18 nt, Salmonella enterica enterica serovar Typhi
ccugcauguacauaaaau

SEQ ID NO: 3611542 - RNA, 20 nt, Salmonella enterica enterica serovar Typhi
ccugcauuaacggcaacagu

SEQ ID NO: 3611543 - RNA, 14 nt, Salmonella enterica enterica serovar Typhi
ccugcauuauccac

SEQ ID NO: 3611544 - RNA, 15 nt, Salmonella enterica enterica serovar Typhi
ccugcauugccugau

SEQ ID NO: 3611545 - RNA, 22 nt, Salmonella enterica enterica serovar Typhi
ccugccacaacggcaauuuuua

SEQ ID NO: 3611546 - RNA, 21 nt, Salmonella enterica enterica serovar Typhi
ccugccagcaacccaccugcc

SEQ ID NO: 3611547 - RNA, 13 nt, Salmonella enterica enterica serovar Typhi
ccugccagccgcu

SEQ ID NO: 3611548 - RNA, 18 nt, Salmonella enterica enterica serovar Typhi
ccugccaggauccguuca

SEQ ID NO: 3611549 - RNA, 13 nt, Salmonella enterica enterica serovar Typhi
ccugccaguccgc

SEQ ID NO: 3611550 - RNA, 18 nt, Salmonella enterica enterica serovar Typhi
ccugccauagcaucacca

SEQ ID NO: 3611551 - RNA, 21 nt, Salmonella enterica enterica serovar Typhi
ccugccauucacgcuggguga

SEQ ID NO: 3611552 - RNA, 20 nt, Salmonella enterica enterica serovar Typhi
ccuggcagaaaggugaaaaa

SEQ ID NO: 3611553 - RNA, 21 nt, Salmonella enterica enterica serovar Typhi
ccuggcagguauuaauccugc

SEQ ID NO: 3611554 - RNA, 15 nt, Salmonella enterica enterica serovar Typhi
ccuggcagugaucca

SEQ ID NO: 3611555 - RNA, 13 nt, Salmonella enterica enterica serovar Typhi
ccuggcauggcuc

SEQ ID NO: 3611556 - RNA, 22 nt, Salmonella enterica enterica serovar Typhi
ccuggcauggugcagccgccau

SEQ ID NO: 3611557 - RNA, 15 nt, Salmonella enterica enterica serovar Typhi
ccuggccaauggcuc

SEQ ID NO: 3611558 - RNA, 19 nt, Salmonella enterica enterica serovar Typhi
ccuggcccggcaguugcug

SEQ ID NO: 3611559 - RNA, 18 nt, Salmonella enterica enterica serovar Typhi
ccuggccgauaugaauaa

SEQ ID NO: 3611560 - RNA, 22 nt, Salmonella enterica enterica serovar Typhi
ccuggcgaauaaaauucagcgc

SEQ ID NO: 3611561 - RNA, 16 nt, Salmonella enterica enterica serovar Typhi
ccuggcgagaauagaa

SEQ ID NO: 3611562 - RNA, 14 nt, Salmonella enterica enterica serovar Typhi
ccuggcgcagcgcg

SEQ ID NO: 3611563 - RNA, 17 nt, Salmonella enterica enterica serovar Typhi
ccuggcggagcugcgcu

SEQ ID NO: 3611564 - RNA, 19 nt, Salmonella enterica enterica serovar Typhi
ccuggcgguaagccaccag

SEQ ID NO: 3611565 - RNA, 21 nt, Salmonella enterica enterica serovar Typhi
ccuggcguaguacgcgcgccg

SEQ ID NO: 3611566 - RNA, 16 nt, Salmonella enterica enterica serovar Typhi
ccuggcguaugcuuuc

SEQ ID NO: 3611567 - RNA, 20 nt, Salmonella enterica enterica serovar Typhi
ccuggcguaugcuuucagca

SEQ ID NO: 3611568 - RNA, 21 nt, Salmonella enterica enterica serovar Typhi
ccuggcgugcgauuugcucaa

SEQ ID NO: 3611569 - RNA, 20 nt, Salmonella enterica enterica serovar Typhi
ccuggcgugucaucaaaauc

SEQ ID NO: 3611570 - RNA, 13 nt, Salmonella enterica enterica serovar Typhi
ccuggcguuauca

SEQ ID NO: 3611571 - RNA, 15 nt, Salmonella enterica enterica serovar Typhi
ccuggcucaauccag

SEQ ID NO: 3611572 - RNA, 13 nt, Salmonella enterica enterica serovar Typhi
ccuggcucuuccg

SEQ ID NO: 3611573 - RNA, 20 nt, Salmonella enterica enterica serovar Typhi
ccuggcugagaaaaauacgc

SEQ ID NO: 3611574 - RNA, 14 nt, Salmonella enterica enterica serovar Typhi
ccuggcuuaccugc

SEQ ID NO: 3611575 - RNA, 19 nt, Salmonella enterica enterica serovar Typhi
ccuggcuuaccugcucugg

SEQ ID NO: 3611576 - RNA, 14 nt, Salmonella enterica enterica serovar Typhi
ccuggcuucaaccu

SEQ ID NO: 3611577 - RNA, 19 nt, Salmonella enterica enterica serovar Typhi
ccuggcuucaaccuccugc

SEQ ID NO: 3611578 - RNA, 16 nt, Salmonella enterica enterica serovar Typhi
ccuggcuugccggcac

SEQ ID NO: 3611579 - RNA, 15 nt, Salmonella enterica enterica serovar Typhi
ccugggaaucgugca

SEQ ID NO: 3611580 - RNA, 13 nt, Salmonella enterica enterica serovar Typhi
ccugggcgaaaac

SEQ ID NO: 3611581 - RNA, 19 nt, Salmonella enterica enterica serovar Typhi
ccugggcgaaaacgcccgc

SEQ ID NO: 3611582 - RNA, 18 nt, Salmonella enterica enterica serovar Typhi
ccugggucguugacguga

SEQ ID NO: 3611583 - RNA, 22 nt, Salmonella enterica enterica serovar Typhi
ccugggucguugacgugagaga

SEQ ID NO: 3611584 - RNA, 15 nt, Salmonella enterica enterica serovar Typhi
ccugguaagcgcaau

SEQ ID NO: 3611585 - RNA, 20 nt, Salmonella enterica enterica serovar Typhi
ccugguaaggcaaauaugcu

SEQ ID NO: 3611586 - RNA, 17 nt, Salmonella enterica enterica serovar Typhi
ccugguccucugauaag

SEQ ID NO: 3611587 - RNA, 17 nt, Salmonella enterica enterica serovar Typhi
ccuggucgauagccuua

SEQ ID NO: 3611588 - RNA, 18 nt, Salmonella enterica enterica serovar Typhi
ccuggucuauucguucuc

SEQ ID NO: 3611589 - RNA, 20 nt, Salmonella enterica enterica serovar Typhi
ccuggucuauucguucucug

SEQ ID NO: 3611590 - RNA, 13 nt, Salmonella enterica enterica serovar Typhi
ccuggucugccag

SEQ ID NO: 3611591 - RNA, 18 nt, Salmonella enterica enterica serovar Typhi
ccuggugagguuucagca

SEQ ID NO: 3611592 - RNA, 19 nt, Salmonella enterica enterica serovar Typhi
ccuggugcgacaccacgca

SEQ ID NO: 3611593 - RNA, 13 nt, Salmonella enterica enterica serovar Typhi
ccugguuaacaau

SEQ ID NO: 3611594 - RNA, 12 nt, Salmonella enterica enterica serovar Typhi
ccugguuaccgc

SEQ ID NO: 3611595 - RNA, 20 nt, Salmonella enterica enterica serovar Typhi
ccugguuauuagaugcgaau

SEQ ID NO: 3611596 - RNA, 15 nt, Salmonella enterica enterica serovar Typhi
ccugguugacccgca

SEQ ID NO: 3611597 - RNA, 17 nt, Salmonella enterica enterica serovar Typhi
ccugguuuguccaaggc

SEQ ID NO: 3611598 - RNA, 14 nt, Salmonella enterica enterica serovar Typhi
ccuguaaaccgccu

SEQ ID NO: 3611599 - RNA, 19 nt, Salmonella enterica enterica serovar Typhi
ccuguaaacgcuucugcgc

SEQ ID NO: 3611600 - RNA, 15 nt, Salmonella enterica enterica serovar Typhi
ccuguaaccccagca

SEQ ID NO: 3611601 - RNA, 21 nt, Salmonella enterica enterica serovar Typhi
ccuguaaccccagcaucugca

SEQ ID NO: 3611602 - RNA, 16 nt, Salmonella enterica enterica serovar Typhi
ccuguaaccuuaaaag

SEQ ID NO: 3611603 - RNA, 18 nt, Salmonella enterica enterica serovar Typhi
ccuguaaccuuaaaaggc

SEQ ID NO: 3611604 - RNA, 19 nt, Salmonella enterica enterica serovar Typhi
ccuguaaugucuggugcag

SEQ ID NO: 3611605 - RNA, 14 nt, Salmonella enterica enterica serovar Typhi
ccuguaccaccacg

SEQ ID NO: 3611606 - RNA, 15 nt, Salmonella enterica enterica serovar Typhi
ccuguaccaccacgc

SEQ ID NO: 3611607 - RNA, 17 nt, Salmonella enterica enterica serovar Typhi
ccuguaccgggcagaca

SEQ ID NO: 3611608 - RNA, 17 nt, Salmonella enterica enterica serovar Typhi
ccuguacuugcgccgcc

SEQ ID NO: 3611609 - RNA, 16 nt, Salmonella enterica enterica serovar Typhi
ccuguagcagcgccag

SEQ ID NO: 3611610 - RNA, 21 nt, Salmonella enterica enterica serovar Typhi
ccuguagggcacugggcgaua

SEQ ID NO: 3611611 - RNA, 19 nt, Salmonella enterica enterica serovar Typhi
ccuguauacaggcauggcc

SEQ ID NO: 3611612 - RNA, 15 nt, Salmonella enterica enterica serovar Typhi
ccugucaggcgagcg

SEQ ID NO: 3611613 - RNA, 17 nt, Salmonella enterica enterica serovar Typhi
ccugucaguacgucgca

SEQ ID NO: 3611614 - RNA, 15 nt, Salmonella enterica enterica serovar Typhi
ccuguccauugcgag

SEQ ID NO: 3611615 - RNA, 18 nt, Salmonella enterica enterica serovar Typhi
ccugucccuucgcccggc

SEQ ID NO: 3611616 - RNA, 16 nt, Salmonella enterica enterica serovar Typhi
ccugucgaucauccac

SEQ ID NO: 3611617 - RNA, 23 nt, Salmonella enterica enterica serovar Typhi
ccugucgcgccauguugcguaaa

SEQ ID NO: 3611618 - RNA, 18 nt, Salmonella enterica enterica serovar Typhi
ccugucggucuuuuucgc

SEQ ID NO: 3611619 - RNA, 16 nt, Salmonella enterica enterica serovar Typhi
ccugucguacgccuaa

SEQ ID NO: 3611620 - RNA, 16 nt, Salmonella enterica enterica serovar Typhi
ccugucguccucaggc

SEQ ID NO: 3611621 - RNA, 21 nt, Salmonella enterica enterica serovar Typhi
ccugucguccucaggccggau

SEQ ID NO: 3611622 - RNA, 14 nt, Salmonella enterica enterica serovar Typhi
ccugucuccagcgc

SEQ ID NO: 3611623 - RNA, 22 nt, Salmonella enterica enterica serovar Typhi
ccugucugucaaaacccagccc

SEQ ID NO: 3611624 - RNA, 23 nt, Salmonella enterica enterica serovar Typhi
ccugucugucaaaacccagccca

SEQ ID NO: 3611625 - RNA, 18 nt, Salmonella enterica enterica serovar Typhi
ccugugcaaccagcucuu

SEQ ID NO: 3611626 - RNA, 13 nt, Salmonella enterica enterica serovar Typhi
ccugugccauacu

SEQ ID NO: 3611627 - RNA, 15 nt, Salmonella enterica enterica serovar Typhi
ccugugccauacugu

SEQ ID NO: 3611628 - RNA, 14 nt, Salmonella enterica enterica serovar Typhi
ccugugcuuugauu

SEQ ID NO: 3611629 - RNA, 20 nt, Salmonella enterica enterica serovar Typhi
ccuguggcuguugguuuauu

SEQ ID NO: 3611630 - RNA, 18 nt, Salmonella enterica enterica serovar Typhi
ccuguguaaugaaagaaa

SEQ ID NO: 3611631 - RNA, 22 nt, Salmonella enterica enterica serovar Typhi
ccugugucguuucauccugaca

SEQ ID NO: 3611632 - RNA, 20 nt, Salmonella enterica enterica serovar Typhi
ccuguuagggcgcggcuggu

SEQ ID NO: 3611633 - RNA, 16 nt, Salmonella enterica enterica serovar Typhi
ccuguucaaaagccug

SEQ ID NO: 3611634 - RNA, 13 nt, Salmonella enterica enterica serovar Typhi
ccuguucaacaug

SEQ ID NO: 3611635 - RNA, 12 nt, Salmonella enterica enterica serovar Typhi
ccuguucaagug

SEQ ID NO: 3611636 - RNA, 15 nt, Salmonella enterica enterica serovar Typhi
ccuguucaugccaga

SEQ ID NO: 3611637 - RNA, 20 nt, Salmonella enterica enterica serovar Typhi
ccuguuccagggcuuccaga

SEQ ID NO: 3611638 - RNA, 17 nt, Salmonella enterica enterica serovar Typhi
ccuuuacuguugccuuu

SEQ ID NO: 3611639 - RNA, 22 nt, Salmonella enterica enterica serovar Typhi
ccuuuauauuuuucccuggccg

SEQ ID NO: 3611640 - RNA, 14 nt, Salmonella enterica enterica serovar Typhi
ccuuuaucugcccu

SEQ ID NO: 3611641 - RNA, 22 nt, Salmonella enterica enterica serovar Typhi
ccuuuauuucaagcaauaccgg

SEQ ID NO: 3611642 - RNA, 19 nt, Salmonella enterica enterica serovar Typhi
ccuuucaacggauugugaa

SEQ ID NO: 3611643 - RNA, 23 nt, Salmonella enterica enterica serovar Typhi
ccuuucagagcgucuuuuauccc

SEQ ID NO: 3611644 - RNA, 15 nt, Salmonella enterica enterica serovar Typhi
ccuuucggacuuccu

SEQ ID NO: 3611645 - RNA, 21 nt, Salmonella enterica enterica serovar Typhi
ccuuucguaguuggcaacccg

SEQ ID NO: 3611646 - RNA, 19 nt, Salmonella enterica enterica serovar Typhi
ccuuucgugcacuucaugc

SEQ ID NO: 3611647 - RNA, 21 nt, Salmonella enterica enterica serovar Typhi
ccuuucucugguuucccugcc

SEQ ID NO: 3611648 - RNA, 14 nt, Salmonella enterica enterica serovar Typhi
ccuuucugcgccag

SEQ ID NO: 3611649 - RNA, 16 nt, Salmonella enterica enterica serovar Typhi
ccuuucuuauuuuuuu

SEQ ID NO: 3611650 - RNA, 22 nt, Salmonella enterica enterica serovar Typhi
ccuuugaaaaucacaucgccgg

SEQ ID NO: 3611651 - RNA, 16 nt, Salmonella enterica enterica serovar Typhi
ccuuugccgguuuuug

SEQ ID NO: 3611652 - RNA, 15 nt, Salmonella enterica enterica serovar Typhi
ccuuugccuucgccg

SEQ ID NO: 3611653 - RNA, 14 nt, Salmonella enterica enterica serovar Typhi
ccuuuggccaccag

SEQ ID NO: 3611654 - RNA, 21 nt, Salmonella enterica enterica serovar Typhi
ccuuugucacccgcuuuuccu

SEQ ID NO: 3611655 - RNA, 13 nt, Salmonella enterica enterica serovar Typhi
ccuuugucaucca

SEQ ID NO: 3611656 - RNA, 18 nt, Salmonella enterica enterica serovar Typhi
ccuuugugaucugguuug

SEQ ID NO: 3611657 - RNA, 15 nt, Salmonella enterica enterica serovar Typhi
ccuuuuaagguuaca

SEQ ID NO: 3611658 - RNA, 16 nt, Salmonella enterica enterica serovar Typhi
ccuuuucguacauguc

SEQ ID NO: 3611659 - RNA, 13 nt, Salmonella enterica enterica serovar Typhi
ccuuuugcagaau

SEQ ID NO: 3611660 - RNA, 19 nt, Salmonella enterica enterica serovar Typhi
ccuuuuuauggcccgccag

SEQ ID NO: 3611661 - RNA, 20 nt, Salmonella enterica enterica serovar Typhi
ccuuuuuauggcccgccagc

SEQ ID NO: 3611662 - RNA, 13 nt, Salmonella enterica enterica serovar Typhi
ccuuuuucaauuu

SEQ ID NO: 3611663 - RNA, 19 nt, Salmonella enterica enterica serovar Typhi
ccuuuuucauccucaacca

SEQ ID NO: 3611664 - RNA, 22 nt, Salmonella enterica enterica serovar Typhi
ccuuuuugauccguuucagaaa

SEQ ID NO: 3611665 - RNA, 15 nt, Salmonella enterica enterica serovar Typhi
ccuuuuugcagcgcg

SEQ ID NO: 3611666 - RNA, 20 nt, Salmonella enterica enterica serovar Typhi
ccuuuuuuauacuccagcag

SEQ ID NO: 3611667 - RNA, 17 nt, Salmonella enterica enterica serovar Typhi
ccuuuuuuauugccuga

SEQ ID NO: 3611668 - RNA, 20 nt, Salmonella enterica enterica serovar Typhi
ccuuuuuugguuauccagca

SEQ ID NO: 3611669 - RNA, 13 nt, Salmonella enterica enterica serovar Typhi
ccuuuuuuguauu

SEQ ID NO: 3611670 - RNA, 13 nt, Salmonella enterica enterica serovar Typhi
cgaaaaaagaugg

SEQ ID NO: 3611671 - RNA, 16 nt, Salmonella enterica enterica serovar Typhi
cgaaaaacccgcuuca

SEQ ID NO: 3611672 - RNA, 16 nt, Salmonella enterica enterica serovar Typhi
cgaaaaggccuggcug

SEQ ID NO: 3611673 - RNA, 12 nt, Salmonella enterica enterica serovar Typhi
cgaaaauacgcg

SEQ ID NO: 3611674 - RNA, 15 nt, Salmonella enterica enterica serovar Typhi
cgaaaauaucggccu

SEQ ID NO: 3611675 - RNA, 13 nt, Salmonella enterica enterica serovar Typhi
cgaaaaucgguaa

SEQ ID NO: 3611676 - RNA, 22 nt, Salmonella enterica enterica serovar Typhi
cgaaacaaccgucgauuuuaau

SEQ ID NO: 3611677 - RNA, 14 nt, Salmonella enterica enterica serovar Typhi
cgaaaccacagcgg

SEQ ID NO: 3611678 - RNA, 13 nt, Salmonella enterica enterica serovar Typhi
cgaaaccagcaua

SEQ ID NO: 3611679 - RNA, 20 nt, Salmonella enterica enterica serovar Typhi
cgaaaccggcggcgacuggc

SEQ ID NO: 3611680 - RNA, 15 nt, Salmonella enterica enterica serovar Typhi
cgaaacuccagcgau

SEQ ID NO: 3611681 - RNA, 17 nt, Salmonella enterica enterica serovar Typhi
cgaaagaaacgccgacc

SEQ ID NO: 3611682 - RNA, 15 nt, Salmonella enterica enterica serovar Typhi
cgaaagauaaaaaua

SEQ ID NO: 3611683 - RNA, 17 nt, Salmonella enterica enterica serovar Typhi
cgaaagcgaccuucucc

SEQ ID NO: 3611684 - RNA, 13 nt, Salmonella enterica enterica serovar Typhi
cgaaaggaagcgg

SEQ ID NO: 3611685 - RNA, 13 nt, Salmonella enterica enterica serovar Typhi
cgaaauaaucagg

SEQ ID NO: 3611686 - RNA, 20 nt, Salmonella enterica enterica serovar Typhi
cgaaaucaaagaccuccgcc

SEQ ID NO: 3611687 - RNA, 23 nt, Salmonella enterica enterica serovar Typhi
cgaaaucaaagaccuccgcccgg

SEQ ID NO: 3611688 - RNA, 17 nt, Salmonella enterica enterica serovar Typhi
cgaaauguccauccauu

SEQ ID NO: 3611689 - RNA, 14 nt, Salmonella enterica enterica serovar Typhi
cgaaauugccgccc

SEQ ID NO: 3611690 - RNA, 18 nt, Salmonella enterica enterica serovar Typhi
cgaaauuggaguuaucau

SEQ ID NO: 3611691 - RNA, 12 nt, Salmonella enterica enterica serovar Typhi
cgaaauuuaaua

SEQ ID NO: 3611692 - RNA, 12 nt, Salmonella enterica enterica serovar Typhi
cgaacagccagg

SEQ ID NO: 3611693 - RNA, 11 nt, Salmonella enterica enterica serovar Typhi
cgaacagcgca

SEQ ID NO: 3611694 - RNA, 13 nt, Salmonella enterica enterica serovar Typhi
cgaacagcgcucc

SEQ ID NO: 3611695 - RNA, 17 nt, Salmonella enterica enterica serovar Typhi
cgaacagcgcuccacgc

SEQ ID NO: 3611696 - RNA, 18 nt, Salmonella enterica enterica serovar Typhi
cgaacaggcucagcgcca

SEQ ID NO: 3611697 - RNA, 19 nt, Salmonella enterica enterica serovar Typhi
cgaacaggcucagcgccac

SEQ ID NO: 3611698 - RNA, 19 nt, Salmonella enterica enterica serovar Typhi
cgaacaguguaaacgccag

SEQ ID NO: 3611699 - RNA, 19 nt, Salmonella enterica enterica serovar Typhi
cgaacaguugcagcgccug

SEQ ID NO: 3611700 - RNA, 22 nt, Salmonella enterica enterica serovar Typhi
cgaacauccuugcacgccaaaa

SEQ ID NO: 3611701 - RNA, 20 nt, Salmonella enterica enterica serovar Typhi
cgaacaucugcguugcgcgc

SEQ ID NO: 3611702 - RNA, 22 nt, Salmonella enterica enterica serovar Typhi
cgaacauuacauccucaauguu

SEQ ID NO: 3611703 - RNA, 17 nt, Salmonella enterica enterica serovar Typhi
cgaacauuucagcgcca

SEQ ID NO: 3611704 - RNA, 21 nt, Salmonella enterica enterica serovar Typhi
cgaaccaccguuuaaucgccc

SEQ ID NO: 3611705 - RNA, 21 nt, Salmonella enterica enterica serovar Typhi
cgaaccacggcuucagcggcg

SEQ ID NO: 3611706 - RNA, 20 nt, Salmonella enterica enterica serovar Typhi
cgaaccaucauuaauauaau

SEQ ID NO: 3611707 - RNA, 17 nt, Salmonella enterica enterica serovar Typhi
cgaacccaucagggaaa

SEQ ID NO: 3611708 - RNA, 21 nt, Salmonella enterica enterica serovar Typhi
cgaaccggaccagcacaaaaa

SEQ ID NO: 3611709 - RNA, 18 nt, Salmonella enterica enterica serovar Typhi
cgaaccguaaacgccugc

SEQ ID NO: 3611710 - RNA, 15 nt, Salmonella enterica enterica serovar Typhi
cgaaccguggccucc

SEQ ID NO: 3611711 - RNA, 19 nt, Salmonella enterica enterica serovar Typhi
cgaaccuuaagcgcgaaau

SEQ ID NO: 3611712 - RNA, 19 nt, Salmonella enterica enterica serovar Typhi
cgaacgcccggugaucggu

SEQ ID NO: 3611713 - RNA, 18 nt, Salmonella enterica enterica serovar Typhi
cgaacgccgccugcgcca

SEQ ID NO: 3611714 - RNA, 15 nt, Salmonella enterica enterica serovar Typhi
cgaacgcuccacugc

SEQ ID NO: 3611715 - RNA, 12 nt, Salmonella enterica enterica serovar Typhi
cgaacggccuga

SEQ ID NO: 3611716 - RNA, 18 nt, Salmonella enterica enterica serovar Typhi
cgaacggcuuuccagcag

SEQ ID NO: 3611717 - RNA, 21 nt, Salmonella enterica enterica serovar Typhi
cgaacggcuuuccagcagcca

SEQ ID NO: 3611718 - RNA, 23 nt, Salmonella enterica enterica serovar Typhi
cgaacggcuuuccagcagccaga

SEQ ID NO: 3611719 - RNA, 16 nt, Salmonella enterica enterica serovar Typhi
cgaacguuggcugggu

SEQ ID NO: 3611720 - RNA, 22 nt, Salmonella enterica enterica serovar Typhi
cgaacguuuuuucgcacgccuc

SEQ ID NO: 3611721 - RNA, 23 nt, Salmonella enterica enterica serovar Typhi
cgaacuacugauuccugccagac

SEQ ID NO: 3611722 - RNA, 12 nt, Salmonella enterica enterica serovar Typhi
cgaacuccccga

SEQ ID NO: 3611723 - RNA, 15 nt, Salmonella enterica enterica serovar Typhi
cgaacucuuccacca

SEQ ID NO: 3611724 - RNA, 14 nt, Salmonella enterica enterica serovar Typhi
cgacaccagcgucg

SEQ ID NO: 3611725 - RNA, 16 nt, Salmonella enterica enterica serovar Typhi
cgacaccagcgucgca

SEQ ID NO: 3611726 - RNA, 18 nt, Salmonella enterica enterica serovar Typhi
cgacacccgauacacgcc

SEQ ID NO: 3611727 - RNA, 19 nt, Salmonella enterica enterica serovar Typhi
cgacacccgauacacgccg

SEQ ID NO: 3611728 - RNA, 16 nt, Salmonella enterica enterica serovar Typhi
cgacaccgcaaaccgu

SEQ ID NO: 3611729 - RNA, 21 nt, Salmonella enterica enterica serovar Typhi
cgacacgcgcgcugcgccugg

SEQ ID NO: 3611730 - RNA, 23 nt, Salmonella enterica enterica serovar Typhi
cgacagagucguuagcagaaugg

SEQ ID NO: 3611731 - RNA, 19 nt, Salmonella enterica enterica serovar Typhi
cgacagauuggucagcagc

SEQ ID NO: 3611732 - RNA, 20 nt, Salmonella enterica enterica serovar Typhi
cgacagccagcauuuccagc

SEQ ID NO: 3611733 - RNA, 13 nt, Salmonella enterica enterica serovar Typhi
cgacagcccccau

SEQ ID NO: 3611734 - RNA, 21 nt, Salmonella enterica enterica serovar Typhi
cgacagccgcguuuugccgcu

SEQ ID NO: 3611735 - RNA, 20 nt, Salmonella enterica enterica serovar Typhi
cgacagcgcuauccggccca

SEQ ID NO: 3611736 - RNA, 16 nt, Salmonella enterica enterica serovar Typhi
cgacaggcugccgaca

SEQ ID NO: 3611737 - RNA, 17 nt, Salmonella enterica enterica serovar Typhi
cgacagggcgugaacca

SEQ ID NO: 3611738 - RNA, 21 nt, Salmonella enterica enterica serovar Typhi
cgacaggguuugccagcacca

SEQ ID NO: 3611739 - RNA, 15 nt, Salmonella enterica enterica serovar Typhi
cgacagucgcagagc

SEQ ID NO: 3611740 - RNA, 17 nt, Salmonella enterica enterica serovar Typhi
cgacaguucccggcaac

SEQ ID NO: 3611741 - RNA, 17 nt, Salmonella enterica enterica serovar Typhi
cgacauaaaacccgccu

SEQ ID NO: 3611742 - RNA, 15 nt, Salmonella enterica enterica serovar Typhi
cgacauaaccggcaa

SEQ ID NO: 3611743 - RNA, 12 nt, Salmonella enterica enterica serovar Typhi
cgacauacgcgc

SEQ ID NO: 3611744 - RNA, 12 nt, Salmonella enterica enterica serovar Typhi
cgacaucagaug

SEQ ID NO: 3611745 - RNA, 12 nt, Salmonella enterica enterica serovar Typhi
cgacaucagcca

SEQ ID NO: 3611746 - RNA, 12 nt, Salmonella enterica enterica serovar Typhi
cgacaucgccaa

SEQ ID NO: 3611747 - RNA, 16 nt, Salmonella enterica enterica serovar Typhi
cgacaucgccaaccgc

SEQ ID NO: 3611748 - RNA, 15 nt, Salmonella enterica enterica serovar Typhi
cgacaucgccaccgc

SEQ ID NO: 3611749 - RNA, 12 nt, Salmonella enterica enterica serovar Typhi
cgacaucgccag

SEQ ID NO: 3611750 - RNA, 15 nt, Salmonella enterica enterica serovar Typhi
cgacaucgccugcuu

SEQ ID NO: 3611751 - RNA, 15 nt, Salmonella enterica enterica serovar Typhi
cgacaucucaggcaa

SEQ ID NO: 3611752 - RNA, 17 nt, Salmonella enterica enterica serovar Typhi
cgacaucuuuuccugaa

SEQ ID NO: 3611753 - RNA, 21 nt, Salmonella enterica enterica serovar Typhi
cgacaugcagaucgcgggcaa

SEQ ID NO: 3611754 - RNA, 14 nt, Salmonella enterica enterica serovar Typhi
cgacaugcgcaugu

SEQ ID NO: 3611755 - RNA, 18 nt, Salmonella enterica enterica serovar Typhi
cgacaugcuccugcaucu

SEQ ID NO: 3611756 - RNA, 19 nt, Salmonella enterica enterica serovar Typhi
cgacauggcgguaaucgcg

SEQ ID NO: 3611757 - RNA, 16 nt, Salmonella enterica enterica serovar Typhi
cgacauggcugagaau

SEQ ID NO: 3611758 - RNA, 14 nt, Salmonella enterica enterica serovar Typhi
cgacauuagcgagu

SEQ ID NO: 3611759 - RNA, 23 nt, Salmonella enterica enterica serovar Typhi
cgacauucgauguuacugagcaa

SEQ ID NO: 3611760 - RNA, 19 nt, Salmonella enterica enterica serovar Typhi
cgacauuuuuguuaauauu

SEQ ID NO: 3611761 - RNA, 19 nt, Salmonella enterica enterica serovar Typhi
cgaccaaacaagaucgcag

SEQ ID NO: 3611762 - RNA, 20 nt, Salmonella enterica enterica serovar Typhi
cgaccacauuauagauguca

SEQ ID NO: 3611763 - RNA, 20 nt, Salmonella enterica enterica serovar Typhi
cgaccacccgcgaccagguc

SEQ ID NO: 3611764 - RNA, 15 nt, Salmonella enterica enterica serovar Typhi
cgaccagacacggug

SEQ ID NO: 3611765 - RNA, 16 nt, Salmonella enterica enterica serovar Typhi
cgaccagcagaugcag

SEQ ID NO: 3611766 - RNA, 18 nt, Salmonella enterica enterica serovar Typhi
cgaccagccugccgucuu

SEQ ID NO: 3611767 - RNA, 13 nt, Salmonella enterica enterica serovar Typhi
cgaccagcgcgcc

SEQ ID NO: 3611768 - RNA, 17 nt, Salmonella enterica enterica serovar Typhi
cgaccagcgucagccag

SEQ ID NO: 3611769 - RNA, 13 nt, Salmonella enterica enterica serovar Typhi
cgaccaggaucag

SEQ ID NO: 3611770 - RNA, 15 nt, Salmonella enterica enterica serovar Typhi
cgaccaggaucagac

SEQ ID NO: 3611771 - RNA, 14 nt, Salmonella enterica enterica serovar Typhi
cgaccagugaacgu

SEQ ID NO: 3611772 - RNA, 18 nt, Salmonella enterica enterica serovar Typhi
cgaccaugguucccgcca

SEQ ID NO: 3611773 - RNA, 21 nt, Salmonella enterica enterica serovar Typhi
cgaccauuuuugacacagcgu

SEQ ID NO: 3611774 - RNA, 13 nt, Salmonella enterica enterica serovar Typhi
cgacccacaaugg

SEQ ID NO: 3611775 - RNA, 16 nt, Salmonella enterica enterica serovar Typhi
cgacccgcaucagacc

SEQ ID NO: 3611776 - RNA, 16 nt, Salmonella enterica enterica serovar Typhi
cgacccgcaucgccgc

SEQ ID NO: 3611777 - RNA, 20 nt, Salmonella enterica enterica serovar Typhi
cgacccgcugcgugaaaagg

SEQ ID NO: 3611778 - RNA, 14 nt, Salmonella enterica enterica serovar Typhi
cgaccgacgcguuu

SEQ ID NO: 3611779 - RNA, 15 nt, Salmonella enterica enterica serovar Typhi
cgaccgccagcagag

SEQ ID NO: 3611780 - RNA, 20 nt, Salmonella enterica enterica serovar Typhi
cgaccggcacucaccucuuc

SEQ ID NO: 3611781 - RNA, 13 nt, Salmonella enterica enterica serovar Typhi
cgaccggcagccg

SEQ ID NO: 3611782 - RNA, 18 nt, Salmonella enterica enterica serovar Typhi
cgaccgguccaccggggg

SEQ ID NO: 3611783 - RNA, 15 nt, Salmonella enterica enterica serovar Typhi
cgaccgucagcagca

SEQ ID NO: 3611784 - RNA, 16 nt, Salmonella enterica enterica serovar Typhi
cgaccgugauuuuuac

SEQ ID NO: 3611785 - RNA, 17 nt, Salmonella enterica enterica serovar Typhi
cgaccugcauauuuuuc

SEQ ID NO: 3611786 - RNA, 20 nt, Salmonella enterica enterica serovar Typhi
cgaccuggcgcucaaucaga

SEQ ID NO: 3611787 - RNA, 19 nt, Salmonella enterica enterica serovar Typhi
cgaccuggcggucggcuuu

SEQ ID NO: 3611788 - RNA, 21 nt, Salmonella enterica enterica serovar Typhi
cgaccuguucaaaauugccac

SEQ ID NO: 3611789 - RNA, 14 nt, Salmonella enterica enterica serovar Typhi
cgaccuucacgccg

SEQ ID NO: 3611790 - RNA, 17 nt, Salmonella enterica enterica serovar Typhi
cgaccuucacgccgcca

SEQ ID NO: 3611791 - RNA, 11 nt, Salmonella enterica enterica serovar Typhi
cgaccuucucc

SEQ ID NO: 3611792 - RNA, 22 nt, Salmonella enterica enterica serovar Typhi
cgacgaccggcagcgucagccc

SEQ ID NO: 3611793 - RNA, 15 nt, Salmonella enterica enterica serovar Typhi
cgacgacgccagcca

SEQ ID NO: 3611794 - RNA, 19 nt, Salmonella enterica enterica serovar Typhi
cgacgauaaaaaaaguauc

SEQ ID NO: 3611795 - RNA, 15 nt, Salmonella enterica enterica serovar Typhi
cgacgaucagcgcca

SEQ ID NO: 3611796 - RNA, 19 nt, Salmonella enterica enterica serovar Typhi
cgacgaucagcgccacgca

SEQ ID NO: 3611797 - RNA, 22 nt, Salmonella enterica enterica serovar Typhi
cgacgauugaccggggcgcaau

SEQ ID NO: 3611798 - RNA, 14 nt, Salmonella enterica enterica serovar Typhi
cgacgcacuccaga

SEQ ID NO: 3611799 - RNA, 17 nt, Salmonella enterica enterica serovar Typhi
cgacgcagacaauaaac

SEQ ID NO: 3611800 - RNA, 23 nt, Salmonella enterica enterica serovar Typhi
cgacgcauugagacaugccgcca

SEQ ID NO: 3611801 - RNA, 17 nt, Salmonella enterica enterica serovar Typhi
cgacgcauuucuccuga

SEQ ID NO: 3611802 - RNA, 14 nt, Salmonella enterica enterica serovar Typhi
cgacgccaaaccug

SEQ ID NO: 3611803 - RNA, 14 nt, Salmonella enterica enterica serovar Typhi
cgacgccaaccgcc

SEQ ID NO: 3611804 - RNA, 18 nt, Salmonella enterica enterica serovar Typhi
cgacgccagauagcgucu

SEQ ID NO: 3611805 - RNA, 13 nt, Salmonella enterica enterica serovar Typhi
cgacgccagccag

SEQ ID NO: 3611806 - RNA, 23 nt, Salmonella enterica enterica serovar Typhi
cgacgccagcgggugaucgcuug

SEQ ID NO: 3611807 - RNA, 17 nt, Salmonella enterica enterica serovar Typhi
cgacgccauuccccagc

SEQ ID NO: 3611808 - RNA, 20 nt, Salmonella enterica enterica serovar Typhi
cgacgcccugcccaugaagc

SEQ ID NO: 3611809 - RNA, 16 nt, Salmonella enterica enterica serovar Typhi
cgacgccgauaaagcc

SEQ ID NO: 3611810 - RNA, 14 nt, Salmonella enterica enterica serovar Typhi
cgagcuguaccguc

SEQ ID NO: 3611811 - RNA, 20 nt, Salmonella enterica enterica serovar Typhi
cgagcugucaccgacacgca

SEQ ID NO: 3611812 - RNA, 17 nt, Salmonella enterica enterica serovar Typhi
cgagcuuuucgccggaa

SEQ ID NO: 3611813 - RNA, 14 nt, Salmonella enterica enterica serovar Typhi
cgagcuuuuuucuu

SEQ ID NO: 3611814 - RNA, 23 nt, Salmonella enterica enterica serovar Typhi
cgaggaacaucagccagcagcuc

SEQ ID NO: 3611815 - RNA, 20 nt, Salmonella enterica enterica serovar Typhi
cgaggaacuguucagccagc

SEQ ID NO: 3611816 - RNA, 22 nt, Salmonella enterica enterica serovar Typhi
cgaggaguaguuaaaaaagguc

SEQ ID NO: 3611817 - RNA, 18 nt, Salmonella enterica enterica serovar Typhi
cgaggccacgcagcgcag

SEQ ID NO: 3611818 - RNA, 16 nt, Salmonella enterica enterica serovar Typhi
cgaggcccauagaugg

SEQ ID NO: 3611819 - RNA, 15 nt, Salmonella enterica enterica serovar Typhi
cgaggcgcccaacgc

SEQ ID NO: 3611820 - RNA, 22 nt, Salmonella enterica enterica serovar Typhi
cgaggcuuuguccuuugcuaca

SEQ ID NO: 3611821 - RNA, 20 nt, Salmonella enterica enterica serovar Typhi
cgagggauuuccuggcaguu

SEQ ID NO: 3611822 - RNA, 14 nt, Salmonella enterica enterica serovar Typhi
cgaggggcaggaag

SEQ ID NO: 3611823 - RNA, 14 nt, Salmonella enterica enterica serovar Typhi
cgaggggccaaaac

SEQ ID NO: 3611824 - RNA, 14 nt, Salmonella enterica enterica serovar Typhi
cgagggugggcgca

SEQ ID NO: 3611825 - RNA, 22 nt, Salmonella enterica enterica serovar Typhi
cgaggucagcauuucauccauu

SEQ ID NO: 3611826 - RNA, 17 nt, Salmonella enterica enterica serovar Typhi
cgaggugaauaaauccu

SEQ ID NO: 3611827 - RNA, 22 nt, Salmonella enterica enterica serovar Typhi
cgagguucaccagcgcgccgcc

SEQ ID NO: 3611828 - RNA, 18 nt, Salmonella enterica enterica serovar Typhi
cgagguucccgccgccau

SEQ ID NO: 3611829 - RNA, 23 nt, Salmonella enterica enterica serovar Typhi
cgaguaacaccgcggcgcucgcc

SEQ ID NO: 3611830 - RNA, 18 nt, Salmonella enterica enterica serovar Typhi
cgaguccgaggcgaaacg

SEQ ID NO: 3611831 - RNA, 20 nt, Salmonella enterica enterica serovar Typhi
cgagucgaucgucgggauaa

SEQ ID NO: 3611832 - RNA, 22 nt, Salmonella enterica enterica serovar Typhi
cgagugaggaccguacucagau

SEQ ID NO: 3611833 - RNA, 12 nt, Salmonella enterica enterica serovar Typhi
cgaguucaaguc

SEQ ID NO: 3611834 - RNA, 23 nt, Salmonella enterica enterica serovar Typhi
cgaguuuuaacacuauauguccu

SEQ ID NO: 3611835 - RNA, 20 nt, Salmonella enterica enterica serovar Typhi
cgauaaaaaacgcccagauc

SEQ ID NO: 3611836 - RNA, 19 nt, Salmonella enterica enterica serovar Typhi
cgauaaaaacccaccagcg

SEQ ID NO: 3611837 - RNA, 21 nt, Salmonella enterica enterica serovar Typhi
cgauaaaaacccaccagcgcc

SEQ ID NO: 3611838 - RNA, 23 nt, Salmonella enterica enterica serovar Typhi
cgauaaaaacccaccagcgccag

SEQ ID NO: 3611839 - RNA, 22 nt, Salmonella enterica enterica serovar Typhi
cgauaaacaguuugugccgcca

SEQ ID NO: 3611840 - RNA, 15 nt, Salmonella enterica enterica serovar Typhi
cgauaaaccaggcag

SEQ ID NO: 3611841 - RNA, 17 nt, Salmonella enterica enterica serovar Typhi
cgauaaaccuucguaau

SEQ ID NO: 3611842 - RNA, 17 nt, Salmonella enterica enterica serovar Typhi
cgauaaacucaaucagg

SEQ ID NO: 3611843 - RNA, 19 nt, Salmonella enterica enterica serovar Typhi
cgauaaagcgguuaucggc

SEQ ID NO: 3611844 - RNA, 14 nt, Salmonella enterica enterica serovar Typhi
cgauaaauaagaag

SEQ ID NO: 3611845 - RNA, 14 nt, Salmonella enterica enterica serovar Typhi
cgauaaauacccga

SEQ ID NO: 3611846 - RNA, 20 nt, Salmonella enterica enterica serovar Typhi
cgauaacacggcuggcaaug

SEQ ID NO: 3611847 - RNA, 17 nt, Salmonella enterica enterica serovar Typhi
cgauaaccaccagcgga

SEQ ID NO: 3611848 - RNA, 14 nt, Salmonella enterica enterica serovar Typhi
cgauaaccagcgcg

SEQ ID NO: 3611849 - RNA, 21 nt, Salmonella enterica enterica serovar Typhi
cgauaaccaugcucagcggcg

SEQ ID NO: 3611850 - RNA, 17 nt, Salmonella enterica enterica serovar Typhi
cgauaacccgcgcaugg

SEQ ID NO: 3611851 - RNA, 22 nt, Salmonella enterica enterica serovar Typhi
cgauaaccggacgauuuaagcu

SEQ ID NO: 3611852 - RNA, 18 nt, Salmonella enterica enterica serovar Typhi
cgauaaccucucaccgcc

SEQ ID NO: 3611853 - RNA, 19 nt, Salmonella enterica enterica serovar Typhi
cgauaaccuguaaauaaua

SEQ ID NO: 3611854 - RNA, 14 nt, Salmonella enterica enterica serovar Typhi
cgauaacgcagcgc

SEQ ID NO: 3611855 - RNA, 19 nt, Salmonella enterica enterica serovar Typhi
cgauaacguuaccgcagcg

SEQ ID NO: 3611856 - RNA, 15 nt, Salmonella enterica enterica serovar Typhi
cgauaacucuucauc

SEQ ID NO: 3611857 - RNA, 15 nt, Salmonella enterica enterica serovar Typhi
cgauaagaacuccaa

SEQ ID NO: 3611858 - RNA, 19 nt, Salmonella enterica enterica serovar Typhi
cgauaaggauaucuugaug

SEQ ID NO: 3611859 - RNA, 20 nt, Salmonella enterica enterica serovar Typhi
cgauaaggucgcuauccagc

SEQ ID NO: 3611860 - RNA, 18 nt, Salmonella enterica enterica serovar Typhi
cgauaauacagccugcgu

SEQ ID NO: 3611861 - RNA, 14 nt, Salmonella enterica enterica serovar Typhi
cgauaauacgcgcg

SEQ ID NO: 3611862 - RNA, 21 nt, Salmonella enterica enterica serovar Typhi
cgauaauauccgacgccuguu

SEQ ID NO: 3611863 - RNA, 15 nt, Salmonella enterica enterica serovar Typhi
cgauaaucaccagcc

SEQ ID NO: 3611864 - RNA, 18 nt, Salmonella enterica enterica serovar Typhi
cgauaaucccggcgcgcg

SEQ ID NO: 3611865 - RNA, 21 nt, Salmonella enterica enterica serovar Typhi
cgauaaugaagcauaaaaaga

SEQ ID NO: 3611866 - RNA, 17 nt, Salmonella enterica enterica serovar Typhi
cgauaauugcucaccca

SEQ ID NO: 3611867 - RNA, 13 nt, Salmonella enterica enterica serovar Typhi
cgauacaccuuca

SEQ ID NO: 3611868 - RNA, 15 nt, Salmonella enterica enterica serovar Typhi
cgauacaccuucaca

SEQ ID NO: 3611869 - RNA, 21 nt, Salmonella enterica enterica serovar Typhi
cgauacaggacugacugcugu

SEQ ID NO: 3611870 - RNA, 15 nt, Salmonella enterica enterica serovar Typhi
cgauacccaccagcg

SEQ ID NO: 3611871 - RNA, 19 nt, Salmonella enterica enterica serovar Typhi
cgauacccgcccagaucag

SEQ ID NO: 3611872 - RNA, 22 nt, Salmonella enterica enterica serovar Typhi
cgauacccgcccagaucaggcc

SEQ ID NO: 3611873 - RNA, 17 nt, Salmonella enterica enterica serovar Typhi
cgauacgccccugcugg

SEQ ID NO: 3611874 - RNA, 19 nt, Salmonella enterica enterica serovar Typhi
cgauacgcggaucggcaca

SEQ ID NO: 3611875 - RNA, 14 nt, Salmonella enterica enterica serovar Typhi
cgauacggauagcg

SEQ ID NO: 3611876 - RNA, 21 nt, Salmonella enterica enterica serovar Typhi
cgauacuaaaacuuuaacacu

SEQ ID NO: 3611877 - RNA, 22 nt, Salmonella enterica enterica serovar Typhi
cgauacucacgacuuucaccag

SEQ ID NO: 3611878 - RNA, 22 nt, Salmonella enterica enterica serovar Typhi
cgauacuccauugucggcagcg

SEQ ID NO: 3611879 - RNA, 12 nt, Salmonella enterica enterica serovar Typhi
cgauagacagca

SEQ ID NO: 3611880 - RNA, 13 nt, Salmonella enterica enterica serovar Typhi
cgauagaccacgc

SEQ ID NO: 3611881 - RNA, 19 nt, Salmonella enterica enterica serovar Typhi
cgauagagaccgcuuuagc

SEQ ID NO: 3611882 - RNA, 16 nt, Salmonella enterica enterica serovar Typhi
cgauagagaguuccuc

SEQ ID NO: 3611883 - RNA, 14 nt, Salmonella enterica enterica serovar Typhi
cgauagcauuuuua

SEQ ID NO: 3611884 - RNA, 20 nt, Salmonella enterica enterica serovar Typhi
cgauagcauuuuuacucagc

SEQ ID NO: 3611885 - RNA, 19 nt, Salmonella enterica enterica serovar Typhi
cgauagcgacggcgcgcca

SEQ ID NO: 3611886 - RNA, 18 nt, Salmonella enterica enterica serovar Typhi
cgauaguccauuuuccua

SEQ ID NO: 3611887 - RNA, 15 nt, Salmonella enterica enterica serovar Typhi
cgauagugaucgccc

SEQ ID NO: 3611888 - RNA, 22 nt, Salmonella enterica enterica serovar Typhi
cgauaguggcgaucugaaugcc

SEQ ID NO: 3611889 - RNA, 17 nt, Salmonella enterica enterica serovar Typhi
cgauaguggucgccacg

SEQ ID NO: 3611890 - RNA, 19 nt, Salmonella enterica enterica serovar Typhi
cgauauaauuuuauuauau

SEQ ID NO: 3611891 - RNA, 20 nt, Salmonella enterica enterica serovar Typhi
cgauauaccacccgcuauga

SEQ ID NO: 3611892 - RNA, 15 nt, Salmonella enterica enterica serovar Typhi
cgauauagcgcauag

SEQ ID NO: 3611893 - RNA, 14 nt, Salmonella enterica enterica serovar Typhi
cgauauagcgcuga

SEQ ID NO: 3611894 - RNA, 17 nt, Salmonella enterica enterica serovar Typhi
cgauauagcgcugaagu

SEQ ID NO: 3611895 - RNA, 14 nt, Salmonella enterica enterica serovar Typhi
cgauguuuugccga

SEQ ID NO: 3611896 - RNA, 16 nt, Salmonella enterica enterica serovar Typhi
cgauuaacgcauguuc

SEQ ID NO: 3611897 - RNA, 21 nt, Salmonella enterica enterica serovar Typhi
cgauuaaugcuccaauaaaua

SEQ ID NO: 3611898 - RNA, 13 nt, Salmonella enterica enterica serovar Typhi
cgauuccccacca

SEQ ID NO: 3611899 - RNA, 17 nt, Salmonella enterica enterica serovar Typhi
cgauuccgugucugaau

SEQ ID NO: 3611900 - RNA, 19 nt, Salmonella enterica enterica serovar Typhi
cgauucgagcgcagcgaga

SEQ ID NO: 3611901 - RNA, 18 nt, Salmonella enterica enterica serovar Typhi
cgauuguguguuaauggc

SEQ ID NO: 3611902 - RNA, 21 nt, Salmonella enterica enterica serovar Typhi
cgauuuauucuuugucugucg

SEQ ID NO: 3611903 - RNA, 17 nt, Salmonella enterica enterica serovar Typhi
cgauuucauuacgccug

SEQ ID NO: 3611904 - RNA, 14 nt, Salmonella enterica enterica serovar Typhi
cgauuuccagcgaa

SEQ ID NO: 3611905 - RNA, 12 nt, Salmonella enterica enterica serovar Typhi
cgauuuccccug

SEQ ID NO: 3611906 - RNA, 20 nt, Salmonella enterica enterica serovar Typhi
cgauuuccuguguuacgcca

SEQ ID NO: 3611907 - RNA, 12 nt, Salmonella enterica enterica serovar Typhi
cgauuugccccg

SEQ ID NO: 3611908 - RNA, 20 nt, Salmonella enterica enterica serovar Typhi
cgauuuucagcaccuuacga

SEQ ID NO: 3611909 - RNA, 15 nt, Salmonella enterica enterica serovar Typhi
cgauuuuuaggccaa

SEQ ID NO: 3611910 - RNA, 21 nt, Salmonella enterica enterica serovar Typhi
cgauuuuuucgacauuaccca

SEQ ID NO: 3611911 - RNA, 17 nt, Salmonella enterica enterica serovar Typhi
cgcaaaaucgcaaacgc

SEQ ID NO: 3611912 - RNA, 18 nt, Salmonella enterica enterica serovar Typhi
cgcaaaauuccggcugau

SEQ ID NO: 3611913 - RNA, 15 nt, Salmonella enterica enterica serovar Typhi
cgcaaacaguacgcc

SEQ ID NO: 3611914 - RNA, 13 nt, Salmonella enterica enterica serovar Typhi
cgcaaacaguuca

SEQ ID NO: 3611915 - RNA, 13 nt, Salmonella enterica enterica serovar Typhi
cgcaaacgccgaa

SEQ ID NO: 3611916 - RNA, 16 nt, Salmonella enterica enterica serovar Typhi
cgcaaacgccgugaac

SEQ ID NO: 3611917 - RNA, 21 nt, Salmonella enterica enterica serovar Typhi
cgcaaacgccgugaacgccaa

SEQ ID NO: 3611918 - RNA, 11 nt, Salmonella enterica enterica serovar Typhi
cgcaaacugcc

SEQ ID NO: 3611919 - RNA, 22 nt, Salmonella enterica enterica serovar Typhi
cgcaaacuuugcgccauuucaa

SEQ ID NO: 3611920 - RNA, 19 nt, Salmonella enterica enterica serovar Typhi
cgcaaagacaggugaccag

SEQ ID NO: 3611921 - RNA, 19 nt, Salmonella enterica enterica serovar Typhi
cgcaaagcaauguaaaacu

SEQ ID NO: 3611922 - RNA, 21 nt, Salmonella enterica enterica serovar Typhi
cgcaaagcccaucagcgccag

SEQ ID NO: 3611923 - RNA, 16 nt, Salmonella enterica enterica serovar Typhi
cgcaaaggaccaacac

SEQ ID NO: 3611924 - RNA, 21 nt, Salmonella enterica enterica serovar Typhi
cgcaaauauccuaccacgccg

SEQ ID NO: 3611925 - RNA, 16 nt, Salmonella enterica enterica serovar Typhi
cgcaaaucaccgucga

SEQ ID NO: 3611926 - RNA, 17 nt, Salmonella enterica enterica serovar Typhi
cgcaaaugaccagauca

SEQ ID NO: 3611927 - RNA, 21 nt, Salmonella enterica enterica serovar Typhi
cgcaaaugauaauaugcucaa

SEQ ID NO: 3611928 - RNA, 18 nt, Salmonella enterica enterica serovar Typhi
cgcaacagcuugcgccca

SEQ ID NO: 3611929 - RNA, 18 nt, Salmonella enterica enterica serovar Typhi
cgcaacaggccgcaucgg

SEQ ID NO: 3611930 - RNA, 21 nt, Salmonella enterica enterica serovar Typhi
cgcaacauucugcuuccagaa

SEQ ID NO: 3611931 - RNA, 14 nt, Salmonella enterica enterica serovar Typhi
cgcaaccuccgcgg

SEQ ID NO: 3611932 - RNA, 23 nt, Salmonella enterica enterica serovar Typhi
cgcaacgcuuaucaguccccaca

SEQ ID NO: 3611933 - RNA, 18 nt, Salmonella enterica enterica serovar Typhi
cgcaacggucggucuuuu

SEQ ID NO: 3611934 - RNA, 15 nt, Salmonella enterica enterica serovar Typhi
cgcaacgucagcgau

SEQ ID NO: 3611935 - RNA, 16 nt, Salmonella enterica enterica serovar Typhi
cgcaacgucagcgauc

SEQ ID NO: 3611936 - RNA, 15 nt, Salmonella enterica enterica serovar Typhi
cgcaacgucaguacg

SEQ ID NO: 3611937 - RNA, 17 nt, Salmonella enterica enterica serovar Typhi
cgcaacgucgccauccg

SEQ ID NO: 3611938 - RNA, 23 nt, Salmonella enterica enterica serovar Typhi
cgcaacguuucuuucaucagauc

SEQ ID NO: 3611939 - RNA, 20 nt, Salmonella enterica enterica serovar Typhi
cgcaacuucugcuggcggaa

SEQ ID NO: 3611940 - RNA, 14 nt, Salmonella enterica enterica serovar Typhi
cgcaagcggcguuc

SEQ ID NO: 3611941 - RNA, 22 nt, Salmonella enterica enterica serovar Typhi
cgcaagcucaccaucuucauga

SEQ ID NO: 3611942 - RNA, 11 nt, Salmonella enterica enterica serovar Typhi
cgcaaggaaau

SEQ ID NO: 3611943 - RNA, 19 nt, Salmonella enterica enterica serovar Typhi
cgcaaggaaauauuaauua

SEQ ID NO: 3611944 - RNA, 22 nt, Salmonella enterica enterica serovar Typhi
cgcaaggcggcguuuuuuuauc

SEQ ID NO: 3611945 - RNA, 20 nt, Salmonella enterica enterica serovar Typhi
cgcaauaaacacgauggcaa

SEQ ID NO: 3611946 - RNA, 16 nt, Salmonella enterica enterica serovar Typhi
cgcaauaacgccgaua

SEQ ID NO: 3611947 - RNA, 21 nt, Salmonella enterica enterica serovar Typhi
cgcaauaaguucaaacucauu

SEQ ID NO: 3611948 - RNA, 19 nt, Salmonella enterica enterica serovar Typhi
cgcaauacagcccgccagc

SEQ ID NO: 3611949 - RNA, 14 nt, Salmonella enterica enterica serovar Typhi
cgcaauaccggcga

SEQ ID NO: 3611950 - RNA, 15 nt, Salmonella enterica enterica serovar Typhi
cgcaaucaugacaga

SEQ ID NO: 3611951 - RNA, 19 nt, Salmonella enterica enterica serovar Typhi
cgcaaucucgcaagauucc

SEQ ID NO: 3611952 - RNA, 17 nt, Salmonella enterica enterica serovar Typhi
cgcaaucuuugccgcaa

SEQ ID NO: 3611953 - RNA, 21 nt, Salmonella enterica enterica serovar Typhi
cgcaaucuuugccgcaaacgc

SEQ ID NO: 3611954 - RNA, 22 nt, Salmonella enterica enterica serovar Typhi
cgcaaugcgcuugcuccgcaga

SEQ ID NO: 3611955 - RNA, 18 nt, Salmonella enterica enterica serovar Typhi
cgcaauguggacaaucag

SEQ ID NO: 3611956 - RNA, 13 nt, Salmonella enterica enterica serovar Typhi
cgcaauuaauuua

SEQ ID NO: 3611957 - RNA, 13 nt, Salmonella enterica enterica serovar Typhi
cgcaauucuucua

SEQ ID NO: 3611958 - RNA, 21 nt, Salmonella enterica enterica serovar Typhi
cgcaauuuugguaauggcgaa

SEQ ID NO: 3611959 - RNA, 12 nt, Salmonella enterica enterica serovar Typhi
cgcacaaacgcu

SEQ ID NO: 3611960 - RNA, 22 nt, Salmonella enterica enterica serovar Typhi
cgcacaaucgccgugaucccaa

SEQ ID NO: 3611961 - RNA, 23 nt, Salmonella enterica enterica serovar Typhi
cgcacagaaucgcuguggcauua

SEQ ID NO: 3611962 - RNA, 21 nt, Salmonella enterica enterica serovar Typhi
cgcacagagaucgugcauccg

SEQ ID NO: 3611963 - RNA, 23 nt, Salmonella enterica enterica serovar Typhi
cgcacagcagacaaccgacgcau

SEQ ID NO: 3611964 - RNA, 20 nt, Salmonella enterica enterica serovar Typhi
cgcacagggugaaaucacgc

SEQ ID NO: 3611965 - RNA, 15 nt, Salmonella enterica enterica serovar Typhi
cgcacauaaucaccg

SEQ ID NO: 3611966 - RNA, 15 nt, Salmonella enterica enterica serovar Typhi
cgcacaugaucuucg

SEQ ID NO: 3611967 - RNA, 22 nt, Salmonella enterica enterica serovar Typhi
cgcacauggaacucugcgacgc

SEQ ID NO: 3611968 - RNA, 20 nt, Salmonella enterica enterica serovar Typhi
cgcacauuuacgccagccag

SEQ ID NO: 3611969 - RNA, 18 nt, Salmonella enterica enterica serovar Typhi
cgcaccacgcaaaccgcu

SEQ ID NO: 3611970 - RNA, 15 nt, Salmonella enterica enterica serovar Typhi
cgcaccacgccgaag

SEQ ID NO: 3611971 - RNA, 21 nt, Salmonella enterica enterica serovar Typhi
cgcaccacugcuguagcgucu

SEQ ID NO: 3611972 - RNA, 13 nt, Salmonella enterica enterica serovar Typhi
cgcaccagucggc

SEQ ID NO: 3611973 - RNA, 18 nt, Salmonella enterica enterica serovar Typhi
cgcacccguuucagacgc

SEQ ID NO: 3611974 - RNA, 20 nt, Salmonella enterica enterica serovar Typhi
cgcaccgucgagaaaccgcu

SEQ ID NO: 3611975 - RNA, 19 nt, Salmonella enterica enterica serovar Typhi
cgcacgccagauaaaucag

SEQ ID NO: 3611976 - RNA, 19 nt, Salmonella enterica enterica serovar Typhi
cgcacgccaucacguccug

SEQ ID NO: 3611977 - RNA, 20 nt, Salmonella enterica enterica serovar Typhi
cgcacgccggccccgcuucc

SEQ ID NO: 3611978 - RNA, 16 nt, Salmonella enterica enterica serovar Typhi
cgcacgccugcggccc

SEQ ID NO: 3611979 - RNA, 17 nt, Salmonella enterica enterica serovar Typhi
cgcacgccugggcgaua

SEQ ID NO: 3611980 - RNA, 15 nt, Salmonella enterica enterica serovar Typhi
cgcaguucgccgcca

SEQ ID NO: 3611981 - RNA, 17 nt, Salmonella enterica enterica serovar Typhi
cgcaguugggcgcgcga

SEQ ID NO: 3611982 - RNA, 23 nt, Salmonella enterica enterica serovar Typhi
cgcaguuguaguagccacagcgg

SEQ ID NO: 3611983 - RNA, 14 nt, Salmonella enterica enterica serovar Typhi
cgcaguuuacgcag

SEQ ID NO: 3611984 - RNA, 14 nt, Salmonella enterica enterica serovar Typhi
cgcauaaaaaauga

SEQ ID NO: 3611985 - RNA, 13 nt, Salmonella enterica enterica serovar Typhi
cgcauaaccgauu

SEQ ID NO: 3611986 - RNA, 15 nt, Salmonella enterica enterica serovar Typhi
cgcauaacguugugg

SEQ ID NO: 3611987 - RNA, 18 nt, Salmonella enterica enterica serovar Typhi
cgcauaaugagcgcuuga

SEQ ID NO: 3611988 - RNA, 22 nt, Salmonella enterica enterica serovar Typhi
cgcauacaucgcagacauggca

SEQ ID NO: 3611989 - RNA, 13 nt, Salmonella enterica enterica serovar Typhi
cgcauaccagcca

SEQ ID NO: 3611990 - RNA, 18 nt, Salmonella enterica enterica serovar Typhi
cgcauaccgaacagaaaa

SEQ ID NO: 3611991 - RNA, 17 nt, Salmonella enterica enterica serovar Typhi
cgcauaccuucaugcau

SEQ ID NO: 3611992 - RNA, 22 nt, Salmonella enterica enterica serovar Typhi
cgcauagacgcccugcaaagca

SEQ ID NO: 3611993 - RNA, 21 nt, Salmonella enterica enterica serovar Typhi
cgcauagauauaaacgcccga

SEQ ID NO: 3611994 - RNA, 16 nt, Salmonella enterica enterica serovar Typhi
cgcauagcggccagau

SEQ ID NO: 3611995 - RNA, 13 nt, Salmonella enterica enterica serovar Typhi
cgcauagcugccc

SEQ ID NO: 3611996 - RNA, 14 nt, Salmonella enterica enterica serovar Typhi
cgcauaucccacug

SEQ ID NO: 3611997 - RNA, 15 nt, Salmonella enterica enterica serovar Typhi
cgcauauuccggcga

SEQ ID NO: 3611998 - RNA, 22 nt, Salmonella enterica enterica serovar Typhi
cgcaucaaacuugcccagcgcc

SEQ ID NO: 3611999 - RNA, 19 nt, Salmonella enterica enterica serovar Typhi
cgcaucaacgccaggcaga

SEQ ID NO: 3612000 - RNA, 19 nt, Salmonella enterica enterica serovar Typhi
cgcaucaacguaaauagag

SEQ ID NO: 3612001 - RNA, 20 nt, Salmonella enterica enterica serovar Typhi
cgcaucaaugcccagcgcaa

SEQ ID NO: 3612002 - RNA, 16 nt, Salmonella enterica enterica serovar Typhi
cgcaucacggcagcac

SEQ ID NO: 3612003 - RNA, 16 nt, Salmonella enterica enterica serovar Typhi
cgcaucacuggcguau

SEQ ID NO: 3612004 - RNA, 18 nt, Salmonella enterica enterica serovar Typhi
cgcaucagaccuccgcca

SEQ ID NO: 3612005 - RNA, 22 nt, Salmonella enterica enterica serovar Typhi
cgcaucaggaucuucaucccau

SEQ ID NO: 3612006 - RNA, 15 nt, Salmonella enterica enterica serovar Typhi
cgcaucauucaucuc

SEQ ID NO: 3612007 - RNA, 11 nt, Salmonella enterica enterica serovar Typhi
cgcauccagcc

SEQ ID NO: 3612008 - RNA, 14 nt, Salmonella enterica enterica serovar Typhi
cgcauccagcgcaa

SEQ ID NO: 3612009 - RNA, 12 nt, Salmonella enterica enterica serovar Typhi
cgcauccagcgu

SEQ ID NO: 3612010 - RNA, 14 nt, Salmonella enterica enterica serovar Typhi
cgcauccagcguca

SEQ ID NO: 3612011 - RNA, 16 nt, Salmonella enterica enterica serovar Typhi
cgcauccaguuguuua

SEQ ID NO: 3612012 - RNA, 16 nt, Salmonella enterica enterica serovar Typhi
cgcauccgcggcgcuu

SEQ ID NO: 3612013 - RNA, 18 nt, Salmonella enterica enterica serovar Typhi
cgcauccggcaaaacgaa

SEQ ID NO: 3612014 - RNA, 13 nt, Salmonella enterica enterica serovar Typhi
cgcauccggcagu

SEQ ID NO: 3612015 - RNA, 14 nt, Salmonella enterica enterica serovar Typhi
cgcauccggcauca

SEQ ID NO: 3612016 - RNA, 24 nt, Salmonella enterica enterica serovar Typhi
cgcauccgggaguuucaugccaua

SEQ ID NO: 3612017 - RNA, 23 nt, Salmonella enterica enterica serovar Typhi
cgcauccuguuuuuucagcgcgc

SEQ ID NO: 3612018 - RNA, 16 nt, Salmonella enterica enterica serovar Typhi
cgcaucgauaucuuua

SEQ ID NO: 3612019 - RNA, 21 nt, Salmonella enterica enterica serovar Typhi
cgcaucgcggauggcggcaua

SEQ ID NO: 3612020 - RNA, 18 nt, Salmonella enterica enterica serovar Typhi
cgcaucgggucgcgcgcc

SEQ ID NO: 3612021 - RNA, 16 nt, Salmonella enterica enterica serovar Typhi
cgcaucguggccgaua

SEQ ID NO: 3612022 - RNA, 22 nt, Salmonella enterica enterica serovar Typhi
cgcaucguggccgauauugccu

SEQ ID NO: 3612023 - RNA, 16 nt, Salmonella enterica enterica serovar Typhi
cgcaucucccugccag

SEQ ID NO: 3612024 - RNA, 17 nt, Salmonella enterica enterica serovar Typhi
cgcaucucccugccagu

SEQ ID NO: 3612025 - RNA, 16 nt, Salmonella enterica enterica serovar Typhi
cgcaucugacaucaga

SEQ ID NO: 3612026 - RNA, 20 nt, Salmonella enterica enterica serovar Typhi
cgcaucugacaucagaaaau

SEQ ID NO: 3612027 - RNA, 16 nt, Salmonella enterica enterica serovar Typhi
cgcaucugggcugaga

SEQ ID NO: 3612028 - RNA, 21 nt, Salmonella enterica enterica serovar Typhi
cgcaucugggcugagaaaaau

SEQ ID NO: 3612029 - RNA, 15 nt, Salmonella enterica enterica serovar Typhi
cgcaugacccaggca

SEQ ID NO: 3612030 - RNA, 19 nt, Salmonella enterica enterica serovar Typhi
cgcaugacuacgaaucgcg

SEQ ID NO: 3612031 - RNA, 19 nt, Salmonella enterica enterica serovar Typhi
cgcaugauauaaaauggcg

SEQ ID NO: 3612032 - RNA, 22 nt, Salmonella enterica enterica serovar Typhi
cgcaugaucucuugcauaauau

SEQ ID NO: 3612033 - RNA, 21 nt, Salmonella enterica enterica serovar Typhi
cgcauggacaaggaucguuac

SEQ ID NO: 3612034 - RNA, 15 nt, Salmonella enterica enterica serovar Typhi
cgcauggcagggcga

SEQ ID NO: 3612035 - RNA, 15 nt, Salmonella enterica enterica serovar Typhi
cgcaugggcauaauc

SEQ ID NO: 3612036 - RNA, 15 nt, Salmonella enterica enterica serovar Typhi
cgcauggggagaccc

SEQ ID NO: 3612037 - RNA, 21 nt, Salmonella enterica enterica serovar Typhi
cgcaugugagcaucggcgauu

SEQ ID NO: 3612038 - RNA, 14 nt, Salmonella enterica enterica serovar Typhi
cgcauguuccgcua

SEQ ID NO: 3612039 - RNA, 23 nt, Salmonella enterica enterica serovar Typhi
cgcauguuccgcuaccugcgagc

SEQ ID NO: 3612040 - RNA, 16 nt, Salmonella enterica enterica serovar Typhi
cgcauguuucgcuuca

SEQ ID NO: 3612041 - RNA, 13 nt, Salmonella enterica enterica serovar Typhi
cgcauguuugccu

SEQ ID NO: 3612042 - RNA, 12 nt, Salmonella enterica enterica serovar Typhi
cgcauucauaag

SEQ ID NO: 3612043 - RNA, 17 nt, Salmonella enterica enterica serovar Typhi
cgcauuccagacccgau

SEQ ID NO: 3612044 - RNA, 17 nt, Salmonella enterica enterica serovar Typhi
cgcauucucgccgugac

SEQ ID NO: 3612045 - RNA, 19 nt, Salmonella enterica enterica serovar Typhi
cgcauucucugucgccgcc

SEQ ID NO: 3612046 - RNA, 20 nt, Salmonella enterica enterica serovar Typhi
cgcauucucugucgccgccc

SEQ ID NO: 3612047 - RNA, 20 nt, Salmonella enterica enterica serovar Typhi
cgcauucuucagcgcguccu

SEQ ID NO: 3612048 - RNA, 16 nt, Salmonella enterica enterica serovar Typhi
cgcauucuuuuuucuc

SEQ ID NO: 3612049 - RNA, 20 nt, Salmonella enterica enterica serovar Typhi
cgcauugcgcuauuacucuu

SEQ ID NO: 3612050 - RNA, 23 nt, Salmonella enterica enterica serovar Typhi
cgcauuuaaucgccugcgcgccu

SEQ ID NO: 3612051 - RNA, 17 nt, Salmonella enterica enterica serovar Typhi
cgcauuucaagcaggcg

SEQ ID NO: 3612052 - RNA, 19 nt, Salmonella enterica enterica serovar Typhi
cgcauuucaagcaggcgau

SEQ ID NO: 3612053 - RNA, 15 nt, Salmonella enterica enterica serovar Typhi
cgcauuucguggcgg

SEQ ID NO: 3612054 - RNA, 19 nt, Salmonella enterica enterica serovar Typhi
cgcauuuuuucuucaguuc

SEQ ID NO: 3612055 - RNA, 16 nt, Salmonella enterica enterica serovar Typhi
cgccaaaaucaggcau

SEQ ID NO: 3612056 - RNA, 14 nt, Salmonella enterica enterica serovar Typhi
cgccaaaccacacc

SEQ ID NO: 3612057 - RNA, 16 nt, Salmonella enterica enterica serovar Typhi
cgccaaaccagacccg

SEQ ID NO: 3612058 - RNA, 12 nt, Salmonella enterica enterica serovar Typhi
cgccaaacccga

SEQ ID NO: 3612059 - RNA, 21 nt, Salmonella enterica enterica serovar Typhi
cgccaaacgggcaagccagca

SEQ ID NO: 3612060 - RNA, 19 nt, Salmonella enterica enterica serovar Typhi
cgccaaacugcgcgccgcc

SEQ ID NO: 3612061 - RNA, 18 nt, Salmonella enterica enterica serovar Typhi
cgccaaagaaacgcugau

SEQ ID NO: 3612062 - RNA, 20 nt, Salmonella enterica enterica serovar Typhi
cgccaaagggauaagaaaga

SEQ ID NO: 3612063 - RNA, 17 nt, Salmonella enterica enterica serovar Typhi
cgccaaaguuaaucagc

SEQ ID NO: 3612064 - RNA, 18 nt, Salmonella enterica enterica serovar Typhi
cgccaaaguuaaucagcg

SEQ ID NO: 3612065 - RNA, 18 nt, Salmonella enterica enterica serovar Typhi
cgccaacgccacugccau

SEQ ID NO: 3612066 - RNA, 15 nt, Salmonella enterica enterica serovar Typhi
cgccagccagcgcca

SEQ ID NO: 3612067 - RNA, 17 nt, Salmonella enterica enterica serovar Typhi
cgccagccagcgccacc

SEQ ID NO: 3612068 - RNA, 21 nt, Salmonella enterica enterica serovar Typhi
cgccagccagcgccaccaaag

SEQ ID NO: 3612069 - RNA, 19 nt, Salmonella enterica enterica serovar Typhi
cgccagccagcucaccagc

SEQ ID NO: 3612070 - RNA, 17 nt, Salmonella enterica enterica serovar Typhi
cgccagccagucgccag

SEQ ID NO: 3612071 - RNA, 21 nt, Salmonella enterica enterica serovar Typhi
cgccagccauuaaagaaggcg

SEQ ID NO: 3612072 - RNA, 18 nt, Salmonella enterica enterica serovar Typhi
cgccagccgaucaucgua

SEQ ID NO: 3612073 - RNA, 19 nt, Salmonella enterica enterica serovar Typhi
cgccagccgcgccaucucc

SEQ ID NO: 3612074 - RNA, 23 nt, Salmonella enterica enterica serovar Typhi
cgccagccgcgccaucuccuccu

SEQ ID NO: 3612075 - RNA, 12 nt, Salmonella enterica enterica serovar Typhi
cgccagccggaa

SEQ ID NO: 3612076 - RNA, 13 nt, Salmonella enterica enterica serovar Typhi
cgccagccgucaa

SEQ ID NO: 3612077 - RNA, 17 nt, Salmonella enterica enterica serovar Typhi
cgccagccugaacaucu

SEQ ID NO: 3612078 - RNA, 15 nt, Salmonella enterica enterica serovar Typhi
cgccagcgagaugaa

SEQ ID NO: 3612079 - RNA, 13 nt, Salmonella enterica enterica serovar Typhi
cgccagcgccaca

SEQ ID NO: 3612080 - RNA, 13 nt, Salmonella enterica enterica serovar Typhi
cgccagcgccgga

SEQ ID NO: 3612081 - RNA, 15 nt, Salmonella enterica enterica serovar Typhi
cgccagcgcgguggc

SEQ ID NO: 3612082 - RNA, 23 nt, Salmonella enterica enterica serovar Typhi
cgccagcgcgguuucuacaccuu

SEQ ID NO: 3612083 - RNA, 22 nt, Salmonella enterica enterica serovar Typhi
cgccagcggccagcguaccugc

SEQ ID NO: 3612084 - RNA, 19 nt, Salmonella enterica enterica serovar Typhi
cgccagcggcgacaguaac

SEQ ID NO: 3612085 - RNA, 12 nt, Salmonella enterica enterica serovar Typhi
cgccagcggcgc

SEQ ID NO: 3612086 - RNA, 13 nt, Salmonella enterica enterica serovar Typhi
cgccagcggcgcc

SEQ ID NO: 3612087 - RNA, 14 nt, Salmonella enterica enterica serovar Typhi
cgccagcggcgcca

SEQ ID NO: 3612088 - RNA, 21 nt, Salmonella enterica enterica serovar Typhi
cgccagcggcgccaucaccau

SEQ ID NO: 3612089 - RNA, 14 nt, Salmonella enterica enterica serovar Typhi
cgccagcggcguuu

SEQ ID NO: 3612090 - RNA, 14 nt, Salmonella enterica enterica serovar Typhi
cgccagcggcugcu

SEQ ID NO: 3612091 - RNA, 20 nt, Salmonella enterica enterica serovar Typhi
cgccagcgugcgcagcgcgu

SEQ ID NO: 3612092 - RNA, 18 nt, Salmonella enterica enterica serovar Typhi
cgccagcgugcuuaaucc

SEQ ID NO: 3612093 - RNA, 13 nt, Salmonella enterica enterica serovar Typhi
cgccagcucaugc

SEQ ID NO: 3612094 - RNA, 21 nt, Salmonella enterica enterica serovar Typhi
cgccagcucaugcgcggcggg

SEQ ID NO: 3612095 - RNA, 14 nt, Salmonella enterica enterica serovar Typhi
cgccagcugcgcgc

SEQ ID NO: 3612096 - RNA, 16 nt, Salmonella enterica enterica serovar Typhi
cgccagcugcgcgcua

SEQ ID NO: 3612097 - RNA, 16 nt, Salmonella enterica enterica serovar Typhi
cgccagcuuucggcga

SEQ ID NO: 3612098 - RNA, 20 nt, Salmonella enterica enterica serovar Typhi
cgccaggaaccgcggucggc

SEQ ID NO: 3612099 - RNA, 20 nt, Salmonella enterica enterica serovar Typhi
cgccaggccagauggcuuua

SEQ ID NO: 3612100 - RNA, 11 nt, Salmonella enterica enterica serovar Typhi
cgccaggccau

SEQ ID NO: 3612101 - RNA, 11 nt, Salmonella enterica enterica serovar Typhi
cgccaggccgc

SEQ ID NO: 3612102 - RNA, 18 nt, Salmonella enterica enterica serovar Typhi
cgccaggccgcggcugua

SEQ ID NO: 3612103 - RNA, 15 nt, Salmonella enterica enterica serovar Typhi
cgccaggcgcugcgu

SEQ ID NO: 3612104 - RNA, 12 nt, Salmonella enterica enterica serovar Typhi
cgccagggcggc

SEQ ID NO: 3612105 - RNA, 22 nt, Salmonella enterica enterica serovar Typhi
cgccagggcgggauccccugcu

SEQ ID NO: 3612106 - RNA, 16 nt, Salmonella enterica enterica serovar Typhi
cgccagggcuucugcu

SEQ ID NO: 3612107 - RNA, 19 nt, Salmonella enterica enterica serovar Typhi
cgccaggucucauagcgcc

SEQ ID NO: 3612108 - RNA, 16 nt, Salmonella enterica enterica serovar Typhi
cgccaguaaucggcgc

SEQ ID NO: 3612109 - RNA, 23 nt, Salmonella enterica enterica serovar Typhi
cgccaguaauuuuucucccagca

SEQ ID NO: 3612110 - RNA, 19 nt, Salmonella enterica enterica serovar Typhi
cgccaguaggaauauacca

SEQ ID NO: 3612111 - RNA, 13 nt, Salmonella enterica enterica serovar Typhi
cgccagucacccu

SEQ ID NO: 3612112 - RNA, 15 nt, Salmonella enterica enterica serovar Typhi
cgccagucaggcgau

SEQ ID NO: 3612113 - RNA, 16 nt, Salmonella enterica enterica serovar Typhi
cgccagugaauccacc

SEQ ID NO: 3612114 - RNA, 18 nt, Salmonella enterica enterica serovar Typhi
cgccagugaauccaccac

SEQ ID NO: 3612115 - RNA, 11 nt, Salmonella enterica enterica serovar Typhi
cgccagugaca

SEQ ID NO: 3612116 - RNA, 14 nt, Salmonella enterica enterica serovar Typhi
cgccagugacgcca

SEQ ID NO: 3612117 - RNA, 17 nt, Salmonella enterica enterica serovar Typhi
cgccagugaugccaaac

SEQ ID NO: 3612118 - RNA, 17 nt, Salmonella enterica enterica serovar Typhi
cgccaguuccaucauug

SEQ ID NO: 3612119 - RNA, 16 nt, Salmonella enterica enterica serovar Typhi
cgccaguucccacagc

SEQ ID NO: 3612120 - RNA, 20 nt, Salmonella enterica enterica serovar Typhi
cgccaguucccacagcuuca

SEQ ID NO: 3612121 - RNA, 14 nt, Salmonella enterica enterica serovar Typhi
cgccaguuuacgcg

SEQ ID NO: 3612122 - RNA, 17 nt, Salmonella enterica enterica serovar Typhi
cgccaguuucuuuuucc

SEQ ID NO: 3612123 - RNA, 19 nt, Salmonella enterica enterica serovar Typhi
cgccaguuugguuaauucc

SEQ ID NO: 3612124 - RNA, 15 nt, Salmonella enterica enterica serovar Typhi
cgccauaaagcugua

SEQ ID NO: 3612125 - RNA, 21 nt, Salmonella enterica enterica serovar Typhi
cgccauaaaucagauccacgc

SEQ ID NO: 3612126 - RNA, 20 nt, Salmonella enterica enterica serovar Typhi
cgccauaaaucccggcgauu

SEQ ID NO: 3612127 - RNA, 11 nt, Salmonella enterica enterica serovar Typhi
cgccauaauac

SEQ ID NO: 3612128 - RNA, 19 nt, Salmonella enterica enterica serovar Typhi
cgccauaauacuuaauuca

SEQ ID NO: 3612129 - RNA, 21 nt, Salmonella enterica enterica serovar Typhi
cgccauaauacuuaauucaua

SEQ ID NO: 3612130 - RNA, 18 nt, Salmonella enterica enterica serovar Typhi
cgccauaauuguucagcu

SEQ ID NO: 3612131 - RNA, 16 nt, Salmonella enterica enterica serovar Typhi
cgccauacuuacugcu

SEQ ID NO: 3612132 - RNA, 19 nt, Salmonella enterica enterica serovar Typhi
cgccauagaaauagccccg

SEQ ID NO: 3612133 - RNA, 20 nt, Salmonella enterica enterica serovar Typhi
cgccauaguccauuacgcag

SEQ ID NO: 3612134 - RNA, 16 nt, Salmonella enterica enterica serovar Typhi
cgccauauacgccacg

SEQ ID NO: 3612135 - RNA, 22 nt, Salmonella enterica enterica serovar Typhi
cgccauauacgccacggccagc

SEQ ID NO: 3612136 - RNA, 16 nt, Salmonella enterica enterica serovar Typhi
cgccauauccgcagac

SEQ ID NO: 3612137 - RNA, 13 nt, Salmonella enterica enterica serovar Typhi
cgccauaucggca

SEQ ID NO: 3612138 - RNA, 18 nt, Salmonella enterica enterica serovar Typhi
cgccauaucuucgcgcgu

SEQ ID NO: 3612139 - RNA, 21 nt, Salmonella enterica enterica serovar Typhi
cgccaucaaacgcagcaaacg

SEQ ID NO: 3612140 - RNA, 22 nt, Salmonella enterica enterica serovar Typhi
cgccaucaacuccuccggcgag

SEQ ID NO: 3612141 - RNA, 17 nt, Salmonella enterica enterica serovar Typhi
cgccaucaauuuugcgc

SEQ ID NO: 3612142 - RNA, 20 nt, Salmonella enterica enterica serovar Typhi
cgccaucaauuuugcgccua

SEQ ID NO: 3612143 - RNA, 17 nt, Salmonella enterica enterica serovar Typhi
cgccaucaccaggucaa

SEQ ID NO: 3612144 - RNA, 17 nt, Salmonella enterica enterica serovar Typhi
cgccaucagccgcgcua

SEQ ID NO: 3612145 - RNA, 17 nt, Salmonella enterica enterica serovar Typhi
cgccaucaggcaaucuu

SEQ ID NO: 3612146 - RNA, 22 nt, Salmonella enterica enterica serovar Typhi
cgccaucaggcaauucggcccu

SEQ ID NO: 3612147 - RNA, 15 nt, Salmonella enterica enterica serovar Typhi
cgccaucaggcacgg

SEQ ID NO: 3612148 - RNA, 17 nt, Salmonella enterica enterica serovar Typhi
cgccaucaggcauaaac

SEQ ID NO: 3612149 - RNA, 21 nt, Salmonella enterica enterica serovar Typhi
cgccaucaggcaugccaaacc

SEQ ID NO: 3612150 - RNA, 15 nt, Salmonella enterica enterica serovar Typhi
cgccaucaggcaugg

SEQ ID NO: 3612151 - RNA, 18 nt, Salmonella enterica enterica serovar Typhi
cgccaucaggcauggcag

SEQ ID NO: 3612152 - RNA, 14 nt, Salmonella enterica enterica serovar Typhi
cgccccacagaccu

SEQ ID NO: 3612153 - RNA, 20 nt, Salmonella enterica enterica serovar Typhi
cgccccagaagagcgagucu

SEQ ID NO: 3612154 - RNA, 22 nt, Salmonella enterica enterica serovar Typhi
cgccccagaagagcgagucuuu

SEQ ID NO: 3612155 - RNA, 22 nt, Salmonella enterica enterica serovar Typhi
cgccccaguaacgugccccaga

SEQ ID NO: 3612156 - RNA, 20 nt, Salmonella enterica enterica serovar Typhi
cgccccccuaccggaaucgc

SEQ ID NO: 3612157 - RNA, 13 nt, Salmonella enterica enterica serovar Typhi
cgcccccuccagu

SEQ ID NO: 3612158 - RNA, 18 nt, Salmonella enterica enterica serovar Typhi
cgccccgccgcgcggccc

SEQ ID NO: 3612159 - RNA, 21 nt, Salmonella enterica enterica serovar Typhi
cgccccggcgagugccugcug

SEQ ID NO: 3612160 - RNA, 14 nt, Salmonella enterica enterica serovar Typhi
cgcccgagcgacgc

SEQ ID NO: 3612161 - RNA, 16 nt, Salmonella enterica enterica serovar Typhi
cgcccgagcgacgccc

SEQ ID NO: 3612162 - RNA, 19 nt, Salmonella enterica enterica serovar Typhi
cgcccgauaauaucacucc

SEQ ID NO: 3612163 - RNA, 22 nt, Salmonella enterica enterica serovar Typhi
cgcccgauaauaucacucccgc

SEQ ID NO: 3612164 - RNA, 20 nt, Salmonella enterica enterica serovar Typhi
cgcccgaucguccgccuccg

SEQ ID NO: 3612165 - RNA, 24 nt, Salmonella enterica enterica serovar Typhi
cgcccgaucucauaaacgccugga

SEQ ID NO: 3612166 - RNA, 14 nt, Salmonella enterica enterica serovar Typhi
cgcccgccaccagc

SEQ ID NO: 3612167 - RNA, 15 nt, Salmonella enterica enterica serovar Typhi
cgcccgccaucgccc

SEQ ID NO: 3612168 - RNA, 14 nt, Salmonella enterica enterica serovar Typhi
cgcccgccgccagc

SEQ ID NO: 3612169 - RNA, 16 nt, Salmonella enterica enterica serovar Typhi
cgcccgccucgcugau

SEQ ID NO: 3612170 - RNA, 23 nt, Salmonella enterica enterica serovar Typhi
cgcccgccugccggauagcggcu

SEQ ID NO: 3612171 - RNA, 18 nt, Salmonella enterica enterica serovar Typhi
cgcccgcucgcgauccuc

SEQ ID NO: 3612172 - RNA, 11 nt, Salmonella enterica enterica serovar Typhi
cgcccgcuuca

SEQ ID NO: 3612173 - RNA, 18 nt, Salmonella enterica enterica serovar Typhi
cgcccggcgcgcuggagg

SEQ ID NO: 3612174 - RNA, 13 nt, Salmonella enterica enterica serovar Typhi
cgcccggcgggua

SEQ ID NO: 3612175 - RNA, 22 nt, Salmonella enterica enterica serovar Typhi
cgcccgguugcaauuccgccau

SEQ ID NO: 3612176 - RNA, 17 nt, Salmonella enterica enterica serovar Typhi
cgcccguacaccugcaa

SEQ ID NO: 3612177 - RNA, 14 nt, Salmonella enterica enterica serovar Typhi
cgcccgucaaugcg

SEQ ID NO: 3612178 - RNA, 13 nt, Salmonella enterica enterica serovar Typhi
cgcccguccgcua

SEQ ID NO: 3612179 - RNA, 15 nt, Salmonella enterica enterica serovar Typhi
cgcccgugacgccag

SEQ ID NO: 3612180 - RNA, 19 nt, Salmonella enterica enterica serovar Typhi
cgcccgugacgccaggcag

SEQ ID NO: 3612181 - RNA, 13 nt, Salmonella enterica enterica serovar Typhi
cgcccguuuccgc

SEQ ID NO: 3612182 - RNA, 22 nt, Salmonella enterica enterica serovar Typhi
cgcccucaagacgguuauuuuu

SEQ ID NO: 3612183 - RNA, 13 nt, Salmonella enterica enterica serovar Typhi
cgcccucgccagc

SEQ ID NO: 3612184 - RNA, 12 nt, Salmonella enterica enterica serovar Typhi
cgcccugaaagc

SEQ ID NO: 3612185 - RNA, 14 nt, Salmonella enterica enterica serovar Typhi
cgcccugacgccgc

SEQ ID NO: 3612186 - RNA, 21 nt, Salmonella enterica enterica serovar Typhi
cgcccugaggaguauuaucca

SEQ ID NO: 3612187 - RNA, 20 nt, Salmonella enterica enterica serovar Typhi
cgcccugccauucccagccg

SEQ ID NO: 3612188 - RNA, 21 nt, Salmonella enterica enterica serovar Typhi
cgcccugccauucccagccga

SEQ ID NO: 3612189 - RNA, 15 nt, Salmonella enterica enterica serovar Typhi
cgcccugcccgccag

SEQ ID NO: 3612190 - RNA, 14 nt, Salmonella enterica enterica serovar Typhi
cgcccugcgccaga

SEQ ID NO: 3612191 - RNA, 18 nt, Salmonella enterica enterica serovar Typhi
cgcccugcgccagcaugg

SEQ ID NO: 3612192 - RNA, 21 nt, Salmonella enterica enterica serovar Typhi
cgcccugcgccagcauggcgu

SEQ ID NO: 3612193 - RNA, 14 nt, Salmonella enterica enterica serovar Typhi
cgcccugcgguagc

SEQ ID NO: 3612194 - RNA, 16 nt, Salmonella enterica enterica serovar Typhi
cgcccugcgucgcgcu

SEQ ID NO: 3612195 - RNA, 21 nt, Salmonella enterica enterica serovar Typhi
cgcccugcgucgcgcuuucaa

SEQ ID NO: 3612196 - RNA, 18 nt, Salmonella enterica enterica serovar Typhi
cgcccugcucccacagcu

SEQ ID NO: 3612197 - RNA, 19 nt, Salmonella enterica enterica serovar Typhi
cgcccuguauacaggcaug

SEQ ID NO: 3612198 - RNA, 21 nt, Salmonella enterica enterica serovar Typhi
cgcccuguauacaggcauggc

SEQ ID NO: 3612199 - RNA, 16 nt, Salmonella enterica enterica serovar Typhi
cgcccuucgucaggag

SEQ ID NO: 3612200 - RNA, 18 nt, Salmonella enterica enterica serovar Typhi
cgccgaaagcgaucacau

SEQ ID NO: 3612201 - RNA, 13 nt, Salmonella enterica enterica serovar Typhi
cgccgaacacgca

SEQ ID NO: 3612202 - RNA, 21 nt, Salmonella enterica enterica serovar Typhi
cgccgaagccagcgcagucaa

SEQ ID NO: 3612203 - RNA, 15 nt, Salmonella enterica enterica serovar Typhi
cgccgaagcggcagu

SEQ ID NO: 3612204 - RNA, 22 nt, Salmonella enterica enterica serovar Typhi
cgccgaaggcaacgccgccagc

SEQ ID NO: 3612205 - RNA, 23 nt, Salmonella enterica enterica serovar Typhi
cgccgaauagaguaauacaucca

SEQ ID NO: 3612206 - RNA, 15 nt, Salmonella enterica enterica serovar Typhi
cgccgacaccggccu

SEQ ID NO: 3612207 - RNA, 18 nt, Salmonella enterica enterica serovar Typhi
cgccgacaucgccaccgc

SEQ ID NO: 3612208 - RNA, 16 nt, Salmonella enterica enterica serovar Typhi
cgccgacaugguuaac

SEQ ID NO: 3612209 - RNA, 23 nt, Salmonella enterica enterica serovar Typhi
cgccgacaugguuaaccaccagc

SEQ ID NO: 3612210 - RNA, 20 nt, Salmonella enterica enterica serovar Typhi
cgccgacauucccugcgcau

SEQ ID NO: 3612211 - RNA, 13 nt, Salmonella enterica enterica serovar Typhi
cgccgaccaccag

SEQ ID NO: 3612212 - RNA, 17 nt, Salmonella enterica enterica serovar Typhi
cgccgacccccuccuug

SEQ ID NO: 3612213 - RNA, 19 nt, Salmonella enterica enterica serovar Typhi
cgccgacccccuccuugua

SEQ ID NO: 3612214 - RNA, 17 nt, Salmonella enterica enterica serovar Typhi
cgccgacgcauccgcca

SEQ ID NO: 3612215 - RNA, 14 nt, Salmonella enterica enterica serovar Typhi
cgccgacucacgca

SEQ ID NO: 3612216 - RNA, 15 nt, Salmonella enterica enterica serovar Typhi
cgccgacucacgcag

SEQ ID NO: 3612217 - RNA, 16 nt, Salmonella enterica enterica serovar Typhi
cgccgacucacgcagc

SEQ ID NO: 3612218 - RNA, 22 nt, Salmonella enterica enterica serovar Typhi
cgccgacugccaccgucgcggc

SEQ ID NO: 3612219 - RNA, 23 nt, Salmonella enterica enterica serovar Typhi
cgccgagacgcugcacacgcugg

SEQ ID NO: 3612220 - RNA, 12 nt, Salmonella enterica enterica serovar Typhi
cgccgagcaucg

SEQ ID NO: 3612221 - RNA, 15 nt, Salmonella enterica enterica serovar Typhi
cgccgagccgcccuu

SEQ ID NO: 3612222 - RNA, 18 nt, Salmonella enterica enterica serovar Typhi
cgccgaggcuaagccaga

SEQ ID NO: 3612223 - RNA, 16 nt, Salmonella enterica enterica serovar Typhi
cgccgaguaauuugaa

SEQ ID NO: 3612224 - RNA, 21 nt, Salmonella enterica enterica serovar Typhi
cgccgauaaccagcgcgccgc

SEQ ID NO: 3612225 - RNA, 21 nt, Salmonella enterica enterica serovar Typhi
cgccgauaccgcuaaucggga

SEQ ID NO: 3612226 - RNA, 15 nt, Salmonella enterica enterica serovar Typhi
cgccgaucagcacca

SEQ ID NO: 3612227 - RNA, 21 nt, Salmonella enterica enterica serovar Typhi
cgccgaucagcaccacgcccg

SEQ ID NO: 3612228 - RNA, 15 nt, Salmonella enterica enterica serovar Typhi
cgccgaucaucccgc

SEQ ID NO: 3612229 - RNA, 23 nt, Salmonella enterica enterica serovar Typhi
cgccgaucaucccgcccagcaac

SEQ ID NO: 3612230 - RNA, 15 nt, Salmonella enterica enterica serovar Typhi
cgccgaucggcguuu

SEQ ID NO: 3612231 - RNA, 21 nt, Salmonella enterica enterica serovar Typhi
cgccgaugaccaguggcguaa

SEQ ID NO: 3612232 - RNA, 14 nt, Salmonella enterica enterica serovar Typhi
cgccgaugccgccg

SEQ ID NO: 3612233 - RNA, 15 nt, Salmonella enterica enterica serovar Typhi
cgccgaugccgccga

SEQ ID NO: 3612234 - RNA, 18 nt, Salmonella enterica enterica serovar Typhi
cgccgaugccgccgacaa

SEQ ID NO: 3612235 - RNA, 16 nt, Salmonella enterica enterica serovar Typhi
cgccgauggcgccaga

SEQ ID NO: 3612236 - RNA, 15 nt, Salmonella enterica enterica serovar Typhi
cgccgauuccugcug

SEQ ID NO: 3612237 - RNA, 22 nt, Salmonella enterica enterica serovar Typhi
cgccgauugagggggaggcggc

SEQ ID NO: 3612238 - RNA, 16 nt, Salmonella enterica enterica serovar Typhi
cgccgggccugccagg

SEQ ID NO: 3612239 - RNA, 16 nt, Salmonella enterica enterica serovar Typhi
cgccgggcuauccggc

SEQ ID NO: 3612240 - RNA, 22 nt, Salmonella enterica enterica serovar Typhi
cgccggggaaaauauuagcggc

SEQ ID NO: 3612241 - RNA, 24 nt, Salmonella enterica enterica serovar Typhi
cgccggggauaucaaugcgcguaa

SEQ ID NO: 3612242 - RNA, 15 nt, Salmonella enterica enterica serovar Typhi
cgccgguacgcagca

SEQ ID NO: 3612243 - RNA, 16 nt, Salmonella enterica enterica serovar Typhi
cgccgguacgcagcag

SEQ ID NO: 3612244 - RNA, 16 nt, Salmonella enterica enterica serovar Typhi
cgccgguauagcgccu

SEQ ID NO: 3612245 - RNA, 15 nt, Salmonella enterica enterica serovar Typhi
cgccggucaugccau

SEQ ID NO: 3612246 - RNA, 21 nt, Salmonella enterica enterica serovar Typhi
cgccgguguuuagccugauac

SEQ ID NO: 3612247 - RNA, 22 nt, Salmonella enterica enterica serovar Typhi
cgccgguguuuccgucacuucc

SEQ ID NO: 3612248 - RNA, 16 nt, Salmonella enterica enterica serovar Typhi
cgccgguuccaacagc

SEQ ID NO: 3612249 - RNA, 14 nt, Salmonella enterica enterica serovar Typhi
cgccgguuuauccc

SEQ ID NO: 3612250 - RNA, 14 nt, Salmonella enterica enterica serovar Typhi
cgccguaaggcgcc

SEQ ID NO: 3612251 - RNA, 19 nt, Salmonella enterica enterica serovar Typhi
cgccguaaggcguaccgcc

SEQ ID NO: 3612252 - RNA, 23 nt, Salmonella enterica enterica serovar Typhi
cgccguacacguauaaacgccgc

SEQ ID NO: 3612253 - RNA, 20 nt, Salmonella enterica enterica serovar Typhi
cgccguacuccagcccauca

SEQ ID NO: 3612254 - RNA, 21 nt, Salmonella enterica enterica serovar Typhi
cgccguacuugacacaggcgu

SEQ ID NO: 3612255 - RNA, 22 nt, Salmonella enterica enterica serovar Typhi
cgccguacuugacacaggcgug

SEQ ID NO: 3612256 - RNA, 19 nt, Salmonella enterica enterica serovar Typhi
cgccguagcugcgcgccgc

SEQ ID NO: 3612257 - RNA, 13 nt, Salmonella enterica enterica serovar Typhi
cgccgucaggcua

SEQ ID NO: 3612258 - RNA, 20 nt, Salmonella enterica enterica serovar Typhi
cgccgucaggcuugccgcgc

SEQ ID NO: 3612259 - RNA, 17 nt, Salmonella enterica enterica serovar Typhi
cgccgucauaccgccca

SEQ ID NO: 3612260 - RNA, 14 nt, Salmonella enterica enterica serovar Typhi
cgccgucauccgcg

SEQ ID NO: 3612261 - RNA, 21 nt, Salmonella enterica enterica serovar Typhi
cgccgucgaugauggcggcua

SEQ ID NO: 3612262 - RNA, 18 nt, Salmonella enterica enterica serovar Typhi
cgccgucgcggcuacgga

SEQ ID NO: 3612263 - RNA, 16 nt, Salmonella enterica enterica serovar Typhi
cgccgucggcaauaaa

SEQ ID NO: 3612264 - RNA, 17 nt, Salmonella enterica enterica serovar Typhi
cgccgucguucagccag

SEQ ID NO: 3612265 - RNA, 22 nt, Salmonella enterica enterica serovar Typhi
cgccgucuucuucuucgcgcau

SEQ ID NO: 3612266 - RNA, 14 nt, Salmonella enterica enterica serovar Typhi
cgccgugaacgcca

SEQ ID NO: 3612267 - RNA, 23 nt, Salmonella enterica enterica serovar Typhi
cgccgugacuguucacauccagc

SEQ ID NO: 3612268 - RNA, 16 nt, Salmonella enterica enterica serovar Typhi
cgccgugcacuucugc

SEQ ID NO: 3612269 - RNA, 20 nt, Salmonella enterica enterica serovar Typhi
cgccgugcacuucugcggua

SEQ ID NO: 3612270 - RNA, 21 nt, Salmonella enterica enterica serovar Typhi
cgccgugcucacuaggcguua

SEQ ID NO: 3612271 - RNA, 20 nt, Salmonella enterica enterica serovar Typhi
cgccguggcggugacuuccu

SEQ ID NO: 3612272 - RNA, 21 nt, Salmonella enterica enterica serovar Typhi
cgccguggcggugacuuccug

SEQ ID NO: 3612273 - RNA, 17 nt, Salmonella enterica enterica serovar Typhi
cgccguguucuuaccca

SEQ ID NO: 3612274 - RNA, 22 nt, Salmonella enterica enterica serovar Typhi
cgccguguugugugccgcgcug

SEQ ID NO: 3612275 - RNA, 20 nt, Salmonella enterica enterica serovar Typhi
cgccguuaaaccguuaugaa

SEQ ID NO: 3612276 - RNA, 18 nt, Salmonella enterica enterica serovar Typhi
cgccguuaccaaucugcg

SEQ ID NO: 3612277 - RNA, 16 nt, Salmonella enterica enterica serovar Typhi
cgccguuaccagcauc

SEQ ID NO: 3612278 - RNA, 18 nt, Salmonella enterica enterica serovar Typhi
cgccguuaccagcaucaa

SEQ ID NO: 3612279 - RNA, 15 nt, Salmonella enterica enterica serovar Typhi
cgccguuccauucca

SEQ ID NO: 3612280 - RNA, 23 nt, Salmonella enterica enterica serovar Typhi
cgccguuggcguaaaucaggcca

SEQ ID NO: 3612281 - RNA, 22 nt, Salmonella enterica enterica serovar Typhi
cgccguuugccauaucuggaua

SEQ ID NO: 3612282 - RNA, 21 nt, Salmonella enterica enterica serovar Typhi
cgccuaaaucaagcagugacg

SEQ ID NO: 3612283 - RNA, 22 nt, Salmonella enterica enterica serovar Typhi
cgccuaagaucggguggccuaa

SEQ ID NO: 3612284 - RNA, 12 nt, Salmonella enterica enterica serovar Typhi
cgccuaccagca

SEQ ID NO: 3612285 - RNA, 14 nt, Salmonella enterica enterica serovar Typhi
cgccuaccgccaua

SEQ ID NO: 3612286 - RNA, 14 nt, Salmonella enterica enterica serovar Typhi
cgccuaccgcuucc

SEQ ID NO: 3612287 - RNA, 21 nt, Salmonella enterica enterica serovar Typhi
cgccuaggccagugccaagca

SEQ ID NO: 3612288 - RNA, 14 nt, Salmonella enterica enterica serovar Typhi
cgccuauuguucca

SEQ ID NO: 3612289 - RNA, 18 nt, Salmonella enterica enterica serovar Typhi
cgccuauuuucucuucca

SEQ ID NO: 3612290 - RNA, 19 nt, Salmonella enterica enterica serovar Typhi
cgccucaauugccgccagc

SEQ ID NO: 3612291 - RNA, 20 nt, Salmonella enterica enterica serovar Typhi
cgccucaucggcguugccca

SEQ ID NO: 3612292 - RNA, 21 nt, Salmonella enterica enterica serovar Typhi
cgccucauugauaccuaaacg

SEQ ID NO: 3612293 - RNA, 22 nt, Salmonella enterica enterica serovar Typhi
cgccuccaccguuugcagccag

SEQ ID NO: 3612294 - RNA, 18 nt, Salmonella enterica enterica serovar Typhi
cgccuccaggccggauaa

SEQ ID NO: 3612295 - RNA, 22 nt, Salmonella enterica enterica serovar Typhi
cgccuccccugccggcggcaga

SEQ ID NO: 3612296 - RNA, 24 nt, Salmonella enterica enterica serovar Typhi
cgccuccggggaagcgcgcgcaca

SEQ ID NO: 3612297 - RNA, 12 nt, Salmonella enterica enterica serovar Typhi
cgccuccugccg

SEQ ID NO: 3612298 - RNA, 22 nt, Salmonella enterica enterica serovar Typhi
cgccuccugccgaugccgccgc

SEQ ID NO: 3612299 - RNA, 19 nt, Salmonella enterica enterica serovar Typhi
cgccucgcgauccgccagc

SEQ ID NO: 3612300 - RNA, 14 nt, Salmonella enterica enterica serovar Typhi
cgccucgcucucuu

SEQ ID NO: 3612301 - RNA, 20 nt, Salmonella enterica enterica serovar Typhi
cgccucguaucugucccagc

SEQ ID NO: 3612302 - RNA, 17 nt, Salmonella enterica enterica serovar Typhi
cgccugaagauacgcca

SEQ ID NO: 3612303 - RNA, 23 nt, Salmonella enterica enterica serovar Typhi
cgccugacgaaagucauccagua

SEQ ID NO: 3612304 - RNA, 16 nt, Salmonella enterica enterica serovar Typhi
cgccugauccggccua

SEQ ID NO: 3612305 - RNA, 20 nt, Salmonella enterica enterica serovar Typhi
cgccugaucguuacccgugc

SEQ ID NO: 3612306 - RNA, 16 nt, Salmonella enterica enterica serovar Typhi
cgccugaucuuucugg

SEQ ID NO: 3612307 - RNA, 14 nt, Salmonella enterica enterica serovar Typhi
cgccugaugacgcu

SEQ ID NO: 3612308 - RNA, 14 nt, Salmonella enterica enterica serovar Typhi
cgccugaugcgccg

SEQ ID NO: 3612309 - RNA, 17 nt, Salmonella enterica enterica serovar Typhi
cgccugaugcgccgccu

SEQ ID NO: 3612310 - RNA, 16 nt, Salmonella enterica enterica serovar Typhi
cgccugaugcuggcag

SEQ ID NO: 3612311 - RNA, 14 nt, Salmonella enterica enterica serovar Typhi
cgccugauggcgac

SEQ ID NO: 3612312 - RNA, 15 nt, Salmonella enterica enterica serovar Typhi
cgccugauucauucc

SEQ ID NO: 3612313 - RNA, 11 nt, Salmonella enterica enterica serovar Typhi
cgccugcacca

SEQ ID NO: 3612314 - RNA, 13 nt, Salmonella enterica enterica serovar Typhi
cgccugccagaua

SEQ ID NO: 3612315 - RNA, 13 nt, Salmonella enterica enterica serovar Typhi
cgccugccagcgc

SEQ ID NO: 3612316 - RNA, 20 nt, Salmonella enterica enterica serovar Typhi
cgccugccauagcaucacca

SEQ ID NO: 3612317 - RNA, 14 nt, Salmonella enterica enterica serovar Typhi
cgccugccgcaugu

SEQ ID NO: 3612318 - RNA, 16 nt, Salmonella enterica enterica serovar Typhi
cgccugcgccagcgcc

SEQ ID NO: 3612319 - RNA, 22 nt, Salmonella enterica enterica serovar Typhi
cgccugcgguaaucgccgcgac

SEQ ID NO: 3612320 - RNA, 12 nt, Salmonella enterica enterica serovar Typhi
cgccugcuccgu

SEQ ID NO: 3612321 - RNA, 14 nt, Salmonella enterica enterica serovar Typhi
cgccugcugccagc

SEQ ID NO: 3612322 - RNA, 14 nt, Salmonella enterica enterica serovar Typhi
cgccugcugugccg

SEQ ID NO: 3612323 - RNA, 20 nt, Salmonella enterica enterica serovar Typhi
cgcgacucccaggcgcgcag

SEQ ID NO: 3612324 - RNA, 21 nt, Salmonella enterica enterica serovar Typhi
cgcgacuggaacgucaucauu

SEQ ID NO: 3612325 - RNA, 19 nt, Salmonella enterica enterica serovar Typhi
cgcgacuuuggcuuuaucc

SEQ ID NO: 3612326 - RNA, 19 nt, Salmonella enterica enterica serovar Typhi
cgcgagaaaauagaggaaa

SEQ ID NO: 3612327 - RNA, 14 nt, Salmonella enterica enterica serovar Typhi
cgcgagaacugcug

SEQ ID NO: 3612328 - RNA, 19 nt, Salmonella enterica enterica serovar Typhi
cgcgagaagcccggccaca

SEQ ID NO: 3612329 - RNA, 21 nt, Salmonella enterica enterica serovar Typhi
cgcgagaagcccggccacagc

SEQ ID NO: 3612330 - RNA, 13 nt, Salmonella enterica enterica serovar Typhi
cgcgagaaguucu

SEQ ID NO: 3612331 - RNA, 12 nt, Salmonella enterica enterica serovar Typhi
cgcgagcagcca

SEQ ID NO: 3612332 - RNA, 21 nt, Salmonella enterica enterica serovar Typhi
cgcgagccguaaacggaacca

SEQ ID NO: 3612333 - RNA, 21 nt, Salmonella enterica enterica serovar Typhi
cgcgagccuuuuaucaaugca

SEQ ID NO: 3612334 - RNA, 17 nt, Salmonella enterica enterica serovar Typhi
cgcgagcgugaucucau

SEQ ID NO: 3612335 - RNA, 20 nt, Salmonella enterica enterica serovar Typhi
cgcgaggcauaccgcccaga

SEQ ID NO: 3612336 - RNA, 17 nt, Salmonella enterica enterica serovar Typhi
cgcgaguauucgcgccc

SEQ ID NO: 3612337 - RNA, 18 nt, Salmonella enterica enterica serovar Typhi
cgcgagugucauccugcg

SEQ ID NO: 3612338 - RNA, 19 nt, Salmonella enterica enterica serovar Typhi
cgcgauaacguuaccgcag

SEQ ID NO: 3612339 - RNA, 20 nt, Salmonella enterica enterica serovar Typhi
cgcgauacacuccggcgcgc

SEQ ID NO: 3612340 - RNA, 22 nt, Salmonella enterica enterica serovar Typhi
cgcgauacacuccggcgcgcgc

SEQ ID NO: 3612341 - RNA, 15 nt, Salmonella enterica enterica serovar Typhi
cgcgauacccgcgau

SEQ ID NO: 3612342 - RNA, 21 nt, Salmonella enterica enterica serovar Typhi
cgcgauaccgccguagaaaau

SEQ ID NO: 3612343 - RNA, 18 nt, Salmonella enterica enterica serovar Typhi
cgcgauacgcagcaccgc

SEQ ID NO: 3612344 - RNA, 20 nt, Salmonella enterica enterica serovar Typhi
cgcgauacgcagcaccgccg

SEQ ID NO: 3612345 - RNA, 14 nt, Salmonella enterica enterica serovar Typhi
cgcgauacugccgc

SEQ ID NO: 3612346 - RNA, 16 nt, Salmonella enterica enterica serovar Typhi
cgcgauacugccgccc

SEQ ID NO: 3612347 - RNA, 15 nt, Salmonella enterica enterica serovar Typhi
cgcgauauccaccac

SEQ ID NO: 3612348 - RNA, 21 nt, Salmonella enterica enterica serovar Typhi
cgcgaucaaucacgccgauaa

SEQ ID NO: 3612349 - RNA, 21 nt, Salmonella enterica enterica serovar Typhi
cgcgauccagccccagcgcca

SEQ ID NO: 3612350 - RNA, 12 nt, Salmonella enterica enterica serovar Typhi
cgcgauccgcca

SEQ ID NO: 3612351 - RNA, 19 nt, Salmonella enterica enterica serovar Typhi
cgcgaucgaugugauaaau

SEQ ID NO: 3612352 - RNA, 13 nt, Salmonella enterica enterica serovar Typhi
cgcgaucgcgcca

SEQ ID NO: 3612353 - RNA, 17 nt, Salmonella enterica enterica serovar Typhi
cgcgaucgcgccagccu

SEQ ID NO: 3612354 - RNA, 14 nt, Salmonella enterica enterica serovar Typhi
cgcgaugacggcgc

SEQ ID NO: 3612355 - RNA, 15 nt, Salmonella enterica enterica serovar Typhi
cgcgaugacucguau

SEQ ID NO: 3612356 - RNA, 16 nt, Salmonella enterica enterica serovar Typhi
cgcgaugccuggcgau

SEQ ID NO: 3612357 - RNA, 11 nt, Salmonella enterica enterica serovar Typhi
cgcgaugcugc

SEQ ID NO: 3612358 - RNA, 19 nt, Salmonella enterica enterica serovar Typhi
cgcgauggugacuauucuu

SEQ ID NO: 3612359 - RNA, 15 nt, Salmonella enterica enterica serovar Typhi
cgcgauucgggccgc

SEQ ID NO: 3612360 - RNA, 15 nt, Salmonella enterica enterica serovar Typhi
cgcgauuuagcguug

SEQ ID NO: 3612361 - RNA, 17 nt, Salmonella enterica enterica serovar Typhi
cgcgauuuucaucaagc

SEQ ID NO: 3612362 - RNA, 20 nt, Salmonella enterica enterica serovar Typhi
cgcgcaaaacucucaccgac

SEQ ID NO: 3612363 - RNA, 19 nt, Salmonella enterica enterica serovar Typhi
cgcgcaaagccuuuccgca

SEQ ID NO: 3612364 - RNA, 15 nt, Salmonella enterica enterica serovar Typhi
cgcgcaaccgcauca

SEQ ID NO: 3612365 - RNA, 19 nt, Salmonella enterica enterica serovar Typhi
cgcgcaaucauuaccggac

SEQ ID NO: 3612366 - RNA, 21 nt, Salmonella enterica enterica serovar Typhi
cgcgcacaacgugcaaaacag

SEQ ID NO: 3612367 - RNA, 19 nt, Salmonella enterica enterica serovar Typhi
cgcgcacagggugaaauca

SEQ ID NO: 3612368 - RNA, 22 nt, Salmonella enterica enterica serovar Typhi
cgcgcaccauaauauaaggauc

SEQ ID NO: 3612369 - RNA, 16 nt, Salmonella enterica enterica serovar Typhi
cgcgcagaaucacuuc

SEQ ID NO: 3612370 - RNA, 18 nt, Salmonella enterica enterica serovar Typhi
cgcgcagaaucagcgugc

SEQ ID NO: 3612371 - RNA, 21 nt, Salmonella enterica enterica serovar Typhi
cgcgcagagauagccagcgau

SEQ ID NO: 3612372 - RNA, 22 nt, Salmonella enterica enterica serovar Typhi
cgcgcagcaacaguugcuggag

SEQ ID NO: 3612373 - RNA, 14 nt, Salmonella enterica enterica serovar Typhi
cgcgcagcaggcca

SEQ ID NO: 3612374 - RNA, 20 nt, Salmonella enterica enterica serovar Typhi
cgcgcagcaucugauagccc

SEQ ID NO: 3612375 - RNA, 17 nt, Salmonella enterica enterica serovar Typhi
cgcgcaggcgccgauaa

SEQ ID NO: 3612376 - RNA, 13 nt, Salmonella enterica enterica serovar Typhi
cgcgcaggcggaa

SEQ ID NO: 3612377 - RNA, 18 nt, Salmonella enterica enterica serovar Typhi
cgcgcaguucaauauuca

SEQ ID NO: 3612378 - RNA, 21 nt, Salmonella enterica enterica serovar Typhi
cgcgcaguuucuuaccuaccu

SEQ ID NO: 3612379 - RNA, 15 nt, Salmonella enterica enterica serovar Typhi
cgcgcaguuuuuauc

SEQ ID NO: 3612380 - RNA, 20 nt, Salmonella enterica enterica serovar Typhi
cgcgcauccugcauaaucca

SEQ ID NO: 3612381 - RNA, 22 nt, Salmonella enterica enterica serovar Typhi
cgcgcaucuucacuguuaucgc

SEQ ID NO: 3612382 - RNA, 11 nt, Salmonella enterica enterica serovar Typhi
cgcgcauggca

SEQ ID NO: 3612383 - RNA, 19 nt, Salmonella enterica enterica serovar Typhi
cgcgcauggcagggcgaua

SEQ ID NO: 3612384 - RNA, 16 nt, Salmonella enterica enterica serovar Typhi
cgcgcauugaccagga

SEQ ID NO: 3612385 - RNA, 19 nt, Salmonella enterica enterica serovar Typhi
cgcgccaaaagaggcagca

SEQ ID NO: 3612386 - RNA, 20 nt, Salmonella enterica enterica serovar Typhi
cgcgccaaaagaggcagcaa

SEQ ID NO: 3612387 - RNA, 15 nt, Salmonella enterica enterica serovar Typhi
cgcgccaaaccguuc

SEQ ID NO: 3612388 - RNA, 16 nt, Salmonella enterica enterica serovar Typhi
cgcgccaaaccguuca

SEQ ID NO: 3612389 - RNA, 16 nt, Salmonella enterica enterica serovar Typhi
cgcgccaaacggcagc

SEQ ID NO: 3612390 - RNA, 19 nt, Salmonella enterica enterica serovar Typhi
cgcgccaaagauaagaccg

SEQ ID NO: 3612391 - RNA, 18 nt, Salmonella enterica enterica serovar Typhi
cgcgccaaaguuaaucag

SEQ ID NO: 3612392 - RNA, 22 nt, Salmonella enterica enterica serovar Typhi
cgcgccaaaguuaaucagcgcc

SEQ ID NO: 3612393 - RNA, 16 nt, Salmonella enterica enterica serovar Typhi
cgcgccaauaacgcau

SEQ ID NO: 3612394 - RNA, 21 nt, Salmonella enterica enterica serovar Typhi
cgcgccaauccaugccggcuu

SEQ ID NO: 3612395 - RNA, 18 nt, Salmonella enterica enterica serovar Typhi
cgcgccaauggccgcccc

SEQ ID NO: 3612396 - RNA, 14 nt, Salmonella enterica enterica serovar Typhi
cgcgccacauacug

SEQ ID NO: 3612397 - RNA, 12 nt, Salmonella enterica enterica serovar Typhi
cgcgccacgcau

SEQ ID NO: 3612398 - RNA, 13 nt, Salmonella enterica enterica serovar Typhi
cgcgccacgcaug

SEQ ID NO: 3612399 - RNA, 13 nt, Salmonella enterica enterica serovar Typhi
cgcgccacgccau

SEQ ID NO: 3612400 - RNA, 14 nt, Salmonella enterica enterica serovar Typhi
cgcgccacgucgga

SEQ ID NO: 3612401 - RNA, 17 nt, Salmonella enterica enterica serovar Typhi
cgcgccacgucggauaa

SEQ ID NO: 3612402 - RNA, 13 nt, Salmonella enterica enterica serovar Typhi
cgcgccacuucca

SEQ ID NO: 3612403 - RNA, 12 nt, Salmonella enterica enterica serovar Typhi
cgcgccagcagg

SEQ ID NO: 3612404 - RNA, 16 nt, Salmonella enterica enterica serovar Typhi
cgcgccagccaauguc

SEQ ID NO: 3612405 - RNA, 13 nt, Salmonella enterica enterica serovar Typhi
cgcgccagcgaca

SEQ ID NO: 3612406 - RNA, 12 nt, Salmonella enterica enterica serovar Typhi
cgcgccagcgau

SEQ ID NO: 3612407 - RNA, 13 nt, Salmonella enterica enterica serovar Typhi
cgcgccagcggau

SEQ ID NO: 3612408 - RNA, 21 nt, Salmonella enterica enterica serovar Typhi
cgcgccagcggauugccauac

SEQ ID NO: 3612409 - RNA, 23 nt, Salmonella enterica enterica serovar Typhi
cgcggaccguguucaugcagcca

SEQ ID NO: 3612410 - RNA, 14 nt, Salmonella enterica enterica serovar Typhi
cgcggacgccacca

SEQ ID NO: 3612411 - RNA, 22 nt, Salmonella enterica enterica serovar Typhi
cgcggagagaucgacagcgcgc

SEQ ID NO: 3612412 - RNA, 16 nt, Salmonella enterica enterica serovar Typhi
cgcggauaagcccggc

SEQ ID NO: 3612413 - RNA, 18 nt, Salmonella enterica enterica serovar Typhi
cgcggauaagcccggcgg

SEQ ID NO: 3612414 - RNA, 17 nt, Salmonella enterica enterica serovar Typhi
cgcggauaugcagcagc

SEQ ID NO: 3612415 - RNA, 20 nt, Salmonella enterica enterica serovar Typhi
cgcggaucagacggcugacc

SEQ ID NO: 3612416 - RNA, 14 nt, Salmonella enterica enterica serovar Typhi
cgcggaucggcaca

SEQ ID NO: 3612417 - RNA, 20 nt, Salmonella enterica enterica serovar Typhi
cgcggaucggcacacagcca

SEQ ID NO: 3612418 - RNA, 21 nt, Salmonella enterica enterica serovar Typhi
cgcggaucgugauaacgcgau

SEQ ID NO: 3612419 - RNA, 16 nt, Salmonella enterica enterica serovar Typhi
cgcggcaaaccccgga

SEQ ID NO: 3612420 - RNA, 15 nt, Salmonella enterica enterica serovar Typhi
cgcggcaaauaccgg

SEQ ID NO: 3612421 - RNA, 15 nt, Salmonella enterica enterica serovar Typhi
cgcggcaaccagccc

SEQ ID NO: 3612422 - RNA, 22 nt, Salmonella enterica enterica serovar Typhi
cgcggcaaccguauccagaccc

SEQ ID NO: 3612423 - RNA, 13 nt, Salmonella enterica enterica serovar Typhi
cgcggcaaugagc

SEQ ID NO: 3612424 - RNA, 22 nt, Salmonella enterica enterica serovar Typhi
cgcggcaaugagcggccagcgg

SEQ ID NO: 3612425 - RNA, 22 nt, Salmonella enterica enterica serovar Typhi
cgcggcacacuuucaucagccg

SEQ ID NO: 3612426 - RNA, 14 nt, Salmonella enterica enterica serovar Typhi
cgcggcagccggaa

SEQ ID NO: 3612427 - RNA, 14 nt, Salmonella enterica enterica serovar Typhi
cgcggcagcgcgca

SEQ ID NO: 3612428 - RNA, 13 nt, Salmonella enterica enterica serovar Typhi
cgcggcaucaggc

SEQ ID NO: 3612429 - RNA, 20 nt, Salmonella enterica enterica serovar Typhi
cgcggcaucguagucaggca

SEQ ID NO: 3612430 - RNA, 16 nt, Salmonella enterica enterica serovar Typhi
cgcggccaaaacccac

SEQ ID NO: 3612431 - RNA, 21 nt, Salmonella enterica enterica serovar Typhi
cgcggccagcaucguaccgug

SEQ ID NO: 3612432 - RNA, 19 nt, Salmonella enterica enterica serovar Typhi
cgcggccccaucagcacau

SEQ ID NO: 3612433 - RNA, 22 nt, Salmonella enterica enterica serovar Typhi
cgcggccuccggaucgacagca

SEQ ID NO: 3612434 - RNA, 19 nt, Salmonella enterica enterica serovar Typhi
cgcggccuuugccuucgcc

SEQ ID NO: 3612435 - RNA, 16 nt, Salmonella enterica enterica serovar Typhi
cgcggcgaaaaagccg

SEQ ID NO: 3612436 - RNA, 16 nt, Salmonella enterica enterica serovar Typhi
cgcggcgaaauaggcc

SEQ ID NO: 3612437 - RNA, 16 nt, Salmonella enterica enterica serovar Typhi
cgcggcgaaccggcau

SEQ ID NO: 3612438 - RNA, 20 nt, Salmonella enterica enterica serovar Typhi
cgcggcgaaccggcaucggc

SEQ ID NO: 3612439 - RNA, 23 nt, Salmonella enterica enterica serovar Typhi
cgcggcgcaacuuuuucgaugau

SEQ ID NO: 3612440 - RNA, 23 nt, Salmonella enterica enterica serovar Typhi
cgcggcgccgaagcaggcggaga

SEQ ID NO: 3612441 - RNA, 22 nt, Salmonella enterica enterica serovar Typhi
cgcggcgcgucuucccggcgcu

SEQ ID NO: 3612442 - RNA, 14 nt, Salmonella enterica enterica serovar Typhi
cgcggcgcucgcca

SEQ ID NO: 3612443 - RNA, 15 nt, Salmonella enterica enterica serovar Typhi
cgcggcgguucaucc

SEQ ID NO: 3612444 - RNA, 22 nt, Salmonella enterica enterica serovar Typhi
cgcggcguacacuucauccggc

SEQ ID NO: 3612445 - RNA, 14 nt, Salmonella enterica enterica serovar Typhi
cgcggcguaccgcg

SEQ ID NO: 3612446 - RNA, 19 nt, Salmonella enterica enterica serovar Typhi
cgcggcguaccgcgcgccc

SEQ ID NO: 3612447 - RNA, 14 nt, Salmonella enterica enterica serovar Typhi
cgcggcucaccagc

SEQ ID NO: 3612448 - RNA, 23 nt, Salmonella enterica enterica serovar Typhi
cgcggcucaccagcugacgcagc

SEQ ID NO: 3612449 - RNA, 13 nt, Salmonella enterica enterica serovar Typhi
cgcggcuccggcu

SEQ ID NO: 3612450 - RNA, 16 nt, Salmonella enterica enterica serovar Typhi
cgcggcugccgucgau

SEQ ID NO: 3612451 - RNA, 16 nt, Salmonella enterica enterica serovar Typhi
cgcgggauaucgcugg

SEQ ID NO: 3612452 - RNA, 21 nt, Salmonella enterica enterica serovar Typhi
cgcgggcgauuaucucgauau

SEQ ID NO: 3612453 - RNA, 13 nt, Salmonella enterica enterica serovar Typhi
cgcgggcgguauu

SEQ ID NO: 3612454 - RNA, 22 nt, Salmonella enterica enterica serovar Typhi
cgcgggcgguauuauccgccgc

SEQ ID NO: 3612455 - RNA, 14 nt, Salmonella enterica enterica serovar Typhi
cgcgggcuggccgg

SEQ ID NO: 3612456 - RNA, 15 nt, Salmonella enterica enterica serovar Typhi
cgcgggcuggccggc

SEQ ID NO: 3612457 - RNA, 16 nt, Salmonella enterica enterica serovar Typhi
cgcgggcuucacguug

SEQ ID NO: 3612458 - RNA, 20 nt, Salmonella enterica enterica serovar Typhi
cgcggggaucgguuuauccc

SEQ ID NO: 3612459 - RNA, 14 nt, Salmonella enterica enterica serovar Typhi
cgcgguaaauuccg

SEQ ID NO: 3612460 - RNA, 13 nt, Salmonella enterica enterica serovar Typhi
cgcgguaacgccu

SEQ ID NO: 3612461 - RNA, 21 nt, Salmonella enterica enterica serovar Typhi
cgcgguauuucgcaacgccgc

SEQ ID NO: 3612462 - RNA, 12 nt, Salmonella enterica enterica serovar Typhi
cgcggucagcgg

SEQ ID NO: 3612463 - RNA, 19 nt, Salmonella enterica enterica serovar Typhi
cgcggucagcggcgcgccg

SEQ ID NO: 3612464 - RNA, 17 nt, Salmonella enterica enterica serovar Typhi
cgcggucauugagccgc

SEQ ID NO: 3612465 - RNA, 23 nt, Salmonella enterica enterica serovar Typhi
cgcggugacuuuggccggcuucu

SEQ ID NO: 3612466 - RNA, 22 nt, Salmonella enterica enterica serovar Typhi
cgcggugaucccaggccggcau

SEQ ID NO: 3612467 - RNA, 18 nt, Salmonella enterica enterica serovar Typhi
cgcgguuaacagccgcug

SEQ ID NO: 3612468 - RNA, 21 nt, Salmonella enterica enterica serovar Typhi
cgcgguucuguuccgcuaucu

SEQ ID NO: 3612469 - RNA, 13 nt, Salmonella enterica enterica serovar Typhi
cgcgguugacgcu

SEQ ID NO: 3612470 - RNA, 16 nt, Salmonella enterica enterica serovar Typhi
cgcgguuuacuucuuc

SEQ ID NO: 3612471 - RNA, 19 nt, Salmonella enterica enterica serovar Typhi
cgcgguuuauccccgcugg

SEQ ID NO: 3612472 - RNA, 17 nt, Salmonella enterica enterica serovar Typhi
cgcgguuucguggcgcu

SEQ ID NO: 3612473 - RNA, 19 nt, Salmonella enterica enterica serovar Typhi
cgcguaaacgcaacaccau

SEQ ID NO: 3612474 - RNA, 20 nt, Salmonella enterica enterica serovar Typhi
cgcguaaauccacauuccag

SEQ ID NO: 3612475 - RNA, 21 nt, Salmonella enterica enterica serovar Typhi
cgcguaaccccugcccgcgau

SEQ ID NO: 3612476 - RNA, 17 nt, Salmonella enterica enterica serovar Typhi
cgcguaagcuuaauggc

SEQ ID NO: 3612477 - RNA, 20 nt, Salmonella enterica enterica serovar Typhi
cgcguaaucuuccacccgcg

SEQ ID NO: 3612478 - RNA, 13 nt, Salmonella enterica enterica serovar Typhi
cgcguaauuugcg

SEQ ID NO: 3612479 - RNA, 14 nt, Salmonella enterica enterica serovar Typhi
cgcguaccucagca

SEQ ID NO: 3612480 - RNA, 12 nt, Salmonella enterica enterica serovar Typhi
cgcguagcagca

SEQ ID NO: 3612481 - RNA, 14 nt, Salmonella enterica enterica serovar Typhi
cgcguagcccagcg

SEQ ID NO: 3612482 - RNA, 16 nt, Salmonella enterica enterica serovar Typhi
cgcguagcccagcgcc

SEQ ID NO: 3612483 - RNA, 19 nt, Salmonella enterica enterica serovar Typhi
cgcguagcccagcgccgca

SEQ ID NO: 3612484 - RNA, 13 nt, Salmonella enterica enterica serovar Typhi
cgcguagcgccaa

SEQ ID NO: 3612485 - RNA, 15 nt, Salmonella enterica enterica serovar Typhi
cgcguauaacgccgc

SEQ ID NO: 3612486 - RNA, 19 nt, Salmonella enterica enterica serovar Typhi
cgcguauaacgccgccccc

SEQ ID NO: 3612487 - RNA, 19 nt, Salmonella enterica enterica serovar Typhi
cgcguauucucaaccagcc

SEQ ID NO: 3612488 - RNA, 17 nt, Salmonella enterica enterica serovar Typhi
cgcgucacaacagccgg

SEQ ID NO: 3612489 - RNA, 23 nt, Salmonella enterica enterica serovar Typhi
cgcgucacaaucgcgccugccag

SEQ ID NO: 3612490 - RNA, 18 nt, Salmonella enterica enterica serovar Typhi
cgcgucacgaccggcgaa

SEQ ID NO: 3612491 - RNA, 18 nt, Salmonella enterica enterica serovar Typhi
cgcgucagcgccuccgcg

SEQ ID NO: 3612492 - RNA, 11 nt, Salmonella enterica enterica serovar Typhi
cgcgucagggc

SEQ ID NO: 3612493 - RNA, 14 nt, Salmonella enterica enterica serovar Typhi
cgcgucagggcgau

SEQ ID NO: 3612494 - RNA, 15 nt, Salmonella enterica enterica serovar Typhi
cgcucagcaucgcau

SEQ ID NO: 3612495 - RNA, 16 nt, Salmonella enterica enterica serovar Typhi
cgcucagccagaaacg

SEQ ID NO: 3612496 - RNA, 18 nt, Salmonella enterica enterica serovar Typhi
cgcucaggagcgccugac

SEQ ID NO: 3612497 - RNA, 20 nt, Salmonella enterica enterica serovar Typhi
cgcucaucacaucgcgcagc

SEQ ID NO: 3612498 - RNA, 14 nt, Salmonella enterica enterica serovar Typhi
cgcucaucggcggc

SEQ ID NO: 3612499 - RNA, 22 nt, Salmonella enterica enterica serovar Typhi
cgcucaugauucuugcggauua

SEQ ID NO: 3612500 - RNA, 14 nt, Salmonella enterica enterica serovar Typhi
cgcucaugccacgc

SEQ ID NO: 3612501 - RNA, 15 nt, Salmonella enterica enterica serovar Typhi
cgcucaugcgccugg

SEQ ID NO: 3612502 - RNA, 13 nt, Salmonella enterica enterica serovar Typhi
cgcucauuugcga

SEQ ID NO: 3612503 - RNA, 14 nt, Salmonella enterica enterica serovar Typhi
cgcuccaccgccgg

SEQ ID NO: 3612504 - RNA, 19 nt, Salmonella enterica enterica serovar Typhi
cgcuccacugauaguccau

SEQ ID NO: 3612505 - RNA, 11 nt, Salmonella enterica enterica serovar Typhi
cgcuccagaag

SEQ ID NO: 3612506 - RNA, 17 nt, Salmonella enterica enterica serovar Typhi
cgcuccagaccaccagc

SEQ ID NO: 3612507 - RNA, 16 nt, Salmonella enterica enterica serovar Typhi
cgcuccagcaguucua

SEQ ID NO: 3612508 - RNA, 15 nt, Salmonella enterica enterica serovar Typhi
cgcuccagcuggcug

SEQ ID NO: 3612509 - RNA, 22 nt, Salmonella enterica enterica serovar Typhi
cgcuccagggauugauggccag

SEQ ID NO: 3612510 - RNA, 14 nt, Salmonella enterica enterica serovar Typhi
cgcucccgcgcgcu

SEQ ID NO: 3612511 - RNA, 14 nt, Salmonella enterica enterica serovar Typhi
cgcucccuuccccc

SEQ ID NO: 3612512 - RNA, 15 nt, Salmonella enterica enterica serovar Typhi
cgcuccgacaaacuu

SEQ ID NO: 3612513 - RNA, 15 nt, Salmonella enterica enterica serovar Typhi
cgcuccggcgcuggc

SEQ ID NO: 3612514 - RNA, 14 nt, Salmonella enterica enterica serovar Typhi
cgcuccugcuccca

SEQ ID NO: 3612515 - RNA, 16 nt, Salmonella enterica enterica serovar Typhi
cgcuccugcucccaga

SEQ ID NO: 3612516 - RNA, 20 nt, Salmonella enterica enterica serovar Typhi
cgcucgccagcauacgucug

SEQ ID NO: 3612517 - RNA, 14 nt, Salmonella enterica enterica serovar Typhi
cgcucgcccgccgc

SEQ ID NO: 3612518 - RNA, 18 nt, Salmonella enterica enterica serovar Typhi
cgcucgcggaagcgaccg

SEQ ID NO: 3612519 - RNA, 22 nt, Salmonella enterica enterica serovar Typhi
cgcucgcggaagcgaccggcgu

SEQ ID NO: 3612520 - RNA, 21 nt, Salmonella enterica enterica serovar Typhi
cgcucgcggcagauaucgcug

SEQ ID NO: 3612521 - RNA, 18 nt, Salmonella enterica enterica serovar Typhi
cgcucgcuuugccgccau

SEQ ID NO: 3612522 - RNA, 13 nt, Salmonella enterica enterica serovar Typhi
cgcucggcauaca

SEQ ID NO: 3612523 - RNA, 20 nt, Salmonella enterica enterica serovar Typhi
cgcucggcauacaccgccag

SEQ ID NO: 3612524 - RNA, 21 nt, Salmonella enterica enterica serovar Typhi
cgcucggcauacaccgccagc

SEQ ID NO: 3612525 - RNA, 16 nt, Salmonella enterica enterica serovar Typhi
cgcucggccagauaac

SEQ ID NO: 3612526 - RNA, 18 nt, Salmonella enterica enterica serovar Typhi
cgcucggugacggaaacc

SEQ ID NO: 3612527 - RNA, 16 nt, Salmonella enterica enterica serovar Typhi
cgcucguacaaaucac

SEQ ID NO: 3612528 - RNA, 19 nt, Salmonella enterica enterica serovar Typhi
cgcucuauauccugcccuu

SEQ ID NO: 3612529 - RNA, 18 nt, Salmonella enterica enterica serovar Typhi
cgcucuaucaccgcccgc

SEQ ID NO: 3612530 - RNA, 16 nt, Salmonella enterica enterica serovar Typhi
cgcucuaucgccgccc

SEQ ID NO: 3612531 - RNA, 18 nt, Salmonella enterica enterica serovar Typhi
cgcucuaucgccgcccgc

SEQ ID NO: 3612532 - RNA, 14 nt, Salmonella enterica enterica serovar Typhi
cgcucucagcgucg

SEQ ID NO: 3612533 - RNA, 15 nt, Salmonella enterica enterica serovar Typhi
cgcucucagcgucgg

SEQ ID NO: 3612534 - RNA, 15 nt, Salmonella enterica enterica serovar Typhi
cgcucucgccgcgcu

SEQ ID NO: 3612535 - RNA, 23 nt, Salmonella enterica enterica serovar Typhi
cgcucucuuucaccagcgccaga

SEQ ID NO: 3612536 - RNA, 15 nt, Salmonella enterica enterica serovar Typhi
cgcucugcuguuccu

SEQ ID NO: 3612537 - RNA, 12 nt, Salmonella enterica enterica serovar Typhi
cgcucuuaccgc

SEQ ID NO: 3612538 - RNA, 13 nt, Salmonella enterica enterica serovar Typhi
cgcucuuccgcca

SEQ ID NO: 3612539 - RNA, 15 nt, Salmonella enterica enterica serovar Typhi
cgcucuuccgccagc

SEQ ID NO: 3612540 - RNA, 15 nt, Salmonella enterica enterica serovar Typhi
cgcucuuuacauaau

SEQ ID NO: 3612541 - RNA, 21 nt, Salmonella enterica enterica serovar Typhi
cgcugaaaacggcaucaagcc

SEQ ID NO: 3612542 - RNA, 15 nt, Salmonella enterica enterica serovar Typhi
cgcugaccacgccgc

SEQ ID NO: 3612543 - RNA, 21 nt, Salmonella enterica enterica serovar Typhi
cgcugaccuuuuucauccuca

SEQ ID NO: 3612544 - RNA, 20 nt, Salmonella enterica enterica serovar Typhi
cgcugacgccgaccaccgcc

SEQ ID NO: 3612545 - RNA, 14 nt, Salmonella enterica enterica serovar Typhi
cgcugacugaacuc

SEQ ID NO: 3612546 - RNA, 21 nt, Salmonella enterica enterica serovar Typhi
cgcugagcggcucauccagca

SEQ ID NO: 3612547 - RNA, 19 nt, Salmonella enterica enterica serovar Typhi
cgcugaguacgcaccagcc

SEQ ID NO: 3612548 - RNA, 21 nt, Salmonella enterica enterica serovar Typhi
cgcugaguggucuggacaugu

SEQ ID NO: 3612549 - RNA, 21 nt, Salmonella enterica enterica serovar Typhi
cgcugaguuucucccgccaga

SEQ ID NO: 3612550 - RNA, 22 nt, Salmonella enterica enterica serovar Typhi
cgcugaguuucucccgccagau

SEQ ID NO: 3612551 - RNA, 17 nt, Salmonella enterica enterica serovar Typhi
cgcugauaaucguauca

SEQ ID NO: 3612552 - RNA, 12 nt, Salmonella enterica enterica serovar Typhi
cgcugaucgcca

SEQ ID NO: 3612553 - RNA, 16 nt, Salmonella enterica enterica serovar Typhi
cgcugaucgccacgcc

SEQ ID NO: 3612554 - RNA, 16 nt, Salmonella enterica enterica serovar Typhi
cgcugaugaaaaccca

SEQ ID NO: 3612555 - RNA, 18 nt, Salmonella enterica enterica serovar Typhi
cgcugaugugcggccugg

SEQ ID NO: 3612556 - RNA, 19 nt, Salmonella enterica enterica serovar Typhi
cgcugauguuuugcgccgc

SEQ ID NO: 3612557 - RNA, 20 nt, Salmonella enterica enterica serovar Typhi
cgcugauguuuugcgccgcg

SEQ ID NO: 3612558 - RNA, 23 nt, Salmonella enterica enterica serovar Typhi
cgcugauguuuugcgccgcgcgu

SEQ ID NO: 3612559 - RNA, 16 nt, Salmonella enterica enterica serovar Typhi
cgcugauuuguuaucu

SEQ ID NO: 3612560 - RNA, 18 nt, Salmonella enterica enterica serovar Typhi
cgcugauuuucuccagca

SEQ ID NO: 3612561 - RNA, 16 nt, Salmonella enterica enterica serovar Typhi
cgcugcagauuuugcu

SEQ ID NO: 3612562 - RNA, 20 nt, Salmonella enterica enterica serovar Typhi
cgcugccacacucucuccag

SEQ ID NO: 3612563 - RNA, 14 nt, Salmonella enterica enterica serovar Typhi
cgcugccagcugcg

SEQ ID NO: 3612564 - RNA, 22 nt, Salmonella enterica enterica serovar Typhi
cgcugccagcugcgucagcgcu

SEQ ID NO: 3612565 - RNA, 15 nt, Salmonella enterica enterica serovar Typhi
cgcugcccugacucg

SEQ ID NO: 3612566 - RNA, 14 nt, Salmonella enterica enterica serovar Typhi
cgcugccgcccuuu

SEQ ID NO: 3612567 - RNA, 16 nt, Salmonella enterica enterica serovar Typhi
cgcugccgcccuuucc

SEQ ID NO: 3612568 - RNA, 19 nt, Salmonella enterica enterica serovar Typhi
cgcugccggaaagccccag

SEQ ID NO: 3612569 - RNA, 21 nt, Salmonella enterica enterica serovar Typhi
cgcugccuuccgggcggcugu

SEQ ID NO: 3612570 - RNA, 15 nt, Salmonella enterica enterica serovar Typhi
cgcugcgaagugaau

SEQ ID NO: 3612571 - RNA, 13 nt, Salmonella enterica enterica serovar Typhi
cgcugcgccagau

SEQ ID NO: 3612572 - RNA, 17 nt, Salmonella enterica enterica serovar Typhi
cgcugcgccgcgccacc

SEQ ID NO: 3612573 - RNA, 18 nt, Salmonella enterica enterica serovar Typhi
cgcugcgccugcugccag

SEQ ID NO: 3612574 - RNA, 15 nt, Salmonella enterica enterica serovar Typhi
cgcugcgcggcgugc

SEQ ID NO: 3612575 - RNA, 14 nt, Salmonella enterica enterica serovar Typhi
cgcugcgcucacgc

SEQ ID NO: 3612576 - RNA, 19 nt, Salmonella enterica enterica serovar Typhi
cgcugcgcuuacccagucu

SEQ ID NO: 3612577 - RNA, 18 nt, Salmonella enterica enterica serovar Typhi
cgcugcgcuuaccgggcc

SEQ ID NO: 3612578 - RNA, 19 nt, Salmonella enterica enterica serovar Typhi
cgcugcgcuuaccgggccu

SEQ ID NO: 3612579 - RNA, 20 nt, Salmonella enterica enterica serovar Typhi
cgcugcgcuuaccgggccua

SEQ ID NO: 3612580 - RNA, 15 nt, Salmonella enterica enterica serovar Typhi
cgcuuccaccucuuc

SEQ ID NO: 3612581 - RNA, 12 nt, Salmonella enterica enterica serovar Typhi
cgcuuccagaau

SEQ ID NO: 3612582 - RNA, 14 nt, Salmonella enterica enterica serovar Typhi
cgcuuccagcgcau

SEQ ID NO: 3612583 - RNA, 18 nt, Salmonella enterica enterica serovar Typhi
cgcuucccgaugccagca

SEQ ID NO: 3612584 - RNA, 13 nt, Salmonella enterica enterica serovar Typhi
cgcuuccugcagu

SEQ ID NO: 3612585 - RNA, 11 nt, Salmonella enterica enterica serovar Typhi
cgcuuccuggg

SEQ ID NO: 3612586 - RNA, 16 nt, Salmonella enterica enterica serovar Typhi
cgcuucgaugcguuca

SEQ ID NO: 3612587 - RNA, 19 nt, Salmonella enterica enterica serovar Typhi
cgcuucgcuugcccggccu

SEQ ID NO: 3612588 - RNA, 20 nt, Salmonella enterica enterica serovar Typhi
cgcuucgcuugcccggccua

SEQ ID NO: 3612589 - RNA, 16 nt, Salmonella enterica enterica serovar Typhi
cgcuucguuccgcgau

SEQ ID NO: 3612590 - RNA, 18 nt, Salmonella enterica enterica serovar Typhi
cgcuucuaacgaaacaga

SEQ ID NO: 3612591 - RNA, 16 nt, Salmonella enterica enterica serovar Typhi
cgcuucuacagccacc

SEQ ID NO: 3612592 - RNA, 18 nt, Salmonella enterica enterica serovar Typhi
cgcuucuauuaccgcagc

SEQ ID NO: 3612593 - RNA, 23 nt, Salmonella enterica enterica serovar Typhi
cgcuucucuauacggcgcgcagu

SEQ ID NO: 3612594 - RNA, 18 nt, Salmonella enterica enterica serovar Typhi
cgcuucuggcguaaugcg

SEQ ID NO: 3612595 - RNA, 12 nt, Salmonella enterica enterica serovar Typhi
cgcuucuucaug

SEQ ID NO: 3612596 - RNA, 23 nt, Salmonella enterica enterica serovar Typhi
cgcuucuucggcagcuuccagca

SEQ ID NO: 3612597 - RNA, 20 nt, Salmonella enterica enterica serovar Typhi
cgcuucuuugaaauugauca

SEQ ID NO: 3612598 - RNA, 14 nt, Salmonella enterica enterica serovar Typhi
cgcuugauacgcca

SEQ ID NO: 3612599 - RNA, 17 nt, Salmonella enterica enterica serovar Typhi
cgcuugauacgccaucu

SEQ ID NO: 3612600 - RNA, 13 nt, Salmonella enterica enterica serovar Typhi
cgcuugcauggca

SEQ ID NO: 3612601 - RNA, 12 nt, Salmonella enterica enterica serovar Typhi
cgcuugccacua

SEQ ID NO: 3612602 - RNA, 14 nt, Salmonella enterica enterica serovar Typhi
cgcuugcgccgcca

SEQ ID NO: 3612603 - RNA, 14 nt, Salmonella enterica enterica serovar Typhi
cgcuugcuccgcag

SEQ ID NO: 3612604 - RNA, 16 nt, Salmonella enterica enterica serovar Typhi
cgcuugugccugcugc

SEQ ID NO: 3612605 - RNA, 14 nt, Salmonella enterica enterica serovar Typhi
cgcuuuacaugacg

SEQ ID NO: 3612606 - RNA, 21 nt, Salmonella enterica enterica serovar Typhi
cgcuuuacccgggccaucuuu

SEQ ID NO: 3612607 - RNA, 15 nt, Salmonella enterica enterica serovar Typhi
cgcuuuaccgccuuc

SEQ ID NO: 3612608 - RNA, 14 nt, Salmonella enterica enterica serovar Typhi
cgcuuuagcgauaa

SEQ ID NO: 3612609 - RNA, 19 nt, Salmonella enterica enterica serovar Typhi
cgcuuuagcguaggccaca

SEQ ID NO: 3612610 - RNA, 21 nt, Salmonella enterica enterica serovar Typhi
cgcuuuaggguaucauuucca

SEQ ID NO: 3612611 - RNA, 12 nt, Salmonella enterica enterica serovar Typhi
cgcuuucaaucg

SEQ ID NO: 3612612 - RNA, 13 nt, Salmonella enterica enterica serovar Typhi
cgcuuucaccauc

SEQ ID NO: 3612613 - RNA, 16 nt, Salmonella enterica enterica serovar Typhi
cgcuuucaguaauaau

SEQ ID NO: 3612614 - RNA, 14 nt, Salmonella enterica enterica serovar Typhi
cgcuuucauacgac

SEQ ID NO: 3612615 - RNA, 16 nt, Salmonella enterica enterica serovar Typhi
cgcuuuccaguugcgg

SEQ ID NO: 3612616 - RNA, 14 nt, Salmonella enterica enterica serovar Typhi
cgcuuucccggcau

SEQ ID NO: 3612617 - RNA, 19 nt, Salmonella enterica enterica serovar Typhi
cgcuuucugagccgcccgg

SEQ ID NO: 3612618 - RNA, 19 nt, Salmonella enterica enterica serovar Typhi
cgcuuugacauugucauaa

SEQ ID NO: 3612619 - RNA, 22 nt, Salmonella enterica enterica serovar Typhi
cgcuuugaggaucaauuuuucg

SEQ ID NO: 3612620 - RNA, 21 nt, Salmonella enterica enterica serovar Typhi
cgcuuugauguccggcgcguu

SEQ ID NO: 3612621 - RNA, 15 nt, Salmonella enterica enterica serovar Typhi
cgcuuugccgccauc

SEQ ID NO: 3612622 - RNA, 22 nt, Salmonella enterica enterica serovar Typhi
cgcuuugcuuauccggccuaca

SEQ ID NO: 3612623 - RNA, 15 nt, Salmonella enterica enterica serovar Typhi
cgcuuuggaggucau

SEQ ID NO: 3612624 - RNA, 22 nt, Salmonella enterica enterica serovar Typhi
cgcuuugucgaacuuacgacgc

SEQ ID NO: 3612625 - RNA, 16 nt, Salmonella enterica enterica serovar Typhi
cgcuuuuaauugcgca

SEQ ID NO: 3612626 - RNA, 19 nt, Salmonella enterica enterica serovar Typhi
cgcuuuuaauugcgcauca

SEQ ID NO: 3612627 - RNA, 19 nt, Salmonella enterica enterica serovar Typhi
cgcuuuuacucuuccugcu

SEQ ID NO: 3612628 - RNA, 20 nt, Salmonella enterica enterica serovar Typhi
cgcuuuuaucggcgucgcgg

SEQ ID NO: 3612629 - RNA, 15 nt, Salmonella enterica enterica serovar Typhi
cgcuuuuccccgcag

SEQ ID NO: 3612630 - RNA, 20 nt, Salmonella enterica enterica serovar Typhi
cgcuuuugguuuuucaacca

SEQ ID NO: 3612631 - RNA, 14 nt, Salmonella enterica enterica serovar Typhi
cgcuuuuugcgcca

SEQ ID NO: 3612632 - RNA, 17 nt, Salmonella enterica enterica serovar Typhi
cgcuuuuugcuucgcca

SEQ ID NO: 3612633 - RNA, 20 nt, Salmonella enterica enterica serovar Typhi
cgcuuuuuuaaacgccugau

SEQ ID NO: 3612634 - RNA, 21 nt, Salmonella enterica enterica serovar Typhi
cgcuuuuuuaacgauuucccc

SEQ ID NO: 3612635 - RNA, 23 nt, Salmonella enterica enterica serovar Typhi
cgcuuuuuuaacgauuuccccug

SEQ ID NO: 3612636 - RNA, 14 nt, Salmonella enterica enterica serovar Typhi
cgcuuuuuucucug

SEQ ID NO: 3612637 - RNA, 16 nt, Salmonella enterica enterica serovar Typhi
cgcuuuuuucucugcu

SEQ ID NO: 3612638 - RNA, 18 nt, Salmonella enterica enterica serovar Typhi
cggaaaaaaauuucugcc

SEQ ID NO: 3612639 - RNA, 13 nt, Salmonella enterica enterica serovar Typhi
cggaaaaaacguu

SEQ ID NO: 3612640 - RNA, 20 nt, Salmonella enterica enterica serovar Typhi
cggaaaauauucagcacauc

SEQ ID NO: 3612641 - RNA, 14 nt, Salmonella enterica enterica serovar Typhi
cggaaaccccaggu

SEQ ID NO: 3612642 - RNA, 23 nt, Salmonella enterica enterica serovar Typhi
cggaaagaagcaggguauugacg

SEQ ID NO: 3612643 - RNA, 15 nt, Salmonella enterica enterica serovar Typhi
cggaaagaauaaucg

SEQ ID NO: 3612644 - RNA, 21 nt, Salmonella enterica enterica serovar Typhi
cggaaagacggcagcgccauc

SEQ ID NO: 3612645 - RNA, 20 nt, Salmonella enterica enterica serovar Typhi
cggaaaggacguucuucucc

SEQ ID NO: 3612646 - RNA, 18 nt, Salmonella enterica enterica serovar Typhi
cggaaagggugcccgccu

SEQ ID NO: 3612647 - RNA, 16 nt, Salmonella enterica enterica serovar Typhi
cggaaaucaacaaucc

SEQ ID NO: 3612648 - RNA, 14 nt, Salmonella enterica enterica serovar Typhi
cggaaaucacgcau

SEQ ID NO: 3612649 - RNA, 18 nt, Salmonella enterica enterica serovar Typhi
cggaaaugaaaaagauag

SEQ ID NO: 3612650 - RNA, 22 nt, Salmonella enterica enterica serovar Typhi
cggaaaugaucagacgcaucag

SEQ ID NO: 3612651 - RNA, 21 nt, Salmonella enterica enterica serovar Typhi
cggaaauucacuuccgucaug

SEQ ID NO: 3612652 - RNA, 12 nt, Salmonella enterica enterica serovar Typhi
cggaacaccagc

SEQ ID NO: 3612653 - RNA, 13 nt, Salmonella enterica enterica serovar Typhi
cggaacaccagcg

SEQ ID NO: 3612654 - RNA, 13 nt, Salmonella enterica enterica serovar Typhi
cggaacagcgggg

SEQ ID NO: 3612655 - RNA, 17 nt, Salmonella enterica enterica serovar Typhi
cggaacagggccgcauc

SEQ ID NO: 3612656 - RNA, 22 nt, Salmonella enterica enterica serovar Typhi
cggaaccgcccaucaacaccag

SEQ ID NO: 3612657 - RNA, 14 nt, Salmonella enterica enterica serovar Typhi
cggaaccuguccug

SEQ ID NO: 3612658 - RNA, 23 nt, Salmonella enterica enterica serovar Typhi
cggaacgcgacucccaggcgcgc

SEQ ID NO: 3612659 - RNA, 18 nt, Salmonella enterica enterica serovar Typhi
cggaacuaacccgcagcc

SEQ ID NO: 3612660 - RNA, 19 nt, Salmonella enterica enterica serovar Typhi
cggaacuuuaucaccagcg

SEQ ID NO: 3612661 - RNA, 21 nt, Salmonella enterica enterica serovar Typhi
cggaacuuuaucaccagcgau

SEQ ID NO: 3612662 - RNA, 16 nt, Salmonella enterica enterica serovar Typhi
cggaagagaaacucuu

SEQ ID NO: 3612663 - RNA, 16 nt, Salmonella enterica enterica serovar Typhi
cggaagagcucgacca

SEQ ID NO: 3612664 - RNA, 21 nt, Salmonella enterica enterica serovar Typhi
cggaagccacguucuuccaga

SEQ ID NO: 3612665 - RNA, 21 nt, Salmonella enterica enterica serovar Typhi
cggaaggugccguauggcguc

SEQ ID NO: 3612666 - RNA, 18 nt, Salmonella enterica enterica serovar Typhi
cggauaagcggcagcgcc

SEQ ID NO: 3612667 - RNA, 19 nt, Salmonella enterica enterica serovar Typhi
cggauaagcggcagcgcca

SEQ ID NO: 3612668 - RNA, 11 nt, Salmonella enterica enterica serovar Typhi
cggauaagcgu

SEQ ID NO: 3612669 - RNA, 22 nt, Salmonella enterica enterica serovar Typhi
cggauaaggccacgccgccauc

SEQ ID NO: 3612670 - RNA, 18 nt, Salmonella enterica enterica serovar Typhi
cggauaaggcgcagccgc

SEQ ID NO: 3612671 - RNA, 20 nt, Salmonella enterica enterica serovar Typhi
cggauaaggcgcagccgcca

SEQ ID NO: 3612672 - RNA, 22 nt, Salmonella enterica enterica serovar Typhi
cggauaaggcgcagccgccauc

SEQ ID NO: 3612673 - RNA, 20 nt, Salmonella enterica enterica serovar Typhi
cggauaaggcguuuacgccg

SEQ ID NO: 3612674 - RNA, 20 nt, Salmonella enterica enterica serovar Typhi
cggauaaggcguuuacgcug

SEQ ID NO: 3612675 - RNA, 22 nt, Salmonella enterica enterica serovar Typhi
cggauacaagguauccgccaua

SEQ ID NO: 3612676 - RNA, 22 nt, Salmonella enterica enterica serovar Typhi
cggauacggcugucaggagcca

SEQ ID NO: 3612677 - RNA, 23 nt, Salmonella enterica enterica serovar Typhi
cggauagaugaagacaacgucgc

SEQ ID NO: 3612678 - RNA, 22 nt, Salmonella enterica enterica serovar Typhi
cggauagcggcuucgccagauc

SEQ ID NO: 3612679 - RNA, 18 nt, Salmonella enterica enterica serovar Typhi
cggauagucauaauuaaa

SEQ ID NO: 3612680 - RNA, 16 nt, Salmonella enterica enterica serovar Typhi
cggauaugcagcagcc

SEQ ID NO: 3612681 - RNA, 23 nt, Salmonella enterica enterica serovar Typhi
cggauaugcgucuuaaugguggu

SEQ ID NO: 3612682 - RNA, 15 nt, Salmonella enterica enterica serovar Typhi
cggauauuacccggc

SEQ ID NO: 3612683 - RNA, 15 nt, Salmonella enterica enterica serovar Typhi
cggaucaauaaacag

SEQ ID NO: 3612684 - RNA, 15 nt, Salmonella enterica enterica serovar Typhi
cggaucaccggcauu

SEQ ID NO: 3612685 - RNA, 16 nt, Salmonella enterica enterica serovar Typhi
cggaucaccggcauuu

SEQ ID NO: 3612686 - RNA, 17 nt, Salmonella enterica enterica serovar Typhi
cggaucaugguugaaaa

SEQ ID NO: 3612687 - RNA, 16 nt, Salmonella enterica enterica serovar Typhi
cggauccggcgcagac

SEQ ID NO: 3612688 - RNA, 18 nt, Salmonella enterica enterica serovar Typhi
cggaucgaucccggcaaa

SEQ ID NO: 3612689 - RNA, 20 nt, Salmonella enterica enterica serovar Typhi
cggaucgaucucgauauuca

SEQ ID NO: 3612690 - RNA, 19 nt, Salmonella enterica enterica serovar Typhi
cggaucgcaagauccugau

SEQ ID NO: 3612691 - RNA, 19 nt, Salmonella enterica enterica serovar Typhi
cggaucgcgcggaucgucg

SEQ ID NO: 3612692 - RNA, 12 nt, Salmonella enterica enterica serovar Typhi
cggaucgcguuu

SEQ ID NO: 3612693 - RNA, 17 nt, Salmonella enterica enterica serovar Typhi
cggaucggccauaucca

SEQ ID NO: 3612694 - RNA, 11 nt, Salmonella enterica enterica serovar Typhi
cggaucgggcu

SEQ ID NO: 3612695 - RNA, 12 nt, Salmonella enterica enterica serovar Typhi
cggaucucgcca

SEQ ID NO: 3612696 - RNA, 11 nt, Salmonella enterica enterica serovar Typhi
cggaugcgcgg

SEQ ID NO: 3612697 - RNA, 17 nt, Salmonella enterica enterica serovar Typhi
cggaugcggcuagcgcc

SEQ ID NO: 3612698 - RNA, 22 nt, Salmonella enterica enterica serovar Typhi
cggauggaauuuugcaccauca

SEQ ID NO: 3612699 - RNA, 20 nt, Salmonella enterica enterica serovar Typhi
cggauggcaguacagggcga

SEQ ID NO: 3612700 - RNA, 17 nt, Salmonella enterica enterica serovar Typhi
cggauggccugcucaau

SEQ ID NO: 3612701 - RNA, 15 nt, Salmonella enterica enterica serovar Typhi
cggauggcggcguga

SEQ ID NO: 3612702 - RNA, 22 nt, Salmonella enterica enterica serovar Typhi
cggauggcggcuaacgccugau

SEQ ID NO: 3612703 - RNA, 18 nt, Salmonella enterica enterica serovar Typhi
cggaugguggcguaaaua

SEQ ID NO: 3612704 - RNA, 14 nt, Salmonella enterica enterica serovar Typhi
cggaugugcauuga

SEQ ID NO: 3612705 - RNA, 20 nt, Salmonella enterica enterica serovar Typhi
cggauguuagcuucacuucg

SEQ ID NO: 3612706 - RNA, 17 nt, Salmonella enterica enterica serovar Typhi
cggauuaaaacgcauac

SEQ ID NO: 3612707 - RNA, 22 nt, Salmonella enterica enterica serovar Typhi
cggauuaagcgaauccagcgcc

SEQ ID NO: 3612708 - RNA, 24 nt, Salmonella enterica enterica serovar Typhi
cggauuacgaauaccguaagacca

SEQ ID NO: 3612709 - RNA, 16 nt, Salmonella enterica enterica serovar Typhi
cggauucaauauugaa

SEQ ID NO: 3612710 - RNA, 14 nt, Salmonella enterica enterica serovar Typhi
cggauuccagaaua

SEQ ID NO: 3612711 - RNA, 19 nt, Salmonella enterica enterica serovar Typhi
cggauucgacugcggucgu

SEQ ID NO: 3612712 - RNA, 24 nt, Salmonella enterica enterica serovar Typhi
cggauugccuucucugucgagcau

SEQ ID NO: 3612713 - RNA, 22 nt, Salmonella enterica enterica serovar Typhi
cggauugucaucugacugcgug

SEQ ID NO: 3612714 - RNA, 20 nt, Salmonella enterica enterica serovar Typhi
cggcaaaaaauauagccauu

SEQ ID NO: 3612715 - RNA, 15 nt, Salmonella enterica enterica serovar Typhi
cggcaaaaacgccgg

SEQ ID NO: 3612716 - RNA, 18 nt, Salmonella enterica enterica serovar Typhi
cggcaaaaagaaucgcca

SEQ ID NO: 3612717 - RNA, 19 nt, Salmonella enterica enterica serovar Typhi
cggcaaaaaucagcccgga

SEQ ID NO: 3612718 - RNA, 13 nt, Salmonella enterica enterica serovar Typhi
cggcaaaagaggc

SEQ ID NO: 3612719 - RNA, 20 nt, Salmonella enterica enterica serovar Typhi
cggcaaaauaguucagcgca

SEQ ID NO: 3612720 - RNA, 15 nt, Salmonella enterica enterica serovar Typhi
cggcaaacagcuuca

SEQ ID NO: 3612721 - RNA, 17 nt, Salmonella enterica enterica serovar Typhi
cggcaaacauagccuca

SEQ ID NO: 3612722 - RNA, 16 nt, Salmonella enterica enterica serovar Typhi
cggcaaaccaaacggc

SEQ ID NO: 3612723 - RNA, 21 nt, Salmonella enterica enterica serovar Typhi
cggcaaagaaaaagaguugca

SEQ ID NO: 3612724 - RNA, 17 nt, Salmonella enterica enterica serovar Typhi
cggcaaagaccaauaaa

SEQ ID NO: 3612725 - RNA, 17 nt, Salmonella enterica enterica serovar Typhi
cggcaaagguugccgca

SEQ ID NO: 3612726 - RNA, 14 nt, Salmonella enterica enterica serovar Typhi
cggcaaagucuuca

SEQ ID NO: 3612727 - RNA, 17 nt, Salmonella enterica enterica serovar Typhi
cggcaaauaccgucaua

SEQ ID NO: 3612728 - RNA, 15 nt, Salmonella enterica enterica serovar Typhi
cggcaaauccuccau

SEQ ID NO: 3612729 - RNA, 16 nt, Salmonella enterica enterica serovar Typhi
cggcaaauccuccaua

SEQ ID NO: 3612730 - RNA, 14 nt, Salmonella enterica enterica serovar Typhi
cggcaaccagccca

SEQ ID NO: 3612731 - RNA, 12 nt, Salmonella enterica enterica serovar Typhi
cggcaacccgcu

SEQ ID NO: 3612732 - RNA, 12 nt, Salmonella enterica enterica serovar Typhi
cggcaacugcgc

SEQ ID NO: 3612733 - RNA, 16 nt, Salmonella enterica enterica serovar Typhi
cggcaacugcgccaaa

SEQ ID NO: 3612734 - RNA, 17 nt, Salmonella enterica enterica serovar Typhi
cggcaagcaucugauau

SEQ ID NO: 3612735 - RNA, 14 nt, Salmonella enterica enterica serovar Typhi
cggcaagcuggcga

SEQ ID NO: 3612736 - RNA, 15 nt, Salmonella enterica enterica serovar Typhi
cggcaagcuggcgaa

SEQ ID NO: 3612737 - RNA, 18 nt, Salmonella enterica enterica serovar Typhi
cggcaaggucugcgccca

SEQ ID NO: 3612738 - RNA, 17 nt, Salmonella enterica enterica serovar Typhi
cggcaagucagaccagu

SEQ ID NO: 3612739 - RNA, 14 nt, Salmonella enterica enterica serovar Typhi
cggcaauacuggac

SEQ ID NO: 3612740 - RNA, 23 nt, Salmonella enterica enterica serovar Typhi
cggcaauauugccgcacgguacu

SEQ ID NO: 3612741 - RNA, 18 nt, Salmonella enterica enterica serovar Typhi
cggcaaugagcggccagc

SEQ ID NO: 3612742 - RNA, 20 nt, Salmonella enterica enterica serovar Typhi
cggcaaugcucugcagguca

SEQ ID NO: 3612743 - RNA, 12 nt, Salmonella enterica enterica serovar Typhi
cggcaauggcca

SEQ ID NO: 3612744 - RNA, 21 nt, Salmonella enterica enterica serovar Typhi
cggcaauuaaccgauaacgcg

SEQ ID NO: 3612745 - RNA, 15 nt, Salmonella enterica enterica serovar Typhi
cggcaauuaccgcca

SEQ ID NO: 3612746 - RNA, 17 nt, Salmonella enterica enterica serovar Typhi
cggcaauuaccgccagc

SEQ ID NO: 3612747 - RNA, 15 nt, Salmonella enterica enterica serovar Typhi
cggcaauuuccggcg

SEQ ID NO: 3612748 - RNA, 16 nt, Salmonella enterica enterica serovar Typhi
cggcaauuuccggcga

SEQ ID NO: 3612749 - RNA, 17 nt, Salmonella enterica enterica serovar Typhi
cggcaauuuccggcgac

SEQ ID NO: 3612750 - RNA, 15 nt, Salmonella enterica enterica serovar Typhi
cggcacaaccuggcu

SEQ ID NO: 3612751 - RNA, 18 nt, Salmonella enterica enterica serovar Typhi
cggcacaaugcccggcau

SEQ ID NO: 3612752 - RNA, 21 nt, Salmonella enterica enterica serovar Typhi
cggcaugcaucucuucaaaca

SEQ ID NO: 3612753 - RNA, 17 nt, Salmonella enterica enterica serovar Typhi
cggcauggaugcaugag

SEQ ID NO: 3612754 - RNA, 20 nt, Salmonella enterica enterica serovar Typhi
cggcauggguaaagcccauc

SEQ ID NO: 3612755 - RNA, 15 nt, Salmonella enterica enterica serovar Typhi
cggcauguccggcga

SEQ ID NO: 3612756 - RNA, 16 nt, Salmonella enterica enterica serovar Typhi
cggcaugucgccagcc

SEQ ID NO: 3612757 - RNA, 18 nt, Salmonella enterica enterica serovar Typhi
cggcaugucgccagccag

SEQ ID NO: 3612758 - RNA, 23 nt, Salmonella enterica enterica serovar Typhi
cggcauguucacaucgcucagaa

SEQ ID NO: 3612759 - RNA, 17 nt, Salmonella enterica enterica serovar Typhi
cggcauuaauacaggcc

SEQ ID NO: 3612760 - RNA, 15 nt, Salmonella enterica enterica serovar Typhi
cggcauuaauuucuu

SEQ ID NO: 3612761 - RNA, 16 nt, Salmonella enterica enterica serovar Typhi
cggcauuaauuucuug

SEQ ID NO: 3612762 - RNA, 17 nt, Salmonella enterica enterica serovar Typhi
cggcauuagcaugggcu

SEQ ID NO: 3612763 - RNA, 15 nt, Salmonella enterica enterica serovar Typhi
cggcauuauaagcgc

SEQ ID NO: 3612764 - RNA, 17 nt, Salmonella enterica enterica serovar Typhi
cggcauucacgucgcgc

SEQ ID NO: 3612765 - RNA, 20 nt, Salmonella enterica enterica serovar Typhi
cggcauucacgucgcgcgcc

SEQ ID NO: 3612766 - RNA, 22 nt, Salmonella enterica enterica serovar Typhi
cggcauuggcguuaccggcagg

SEQ ID NO: 3612767 - RNA, 21 nt, Salmonella enterica enterica serovar Typhi
cggcauuucugucugacgacc

SEQ ID NO: 3612768 - RNA, 19 nt, Salmonella enterica enterica serovar Typhi
cggccaaagcgcgacugga

SEQ ID NO: 3612769 - RNA, 22 nt, Salmonella enterica enterica serovar Typhi
cggccaauccugcacccgccuu

SEQ ID NO: 3612770 - RNA, 14 nt, Salmonella enterica enterica serovar Typhi
cggccacaaaacag

SEQ ID NO: 3612771 - RNA, 17 nt, Salmonella enterica enterica serovar Typhi
cggccacaauugccagc

SEQ ID NO: 3612772 - RNA, 15 nt, Salmonella enterica enterica serovar Typhi
cggccacagccaucc

SEQ ID NO: 3612773 - RNA, 16 nt, Salmonella enterica enterica serovar Typhi
cggccacagccauccg

SEQ ID NO: 3612774 - RNA, 14 nt, Salmonella enterica enterica serovar Typhi
cggccacagcgcca

SEQ ID NO: 3612775 - RNA, 16 nt, Salmonella enterica enterica serovar Typhi
cggccacagcgccaga

SEQ ID NO: 3612776 - RNA, 15 nt, Salmonella enterica enterica serovar Typhi
cggccacaggcgucg

SEQ ID NO: 3612777 - RNA, 14 nt, Salmonella enterica enterica serovar Typhi
cggccaccacauac

SEQ ID NO: 3612778 - RNA, 21 nt, Salmonella enterica enterica serovar Typhi
cggccaccauuacgcccccuc

SEQ ID NO: 3612779 - RNA, 14 nt, Salmonella enterica enterica serovar Typhi
cggccacgagcugu

SEQ ID NO: 3612780 - RNA, 20 nt, Salmonella enterica enterica serovar Typhi
cggccacgcgcgucaggacg

SEQ ID NO: 3612781 - RNA, 15 nt, Salmonella enterica enterica serovar Typhi
cggccacgguguggc

SEQ ID NO: 3612782 - RNA, 21 nt, Salmonella enterica enterica serovar Typhi
cggccacgguguggcccagcg

SEQ ID NO: 3612783 - RNA, 21 nt, Salmonella enterica enterica serovar Typhi
cggccagauaguggcugaggc

SEQ ID NO: 3612784 - RNA, 14 nt, Salmonella enterica enterica serovar Typhi
cggccagcagccau

SEQ ID NO: 3612785 - RNA, 12 nt, Salmonella enterica enterica serovar Typhi
cggccagccaua

SEQ ID NO: 3612786 - RNA, 19 nt, Salmonella enterica enterica serovar Typhi
cggccagcgagucgccgcu

SEQ ID NO: 3612787 - RNA, 13 nt, Salmonella enterica enterica serovar Typhi
cggccagcgccag

SEQ ID NO: 3612788 - RNA, 14 nt, Salmonella enterica enterica serovar Typhi
cggccagcgccagc

SEQ ID NO: 3612789 - RNA, 19 nt, Salmonella enterica enterica serovar Typhi
cggccagcgccagcguaga

SEQ ID NO: 3612790 - RNA, 13 nt, Salmonella enterica enterica serovar Typhi
cggccaggauggc

SEQ ID NO: 3612791 - RNA, 19 nt, Salmonella enterica enterica serovar Typhi
cggccaggauggcccgguu

SEQ ID NO: 3612792 - RNA, 20 nt, Salmonella enterica enterica serovar Typhi
cggccaguucuuguaguuuu

SEQ ID NO: 3612793 - RNA, 15 nt, Salmonella enterica enterica serovar Typhi
cggccauagcgugag

SEQ ID NO: 3612794 - RNA, 19 nt, Salmonella enterica enterica serovar Typhi
cggccauagcgugagguca

SEQ ID NO: 3612795 - RNA, 23 nt, Salmonella enterica enterica serovar Typhi
cggccaugacucaaacagauagc

SEQ ID NO: 3612796 - RNA, 16 nt, Salmonella enterica enterica serovar Typhi
cggccauuaacacaca

SEQ ID NO: 3612797 - RNA, 16 nt, Salmonella enterica enterica serovar Typhi
cggccauuaccaguac

SEQ ID NO: 3612798 - RNA, 15 nt, Salmonella enterica enterica serovar Typhi
cggcccacgcgcaga

SEQ ID NO: 3612799 - RNA, 22 nt, Salmonella enterica enterica serovar Typhi
cggcccaggcaucgacgccagc

SEQ ID NO: 3612800 - RNA, 23 nt, Salmonella enterica enterica serovar Typhi
cggcccauaucaaucaacgguuc

SEQ ID NO: 3612801 - RNA, 15 nt, Salmonella enterica enterica serovar Typhi
cggccccagccugga

SEQ ID NO: 3612802 - RNA, 14 nt, Salmonella enterica enterica serovar Typhi
cggccccgggcgac

SEQ ID NO: 3612803 - RNA, 22 nt, Salmonella enterica enterica serovar Typhi
cggcccgaagggcgagcguagc

SEQ ID NO: 3612804 - RNA, 20 nt, Salmonella enterica enterica serovar Typhi
cggcccgaugccuggauaau

SEQ ID NO: 3612805 - RNA, 14 nt, Salmonella enterica enterica serovar Typhi
cggcccgccgcugg

SEQ ID NO: 3612806 - RNA, 13 nt, Salmonella enterica enterica serovar Typhi
cggcccgcgcuga

SEQ ID NO: 3612807 - RNA, 23 nt, Salmonella enterica enterica serovar Typhi
cggcccgcuucauuggcgucugc

SEQ ID NO: 3612808 - RNA, 17 nt, Salmonella enterica enterica serovar Typhi
cggcccgggcacgaugg

SEQ ID NO: 3612809 - RNA, 18 nt, Salmonella enterica enterica serovar Typhi
cggcccgugccagcuauc

SEQ ID NO: 3612810 - RNA, 17 nt, Salmonella enterica enterica serovar Typhi
cggccgccaucgcaauc

SEQ ID NO: 3612811 - RNA, 17 nt, Salmonella enterica enterica serovar Typhi
cggccgcuuuucggcgc

SEQ ID NO: 3612812 - RNA, 17 nt, Salmonella enterica enterica serovar Typhi
cggccuacaaagccaaa

SEQ ID NO: 3612813 - RNA, 15 nt, Salmonella enterica enterica serovar Typhi
cggccuacaacucag

SEQ ID NO: 3612814 - RNA, 14 nt, Salmonella enterica enterica serovar Typhi
cggccuccgcuucc

SEQ ID NO: 3612815 - RNA, 23 nt, Salmonella enterica enterica serovar Typhi
cggccucuucacgcagcgccuua

SEQ ID NO: 3612816 - RNA, 19 nt, Salmonella enterica enterica serovar Typhi
cggccugaaucagcaucuu

SEQ ID NO: 3612817 - RNA, 23 nt, Salmonella enterica enterica serovar Typhi
cggccugauaagcauagcgccau

SEQ ID NO: 3612818 - RNA, 18 nt, Salmonella enterica enterica serovar Typhi
cggccugcaaaccgccuc

SEQ ID NO: 3612819 - RNA, 20 nt, Salmonella enterica enterica serovar Typhi
cggccugcaaaccgccucgc

SEQ ID NO: 3612820 - RNA, 20 nt, Salmonella enterica enterica serovar Typhi
cggccugcacaagaaacaug

SEQ ID NO: 3612821 - RNA, 16 nt, Salmonella enterica enterica serovar Typhi
cggccugcaggcaacg

SEQ ID NO: 3612822 - RNA, 22 nt, Salmonella enterica enterica serovar Typhi
cggccugcggugguggggccua

SEQ ID NO: 3612823 - RNA, 12 nt, Salmonella enterica enterica serovar Typhi
cggccuggcccg

SEQ ID NO: 3612824 - RNA, 14 nt, Salmonella enterica enterica serovar Typhi
cggccuggcgcagc

SEQ ID NO: 3612825 - RNA, 15 nt, Salmonella enterica enterica serovar Typhi
cggccuggcucuucc

SEQ ID NO: 3612826 - RNA, 15 nt, Salmonella enterica enterica serovar Typhi
cggccugucgcgacc

SEQ ID NO: 3612827 - RNA, 13 nt, Salmonella enterica enterica serovar Typhi
cggccuuauuuuu

SEQ ID NO: 3612828 - RNA, 16 nt, Salmonella enterica enterica serovar Typhi
cggccuuauuuuucag

SEQ ID NO: 3612829 - RNA, 23 nt, Salmonella enterica enterica serovar Typhi
cggccuugaaguuauccagcgcc

SEQ ID NO: 3612830 - RNA, 16 nt, Salmonella enterica enterica serovar Typhi
cggccuugccgccagc

SEQ ID NO: 3612831 - RNA, 16 nt, Salmonella enterica enterica serovar Typhi
cggccuuuuugcgccg

SEQ ID NO: 3612832 - RNA, 21 nt, Salmonella enterica enterica serovar Typhi
cggcgaaagaagcgcuggaga

SEQ ID NO: 3612833 - RNA, 17 nt, Salmonella enterica enterica serovar Typhi
cggcgaaauauuaucgc

SEQ ID NO: 3612834 - RNA, 20 nt, Salmonella enterica enterica serovar Typhi
cggcgaaaucgugcgcccca

SEQ ID NO: 3612835 - RNA, 16 nt, Salmonella enterica enterica serovar Typhi
cggcgaacaggcguaa

SEQ ID NO: 3612836 - RNA, 15 nt, Salmonella enterica enterica serovar Typhi
cggcgaaccggcauc

SEQ ID NO: 3612837 - RNA, 17 nt, Salmonella enterica enterica serovar Typhi
cggcgaacguuggcugg

SEQ ID NO: 3612838 - RNA, 16 nt, Salmonella enterica enterica serovar Typhi
cggcggaaugcugguu

SEQ ID NO: 3612839 - RNA, 18 nt, Salmonella enterica enterica serovar Typhi
cggcggcaagcuggcgaa

SEQ ID NO: 3612840 - RNA, 15 nt, Salmonella enterica enterica serovar Typhi
cggcggcaaugccgc

SEQ ID NO: 3612841 - RNA, 13 nt, Salmonella enterica enterica serovar Typhi
cggcggccaaccc

SEQ ID NO: 3612842 - RNA, 20 nt, Salmonella enterica enterica serovar Typhi
cggcggccaaccccggcaaa

SEQ ID NO: 3612843 - RNA, 11 nt, Salmonella enterica enterica serovar Typhi
cggcggcguuu

SEQ ID NO: 3612844 - RNA, 21 nt, Salmonella enterica enterica serovar Typhi
cggcggcuugccuucauccgc

SEQ ID NO: 3612845 - RNA, 18 nt, Salmonella enterica enterica serovar Typhi
cggcgggaucuccagaag

SEQ ID NO: 3612846 - RNA, 22 nt, Salmonella enterica enterica serovar Typhi
cggcgggcggaaagcauucgca

SEQ ID NO: 3612847 - RNA, 14 nt, Salmonella enterica enterica serovar Typhi
cggcggucagccag

SEQ ID NO: 3612848 - RNA, 21 nt, Salmonella enterica enterica serovar Typhi
cggcggugcagguugccugau

SEQ ID NO: 3612849 - RNA, 15 nt, Salmonella enterica enterica serovar Typhi
cggcgguggccaguc

SEQ ID NO: 3612850 - RNA, 20 nt, Salmonella enterica enterica serovar Typhi
cggcgguucauccugcgcca

SEQ ID NO: 3612851 - RNA, 15 nt, Salmonella enterica enterica serovar Typhi
cggcgguucaucgga

SEQ ID NO: 3612852 - RNA, 15 nt, Salmonella enterica enterica serovar Typhi
cggcguaaacgccuu

SEQ ID NO: 3612853 - RNA, 15 nt, Salmonella enterica enterica serovar Typhi
cggcguaccgcgcgc

SEQ ID NO: 3612854 - RNA, 17 nt, Salmonella enterica enterica serovar Typhi
cggcguaccgcgcgccc

SEQ ID NO: 3612855 - RNA, 15 nt, Salmonella enterica enterica serovar Typhi
cggcguagccgccga

SEQ ID NO: 3612856 - RNA, 21 nt, Salmonella enterica enterica serovar Typhi
cggcguagccgccgagcgccg

SEQ ID NO: 3612857 - RNA, 20 nt, Salmonella enterica enterica serovar Typhi
cggcguagcgcguucagggu

SEQ ID NO: 3612858 - RNA, 15 nt, Salmonella enterica enterica serovar Typhi
cggcguagcucgccc

SEQ ID NO: 3612859 - RNA, 22 nt, Salmonella enterica enterica serovar Typhi
cggcgucauaguuuuccagccc

SEQ ID NO: 3612860 - RNA, 23 nt, Salmonella enterica enterica serovar Typhi
cggcgucaucauugcgccaagac

SEQ ID NO: 3612861 - RNA, 16 nt, Salmonella enterica enterica serovar Typhi
cggcgucgccuggugg

SEQ ID NO: 3612862 - RNA, 14 nt, Salmonella enterica enterica serovar Typhi
cggcgugaaagcgc

SEQ ID NO: 3612863 - RNA, 16 nt, Salmonella enterica enterica serovar Typhi
cggcgugaauaaaaua

SEQ ID NO: 3612864 - RNA, 17 nt, Salmonella enterica enterica serovar Typhi
cggcgugaauaaaauag

SEQ ID NO: 3612865 - RNA, 14 nt, Salmonella enterica enterica serovar Typhi
cggcgugcgcugca

SEQ ID NO: 3612866 - RNA, 16 nt, Salmonella enterica enterica serovar Typhi
cggcgugguagcguca

SEQ ID NO: 3612867 - RNA, 21 nt, Salmonella enterica enterica serovar Typhi
cggcguguagccaaucagccc

SEQ ID NO: 3612868 - RNA, 22 nt, Salmonella enterica enterica serovar Typhi
cggcguguuguaaaacgcgccc

SEQ ID NO: 3612869 - RNA, 16 nt, Salmonella enterica enterica serovar Typhi
cggcguguuucaucuc

SEQ ID NO: 3612870 - RNA, 20 nt, Salmonella enterica enterica serovar Typhi
cggcguuacccgucuggcgc

SEQ ID NO: 3612871 - RNA, 15 nt, Salmonella enterica enterica serovar Typhi
cggcguuccgcccag

SEQ ID NO: 3612872 - RNA, 12 nt, Salmonella enterica enterica serovar Typhi
cggcguucugcg

SEQ ID NO: 3612873 - RNA, 13 nt, Salmonella enterica enterica serovar Typhi
cggcguugcgccc

SEQ ID NO: 3612874 - RNA, 19 nt, Salmonella enterica enterica serovar Typhi
cggcguugcgcccaggcca

SEQ ID NO: 3612875 - RNA, 18 nt, Salmonella enterica enterica serovar Typhi
cggcguugcgccgccagg

SEQ ID NO: 3612876 - RNA, 16 nt, Salmonella enterica enterica serovar Typhi
cggcguuuauauaaaa

SEQ ID NO: 3612877 - RNA, 23 nt, Salmonella enterica enterica serovar Typhi
cggcguuucaagcaguuccagca

SEQ ID NO: 3612878 - RNA, 17 nt, Salmonella enterica enterica serovar Typhi
cggcguuuuaauauccu

SEQ ID NO: 3612879 - RNA, 17 nt, Salmonella enterica enterica serovar Typhi
cggcguuuuagcgccau

SEQ ID NO: 3612880 - RNA, 18 nt, Salmonella enterica enterica serovar Typhi
cggcguuuuuuccugcug

SEQ ID NO: 3612881 - RNA, 13 nt, Salmonella enterica enterica serovar Typhi
cggcuaaacugcg

SEQ ID NO: 3612882 - RNA, 21 nt, Salmonella enterica enterica serovar Typhi
cggcuaaaugacgcgcgagaa

SEQ ID NO: 3612883 - RNA, 14 nt, Salmonella enterica enterica serovar Typhi
cggcuaacgccuga

SEQ ID NO: 3612884 - RNA, 16 nt, Salmonella enterica enterica serovar Typhi
cggcuaacgccugauc

SEQ ID NO: 3612885 - RNA, 20 nt, Salmonella enterica enterica serovar Typhi
cggcuacgccuuauccggcc

SEQ ID NO: 3612886 - RNA, 18 nt, Salmonella enterica enterica serovar Typhi
cggcuacggaguucgccg

SEQ ID NO: 3612887 - RNA, 16 nt, Salmonella enterica enterica serovar Typhi
cggcuagcgcaguuug

SEQ ID NO: 3612888 - RNA, 15 nt, Salmonella enterica enterica serovar Typhi
cggcuagucaauaaa

SEQ ID NO: 3612889 - RNA, 20 nt, Salmonella enterica enterica serovar Typhi
cggcuauuccucgaucgccu

SEQ ID NO: 3612890 - RNA, 16 nt, Salmonella enterica enterica serovar Typhi
cggcucauccagcaac

SEQ ID NO: 3612891 - RNA, 16 nt, Salmonella enterica enterica serovar Typhi
cggcuccagcgccagc

SEQ ID NO: 3612892 - RNA, 18 nt, Salmonella enterica enterica serovar Typhi
cggcucccauuugcgggu

SEQ ID NO: 3612893 - RNA, 20 nt, Salmonella enterica enterica serovar Typhi
cggcucgcacauaucgcaau

SEQ ID NO: 3612894 - RNA, 22 nt, Salmonella enterica enterica serovar Typhi
cggcucgccuuugcgcccguac

SEQ ID NO: 3612895 - RNA, 20 nt, Salmonella enterica enterica serovar Typhi
cggcucgcuguucgccagac

SEQ ID NO: 3612896 - RNA, 19 nt, Salmonella enterica enterica serovar Typhi
cggcugacacucauccaga

SEQ ID NO: 3612897 - RNA, 22 nt, Salmonella enterica enterica serovar Typhi
cggcugacgauacucagcccca

SEQ ID NO: 3612898 - RNA, 16 nt, Salmonella enterica enterica serovar Typhi
cggcugacgcccauca

SEQ ID NO: 3612899 - RNA, 18 nt, Salmonella enterica enterica serovar Typhi
cggcugacgcccaucagc

SEQ ID NO: 3612900 - RNA, 19 nt, Salmonella enterica enterica serovar Typhi
cggcugacgcccaucagca

SEQ ID NO: 3612901 - RNA, 21 nt, Salmonella enterica enterica serovar Typhi
cggcugaggcuuugagcguca

SEQ ID NO: 3612902 - RNA, 18 nt, Salmonella enterica enterica serovar Typhi
cggcugaguucaggcacg

SEQ ID NO: 3612903 - RNA, 23 nt, Salmonella enterica enterica serovar Typhi
cggcugaguucaggcacgugcau

SEQ ID NO: 3612904 - RNA, 16 nt, Salmonella enterica enterica serovar Typhi
cggcugcacaaaauac

SEQ ID NO: 3612905 - RNA, 17 nt, Salmonella enterica enterica serovar Typhi
cggcugcaccagcguua

SEQ ID NO: 3612906 - RNA, 13 nt, Salmonella enterica enterica serovar Typhi
cggcugcauauac

SEQ ID NO: 3612907 - RNA, 19 nt, Salmonella enterica enterica serovar Typhi
cggcugccauuaucaccau

SEQ ID NO: 3612908 - RNA, 16 nt, Salmonella enterica enterica serovar Typhi
cggcugcgccugcggg

SEQ ID NO: 3612909 - RNA, 19 nt, Salmonella enterica enterica serovar Typhi
cggcugcgccuuauccggc

SEQ ID NO: 3612910 - RNA, 15 nt, Salmonella enterica enterica serovar Typhi
cggcugcgcugccag

SEQ ID NO: 3612911 - RNA, 16 nt, Salmonella enterica enterica serovar Typhi
cggcugcgcugccagc

SEQ ID NO: 3612912 - RNA, 23 nt, Salmonella enterica enterica serovar Typhi
cggcugcgcugccagcugcguca

SEQ ID NO: 3612913 - RNA, 15 nt, Salmonella enterica enterica serovar Typhi
cggcugcucccccag

SEQ ID NO: 3612914 - RNA, 22 nt, Salmonella enterica enterica serovar Typhi
cggcugggccggugcagcaggu

SEQ ID NO: 3612915 - RNA, 22 nt, Salmonella enterica enterica serovar Typhi
cggcuggguuuccggaucgccg

SEQ ID NO: 3612916 - RNA, 14 nt, Salmonella enterica enterica serovar Typhi
cggcugguaagaga

SEQ ID NO: 3612917 - RNA, 16 nt, Salmonella enterica enterica serovar Typhi
cggcugguaagagagc

SEQ ID NO: 3612918 - RNA, 13 nt, Salmonella enterica enterica serovar Typhi
cggcuguagccag

SEQ ID NO: 3612919 - RNA, 12 nt, Salmonella enterica enterica serovar Typhi
cggcuguauaca

SEQ ID NO: 3612920 - RNA, 13 nt, Salmonella enterica enterica serovar Typhi
cggcugucaucaa

SEQ ID NO: 3612921 - RNA, 22 nt, Salmonella enterica enterica serovar Typhi
cggcuguguccgccaugugcug

SEQ ID NO: 3612922 - RNA, 15 nt, Salmonella enterica enterica serovar Typhi
cggcuguugguuuau

SEQ ID NO: 3612923 - RNA, 22 nt, Salmonella enterica enterica serovar Typhi
cggcuuacaacauuguuauguu

SEQ ID NO: 3612924 - RNA, 20 nt, Salmonella enterica enterica serovar Typhi
cgggcggcgcagcgcgcgac

SEQ ID NO: 3612925 - RNA, 17 nt, Salmonella enterica enterica serovar Typhi
cgggcguuugcgcgcgc

SEQ ID NO: 3612926 - RNA, 19 nt, Salmonella enterica enterica serovar Typhi
cgggcuaaaugcccacggc

SEQ ID NO: 3612927 - RNA, 13 nt, Salmonella enterica enterica serovar Typhi
cgggcucacgcug

SEQ ID NO: 3612928 - RNA, 14 nt, Salmonella enterica enterica serovar Typhi
cgggcucacgcugg

SEQ ID NO: 3612929 - RNA, 15 nt, Salmonella enterica enterica serovar Typhi
cgggcucacgcuggu

SEQ ID NO: 3612930 - RNA, 13 nt, Salmonella enterica enterica serovar Typhi
cgggcucggcgcu

SEQ ID NO: 3612931 - RNA, 14 nt, Salmonella enterica enterica serovar Typhi
cgggcucguugcgu

SEQ ID NO: 3612932 - RNA, 20 nt, Salmonella enterica enterica serovar Typhi
cgggcugccccagacgcccu

SEQ ID NO: 3612933 - RNA, 13 nt, Salmonella enterica enterica serovar Typhi
cgggcuucaggau

SEQ ID NO: 3612934 - RNA, 18 nt, Salmonella enterica enterica serovar Typhi
cgggcuuuuagccgcgcc

SEQ ID NO: 3612935 - RNA, 23 nt, Salmonella enterica enterica serovar Typhi
cggggaaaauauuagcggcggca

SEQ ID NO: 3612936 - RNA, 16 nt, Salmonella enterica enterica serovar Typhi
cggggaacacggacag

SEQ ID NO: 3612937 - RNA, 23 nt, Salmonella enterica enterica serovar Typhi
cggggaacacggacagcaacccg

SEQ ID NO: 3612938 - RNA, 24 nt, Salmonella enterica enterica serovar Typhi
cggggaacacucuaaaucuaccca

SEQ ID NO: 3612939 - RNA, 15 nt, Salmonella enterica enterica serovar Typhi
cggggaagcgcgcgc

SEQ ID NO: 3612940 - RNA, 16 nt, Salmonella enterica enterica serovar Typhi
cggggauaaucagcag

SEQ ID NO: 3612941 - RNA, 18 nt, Salmonella enterica enterica serovar Typhi
cggggauaaucagcagcg

SEQ ID NO: 3612942 - RNA, 13 nt, Salmonella enterica enterica serovar Typhi
cggggaucgguuu

SEQ ID NO: 3612943 - RNA, 16 nt, Salmonella enterica enterica serovar Typhi
cggggaucgguuuauc

SEQ ID NO: 3612944 - RNA, 17 nt, Salmonella enterica enterica serovar Typhi
cggggaucgguuuaucc

SEQ ID NO: 3612945 - RNA, 24 nt, Salmonella enterica enterica serovar Typhi
cggggcuuuugagucgcauccagu

SEQ ID NO: 3612946 - RNA, 16 nt, Salmonella enterica enterica serovar Typhi
cgggggcgacagcccc

SEQ ID NO: 3612947 - RNA, 16 nt, Salmonella enterica enterica serovar Typhi
cgggggcgaucagcag

SEQ ID NO: 3612948 - RNA, 17 nt, Salmonella enterica enterica serovar Typhi
cgggguaucuguuuauu

SEQ ID NO: 3612949 - RNA, 14 nt, Salmonella enterica enterica serovar Typhi
cggggugcuguucu

SEQ ID NO: 3612950 - RNA, 14 nt, Salmonella enterica enterica serovar Typhi
cgggguuugcagau

SEQ ID NO: 3612951 - RNA, 14 nt, Salmonella enterica enterica serovar Typhi
cggguaaacaaaca

SEQ ID NO: 3612952 - RNA, 21 nt, Salmonella enterica enterica serovar Typhi
cggguaaacaaacacagccau

SEQ ID NO: 3612953 - RNA, 23 nt, Salmonella enterica enterica serovar Typhi
cggguaaacgucccugccacagu

SEQ ID NO: 3612954 - RNA, 22 nt, Salmonella enterica enterica serovar Typhi
cggguaaacucacccaggcgau

SEQ ID NO: 3612955 - RNA, 23 nt, Salmonella enterica enterica serovar Typhi
cggguaaaugcgcgcggcuaccg

SEQ ID NO: 3612956 - RNA, 15 nt, Salmonella enterica enterica serovar Typhi
cggguaaccggagau

SEQ ID NO: 3612957 - RNA, 12 nt, Salmonella enterica enterica serovar Typhi
cggguaagcgcu

SEQ ID NO: 3612958 - RNA, 20 nt, Salmonella enterica enterica serovar Typhi
cggguaagcgcuagcgccac

SEQ ID NO: 3612959 - RNA, 20 nt, Salmonella enterica enterica serovar Typhi
cggguaagcguaagcgucac

SEQ ID NO: 3612960 - RNA, 14 nt, Salmonella enterica enterica serovar Typhi
cggguaauuugcgc

SEQ ID NO: 3612961 - RNA, 22 nt, Salmonella enterica enterica serovar Typhi
cggguaggccggauaaggccac

SEQ ID NO: 3612962 - RNA, 15 nt, Salmonella enterica enterica serovar Typhi
cggguagucaucgcc

SEQ ID NO: 3612963 - RNA, 23 nt, Salmonella enterica enterica serovar Typhi
cggguagucaucgccuucauccg

SEQ ID NO: 3612964 - RNA, 18 nt, Salmonella enterica enterica serovar Typhi
cggguagucccaggauag

SEQ ID NO: 3612965 - RNA, 19 nt, Salmonella enterica enterica serovar Typhi
cggguauccauugccagau

SEQ ID NO: 3612966 - RNA, 20 nt, Salmonella enterica enterica serovar Typhi
cggguauggcaaugcccccu

SEQ ID NO: 3612967 - RNA, 14 nt, Salmonella enterica enterica serovar Typhi
cgggucagcggggu

SEQ ID NO: 3612968 - RNA, 14 nt, Salmonella enterica enterica serovar Typhi
cgggucagcgucug

SEQ ID NO: 3612969 - RNA, 19 nt, Salmonella enterica enterica serovar Typhi
cgggucagcgucugcccca

SEQ ID NO: 3612970 - RNA, 18 nt, Salmonella enterica enterica serovar Typhi
cggguccagucgcgccgc

SEQ ID NO: 3612971 - RNA, 15 nt, Salmonella enterica enterica serovar Typhi
cggguccugaucggc

SEQ ID NO: 3612972 - RNA, 14 nt, Salmonella enterica enterica serovar Typhi
cgggucgcgcgccg

SEQ ID NO: 3612973 - RNA, 16 nt, Salmonella enterica enterica serovar Typhi
cgggucgcgcgccgca

SEQ ID NO: 3612974 - RNA, 22 nt, Salmonella enterica enterica serovar Typhi
cgggucggacgagcgcgucagc

SEQ ID NO: 3612975 - RNA, 21 nt, Salmonella enterica enterica serovar Typhi
cgggugcauuuucaccuggau

SEQ ID NO: 3612976 - RNA, 14 nt, Salmonella enterica enterica serovar Typhi
cgggugcgcagcaa

SEQ ID NO: 3612977 - RNA, 22 nt, Salmonella enterica enterica serovar Typhi
cggguuaaaccagcucacgcca

SEQ ID NO: 3612978 - RNA, 21 nt, Salmonella enterica enterica serovar Typhi
cggguuaaaucgcgcaaauau

SEQ ID NO: 3612979 - RNA, 14 nt, Salmonella enterica enterica serovar Typhi
cggguuaggcaagc

SEQ ID NO: 3612980 - RNA, 22 nt, Salmonella enterica enterica serovar Typhi
cggguucagcgacaggcugucg

SEQ ID NO: 3612981 - RNA, 13 nt, Salmonella enterica enterica serovar Typhi
cggguucaucgcc

SEQ ID NO: 3612982 - RNA, 15 nt, Salmonella enterica enterica serovar Typhi
cggguucaucgccac

SEQ ID NO: 3612983 - RNA, 17 nt, Salmonella enterica enterica serovar Typhi
cggguugauuacucccg

SEQ ID NO: 3612984 - RNA, 23 nt, Salmonella enterica enterica serovar Typhi
cggguugcacauuguugcaggga

SEQ ID NO: 3612985 - RNA, 22 nt, Salmonella enterica enterica serovar Typhi
cggguuucugaauagaaagucg

SEQ ID NO: 3612986 - RNA, 23 nt, Salmonella enterica enterica serovar Typhi
cggguuuucaauaaucaucaggc

SEQ ID NO: 3612987 - RNA, 15 nt, Salmonella enterica enterica serovar Typhi
cgguaaaccaggcca

SEQ ID NO: 3612988 - RNA, 16 nt, Salmonella enterica enterica serovar Typhi
cgguaaaccaggccag

SEQ ID NO: 3612989 - RNA, 17 nt, Salmonella enterica enterica serovar Typhi
cgguaaaccaggccagc

SEQ ID NO: 3612990 - RNA, 14 nt, Salmonella enterica enterica serovar Typhi
cgguaaaccucuuu

SEQ ID NO: 3612991 - RNA, 13 nt, Salmonella enterica enterica serovar Typhi
cgguaaacgucga

SEQ ID NO: 3612992 - RNA, 17 nt, Salmonella enterica enterica serovar Typhi
cgguaaagcagugcagu

SEQ ID NO: 3612993 - RNA, 23 nt, Salmonella enterica enterica serovar Typhi
cgguaaagguaauaucauccggu

SEQ ID NO: 3612994 - RNA, 24 nt, Salmonella enterica enterica serovar Typhi
cgguaaauccacaaccggcuggcu

SEQ ID NO: 3612995 - RNA, 22 nt, Salmonella enterica enterica serovar Typhi
cgguaaaugcuuaucugaugaa

SEQ ID NO: 3612996 - RNA, 16 nt, Salmonella enterica enterica serovar Typhi
cgguaaauuucaaccc

SEQ ID NO: 3612997 - RNA, 21 nt, Salmonella enterica enterica serovar Typhi
cgguaaauuucuugaucaauc

SEQ ID NO: 3612998 - RNA, 20 nt, Salmonella enterica enterica serovar Typhi
cgguaacagcuugaucauca

SEQ ID NO: 3612999 - RNA, 18 nt, Salmonella enterica enterica serovar Typhi
cgguaacgauacccacca

SEQ ID NO: 3613000 - RNA, 20 nt, Salmonella enterica enterica serovar Typhi
cgguaacgauacccaccagc

SEQ ID NO: 3613001 - RNA, 18 nt, Salmonella enterica enterica serovar Typhi
cgguaacguaaauaccca

SEQ ID NO: 3613002 - RNA, 21 nt, Salmonella enterica enterica serovar Typhi
cgguaacguaacuugauuccu

SEQ ID NO: 3613003 - RNA, 22 nt, Salmonella enterica enterica serovar Typhi
cgguaagaagaaccagcgcgac

SEQ ID NO: 3613004 - RNA, 18 nt, Salmonella enterica enterica serovar Typhi
cgguaagaaugcgcguca

SEQ ID NO: 3613005 - RNA, 17 nt, Salmonella enterica enterica serovar Typhi
cgguaagcacaacgcau

SEQ ID NO: 3613006 - RNA, 22 nt, Salmonella enterica enterica serovar Typhi
cgguaagcccauggcaggcagc

SEQ ID NO: 3613007 - RNA, 17 nt, Salmonella enterica enterica serovar Typhi
cgguaagcgucgccaga

SEQ ID NO: 3613008 - RNA, 22 nt, Salmonella enterica enterica serovar Typhi
cgguaauaauuagcauccagca

SEQ ID NO: 3613009 - RNA, 21 nt, Salmonella enterica enterica serovar Typhi
cggugcuuucgauaaucugac

SEQ ID NO: 3613010 - RNA, 16 nt, Salmonella enterica enterica serovar Typhi
cggugcuuucuccugc

SEQ ID NO: 3613011 - RNA, 17 nt, Salmonella enterica enterica serovar Typhi
cgguggaaaccgcagaa

SEQ ID NO: 3613012 - RNA, 18 nt, Salmonella enterica enterica serovar Typhi
cgguggcaacgcuggcgg

SEQ ID NO: 3613013 - RNA, 22 nt, Salmonella enterica enterica serovar Typhi
cgguggccgagaguccagcgcc

SEQ ID NO: 3613014 - RNA, 16 nt, Salmonella enterica enterica serovar Typhi
cgguggcgcugcgcuu

SEQ ID NO: 3613015 - RNA, 18 nt, Salmonella enterica enterica serovar Typhi
cgguggguagcggcaauu

SEQ ID NO: 3613016 - RNA, 19 nt, Salmonella enterica enterica serovar Typhi
cgguggugucaauggaugu

SEQ ID NO: 3613017 - RNA, 18 nt, Salmonella enterica enterica serovar Typhi
cgguguaccccgccugac

SEQ ID NO: 3613018 - RNA, 17 nt, Salmonella enterica enterica serovar Typhi
cggugugaucaccgccc

SEQ ID NO: 3613019 - RNA, 16 nt, Salmonella enterica enterica serovar Typhi
cggugugauuaaucca

SEQ ID NO: 3613020 - RNA, 16 nt, Salmonella enterica enterica serovar Typhi
cgguguggcccagcgc

SEQ ID NO: 3613021 - RNA, 21 nt, Salmonella enterica enterica serovar Typhi
cgguguuucaucuucaucacu

SEQ ID NO: 3613022 - RNA, 22 nt, Salmonella enterica enterica serovar Typhi
cgguuaacugcccguuacgcau

SEQ ID NO: 3613023 - RNA, 21 nt, Salmonella enterica enterica serovar Typhi
cgguuauaccgccauccggca

SEQ ID NO: 3613024 - RNA, 19 nt, Salmonella enterica enterica serovar Typhi
cgguuaugcauugcugauc

SEQ ID NO: 3613025 - RNA, 17 nt, Salmonella enterica enterica serovar Typhi
cgguuaugccugccagc

SEQ ID NO: 3613026 - RNA, 12 nt, Salmonella enterica enterica serovar Typhi
cgguuaugcgau

SEQ ID NO: 3613027 - RNA, 14 nt, Salmonella enterica enterica serovar Typhi
cgguucaaucacgc

SEQ ID NO: 3613028 - RNA, 13 nt, Salmonella enterica enterica serovar Typhi
cgguucauccugc

SEQ ID NO: 3613029 - RNA, 17 nt, Salmonella enterica enterica serovar Typhi
cgguucauccugcgcca

SEQ ID NO: 3613030 - RNA, 13 nt, Salmonella enterica enterica serovar Typhi
cgguuccagcggc

SEQ ID NO: 3613031 - RNA, 16 nt, Salmonella enterica enterica serovar Typhi
cgguucgccgcgcgca

SEQ ID NO: 3613032 - RNA, 16 nt, Salmonella enterica enterica serovar Typhi
cgguucucccggcaua

SEQ ID NO: 3613033 - RNA, 15 nt, Salmonella enterica enterica serovar Typhi
cgguucuucccacuc

SEQ ID NO: 3613034 - RNA, 15 nt, Salmonella enterica enterica serovar Typhi
cgguugcaauuccgc

SEQ ID NO: 3613035 - RNA, 16 nt, Salmonella enterica enterica serovar Typhi
cgguugccaaugcgga

SEQ ID NO: 3613036 - RNA, 18 nt, Salmonella enterica enterica serovar Typhi
cgguugccuuucgccagc

SEQ ID NO: 3613037 - RNA, 15 nt, Salmonella enterica enterica serovar Typhi
cgguuuaagcggaua

SEQ ID NO: 3613038 - RNA, 20 nt, Salmonella enterica enterica serovar Typhi
cgguuuauccgcaacugaaa

SEQ ID NO: 3613039 - RNA, 23 nt, Salmonella enterica enterica serovar Typhi
cgguuuaugaugccgcuucgcca

SEQ ID NO: 3613040 - RNA, 17 nt, Salmonella enterica enterica serovar Typhi
cgguuucuaccacccag

SEQ ID NO: 3613041 - RNA, 17 nt, Salmonella enterica enterica serovar Typhi
cgguuugagcaccacgc

SEQ ID NO: 3613042 - RNA, 19 nt, Salmonella enterica enterica serovar Typhi
cgguuugcaggccggauaa

SEQ ID NO: 3613043 - RNA, 17 nt, Salmonella enterica enterica serovar Typhi
cgguuugcgccuacgau

SEQ ID NO: 3613044 - RNA, 20 nt, Salmonella enterica enterica serovar Typhi
cgguuugggcgcgaaacugc

SEQ ID NO: 3613045 - RNA, 21 nt, Salmonella enterica enterica serovar Typhi
cgguuuuacuauugccgauaa

SEQ ID NO: 3613046 - RNA, 22 nt, Salmonella enterica enterica serovar Typhi
cgguuuuauaguagcgcgcgcu

SEQ ID NO: 3613047 - RNA, 17 nt, Salmonella enterica enterica serovar Typhi
cgguuuuauccccuuca

SEQ ID NO: 3613048 - RNA, 21 nt, Salmonella enterica enterica serovar Typhi
cgguuuuauccccuucaggaa

SEQ ID NO: 3613049 - RNA, 14 nt, Salmonella enterica enterica serovar Typhi
cgguuuuccggguc

SEQ ID NO: 3613050 - RNA, 13 nt, Salmonella enterica enterica serovar Typhi
cgguuuugcgcug

SEQ ID NO: 3613051 - RNA, 21 nt, Salmonella enterica enterica serovar Typhi
cgguuuuuuuguggccugcuu

SEQ ID NO: 3613052 - RNA, 23 nt, Salmonella enterica enterica serovar Typhi
cgguuuuuuuguggccugcuuaa

SEQ ID NO: 3613053 - RNA, 16 nt, Salmonella enterica enterica serovar Typhi
cguaaaaaacaucaua

SEQ ID NO: 3613054 - RNA, 14 nt, Salmonella enterica enterica serovar Typhi
cguaaaaacccuuu

SEQ ID NO: 3613055 - RNA, 22 nt, Salmonella enterica enterica serovar Typhi
cguaaaaauuguuccuguaaag

SEQ ID NO: 3613056 - RNA, 15 nt, Salmonella enterica enterica serovar Typhi
cguaaaacaacagcg

SEQ ID NO: 3613057 - RNA, 18 nt, Salmonella enterica enterica serovar Typhi
cguaaaacaacagcggcg

SEQ ID NO: 3613058 - RNA, 19 nt, Salmonella enterica enterica serovar Typhi
cguaaaagcgauaaagaca

SEQ ID NO: 3613059 - RNA, 14 nt, Salmonella enterica enterica serovar Typhi
cguaaaauauacag

SEQ ID NO: 3613060 - RNA, 22 nt, Salmonella enterica enterica serovar Typhi
cguaaaauauauauuuucucaa

SEQ ID NO: 3613061 - RNA, 16 nt, Salmonella enterica enterica serovar Typhi
cguaaacacguuaucu

SEQ ID NO: 3613062 - RNA, 15 nt, Salmonella enterica enterica serovar Typhi
cguaaaccauuucuc

SEQ ID NO: 3613063 - RNA, 20 nt, Salmonella enterica enterica serovar Typhi
cguaaaccccuucaccgcuu

SEQ ID NO: 3613064 - RNA, 21 nt, Salmonella enterica enterica serovar Typhi
cguaaaccccuucaccgcuuu

SEQ ID NO: 3613065 - RNA, 18 nt, Salmonella enterica enterica serovar Typhi
cguaaagcaucagacuac

SEQ ID NO: 3613066 - RNA, 14 nt, Salmonella enterica enterica serovar Typhi
cguaaagcauggcu

SEQ ID NO: 3613067 - RNA, 16 nt, Salmonella enterica enterica serovar Typhi
cguaaagcgcauccag

SEQ ID NO: 3613068 - RNA, 12 nt, Salmonella enterica enterica serovar Typhi
cguaaagcuggc

SEQ ID NO: 3613069 - RNA, 22 nt, Salmonella enterica enterica serovar Typhi
cguaaagcuggccuucagguuu

SEQ ID NO: 3613070 - RNA, 15 nt, Salmonella enterica enterica serovar Typhi
cguaaaguucccagc

SEQ ID NO: 3613071 - RNA, 17 nt, Salmonella enterica enterica serovar Typhi
cguaaauaaauaccgca

SEQ ID NO: 3613072 - RNA, 21 nt, Salmonella enterica enterica serovar Typhi
cguaaauaccaccugccaaag

SEQ ID NO: 3613073 - RNA, 14 nt, Salmonella enterica enterica serovar Typhi
cguaaauacccagg

SEQ ID NO: 3613074 - RNA, 13 nt, Salmonella enterica enterica serovar Typhi
cguaaaucaggcc

SEQ ID NO: 3613075 - RNA, 20 nt, Salmonella enterica enterica serovar Typhi
cguaaauccacauuccagac

SEQ ID NO: 3613076 - RNA, 23 nt, Salmonella enterica enterica serovar Typhi
cguaaaucgcgagccuucaacaa

SEQ ID NO: 3613077 - RNA, 17 nt, Salmonella enterica enterica serovar Typhi
cguaaauucccuccaga

SEQ ID NO: 3613078 - RNA, 18 nt, Salmonella enterica enterica serovar Typhi
cguaaauucccuccagau

SEQ ID NO: 3613079 - RNA, 23 nt, Salmonella enterica enterica serovar Typhi
cguaacagacgcaucuuuuuccc

SEQ ID NO: 3613080 - RNA, 13 nt, Salmonella enterica enterica serovar Typhi
cguaacaggucac

SEQ ID NO: 3613081 - RNA, 17 nt, Salmonella enterica enterica serovar Typhi
cguaaccgcaaaugcca

SEQ ID NO: 3613082 - RNA, 19 nt, Salmonella enterica enterica serovar Typhi
cguaacgccgucgacaaag

SEQ ID NO: 3613083 - RNA, 16 nt, Salmonella enterica enterica serovar Typhi
cguaacgcgcaucuuc

SEQ ID NO: 3613084 - RNA, 20 nt, Salmonella enterica enterica serovar Typhi
cguaacggcugacgcccauc

SEQ ID NO: 3613085 - RNA, 14 nt, Salmonella enterica enterica serovar Typhi
cguaacguaaccug

SEQ ID NO: 3613086 - RNA, 16 nt, Salmonella enterica enterica serovar Typhi
cguaacgucguaaauu

SEQ ID NO: 3613087 - RNA, 21 nt, Salmonella enterica enterica serovar Typhi
cguaacugcgguaaauaaugc

SEQ ID NO: 3613088 - RNA, 19 nt, Salmonella enterica enterica serovar Typhi
cguaacuugauuccuggcu

SEQ ID NO: 3613089 - RNA, 22 nt, Salmonella enterica enterica serovar Typhi
cguaagccaccgcccagagaau

SEQ ID NO: 3613090 - RNA, 22 nt, Salmonella enterica enterica serovar Typhi
cguaagcgcccguccaugagua

SEQ ID NO: 3613091 - RNA, 16 nt, Salmonella enterica enterica serovar Typhi
cguaagcgggaugggu

SEQ ID NO: 3613092 - RNA, 23 nt, Salmonella enterica enterica serovar Typhi
cguaagcuuucugaauuucacgc

SEQ ID NO: 3613093 - RNA, 18 nt, Salmonella enterica enterica serovar Typhi
cguaaggauacucagcga

SEQ ID NO: 3613094 - RNA, 10 nt, Salmonella enterica enterica serovar Typhi
cguaucuucc

SEQ ID NO: 3613095 - RNA, 14 nt, Salmonella enterica enterica serovar Typhi
cguaugaaugaaac

SEQ ID NO: 3613096 - RNA, 22 nt, Salmonella enterica enterica serovar Typhi
cguaugacguggccagcaugcc

SEQ ID NO: 3613097 - RNA, 21 nt, Salmonella enterica enterica serovar Typhi
cguaugauuuucuuauuacaa

SEQ ID NO: 3613098 - RNA, 14 nt, Salmonella enterica enterica serovar Typhi
cguaugcagccagg

SEQ ID NO: 3613099 - RNA, 18 nt, Salmonella enterica enterica serovar Typhi
cguaugcagccaggccau

SEQ ID NO: 3613100 - RNA, 20 nt, Salmonella enterica enterica serovar Typhi
cguauuacaaguaauaaaau

SEQ ID NO: 3613101 - RNA, 13 nt, Salmonella enterica enterica serovar Typhi
cguauuagauaag

SEQ ID NO: 3613102 - RNA, 12 nt, Salmonella enterica enterica serovar Typhi
cguauucccccu

SEQ ID NO: 3613103 - RNA, 15 nt, Salmonella enterica enterica serovar Typhi
cguauucuuacccac

SEQ ID NO: 3613104 - RNA, 12 nt, Salmonella enterica enterica serovar Typhi
cguauugccauc

SEQ ID NO: 3613105 - RNA, 16 nt, Salmonella enterica enterica serovar Typhi
cgucaaaacagauucc

SEQ ID NO: 3613106 - RNA, 17 nt, Salmonella enterica enterica serovar Typhi
cgucaaaacaggucugu

SEQ ID NO: 3613107 - RNA, 18 nt, Salmonella enterica enterica serovar Typhi
cgucaaaaccaaacagcg

SEQ ID NO: 3613108 - RNA, 23 nt, Salmonella enterica enterica serovar Typhi
cgucaaaaccaaacagcgacaca

SEQ ID NO: 3613109 - RNA, 18 nt, Salmonella enterica enterica serovar Typhi
cgucaaaacuuauuuuau

SEQ ID NO: 3613110 - RNA, 15 nt, Salmonella enterica enterica serovar Typhi
cgucaaacaguucag

SEQ ID NO: 3613111 - RNA, 17 nt, Salmonella enterica enterica serovar Typhi
cgucaaacaguucagac

SEQ ID NO: 3613112 - RNA, 16 nt, Salmonella enterica enterica serovar Typhi
cgucaaacaguuccug

SEQ ID NO: 3613113 - RNA, 18 nt, Salmonella enterica enterica serovar Typhi
cgucaaacucuuccgggc

SEQ ID NO: 3613114 - RNA, 23 nt, Salmonella enterica enterica serovar Typhi
cgucaaauagagaaaauaacaau

SEQ ID NO: 3613115 - RNA, 20 nt, Salmonella enterica enterica serovar Typhi
cgucaaauucacccguuauu

SEQ ID NO: 3613116 - RNA, 14 nt, Salmonella enterica enterica serovar Typhi
cgucaacgaccaga

SEQ ID NO: 3613117 - RNA, 15 nt, Salmonella enterica enterica serovar Typhi
cgucaacgaccagaa

SEQ ID NO: 3613118 - RNA, 22 nt, Salmonella enterica enterica serovar Typhi
cgucaacgcacuguaacgcacu

SEQ ID NO: 3613119 - RNA, 17 nt, Salmonella enterica enterica serovar Typhi
cgucaacgcuuuuaucg

SEQ ID NO: 3613120 - RNA, 16 nt, Salmonella enterica enterica serovar Typhi
cgucaacguuuuucag

SEQ ID NO: 3613121 - RNA, 20 nt, Salmonella enterica enterica serovar Typhi
cgucaagaucgcgcagcagg

SEQ ID NO: 3613122 - RNA, 19 nt, Salmonella enterica enterica serovar Typhi
cgucaauaaagccgcccau

SEQ ID NO: 3613123 - RNA, 13 nt, Salmonella enterica enterica serovar Typhi
cgucaauaacagg

SEQ ID NO: 3613124 - RNA, 15 nt, Salmonella enterica enterica serovar Typhi
cgucaauaaucgcgc

SEQ ID NO: 3613125 - RNA, 21 nt, Salmonella enterica enterica serovar Typhi
cgucaaucaggaaagagccgc

SEQ ID NO: 3613126 - RNA, 23 nt, Salmonella enterica enterica serovar Typhi
cgucacaaaaacacccgcagccg

SEQ ID NO: 3613127 - RNA, 21 nt, Salmonella enterica enterica serovar Typhi
cgucacaauaucgagaugacc

SEQ ID NO: 3613128 - RNA, 20 nt, Salmonella enterica enterica serovar Typhi
cgucaccaccgcaggcagcg

SEQ ID NO: 3613129 - RNA, 22 nt, Salmonella enterica enterica serovar Typhi
cgucaccacgguguaccccgcc

SEQ ID NO: 3613130 - RNA, 23 nt, Salmonella enterica enterica serovar Typhi
cgucacccgccggcagcagcuuc

SEQ ID NO: 3613131 - RNA, 11 nt, Salmonella enterica enterica serovar Typhi
cgucacccggc

SEQ ID NO: 3613132 - RNA, 15 nt, Salmonella enterica enterica serovar Typhi
cgucaccgaauagcg

SEQ ID NO: 3613133 - RNA, 13 nt, Salmonella enterica enterica serovar Typhi
cgucaccgcgcac

SEQ ID NO: 3613134 - RNA, 16 nt, Salmonella enterica enterica serovar Typhi
cgucaccggaucgcug

SEQ ID NO: 3613135 - RNA, 15 nt, Salmonella enterica enterica serovar Typhi
cgucaccgggcugca

SEQ ID NO: 3613136 - RNA, 19 nt, Salmonella enterica enterica serovar Typhi
cgucaccguauugccaucg

SEQ ID NO: 3613137 - RNA, 21 nt, Salmonella enterica enterica serovar Typhi
cgucacgaaugucgcgucagg

SEQ ID NO: 3613138 - RNA, 17 nt, Salmonella enterica enterica serovar Typhi
cgucacgcaacaggccg

SEQ ID NO: 3613139 - RNA, 17 nt, Salmonella enterica enterica serovar Typhi
cgucacgcaugucguau

SEQ ID NO: 3613140 - RNA, 21 nt, Salmonella enterica enterica serovar Typhi
cgucacgccgacgaccggcag

SEQ ID NO: 3613141 - RNA, 18 nt, Salmonella enterica enterica serovar Typhi
cgucacgcguucgaccgu

SEQ ID NO: 3613142 - RNA, 15 nt, Salmonella enterica enterica serovar Typhi
cgucagaaauccgcg

SEQ ID NO: 3613143 - RNA, 22 nt, Salmonella enterica enterica serovar Typhi
cgucagacggcuccagcgccag

SEQ ID NO: 3613144 - RNA, 15 nt, Salmonella enterica enterica serovar Typhi
cgucagauucugcgg

SEQ ID NO: 3613145 - RNA, 19 nt, Salmonella enterica enterica serovar Typhi
cgucagauucugcgguaau

SEQ ID NO: 3613146 - RNA, 15 nt, Salmonella enterica enterica serovar Typhi
cgucagcaacaccac

SEQ ID NO: 3613147 - RNA, 16 nt, Salmonella enterica enterica serovar Typhi
cgucagcacgccgccc

SEQ ID NO: 3613148 - RNA, 15 nt, Salmonella enterica enterica serovar Typhi
cgucagcaucuccug

SEQ ID NO: 3613149 - RNA, 13 nt, Salmonella enterica enterica serovar Typhi
cgucagcauggua

SEQ ID NO: 3613150 - RNA, 11 nt, Salmonella enterica enterica serovar Typhi
cgucagccaga

SEQ ID NO: 3613151 - RNA, 15 nt, Salmonella enterica enterica serovar Typhi
cgucagccagaacga

SEQ ID NO: 3613152 - RNA, 22 nt, Salmonella enterica enterica serovar Typhi
cgucagcccaagcugacggaua

SEQ ID NO: 3613153 - RNA, 13 nt, Salmonella enterica enterica serovar Typhi
cgucagcgcgucg

SEQ ID NO: 3613154 - RNA, 17 nt, Salmonella enterica enterica serovar Typhi
cgucagcgcuugccgca

SEQ ID NO: 3613155 - RNA, 17 nt, Salmonella enterica enterica serovar Typhi
cgucaggacggcgaaua

SEQ ID NO: 3613156 - RNA, 14 nt, Salmonella enterica enterica serovar Typhi
cgucaggaggccug

SEQ ID NO: 3613157 - RNA, 23 nt, Salmonella enterica enterica serovar Typhi
cgucaggcccauuuucggcauca

SEQ ID NO: 3613158 - RNA, 22 nt, Salmonella enterica enterica serovar Typhi
cgucaggcgaaguuccgggcuc

SEQ ID NO: 3613159 - RNA, 22 nt, Salmonella enterica enterica serovar Typhi
cgucaggcuguuguucuuuucu

SEQ ID NO: 3613160 - RNA, 16 nt, Salmonella enterica enterica serovar Typhi
cgucaggcuugccgcg

SEQ ID NO: 3613161 - RNA, 19 nt, Salmonella enterica enterica serovar Typhi
cgucaggcuugccgcgcca

SEQ ID NO: 3613162 - RNA, 21 nt, Salmonella enterica enterica serovar Typhi
cgucaggcuugccgcgccaga

SEQ ID NO: 3613163 - RNA, 13 nt, Salmonella enterica enterica serovar Typhi
cgucagucgcucu

SEQ ID NO: 3613164 - RNA, 15 nt, Salmonella enterica enterica serovar Typhi
cgucauaacgcgcau

SEQ ID NO: 3613165 - RNA, 13 nt, Salmonella enterica enterica serovar Typhi
cgucauaaucgcg

SEQ ID NO: 3613166 - RNA, 22 nt, Salmonella enterica enterica serovar Typhi
cgucauacccgcgcucuccggc

SEQ ID NO: 3613167 - RNA, 15 nt, Salmonella enterica enterica serovar Typhi
cgucauacugccaac

SEQ ID NO: 3613168 - RNA, 16 nt, Salmonella enterica enterica serovar Typhi
cgucauagccgcgcgu

SEQ ID NO: 3613169 - RNA, 16 nt, Salmonella enterica enterica serovar Typhi
cgucauauagccgcgc

SEQ ID NO: 3613170 - RNA, 18 nt, Salmonella enterica enterica serovar Typhi
cgucauauagccgcgcag

SEQ ID NO: 3613171 - RNA, 13 nt, Salmonella enterica enterica serovar Typhi
cgucaucaacaua

SEQ ID NO: 3613172 - RNA, 23 nt, Salmonella enterica enterica serovar Typhi
cgucaucaggccauuaacgccgc

SEQ ID NO: 3613173 - RNA, 15 nt, Salmonella enterica enterica serovar Typhi
cgucaucaggcguug

SEQ ID NO: 3613174 - RNA, 23 nt, Salmonella enterica enterica serovar Typhi
cgucaucauuaccuuuuccggcg

SEQ ID NO: 3613175 - RNA, 12 nt, Salmonella enterica enterica serovar Typhi
cgucaucauugc

SEQ ID NO: 3613176 - RNA, 17 nt, Salmonella enterica enterica serovar Typhi
cgucaucauugcgccaa

SEQ ID NO: 3613177 - RNA, 19 nt, Salmonella enterica enterica serovar Typhi
cgucauccgcguaaucgcg

SEQ ID NO: 3613178 - RNA, 18 nt, Salmonella enterica enterica serovar Typhi
cgucauccggcaaucaga

SEQ ID NO: 3613179 - RNA, 14 nt, Salmonella enterica enterica serovar Typhi
cgucauccugcagg

SEQ ID NO: 3613180 - RNA, 20 nt, Salmonella enterica enterica serovar Typhi
cgucguuggcauggucagca

SEQ ID NO: 3613181 - RNA, 21 nt, Salmonella enterica enterica serovar Typhi
cgucguuguccggcugaagcg

SEQ ID NO: 3613182 - RNA, 13 nt, Salmonella enterica enterica serovar Typhi
cgucuauagauga

SEQ ID NO: 3613183 - RNA, 15 nt, Salmonella enterica enterica serovar Typhi
cgucucucauuuucu

SEQ ID NO: 3613184 - RNA, 18 nt, Salmonella enterica enterica serovar Typhi
cgucucuuucauggaaau

SEQ ID NO: 3613185 - RNA, 20 nt, Salmonella enterica enterica serovar Typhi
cgucugaagaaguucuucug

SEQ ID NO: 3613186 - RNA, 16 nt, Salmonella enterica enterica serovar Typhi
cgucugacgcuugcau

SEQ ID NO: 3613187 - RNA, 15 nt, Salmonella enterica enterica serovar Typhi
cgucugaugaauacg

SEQ ID NO: 3613188 - RNA, 14 nt, Salmonella enterica enterica serovar Typhi
cgucugauucaggu

SEQ ID NO: 3613189 - RNA, 22 nt, Salmonella enterica enterica serovar Typhi
cgucugcacguuuugcucuucu

SEQ ID NO: 3613190 - RNA, 13 nt, Salmonella enterica enterica serovar Typhi
cgucugcucagaa

SEQ ID NO: 3613191 - RNA, 18 nt, Salmonella enterica enterica serovar Typhi
cgucugcugaaaugccug

SEQ ID NO: 3613192 - RNA, 20 nt, Salmonella enterica enterica serovar Typhi
cgucugguaauaggccggag

SEQ ID NO: 3613193 - RNA, 19 nt, Salmonella enterica enterica serovar Typhi
cgucugguacggccaccag

SEQ ID NO: 3613194 - RNA, 20 nt, Salmonella enterica enterica serovar Typhi
cgucugguacggccaccagg

SEQ ID NO: 3613195 - RNA, 14 nt, Salmonella enterica enterica serovar Typhi
cgucuggugaucca

SEQ ID NO: 3613196 - RNA, 15 nt, Salmonella enterica enterica serovar Typhi
cgucuguguuuaucc

SEQ ID NO: 3613197 - RNA, 22 nt, Salmonella enterica enterica serovar Typhi
cgucuguuucaacgcauccagc

SEQ ID NO: 3613198 - RNA, 21 nt, Salmonella enterica enterica serovar Typhi
cgucuuaaaauugcucagcca

SEQ ID NO: 3613199 - RNA, 17 nt, Salmonella enterica enterica serovar Typhi
cgucuuaaugcucucca

SEQ ID NO: 3613200 - RNA, 21 nt, Salmonella enterica enterica serovar Typhi
cgucuuaaugguggucgcggc

SEQ ID NO: 3613201 - RNA, 23 nt, Salmonella enterica enterica serovar Typhi
cgucuuaaugguggucgcggcca

SEQ ID NO: 3613202 - RNA, 14 nt, Salmonella enterica enterica serovar Typhi
cgucuuagaacugg

SEQ ID NO: 3613203 - RNA, 15 nt, Salmonella enterica enterica serovar Typhi
cgucuuauccggccu

SEQ ID NO: 3613204 - RNA, 16 nt, Salmonella enterica enterica serovar Typhi
cgucuuauccggccuc

SEQ ID NO: 3613205 - RNA, 17 nt, Salmonella enterica enterica serovar Typhi
cgucuuauccggccugc

SEQ ID NO: 3613206 - RNA, 23 nt, Salmonella enterica enterica serovar Typhi
cgucuucaggucauucaggacgg

SEQ ID NO: 3613207 - RNA, 18 nt, Salmonella enterica enterica serovar Typhi
cgucuucaucaacgucaa

SEQ ID NO: 3613208 - RNA, 17 nt, Salmonella enterica enterica serovar Typhi
cgucuucaucagccagc

SEQ ID NO: 3613209 - RNA, 18 nt, Salmonella enterica enterica serovar Typhi
cgucuucaucagccagca

SEQ ID NO: 3613210 - RNA, 21 nt, Salmonella enterica enterica serovar Typhi
cgucuucaucagccagcaucg

SEQ ID NO: 3613211 - RNA, 13 nt, Salmonella enterica enterica serovar Typhi
cgucuucaucuuc

SEQ ID NO: 3613212 - RNA, 17 nt, Salmonella enterica enterica serovar Typhi
cgucuucaucuucgucu

SEQ ID NO: 3613213 - RNA, 17 nt, Salmonella enterica enterica serovar Typhi
cgucuuccggauaacgc

SEQ ID NO: 3613214 - RNA, 12 nt, Salmonella enterica enterica serovar Typhi
cgucuugccgug

SEQ ID NO: 3613215 - RNA, 23 nt, Salmonella enterica enterica serovar Typhi
cgucuuuauucaucaucuugucc

SEQ ID NO: 3613216 - RNA, 14 nt, Salmonella enterica enterica serovar Typhi
cgucuuuuagucac

SEQ ID NO: 3613217 - RNA, 22 nt, Salmonella enterica enterica serovar Typhi
cgucuuuuauccccaccaccgc

SEQ ID NO: 3613218 - RNA, 16 nt, Salmonella enterica enterica serovar Typhi
cgugaaauauccuccg

SEQ ID NO: 3613219 - RNA, 16 nt, Salmonella enterica enterica serovar Typhi
cgugaacaaugccauu

SEQ ID NO: 3613220 - RNA, 16 nt, Salmonella enterica enterica serovar Typhi
cgugaacaccacugaa

SEQ ID NO: 3613221 - RNA, 17 nt, Salmonella enterica enterica serovar Typhi
cgugaacacgccccaca

SEQ ID NO: 3613222 - RNA, 20 nt, Salmonella enterica enterica serovar Typhi
cgugaagauuagcagagcgg

SEQ ID NO: 3613223 - RNA, 19 nt, Salmonella enterica enterica serovar Typhi
cgugaaugguuucccaggu

SEQ ID NO: 3613224 - RNA, 18 nt, Salmonella enterica enterica serovar Typhi
cgugaauguccugcggca

SEQ ID NO: 3613225 - RNA, 19 nt, Salmonella enterica enterica serovar Typhi
cgugaauugcgguuuaucc

SEQ ID NO: 3613226 - RNA, 18 nt, Salmonella enterica enterica serovar Typhi
cgugacaccgguuugcgc

SEQ ID NO: 3613227 - RNA, 20 nt, Salmonella enterica enterica serovar Typhi
cgugacaccgguuugcgccu

SEQ ID NO: 3613228 - RNA, 18 nt, Salmonella enterica enterica serovar Typhi
cgugacaucaagcccaca

SEQ ID NO: 3613229 - RNA, 15 nt, Salmonella enterica enterica serovar Typhi
cgugaccaccgccau

SEQ ID NO: 3613230 - RNA, 15 nt, Salmonella enterica enterica serovar Typhi
cgugacccgccagca

SEQ ID NO: 3613231 - RNA, 20 nt, Salmonella enterica enterica serovar Typhi
cgugaccgauaaaaaagccu

SEQ ID NO: 3613232 - RNA, 21 nt, Salmonella enterica enterica serovar Typhi
cgugaccgguaagcccauggc

SEQ ID NO: 3613233 - RNA, 11 nt, Salmonella enterica enterica serovar Typhi
cgugaccugcu

SEQ ID NO: 3613234 - RNA, 23 nt, Salmonella enterica enterica serovar Typhi
cgugacgccuuccuccaguaauu

SEQ ID NO: 3613235 - RNA, 14 nt, Salmonella enterica enterica serovar Typhi
cgugacgcgccagc

SEQ ID NO: 3613236 - RNA, 17 nt, Salmonella enterica enterica serovar Typhi
cgugacgcgccagcgga

SEQ ID NO: 3613237 - RNA, 21 nt, Salmonella enterica enterica serovar Typhi
cgugacuguucacauccagcc

SEQ ID NO: 3613238 - RNA, 18 nt, Salmonella enterica enterica serovar Typhi
cgugagagaaaaucacgc

SEQ ID NO: 3613239 - RNA, 22 nt, Salmonella enterica enterica serovar Typhi
cgugagccacuauccagucagc

SEQ ID NO: 3613240 - RNA, 21 nt, Salmonella enterica enterica serovar Typhi
cgugagccgaaauccaccagc

SEQ ID NO: 3613241 - RNA, 22 nt, Salmonella enterica enterica serovar Typhi
cgugagccgaaauccaccagcg

SEQ ID NO: 3613242 - RNA, 17 nt, Salmonella enterica enterica serovar Typhi
cgugagccggacacugc

SEQ ID NO: 3613243 - RNA, 15 nt, Salmonella enterica enterica serovar Typhi
cgugagcgcgccgca

SEQ ID NO: 3613244 - RNA, 17 nt, Salmonella enterica enterica serovar Typhi
cgugagcgcgucaucau

SEQ ID NO: 3613245 - RNA, 19 nt, Salmonella enterica enterica serovar Typhi
cgugaguggcggcgcgcag

SEQ ID NO: 3613246 - RNA, 21 nt, Salmonella enterica enterica serovar Typhi
cgugagugguagaaacuggca

SEQ ID NO: 3613247 - RNA, 18 nt, Salmonella enterica enterica serovar Typhi
cgugaguuucaguaucau

SEQ ID NO: 3613248 - RNA, 23 nt, Salmonella enterica enterica serovar Typhi
cgugauaaacgguucagucagcg

SEQ ID NO: 3613249 - RNA, 20 nt, Salmonella enterica enterica serovar Typhi
cgugauaaagguauagugga

SEQ ID NO: 3613250 - RNA, 18 nt, Salmonella enterica enterica serovar Typhi
cgugauaaauacgcugcg

SEQ ID NO: 3613251 - RNA, 21 nt, Salmonella enterica enterica serovar Typhi
cgugauaauucccccauccgc

SEQ ID NO: 3613252 - RNA, 17 nt, Salmonella enterica enterica serovar Typhi
cgugauauugaccaucu

SEQ ID NO: 3613253 - RNA, 19 nt, Salmonella enterica enterica serovar Typhi
cgugaugcgacgcgcucac

SEQ ID NO: 3613254 - RNA, 14 nt, Salmonella enterica enterica serovar Typhi
cgugauugagcaga

SEQ ID NO: 3613255 - RNA, 21 nt, Salmonella enterica enterica serovar Typhi
cgugauuuuggccucauccgc

SEQ ID NO: 3613256 - RNA, 19 nt, Salmonella enterica enterica serovar Typhi
cgugcaaaaucacgcggcg

SEQ ID NO: 3613257 - RNA, 15 nt, Salmonella enterica enterica serovar Typhi
cgugcaaccccuugc

SEQ ID NO: 3613258 - RNA, 18 nt, Salmonella enterica enterica serovar Typhi
cgugcaaugucaugacug

SEQ ID NO: 3613259 - RNA, 13 nt, Salmonella enterica enterica serovar Typhi
cgugcacgcugcg

SEQ ID NO: 3613260 - RNA, 13 nt, Salmonella enterica enterica serovar Typhi
cgugcagcgccgc

SEQ ID NO: 3613261 - RNA, 15 nt, Salmonella enterica enterica serovar Typhi
cgugcagcgccgccu

SEQ ID NO: 3613262 - RNA, 16 nt, Salmonella enterica enterica serovar Typhi
cgugcagcgccgccug

SEQ ID NO: 3613263 - RNA, 18 nt, Salmonella enterica enterica serovar Typhi
cgugcagcgugccgggau

SEQ ID NO: 3613264 - RNA, 20 nt, Salmonella enterica enterica serovar Typhi
cgugcaguucuguaggccgg

SEQ ID NO: 3613265 - RNA, 21 nt, Salmonella enterica enterica serovar Typhi
cguuaaucgauuuucuccgga

SEQ ID NO: 3613266 - RNA, 13 nt, Salmonella enterica enterica serovar Typhi
cguuaaucggcac

SEQ ID NO: 3613267 - RNA, 22 nt, Salmonella enterica enterica serovar Typhi
cguuaaugcgcgcuucuucaug

SEQ ID NO: 3613268 - RNA, 17 nt, Salmonella enterica enterica serovar Typhi
cguuaauucauggccau

SEQ ID NO: 3613269 - RNA, 23 nt, Salmonella enterica enterica serovar Typhi
cguuaauugauggcaccaccugg

SEQ ID NO: 3613270 - RNA, 20 nt, Salmonella enterica enterica serovar Typhi
cguuaauuuuccccgcacgc

SEQ ID NO: 3613271 - RNA, 14 nt, Salmonella enterica enterica serovar Typhi
cguuacaaauagcg

SEQ ID NO: 3613272 - RNA, 12 nt, Salmonella enterica enterica serovar Typhi
cguuaccagcau

SEQ ID NO: 3613273 - RNA, 18 nt, Salmonella enterica enterica serovar Typhi
cguuaccagcaucaauag

SEQ ID NO: 3613274 - RNA, 16 nt, Salmonella enterica enterica serovar Typhi
cguuacccaugagcga

SEQ ID NO: 3613275 - RNA, 20 nt, Salmonella enterica enterica serovar Typhi
cguuacccgauaccgccagc

SEQ ID NO: 3613276 - RNA, 15 nt, Salmonella enterica enterica serovar Typhi
cguuacccggccagc

SEQ ID NO: 3613277 - RNA, 12 nt, Salmonella enterica enterica serovar Typhi
cguuacccuccu

SEQ ID NO: 3613278 - RNA, 16 nt, Salmonella enterica enterica serovar Typhi
cguuaccgccgagcau

SEQ ID NO: 3613279 - RNA, 15 nt, Salmonella enterica enterica serovar Typhi
cguuaccggcaggcu

SEQ ID NO: 3613280 - RNA, 21 nt, Salmonella enterica enterica serovar Typhi
cguuaccggugauauugccga

SEQ ID NO: 3613281 - RNA, 14 nt, Salmonella enterica enterica serovar Typhi
cguuaccguggcgg

SEQ ID NO: 3613282 - RNA, 13 nt, Salmonella enterica enterica serovar Typhi
cguuacgcauuuc

SEQ ID NO: 3613283 - RNA, 20 nt, Salmonella enterica enterica serovar Typhi
cguuacggcugaagcugccg

SEQ ID NO: 3613284 - RNA, 19 nt, Salmonella enterica enterica serovar Typhi
cguuacuuucauaauguuc

SEQ ID NO: 3613285 - RNA, 15 nt, Salmonella enterica enterica serovar Typhi
cguuagaauaacguu

SEQ ID NO: 3613286 - RNA, 19 nt, Salmonella enterica enterica serovar Typhi
cguuagauauagcuuuuca

SEQ ID NO: 3613287 - RNA, 20 nt, Salmonella enterica enterica serovar Typhi
cguuagauauagcuuuucaa

SEQ ID NO: 3613288 - RNA, 19 nt, Salmonella enterica enterica serovar Typhi
cguuagccgccauccggca

SEQ ID NO: 3613289 - RNA, 16 nt, Salmonella enterica enterica serovar Typhi
cguuagcggcguugcc

SEQ ID NO: 3613290 - RNA, 21 nt, Salmonella enterica enterica serovar Typhi
cguuagcguuuugaacgccgc

SEQ ID NO: 3613291 - RNA, 15 nt, Salmonella enterica enterica serovar Typhi
cguuaggccacuuca

SEQ ID NO: 3613292 - RNA, 19 nt, Salmonella enterica enterica serovar Typhi
cguuagucaacucgcacag

SEQ ID NO: 3613293 - RNA, 21 nt, Salmonella enterica enterica serovar Typhi
cguuauaaggccugccguccu

SEQ ID NO: 3613294 - RNA, 12 nt, Salmonella enterica enterica serovar Typhi
cguuauccagca

SEQ ID NO: 3613295 - RNA, 15 nt, Salmonella enterica enterica serovar Typhi
cguuauccagcagcc

SEQ ID NO: 3613296 - RNA, 18 nt, Salmonella enterica enterica serovar Typhi
cguuauccagcagccaca

SEQ ID NO: 3613297 - RNA, 18 nt, Salmonella enterica enterica serovar Typhi
cguuaucguagugccaca

SEQ ID NO: 3613298 - RNA, 23 nt, Salmonella enterica enterica serovar Typhi
cguuaucguagugccacaacgcc

SEQ ID NO: 3613299 - RNA, 17 nt, Salmonella enterica enterica serovar Typhi
cguuaucugaccuacag

SEQ ID NO: 3613300 - RNA, 18 nt, Salmonella enterica enterica serovar Typhi
cguuaucugaccuacagg

SEQ ID NO: 3613301 - RNA, 15 nt, Salmonella enterica enterica serovar Typhi
cguuauucgaugcgg

SEQ ID NO: 3613302 - RNA, 20 nt, Salmonella enterica enterica serovar Typhi
cguuauugaccaucgccagc

SEQ ID NO: 3613303 - RNA, 15 nt, Salmonella enterica enterica serovar Typhi
cguuauuuuccugaa

SEQ ID NO: 3613304 - RNA, 21 nt, Salmonella enterica enterica serovar Typhi
cguuauuuuccugaaaaaauu

SEQ ID NO: 3613305 - RNA, 19 nt, Salmonella enterica enterica serovar Typhi
cguucaacggcaaaucgcg

SEQ ID NO: 3613306 - RNA, 21 nt, Salmonella enterica enterica serovar Typhi
cguucaccagccacugcgcca

SEQ ID NO: 3613307 - RNA, 16 nt, Salmonella enterica enterica serovar Typhi
cguucacgaucaccug

SEQ ID NO: 3613308 - RNA, 11 nt, Salmonella enterica enterica serovar Typhi
cguucacgccg

SEQ ID NO: 3613309 - RNA, 23 nt, Salmonella enterica enterica serovar Typhi
cguucacuaacgcggcaucaagc

SEQ ID NO: 3613310 - RNA, 21 nt, Salmonella enterica enterica serovar Typhi
cguucagauaggcgcgaaaug

SEQ ID NO: 3613311 - RNA, 17 nt, Salmonella enterica enterica serovar Typhi
cguucagcauauccagc

SEQ ID NO: 3613312 - RNA, 12 nt, Salmonella enterica enterica serovar Typhi
cguucagcaucg

SEQ ID NO: 3613313 - RNA, 15 nt, Salmonella enterica enterica serovar Typhi
cguucagcaucggga

SEQ ID NO: 3613314 - RNA, 19 nt, Salmonella enterica enterica serovar Typhi
cguucagcccuuauaucau

SEQ ID NO: 3613315 - RNA, 18 nt, Salmonella enterica enterica serovar Typhi
cguucaucaggcaauaaa

SEQ ID NO: 3613316 - RNA, 17 nt, Salmonella enterica enterica serovar Typhi
cguucauccaugauggc

SEQ ID NO: 3613317 - RNA, 18 nt, Salmonella enterica enterica serovar Typhi
cguucauccgucuggcga

SEQ ID NO: 3613318 - RNA, 12 nt, Salmonella enterica enterica serovar Typhi
cguucauccucc

SEQ ID NO: 3613319 - RNA, 15 nt, Salmonella enterica enterica serovar Typhi
cguucaucggcauac

SEQ ID NO: 3613320 - RNA, 16 nt, Salmonella enterica enterica serovar Typhi
cguucaucggcauaca

SEQ ID NO: 3613321 - RNA, 15 nt, Salmonella enterica enterica serovar Typhi
cguucauucccgcca

SEQ ID NO: 3613322 - RNA, 19 nt, Salmonella enterica enterica serovar Typhi
cguucauucgccccagcau

SEQ ID NO: 3613323 - RNA, 16 nt, Salmonella enterica enterica serovar Typhi
cguucauugcuuucuu

SEQ ID NO: 3613324 - RNA, 19 nt, Salmonella enterica enterica serovar Typhi
cguuccacgucgcacgcca

SEQ ID NO: 3613325 - RNA, 18 nt, Salmonella enterica enterica serovar Typhi
cguuccaucacuuccugu

SEQ ID NO: 3613326 - RNA, 20 nt, Salmonella enterica enterica serovar Typhi
cguuccgcgauuuccugugu

SEQ ID NO: 3613327 - RNA, 18 nt, Salmonella enterica enterica serovar Typhi
cguuccgguucaggcuua

SEQ ID NO: 3613328 - RNA, 14 nt, Salmonella enterica enterica serovar Typhi
cguuccguuaauug

SEQ ID NO: 3613329 - RNA, 16 nt, Salmonella enterica enterica serovar Typhi
cguuccucaacagcgc

SEQ ID NO: 3613330 - RNA, 18 nt, Salmonella enterica enterica serovar Typhi
cguucgacaacggaucgc

SEQ ID NO: 3613331 - RNA, 21 nt, Salmonella enterica enterica serovar Typhi
cguucgcauauucugcgaaag

SEQ ID NO: 3613332 - RNA, 17 nt, Salmonella enterica enterica serovar Typhi
cguucgcgguaaucgcg

SEQ ID NO: 3613333 - RNA, 20 nt, Salmonella enterica enterica serovar Typhi
cguucgcgucacaaucgcgc

SEQ ID NO: 3613334 - RNA, 18 nt, Salmonella enterica enterica serovar Typhi
cguucgggguugaugguu

SEQ ID NO: 3613335 - RNA, 16 nt, Salmonella enterica enterica serovar Typhi
cguucggguuuuccug

SEQ ID NO: 3613336 - RNA, 22 nt, Salmonella enterica enterica serovar Typhi
cguucuaucagguaucccgcca

SEQ ID NO: 3613337 - RNA, 22 nt, Salmonella enterica enterica serovar Typhi
cguucuauugucaccgggcgcu

SEQ ID NO: 3613338 - RNA, 23 nt, Salmonella enterica enterica serovar Typhi
cguucuauugucaccgggcgcug

SEQ ID NO: 3613339 - RNA, 20 nt, Salmonella enterica enterica serovar Typhi
cguucucacggucuccugaa

SEQ ID NO: 3613340 - RNA, 22 nt, Salmonella enterica enterica serovar Typhi
cguucucacggucuccugaacu

SEQ ID NO: 3613341 - RNA, 15 nt, Salmonella enterica enterica serovar Typhi
cguucucauugcugu

SEQ ID NO: 3613342 - RNA, 12 nt, Salmonella enterica enterica serovar Typhi
cguucugcgcca

SEQ ID NO: 3613343 - RNA, 16 nt, Salmonella enterica enterica serovar Typhi
cguucugucgauaaac

SEQ ID NO: 3613344 - RNA, 15 nt, Salmonella enterica enterica serovar Typhi
cguucuuccagaacg

SEQ ID NO: 3613345 - RNA, 15 nt, Salmonella enterica enterica serovar Typhi
cguucuuuugaacuu

SEQ ID NO: 3613346 - RNA, 15 nt, Salmonella enterica enterica serovar Typhi
cguugaccagcgacg

SEQ ID NO: 3613347 - RNA, 22 nt, Salmonella enterica enterica serovar Typhi
cguugaguauugacgaaaagau

SEQ ID NO: 3613348 - RNA, 19 nt, Salmonella enterica enterica serovar Typhi
cguugaguuugacugccag

SEQ ID NO: 3613349 - RNA, 15 nt, Salmonella enterica enterica serovar Typhi
cguugauagacgaca

SEQ ID NO: 3613350 - RNA, 14 nt, Salmonella enterica enterica serovar Typhi
cguugauaucgcug

SEQ ID NO: 3613351 - RNA, 11 nt, Salmonella enterica enterica serovar Typhi
cuaaaccggcg

SEQ ID NO: 3613352 - RNA, 16 nt, Salmonella enterica enterica serovar Typhi
cuaaaccuucgcuuuu

SEQ ID NO: 3613353 - RNA, 15 nt, Salmonella enterica enterica serovar Typhi
cuaaacucaacuggg

SEQ ID NO: 3613354 - RNA, 18 nt, Salmonella enterica enterica serovar Typhi
cuaaacucaacugggcga

SEQ ID NO: 3613355 - RNA, 13 nt, Salmonella enterica enterica serovar Typhi
cuaaacucaucuu

SEQ ID NO: 3613356 - RNA, 18 nt, Salmonella enterica enterica serovar Typhi
cuaaacucaucuuuauuc

SEQ ID NO: 3613357 - RNA, 18 nt, Salmonella enterica enterica serovar Typhi
cuaaagacgguaaucaga

SEQ ID NO: 3613358 - RNA, 21 nt, Salmonella enterica enterica serovar Typhi
cuaaagacgugccggaagcga

SEQ ID NO: 3613359 - RNA, 16 nt, Salmonella enterica enterica serovar Typhi
cuaaagagcgccugac

SEQ ID NO: 3613360 - RNA, 22 nt, Salmonella enterica enterica serovar Typhi
cuaaagcgacuuauccggccua

SEQ ID NO: 3613361 - RNA, 20 nt, Salmonella enterica enterica serovar Typhi
cuaaagcgcugguggccggg

SEQ ID NO: 3613362 - RNA, 17 nt, Salmonella enterica enterica serovar Typhi
cuaaagggaucuuccug

SEQ ID NO: 3613363 - RNA, 20 nt, Salmonella enterica enterica serovar Typhi
cuaaaguuuauuuaggauuu

SEQ ID NO: 3613364 - RNA, 13 nt, Salmonella enterica enterica serovar Typhi
cuaaauaaaaaua

SEQ ID NO: 3613365 - RNA, 24 nt, Salmonella enterica enterica serovar Typhi
cuaaaucagugauggauuucacga

SEQ ID NO: 3613366 - RNA, 14 nt, Salmonella enterica enterica serovar Typhi
cuaaaucauaccag

SEQ ID NO: 3613367 - RNA, 19 nt, Salmonella enterica enterica serovar Typhi
cuaaaucuuuuugugcaau

SEQ ID NO: 3613368 - RNA, 22 nt, Salmonella enterica enterica serovar Typhi
cuaaaugacgcgcgagaacugc

SEQ ID NO: 3613369 - RNA, 23 nt, Salmonella enterica enterica serovar Typhi
cuaaaugacgcgcgagaacugcu

SEQ ID NO: 3613370 - RNA, 18 nt, Salmonella enterica enterica serovar Typhi
cuaaaugcauagccccag

SEQ ID NO: 3613371 - RNA, 17 nt, Salmonella enterica enterica serovar Typhi
cuaaaugggcaggagau

SEQ ID NO: 3613372 - RNA, 18 nt, Salmonella enterica enterica serovar Typhi
cuaaauugggauguugcc

SEQ ID NO: 3613373 - RNA, 11 nt, Salmonella enterica enterica serovar Typhi
cuaacaggaag

SEQ ID NO: 3613374 - RNA, 22 nt, Salmonella enterica enterica serovar Typhi
cuaacaucauucccguaucuuc

SEQ ID NO: 3613375 - RNA, 20 nt, Salmonella enterica enterica serovar Typhi
cuaaccuguaucugcugaca

SEQ ID NO: 3613376 - RNA, 18 nt, Salmonella enterica enterica serovar Typhi
cuaacgaaaccggcggcg

SEQ ID NO: 3613377 - RNA, 21 nt, Salmonella enterica enterica serovar Typhi
cuaacgacccgaagugguggg

SEQ ID NO: 3613378 - RNA, 15 nt, Salmonella enterica enterica serovar Typhi
cuaacgaggccacca

SEQ ID NO: 3613379 - RNA, 23 nt, Salmonella enterica enterica serovar Typhi
cuaacgcaacggaaggaaauaac

SEQ ID NO: 3613380 - RNA, 19 nt, Salmonella enterica enterica serovar Typhi
cuaacgccugauccggccu

SEQ ID NO: 3613381 - RNA, 20 nt, Salmonella enterica enterica serovar Typhi
cuaacgccugauccggccua

SEQ ID NO: 3613382 - RNA, 18 nt, Salmonella enterica enterica serovar Typhi
cuaacgcgaagauuaacc

SEQ ID NO: 3613383 - RNA, 19 nt, Salmonella enterica enterica serovar Typhi
cuaacgcguacccggcuua

SEQ ID NO: 3613384 - RNA, 14 nt, Salmonella enterica enterica serovar Typhi
cuaacgcucuucuc

SEQ ID NO: 3613385 - RNA, 15 nt, Salmonella enterica enterica serovar Typhi
cuaacgcucuucucc

SEQ ID NO: 3613386 - RNA, 19 nt, Salmonella enterica enterica serovar Typhi
cuaacgcuuauccggccua

SEQ ID NO: 3613387 - RNA, 15 nt, Salmonella enterica enterica serovar Typhi
cuaacgucagcgcca

SEQ ID NO: 3613388 - RNA, 17 nt, Salmonella enterica enterica serovar Typhi
cuaacucaauaacgacu

SEQ ID NO: 3613389 - RNA, 14 nt, Salmonella enterica enterica serovar Typhi
cuaacuggaaaaag

SEQ ID NO: 3613390 - RNA, 17 nt, Salmonella enterica enterica serovar Typhi
cuaacugguacguccau

SEQ ID NO: 3613391 - RNA, 18 nt, Salmonella enterica enterica serovar Typhi
cuaagaccagcaccaucu

SEQ ID NO: 3613392 - RNA, 13 nt, Salmonella enterica enterica serovar Typhi
cuaagaccagcau

SEQ ID NO: 3613393 - RNA, 13 nt, Salmonella enterica enterica serovar Typhi
cuaagagaaaacc

SEQ ID NO: 3613394 - RNA, 21 nt, Salmonella enterica enterica serovar Typhi
cuaagagccugucccaccagg

SEQ ID NO: 3613395 - RNA, 17 nt, Salmonella enterica enterica serovar Typhi
cuaagcagaacggcgau

SEQ ID NO: 3613396 - RNA, 12 nt, Salmonella enterica enterica serovar Typhi
cuaagccagaag

SEQ ID NO: 3613397 - RNA, 19 nt, Salmonella enterica enterica serovar Typhi
cuaagccggacgcccgucc

SEQ ID NO: 3613398 - RNA, 16 nt, Salmonella enterica enterica serovar Typhi
cuaagccggcaggcag

SEQ ID NO: 3613399 - RNA, 15 nt, Salmonella enterica enterica serovar Typhi
cuaagugagcauuac

SEQ ID NO: 3613400 - RNA, 17 nt, Salmonella enterica enterica serovar Typhi
cuaagugaguaaacgcu

SEQ ID NO: 3613401 - RNA, 16 nt, Salmonella enterica enterica serovar Typhi
cuaauaaaauaacuau

SEQ ID NO: 3613402 - RNA, 20 nt, Salmonella enterica enterica serovar Typhi
cuaauaaaauaacuauaauu

SEQ ID NO: 3613403 - RNA, 19 nt, Salmonella enterica enterica serovar Typhi
cuaauauccaccagcccau

SEQ ID NO: 3613404 - RNA, 19 nt, Salmonella enterica enterica serovar Typhi
cuaaucaauaaguuuuuuc

SEQ ID NO: 3613405 - RNA, 18 nt, Salmonella enterica enterica serovar Typhi
cuaaucacccacuucuca

SEQ ID NO: 3613406 - RNA, 16 nt, Salmonella enterica enterica serovar Typhi
cuaauccccauuuuuu

SEQ ID NO: 3613407 - RNA, 20 nt, Salmonella enterica enterica serovar Typhi
cuaauccccauuuuuuucag

SEQ ID NO: 3613408 - RNA, 22 nt, Salmonella enterica enterica serovar Typhi
cuaauccucuucucugaaaaga

SEQ ID NO: 3613409 - RNA, 23 nt, Salmonella enterica enterica serovar Typhi
cuaaucgccacgacgcugguucc

SEQ ID NO: 3613410 - RNA, 15 nt, Salmonella enterica enterica serovar Typhi
cuaaugaagcgcguu

SEQ ID NO: 3613411 - RNA, 15 nt, Salmonella enterica enterica serovar Typhi
cuaaugaauuuaaua

SEQ ID NO: 3613412 - RNA, 17 nt, Salmonella enterica enterica serovar Typhi
cuaaugagccagaugga

SEQ ID NO: 3613413 - RNA, 16 nt, Salmonella enterica enterica serovar Typhi
cuaaugauuaucuuuu

SEQ ID NO: 3613414 - RNA, 15 nt, Salmonella enterica enterica serovar Typhi
cuaauggcaauaaua

SEQ ID NO: 3613415 - RNA, 19 nt, Salmonella enterica enterica serovar Typhi
cuaaugggccagauucuua

SEQ ID NO: 3613416 - RNA, 15 nt, Salmonella enterica enterica serovar Typhi
cuaauguacgccuaa

SEQ ID NO: 3613417 - RNA, 16 nt, Salmonella enterica enterica serovar Typhi
cuaauguacgccuaaa

SEQ ID NO: 3613418 - RNA, 19 nt, Salmonella enterica enterica serovar Typhi
cuaauuaaucugucgaugc

SEQ ID NO: 3613419 - RNA, 14 nt, Salmonella enterica enterica serovar Typhi
cuaauuaauucuaa

SEQ ID NO: 3613420 - RNA, 12 nt, Salmonella enterica enterica serovar Typhi
cuaauuaucugc

SEQ ID NO: 3613421 - RNA, 16 nt, Salmonella enterica enterica serovar Typhi
cuaauuaucugccagc

SEQ ID NO: 3613422 - RNA, 19 nt, Salmonella enterica enterica serovar Typhi
cuaauuauuuuucaaauga

SEQ ID NO: 3613423 - RNA, 12 nt, Salmonella enterica enterica serovar Typhi
cuaauuccagga

SEQ ID NO: 3613424 - RNA, 20 nt, Salmonella enterica enterica serovar Typhi
cuaauuuauugccacgccau

SEQ ID NO: 3613425 - RNA, 13 nt, Salmonella enterica enterica serovar Typhi
cuaauuucaauuu

SEQ ID NO: 3613426 - RNA, 21 nt, Salmonella enterica enterica serovar Typhi
cuaauuugagucgcagcacau

SEQ ID NO: 3613427 - RNA, 17 nt, Salmonella enterica enterica serovar Typhi
cuaauuugaugccuggc

SEQ ID NO: 3613428 - RNA, 13 nt, Salmonella enterica enterica serovar Typhi
cuaauuuuacuuu

SEQ ID NO: 3613429 - RNA, 15 nt, Salmonella enterica enterica serovar Typhi
cuaauuuucagggug

SEQ ID NO: 3613430 - RNA, 14 nt, Salmonella enterica enterica serovar Typhi
cuaauuuuuaaaga

SEQ ID NO: 3613431 - RNA, 12 nt, Salmonella enterica enterica serovar Typhi
cuacaaagcugg

SEQ ID NO: 3613432 - RNA, 13 nt, Salmonella enterica enterica serovar Typhi
cuacaacucagcg

SEQ ID NO: 3613433 - RNA, 20 nt, Salmonella enterica enterica serovar Typhi
cuacaauggaaaaaucugua

SEQ ID NO: 3613434 - RNA, 22 nt, Salmonella enterica enterica serovar Typhi
cuacacacucggugcauuuguc

SEQ ID NO: 3613435 - RNA, 18 nt, Salmonella enterica enterica serovar Typhi
cuacaccuucuucgccaa

SEQ ID NO: 3613436 - RNA, 16 nt, Salmonella enterica enterica serovar Typhi
cuacacgaauaccucu

SEQ ID NO: 3613437 - RNA, 14 nt, Salmonella enterica enterica serovar Typhi
cuauccagucagcg

SEQ ID NO: 3613438 - RNA, 16 nt, Salmonella enterica enterica serovar Typhi
cuauccagucagcguu

SEQ ID NO: 3613439 - RNA, 23 nt, Salmonella enterica enterica serovar Typhi
cuauccaucgccgcgccgucggg

SEQ ID NO: 3613440 - RNA, 18 nt, Salmonella enterica enterica serovar Typhi
cuauccgaugaagccugg

SEQ ID NO: 3613441 - RNA, 15 nt, Salmonella enterica enterica serovar Typhi
cuauccgccgccagc

SEQ ID NO: 3613442 - RNA, 18 nt, Salmonella enterica enterica serovar Typhi
cuauccguccucuuuccc

SEQ ID NO: 3613443 - RNA, 23 nt, Salmonella enterica enterica serovar Typhi
cuauccucuuuuaucacccggau

SEQ ID NO: 3613444 - RNA, 12 nt, Salmonella enterica enterica serovar Typhi
cuauccuggccu

SEQ ID NO: 3613445 - RNA, 18 nt, Salmonella enterica enterica serovar Typhi
cuaucgcgccggacagca

SEQ ID NO: 3613446 - RNA, 20 nt, Salmonella enterica enterica serovar Typhi
cuaucgcuccucccugacug

SEQ ID NO: 3613447 - RNA, 15 nt, Salmonella enterica enterica serovar Typhi
cuaucgcugcgcugc

SEQ ID NO: 3613448 - RNA, 20 nt, Salmonella enterica enterica serovar Typhi
cuaucgcugcugauuggcga

SEQ ID NO: 3613449 - RNA, 13 nt, Salmonella enterica enterica serovar Typhi
cuaucgcuuuaac

SEQ ID NO: 3613450 - RNA, 20 nt, Salmonella enterica enterica serovar Typhi
cuaucggcaaaccaugaucg

SEQ ID NO: 3613451 - RNA, 22 nt, Salmonella enterica enterica serovar Typhi
cuaucgggucugcgcgccggaa

SEQ ID NO: 3613452 - RNA, 23 nt, Salmonella enterica enterica serovar Typhi
cuaucguuauauauacuucacca

SEQ ID NO: 3613453 - RNA, 19 nt, Salmonella enterica enterica serovar Typhi
cuaucuucaauacgaaaac

SEQ ID NO: 3613454 - RNA, 12 nt, Salmonella enterica enterica serovar Typhi
cuaugacaaguc

SEQ ID NO: 3613455 - RNA, 13 nt, Salmonella enterica enterica serovar Typhi
cuaugauaagccu

SEQ ID NO: 3613456 - RNA, 22 nt, Salmonella enterica enterica serovar Typhi
cuaugauggccgacuggcacca

SEQ ID NO: 3613457 - RNA, 15 nt, Salmonella enterica enterica serovar Typhi
cuaugcaaaagaaaa

SEQ ID NO: 3613458 - RNA, 13 nt, Salmonella enterica enterica serovar Typhi
cuaugccagaaua

SEQ ID NO: 3613459 - RNA, 16 nt, Salmonella enterica enterica serovar Typhi
cuaugccaggcgcaac

SEQ ID NO: 3613460 - RNA, 19 nt, Salmonella enterica enterica serovar Typhi
cuaugcgccaguuguccgc

SEQ ID NO: 3613461 - RNA, 16 nt, Salmonella enterica enterica serovar Typhi
cuaugcuuauccggcc

SEQ ID NO: 3613462 - RNA, 12 nt, Salmonella enterica enterica serovar Typhi
cuaugguacaca

SEQ ID NO: 3613463 - RNA, 19 nt, Salmonella enterica enterica serovar Typhi
cuauggucugaaagaguuc

SEQ ID NO: 3613464 - RNA, 18 nt, Salmonella enterica enterica serovar Typhi
cuauguacgccaagcugc

SEQ ID NO: 3613465 - RNA, 19 nt, Salmonella enterica enterica serovar Typhi
cuauguacgccaagcugca

SEQ ID NO: 3613466 - RNA, 18 nt, Salmonella enterica enterica serovar Typhi
cuauuaaucugugagcac

SEQ ID NO: 3613467 - RNA, 19 nt, Salmonella enterica enterica serovar Typhi
cuauuacaaaaaucaugcc

SEQ ID NO: 3613468 - RNA, 18 nt, Salmonella enterica enterica serovar Typhi
cuauuaccggcuggaagc

SEQ ID NO: 3613469 - RNA, 17 nt, Salmonella enterica enterica serovar Typhi
cuauuaguucugaggcu

SEQ ID NO: 3613470 - RNA, 12 nt, Salmonella enterica enterica serovar Typhi
cuauucagcagu

SEQ ID NO: 3613471 - RNA, 15 nt, Salmonella enterica enterica serovar Typhi
cuauucagcaguuca

SEQ ID NO: 3613472 - RNA, 18 nt, Salmonella enterica enterica serovar Typhi
cuauuccaaaauaauaaa

SEQ ID NO: 3613473 - RNA, 16 nt, Salmonella enterica enterica serovar Typhi
cuauuccaguuuuuau

SEQ ID NO: 3613474 - RNA, 12 nt, Salmonella enterica enterica serovar Typhi
cuauucccaggc

SEQ ID NO: 3613475 - RNA, 20 nt, Salmonella enterica enterica serovar Typhi
cuauucccaggcaaaugauu

SEQ ID NO: 3613476 - RNA, 21 nt, Salmonella enterica enterica serovar Typhi
cuauuccuguauaauuauuug

SEQ ID NO: 3613477 - RNA, 20 nt, Salmonella enterica enterica serovar Typhi
cuauugagguaguccugcuc

SEQ ID NO: 3613478 - RNA, 15 nt, Salmonella enterica enterica serovar Typhi
cuauugccuaaauaa

SEQ ID NO: 3613479 - RNA, 17 nt, Salmonella enterica enterica serovar Typhi
cuauuuaacccugguuu

SEQ ID NO: 3613480 - RNA, 15 nt, Salmonella enterica enterica serovar Typhi
cuauuuauugaagau

SEQ ID NO: 3613481 - RNA, 17 nt, Salmonella enterica enterica serovar Typhi
cuauuuauugaagaugu

SEQ ID NO: 3613482 - RNA, 16 nt, Salmonella enterica enterica serovar Typhi
cuauuucaacccggca

SEQ ID NO: 3613483 - RNA, 22 nt, Salmonella enterica enterica serovar Typhi
cuauuucaguacagccaaaaau

SEQ ID NO: 3613484 - RNA, 14 nt, Salmonella enterica enterica serovar Typhi
cuauuuccagaaau

SEQ ID NO: 3613485 - RNA, 16 nt, Salmonella enterica enterica serovar Typhi
cuauuucuuagcgcca

SEQ ID NO: 3613486 - RNA, 17 nt, Salmonella enterica enterica serovar Typhi
cuauuucuuagcgccag

SEQ ID NO: 3613487 - RNA, 13 nt, Salmonella enterica enterica serovar Typhi
cuauuugcagauu

SEQ ID NO: 3613488 - RNA, 17 nt, Salmonella enterica enterica serovar Typhi
cuauuuucgccgacccc

SEQ ID NO: 3613489 - RNA, 19 nt, Salmonella enterica enterica serovar Typhi
cuauuuucucuuccacaaa

SEQ ID NO: 3613490 - RNA, 18 nt, Salmonella enterica enterica serovar Typhi
cucaacacauaacgcccg

SEQ ID NO: 3613491 - RNA, 18 nt, Salmonella enterica enterica serovar Typhi
cucaacauacgccgccag

SEQ ID NO: 3613492 - RNA, 13 nt, Salmonella enterica enterica serovar Typhi
cucaacaucauua

SEQ ID NO: 3613493 - RNA, 14 nt, Salmonella enterica enterica serovar Typhi
cucaacaucauuaa

SEQ ID NO: 3613494 - RNA, 16 nt, Salmonella enterica enterica serovar Typhi
cucaacauugccggca

SEQ ID NO: 3613495 - RNA, 19 nt, Salmonella enterica enterica serovar Typhi
cucaacauugccggcauca

SEQ ID NO: 3613496 - RNA, 21 nt, Salmonella enterica enterica serovar Typhi
cucaacauugccggcaucauu

SEQ ID NO: 3613497 - RNA, 12 nt, Salmonella enterica enterica serovar Typhi
cucaaccagccg

SEQ ID NO: 3613498 - RNA, 18 nt, Salmonella enterica enterica serovar Typhi
cucaaccaguaccgggcc

SEQ ID NO: 3613499 - RNA, 23 nt, Salmonella enterica enterica serovar Typhi
cucaaccaugauaaccagccccg

SEQ ID NO: 3613500 - RNA, 15 nt, Salmonella enterica enterica serovar Typhi
cucaaccgcgcggcg

SEQ ID NO: 3613501 - RNA, 23 nt, Salmonella enterica enterica serovar Typhi
cucaaccgcgcggcguucugcgc

SEQ ID NO: 3613502 - RNA, 18 nt, Salmonella enterica enterica serovar Typhi
cucaaccugaggaaaaag

SEQ ID NO: 3613503 - RNA, 15 nt, Salmonella enterica enterica serovar Typhi
cucaacgcccugcuc

SEQ ID NO: 3613504 - RNA, 22 nt, Salmonella enterica enterica serovar Typhi
cucaacguuguguccagggugu

SEQ ID NO: 3613505 - RNA, 13 nt, Salmonella enterica enterica serovar Typhi
cucaacuauuaaa

SEQ ID NO: 3613506 - RNA, 22 nt, Salmonella enterica enterica serovar Typhi
cucaacugggcgagggaggcaa

SEQ ID NO: 3613507 - RNA, 17 nt, Salmonella enterica enterica serovar Typhi
cucaagcccgcgucguu

SEQ ID NO: 3613508 - RNA, 14 nt, Salmonella enterica enterica serovar Typhi
cucaagcggcacca

SEQ ID NO: 3613509 - RNA, 20 nt, Salmonella enterica enterica serovar Typhi
cucaagguagcgugucuacc

SEQ ID NO: 3613510 - RNA, 15 nt, Salmonella enterica enterica serovar Typhi
cucaaggucugucag

SEQ ID NO: 3613511 - RNA, 20 nt, Salmonella enterica enterica serovar Typhi
cucaaguuauguuaucccca

SEQ ID NO: 3613512 - RNA, 21 nt, Salmonella enterica enterica serovar Typhi
cucaauacgagugacauuauu

SEQ ID NO: 3613513 - RNA, 18 nt, Salmonella enterica enterica serovar Typhi
cucaaucauugucauuaa

SEQ ID NO: 3613514 - RNA, 22 nt, Salmonella enterica enterica serovar Typhi
cucaauccuucuaccuucaccc

SEQ ID NO: 3613515 - RNA, 15 nt, Salmonella enterica enterica serovar Typhi
cucaaucugaugaug

SEQ ID NO: 3613516 - RNA, 22 nt, Salmonella enterica enterica serovar Typhi
cucaaugaacaguuucgccagc

SEQ ID NO: 3613517 - RNA, 17 nt, Salmonella enterica enterica serovar Typhi
cucaauggcgcgccagc

SEQ ID NO: 3613518 - RNA, 17 nt, Salmonella enterica enterica serovar Typhi
cucaaugguuucacgcu

SEQ ID NO: 3613519 - RNA, 14 nt, Salmonella enterica enterica serovar Typhi
cucaauuuuacagc

SEQ ID NO: 3613520 - RNA, 17 nt, Salmonella enterica enterica serovar Typhi
cucaauuuuacagccuc

SEQ ID NO: 3613521 - RNA, 15 nt, Salmonella enterica enterica serovar Typhi
cucacaaaacuauuu

SEQ ID NO: 3613522 - RNA, 18 nt, Salmonella enterica enterica serovar Typhi
cucacaaaacuauuuucc

SEQ ID NO: 3613523 - RNA, 16 nt, Salmonella enterica enterica serovar Typhi
cucauuuuauccaaca

SEQ ID NO: 3613524 - RNA, 13 nt, Salmonella enterica enterica serovar Typhi
cucauuuucuuua

SEQ ID NO: 3613525 - RNA, 20 nt, Salmonella enterica enterica serovar Typhi
cucauuuuguugcuccagca

SEQ ID NO: 3613526 - RNA, 23 nt, Salmonella enterica enterica serovar Typhi
cucauuuuugaguuugucaucca

SEQ ID NO: 3613527 - RNA, 16 nt, Salmonella enterica enterica serovar Typhi
cucauuuuugcccagc

SEQ ID NO: 3613528 - RNA, 14 nt, Salmonella enterica enterica serovar Typhi
cuccacaguucaau

SEQ ID NO: 3613529 - RNA, 13 nt, Salmonella enterica enterica serovar Typhi
cuccacauccugu

SEQ ID NO: 3613530 - RNA, 13 nt, Salmonella enterica enterica serovar Typhi
cuccaccaaccag

SEQ ID NO: 3613531 - RNA, 17 nt, Salmonella enterica enterica serovar Typhi
cuccacgcccagcgccg

SEQ ID NO: 3613532 - RNA, 17 nt, Salmonella enterica enterica serovar Typhi
cuccacugucaaaaaua

SEQ ID NO: 3613533 - RNA, 23 nt, Salmonella enterica enterica serovar Typhi
cuccacugucaaaaauaacaggc

SEQ ID NO: 3613534 - RNA, 12 nt, Salmonella enterica enterica serovar Typhi
cuccagaagcau

SEQ ID NO: 3613535 - RNA, 22 nt, Salmonella enterica enterica serovar Typhi
cuccagaauauugacaucgccg

SEQ ID NO: 3613536 - RNA, 19 nt, Salmonella enterica enterica serovar Typhi
cuccagacaggacgccagc

SEQ ID NO: 3613537 - RNA, 15 nt, Salmonella enterica enterica serovar Typhi
cuccagaccaccagc

SEQ ID NO: 3613538 - RNA, 17 nt, Salmonella enterica enterica serovar Typhi
cuccagaccgcugcgga

SEQ ID NO: 3613539 - RNA, 18 nt, Salmonella enterica enterica serovar Typhi
cuccagaccucguucggc

SEQ ID NO: 3613540 - RNA, 21 nt, Salmonella enterica enterica serovar Typhi
cuccagcacgcgcugcgccgc

SEQ ID NO: 3613541 - RNA, 14 nt, Salmonella enterica enterica serovar Typhi
cuccagcagaccgg

SEQ ID NO: 3613542 - RNA, 20 nt, Salmonella enterica enterica serovar Typhi
cuccagcagaccggcaaaaa

SEQ ID NO: 3613543 - RNA, 19 nt, Salmonella enterica enterica serovar Typhi
cuccagcagacgcugcuuc

SEQ ID NO: 3613544 - RNA, 17 nt, Salmonella enterica enterica serovar Typhi
cuccagcccgccgcccu

SEQ ID NO: 3613545 - RNA, 16 nt, Salmonella enterica enterica serovar Typhi
cuccagccucgcgcau

SEQ ID NO: 3613546 - RNA, 23 nt, Salmonella enterica enterica serovar Typhi
cuccagcgauagucguugcgccg

SEQ ID NO: 3613547 - RNA, 17 nt, Salmonella enterica enterica serovar Typhi
cuccagcgcauugccuu

SEQ ID NO: 3613548 - RNA, 16 nt, Salmonella enterica enterica serovar Typhi
cuccagcgccuguuga

SEQ ID NO: 3613549 - RNA, 22 nt, Salmonella enterica enterica serovar Typhi
cuccagcgggcuggcauucauu

SEQ ID NO: 3613550 - RNA, 16 nt, Salmonella enterica enterica serovar Typhi
cuccagcucagggucc

SEQ ID NO: 3613551 - RNA, 12 nt, Salmonella enterica enterica serovar Typhi
cuccagcuggcu

SEQ ID NO: 3613552 - RNA, 16 nt, Salmonella enterica enterica serovar Typhi
cuccagcuggcuggca

SEQ ID NO: 3613553 - RNA, 16 nt, Salmonella enterica enterica serovar Typhi
cuccaggccaagcgcc

SEQ ID NO: 3613554 - RNA, 19 nt, Salmonella enterica enterica serovar Typhi
cuccaggcgaauccccauc

SEQ ID NO: 3613555 - RNA, 16 nt, Salmonella enterica enterica serovar Typhi
cuccaggcguuuauga

SEQ ID NO: 3613556 - RNA, 17 nt, Salmonella enterica enterica serovar Typhi
cuccaggcguuuaugag

SEQ ID NO: 3613557 - RNA, 21 nt, Salmonella enterica enterica serovar Typhi
cuccagggcaacggccagcgc

SEQ ID NO: 3613558 - RNA, 22 nt, Salmonella enterica enterica serovar Typhi
cuccaguugauacaggaauaac

SEQ ID NO: 3613559 - RNA, 13 nt, Salmonella enterica enterica serovar Typhi
cuccauaauuuga

SEQ ID NO: 3613560 - RNA, 20 nt, Salmonella enterica enterica serovar Typhi
cuccauacccuauuuacaga

SEQ ID NO: 3613561 - RNA, 23 nt, Salmonella enterica enterica serovar Typhi
cuccaucagacguuuauacccca

SEQ ID NO: 3613562 - RNA, 18 nt, Salmonella enterica enterica serovar Typhi
cuccaucgccagcacguu

SEQ ID NO: 3613563 - RNA, 12 nt, Salmonella enterica enterica serovar Typhi
cuccaucgccug

SEQ ID NO: 3613564 - RNA, 13 nt, Salmonella enterica enterica serovar Typhi
cuccaucgcuuua

SEQ ID NO: 3613565 - RNA, 14 nt, Salmonella enterica enterica serovar Typhi
cuccaugcccacac

SEQ ID NO: 3613566 - RNA, 17 nt, Salmonella enterica enterica serovar Typhi
cuccauggucagacgcu

SEQ ID NO: 3613567 - RNA, 22 nt, Salmonella enterica enterica serovar Typhi
cuccauggucagacgcucagcc

SEQ ID NO: 3613568 - RNA, 19 nt, Salmonella enterica enterica serovar Typhi
cuccauuuuggggaaaaua

SEQ ID NO: 3613569 - RNA, 23 nt, Salmonella enterica enterica serovar Typhi
cucccaaacucgggaaaauagcc

SEQ ID NO: 3613570 - RNA, 15 nt, Salmonella enterica enterica serovar Typhi
cucccaaauuuuuuu

SEQ ID NO: 3613571 - RNA, 14 nt, Salmonella enterica enterica serovar Typhi
cucccacucuucca

SEQ ID NO: 3613572 - RNA, 20 nt, Salmonella enterica enterica serovar Typhi
cucccacucuuccagcaccg

SEQ ID NO: 3613573 - RNA, 23 nt, Salmonella enterica enterica serovar Typhi
cucccaggccgccaccgccucgc

SEQ ID NO: 3613574 - RNA, 17 nt, Salmonella enterica enterica serovar Typhi
cucccaggcgcgcagcu

SEQ ID NO: 3613575 - RNA, 21 nt, Salmonella enterica enterica serovar Typhi
cucccaggcgcgcagcugcca

SEQ ID NO: 3613576 - RNA, 16 nt, Salmonella enterica enterica serovar Typhi
cuccccaaccgccagc

SEQ ID NO: 3613577 - RNA, 20 nt, Salmonella enterica enterica serovar Typhi
cuccccacaaucccgccaga

SEQ ID NO: 3613578 - RNA, 12 nt, Salmonella enterica enterica serovar Typhi
cuccccagaaug

SEQ ID NO: 3613579 - RNA, 20 nt, Salmonella enterica enterica serovar Typhi
cuccccagaaugauaaugcc

SEQ ID NO: 3613580 - RNA, 18 nt, Salmonella enterica enterica serovar Typhi
cucccccaccgacacaaa

SEQ ID NO: 3613581 - RNA, 21 nt, Salmonella enterica enterica serovar Typhi
cuccccggcuugcggggagaa

SEQ ID NO: 3613582 - RNA, 18 nt, Salmonella enterica enterica serovar Typhi
cuccccguuccaccgcca

SEQ ID NO: 3613583 - RNA, 15 nt, Salmonella enterica enterica serovar Typhi
cuccccuuuuuucug

SEQ ID NO: 3613584 - RNA, 16 nt, Salmonella enterica enterica serovar Typhi
cucccgcagccacucc

SEQ ID NO: 3613585 - RNA, 15 nt, Salmonella enterica enterica serovar Typhi
cucccgccagcgaga

SEQ ID NO: 3613586 - RNA, 21 nt, Salmonella enterica enterica serovar Typhi
cucccgcgucacgaccggcga

SEQ ID NO: 3613587 - RNA, 21 nt, Salmonella enterica enterica serovar Typhi
cucccggaugcaccaucucuu

SEQ ID NO: 3613588 - RNA, 17 nt, Salmonella enterica enterica serovar Typhi
cucccgucgccuguuuc

SEQ ID NO: 3613589 - RNA, 13 nt, Salmonella enterica enterica serovar Typhi
cucccucaaccag

SEQ ID NO: 3613590 - RNA, 13 nt, Salmonella enterica enterica serovar Typhi
cucccuccugcuc

SEQ ID NO: 3613591 - RNA, 16 nt, Salmonella enterica enterica serovar Typhi
cucccugagucuugcc

SEQ ID NO: 3613592 - RNA, 18 nt, Salmonella enterica enterica serovar Typhi
cucccugccuaaagaaaa

SEQ ID NO: 3613593 - RNA, 12 nt, Salmonella enterica enterica serovar Typhi
cucccuggcagu

SEQ ID NO: 3613594 - RNA, 18 nt, Salmonella enterica enterica serovar Typhi
cucccuggcagugaucca

SEQ ID NO: 3613595 - RNA, 19 nt, Salmonella enterica enterica serovar Typhi
cucccuguuccuguauuug

SEQ ID NO: 3613596 - RNA, 13 nt, Salmonella enterica enterica serovar Typhi
cucccuuccccca

SEQ ID NO: 3613597 - RNA, 19 nt, Salmonella enterica enterica serovar Typhi
cuccgaauaauccuucccg

SEQ ID NO: 3613598 - RNA, 21 nt, Salmonella enterica enterica serovar Typhi
cuccgaauaauccuucccgcu

SEQ ID NO: 3613599 - RNA, 12 nt, Salmonella enterica enterica serovar Typhi
cuccgacaacaa

SEQ ID NO: 3613600 - RNA, 15 nt, Salmonella enterica enterica serovar Typhi
cuccgcaauuuccug

SEQ ID NO: 3613601 - RNA, 19 nt, Salmonella enterica enterica serovar Typhi
cuccgcacgguuagccgga

SEQ ID NO: 3613602 - RNA, 14 nt, Salmonella enterica enterica serovar Typhi
cuccgccagggcgg

SEQ ID NO: 3613603 - RNA, 15 nt, Salmonella enterica enterica serovar Typhi
cuccgcccagacaau

SEQ ID NO: 3613604 - RNA, 15 nt, Salmonella enterica enterica serovar Typhi
cuccgcccauccagg

SEQ ID NO: 3613605 - RNA, 21 nt, Salmonella enterica enterica serovar Typhi
cuccgccgcuuuaucguaacc

SEQ ID NO: 3613606 - RNA, 23 nt, Salmonella enterica enterica serovar Typhi
cuccgccgucguaauaauaugcc

SEQ ID NO: 3613607 - RNA, 16 nt, Salmonella enterica enterica serovar Typhi
cuccgcgagcagccaa

SEQ ID NO: 3613608 - RNA, 16 nt, Salmonella enterica enterica serovar Typhi
cuccgcgcgcguaagc

SEQ ID NO: 3613609 - RNA, 22 nt, Salmonella enterica enterica serovar Typhi
cucgcugauacgcuggcacagg

SEQ ID NO: 3613610 - RNA, 23 nt, Salmonella enterica enterica serovar Typhi
cucgcugauacgcuggcacagga

SEQ ID NO: 3613611 - RNA, 15 nt, Salmonella enterica enterica serovar Typhi
cucgcugauggcgag

SEQ ID NO: 3613612 - RNA, 19 nt, Salmonella enterica enterica serovar Typhi
cucgcugauggcgagaagc

SEQ ID NO: 3613613 - RNA, 18 nt, Salmonella enterica enterica serovar Typhi
cucgcugccgaccuggcu

SEQ ID NO: 3613614 - RNA, 16 nt, Salmonella enterica enterica serovar Typhi
cucgcugccggaaagc

SEQ ID NO: 3613615 - RNA, 21 nt, Salmonella enterica enterica serovar Typhi
cucgcuggugccaaucuccag

SEQ ID NO: 3613616 - RNA, 19 nt, Salmonella enterica enterica serovar Typhi
cucgcuguauuucccucuc

SEQ ID NO: 3613617 - RNA, 19 nt, Salmonella enterica enterica serovar Typhi
cucgcuguggccaggcacg

SEQ ID NO: 3613618 - RNA, 11 nt, Salmonella enterica enterica serovar Typhi
cucgcuuguug

SEQ ID NO: 3613619 - RNA, 16 nt, Salmonella enterica enterica serovar Typhi
cucggauagcuacgau

SEQ ID NO: 3613620 - RNA, 16 nt, Salmonella enterica enterica serovar Typhi
cucggcaccauuggcg

SEQ ID NO: 3613621 - RNA, 21 nt, Salmonella enterica enterica serovar Typhi
cucggcagcaauacgcccgcc

SEQ ID NO: 3613622 - RNA, 18 nt, Salmonella enterica enterica serovar Typhi
cucggcauacaccgccag

SEQ ID NO: 3613623 - RNA, 18 nt, Salmonella enterica enterica serovar Typhi
cucggcggucagccacau

SEQ ID NO: 3613624 - RNA, 17 nt, Salmonella enterica enterica serovar Typhi
cucggcgucaucccggu

SEQ ID NO: 3613625 - RNA, 23 nt, Salmonella enterica enterica serovar Typhi
cucgggccuguuccggcgaggac

SEQ ID NO: 3613626 - RNA, 16 nt, Salmonella enterica enterica serovar Typhi
cucgguauguccugcc

SEQ ID NO: 3613627 - RNA, 13 nt, Salmonella enterica enterica serovar Typhi
cucgguccacacc

SEQ ID NO: 3613628 - RNA, 19 nt, Salmonella enterica enterica serovar Typhi
cucgguggauaaauuuguc

SEQ ID NO: 3613629 - RNA, 22 nt, Salmonella enterica enterica serovar Typhi
cucguacacgcgcccgccgcca

SEQ ID NO: 3613630 - RNA, 20 nt, Salmonella enterica enterica serovar Typhi
cucguaggccggauaagacg

SEQ ID NO: 3613631 - RNA, 23 nt, Salmonella enterica enterica serovar Typhi
cucguaucugucccagccuuccu

SEQ ID NO: 3613632 - RNA, 21 nt, Salmonella enterica enterica serovar Typhi
cucgucauagugagcgacuuc

SEQ ID NO: 3613633 - RNA, 15 nt, Salmonella enterica enterica serovar Typhi
cucguccugcaauuu

SEQ ID NO: 3613634 - RNA, 13 nt, Salmonella enterica enterica serovar Typhi
cucgucgcgcgcc

SEQ ID NO: 3613635 - RNA, 17 nt, Salmonella enterica enterica serovar Typhi
cucgugaucgccaaagc

SEQ ID NO: 3613636 - RNA, 22 nt, Salmonella enterica enterica serovar Typhi
cucgugcaggccggauaagccg

SEQ ID NO: 3613637 - RNA, 14 nt, Salmonella enterica enterica serovar Typhi
cucguguaaggcuu

SEQ ID NO: 3613638 - RNA, 19 nt, Salmonella enterica enterica serovar Typhi
cucguucgauagcguuuuc

SEQ ID NO: 3613639 - RNA, 23 nt, Salmonella enterica enterica serovar Typhi
cucguugauguuuuuaaaagaag

SEQ ID NO: 3613640 - RNA, 14 nt, Salmonella enterica enterica serovar Typhi
cucguugcgucgug

SEQ ID NO: 3613641 - RNA, 20 nt, Salmonella enterica enterica serovar Typhi
cucuaaaugggcaggagaug

SEQ ID NO: 3613642 - RNA, 22 nt, Salmonella enterica enterica serovar Typhi
cucuaacgucagcgccacccau

SEQ ID NO: 3613643 - RNA, 19 nt, Salmonella enterica enterica serovar Typhi
cucuaauucccaguaaccu

SEQ ID NO: 3613644 - RNA, 18 nt, Salmonella enterica enterica serovar Typhi
cucuaauugaauauggug

SEQ ID NO: 3613645 - RNA, 12 nt, Salmonella enterica enterica serovar Typhi
cucuacauuucg

SEQ ID NO: 3613646 - RNA, 13 nt, Salmonella enterica enterica serovar Typhi
cucuacgcggcgg

SEQ ID NO: 3613647 - RNA, 15 nt, Salmonella enterica enterica serovar Typhi
cucuacuuuccugaa

SEQ ID NO: 3613648 - RNA, 21 nt, Salmonella enterica enterica serovar Typhi
cucuauaccauaaaugaaacc

SEQ ID NO: 3613649 - RNA, 16 nt, Salmonella enterica enterica serovar Typhi
cucuauacggcgcgca

SEQ ID NO: 3613650 - RNA, 13 nt, Salmonella enterica enterica serovar Typhi
cucuaucagcgcc

SEQ ID NO: 3613651 - RNA, 17 nt, Salmonella enterica enterica serovar Typhi
cucuaucagcgccuccg

SEQ ID NO: 3613652 - RNA, 15 nt, Salmonella enterica enterica serovar Typhi
cucuaucggcaaacc

SEQ ID NO: 3613653 - RNA, 20 nt, Salmonella enterica enterica serovar Typhi
cucuaucuuuucaaucaggu

SEQ ID NO: 3613654 - RNA, 18 nt, Salmonella enterica enterica serovar Typhi
cucuaugaaugccggaug

SEQ ID NO: 3613655 - RNA, 22 nt, Salmonella enterica enterica serovar Typhi
cucuauguucaguaggacaaaa

SEQ ID NO: 3613656 - RNA, 19 nt, Salmonella enterica enterica serovar Typhi
cucucaccaucauaaagcc

SEQ ID NO: 3613657 - RNA, 18 nt, Salmonella enterica enterica serovar Typhi
cucucauagccgacccgc

SEQ ID NO: 3613658 - RNA, 13 nt, Salmonella enterica enterica serovar Typhi
cucucauauucca

SEQ ID NO: 3613659 - RNA, 14 nt, Salmonella enterica enterica serovar Typhi
cucucauuuucuuu

SEQ ID NO: 3613660 - RNA, 23 nt, Salmonella enterica enterica serovar Typhi
cucuccaguuugcguucacagca

SEQ ID NO: 3613661 - RNA, 14 nt, Salmonella enterica enterica serovar Typhi
cucucccagcugag

SEQ ID NO: 3613662 - RNA, 20 nt, Salmonella enterica enterica serovar Typhi
cucucccccaccgacacaaa

SEQ ID NO: 3613663 - RNA, 14 nt, Salmonella enterica enterica serovar Typhi
cucucccuggcagg

SEQ ID NO: 3613664 - RNA, 20 nt, Salmonella enterica enterica serovar Typhi
cucucgauaucggcaauauu

SEQ ID NO: 3613665 - RNA, 19 nt, Salmonella enterica enterica serovar Typhi
cucucgccgcgcuccauca

SEQ ID NO: 3613666 - RNA, 21 nt, Salmonella enterica enterica serovar Typhi
cucucguucccgccugcugca

SEQ ID NO: 3613667 - RNA, 19 nt, Salmonella enterica enterica serovar Typhi
cucucucaaacuauuuuua

SEQ ID NO: 3613668 - RNA, 16 nt, Salmonella enterica enterica serovar Typhi
cucucuucgugacccg

SEQ ID NO: 3613669 - RNA, 20 nt, Salmonella enterica enterica serovar Typhi
cucucuuucaccagcgccag

SEQ ID NO: 3613670 - RNA, 16 nt, Salmonella enterica enterica serovar Typhi
cucugaaucucuuccc

SEQ ID NO: 3613671 - RNA, 20 nt, Salmonella enterica enterica serovar Typhi
cucugauuucgacgauaaaa

SEQ ID NO: 3613672 - RNA, 14 nt, Salmonella enterica enterica serovar Typhi
cucugccagcgccc

SEQ ID NO: 3613673 - RNA, 18 nt, Salmonella enterica enterica serovar Typhi
cucugccgguugaccggc

SEQ ID NO: 3613674 - RNA, 19 nt, Salmonella enterica enterica serovar Typhi
cucugccgguugaccggcc

SEQ ID NO: 3613675 - RNA, 20 nt, Salmonella enterica enterica serovar Typhi
cucugccgguugaccggccc

SEQ ID NO: 3613676 - RNA, 13 nt, Salmonella enterica enterica serovar Typhi
cucugccucagca

SEQ ID NO: 3613677 - RNA, 17 nt, Salmonella enterica enterica serovar Typhi
cucugcgccuuuuaccu

SEQ ID NO: 3613678 - RNA, 22 nt, Salmonella enterica enterica serovar Typhi
cucugcgcguaaacgcaacacc

SEQ ID NO: 3613679 - RNA, 19 nt, Salmonella enterica enterica serovar Typhi
cucugcugugccaguaccg

SEQ ID NO: 3613680 - RNA, 20 nt, Salmonella enterica enterica serovar Typhi
cucugcuuuucucacaauaa

SEQ ID NO: 3613681 - RNA, 21 nt, Salmonella enterica enterica serovar Typhi
cucuggccgcgcuuuuuuaac

SEQ ID NO: 3613682 - RNA, 15 nt, Salmonella enterica enterica serovar Typhi
cucuggcgacgccaa

SEQ ID NO: 3613683 - RNA, 22 nt, Salmonella enterica enterica serovar Typhi
cucuggcgacgccaaucggcgu

SEQ ID NO: 3613684 - RNA, 20 nt, Salmonella enterica enterica serovar Typhi
cucugguaguuguaauaaac

SEQ ID NO: 3613685 - RNA, 22 nt, Salmonella enterica enterica serovar Typhi
cucugguugcagcgccagagau

SEQ ID NO: 3613686 - RNA, 16 nt, Salmonella enterica enterica serovar Typhi
cucugguuucccugcc

SEQ ID NO: 3613687 - RNA, 16 nt, Salmonella enterica enterica serovar Typhi
cucuguccacacaggc

SEQ ID NO: 3613688 - RNA, 14 nt, Salmonella enterica enterica serovar Typhi
cucugucgccgccc

SEQ ID NO: 3613689 - RNA, 18 nt, Salmonella enterica enterica serovar Typhi
cucuuauucaaucaauuu

SEQ ID NO: 3613690 - RNA, 19 nt, Salmonella enterica enterica serovar Typhi
cucuucaaacuccccuguc

SEQ ID NO: 3613691 - RNA, 14 nt, Salmonella enterica enterica serovar Typhi
cucuucaguaacca

SEQ ID NO: 3613692 - RNA, 14 nt, Salmonella enterica enterica serovar Typhi
cucuucaguaagcg

SEQ ID NO: 3613693 - RNA, 16 nt, Salmonella enterica enterica serovar Typhi
cucuucaucgcgccuc

SEQ ID NO: 3613694 - RNA, 18 nt, Salmonella enterica enterica serovar Typhi
cugacaaaaacggcuuua

SEQ ID NO: 3613695 - RNA, 16 nt, Salmonella enterica enterica serovar Typhi
cugacaaacccuguau

SEQ ID NO: 3613696 - RNA, 14 nt, Salmonella enterica enterica serovar Typhi
cugacaaucagcac

SEQ ID NO: 3613697 - RNA, 12 nt, Salmonella enterica enterica serovar Typhi
cugacacccucu

SEQ ID NO: 3613698 - RNA, 15 nt, Salmonella enterica enterica serovar Typhi
cugacacccucugcg

SEQ ID NO: 3613699 - RNA, 18 nt, Salmonella enterica enterica serovar Typhi
cugacacccucugcgccu

SEQ ID NO: 3613700 - RNA, 20 nt, Salmonella enterica enterica serovar Typhi
cugacagaaauagccgguaa

SEQ ID NO: 3613701 - RNA, 21 nt, Salmonella enterica enterica serovar Typhi
cugacagaaauagccgguaac

SEQ ID NO: 3613702 - RNA, 21 nt, Salmonella enterica enterica serovar Typhi
cugacagaauauaggagagcg

SEQ ID NO: 3613703 - RNA, 20 nt, Salmonella enterica enterica serovar Typhi
cugacagagcucgucaaaaa

SEQ ID NO: 3613704 - RNA, 13 nt, Salmonella enterica enterica serovar Typhi
cugacagauaucu

SEQ ID NO: 3613705 - RNA, 17 nt, Salmonella enterica enterica serovar Typhi
cugacagccaaacugcu

SEQ ID NO: 3613706 - RNA, 16 nt, Salmonella enterica enterica serovar Typhi
cugacagcgcgcgaau

SEQ ID NO: 3613707 - RNA, 23 nt, Salmonella enterica enterica serovar Typhi
cugacaggccggauuagcgacag

SEQ ID NO: 3613708 - RNA, 15 nt, Salmonella enterica enterica serovar Typhi
cugacagugacggca

SEQ ID NO: 3613709 - RNA, 16 nt, Salmonella enterica enterica serovar Typhi
cugacauaaucaugaa

SEQ ID NO: 3613710 - RNA, 20 nt, Salmonella enterica enterica serovar Typhi
cugacauaaucaugaacguu

SEQ ID NO: 3613711 - RNA, 23 nt, Salmonella enterica enterica serovar Typhi
cugacauauacaaaccaccacca

SEQ ID NO: 3613712 - RNA, 15 nt, Salmonella enterica enterica serovar Typhi
cugacauucagcgcu

SEQ ID NO: 3613713 - RNA, 20 nt, Salmonella enterica enterica serovar Typhi
cugaccaacgucagcaucuc

SEQ ID NO: 3613714 - RNA, 19 nt, Salmonella enterica enterica serovar Typhi
cugaccaagcgucagcaug

SEQ ID NO: 3613715 - RNA, 18 nt, Salmonella enterica enterica serovar Typhi
cugaccauugauuuccgc

SEQ ID NO: 3613716 - RNA, 21 nt, Salmonella enterica enterica serovar Typhi
cugaccauugauuuccgcgca

SEQ ID NO: 3613717 - RNA, 14 nt, Salmonella enterica enterica serovar Typhi
cugaccgagaucag

SEQ ID NO: 3613718 - RNA, 13 nt, Salmonella enterica enterica serovar Typhi
cugaccuacaggc

SEQ ID NO: 3613719 - RNA, 18 nt, Salmonella enterica enterica serovar Typhi
cugaccuuuuucauccuc

SEQ ID NO: 3613720 - RNA, 21 nt, Salmonella enterica enterica serovar Typhi
cugacgacacuuuugccgagc

SEQ ID NO: 3613721 - RNA, 16 nt, Salmonella enterica enterica serovar Typhi
cugacgauaucgucac

SEQ ID NO: 3613722 - RNA, 20 nt, Salmonella enterica enterica serovar Typhi
cugacgcaauuguugcgcca

SEQ ID NO: 3613723 - RNA, 12 nt, Salmonella enterica enterica serovar Typhi
cugacgcagcag

SEQ ID NO: 3613724 - RNA, 16 nt, Salmonella enterica enterica serovar Typhi
cugacgcagcaguucc

SEQ ID NO: 3613725 - RNA, 19 nt, Salmonella enterica enterica serovar Typhi
cugacgcagcaguuccccg

SEQ ID NO: 3613726 - RNA, 16 nt, Salmonella enterica enterica serovar Typhi
cugacgccaggccauc

SEQ ID NO: 3613727 - RNA, 15 nt, Salmonella enterica enterica serovar Typhi
cugacgcgaucgccg

SEQ ID NO: 3613728 - RNA, 13 nt, Salmonella enterica enterica serovar Typhi
cugacgcgcagcg

SEQ ID NO: 3613729 - RNA, 20 nt, Salmonella enterica enterica serovar Typhi
cugacgcgcagcgauauagc

SEQ ID NO: 3613730 - RNA, 17 nt, Salmonella enterica enterica serovar Typhi
cugacgcggacgccacc

SEQ ID NO: 3613731 - RNA, 14 nt, Salmonella enterica enterica serovar Typhi
cugacgcugcgccu

SEQ ID NO: 3613732 - RNA, 16 nt, Salmonella enterica enterica serovar Typhi
cugacggcgcugucac

SEQ ID NO: 3613733 - RNA, 21 nt, Salmonella enterica enterica serovar Typhi
cugacgggcauuguuaaucca

SEQ ID NO: 3613734 - RNA, 22 nt, Salmonella enterica enterica serovar Typhi
cugacggugauguuggcccgga

SEQ ID NO: 3613735 - RNA, 16 nt, Salmonella enterica enterica serovar Typhi
cugacggugguaaauc

SEQ ID NO: 3613736 - RNA, 18 nt, Salmonella enterica enterica serovar Typhi
cugacggugguaaaucag

SEQ ID NO: 3613737 - RNA, 16 nt, Salmonella enterica enterica serovar Typhi
cugacguugcgggccu

SEQ ID NO: 3613738 - RNA, 13 nt, Salmonella enterica enterica serovar Typhi
cugacuauccaca

SEQ ID NO: 3613739 - RNA, 15 nt, Salmonella enterica enterica serovar Typhi
cugacuauccacagc

SEQ ID NO: 3613740 - RNA, 22 nt, Salmonella enterica enterica serovar Typhi
cugacugccguauaauccagcu

SEQ ID NO: 3613741 - RNA, 13 nt, Salmonella enterica enterica serovar Typhi
cugagaaaaauac

SEQ ID NO: 3613742 - RNA, 16 nt, Salmonella enterica enterica serovar Typhi
cugagaauuuccaguu

SEQ ID NO: 3613743 - RNA, 20 nt, Salmonella enterica enterica serovar Typhi
cugagacaggccagaauuca

SEQ ID NO: 3613744 - RNA, 19 nt, Salmonella enterica enterica serovar Typhi
cugagacucagcagcgcau

SEQ ID NO: 3613745 - RNA, 19 nt, Salmonella enterica enterica serovar Typhi
cugagauaauacauaucau

SEQ ID NO: 3613746 - RNA, 13 nt, Salmonella enterica enterica serovar Typhi
cugagaucaaaca

SEQ ID NO: 3613747 - RNA, 18 nt, Salmonella enterica enterica serovar Typhi
cugagaucaaacaagaga

SEQ ID NO: 3613748 - RNA, 13 nt, Salmonella enterica enterica serovar Typhi
cugagcaaucagu

SEQ ID NO: 3613749 - RNA, 16 nt, Salmonella enterica enterica serovar Typhi
cugagcacgcccgguc

SEQ ID NO: 3613750 - RNA, 23 nt, Salmonella enterica enterica serovar Typhi
cugagccgcccggcgcgcuggag

SEQ ID NO: 3613751 - RNA, 22 nt, Salmonella enterica enterica serovar Typhi
cugagcgaauccccgggaacau

SEQ ID NO: 3613752 - RNA, 17 nt, Salmonella enterica enterica serovar Typhi
cugagcgccgccaagau

SEQ ID NO: 3613753 - RNA, 16 nt, Salmonella enterica enterica serovar Typhi
cugagcgcgagcaugu

SEQ ID NO: 3613754 - RNA, 12 nt, Salmonella enterica enterica serovar Typhi
cugagcgcgcag

SEQ ID NO: 3613755 - RNA, 16 nt, Salmonella enterica enterica serovar Typhi
cugagcgcgccaugag

SEQ ID NO: 3613756 - RNA, 21 nt, Salmonella enterica enterica serovar Typhi
cugagcggucgugccaaggca

SEQ ID NO: 3613757 - RNA, 17 nt, Salmonella enterica enterica serovar Typhi
cugagcuaaucacccac

SEQ ID NO: 3613758 - RNA, 18 nt, Salmonella enterica enterica serovar Typhi
cugagcuaaucacccacu

SEQ ID NO: 3613759 - RNA, 16 nt, Salmonella enterica enterica serovar Typhi
cugagcucacuuuuug

SEQ ID NO: 3613760 - RNA, 19 nt, Salmonella enterica enterica serovar Typhi
cugagcugguguaauugcg

SEQ ID NO: 3613761 - RNA, 20 nt, Salmonella enterica enterica serovar Typhi
cugaggaguauuauccauug

SEQ ID NO: 3613762 - RNA, 14 nt, Salmonella enterica enterica serovar Typhi
cugaggcgacaauc

SEQ ID NO: 3613763 - RNA, 20 nt, Salmonella enterica enterica serovar Typhi
cugaggcguugcuccagcag

SEQ ID NO: 3613764 - RNA, 20 nt, Salmonella enterica enterica serovar Typhi
cugaguauaaaacucgccgc

SEQ ID NO: 3613765 - RNA, 12 nt, Salmonella enterica enterica serovar Typhi
cugagucauccu

SEQ ID NO: 3613766 - RNA, 13 nt, Salmonella enterica enterica serovar Typhi
cugagucuugccu

SEQ ID NO: 3613767 - RNA, 17 nt, Salmonella enterica enterica serovar Typhi
cugagugacgggcuggc

SEQ ID NO: 3613768 - RNA, 20 nt, Salmonella enterica enterica serovar Typhi
cugaguuaaugccaucauca

SEQ ID NO: 3613769 - RNA, 17 nt, Salmonella enterica enterica serovar Typhi
cugaguuuagccagcag

SEQ ID NO: 3613770 - RNA, 19 nt, Salmonella enterica enterica serovar Typhi
cugaguuucucccgccaga

SEQ ID NO: 3613771 - RNA, 23 nt, Salmonella enterica enterica serovar Typhi
cugaguuucucccgccagaugca

SEQ ID NO: 3613772 - RNA, 19 nt, Salmonella enterica enterica serovar Typhi
cugauaaaagagagcgcca

SEQ ID NO: 3613773 - RNA, 20 nt, Salmonella enterica enterica serovar Typhi
cugauaaagcuuucaucuuu

SEQ ID NO: 3613774 - RNA, 18 nt, Salmonella enterica enterica serovar Typhi
cugauaaccuauuuugca

SEQ ID NO: 3613775 - RNA, 19 nt, Salmonella enterica enterica serovar Typhi
cugauaagcauagcgccau

SEQ ID NO: 3613776 - RNA, 12 nt, Salmonella enterica enterica serovar Typhi
cugauaagcgca

SEQ ID NO: 3613777 - RNA, 17 nt, Salmonella enterica enterica serovar Typhi
cugauaagcgcagcgcc

SEQ ID NO: 3613778 - RNA, 18 nt, Salmonella enterica enterica serovar Typhi
cugauaagcgcagcgcca

SEQ ID NO: 3613779 - RNA, 14 nt, Salmonella enterica enterica serovar Typhi
cugauaagcguagc

SEQ ID NO: 3613780 - RNA, 19 nt, Salmonella enterica enterica serovar Typhi
cugccgcaaacgccugcuc

SEQ ID NO: 3613781 - RNA, 21 nt, Salmonella enterica enterica serovar Typhi
cugccgcagcacccgcucgcu

SEQ ID NO: 3613782 - RNA, 14 nt, Salmonella enterica enterica serovar Typhi
cugccgccacgccg

SEQ ID NO: 3613783 - RNA, 18 nt, Salmonella enterica enterica serovar Typhi
cugccgccagcaguugca

SEQ ID NO: 3613784 - RNA, 22 nt, Salmonella enterica enterica serovar Typhi
cugccgccauaacgccggcgcu

SEQ ID NO: 3613785 - RNA, 13 nt, Salmonella enterica enterica serovar Typhi
cugccgccaucgc

SEQ ID NO: 3613786 - RNA, 17 nt, Salmonella enterica enterica serovar Typhi
cugccgcccaucgccac

SEQ ID NO: 3613787 - RNA, 21 nt, Salmonella enterica enterica serovar Typhi
cugccgccgucaucugcgccg

SEQ ID NO: 3613788 - RNA, 17 nt, Salmonella enterica enterica serovar Typhi
cugccgcgcccgcgccg

SEQ ID NO: 3613789 - RNA, 16 nt, Salmonella enterica enterica serovar Typhi
cugccggcuuaacgcu

SEQ ID NO: 3613790 - RNA, 16 nt, Salmonella enterica enterica serovar Typhi
cugccgggacuuuaaa

SEQ ID NO: 3613791 - RNA, 16 nt, Salmonella enterica enterica serovar Typhi
cugccgggagcagauu

SEQ ID NO: 3613792 - RNA, 18 nt, Salmonella enterica enterica serovar Typhi
cugccgggguaucauaaa

SEQ ID NO: 3613793 - RNA, 14 nt, Salmonella enterica enterica serovar Typhi
cugccggucggcgu

SEQ ID NO: 3613794 - RNA, 19 nt, Salmonella enterica enterica serovar Typhi
cugccggucggcgucugau

SEQ ID NO: 3613795 - RNA, 14 nt, Salmonella enterica enterica serovar Typhi
cugccggugguggu

SEQ ID NO: 3613796 - RNA, 15 nt, Salmonella enterica enterica serovar Typhi
cugccgguucggcau

SEQ ID NO: 3613797 - RNA, 18 nt, Salmonella enterica enterica serovar Typhi
cugccgguuggucaauaa

SEQ ID NO: 3613798 - RNA, 12 nt, Salmonella enterica enterica serovar Typhi
cugccguaaaca

SEQ ID NO: 3613799 - RNA, 16 nt, Salmonella enterica enterica serovar Typhi
cugccgucaucgacuu

SEQ ID NO: 3613800 - RNA, 14 nt, Salmonella enterica enterica serovar Typhi
cugccguccgcucu

SEQ ID NO: 3613801 - RNA, 12 nt, Salmonella enterica enterica serovar Typhi
cugccguccuga

SEQ ID NO: 3613802 - RNA, 14 nt, Salmonella enterica enterica serovar Typhi
cugccgucgcggcu

SEQ ID NO: 3613803 - RNA, 22 nt, Salmonella enterica enterica serovar Typhi
cugccguuuuuaacgccggcaa

SEQ ID NO: 3613804 - RNA, 16 nt, Salmonella enterica enterica serovar Typhi
cugccuaaauugacgc

SEQ ID NO: 3613805 - RNA, 12 nt, Salmonella enterica enterica serovar Typhi
cugccugcagac

SEQ ID NO: 3613806 - RNA, 13 nt, Salmonella enterica enterica serovar Typhi
cugccugcagacc

SEQ ID NO: 3613807 - RNA, 13 nt, Salmonella enterica enterica serovar Typhi
cugccugcuucag

SEQ ID NO: 3613808 - RNA, 14 nt, Salmonella enterica enterica serovar Typhi
cugccugcuucaga

SEQ ID NO: 3613809 - RNA, 20 nt, Salmonella enterica enterica serovar Typhi
cugccuguagcagcgccagc

SEQ ID NO: 3613810 - RNA, 18 nt, Salmonella enterica enterica serovar Typhi
cugccuguuuacggcagg

SEQ ID NO: 3613811 - RNA, 21 nt, Salmonella enterica enterica serovar Typhi
cugccuuaauccccggcccgc

SEQ ID NO: 3613812 - RNA, 19 nt, Salmonella enterica enterica serovar Typhi
cugccuuuaacaaauuaaa

SEQ ID NO: 3613813 - RNA, 19 nt, Salmonella enterica enterica serovar Typhi
cugccuuuacugaaucuca

SEQ ID NO: 3613814 - RNA, 17 nt, Salmonella enterica enterica serovar Typhi
cugcgaacagcgcucca

SEQ ID NO: 3613815 - RNA, 22 nt, Salmonella enterica enterica serovar Typhi
cugcgacgccaggcgccacgau

SEQ ID NO: 3613816 - RNA, 23 nt, Salmonella enterica enterica serovar Typhi
cugcgaggucaccgggcgaaagc

SEQ ID NO: 3613817 - RNA, 18 nt, Salmonella enterica enterica serovar Typhi
cugcgauagcugcugacg

SEQ ID NO: 3613818 - RNA, 19 nt, Salmonella enterica enterica serovar Typhi
cugcgcaacauucugcuuc

SEQ ID NO: 3613819 - RNA, 21 nt, Salmonella enterica enterica serovar Typhi
cugcgcaacauucugcuucca

SEQ ID NO: 3613820 - RNA, 13 nt, Salmonella enterica enterica serovar Typhi
cugcgcaccugca

SEQ ID NO: 3613821 - RNA, 20 nt, Salmonella enterica enterica serovar Typhi
cugcgcauacgucaugccuu

SEQ ID NO: 3613822 - RNA, 17 nt, Salmonella enterica enterica serovar Typhi
cugcgcauccgcggcgc

SEQ ID NO: 3613823 - RNA, 18 nt, Salmonella enterica enterica serovar Typhi
cugcgcauccgcggcgcu

SEQ ID NO: 3613824 - RNA, 15 nt, Salmonella enterica enterica serovar Typhi
cugcgcauccucuuu

SEQ ID NO: 3613825 - RNA, 16 nt, Salmonella enterica enterica serovar Typhi
cugcgcauccucuuuc

SEQ ID NO: 3613826 - RNA, 14 nt, Salmonella enterica enterica serovar Typhi
cugcgccaaaucgg

SEQ ID NO: 3613827 - RNA, 20 nt, Salmonella enterica enterica serovar Typhi
cugcgccacaucauugcugu

SEQ ID NO: 3613828 - RNA, 13 nt, Salmonella enterica enterica serovar Typhi
cugcgccagcaug

SEQ ID NO: 3613829 - RNA, 16 nt, Salmonella enterica enterica serovar Typhi
cugcgccagccugcug

SEQ ID NO: 3613830 - RNA, 13 nt, Salmonella enterica enterica serovar Typhi
cugcgccagcgca

SEQ ID NO: 3613831 - RNA, 14 nt, Salmonella enterica enterica serovar Typhi
cugcgccagcucau

SEQ ID NO: 3613832 - RNA, 22 nt, Salmonella enterica enterica serovar Typhi
cugcgccauauccucgcugggc

SEQ ID NO: 3613833 - RNA, 14 nt, Salmonella enterica enterica serovar Typhi
cugcgccaucuucc

SEQ ID NO: 3613834 - RNA, 16 nt, Salmonella enterica enterica serovar Typhi
cugcgcccgccugcug

SEQ ID NO: 3613835 - RNA, 16 nt, Salmonella enterica enterica serovar Typhi
cugcgccgcaucgcca

SEQ ID NO: 3613836 - RNA, 13 nt, Salmonella enterica enterica serovar Typhi
cugcgccgcuugu

SEQ ID NO: 3613837 - RNA, 15 nt, Salmonella enterica enterica serovar Typhi
cugcgccggcugcgc

SEQ ID NO: 3613838 - RNA, 12 nt, Salmonella enterica enterica serovar Typhi
cugcgccugcau

SEQ ID NO: 3613839 - RNA, 15 nt, Salmonella enterica enterica serovar Typhi
cugcgccugcauauc

SEQ ID NO: 3613840 - RNA, 22 nt, Salmonella enterica enterica serovar Typhi
cugcgccuggaaaaaagcgccc

SEQ ID NO: 3613841 - RNA, 17 nt, Salmonella enterica enterica serovar Typhi
cugcgcgccaaaccguu

SEQ ID NO: 3613842 - RNA, 12 nt, Salmonella enterica enterica serovar Typhi
cugcgcgccgga

SEQ ID NO: 3613843 - RNA, 15 nt, Salmonella enterica enterica serovar Typhi
cugcgcgccugcgcu

SEQ ID NO: 3613844 - RNA, 15 nt, Salmonella enterica enterica serovar Typhi
cugcgcggcaaugag

SEQ ID NO: 3613845 - RNA, 15 nt, Salmonella enterica enterica serovar Typhi
cugcgcggccugcgc

SEQ ID NO: 3613846 - RNA, 17 nt, Salmonella enterica enterica serovar Typhi
cugcgcgucccucucca

SEQ ID NO: 3613847 - RNA, 22 nt, Salmonella enterica enterica serovar Typhi
cugcgcgucccucuccagggca

SEQ ID NO: 3613848 - RNA, 19 nt, Salmonella enterica enterica serovar Typhi
cugcgcguucugcuccaga

SEQ ID NO: 3613849 - RNA, 20 nt, Salmonella enterica enterica serovar Typhi
cugcgcguucugcuccagac

SEQ ID NO: 3613850 - RNA, 17 nt, Salmonella enterica enterica serovar Typhi
cugcgcucacgcggcgc

SEQ ID NO: 3613851 - RNA, 23 nt, Salmonella enterica enterica serovar Typhi
cugcgcucaucaggccugggcga

SEQ ID NO: 3613852 - RNA, 14 nt, Salmonella enterica enterica serovar Typhi
cugcgcugacggcg

SEQ ID NO: 3613853 - RNA, 17 nt, Salmonella enterica enterica serovar Typhi
cugcgcugacggcggca

SEQ ID NO: 3613854 - RNA, 13 nt, Salmonella enterica enterica serovar Typhi
cugcgcugccagc

SEQ ID NO: 3613855 - RNA, 13 nt, Salmonella enterica enterica serovar Typhi
cugcgcugggccg

SEQ ID NO: 3613856 - RNA, 18 nt, Salmonella enterica enterica serovar Typhi
cugcgcuuaccgggccua

SEQ ID NO: 3613857 - RNA, 15 nt, Salmonella enterica enterica serovar Typhi
cugcgcuuacggcca

SEQ ID NO: 3613858 - RNA, 18 nt, Salmonella enterica enterica serovar Typhi
cugcgcuuaucaggccua

SEQ ID NO: 3613859 - RNA, 21 nt, Salmonella enterica enterica serovar Typhi
cugcgcuucgaugcguucaaa

SEQ ID NO: 3613860 - RNA, 14 nt, Salmonella enterica enterica serovar Typhi
cugcgcuucggcca

SEQ ID NO: 3613861 - RNA, 18 nt, Salmonella enterica enterica serovar Typhi
cugcgcuucuauccacug

SEQ ID NO: 3613862 - RNA, 13 nt, Salmonella enterica enterica serovar Typhi
cugcgcuucugau

SEQ ID NO: 3613863 - RNA, 16 nt, Salmonella enterica enterica serovar Typhi
cugcgcuugcggccga

SEQ ID NO: 3613864 - RNA, 11 nt, Salmonella enterica enterica serovar Typhi
cugcgcuuuga

SEQ ID NO: 3613865 - RNA, 16 nt, Salmonella enterica enterica serovar Typhi
cugcgcuuuggguuaa

SEQ ID NO: 3613866 - RNA, 15 nt, Salmonella enterica enterica serovar Typhi
cugcggaacaccagc

SEQ ID NO: 3613867 - RNA, 23 nt, Salmonella enterica enterica serovar Typhi
cugcggaacuaacccgcagccgg

SEQ ID NO: 3613868 - RNA, 21 nt, Salmonella enterica enterica serovar Typhi
cugcggaugaugucagcguga

SEQ ID NO: 3613869 - RNA, 21 nt, Salmonella enterica enterica serovar Typhi
cugcggcacgaaaaauaaaaa

SEQ ID NO: 3613870 - RNA, 20 nt, Salmonella enterica enterica serovar Typhi
cugcggcacgucauuacggu

SEQ ID NO: 3613871 - RNA, 14 nt, Salmonella enterica enterica serovar Typhi
cugcggcagaccgg

SEQ ID NO: 3613872 - RNA, 16 nt, Salmonella enterica enterica serovar Typhi
cugcggccucgccucu

SEQ ID NO: 3613873 - RNA, 14 nt, Salmonella enterica enterica serovar Typhi
cugcggccugccca

SEQ ID NO: 3613874 - RNA, 17 nt, Salmonella enterica enterica serovar Typhi
cugcggccuugccgcca

SEQ ID NO: 3613875 - RNA, 23 nt, Salmonella enterica enterica serovar Typhi
cugcggcggcggaaaauagccag

SEQ ID NO: 3613876 - RNA, 18 nt, Salmonella enterica enterica serovar Typhi
cugcggcuauauaaaauc

SEQ ID NO: 3613877 - RNA, 20 nt, Salmonella enterica enterica serovar Typhi
cugcggcuauauaaaaucgg

SEQ ID NO: 3613878 - RNA, 15 nt, Salmonella enterica enterica serovar Typhi
cugcggcucgccaau

SEQ ID NO: 3613879 - RNA, 15 nt, Salmonella enterica enterica serovar Typhi
cugcgguaaucgccg

SEQ ID NO: 3613880 - RNA, 18 nt, Salmonella enterica enterica serovar Typhi
cugcgguaaucugccagc

SEQ ID NO: 3613881 - RNA, 16 nt, Salmonella enterica enterica serovar Typhi
cugcgguacggccagc

SEQ ID NO: 3613882 - RNA, 15 nt, Salmonella enterica enterica serovar Typhi
cugcgguauauuccc

SEQ ID NO: 3613883 - RNA, 16 nt, Salmonella enterica enterica serovar Typhi
cugcggucaggaauga

SEQ ID NO: 3613884 - RNA, 22 nt, Salmonella enterica enterica serovar Typhi
cugcggucguauuuaccgcugg

SEQ ID NO: 3613885 - RNA, 17 nt, Salmonella enterica enterica serovar Typhi
cugcguaaaaucagcau

SEQ ID NO: 3613886 - RNA, 21 nt, Salmonella enterica enterica serovar Typhi
cugcguaaaccauuucuccug

SEQ ID NO: 3613887 - RNA, 23 nt, Salmonella enterica enterica serovar Typhi
cugcguaaaccauuucuccugca

SEQ ID NO: 3613888 - RNA, 15 nt, Salmonella enterica enterica serovar Typhi
cugcguaacgcgccg

SEQ ID NO: 3613889 - RNA, 23 nt, Salmonella enterica enterica serovar Typhi
cugcguagacgaugcaggccgga

SEQ ID NO: 3613890 - RNA, 13 nt, Salmonella enterica enterica serovar Typhi
cugcgucacagac

SEQ ID NO: 3613891 - RNA, 22 nt, Salmonella enterica enterica serovar Typhi
cugcgucacgcgcaaagcugcg

SEQ ID NO: 3613892 - RNA, 22 nt, Salmonella enterica enterica serovar Typhi
cugcgucaugucguuagaacca

SEQ ID NO: 3613893 - RNA, 14 nt, Salmonella enterica enterica serovar Typhi
cugcgucgcgcgcg

SEQ ID NO: 3613894 - RNA, 16 nt, Salmonella enterica enterica serovar Typhi
cugcgucgcgcgcguu

SEQ ID NO: 3613895 - RNA, 22 nt, Salmonella enterica enterica serovar Typhi
cugcgucgggugcagcgucagg

SEQ ID NO: 3613896 - RNA, 13 nt, Salmonella enterica enterica serovar Typhi
cugcgugaaaagg

SEQ ID NO: 3613897 - RNA, 16 nt, Salmonella enterica enterica serovar Typhi
cugcgugaagacacaa

SEQ ID NO: 3613898 - RNA, 15 nt, Salmonella enterica enterica serovar Typhi
cugcguugcgcgcgu

SEQ ID NO: 3613899 - RNA, 20 nt, Salmonella enterica enterica serovar Typhi
cugcguugcuauggcaacaa

SEQ ID NO: 3613900 - RNA, 20 nt, Salmonella enterica enterica serovar Typhi
cugcuagaacauuucccgaa

SEQ ID NO: 3613901 - RNA, 21 nt, Salmonella enterica enterica serovar Typhi
cugcuaucaggauucgacggc

SEQ ID NO: 3613902 - RNA, 14 nt, Salmonella enterica enterica serovar Typhi
cugcuauccccauu

SEQ ID NO: 3613903 - RNA, 22 nt, Salmonella enterica enterica serovar Typhi
cugcucaagaauacccuuuaca

SEQ ID NO: 3613904 - RNA, 20 nt, Salmonella enterica enterica serovar Typhi
cugcucagaaauauucagua

SEQ ID NO: 3613905 - RNA, 18 nt, Salmonella enterica enterica serovar Typhi
cugcucauuuaugcgcug

SEQ ID NO: 3613906 - RNA, 12 nt, Salmonella enterica enterica serovar Typhi
cugcuccaugac

SEQ ID NO: 3613907 - RNA, 17 nt, Salmonella enterica enterica serovar Typhi
cugcucccccaguugcu

SEQ ID NO: 3613908 - RNA, 21 nt, Salmonella enterica enterica serovar Typhi
cugcucccccaguugcugcau

SEQ ID NO: 3613909 - RNA, 18 nt, Salmonella enterica enterica serovar Typhi
cugcucccgcugcggcgu

SEQ ID NO: 3613910 - RNA, 15 nt, Salmonella enterica enterica serovar Typhi
cugcuccgccagcaa

SEQ ID NO: 3613911 - RNA, 18 nt, Salmonella enterica enterica serovar Typhi
cugcuccggcuuaaugcc

SEQ ID NO: 3613912 - RNA, 19 nt, Salmonella enterica enterica serovar Typhi
cugcuccguccacgcgagc

SEQ ID NO: 3613913 - RNA, 23 nt, Salmonella enterica enterica serovar Typhi
cugcuccugccagauuuucuuua

SEQ ID NO: 3613914 - RNA, 15 nt, Salmonella enterica enterica serovar Typhi
cugcuccugcggcgu

SEQ ID NO: 3613915 - RNA, 16 nt, Salmonella enterica enterica serovar Typhi
cugcucggcggucagc

SEQ ID NO: 3613916 - RNA, 17 nt, Salmonella enterica enterica serovar Typhi
cugcucgguaaaaaguu

SEQ ID NO: 3613917 - RNA, 14 nt, Salmonella enterica enterica serovar Typhi
cugcucgguaucgu

SEQ ID NO: 3613918 - RNA, 24 nt, Salmonella enterica enterica serovar Typhi
cugcucguaaagcaucagacuacu

SEQ ID NO: 3613919 - RNA, 20 nt, Salmonella enterica enterica serovar Typhi
cugcucguuaaauccuccca

SEQ ID NO: 3613920 - RNA, 20 nt, Salmonella enterica enterica serovar Typhi
cugcucuaccaacugagcua

SEQ ID NO: 3613921 - RNA, 20 nt, Salmonella enterica enterica serovar Typhi
cugcucuccuugcggugaga

SEQ ID NO: 3613922 - RNA, 15 nt, Salmonella enterica enterica serovar Typhi
cugcucucgggcagg

SEQ ID NO: 3613923 - RNA, 23 nt, Salmonella enterica enterica serovar Typhi
cugcugacaaaaacggcuuuaau

SEQ ID NO: 3613924 - RNA, 15 nt, Salmonella enterica enterica serovar Typhi
cugcugacaaucagc

SEQ ID NO: 3613925 - RNA, 15 nt, Salmonella enterica enterica serovar Typhi
cugcugacguuugca

SEQ ID NO: 3613926 - RNA, 16 nt, Salmonella enterica enterica serovar Typhi
cugcugagugacgggc

SEQ ID NO: 3613927 - RNA, 11 nt, Salmonella enterica enterica serovar Typhi
cugcugauaau

SEQ ID NO: 3613928 - RNA, 16 nt, Salmonella enterica enterica serovar Typhi
cugcugauuggcgacg

SEQ ID NO: 3613929 - RNA, 18 nt, Salmonella enterica enterica serovar Typhi
cugcugccagccgccgcc

SEQ ID NO: 3613930 - RNA, 17 nt, Salmonella enterica enterica serovar Typhi
cugcugccagcgccgcc

SEQ ID NO: 3613931 - RNA, 16 nt, Salmonella enterica enterica serovar Typhi
cugcugcgcuuugaca

SEQ ID NO: 3613932 - RNA, 20 nt, Salmonella enterica enterica serovar Typhi
cugcugcugauggccuuugu

SEQ ID NO: 3613933 - RNA, 15 nt, Salmonella enterica enterica serovar Typhi
cugcugcuggguuga

SEQ ID NO: 3613934 - RNA, 21 nt, Salmonella enterica enterica serovar Typhi
cugcugcuugcuuuucaucac

SEQ ID NO: 3613935 - RNA, 23 nt, Salmonella enterica enterica serovar Typhi
cugcugcuugcuuuucaucacca

SEQ ID NO: 3613936 - RNA, 17 nt, Salmonella enterica enterica serovar Typhi
cugcuggaaaucuuucu

SEQ ID NO: 3613937 - RNA, 15 nt, Salmonella enterica enterica serovar Typhi
cugcuggagccggaa

SEQ ID NO: 3613938 - RNA, 16 nt, Salmonella enterica enterica serovar Typhi
cugcuggcaaaacgca

SEQ ID NO: 3613939 - RNA, 16 nt, Salmonella enterica enterica serovar Typhi
cugcuggcgagcagga

SEQ ID NO: 3613940 - RNA, 14 nt, Salmonella enterica enterica serovar Typhi
cugcuggcgcguca

SEQ ID NO: 3613941 - RNA, 23 nt, Salmonella enterica enterica serovar Typhi
cugcuggcggaauccaucccccu

SEQ ID NO: 3613942 - RNA, 16 nt, Salmonella enterica enterica serovar Typhi
cugcuguaacagacgc

SEQ ID NO: 3613943 - RNA, 22 nt, Salmonella enterica enterica serovar Typhi
cugcuguaacagacgcaggccg

SEQ ID NO: 3613944 - RNA, 16 nt, Salmonella enterica enterica serovar Typhi
cugcuguaccucuugc

SEQ ID NO: 3613945 - RNA, 20 nt, Salmonella enterica enterica serovar Typhi
cugcuguagcgucucaucaa

SEQ ID NO: 3613946 - RNA, 16 nt, Salmonella enterica enterica serovar Typhi
cugcuguccgccagca

SEQ ID NO: 3613947 - RNA, 12 nt, Salmonella enterica enterica serovar Typhi
cugcugugcaua

SEQ ID NO: 3613948 - RNA, 22 nt, Salmonella enterica enterica serovar Typhi
cugcuguuaaccuugcgccucu

SEQ ID NO: 3613949 - RNA, 23 nt, Salmonella enterica enterica serovar Typhi
cugcuguuccuggugcgacacca

SEQ ID NO: 3613950 - RNA, 18 nt, Salmonella enterica enterica serovar Typhi
cugcuguuuuugaaaaug

SEQ ID NO: 3613951 - RNA, 15 nt, Salmonella enterica enterica serovar Typhi
cuggcgcaaaugggc

SEQ ID NO: 3613952 - RNA, 20 nt, Salmonella enterica enterica serovar Typhi
cuggcgcaacuggcgccgga

SEQ ID NO: 3613953 - RNA, 19 nt, Salmonella enterica enterica serovar Typhi
cuggcgcagcgcuuuugcc

SEQ ID NO: 3613954 - RNA, 18 nt, Salmonella enterica enterica serovar Typhi
cuggcgcauuuuaaugau

SEQ ID NO: 3613955 - RNA, 14 nt, Salmonella enterica enterica serovar Typhi
cuggcgcccgguuc

SEQ ID NO: 3613956 - RNA, 13 nt, Salmonella enterica enterica serovar Typhi
cuggcgccgcaaa

SEQ ID NO: 3613957 - RNA, 13 nt, Salmonella enterica enterica serovar Typhi
cuggcgccgcaag

SEQ ID NO: 3613958 - RNA, 17 nt, Salmonella enterica enterica serovar Typhi
cuggcgcggggaacaca

SEQ ID NO: 3613959 - RNA, 18 nt, Salmonella enterica enterica serovar Typhi
cuggcgcggggaacacac

SEQ ID NO: 3613960 - RNA, 19 nt, Salmonella enterica enterica serovar Typhi
cuggcgcggggaacacacg

SEQ ID NO: 3613961 - RNA, 19 nt, Salmonella enterica enterica serovar Typhi
cuggcgcggggaacaccca

SEQ ID NO: 3613962 - RNA, 17 nt, Salmonella enterica enterica serovar Typhi
cuggcgcggggaacacg

SEQ ID NO: 3613963 - RNA, 17 nt, Salmonella enterica enterica serovar Typhi
cuggcgcggggaacacu

SEQ ID NO: 3613964 - RNA, 19 nt, Salmonella enterica enterica serovar Typhi
cuggcgcggggaacacuaa

SEQ ID NO: 3613965 - RNA, 16 nt, Salmonella enterica enterica serovar Typhi
cuggcgcgugcccagu

SEQ ID NO: 3613966 - RNA, 17 nt, Salmonella enterica enterica serovar Typhi
cuggcgcugaccgcccc

SEQ ID NO: 3613967 - RNA, 15 nt, Salmonella enterica enterica serovar Typhi
cuggcgcuggguaac

SEQ ID NO: 3613968 - RNA, 23 nt, Salmonella enterica enterica serovar Typhi
cuggcgcuguaauagauaugaaa

SEQ ID NO: 3613969 - RNA, 19 nt, Salmonella enterica enterica serovar Typhi
cuggcgcuuuuccagcacg

SEQ ID NO: 3613970 - RNA, 20 nt, Salmonella enterica enterica serovar Typhi
cuggcggaauccaucccccu

SEQ ID NO: 3613971 - RNA, 20 nt, Salmonella enterica enterica serovar Typhi
cuggcggaauggcgggcgca

SEQ ID NO: 3613972 - RNA, 14 nt, Salmonella enterica enterica serovar Typhi
cuggcggcaaaaac

SEQ ID NO: 3613973 - RNA, 20 nt, Salmonella enterica enterica serovar Typhi
cuggcggcaaaaacgccggu

SEQ ID NO: 3613974 - RNA, 13 nt, Salmonella enterica enterica serovar Typhi
cuggcggccccuc

SEQ ID NO: 3613975 - RNA, 18 nt, Salmonella enterica enterica serovar Typhi
cuggcggccccucuucca

SEQ ID NO: 3613976 - RNA, 22 nt, Salmonella enterica enterica serovar Typhi
cuggcgguaugaaagccaucgc

SEQ ID NO: 3613977 - RNA, 23 nt, Salmonella enterica enterica serovar Typhi
cuggcggugcggucacaggcaua

SEQ ID NO: 3613978 - RNA, 23 nt, Salmonella enterica enterica serovar Typhi
cuggcguagucucccuccugcuc

SEQ ID NO: 3613979 - RNA, 21 nt, Salmonella enterica enterica serovar Typhi
cuggcguaugcuuucagcaug

SEQ ID NO: 3613980 - RNA, 21 nt, Salmonella enterica enterica serovar Typhi
cuggcguauucgcccggcagg

SEQ ID NO: 3613981 - RNA, 19 nt, Salmonella enterica enterica serovar Typhi
cuggcguccagcccgucca

SEQ ID NO: 3613982 - RNA, 18 nt, Salmonella enterica enterica serovar Typhi
cuggcgucccgggucagg

SEQ ID NO: 3613983 - RNA, 23 nt, Salmonella enterica enterica serovar Typhi
cuggcgucccuuucccuuccagc

SEQ ID NO: 3613984 - RNA, 16 nt, Salmonella enterica enterica serovar Typhi
cuggcgucuguccggc

SEQ ID NO: 3613985 - RNA, 19 nt, Salmonella enterica enterica serovar Typhi
cuggcgucuguccggcgcu

SEQ ID NO: 3613986 - RNA, 15 nt, Salmonella enterica enterica serovar Typhi
cuggcuacguacaca

SEQ ID NO: 3613987 - RNA, 11 nt, Salmonella enterica enterica serovar Typhi
cuggcucagac

SEQ ID NO: 3613988 - RNA, 13 nt, Salmonella enterica enterica serovar Typhi
cuggcucagacca

SEQ ID NO: 3613989 - RNA, 17 nt, Salmonella enterica enterica serovar Typhi
cuggcucccgcagccac

SEQ ID NO: 3613990 - RNA, 14 nt, Salmonella enterica enterica serovar Typhi
cuggcucggccugu

SEQ ID NO: 3613991 - RNA, 14 nt, Salmonella enterica enterica serovar Typhi
cuggcugagaaaaa

SEQ ID NO: 3613992 - RNA, 17 nt, Salmonella enterica enterica serovar Typhi
cuggcugcugauggucu

SEQ ID NO: 3613993 - RNA, 22 nt, Salmonella enterica enterica serovar Typhi
cuggcuguccuugcgccaucgg

SEQ ID NO: 3613994 - RNA, 16 nt, Salmonella enterica enterica serovar Typhi
cuggcugugccaauaa

SEQ ID NO: 3613995 - RNA, 21 nt, Salmonella enterica enterica serovar Typhi
cuggcuguuccaccaacgacc

SEQ ID NO: 3613996 - RNA, 14 nt, Salmonella enterica enterica serovar Typhi
cuggcuucagccug

SEQ ID NO: 3613997 - RNA, 16 nt, Salmonella enterica enterica serovar Typhi
cuggcuucagccugug

SEQ ID NO: 3613998 - RNA, 18 nt, Salmonella enterica enterica serovar Typhi
cuggcuucagccugugca

SEQ ID NO: 3613999 - RNA, 11 nt, Salmonella enterica enterica serovar Typhi
cuggcuuuaua

SEQ ID NO: 3614000 - RNA, 14 nt, Salmonella enterica enterica serovar Typhi
cuggcuuuauauaa

SEQ ID NO: 3614001 - RNA, 17 nt, Salmonella enterica enterica serovar Typhi
cuggcuuuauauaaaaa

SEQ ID NO: 3614002 - RNA, 19 nt, Salmonella enterica enterica serovar Typhi
cuggcuuugcgccacuuca

SEQ ID NO: 3614003 - RNA, 16 nt, Salmonella enterica enterica serovar Typhi
cuggcuuugcgccggc

SEQ ID NO: 3614004 - RNA, 17 nt, Salmonella enterica enterica serovar Typhi
cugggaaguugcccuua

SEQ ID NO: 3614005 - RNA, 15 nt, Salmonella enterica enterica serovar Typhi
cugggaauaggccgc

SEQ ID NO: 3614006 - RNA, 15 nt, Salmonella enterica enterica serovar Typhi
cugggagccgcugcu

SEQ ID NO: 3614007 - RNA, 18 nt, Salmonella enterica enterica serovar Typhi
cugggauaagcagaacaa

SEQ ID NO: 3614008 - RNA, 15 nt, Salmonella enterica enterica serovar Typhi
cugggauuugugcga

SEQ ID NO: 3614009 - RNA, 22 nt, Salmonella enterica enterica serovar Typhi
cugggcacgcuaugguacggcg

SEQ ID NO: 3614010 - RNA, 17 nt, Salmonella enterica enterica serovar Typhi
cugggcgacuucauuca

SEQ ID NO: 3614011 - RNA, 19 nt, Salmonella enterica enterica serovar Typhi
cugggcgcaugaggccugu

SEQ ID NO: 3614012 - RNA, 14 nt, Salmonella enterica enterica serovar Typhi
cugggcugagaaaa

SEQ ID NO: 3614013 - RNA, 15 nt, Salmonella enterica enterica serovar Typhi
cugggcugauaggcc

SEQ ID NO: 3614014 - RNA, 21 nt, Salmonella enterica enterica serovar Typhi
cugggcuuuauccugaccgcu

SEQ ID NO: 3614015 - RNA, 13 nt, Salmonella enterica enterica serovar Typhi
cuggguaauagau

SEQ ID NO: 3614016 - RNA, 17 nt, Salmonella enterica enterica serovar Typhi
cugggucacgauaacca

SEQ ID NO: 3614017 - RNA, 20 nt, Salmonella enterica enterica serovar Typhi
cuggguuagccaaacucuga

SEQ ID NO: 3614018 - RNA, 22 nt, Salmonella enterica enterica serovar Typhi
cuggguuagcuguauccacccg

SEQ ID NO: 3614019 - RNA, 23 nt, Salmonella enterica enterica serovar Typhi
cuggguucauccagcaauaacac

SEQ ID NO: 3614020 - RNA, 16 nt, Salmonella enterica enterica serovar Typhi
cuggguugauaccgga

SEQ ID NO: 3614021 - RNA, 17 nt, Salmonella enterica enterica serovar Typhi
cuggguuuauuugguac

SEQ ID NO: 3614022 - RNA, 19 nt, Salmonella enterica enterica serovar Typhi
cuggguuuccggaucgccg

SEQ ID NO: 3614023 - RNA, 16 nt, Salmonella enterica enterica serovar Typhi
cuggguuugcugaauc

SEQ ID NO: 3614024 - RNA, 21 nt, Salmonella enterica enterica serovar Typhi
cuggguuuuuccgcuuuuccu

SEQ ID NO: 3614025 - RNA, 16 nt, Salmonella enterica enterica serovar Typhi
cugguaacggcacugc

SEQ ID NO: 3614026 - RNA, 19 nt, Salmonella enterica enterica serovar Typhi
cugguaacggcacugcuuu

SEQ ID NO: 3614027 - RNA, 22 nt, Salmonella enterica enterica serovar Typhi
cugguaacggcacugcuuuucg

SEQ ID NO: 3614028 - RNA, 13 nt, Salmonella enterica enterica serovar Typhi
cugguaagagagc

SEQ ID NO: 3614029 - RNA, 14 nt, Salmonella enterica enterica serovar Typhi
cugguaagagagcc

SEQ ID NO: 3614030 - RNA, 17 nt, Salmonella enterica enterica serovar Typhi
cugguaagagagccuua

SEQ ID NO: 3614031 - RNA, 19 nt, Salmonella enterica enterica serovar Typhi
cugguaagcguagcgccac

SEQ ID NO: 3614032 - RNA, 20 nt, Salmonella enterica enterica serovar Typhi
cugguaaguguuagcucuua

SEQ ID NO: 3614033 - RNA, 16 nt, Salmonella enterica enterica serovar Typhi
cugguacguccauccg

SEQ ID NO: 3614034 - RNA, 18 nt, Salmonella enterica enterica serovar Typhi
cugguagagaucgacaaa

SEQ ID NO: 3614035 - RNA, 23 nt, Salmonella enterica enterica serovar Typhi
cugguagagcaucgcggcaucau

SEQ ID NO: 3614036 - RNA, 18 nt, Salmonella enterica enterica serovar Typhi
cuguccgcccaguaccag

SEQ ID NO: 3614037 - RNA, 19 nt, Salmonella enterica enterica serovar Typhi
cuguccggaauaacuccag

SEQ ID NO: 3614038 - RNA, 17 nt, Salmonella enterica enterica serovar Typhi
cuguccgguguccauca

SEQ ID NO: 3614039 - RNA, 19 nt, Salmonella enterica enterica serovar Typhi
cuguccugaguaaagccug

SEQ ID NO: 3614040 - RNA, 18 nt, Salmonella enterica enterica serovar Typhi
cuguccuuucugcugccg

SEQ ID NO: 3614041 - RNA, 16 nt, Salmonella enterica enterica serovar Typhi
cugucgaaaccagcau

SEQ ID NO: 3614042 - RNA, 22 nt, Salmonella enterica enterica serovar Typhi
cugucgaaaccagcauaaugag

SEQ ID NO: 3614043 - RNA, 16 nt, Salmonella enterica enterica serovar Typhi
cugucgauaaacucau

SEQ ID NO: 3614044 - RNA, 22 nt, Salmonella enterica enterica serovar Typhi
cugucgauaacagcauaaacgu

SEQ ID NO: 3614045 - RNA, 13 nt, Salmonella enterica enterica serovar Typhi
cugucgccaccac

SEQ ID NO: 3614046 - RNA, 17 nt, Salmonella enterica enterica serovar Typhi
cugucgcccgcaaccac

SEQ ID NO: 3614047 - RNA, 14 nt, Salmonella enterica enterica serovar Typhi
cugucgccgcccgu

SEQ ID NO: 3614048 - RNA, 15 nt, Salmonella enterica enterica serovar Typhi
cugucgccgcccguc

SEQ ID NO: 3614049 - RNA, 17 nt, Salmonella enterica enterica serovar Typhi
cugucgccgcguaaauc

SEQ ID NO: 3614050 - RNA, 18 nt, Salmonella enterica enterica serovar Typhi
cugucgccgucugcaaaa

SEQ ID NO: 3614051 - RNA, 23 nt, Salmonella enterica enterica serovar Typhi
cugucgcuaaagcacuccccggc

SEQ ID NO: 3614052 - RNA, 15 nt, Salmonella enterica enterica serovar Typhi
cugucgcucgcggca

SEQ ID NO: 3614053 - RNA, 16 nt, Salmonella enterica enterica serovar Typhi
cugucgcucgcggcag

SEQ ID NO: 3614054 - RNA, 15 nt, Salmonella enterica enterica serovar Typhi
cugucggcagaaccu

SEQ ID NO: 3614055 - RNA, 22 nt, Salmonella enterica enterica serovar Typhi
cugucggcgagguacugcauaa

SEQ ID NO: 3614056 - RNA, 15 nt, Salmonella enterica enterica serovar Typhi
cugucggucagauuc

SEQ ID NO: 3614057 - RNA, 16 nt, Salmonella enterica enterica serovar Typhi
cugucgucaccagcag

SEQ ID NO: 3614058 - RNA, 14 nt, Salmonella enterica enterica serovar Typhi
cugucuccagcgcc

SEQ ID NO: 3614059 - RNA, 20 nt, Salmonella enterica enterica serovar Typhi
cugucugcaagagaaauaac

SEQ ID NO: 3614060 - RNA, 18 nt, Salmonella enterica enterica serovar Typhi
cugucugucgcgggcgaa

SEQ ID NO: 3614061 - RNA, 14 nt, Salmonella enterica enterica serovar Typhi
cugucuuguggaac

SEQ ID NO: 3614062 - RNA, 15 nt, Salmonella enterica enterica serovar Typhi
cugucuuguuuuucu

SEQ ID NO: 3614063 - RNA, 16 nt, Salmonella enterica enterica serovar Typhi
cugucuuguuuuucug

SEQ ID NO: 3614064 - RNA, 18 nt, Salmonella enterica enterica serovar Typhi
cugugaagcgaucggcgu

SEQ ID NO: 3614065 - RNA, 14 nt, Salmonella enterica enterica serovar Typhi
cugugaaguaauuc

SEQ ID NO: 3614066 - RNA, 16 nt, Salmonella enterica enterica serovar Typhi
cugugauugaauucac

SEQ ID NO: 3614067 - RNA, 17 nt, Salmonella enterica enterica serovar Typhi
cugugcaacaucuuacc

SEQ ID NO: 3614068 - RNA, 23 nt, Salmonella enterica enterica serovar Typhi
cugugcaacaucuuaccggugcg

SEQ ID NO: 3614069 - RNA, 18 nt, Salmonella enterica enterica serovar Typhi
cugugcauaucuggcgag

SEQ ID NO: 3614070 - RNA, 20 nt, Salmonella enterica enterica serovar Typhi
cugugccagcucguuauuuc

SEQ ID NO: 3614071 - RNA, 23 nt, Salmonella enterica enterica serovar Typhi
cugugcccagagcgacaaugaac

SEQ ID NO: 3614072 - RNA, 21 nt, Salmonella enterica enterica serovar Typhi
cugugccgcuggugcuacggg

SEQ ID NO: 3614073 - RNA, 15 nt, Salmonella enterica enterica serovar Typhi
cugugccugccugug

SEQ ID NO: 3614074 - RNA, 14 nt, Salmonella enterica enterica serovar Typhi
cugugcgacaaccu

SEQ ID NO: 3614075 - RNA, 14 nt, Salmonella enterica enterica serovar Typhi
cugugcgugaccca

SEQ ID NO: 3614076 - RNA, 18 nt, Salmonella enterica enterica serovar Typhi
cugugcuaugauaagccu

SEQ ID NO: 3614077 - RNA, 16 nt, Salmonella enterica enterica serovar Typhi
cugugcuuaccgggcc

SEQ ID NO: 3614078 - RNA, 15 nt, Salmonella enterica enterica serovar Typhi
cuguggaaaaucugg

SEQ ID NO: 3614079 - RNA, 19 nt, Salmonella enterica enterica serovar Typhi
cugugggcgugucgccggg

SEQ ID NO: 3614080 - RNA, 14 nt, Salmonella enterica enterica serovar Typhi
cugugguucugcca

SEQ ID NO: 3614081 - RNA, 16 nt, Salmonella enterica enterica serovar Typhi
cugugguucugccaga

SEQ ID NO: 3614082 - RNA, 20 nt, Salmonella enterica enterica serovar Typhi
cuguguacgcguucugaaua

SEQ ID NO: 3614083 - RNA, 13 nt, Salmonella enterica enterica serovar Typhi
cuguguacuuuua

SEQ ID NO: 3614084 - RNA, 15 nt, Salmonella enterica enterica serovar Typhi
cuguguccgccugcu

SEQ ID NO: 3614085 - RNA, 15 nt, Salmonella enterica enterica serovar Typhi
cugugucguccaggc

SEQ ID NO: 3614086 - RNA, 18 nt, Salmonella enterica enterica serovar Typhi
cugugucguccaggccug

SEQ ID NO: 3614087 - RNA, 20 nt, Salmonella enterica enterica serovar Typhi
cugugugaccagcaguuccg

SEQ ID NO: 3614088 - RNA, 12 nt, Salmonella enterica enterica serovar Typhi
cugugugagcgc

SEQ ID NO: 3614089 - RNA, 17 nt, Salmonella enterica enterica serovar Typhi
cuguuaaaaccggcugc

SEQ ID NO: 3614090 - RNA, 21 nt, Salmonella enterica enterica serovar Typhi
cuguuaauaaguccgcgggca

SEQ ID NO: 3614091 - RNA, 14 nt, Salmonella enterica enterica serovar Typhi
cuguuaauaccgug

SEQ ID NO: 3614092 - RNA, 14 nt, Salmonella enterica enterica serovar Typhi
cuguuaauuucccg

SEQ ID NO: 3614093 - RNA, 18 nt, Salmonella enterica enterica serovar Typhi
cuguuaucgccauuauuc

SEQ ID NO: 3614094 - RNA, 15 nt, Salmonella enterica enterica serovar Typhi
cuguuaugccuuuuu

SEQ ID NO: 3614095 - RNA, 15 nt, Salmonella enterica enterica serovar Typhi
cuguuaugggucgcu

SEQ ID NO: 3614096 - RNA, 19 nt, Salmonella enterica enterica serovar Typhi
cuguuauugacgauauaaa

SEQ ID NO: 3614097 - RNA, 20 nt, Salmonella enterica enterica serovar Typhi
cuguucaaguggcaaucgac

SEQ ID NO: 3614098 - RNA, 13 nt, Salmonella enterica enterica serovar Typhi
cuguucacaucca

SEQ ID NO: 3614099 - RNA, 14 nt, Salmonella enterica enterica serovar Typhi
cuguucacauccag

SEQ ID NO: 3614100 - RNA, 23 nt, Salmonella enterica enterica serovar Typhi
cuguucagaaaucggcagcaccc

SEQ ID NO: 3614101 - RNA, 16 nt, Salmonella enterica enterica serovar Typhi
cuguucaucaaagaaa

SEQ ID NO: 3614102 - RNA, 17 nt, Salmonella enterica enterica serovar Typhi
cuguucaucaaagaaaa

SEQ ID NO: 3614103 - RNA, 14 nt, Salmonella enterica enterica serovar Typhi
cuguucaugccaga

SEQ ID NO: 3614104 - RNA, 23 nt, Salmonella enterica enterica serovar Typhi
cuguuccacagaucuaucugaac

SEQ ID NO: 3614105 - RNA, 17 nt, Salmonella enterica enterica serovar Typhi
cuguuccagccgcccgc

SEQ ID NO: 3614106 - RNA, 18 nt, Salmonella enterica enterica serovar Typhi
cuguuccagguucaagcu

SEQ ID NO: 3614107 - RNA, 19 nt, Salmonella enterica enterica serovar Typhi
cuguuccagugggcggaua

SEQ ID NO: 3614108 - RNA, 19 nt, Salmonella enterica enterica serovar Typhi
cuguuccgaaauaaaucga

SEQ ID NO: 3614109 - RNA, 12 nt, Salmonella enterica enterica serovar Typhi
cuguuccucuuu

SEQ ID NO: 3614110 - RNA, 14 nt, Salmonella enterica enterica serovar Typhi
cuguuccuucagaa

SEQ ID NO: 3614111 - RNA, 14 nt, Salmonella enterica enterica serovar Typhi
cuguucgccggaug

SEQ ID NO: 3614112 - RNA, 14 nt, Salmonella enterica enterica serovar Typhi
cuguucgccuucgu

SEQ ID NO: 3614113 - RNA, 15 nt, Salmonella enterica enterica serovar Typhi
cuguucgcuuauucc

SEQ ID NO: 3614114 - RNA, 20 nt, Salmonella enterica enterica serovar Typhi
cuguucggggaauucaaaga

SEQ ID NO: 3614115 - RNA, 16 nt, Salmonella enterica enterica serovar Typhi
cuguucuacuacagaa

SEQ ID NO: 3614116 - RNA, 23 nt, Salmonella enterica enterica serovar Typhi
cuguucuggauagucuucaagcc

SEQ ID NO: 3614117 - RNA, 17 nt, Salmonella enterica enterica serovar Typhi
cuguucuugcugcugcu

SEQ ID NO: 3614118 - RNA, 16 nt, Salmonella enterica enterica serovar Typhi
cuguugaaagccccgg

SEQ ID NO: 3614119 - RNA, 19 nt, Salmonella enterica enterica serovar Typhi
cuguugaguucccuucucc

SEQ ID NO: 3614120 - RNA, 22 nt, Salmonella enterica enterica serovar Typhi
cuguugaguucccuucuccuca

SEQ ID NO: 3614121 - RNA, 20 nt, Salmonella enterica enterica serovar Typhi
cuguugaugauaaccgccgc

SEQ ID NO: 3614122 - RNA, 18 nt, Salmonella enterica enterica serovar Typhi
cuuauacccuuguaaauu

SEQ ID NO: 3614123 - RNA, 17 nt, Salmonella enterica enterica serovar Typhi
cuuauacugauaaacua

SEQ ID NO: 3614124 - RNA, 19 nt, Salmonella enterica enterica serovar Typhi
cuuauacugauaaacuauc

SEQ ID NO: 3614125 - RNA, 15 nt, Salmonella enterica enterica serovar Typhi
cuuaucaaaccagcu

SEQ ID NO: 3614126 - RNA, 20 nt, Salmonella enterica enterica serovar Typhi
cuuaucaaaccagcuuuuca

SEQ ID NO: 3614127 - RNA, 22 nt, Salmonella enterica enterica serovar Typhi
cuuaucaggccgacaaaugacg

SEQ ID NO: 3614128 - RNA, 19 nt, Salmonella enterica enterica serovar Typhi
cuuaucaggccuaccagcc

SEQ ID NO: 3614129 - RNA, 13 nt, Salmonella enterica enterica serovar Typhi
cuuaucccagccg

SEQ ID NO: 3614130 - RNA, 20 nt, Salmonella enterica enterica serovar Typhi
cuuauccccauucugcugau

SEQ ID NO: 3614131 - RNA, 21 nt, Salmonella enterica enterica serovar Typhi
cuuauccggccuacagaacug

SEQ ID NO: 3614132 - RNA, 19 nt, Salmonella enterica enterica serovar Typhi
cuuauccggccuauagcua

SEQ ID NO: 3614133 - RNA, 17 nt, Salmonella enterica enterica serovar Typhi
cuuauccggccuccaaa

SEQ ID NO: 3614134 - RNA, 22 nt, Salmonella enterica enterica serovar Typhi
cuuauccggccugcaaaccgcc

SEQ ID NO: 3614135 - RNA, 20 nt, Salmonella enterica enterica serovar Typhi
cuuauccggccugcaggcaa

SEQ ID NO: 3614136 - RNA, 20 nt, Salmonella enterica enterica serovar Typhi
cuuauccggcuuacggcuau

SEQ ID NO: 3614137 - RNA, 16 nt, Salmonella enterica enterica serovar Typhi
cuuaucgccaaagaua

SEQ ID NO: 3614138 - RNA, 17 nt, Salmonella enterica enterica serovar Typhi
cuuaucgccaaagauau

SEQ ID NO: 3614139 - RNA, 20 nt, Salmonella enterica enterica serovar Typhi
cuuaucgccguaaccgccug

SEQ ID NO: 3614140 - RNA, 13 nt, Salmonella enterica enterica serovar Typhi
cuuaucuggauga

SEQ ID NO: 3614141 - RNA, 19 nt, Salmonella enterica enterica serovar Typhi
cuuaucuuucagcgccgga

SEQ ID NO: 3614142 - RNA, 22 nt, Salmonella enterica enterica serovar Typhi
cuuaugaaaccccaaaucagca

SEQ ID NO: 3614143 - RNA, 13 nt, Salmonella enterica enterica serovar Typhi
cuuaugaucgccc

SEQ ID NO: 3614144 - RNA, 15 nt, Salmonella enterica enterica serovar Typhi
cuuaugaucgcccag

SEQ ID NO: 3614145 - RNA, 21 nt, Salmonella enterica enterica serovar Typhi
cuuaugaucgcccagccacuc

SEQ ID NO: 3614146 - RNA, 21 nt, Salmonella enterica enterica serovar Typhi
cuuauuagaggcguaaguaaa

SEQ ID NO: 3614147 - RNA, 23 nt, Salmonella enterica enterica serovar Typhi
cuuauuagaggcguaaguaaaag

SEQ ID NO: 3614148 - RNA, 13 nt, Salmonella enterica enterica serovar Typhi
cuuauucaaucaa

SEQ ID NO: 3614149 - RNA, 12 nt, Salmonella enterica enterica serovar Typhi
cuuauuccaguc

SEQ ID NO: 3614150 - RNA, 15 nt, Salmonella enterica enterica serovar Typhi
cuuauugaguuaccg

SEQ ID NO: 3614151 - RNA, 17 nt, Salmonella enterica enterica serovar Typhi
cuuauugaugacgcuua

SEQ ID NO: 3614152 - RNA, 16 nt, Salmonella enterica enterica serovar Typhi
cuuauugauuuucaac

SEQ ID NO: 3614153 - RNA, 21 nt, Salmonella enterica enterica serovar Typhi
cuuauuuuucagcgccaguga

SEQ ID NO: 3614154 - RNA, 19 nt, Salmonella enterica enterica serovar Typhi
cuucaaaacagaaccccau

SEQ ID NO: 3614155 - RNA, 18 nt, Salmonella enterica enterica serovar Typhi
cuucaaagccacacugca

SEQ ID NO: 3614156 - RNA, 23 nt, Salmonella enterica enterica serovar Typhi
cuucaaauauauugaaaagggac

SEQ ID NO: 3614157 - RNA, 17 nt, Salmonella enterica enterica serovar Typhi
cuucaacagcucgccau

SEQ ID NO: 3614158 - RNA, 19 nt, Salmonella enterica enterica serovar Typhi
cuucaaccguuucuuuuuc

SEQ ID NO: 3614159 - RNA, 18 nt, Salmonella enterica enterica serovar Typhi
cuucaaccuuugggcaga

SEQ ID NO: 3614160 - RNA, 19 nt, Salmonella enterica enterica serovar Typhi
cuucaacgcaggcgaaauc

SEQ ID NO: 3614161 - RNA, 19 nt, Salmonella enterica enterica serovar Typhi
cuucaacgcucaguacgcu

SEQ ID NO: 3614162 - RNA, 18 nt, Salmonella enterica enterica serovar Typhi
cuucaagccaggcuuuaa

SEQ ID NO: 3614163 - RNA, 22 nt, Salmonella enterica enterica serovar Typhi
cuucaagcuggugcuuuaugua

SEQ ID NO: 3614164 - RNA, 23 nt, Salmonella enterica enterica serovar Typhi
cuucaagcuggugcuuuauguag

SEQ ID NO: 3614165 - RNA, 16 nt, Salmonella enterica enterica serovar Typhi
cuucaauaucaacgac

SEQ ID NO: 3614166 - RNA, 14 nt, Salmonella enterica enterica serovar Typhi
cuucaauauugaug

SEQ ID NO: 3614167 - RNA, 12 nt, Salmonella enterica enterica serovar Typhi
cuucaaugaaca

SEQ ID NO: 3614168 - RNA, 18 nt, Salmonella enterica enterica serovar Typhi
cuucaaugcgccccgucu

SEQ ID NO: 3614169 - RNA, 16 nt, Salmonella enterica enterica serovar Typhi
cuucaauucagaaagu

SEQ ID NO: 3614170 - RNA, 19 nt, Salmonella enterica enterica serovar Typhi
cuucaauucagaaaguuac

SEQ ID NO: 3614171 - RNA, 20 nt, Salmonella enterica enterica serovar Typhi
cuucaauuccuggaacugac

SEQ ID NO: 3614172 - RNA, 21 nt, Salmonella enterica enterica serovar Typhi
cuucaauuugaccugaccugg

SEQ ID NO: 3614173 - RNA, 18 nt, Salmonella enterica enterica serovar Typhi
cuucacaaacaauuuccc

SEQ ID NO: 3614174 - RNA, 14 nt, Salmonella enterica enterica serovar Typhi
cuucacaaucagcg

SEQ ID NO: 3614175 - RNA, 19 nt, Salmonella enterica enterica serovar Typhi
cuucacauuuuuaucagcu

SEQ ID NO: 3614176 - RNA, 14 nt, Salmonella enterica enterica serovar Typhi
cuucaccacgccau

SEQ ID NO: 3614177 - RNA, 23 nt, Salmonella enterica enterica serovar Typhi
cuucacccuucuucuggcucaga

SEQ ID NO: 3614178 - RNA, 18 nt, Salmonella enterica enterica serovar Typhi
cuucaccgagaaauuuag

SEQ ID NO: 3614179 - RNA, 21 nt, Salmonella enterica enterica serovar Typhi
cuucaccguugugcuccagcg

SEQ ID NO: 3614180 - RNA, 19 nt, Salmonella enterica enterica serovar Typhi
cuucaccucagccaaccca

SEQ ID NO: 3614181 - RNA, 14 nt, Salmonella enterica enterica serovar Typhi
cuucaccuugcugc

SEQ ID NO: 3614182 - RNA, 21 nt, Salmonella enterica enterica serovar Typhi
cuucacgagcggucaggccag

SEQ ID NO: 3614183 - RNA, 15 nt, Salmonella enterica enterica serovar Typhi
cuucacgccauccag

SEQ ID NO: 3614184 - RNA, 19 nt, Salmonella enterica enterica serovar Typhi
cuucacgccauccaguuua

SEQ ID NO: 3614185 - RNA, 13 nt, Salmonella enterica enterica serovar Typhi
cuucacgccaucg

SEQ ID NO: 3614186 - RNA, 22 nt, Salmonella enterica enterica serovar Typhi
cuucacgcgcggcuacugccag

SEQ ID NO: 3614187 - RNA, 14 nt, Salmonella enterica enterica serovar Typhi
cuucacgcuaaucc

SEQ ID NO: 3614188 - RNA, 23 nt, Salmonella enterica enterica serovar Typhi
cuucacguugacgcaaacugcca

SEQ ID NO: 3614189 - RNA, 20 nt, Salmonella enterica enterica serovar Typhi
cuucacuaauuugaugccug

SEQ ID NO: 3614190 - RNA, 18 nt, Salmonella enterica enterica serovar Typhi
cuucacuguuaucgccau

SEQ ID NO: 3614191 - RNA, 17 nt, Salmonella enterica enterica serovar Typhi
cuucacuucacaaacaa

SEQ ID NO: 3614192 - RNA, 17 nt, Salmonella enterica enterica serovar Typhi
cuucagaaagcagguuu

SEQ ID NO: 3614193 - RNA, 16 nt, Salmonella enterica enterica serovar Typhi
cuucagacaacgccgc

SEQ ID NO: 3614194 - RNA, 13 nt, Salmonella enterica enterica serovar Typhi
cuucagagcaggu

SEQ ID NO: 3614195 - RNA, 21 nt, Salmonella enterica enterica serovar Typhi
cuucagagcugaaaauguggu

SEQ ID NO: 3614196 - RNA, 18 nt, Salmonella enterica enterica serovar Typhi
cuucagaggccuuuugca

SEQ ID NO: 3614197 - RNA, 12 nt, Salmonella enterica enterica serovar Typhi
cuucagccagac

SEQ ID NO: 3614198 - RNA, 17 nt, Salmonella enterica enterica serovar Typhi
cuucagcgacaucguca

SEQ ID NO: 3614199 - RNA, 13 nt, Salmonella enterica enterica serovar Typhi
cuucagcgcgccc

SEQ ID NO: 3614200 - RNA, 20 nt, Salmonella enterica enterica serovar Typhi
cuucagcggcgcguugccgc

SEQ ID NO: 3614201 - RNA, 15 nt, Salmonella enterica enterica serovar Typhi
cuucagcguugcuau

SEQ ID NO: 3614202 - RNA, 16 nt, Salmonella enterica enterica serovar Typhi
cuucagcguugucccg

SEQ ID NO: 3614203 - RNA, 20 nt, Salmonella enterica enterica serovar Typhi
cuucaggcucaucagcgcca

SEQ ID NO: 3614204 - RNA, 22 nt, Salmonella enterica enterica serovar Typhi
cuucaggcuguugcgcauucag

SEQ ID NO: 3614205 - RNA, 23 nt, Salmonella enterica enterica serovar Typhi
cuucaggcuguugcgcauucagg

SEQ ID NO: 3614206 - RNA, 14 nt, Salmonella enterica enterica serovar Typhi
cuucagguuaagug

SEQ ID NO: 3614207 - RNA, 18 nt, Salmonella enterica enterica serovar Typhi
cuucgaccgucagcagca

SEQ ID NO: 3614208 - RNA, 22 nt, Salmonella enterica enterica serovar Typhi
cuucgaggauaaaaucgccaaa

SEQ ID NO: 3614209 - RNA, 15 nt, Salmonella enterica enterica serovar Typhi
cuucgauaaacgccu

SEQ ID NO: 3614210 - RNA, 21 nt, Salmonella enterica enterica serovar Typhi
cuucgauaguccauuuuccua

SEQ ID NO: 3614211 - RNA, 21 nt, Salmonella enterica enterica serovar Typhi
cuucgauuguugacugccagc

SEQ ID NO: 3614212 - RNA, 13 nt, Salmonella enterica enterica serovar Typhi
cuucgcacugccc

SEQ ID NO: 3614213 - RNA, 18 nt, Salmonella enterica enterica serovar Typhi
cuucgcagaucgccugga

SEQ ID NO: 3614214 - RNA, 19 nt, Salmonella enterica enterica serovar Typhi
cuucgcagcgauauuucuc

SEQ ID NO: 3614215 - RNA, 21 nt, Salmonella enterica enterica serovar Typhi
cuucgccaacuuuuugcgcaa

SEQ ID NO: 3614216 - RNA, 20 nt, Salmonella enterica enterica serovar Typhi
cuucgccaucuccaucauuu

SEQ ID NO: 3614217 - RNA, 19 nt, Salmonella enterica enterica serovar Typhi
cuucgccauuacaggacag

SEQ ID NO: 3614218 - RNA, 23 nt, Salmonella enterica enterica serovar Typhi
cuucgcccauugccacccauuua

SEQ ID NO: 3614219 - RNA, 20 nt, Salmonella enterica enterica serovar Typhi
cuucgccccggcgagugccu

SEQ ID NO: 3614220 - RNA, 19 nt, Salmonella enterica enterica serovar Typhi
cuucgccguuaucggccug

SEQ ID NO: 3614221 - RNA, 20 nt, Salmonella enterica enterica serovar Typhi
cuucgccguuaucggccugc

SEQ ID NO: 3614222 - RNA, 22 nt, Salmonella enterica enterica serovar Typhi
cuucgccuuucaccagcgccug

SEQ ID NO: 3614223 - RNA, 21 nt, Salmonella enterica enterica serovar Typhi
cuucgcgccuucuaccgcuuc

SEQ ID NO: 3614224 - RNA, 18 nt, Salmonella enterica enterica serovar Typhi
cuucgcguuuaucaccaa

SEQ ID NO: 3614225 - RNA, 21 nt, Salmonella enterica enterica serovar Typhi
cuucgcugaguggucuggaca

SEQ ID NO: 3614226 - RNA, 13 nt, Salmonella enterica enterica serovar Typhi
cuucgcuggcgga

SEQ ID NO: 3614227 - RNA, 19 nt, Salmonella enterica enterica serovar Typhi
cuucgcuuaucaggccuac

SEQ ID NO: 3614228 - RNA, 14 nt, Salmonella enterica enterica serovar Typhi
cuucgcuuaucugg

SEQ ID NO: 3614229 - RNA, 18 nt, Salmonella enterica enterica serovar Typhi
cuucggacuccugacgcu

SEQ ID NO: 3614230 - RNA, 22 nt, Salmonella enterica enterica serovar Typhi
cuucggcaaaauauucagcgaa

SEQ ID NO: 3614231 - RNA, 14 nt, Salmonella enterica enterica serovar Typhi
cuucggccuccgcu

SEQ ID NO: 3614232 - RNA, 23 nt, Salmonella enterica enterica serovar Typhi
cuucggcgggaucuccagaagca

SEQ ID NO: 3614233 - RNA, 14 nt, Salmonella enterica enterica serovar Typhi
cuucguauuucuuc

SEQ ID NO: 3614234 - RNA, 14 nt, Salmonella enterica enterica serovar Typhi
cuucgucaaaaugg

SEQ ID NO: 3614235 - RNA, 14 nt, Salmonella enterica enterica serovar Typhi
cuucgucuuuauuc

SEQ ID NO: 3614236 - RNA, 19 nt, Salmonella enterica enterica serovar Typhi
cuucguggaacugcagcgc

SEQ ID NO: 3614237 - RNA, 15 nt, Salmonella enterica enterica serovar Typhi
cuucguuaagcgguu

SEQ ID NO: 3614238 - RNA, 15 nt, Salmonella enterica enterica serovar Typhi
cuucguuauuuuccu

SEQ ID NO: 3614239 - RNA, 14 nt, Salmonella enterica enterica serovar Typhi
cuucguucuguauc

SEQ ID NO: 3614240 - RNA, 14 nt, Salmonella enterica enterica serovar Typhi
cuucguuggcgcug

SEQ ID NO: 3614241 - RNA, 15 nt, Salmonella enterica enterica serovar Typhi
cuucuaccugcacau

SEQ ID NO: 3614242 - RNA, 18 nt, Salmonella enterica enterica serovar Typhi
cuucuaccuucaccccca

SEQ ID NO: 3614243 - RNA, 21 nt, Salmonella enterica enterica serovar Typhi
cuucucacggauccagaacug

SEQ ID NO: 3614244 - RNA, 19 nt, Salmonella enterica enterica serovar Typhi
cuucucaggcgagcccugu

SEQ ID NO: 3614245 - RNA, 23 nt, Salmonella enterica enterica serovar Typhi
cuucuccccuucaucaguaacug

SEQ ID NO: 3614246 - RNA, 13 nt, Salmonella enterica enterica serovar Typhi
cuucuccgccugc

SEQ ID NO: 3614247 - RNA, 16 nt, Salmonella enterica enterica serovar Typhi
cuucuccgccugcggu

SEQ ID NO: 3614248 - RNA, 17 nt, Salmonella enterica enterica serovar Typhi
cuucuccucaacagaca

SEQ ID NO: 3614249 - RNA, 19 nt, Salmonella enterica enterica serovar Typhi
cuucucgccuucggccuga

SEQ ID NO: 3614250 - RNA, 17 nt, Salmonella enterica enterica serovar Typhi
cuucugacagugacggc

SEQ ID NO: 3614251 - RNA, 19 nt, Salmonella enterica enterica serovar Typhi
cuucugauggcuuugcugu

SEQ ID NO: 3614252 - RNA, 22 nt, Salmonella enterica enterica serovar Typhi
cuucugcgcaggaggcuuccgc

SEQ ID NO: 3614253 - RNA, 23 nt, Salmonella enterica enterica serovar Typhi
cuucugcgucaugcuuuuuuucu

SEQ ID NO: 3614254 - RNA, 12 nt, Salmonella enterica enterica serovar Typhi
cuucuggaauuc

SEQ ID NO: 3614255 - RNA, 18 nt, Salmonella enterica enterica serovar Typhi
cuucuggcgucccuuucc

SEQ ID NO: 3614256 - RNA, 18 nt, Salmonella enterica enterica serovar Typhi
cuucugguagccagacau

SEQ ID NO: 3614257 - RNA, 21 nt, Salmonella enterica enterica serovar Typhi
cuucuguacgcugaauaaccc

SEQ ID NO: 3614258 - RNA, 20 nt, Salmonella enterica enterica serovar Typhi
cuucugucugcgugaagaca

SEQ ID NO: 3614259 - RNA, 17 nt, Salmonella enterica enterica serovar Typhi
cuucuucaagccaggcu

SEQ ID NO: 3614260 - RNA, 15 nt, Salmonella enterica enterica serovar Typhi
cuucuucacuaaaaa

SEQ ID NO: 3614261 - RNA, 14 nt, Salmonella enterica enterica serovar Typhi
cuucuucaggcuug

SEQ ID NO: 3614262 - RNA, 17 nt, Salmonella enterica enterica serovar Typhi
cuucuucaguuccgcca

SEQ ID NO: 3614263 - RNA, 19 nt, Salmonella enterica enterica serovar Typhi
cuucuucaguuccgccaga

SEQ ID NO: 3614264 - RNA, 14 nt, Salmonella enterica enterica serovar Typhi
cuucuuccagcccg

SEQ ID NO: 3614265 - RNA, 12 nt, Salmonella enterica enterica serovar Typhi
cuucuuccagcg

SEQ ID NO: 3614266 - RNA, 13 nt, Salmonella enterica enterica serovar Typhi
cuucuucccccug

SEQ ID NO: 3614267 - RNA, 21 nt, Salmonella enterica enterica serovar Typhi
cuucuucggcagcuuccagca

SEQ ID NO: 3614268 - RNA, 14 nt, Salmonella enterica enterica serovar Typhi
cuucuuuagauaau

SEQ ID NO: 3614269 - RNA, 14 nt, Salmonella enterica enterica serovar Typhi
cuucuuuauccuga

SEQ ID NO: 3614270 - RNA, 21 nt, Salmonella enterica enterica serovar Typhi
cuucuuuauucgcgaugcacc

SEQ ID NO: 3614271 - RNA, 15 nt, Salmonella enterica enterica serovar Typhi
cuucuuugcgauuug

SEQ ID NO: 3614272 - RNA, 13 nt, Salmonella enterica enterica serovar Typhi
cuucuuuuacugc

SEQ ID NO: 3614273 - RNA, 22 nt, Salmonella enterica enterica serovar Typhi
cuugaagccuuucuguucuuug

SEQ ID NO: 3614274 - RNA, 17 nt, Salmonella enterica enterica serovar Typhi
cuugaauccuuuaaucg

SEQ ID NO: 3614275 - RNA, 15 nt, Salmonella enterica enterica serovar Typhi
cuugaccagcacuuc

SEQ ID NO: 3614276 - RNA, 18 nt, Salmonella enterica enterica serovar Typhi
cuugacucugaagcggga

SEQ ID NO: 3614277 - RNA, 17 nt, Salmonella enterica enterica serovar Typhi
cuugacuuugcucuccu

SEQ ID NO: 3614278 - RNA, 20 nt, Salmonella enterica enterica serovar Typhi
cuugagaaauuauuuuaaau

SEQ ID NO: 3614279 - RNA, 19 nt, Salmonella enterica enterica serovar Typhi
cuugagacuguuugucuca

SEQ ID NO: 3614280 - RNA, 17 nt, Salmonella enterica enterica serovar Typhi
cuugagcaaaacaccgc

SEQ ID NO: 3614281 - RNA, 17 nt, Salmonella enterica enterica serovar Typhi
cuugauaaauaucaaga

SEQ ID NO: 3614282 - RNA, 19 nt, Salmonella enterica enterica serovar Typhi
cuugauaaugucaacuuaa

SEQ ID NO: 3614283 - RNA, 20 nt, Salmonella enterica enterica serovar Typhi
cuugauacgccaucuuucuu

SEQ ID NO: 3614284 - RNA, 16 nt, Salmonella enterica enterica serovar Typhi
cuugauacggcuuuca

SEQ ID NO: 3614285 - RNA, 14 nt, Salmonella enterica enterica serovar Typhi
cuugaucggcuggc

SEQ ID NO: 3614286 - RNA, 20 nt, Salmonella enterica enterica serovar Typhi
cuugaugauacccccagaga

SEQ ID NO: 3614287 - RNA, 18 nt, Salmonella enterica enterica serovar Typhi
cuugauggaaaacgcauc

SEQ ID NO: 3614288 - RNA, 20 nt, Salmonella enterica enterica serovar Typhi
cuugauggcgaucagcgcca

SEQ ID NO: 3614289 - RNA, 19 nt, Salmonella enterica enterica serovar Typhi
cuugcaaugaaaaaucccc

SEQ ID NO: 3614290 - RNA, 15 nt, Salmonella enterica enterica serovar Typhi
cuugcaauuuaucca

SEQ ID NO: 3614291 - RNA, 19 nt, Salmonella enterica enterica serovar Typhi
cuugcacgccaaaaaguga

SEQ ID NO: 3614292 - RNA, 20 nt, Salmonella enterica enterica serovar Typhi
cuuuauuuuuaauugcugaa

SEQ ID NO: 3614293 - RNA, 23 nt, Salmonella enterica enterica serovar Typhi
cuuucaacauauuuuucacacau

SEQ ID NO: 3614294 - RNA, 18 nt, Salmonella enterica enterica serovar Typhi
cuuucaauccuucuucug

SEQ ID NO: 3614295 - RNA, 17 nt, Salmonella enterica enterica serovar Typhi
cuuucaaucgucagacg

SEQ ID NO: 3614296 - RNA, 16 nt, Salmonella enterica enterica serovar Typhi
cuuucaauuuccgcac

SEQ ID NO: 3614297 - RNA, 16 nt, Salmonella enterica enterica serovar Typhi
cuuucaccagcgccag

SEQ ID NO: 3614298 - RNA, 24 nt, Salmonella enterica enterica serovar Typhi
cuuucaccagugauuggcuggaca

SEQ ID NO: 3614299 - RNA, 14 nt, Salmonella enterica enterica serovar Typhi
cuuucacccauuga

SEQ ID NO: 3614300 - RNA, 13 nt, Salmonella enterica enterica serovar Typhi
cuuucaccgccuc

SEQ ID NO: 3614301 - RNA, 18 nt, Salmonella enterica enterica serovar Typhi
cuuucaccggucgcaaga

SEQ ID NO: 3614302 - RNA, 16 nt, Salmonella enterica enterica serovar Typhi
cuuucacgaaaccggc

SEQ ID NO: 3614303 - RNA, 21 nt, Salmonella enterica enterica serovar Typhi
cuuucagaccaaauucagcgu

SEQ ID NO: 3614304 - RNA, 13 nt, Salmonella enterica enterica serovar Typhi
cuuucagaucggc

SEQ ID NO: 3614305 - RNA, 13 nt, Salmonella enterica enterica serovar Typhi
cuuucagauuuuu

SEQ ID NO: 3614306 - RNA, 13 nt, Salmonella enterica enterica serovar Typhi
cuuucaucaaacg

SEQ ID NO: 3614307 - RNA, 18 nt, Salmonella enterica enterica serovar Typhi
cuuucauuacgcuuccug

SEQ ID NO: 3614308 - RNA, 14 nt, Salmonella enterica enterica serovar Typhi
cuuucauuccuuua

SEQ ID NO: 3614309 - RNA, 18 nt, Salmonella enterica enterica serovar Typhi
cuuuccaaaauccaggga

SEQ ID NO: 3614310 - RNA, 15 nt, Salmonella enterica enterica serovar Typhi
cuuuccaaagcgaag

SEQ ID NO: 3614311 - RNA, 18 nt, Salmonella enterica enterica serovar Typhi
cuuuccccaaagguguua

SEQ ID NO: 3614312 - RNA, 18 nt, Salmonella enterica enterica serovar Typhi
cuuucccuuuuuaaaaug

SEQ ID NO: 3614313 - RNA, 17 nt, Salmonella enterica enterica serovar Typhi
cuuuccgccaugaaaaa

SEQ ID NO: 3614314 - RNA, 19 nt, Salmonella enterica enterica serovar Typhi
cuuuccgccaugaaaaaaa

SEQ ID NO: 3614315 - RNA, 15 nt, Salmonella enterica enterica serovar Typhi
cuuuccguacgguuu

SEQ ID NO: 3614316 - RNA, 21 nt, Salmonella enterica enterica serovar Typhi
cuuuccugaucaaucaacucu

SEQ ID NO: 3614317 - RNA, 13 nt, Salmonella enterica enterica serovar Typhi
cuuuccugcaaau

SEQ ID NO: 3614318 - RNA, 18 nt, Salmonella enterica enterica serovar Typhi
cuuucggaauauugguac

SEQ ID NO: 3614319 - RNA, 16 nt, Salmonella enterica enterica serovar Typhi
cuuucggacuuccugu

SEQ ID NO: 3614320 - RNA, 17 nt, Salmonella enterica enterica serovar Typhi
cuuucggacuuccugua

SEQ ID NO: 3614321 - RNA, 19 nt, Salmonella enterica enterica serovar Typhi
cuuucggcaaagcacugcu

SEQ ID NO: 3614322 - RNA, 22 nt, Salmonella enterica enterica serovar Typhi
cuuucggguugcccugcuuguc

SEQ ID NO: 3614323 - RNA, 18 nt, Salmonella enterica enterica serovar Typhi
cuuucgguagccacagau

SEQ ID NO: 3614324 - RNA, 12 nt, Salmonella enterica enterica serovar Typhi
cuuucuacaaau

SEQ ID NO: 3614325 - RNA, 13 nt, Salmonella enterica enterica serovar Typhi
cuuucucgggccu

SEQ ID NO: 3614326 - RNA, 22 nt, Salmonella enterica enterica serovar Typhi
cuuucugcuccaugaucgccug

SEQ ID NO: 3614327 - RNA, 15 nt, Salmonella enterica enterica serovar Typhi
cuuucugcugccgca

SEQ ID NO: 3614328 - RNA, 14 nt, Salmonella enterica enterica serovar Typhi
cuuucugguaaccg

SEQ ID NO: 3614329 - RNA, 19 nt, Salmonella enterica enterica serovar Typhi
cuuucuuccagguuaaccc

SEQ ID NO: 3614330 - RNA, 15 nt, Salmonella enterica enterica serovar Typhi
cuuucuucccggcag

SEQ ID NO: 3614331 - RNA, 14 nt, Salmonella enterica enterica serovar Typhi
cuuucuuuuuuugu

SEQ ID NO: 3614332 - RNA, 11 nt, Salmonella enterica enterica serovar Typhi
cuuugaacagc

SEQ ID NO: 3614333 - RNA, 14 nt, Salmonella enterica enterica serovar Typhi
cuuugaacagccag

SEQ ID NO: 3614334 - RNA, 20 nt, Salmonella enterica enterica serovar Typhi
cuuugaacagccagaagccu

SEQ ID NO: 3614335 - RNA, 21 nt, Salmonella enterica enterica serovar Typhi
cuuugaccauuaccauuccuc

SEQ ID NO: 3614336 - RNA, 18 nt, Salmonella enterica enterica serovar Typhi
cuuugacgacccgcuucc

SEQ ID NO: 3614337 - RNA, 23 nt, Salmonella enterica enterica serovar Typhi
cuuugagcaucaaacuuuuaaau

SEQ ID NO: 3614338 - RNA, 15 nt, Salmonella enterica enterica serovar Typhi
cuuugaggaucaauu

SEQ ID NO: 3614339 - RNA, 22 nt, Salmonella enterica enterica serovar Typhi
cuuugagggcgauaauccgcuc

SEQ ID NO: 3614340 - RNA, 14 nt, Salmonella enterica enterica serovar Typhi
cuuugauuuugcgc

SEQ ID NO: 3614341 - RNA, 20 nt, Salmonella enterica enterica serovar Typhi
cuuugcacagucugcagacc

SEQ ID NO: 3614342 - RNA, 18 nt, Salmonella enterica enterica serovar Typhi
cuuugcacguucugcugg

SEQ ID NO: 3614343 - RNA, 20 nt, Salmonella enterica enterica serovar Typhi
cuuugcccgagcgcuggcau

SEQ ID NO: 3614344 - RNA, 15 nt, Salmonella enterica enterica serovar Typhi
cuuugcccucaaaga

SEQ ID NO: 3614345 - RNA, 18 nt, Salmonella enterica enterica serovar Typhi
cuuugccgcaaacgccga

SEQ ID NO: 3614346 - RNA, 22 nt, Salmonella enterica enterica serovar Typhi
cuuugccguucucugacaaaau

SEQ ID NO: 3614347 - RNA, 21 nt, Salmonella enterica enterica serovar Typhi
cuuugccuuuuucccacugcg

SEQ ID NO: 3614348 - RNA, 15 nt, Salmonella enterica enterica serovar Typhi
cuuugcgauuugucc

SEQ ID NO: 3614349 - RNA, 20 nt, Salmonella enterica enterica serovar Typhi
cuuugcgccggcaguuuaag

SEQ ID NO: 3614350 - RNA, 21 nt, Salmonella enterica enterica serovar Typhi
cuuugcgcucaugcgccuggc

SEQ ID NO: 3614351 - RNA, 17 nt, Salmonella enterica enterica serovar Typhi
cuuugcguaaaaaacau

SEQ ID NO: 3614352 - RNA, 20 nt, Salmonella enterica enterica serovar Typhi
cuuugcguaaaaaacaucau

SEQ ID NO: 3614353 - RNA, 19 nt, Salmonella enterica enterica serovar Typhi
cuuugcguuuacuuacaaa

SEQ ID NO: 3614354 - RNA, 17 nt, Salmonella enterica enterica serovar Typhi
cuuuggacggcaucagg

SEQ ID NO: 3614355 - RNA, 19 nt, Salmonella enterica enterica serovar Typhi
cuuuggacggcaucaggaa

SEQ ID NO: 3614356 - RNA, 15 nt, Salmonella enterica enterica serovar Typhi
cuuuggcaaaaaagg

SEQ ID NO: 3614357 - RNA, 22 nt, Salmonella enterica enterica serovar Typhi
cuuuggcaggccucuaucuucu

SEQ ID NO: 3614358 - RNA, 23 nt, Salmonella enterica enterica serovar Typhi
cuuuggccuggagaucagcaugg

SEQ ID NO: 3614359 - RNA, 20 nt, Salmonella enterica enterica serovar Typhi
cuuuggcgcgcgguuuaucc

SEQ ID NO: 3614360 - RNA, 21 nt, Salmonella enterica enterica serovar Typhi
cuuuggcuuaaucauugcuca

SEQ ID NO: 3614361 - RNA, 14 nt, Salmonella enterica enterica serovar Typhi
cuuugucaccggag

SEQ ID NO: 3614362 - RNA, 14 nt, Salmonella enterica enterica serovar Typhi
cuuuguccugaagg

SEQ ID NO: 3614363 - RNA, 15 nt, Salmonella enterica enterica serovar Typhi
cuuugucgccaauaa

SEQ ID NO: 3614364 - RNA, 16 nt, Salmonella enterica enterica serovar Typhi
cuuugucgccaauaau

SEQ ID NO: 3614365 - RNA, 22 nt, Salmonella enterica enterica serovar Typhi
cuuugucgcgguuaaggaugua

SEQ ID NO: 3614366 - RNA, 21 nt, Salmonella enterica enterica serovar Typhi
cuuugugaucugguuugguaa

SEQ ID NO: 3614367 - RNA, 16 nt, Salmonella enterica enterica serovar Typhi
cuuugugcaggaucaa

SEQ ID NO: 3614368 - RNA, 21 nt, Salmonella enterica enterica serovar Typhi
cuuuguucuguugaguucccu

SEQ ID NO: 3614369 - RNA, 18 nt, Salmonella enterica enterica serovar Typhi
cuuuuaaaaaucagucac

SEQ ID NO: 3614370 - RNA, 23 nt, Salmonella enterica enterica serovar Typhi
cuuuuaaacgugcggcggccucu

SEQ ID NO: 3614371 - RNA, 14 nt, Salmonella enterica enterica serovar Typhi
cuuuuaacaaaucg

SEQ ID NO: 3614372 - RNA, 23 nt, Salmonella enterica enterica serovar Typhi
cuuuuaaccaugcaaucucuucc

SEQ ID NO: 3614373 - RNA, 19 nt, Salmonella enterica enterica serovar Typhi
cuuuuaaggcggcaaagau

SEQ ID NO: 3614374 - RNA, 21 nt, Salmonella enterica enterica serovar Typhi
cuuuuaaggcggcaaagauaa

SEQ ID NO: 3614375 - RNA, 17 nt, Salmonella enterica enterica serovar Typhi
cuuuuaagguuaauucu

SEQ ID NO: 3614376 - RNA, 21 nt, Salmonella enterica enterica serovar Typhi
cuuuuaauagcguagccugca

SEQ ID NO: 3614377 - RNA, 13 nt, Salmonella enterica enterica serovar Typhi
gaaaaaucauuau

SEQ ID NO: 3614378 - RNA, 16 nt, Salmonella enterica enterica serovar Typhi
gaaaaaugaauaccaa

SEQ ID NO: 3614379 - RNA, 13 nt, Salmonella enterica enterica serovar Typhi
gaaaaauguguug

SEQ ID NO: 3614380 - RNA, 17 nt, Salmonella enterica enterica serovar Typhi
gaaaacaagugcagaag

SEQ ID NO: 3614381 - RNA, 16 nt, Salmonella enterica enterica serovar Typhi
gaaaacagcgccggca

SEQ ID NO: 3614382 - RNA, 20 nt, Salmonella enterica enterica serovar Typhi
gaaaacagcgccggcagcag

SEQ ID NO: 3614383 - RNA, 11 nt, Salmonella enterica enterica serovar Typhi
gaaaacaucac

SEQ ID NO: 3614384 - RNA, 18 nt, Salmonella enterica enterica serovar Typhi
gaaaaccacaaucacagc

SEQ ID NO: 3614385 - RNA, 13 nt, Salmonella enterica enterica serovar Typhi
gaaaaccgaugcc

SEQ ID NO: 3614386 - RNA, 18 nt, Salmonella enterica enterica serovar Typhi
gaaaaccguacucgcugg

SEQ ID NO: 3614387 - RNA, 16 nt, Salmonella enterica enterica serovar Typhi
gaaaaccguccacauc

SEQ ID NO: 3614388 - RNA, 17 nt, Salmonella enterica enterica serovar Typhi
gaaaaccuuugcugacg

SEQ ID NO: 3614389 - RNA, 22 nt, Salmonella enterica enterica serovar Typhi
gaaaacgcccgccgcgaccagc

SEQ ID NO: 3614390 - RNA, 23 nt, Salmonella enterica enterica serovar Typhi
gaaaacgcccgccgcgaccagca

SEQ ID NO: 3614391 - RNA, 20 nt, Salmonella enterica enterica serovar Typhi
gaaaacgggugaucugcgcc

SEQ ID NO: 3614392 - RNA, 16 nt, Salmonella enterica enterica serovar Typhi
gaaaacuccagcagac

SEQ ID NO: 3614393 - RNA, 18 nt, Salmonella enterica enterica serovar Typhi
gaaaacugggcaaucauc

SEQ ID NO: 3614394 - RNA, 20 nt, Salmonella enterica enterica serovar Typhi
gaaaacuuuccaaccuguua

SEQ ID NO: 3614395 - RNA, 14 nt, Salmonella enterica enterica serovar Typhi
gaaaagcagccaga

SEQ ID NO: 3614396 - RNA, 19 nt, Salmonella enterica enterica serovar Typhi
gaaaagccggaauauugag

SEQ ID NO: 3614397 - RNA, 16 nt, Salmonella enterica enterica serovar Typhi
gaaaagcgcuggcugg

SEQ ID NO: 3614398 - RNA, 20 nt, Salmonella enterica enterica serovar Typhi
gaaaagcgggggcgacagcc

SEQ ID NO: 3614399 - RNA, 21 nt, Salmonella enterica enterica serovar Typhi
gaaaagcugguauugaauauu

SEQ ID NO: 3614400 - RNA, 20 nt, Salmonella enterica enterica serovar Typhi
gaaaagcuguagcauaaaug

SEQ ID NO: 3614401 - RNA, 20 nt, Salmonella enterica enterica serovar Typhi
gaaaaggaagaauaaauaac

SEQ ID NO: 3614402 - RNA, 22 nt, Salmonella enterica enterica serovar Typhi
gaaaaggccuggcugagaaaaa

SEQ ID NO: 3614403 - RNA, 23 nt, Salmonella enterica enterica serovar Typhi
gaaaaggccuggcugagaaaaau

SEQ ID NO: 3614404 - RNA, 22 nt, Salmonella enterica enterica serovar Typhi
gaaaagggaugcugaagccgcu

SEQ ID NO: 3614405 - RNA, 21 nt, Salmonella enterica enterica serovar Typhi
gaaaagguuucggcgaucacc

SEQ ID NO: 3614406 - RNA, 17 nt, Salmonella enterica enterica serovar Typhi
gaaaaguauggcgguuc

SEQ ID NO: 3614407 - RNA, 18 nt, Salmonella enterica enterica serovar Typhi
gaaaaguuacaggcucca

SEQ ID NO: 3614408 - RNA, 22 nt, Salmonella enterica enterica serovar Typhi
gaaaaguuacaggcuccaagua

SEQ ID NO: 3614409 - RNA, 15 nt, Salmonella enterica enterica serovar Typhi
gaaaauaauucuuaa

SEQ ID NO: 3614410 - RNA, 17 nt, Salmonella enterica enterica serovar Typhi
gaaaauaccgcacauca

SEQ ID NO: 3614411 - RNA, 13 nt, Salmonella enterica enterica serovar Typhi
gaaaauauaaucu

SEQ ID NO: 3614412 - RNA, 15 nt, Salmonella enterica enterica serovar Typhi
gaaaauauaugacaa

SEQ ID NO: 3614413 - RNA, 18 nt, Salmonella enterica enterica serovar Typhi
gaaaauaucggccugaau

SEQ ID NO: 3614414 - RNA, 14 nt, Salmonella enterica enterica serovar Typhi
gaaaauauucagca

SEQ ID NO: 3614415 - RNA, 22 nt, Salmonella enterica enterica serovar Typhi
gaaaaucacuaucaguuuuggc

SEQ ID NO: 3614416 - RNA, 14 nt, Salmonella enterica enterica serovar Typhi
gaaaauccggaauc

SEQ ID NO: 3614417 - RNA, 13 nt, Salmonella enterica enterica serovar Typhi
gaaaaucugguuu

SEQ ID NO: 3614418 - RNA, 18 nt, Salmonella enterica enterica serovar Typhi
gaaaaugcgccaggaaac

SEQ ID NO: 3614419 - RNA, 16 nt, Salmonella enterica enterica serovar Typhi
gaaaaugguuuugccc

SEQ ID NO: 3614420 - RNA, 14 nt, Salmonella enterica enterica serovar Typhi
gaaaaugugcaaag

SEQ ID NO: 3614421 - RNA, 17 nt, Salmonella enterica enterica serovar Typhi
gaaaaugugcaaagaga

SEQ ID NO: 3614422 - RNA, 23 nt, Salmonella enterica enterica serovar Typhi
gaaaauuaaucccaacccgacca

SEQ ID NO: 3614423 - RNA, 21 nt, Salmonella enterica enterica serovar Typhi
gaaaauuguccacggggcggc

SEQ ID NO: 3614424 - RNA, 22 nt, Salmonella enterica enterica serovar Typhi
gaaaauuguccacggggcggca

SEQ ID NO: 3614425 - RNA, 23 nt, Salmonella enterica enterica serovar Typhi
gaaacaacacaaaucgggcgggc

SEQ ID NO: 3614426 - RNA, 22 nt, Salmonella enterica enterica serovar Typhi
gaaacaacacgaucgaugcccu

SEQ ID NO: 3614427 - RNA, 14 nt, Salmonella enterica enterica serovar Typhi
gaaacaagaagcac

SEQ ID NO: 3614428 - RNA, 20 nt, Salmonella enterica enterica serovar Typhi
gaaacaagaagcacgacaca

SEQ ID NO: 3614429 - RNA, 23 nt, Salmonella enterica enterica serovar Typhi
gaaacaauccguuauuucacagc

SEQ ID NO: 3614430 - RNA, 12 nt, Salmonella enterica enterica serovar Typhi
gaaacaccagaa

SEQ ID NO: 3614431 - RNA, 18 nt, Salmonella enterica enterica serovar Typhi
gaaacaggucggcaugca

SEQ ID NO: 3614432 - RNA, 14 nt, Salmonella enterica enterica serovar Typhi
gaaacaucaucguu

SEQ ID NO: 3614433 - RNA, 15 nt, Salmonella enterica enterica serovar Typhi
gaaacaucaucguuu

SEQ ID NO: 3614434 - RNA, 19 nt, Salmonella enterica enterica serovar Typhi
gaaaccagcauaauauuca

SEQ ID NO: 3614435 - RNA, 13 nt, Salmonella enterica enterica serovar Typhi
gaaaccaggcacu

SEQ ID NO: 3614436 - RNA, 17 nt, Salmonella enterica enterica serovar Typhi
gaaaccaguucacgcgu

SEQ ID NO: 3614437 - RNA, 14 nt, Salmonella enterica enterica serovar Typhi
gaaacccgccaccg

SEQ ID NO: 3614438 - RNA, 16 nt, Salmonella enterica enterica serovar Typhi
gaaacccgccaccgcc

SEQ ID NO: 3614439 - RNA, 21 nt, Salmonella enterica enterica serovar Typhi
gaaacccgccaccgccagcca

SEQ ID NO: 3614440 - RNA, 14 nt, Salmonella enterica enterica serovar Typhi
gaaaccgauuuccu

SEQ ID NO: 3614441 - RNA, 16 nt, Salmonella enterica enterica serovar Typhi
gaaaccgcagaaaaag

SEQ ID NO: 3614442 - RNA, 17 nt, Salmonella enterica enterica serovar Typhi
gaaaccgcuacccggca

SEQ ID NO: 3614443 - RNA, 20 nt, Salmonella enterica enterica serovar Typhi
gaaaccgcuacccggcacaa

SEQ ID NO: 3614444 - RNA, 18 nt, Salmonella enterica enterica serovar Typhi
gaaaccgcucgccgccuc

SEQ ID NO: 3614445 - RNA, 19 nt, Salmonella enterica enterica serovar Typhi
gaaaccgcucgccgccucc

SEQ ID NO: 3614446 - RNA, 16 nt, Salmonella enterica enterica serovar Typhi
gaaaccggccgccauc

SEQ ID NO: 3614447 - RNA, 22 nt, Salmonella enterica enterica serovar Typhi
gaaaccggcgcgccuuccagca

SEQ ID NO: 3614448 - RNA, 13 nt, Salmonella enterica enterica serovar Typhi
gaaaccggcggcg

SEQ ID NO: 3614449 - RNA, 20 nt, Salmonella enterica enterica serovar Typhi
gaaaccuccgcagugcggag

SEQ ID NO: 3614450 - RNA, 21 nt, Salmonella enterica enterica serovar Typhi
gaaacgcgccacgcgccagcc

SEQ ID NO: 3614451 - RNA, 20 nt, Salmonella enterica enterica serovar Typhi
gaaacgcuuuccggggugaa

SEQ ID NO: 3614452 - RNA, 16 nt, Salmonella enterica enterica serovar Typhi
gaaacggaucaaaaag

SEQ ID NO: 3614453 - RNA, 22 nt, Salmonella enterica enterica serovar Typhi
gaaacgguccugauccggaaua

SEQ ID NO: 3614454 - RNA, 17 nt, Salmonella enterica enterica serovar Typhi
gaaacguagcguucauu

SEQ ID NO: 3614455 - RNA, 16 nt, Salmonella enterica enterica serovar Typhi
gaaacguccccugcgg

SEQ ID NO: 3614456 - RNA, 19 nt, Salmonella enterica enterica serovar Typhi
gaaacgugcauuauuuuag

SEQ ID NO: 3614457 - RNA, 16 nt, Salmonella enterica enterica serovar Typhi
gaaacguguuuauccc

SEQ ID NO: 3614458 - RNA, 19 nt, Salmonella enterica enterica serovar Typhi
gaaacguucggugaagaaa

SEQ ID NO: 3614459 - RNA, 14 nt, Salmonella enterica enterica serovar Typhi
gaaacucagcggcc

SEQ ID NO: 3614460 - RNA, 19 nt, Salmonella enterica enterica serovar Typhi
gaaacuccuccgggaaaac

SEQ ID NO: 3614461 - RNA, 21 nt, Salmonella enterica enterica serovar Typhi
gaaacuccuccgggaaaacau

SEQ ID NO: 3614462 - RNA, 17 nt, Salmonella enterica enterica serovar Typhi
gaaauucuaugccaggc

SEQ ID NO: 3614463 - RNA, 22 nt, Salmonella enterica enterica serovar Typhi
gaaauucugacgcagcuucuga

SEQ ID NO: 3614464 - RNA, 22 nt, Salmonella enterica enterica serovar Typhi
gaaauugcagggugcagcaaau

SEQ ID NO: 3614465 - RNA, 14 nt, Salmonella enterica enterica serovar Typhi
gaaauuuaaagaua

SEQ ID NO: 3614466 - RNA, 13 nt, Salmonella enterica enterica serovar Typhi
gaaauuuauucau

SEQ ID NO: 3614467 - RNA, 16 nt, Salmonella enterica enterica serovar Typhi
gaaauuucuuuuccag

SEQ ID NO: 3614468 - RNA, 14 nt, Salmonella enterica enterica serovar Typhi
gaacaaaagaaagc

SEQ ID NO: 3614469 - RNA, 19 nt, Salmonella enterica enterica serovar Typhi
gaacaaacagaccgccaug

SEQ ID NO: 3614470 - RNA, 20 nt, Salmonella enterica enterica serovar Typhi
gaacaaacagaccgccaugc

SEQ ID NO: 3614471 - RNA, 20 nt, Salmonella enterica enterica serovar Typhi
gaacaaguucuucgaagcac

SEQ ID NO: 3614472 - RNA, 21 nt, Salmonella enterica enterica serovar Typhi
gaacaaguucuucgaagcacu

SEQ ID NO: 3614473 - RNA, 17 nt, Salmonella enterica enterica serovar Typhi
gaacaauaacaccacaa

SEQ ID NO: 3614474 - RNA, 20 nt, Salmonella enterica enterica serovar Typhi
gaacaaugccauuauugcau

SEQ ID NO: 3614475 - RNA, 23 nt, Salmonella enterica enterica serovar Typhi
gaacacggacucgccuuucucca

SEQ ID NO: 3614476 - RNA, 21 nt, Salmonella enterica enterica serovar Typhi
gaacagaacagugaguuaaga

SEQ ID NO: 3614477 - RNA, 14 nt, Salmonella enterica enterica serovar Typhi
gaacagaagcgccg

SEQ ID NO: 3614478 - RNA, 14 nt, Salmonella enterica enterica serovar Typhi
gaacagacggcggc

SEQ ID NO: 3614479 - RNA, 15 nt, Salmonella enterica enterica serovar Typhi
gaacagauaaauguc

SEQ ID NO: 3614480 - RNA, 20 nt, Salmonella enterica enterica serovar Typhi
gaacagcaaugcccaaaaua

SEQ ID NO: 3614481 - RNA, 12 nt, Salmonella enterica enterica serovar Typhi
gaacagcaucac

SEQ ID NO: 3614482 - RNA, 13 nt, Salmonella enterica enterica serovar Typhi
gaacagccaggcu

SEQ ID NO: 3614483 - RNA, 13 nt, Salmonella enterica enterica serovar Typhi
gaacagcggcagg

SEQ ID NO: 3614484 - RNA, 16 nt, Salmonella enterica enterica serovar Typhi
gaacagcggcaggcgg

SEQ ID NO: 3614485 - RNA, 16 nt, Salmonella enterica enterica serovar Typhi
gaacagcgucauccag

SEQ ID NO: 3614486 - RNA, 21 nt, Salmonella enterica enterica serovar Typhi
gaacagcgucauccaguguua

SEQ ID NO: 3614487 - RNA, 20 nt, Salmonella enterica enterica serovar Typhi
gaacagcuggugcggcauau

SEQ ID NO: 3614488 - RNA, 22 nt, Salmonella enterica enterica serovar Typhi
gaacagugacaaacucacguuc

SEQ ID NO: 3614489 - RNA, 18 nt, Salmonella enterica enterica serovar Typhi
gaacaguguaaacgccag

SEQ ID NO: 3614490 - RNA, 21 nt, Salmonella enterica enterica serovar Typhi
gaacaguguaaacgccagaua

SEQ ID NO: 3614491 - RNA, 23 nt, Salmonella enterica enterica serovar Typhi
gaacaguguaaacgccagauaau

SEQ ID NO: 3614492 - RNA, 15 nt, Salmonella enterica enterica serovar Typhi
gaacaguuucgccag

SEQ ID NO: 3614493 - RNA, 16 nt, Salmonella enterica enterica serovar Typhi
gaacaguuucgccagc

SEQ ID NO: 3614494 - RNA, 13 nt, Salmonella enterica enterica serovar Typhi
gaacaguuucucg

SEQ ID NO: 3614495 - RNA, 23 nt, Salmonella enterica enterica serovar Typhi
gaacauacuuucucuccuucacg

SEQ ID NO: 3614496 - RNA, 13 nt, Salmonella enterica enterica serovar Typhi
gaacauaugaagg

SEQ ID NO: 3614497 - RNA, 18 nt, Salmonella enterica enterica serovar Typhi
gaacaucacgaugaaagg

SEQ ID NO: 3614498 - RNA, 15 nt, Salmonella enterica enterica serovar Typhi
gaacauccucuccug

SEQ ID NO: 3614499 - RNA, 18 nt, Salmonella enterica enterica serovar Typhi
gaacaucgcgacggaggc

SEQ ID NO: 3614500 - RNA, 15 nt, Salmonella enterica enterica serovar Typhi
gaacaucuuccaggu

SEQ ID NO: 3614501 - RNA, 14 nt, Salmonella enterica enterica serovar Typhi
gaacaugacggcag

SEQ ID NO: 3614502 - RNA, 18 nt, Salmonella enterica enterica serovar Typhi
gaacaugacguauucacc

SEQ ID NO: 3614503 - RNA, 12 nt, Salmonella enterica enterica serovar Typhi
gaacaugcauau

SEQ ID NO: 3614504 - RNA, 15 nt, Salmonella enterica enterica serovar Typhi
gaacaugccgacgga

SEQ ID NO: 3614505 - RNA, 16 nt, Salmonella enterica enterica serovar Typhi
gaacauuuaagauuua

SEQ ID NO: 3614506 - RNA, 21 nt, Salmonella enterica enterica serovar Typhi
gaaccaaucgagaagccauca

SEQ ID NO: 3614507 - RNA, 16 nt, Salmonella enterica enterica serovar Typhi
gaaccacauagaguga

SEQ ID NO: 3614508 - RNA, 18 nt, Salmonella enterica enterica serovar Typhi
gaaccacgcaaaggcguu

SEQ ID NO: 3614509 - RNA, 13 nt, Salmonella enterica enterica serovar Typhi
gaaccagcggcac

SEQ ID NO: 3614510 - RNA, 21 nt, Salmonella enterica enterica serovar Typhi
gaaccagcggcaccagcacga

SEQ ID NO: 3614511 - RNA, 18 nt, Salmonella enterica enterica serovar Typhi
gaaccaucauuaauauaa

SEQ ID NO: 3614512 - RNA, 18 nt, Salmonella enterica enterica serovar Typhi
gaaccauggcaacaugga

SEQ ID NO: 3614513 - RNA, 13 nt, Salmonella enterica enterica serovar Typhi
gaaccauugagau

SEQ ID NO: 3614514 - RNA, 14 nt, Salmonella enterica enterica serovar Typhi
gaacccaucaggga

SEQ ID NO: 3614515 - RNA, 16 nt, Salmonella enterica enterica serovar Typhi
gaacccgaccgucuuu

SEQ ID NO: 3614516 - RNA, 17 nt, Salmonella enterica enterica serovar Typhi
gaacccucgaaugugaa

SEQ ID NO: 3614517 - RNA, 13 nt, Salmonella enterica enterica serovar Typhi
gaaccgacggugc

SEQ ID NO: 3614518 - RNA, 23 nt, Salmonella enterica enterica serovar Typhi
gaaccgacggugcucaugacauc

SEQ ID NO: 3614519 - RNA, 18 nt, Salmonella enterica enterica serovar Typhi
gaaccgcccaucaacacc

SEQ ID NO: 3614520 - RNA, 13 nt, Salmonella enterica enterica serovar Typhi
gaaccgccgaccc

SEQ ID NO: 3614521 - RNA, 18 nt, Salmonella enterica enterica serovar Typhi
gaaccgccgacccccucc

SEQ ID NO: 3614522 - RNA, 19 nt, Salmonella enterica enterica serovar Typhi
gaaccggcaucggcagcgu

SEQ ID NO: 3614523 - RNA, 20 nt, Salmonella enterica enterica serovar Typhi
gaaccggguauugaauccau

SEQ ID NO: 3614524 - RNA, 19 nt, Salmonella enterica enterica serovar Typhi
gaaccguaaacgccugcac

SEQ ID NO: 3614525 - RNA, 14 nt, Salmonella enterica enterica serovar Typhi
gaaccgucaucagc

SEQ ID NO: 3614526 - RNA, 22 nt, Salmonella enterica enterica serovar Typhi
gaaccguucucaauccgcagca

SEQ ID NO: 3614527 - RNA, 20 nt, Salmonella enterica enterica serovar Typhi
gaaccuguccugagcgaaug

SEQ ID NO: 3614528 - RNA, 13 nt, Salmonella enterica enterica serovar Typhi
gaaccuucacgcu

SEQ ID NO: 3614529 - RNA, 15 nt, Salmonella enterica enterica serovar Typhi
gaacgacucacgcgc

SEQ ID NO: 3614530 - RNA, 20 nt, Salmonella enterica enterica serovar Typhi
gaacgacugaguauuggcaa

SEQ ID NO: 3614531 - RNA, 15 nt, Salmonella enterica enterica serovar Typhi
gaacgagaggaggag

SEQ ID NO: 3614532 - RNA, 19 nt, Salmonella enterica enterica serovar Typhi
gaacgcacuuaaugcaaug

SEQ ID NO: 3614533 - RNA, 17 nt, Salmonella enterica enterica serovar Typhi
gaacgcauccagccacg

SEQ ID NO: 3614534 - RNA, 23 nt, Salmonella enterica enterica serovar Typhi
gaacgccgccugcgccagcgccg

SEQ ID NO: 3614535 - RNA, 16 nt, Salmonella enterica enterica serovar Typhi
gaacgccuuauccggc

SEQ ID NO: 3614536 - RNA, 17 nt, Salmonella enterica enterica serovar Typhi
gaacgccuuauccggcc

SEQ ID NO: 3614537 - RNA, 15 nt, Salmonella enterica enterica serovar Typhi
gaacgcgagaagccc

SEQ ID NO: 3614538 - RNA, 18 nt, Salmonella enterica enterica serovar Typhi
gaacgcuggcggcaggcc

SEQ ID NO: 3614539 - RNA, 24 nt, Salmonella enterica enterica serovar Typhi
gaacgcuguugccgcugcuggcgu

SEQ ID NO: 3614540 - RNA, 20 nt, Salmonella enterica enterica serovar Typhi
gaacggcaccggaaccggca

SEQ ID NO: 3614541 - RNA, 19 nt, Salmonella enterica enterica serovar Typhi
gaacggcuuuccagcagcc

SEQ ID NO: 3614542 - RNA, 14 nt, Salmonella enterica enterica serovar Typhi
gaacgggugguuuc

SEQ ID NO: 3614543 - RNA, 14 nt, Salmonella enterica enterica serovar Typhi
gaacguaauggcau

SEQ ID NO: 3614544 - RNA, 22 nt, Salmonella enterica enterica serovar Typhi
gaacguuaucggcauaggcuau

SEQ ID NO: 3614545 - RNA, 15 nt, Salmonella enterica enterica serovar Typhi
gaacguuggcugggu

SEQ ID NO: 3614546 - RNA, 18 nt, Salmonella enterica enterica serovar Typhi
gaacuacugauuccugcc

SEQ ID NO: 3614547 - RNA, 15 nt, Salmonella enterica enterica serovar Typhi
gaacuccaaauaccg

SEQ ID NO: 3614548 - RNA, 14 nt, Salmonella enterica enterica serovar Typhi
gaagcugagaaaag

SEQ ID NO: 3614549 - RNA, 17 nt, Salmonella enterica enterica serovar Typhi
gaagcuggagccacauc

SEQ ID NO: 3614550 - RNA, 13 nt, Salmonella enterica enterica serovar Typhi
gaagcuuaccacc

SEQ ID NO: 3614551 - RNA, 12 nt, Salmonella enterica enterica serovar Typhi
gaaggacaagcu

SEQ ID NO: 3614552 - RNA, 19 nt, Salmonella enterica enterica serovar Typhi
gaaggacugauacagccaa

SEQ ID NO: 3614553 - RNA, 19 nt, Salmonella enterica enterica serovar Typhi
gaaggauuauuggcaucau

SEQ ID NO: 3614554 - RNA, 15 nt, Salmonella enterica enterica serovar Typhi
gaaggcaacgccgcc

SEQ ID NO: 3614555 - RNA, 14 nt, Salmonella enterica enterica serovar Typhi
gaaggcaacugauc

SEQ ID NO: 3614556 - RNA, 20 nt, Salmonella enterica enterica serovar Typhi
gaaggcaacugauccugcgu

SEQ ID NO: 3614557 - RNA, 21 nt, Salmonella enterica enterica serovar Typhi
gaaggcaucuucagacaguuu

SEQ ID NO: 3614558 - RNA, 11 nt, Salmonella enterica enterica serovar Typhi
gaaggcggcgg

SEQ ID NO: 3614559 - RNA, 17 nt, Salmonella enterica enterica serovar Typhi
gaaggcuaacagcuggc

SEQ ID NO: 3614560 - RNA, 22 nt, Salmonella enterica enterica serovar Typhi
gaaggcucuacucgcggacgac

SEQ ID NO: 3614561 - RNA, 17 nt, Salmonella enterica enterica serovar Typhi
gaaggcuuugccauacg

SEQ ID NO: 3614562 - RNA, 13 nt, Salmonella enterica enterica serovar Typhi
gaaggcuuuugcu

SEQ ID NO: 3614563 - RNA, 15 nt, Salmonella enterica enterica serovar Typhi
gaagggauucccauc

SEQ ID NO: 3614564 - RNA, 16 nt, Salmonella enterica enterica serovar Typhi
gaagggauucccaucc

SEQ ID NO: 3614565 - RNA, 17 nt, Salmonella enterica enterica serovar Typhi
gaagggcagaucgagga

SEQ ID NO: 3614566 - RNA, 21 nt, Salmonella enterica enterica serovar Typhi
gaagggcauauuaugcugcuc

SEQ ID NO: 3614567 - RNA, 22 nt, Salmonella enterica enterica serovar Typhi
gaagggguggcgaucguuguuu

SEQ ID NO: 3614568 - RNA, 19 nt, Salmonella enterica enterica serovar Typhi
gaagggugacgugccgcag

SEQ ID NO: 3614569 - RNA, 14 nt, Salmonella enterica enterica serovar Typhi
gaaggucaggccac

SEQ ID NO: 3614570 - RNA, 13 nt, Salmonella enterica enterica serovar Typhi
gaaggucgcgccg

SEQ ID NO: 3614571 - RNA, 14 nt, Salmonella enterica enterica serovar Typhi
gaagguuuuucccg

SEQ ID NO: 3614572 - RNA, 22 nt, Salmonella enterica enterica serovar Typhi
gaaguaaaggccguuaaaccaa

SEQ ID NO: 3614573 - RNA, 23 nt, Salmonella enterica enterica serovar Typhi
gaaguaaucguuagcgagguucc

SEQ ID NO: 3614574 - RNA, 14 nt, Salmonella enterica enterica serovar Typhi
gaaguacuggauca

SEQ ID NO: 3614575 - RNA, 17 nt, Salmonella enterica enterica serovar Typhi
gaaguagcagagaaaag

SEQ ID NO: 3614576 - RNA, 18 nt, Salmonella enterica enterica serovar Typhi
gaaguauccuggaacaaa

SEQ ID NO: 3614577 - RNA, 16 nt, Salmonella enterica enterica serovar Typhi
gaaguaucgacgcaga

SEQ ID NO: 3614578 - RNA, 16 nt, Salmonella enterica enterica serovar Typhi
gaagucaaaggccagu

SEQ ID NO: 3614579 - RNA, 21 nt, Salmonella enterica enterica serovar Typhi
gaaguccguauuauccacccc

SEQ ID NO: 3614580 - RNA, 14 nt, Salmonella enterica enterica serovar Typhi
gaaguccuucacaa

SEQ ID NO: 3614581 - RNA, 14 nt, Salmonella enterica enterica serovar Typhi
gaagucggaaaucu

SEQ ID NO: 3614582 - RNA, 22 nt, Salmonella enterica enterica serovar Typhi
gaagugccaguaacucaucgcc

SEQ ID NO: 3614583 - RNA, 20 nt, Salmonella enterica enterica serovar Typhi
gaagugguggcgaacaggcu

SEQ ID NO: 3614584 - RNA, 15 nt, Salmonella enterica enterica serovar Typhi
gaaguggugggugau

SEQ ID NO: 3614585 - RNA, 13 nt, Salmonella enterica enterica serovar Typhi
gaaguuauccagc

SEQ ID NO: 3614586 - RNA, 17 nt, Salmonella enterica enterica serovar Typhi
gaaguuauccagcgccc

SEQ ID NO: 3614587 - RNA, 20 nt, Salmonella enterica enterica serovar Typhi
gaaguuaucgaaggucaggc

SEQ ID NO: 3614588 - RNA, 17 nt, Salmonella enterica enterica serovar Typhi
gaaguucuucuggcgca

SEQ ID NO: 3614589 - RNA, 15 nt, Salmonella enterica enterica serovar Typhi
gaaguugcuuccagu

SEQ ID NO: 3614590 - RNA, 16 nt, Salmonella enterica enterica serovar Typhi
gaaguuuaauucuuug

SEQ ID NO: 3614591 - RNA, 16 nt, Salmonella enterica enterica serovar Typhi
gaaguuuugcuggaau

SEQ ID NO: 3614592 - RNA, 16 nt, Salmonella enterica enterica serovar Typhi
gaauaaaaccggcaua

SEQ ID NO: 3614593 - RNA, 14 nt, Salmonella enterica enterica serovar Typhi
gaauaaaacugccg

SEQ ID NO: 3614594 - RNA, 13 nt, Salmonella enterica enterica serovar Typhi
gaauaaacgguaa

SEQ ID NO: 3614595 - RNA, 16 nt, Salmonella enterica enterica serovar Typhi
gaauaaagacacugcu

SEQ ID NO: 3614596 - RNA, 15 nt, Salmonella enterica enterica serovar Typhi
gaauaaaggccggga

SEQ ID NO: 3614597 - RNA, 21 nt, Salmonella enterica enterica serovar Typhi
gaauaaauauaagaucuauuu

SEQ ID NO: 3614598 - RNA, 11 nt, Salmonella enterica enterica serovar Typhi
gaauaaauccu

SEQ ID NO: 3614599 - RNA, 23 nt, Salmonella enterica enterica serovar Typhi
gaauaaaugaauuauuuuuucau

SEQ ID NO: 3614600 - RNA, 12 nt, Salmonella enterica enterica serovar Typhi
gaauaacagcac

SEQ ID NO: 3614601 - RNA, 22 nt, Salmonella enterica enterica serovar Typhi
gaauaacauaauauuccagcgu

SEQ ID NO: 3614602 - RNA, 17 nt, Salmonella enterica enterica serovar Typhi
gaauaacaucguaaauc

SEQ ID NO: 3614603 - RNA, 19 nt, Salmonella enterica enterica serovar Typhi
gaauaacaucguaaaucaa

SEQ ID NO: 3614604 - RNA, 22 nt, Salmonella enterica enterica serovar Typhi
gaauaacccccgcgaacgcgau

SEQ ID NO: 3614605 - RNA, 14 nt, Salmonella enterica enterica serovar Typhi
gaauaacgccaggu

SEQ ID NO: 3614606 - RNA, 23 nt, Salmonella enterica enterica serovar Typhi
gaauaacuccagugcagaaagug

SEQ ID NO: 3614607 - RNA, 14 nt, Salmonella enterica enterica serovar Typhi
gaauaagccggaug

SEQ ID NO: 3614608 - RNA, 19 nt, Salmonella enterica enterica serovar Typhi
gaauaagcugaaugguaaa

SEQ ID NO: 3614609 - RNA, 15 nt, Salmonella enterica enterica serovar Typhi
gaauaaucccggcgc

SEQ ID NO: 3614610 - RNA, 15 nt, Salmonella enterica enterica serovar Typhi
gaauaauccuucccg

SEQ ID NO: 3614611 - RNA, 15 nt, Salmonella enterica enterica serovar Typhi
gaauaaucgccgccg

SEQ ID NO: 3614612 - RNA, 18 nt, Salmonella enterica enterica serovar Typhi
gaauaaucgccgggcggc

SEQ ID NO: 3614613 - RNA, 16 nt, Salmonella enterica enterica serovar Typhi
gaauaauguaaaaaaa

SEQ ID NO: 3614614 - RNA, 17 nt, Salmonella enterica enterica serovar Typhi
gaauaauguaaaaaaau

SEQ ID NO: 3614615 - RNA, 16 nt, Salmonella enterica enterica serovar Typhi
gaauaauuucggcggc

SEQ ID NO: 3614616 - RNA, 16 nt, Salmonella enterica enterica serovar Typhi
gaauacaaaaaagccg

SEQ ID NO: 3614617 - RNA, 12 nt, Salmonella enterica enterica serovar Typhi
gaauacacaaug

SEQ ID NO: 3614618 - RNA, 12 nt, Salmonella enterica enterica serovar Typhi
gaauaccacugu

SEQ ID NO: 3614619 - RNA, 19 nt, Salmonella enterica enterica serovar Typhi
gaauacccgcccgguuuug

SEQ ID NO: 3614620 - RNA, 21 nt, Salmonella enterica enterica serovar Typhi
gaauaccgauucccagucauc

SEQ ID NO: 3614621 - RNA, 13 nt, Salmonella enterica enterica serovar Typhi
gaauaccuucccg

SEQ ID NO: 3614622 - RNA, 17 nt, Salmonella enterica enterica serovar Typhi
gaauaccuugauaacug

SEQ ID NO: 3614623 - RNA, 19 nt, Salmonella enterica enterica serovar Typhi
gaauacggaaggauagccg

SEQ ID NO: 3614624 - RNA, 17 nt, Salmonella enterica enterica serovar Typhi
gaauacuacugguggaa

SEQ ID NO: 3614625 - RNA, 17 nt, Salmonella enterica enterica serovar Typhi
gaauacugggcgcauga

SEQ ID NO: 3614626 - RNA, 19 nt, Salmonella enterica enterica serovar Typhi
gaauacugggcgcaugagg

SEQ ID NO: 3614627 - RNA, 17 nt, Salmonella enterica enterica serovar Typhi
gaauagaggcgcuggcg

SEQ ID NO: 3614628 - RNA, 15 nt, Salmonella enterica enterica serovar Typhi
gaauagccagccccc

SEQ ID NO: 3614629 - RNA, 23 nt, Salmonella enterica enterica serovar Typhi
gaauagccccucaauuauguauu

SEQ ID NO: 3614630 - RNA, 23 nt, Salmonella enterica enterica serovar Typhi
gaauagcccucgguggauaaauu

SEQ ID NO: 3614631 - RNA, 13 nt, Salmonella enterica enterica serovar Typhi
gaauagccggaua

SEQ ID NO: 3614632 - RNA, 13 nt, Salmonella enterica enterica serovar Typhi
gaauagcgacaaa

SEQ ID NO: 3614633 - RNA, 22 nt, Salmonella enterica enterica serovar Typhi
gaauagcggcaguacgagcauc

SEQ ID NO: 3614634 - RNA, 12 nt, Salmonella enterica enterica serovar Typhi
gaauggcgccuu

SEQ ID NO: 3614635 - RNA, 20 nt, Salmonella enterica enterica serovar Typhi
gaauggcgggccuacgcgca

SEQ ID NO: 3614636 - RNA, 16 nt, Salmonella enterica enterica serovar Typhi
gaauggcugcuuuugc

SEQ ID NO: 3614637 - RNA, 23 nt, Salmonella enterica enterica serovar Typhi
gaauggugcggccuuacccauac

SEQ ID NO: 3614638 - RNA, 14 nt, Salmonella enterica enterica serovar Typhi
gaaugguucccuga

SEQ ID NO: 3614639 - RNA, 20 nt, Salmonella enterica enterica serovar Typhi
gaauguaggccggguaagcg

SEQ ID NO: 3614640 - RNA, 17 nt, Salmonella enterica enterica serovar Typhi
gaauguauaauccaaca

SEQ ID NO: 3614641 - RNA, 14 nt, Salmonella enterica enterica serovar Typhi
gaaugugcaccuua

SEQ ID NO: 3614642 - RNA, 17 nt, Salmonella enterica enterica serovar Typhi
gaaugugcuuaucacgu

SEQ ID NO: 3614643 - RNA, 19 nt, Salmonella enterica enterica serovar Typhi
gaauguggguauccacgcc

SEQ ID NO: 3614644 - RNA, 16 nt, Salmonella enterica enterica serovar Typhi
gaauuaagcaauccau

SEQ ID NO: 3614645 - RNA, 19 nt, Salmonella enterica enterica serovar Typhi
gaauuauuaaaucaauacu

SEQ ID NO: 3614646 - RNA, 13 nt, Salmonella enterica enterica serovar Typhi
gaauuauuaccaa

SEQ ID NO: 3614647 - RNA, 19 nt, Salmonella enterica enterica serovar Typhi
gaauuauucguguuucgac

SEQ ID NO: 3614648 - RNA, 13 nt, Salmonella enterica enterica serovar Typhi
gaauucaacgucc

SEQ ID NO: 3614649 - RNA, 15 nt, Salmonella enterica enterica serovar Typhi
gaauuccaguccuuu

SEQ ID NO: 3614650 - RNA, 13 nt, Salmonella enterica enterica serovar Typhi
gaauugauaaaga

SEQ ID NO: 3614651 - RNA, 16 nt, Salmonella enterica enterica serovar Typhi
gaauugauaaagaucu

SEQ ID NO: 3614652 - RNA, 13 nt, Salmonella enterica enterica serovar Typhi
gaauugcaaggcg

SEQ ID NO: 3614653 - RNA, 17 nt, Salmonella enterica enterica serovar Typhi
gaauugccauuguucgc

SEQ ID NO: 3614654 - RNA, 17 nt, Salmonella enterica enterica serovar Typhi
gaauugcgguuuauccc

SEQ ID NO: 3614655 - RNA, 13 nt, Salmonella enterica enterica serovar Typhi
gaauugguagacg

SEQ ID NO: 3614656 - RNA, 16 nt, Salmonella enterica enterica serovar Typhi
gaauuuaaauagcaau

SEQ ID NO: 3614657 - RNA, 13 nt, Salmonella enterica enterica serovar Typhi
gaauuuacgggcg

SEQ ID NO: 3614658 - RNA, 22 nt, Salmonella enterica enterica serovar Typhi
gaauuuaucaauaaccgccagc

SEQ ID NO: 3614659 - RNA, 16 nt, Salmonella enterica enterica serovar Typhi
gaauuuaucccguggu

SEQ ID NO: 3614660 - RNA, 13 nt, Salmonella enterica enterica serovar Typhi
gaauuucaccacc

SEQ ID NO: 3614661 - RNA, 13 nt, Salmonella enterica enterica serovar Typhi
gaauuucaggaag

SEQ ID NO: 3614662 - RNA, 13 nt, Salmonella enterica enterica serovar Typhi
gaauuuccugcgc

SEQ ID NO: 3614663 - RNA, 19 nt, Salmonella enterica enterica serovar Typhi
gaauuucgcgaauaaucug

SEQ ID NO: 3614664 - RNA, 21 nt, Salmonella enterica enterica serovar Typhi
gaauuucugcugccagcgccg

SEQ ID NO: 3614665 - RNA, 18 nt, Salmonella enterica enterica serovar Typhi
gaauuugaacucuuucag

SEQ ID NO: 3614666 - RNA, 14 nt, Salmonella enterica enterica serovar Typhi
gaauuugccccaga

SEQ ID NO: 3614667 - RNA, 22 nt, Salmonella enterica enterica serovar Typhi
gaauuuguugguuuaaacucug

SEQ ID NO: 3614668 - RNA, 20 nt, Salmonella enterica enterica serovar Typhi
gaauuuuauuaagcaggccg

SEQ ID NO: 3614669 - RNA, 21 nt, Salmonella enterica enterica serovar Typhi
gaauuuuccgccgugauucau

SEQ ID NO: 3614670 - RNA, 20 nt, Salmonella enterica enterica serovar Typhi
gaauuuuuccagcucagaaa

SEQ ID NO: 3614671 - RNA, 14 nt, Salmonella enterica enterica serovar Typhi
gacaaaaauuaaaa

SEQ ID NO: 3614672 - RNA, 15 nt, Salmonella enterica enterica serovar Typhi
gacaaaaggugucac

SEQ ID NO: 3614673 - RNA, 21 nt, Salmonella enterica enterica serovar Typhi
gacaaaauaaagugaaauaaa

SEQ ID NO: 3614674 - RNA, 14 nt, Salmonella enterica enterica serovar Typhi
gacaaacccuguau

SEQ ID NO: 3614675 - RNA, 20 nt, Salmonella enterica enterica serovar Typhi
gacaaacucacguuccccag

SEQ ID NO: 3614676 - RNA, 17 nt, Salmonella enterica enterica serovar Typhi
gacaaaggcaagauccg

SEQ ID NO: 3614677 - RNA, 17 nt, Salmonella enterica enterica serovar Typhi
gacaaauaccuccuggc

SEQ ID NO: 3614678 - RNA, 17 nt, Salmonella enterica enterica serovar Typhi
gacaacaaaaagauauu

SEQ ID NO: 3614679 - RNA, 20 nt, Salmonella enterica enterica serovar Typhi
gacaacacauccgcagcgaa

SEQ ID NO: 3614680 - RNA, 15 nt, Salmonella enterica enterica serovar Typhi
gacaaccagcgaaau

SEQ ID NO: 3614681 - RNA, 19 nt, Salmonella enterica enterica serovar Typhi
gacaaccagcgaaaugacg

SEQ ID NO: 3614682 - RNA, 14 nt, Salmonella enterica enterica serovar Typhi
gacaacgaccagug

SEQ ID NO: 3614683 - RNA, 19 nt, Salmonella enterica enterica serovar Typhi
gacaacgccgccuggcauc

SEQ ID NO: 3614684 - RNA, 23 nt, Salmonella enterica enterica serovar Typhi
gacaacgccgguacgcagcaggc

SEQ ID NO: 3614685 - RNA, 15 nt, Salmonella enterica enterica serovar Typhi
gacaacgcuccagca

SEQ ID NO: 3614686 - RNA, 18 nt, Salmonella enterica enterica serovar Typhi
gacaacgcuccagcaguu

SEQ ID NO: 3614687 - RNA, 19 nt, Salmonella enterica enterica serovar Typhi
gacaacguaaacggcagcc

SEQ ID NO: 3614688 - RNA, 22 nt, Salmonella enterica enterica serovar Typhi
gacaacguaaacggcagccgcc

SEQ ID NO: 3614689 - RNA, 23 nt, Salmonella enterica enterica serovar Typhi
gacaacguaaacggcagccgcca

SEQ ID NO: 3614690 - RNA, 18 nt, Salmonella enterica enterica serovar Typhi
gacaacuagaauuuucac

SEQ ID NO: 3614691 - RNA, 18 nt, Salmonella enterica enterica serovar Typhi
gacaaggcgcgccagcgc

SEQ ID NO: 3614692 - RNA, 22 nt, Salmonella enterica enterica serovar Typhi
gacaaggcgguacgccgccauc

SEQ ID NO: 3614693 - RNA, 15 nt, Salmonella enterica enterica serovar Typhi
gacaagguugaucag

SEQ ID NO: 3614694 - RNA, 18 nt, Salmonella enterica enterica serovar Typhi
gacaauaaacuggcugug

SEQ ID NO: 3614695 - RNA, 19 nt, Salmonella enterica enterica serovar Typhi
gacaauacuuaaaccugcg

SEQ ID NO: 3614696 - RNA, 14 nt, Salmonella enterica enterica serovar Typhi
gacaaucagcacca

SEQ ID NO: 3614697 - RNA, 23 nt, Salmonella enterica enterica serovar Typhi
gacaaucgucacuucaauuugcc

SEQ ID NO: 3614698 - RNA, 19 nt, Salmonella enterica enterica serovar Typhi
gacaaucuccuccggcuuc

SEQ ID NO: 3614699 - RNA, 15 nt, Salmonella enterica enterica serovar Typhi
gacaaugaaccagcc

SEQ ID NO: 3614700 - RNA, 15 nt, Salmonella enterica enterica serovar Typhi
gacaaugaucagacg

SEQ ID NO: 3614701 - RNA, 15 nt, Salmonella enterica enterica serovar Typhi
gacaaugauuugcaa

SEQ ID NO: 3614702 - RNA, 15 nt, Salmonella enterica enterica serovar Typhi
gacaauuuucuucau

SEQ ID NO: 3614703 - RNA, 23 nt, Salmonella enterica enterica serovar Typhi
gacaauuuugauaagagaaaaua

SEQ ID NO: 3614704 - RNA, 18 nt, Salmonella enterica enterica serovar Typhi
gacacaaaucuguuaucu

SEQ ID NO: 3614705 - RNA, 20 nt, Salmonella enterica enterica serovar Typhi
gacacaacggcacaacggcc

SEQ ID NO: 3614706 - RNA, 21 nt, Salmonella enterica enterica serovar Typhi
gacacagcguacaauggcagg

SEQ ID NO: 3614707 - RNA, 18 nt, Salmonella enterica enterica serovar Typhi
gacacagcguuuaacuga

SEQ ID NO: 3614708 - RNA, 20 nt, Salmonella enterica enterica serovar Typhi
gacacagucauugguaagag

SEQ ID NO: 3614709 - RNA, 17 nt, Salmonella enterica enterica serovar Typhi
gacacauccugcgggau

SEQ ID NO: 3614710 - RNA, 20 nt, Salmonella enterica enterica serovar Typhi
gacacauucaggcuuuccac

SEQ ID NO: 3614711 - RNA, 13 nt, Salmonella enterica enterica serovar Typhi
gacaccacgcagg

SEQ ID NO: 3614712 - RNA, 13 nt, Salmonella enterica enterica serovar Typhi
gacacccgcagcc

SEQ ID NO: 3614713 - RNA, 23 nt, Salmonella enterica enterica serovar Typhi
gacacccgcagccagaacagaag

SEQ ID NO: 3614714 - RNA, 15 nt, Salmonella enterica enterica serovar Typhi
gacaccgcaaaccgu

SEQ ID NO: 3614715 - RNA, 21 nt, Salmonella enterica enterica serovar Typhi
gacacgcgcgcugcgccugga

SEQ ID NO: 3614716 - RNA, 21 nt, Salmonella enterica enterica serovar Typhi
gacacgcucauaaauugcagc

SEQ ID NO: 3614717 - RNA, 11 nt, Salmonella enterica enterica serovar Typhi
gacacucaucc

SEQ ID NO: 3614718 - RNA, 17 nt, Salmonella enterica enterica serovar Typhi
gacacucauccagacca

SEQ ID NO: 3614719 - RNA, 18 nt, Salmonella enterica enterica serovar Typhi
gacacuggaaacagccaa

SEQ ID NO: 3614720 - RNA, 13 nt, Salmonella enterica enterica serovar Typhi
gaccagcaucagc

SEQ ID NO: 3614721 - RNA, 17 nt, Salmonella enterica enterica serovar Typhi
gaccagcaugugccgga

SEQ ID NO: 3614722 - RNA, 21 nt, Salmonella enterica enterica serovar Typhi
gaccagccuaccugccgccau

SEQ ID NO: 3614723 - RNA, 14 nt, Salmonella enterica enterica serovar Typhi
gaccagcgucagcc

SEQ ID NO: 3614724 - RNA, 18 nt, Salmonella enterica enterica serovar Typhi
gaccagcugacgacgcca

SEQ ID NO: 3614725 - RNA, 20 nt, Salmonella enterica enterica serovar Typhi
gaccagcugacgacgccagc

SEQ ID NO: 3614726 - RNA, 13 nt, Salmonella enterica enterica serovar Typhi
gaccaggaucaga

SEQ ID NO: 3614727 - RNA, 16 nt, Salmonella enterica enterica serovar Typhi
gaccaggauggccagc

SEQ ID NO: 3614728 - RNA, 20 nt, Salmonella enterica enterica serovar Typhi
gaccaggauuuaauggucuc

SEQ ID NO: 3614729 - RNA, 18 nt, Salmonella enterica enterica serovar Typhi
gaccaggcgacuauccac

SEQ ID NO: 3614730 - RNA, 15 nt, Salmonella enterica enterica serovar Typhi
gaccagguacagcuu

SEQ ID NO: 3614731 - RNA, 17 nt, Salmonella enterica enterica serovar Typhi
gaccaggucgccagcgg

SEQ ID NO: 3614732 - RNA, 16 nt, Salmonella enterica enterica serovar Typhi
gaccaguuauucggca

SEQ ID NO: 3614733 - RNA, 21 nt, Salmonella enterica enterica serovar Typhi
gaccaguucaccggcggccag

SEQ ID NO: 3614734 - RNA, 20 nt, Salmonella enterica enterica serovar Typhi
gaccaguugccccugcguca

SEQ ID NO: 3614735 - RNA, 20 nt, Salmonella enterica enterica serovar Typhi
gaccaguuguaaucggcgcc

SEQ ID NO: 3614736 - RNA, 21 nt, Salmonella enterica enterica serovar Typhi
gaccaguuuuugcgccagcgc

SEQ ID NO: 3614737 - RNA, 16 nt, Salmonella enterica enterica serovar Typhi
gaccauaaauagccga

SEQ ID NO: 3614738 - RNA, 18 nt, Salmonella enterica enterica serovar Typhi
gaccauaaauagccgacc

SEQ ID NO: 3614739 - RNA, 12 nt, Salmonella enterica enterica serovar Typhi
gaccauacuaau

SEQ ID NO: 3614740 - RNA, 20 nt, Salmonella enterica enterica serovar Typhi
gaccauaugcggcaucgucc

SEQ ID NO: 3614741 - RNA, 14 nt, Salmonella enterica enterica serovar Typhi
gaccaucaacagcg

SEQ ID NO: 3614742 - RNA, 17 nt, Salmonella enterica enterica serovar Typhi
gaccaucaagcauauca

SEQ ID NO: 3614743 - RNA, 12 nt, Salmonella enterica enterica serovar Typhi
gaccauccacca

SEQ ID NO: 3614744 - RNA, 14 nt, Salmonella enterica enterica serovar Typhi
gaccaucggccgcu

SEQ ID NO: 3614745 - RNA, 16 nt, Salmonella enterica enterica serovar Typhi
gaccaucucuuccgcg

SEQ ID NO: 3614746 - RNA, 15 nt, Salmonella enterica enterica serovar Typhi
gaccaucuuccaacu

SEQ ID NO: 3614747 - RNA, 15 nt, Salmonella enterica enterica serovar Typhi
gaccauuccagguca

SEQ ID NO: 3614748 - RNA, 17 nt, Salmonella enterica enterica serovar Typhi
gaccauugcguauuuca

SEQ ID NO: 3614749 - RNA, 22 nt, Salmonella enterica enterica serovar Typhi
gacccacagccgguuagccaca

SEQ ID NO: 3614750 - RNA, 23 nt, Salmonella enterica enterica serovar Typhi
gacccacaguuucauauccgaca

SEQ ID NO: 3614751 - RNA, 22 nt, Salmonella enterica enterica serovar Typhi
gacccaccugacuguucacgca

SEQ ID NO: 3614752 - RNA, 17 nt, Salmonella enterica enterica serovar Typhi
gacccacgccagcagcu

SEQ ID NO: 3614753 - RNA, 16 nt, Salmonella enterica enterica serovar Typhi
gacccacuuucagcuc

SEQ ID NO: 3614754 - RNA, 19 nt, Salmonella enterica enterica serovar Typhi
gacccagcgcgaauuugcc

SEQ ID NO: 3614755 - RNA, 12 nt, Salmonella enterica enterica serovar Typhi
gacccauuuuaa

SEQ ID NO: 3614756 - RNA, 13 nt, Salmonella enterica enterica serovar Typhi
gaccccagauaau

SEQ ID NO: 3614757 - RNA, 22 nt, Salmonella enterica enterica serovar Typhi
gaccccauuaaacuggccccgc

SEQ ID NO: 3614758 - RNA, 22 nt, Salmonella enterica enterica serovar Typhi
gaccccgccgucagacaggccu

SEQ ID NO: 3614759 - RNA, 18 nt, Salmonella enterica enterica serovar Typhi
gaccccggccucgcccgc

SEQ ID NO: 3614760 - RNA, 21 nt, Salmonella enterica enterica serovar Typhi
gaccccguccguucacuaacg

SEQ ID NO: 3614761 - RNA, 19 nt, Salmonella enterica enterica serovar Typhi
gaccccuccggccagcgcc

SEQ ID NO: 3614762 - RNA, 14 nt, Salmonella enterica enterica serovar Typhi
gaccccucuucuuu

SEQ ID NO: 3614763 - RNA, 22 nt, Salmonella enterica enterica serovar Typhi
gacccgcaaaccaggucugcgc

SEQ ID NO: 3614764 - RNA, 14 nt, Salmonella enterica enterica serovar Typhi
gacccgcagcaauc

SEQ ID NO: 3614765 - RNA, 15 nt, Salmonella enterica enterica serovar Typhi
gacccgcaucagacc

SEQ ID NO: 3614766 - RNA, 15 nt, Salmonella enterica enterica serovar Typhi
gacccgccgccagca

SEQ ID NO: 3614767 - RNA, 19 nt, Salmonella enterica enterica serovar Typhi
gacccgcuuccaguuuugc

SEQ ID NO: 3614768 - RNA, 21 nt, Salmonella enterica enterica serovar Typhi
gacccgcuuccaguuuugcca

SEQ ID NO: 3614769 - RNA, 22 nt, Salmonella enterica enterica serovar Typhi
gacccguuacgcagucagcacu

SEQ ID NO: 3614770 - RNA, 19 nt, Salmonella enterica enterica serovar Typhi
gacccugagcucaaacgua

SEQ ID NO: 3614771 - RNA, 18 nt, Salmonella enterica enterica serovar Typhi
gacccuuaugucauucag

SEQ ID NO: 3614772 - RNA, 14 nt, Salmonella enterica enterica serovar Typhi
gacccuugcgacca

SEQ ID NO: 3614773 - RNA, 19 nt, Salmonella enterica enterica serovar Typhi
gaccgacaagccccccgca

SEQ ID NO: 3614774 - RNA, 19 nt, Salmonella enterica enterica serovar Typhi
gaccgacauaaaacccgcc

SEQ ID NO: 3614775 - RNA, 23 nt, Salmonella enterica enterica serovar Typhi
gaccgacgcguuuuccagcacca

SEQ ID NO: 3614776 - RNA, 17 nt, Salmonella enterica enterica serovar Typhi
gaccgagacccagcgcg

SEQ ID NO: 3614777 - RNA, 15 nt, Salmonella enterica enterica serovar Typhi
gaccgagaucaggcc

SEQ ID NO: 3614778 - RNA, 13 nt, Salmonella enterica enterica serovar Typhi
gaccgagucuaca

SEQ ID NO: 3614779 - RNA, 23 nt, Salmonella enterica enterica serovar Typhi
gaccgagucuacaucaagagaaa

SEQ ID NO: 3614780 - RNA, 14 nt, Salmonella enterica enterica serovar Typhi
gaccgauaaauacc

SEQ ID NO: 3614781 - RNA, 16 nt, Salmonella enterica enterica serovar Typhi
gaccgaucucaugcaa

SEQ ID NO: 3614782 - RNA, 23 nt, Salmonella enterica enterica serovar Typhi
gaccgcaaaccgaauucguccac

SEQ ID NO: 3614783 - RNA, 13 nt, Salmonella enterica enterica serovar Typhi
gaccgcaacgucc

SEQ ID NO: 3614784 - RNA, 18 nt, Salmonella enterica enterica serovar Typhi
gaccgcagcuuauuccag

SEQ ID NO: 3614785 - RNA, 15 nt, Salmonella enterica enterica serovar Typhi
gaccgccaagcgcgg

SEQ ID NO: 3614786 - RNA, 13 nt, Salmonella enterica enterica serovar Typhi
gaccgccagcaga

SEQ ID NO: 3614787 - RNA, 11 nt, Salmonella enterica enterica serovar Typhi
gaccgccauaa

SEQ ID NO: 3614788 - RNA, 19 nt, Salmonella enterica enterica serovar Typhi
gaccgccccguaucauuag

SEQ ID NO: 3614789 - RNA, 18 nt, Salmonella enterica enterica serovar Typhi
gaccgccgaguccgaggc

SEQ ID NO: 3614790 - RNA, 15 nt, Salmonella enterica enterica serovar Typhi
gaccgcgaucgcugg

SEQ ID NO: 3614791 - RNA, 16 nt, Salmonella enterica enterica serovar Typhi
gaccgcugauggaccu

SEQ ID NO: 3614792 - RNA, 14 nt, Salmonella enterica enterica serovar Typhi
gaccgcuucgcugg

SEQ ID NO: 3614793 - RNA, 15 nt, Salmonella enterica enterica serovar Typhi
gaccgcuuuuuccag

SEQ ID NO: 3614794 - RNA, 17 nt, Salmonella enterica enterica serovar Typhi
gaccggaacggacgugc

SEQ ID NO: 3614795 - RNA, 20 nt, Salmonella enterica enterica serovar Typhi
gaccggaugauggccuggcg

SEQ ID NO: 3614796 - RNA, 22 nt, Salmonella enterica enterica serovar Typhi
gaccggcacucaccucuuccgc

SEQ ID NO: 3614797 - RNA, 19 nt, Salmonella enterica enterica serovar Typhi
gaccggcagccguuuuccg

SEQ ID NO: 3614798 - RNA, 21 nt, Salmonella enterica enterica serovar Typhi
gaccgggggcuggccacugga

SEQ ID NO: 3614799 - RNA, 16 nt, Salmonella enterica enterica serovar Typhi
gaccggucagccgguu

SEQ ID NO: 3614800 - RNA, 17 nt, Salmonella enterica enterica serovar Typhi
gaccggucagccgguuu

SEQ ID NO: 3614801 - RNA, 22 nt, Salmonella enterica enterica serovar Typhi
gaccggucauacugaacaagcg

SEQ ID NO: 3614802 - RNA, 18 nt, Salmonella enterica enterica serovar Typhi
gaccggugaugugcuggc

SEQ ID NO: 3614803 - RNA, 21 nt, Salmonella enterica enterica serovar Typhi
gaccggugaugugcuggcgga

SEQ ID NO: 3614804 - RNA, 14 nt, Salmonella enterica enterica serovar Typhi
gaccgucagcagca

SEQ ID NO: 3614805 - RNA, 16 nt, Salmonella enterica enterica serovar Typhi
gaccgucgcgcccucc

SEQ ID NO: 3614806 - RNA, 17 nt, Salmonella enterica enterica serovar Typhi
gacgcuuacaucgccau

SEQ ID NO: 3614807 - RNA, 16 nt, Salmonella enterica enterica serovar Typhi
gacgcuucgcccguuc

SEQ ID NO: 3614808 - RNA, 21 nt, Salmonella enterica enterica serovar Typhi
gacgcuuugcauuaucgaugc

SEQ ID NO: 3614809 - RNA, 17 nt, Salmonella enterica enterica serovar Typhi
gacgcuuuucagcgucu

SEQ ID NO: 3614810 - RNA, 14 nt, Salmonella enterica enterica serovar Typhi
gacggaaaccagau

SEQ ID NO: 3614811 - RNA, 13 nt, Salmonella enterica enterica serovar Typhi
gacggaaaccagc

SEQ ID NO: 3614812 - RNA, 14 nt, Salmonella enterica enterica serovar Typhi
gacggaaaccagca

SEQ ID NO: 3614813 - RNA, 11 nt, Salmonella enterica enterica serovar Typhi
gacggagaaaa

SEQ ID NO: 3614814 - RNA, 20 nt, Salmonella enterica enterica serovar Typhi
gacggagauuaacagcgcga

SEQ ID NO: 3614815 - RNA, 22 nt, Salmonella enterica enterica serovar Typhi
gacggauuggcgcucaauagcc

SEQ ID NO: 3614816 - RNA, 24 nt, Salmonella enterica enterica serovar Typhi
gacggcaacggcgacaagaauaug

SEQ ID NO: 3614817 - RNA, 13 nt, Salmonella enterica enterica serovar Typhi
gacggcagccacg

SEQ ID NO: 3614818 - RNA, 20 nt, Salmonella enterica enterica serovar Typhi
gacggcagcgccauccggca

SEQ ID NO: 3614819 - RNA, 23 nt, Salmonella enterica enterica serovar Typhi
gacggcagucgcuacaaccagcg

SEQ ID NO: 3614820 - RNA, 13 nt, Salmonella enterica enterica serovar Typhi
gacggccaccagc

SEQ ID NO: 3614821 - RNA, 15 nt, Salmonella enterica enterica serovar Typhi
gacggccaccagcgu

SEQ ID NO: 3614822 - RNA, 12 nt, Salmonella enterica enterica serovar Typhi
gacggccagcgc

SEQ ID NO: 3614823 - RNA, 15 nt, Salmonella enterica enterica serovar Typhi
gacggccugucuccu

SEQ ID NO: 3614824 - RNA, 14 nt, Salmonella enterica enterica serovar Typhi
gacggcggaccccu

SEQ ID NO: 3614825 - RNA, 19 nt, Salmonella enterica enterica serovar Typhi
gacggcguaagucgcgcau

SEQ ID NO: 3614826 - RNA, 22 nt, Salmonella enterica enterica serovar Typhi
gacggcguauucggcauagcgc

SEQ ID NO: 3614827 - RNA, 20 nt, Salmonella enterica enterica serovar Typhi
gacggcuaauaugccaggcu

SEQ ID NO: 3614828 - RNA, 13 nt, Salmonella enterica enterica serovar Typhi
gacggcugacgca

SEQ ID NO: 3614829 - RNA, 15 nt, Salmonella enterica enterica serovar Typhi
gacggcuucacugcc

SEQ ID NO: 3614830 - RNA, 17 nt, Salmonella enterica enterica serovar Typhi
gacgggaaaaagcgcgc

SEQ ID NO: 3614831 - RNA, 20 nt, Salmonella enterica enterica serovar Typhi
gacgggaaaucucccuggca

SEQ ID NO: 3614832 - RNA, 21 nt, Salmonella enterica enterica serovar Typhi
gacgggaaaucucccuggcag

SEQ ID NO: 3614833 - RNA, 18 nt, Salmonella enterica enterica serovar Typhi
gacgggacgaauuuccag

SEQ ID NO: 3614834 - RNA, 14 nt, Salmonella enterica enterica serovar Typhi
gacgggauuaaaug

SEQ ID NO: 3614835 - RNA, 21 nt, Salmonella enterica enterica serovar Typhi
gacgggauuaaaugacgcccu

SEQ ID NO: 3614836 - RNA, 20 nt, Salmonella enterica enterica serovar Typhi
gacgggcggcgacagagaau

SEQ ID NO: 3614837 - RNA, 21 nt, Salmonella enterica enterica serovar Typhi
gacgggcguccggcuuaggca

SEQ ID NO: 3614838 - RNA, 23 nt, Salmonella enterica enterica serovar Typhi
gacgggggcgaucagcaggucag

SEQ ID NO: 3614839 - RNA, 14 nt, Salmonella enterica enterica serovar Typhi
gacggguaacgcca

SEQ ID NO: 3614840 - RNA, 17 nt, Salmonella enterica enterica serovar Typhi
gacgguaccugaagcca

SEQ ID NO: 3614841 - RNA, 19 nt, Salmonella enterica enterica serovar Typhi
gacgguaccugaagccauc

SEQ ID NO: 3614842 - RNA, 15 nt, Salmonella enterica enterica serovar Typhi
gacgguccuggccag

SEQ ID NO: 3614843 - RNA, 20 nt, Salmonella enterica enterica serovar Typhi
gacgguggucaucuggucaa

SEQ ID NO: 3614844 - RNA, 16 nt, Salmonella enterica enterica serovar Typhi
gacgguuauuuuucag

SEQ ID NO: 3614845 - RNA, 18 nt, Salmonella enterica enterica serovar Typhi
gacguaaacgucggccuu

SEQ ID NO: 3614846 - RNA, 23 nt, Salmonella enterica enterica serovar Typhi
gacguaacgguguuucaucuuca

SEQ ID NO: 3614847 - RNA, 17 nt, Salmonella enterica enterica serovar Typhi
gacguagcgccaucagg

SEQ ID NO: 3614848 - RNA, 19 nt, Salmonella enterica enterica serovar Typhi
gacguaggccgaauaagac

SEQ ID NO: 3614849 - RNA, 11 nt, Salmonella enterica enterica serovar Typhi
gacguccagac

SEQ ID NO: 3614850 - RNA, 14 nt, Salmonella enterica enterica serovar Typhi
gacguccaggccgu

SEQ ID NO: 3614851 - RNA, 19 nt, Salmonella enterica enterica serovar Typhi
gacgucgguaaucacauca

SEQ ID NO: 3614852 - RNA, 13 nt, Salmonella enterica enterica serovar Typhi
gacgucgucacca

SEQ ID NO: 3614853 - RNA, 14 nt, Salmonella enterica enterica serovar Typhi
gacgugaccgguug

SEQ ID NO: 3614854 - RNA, 20 nt, Salmonella enterica enterica serovar Typhi
gacgugauuuuggcagcccg

SEQ ID NO: 3614855 - RNA, 18 nt, Salmonella enterica enterica serovar Typhi
gacgugccuuccaucggc

SEQ ID NO: 3614856 - RNA, 19 nt, Salmonella enterica enterica serovar Typhi
gacgugcggcagggcgguc

SEQ ID NO: 3614857 - RNA, 19 nt, Salmonella enterica enterica serovar Typhi
gacguggauauucaucagu

SEQ ID NO: 3614858 - RNA, 17 nt, Salmonella enterica enterica serovar Typhi
gacguggggguucaagu

SEQ ID NO: 3614859 - RNA, 17 nt, Salmonella enterica enterica serovar Typhi
gacgugugauuguggcg

SEQ ID NO: 3614860 - RNA, 21 nt, Salmonella enterica enterica serovar Typhi
gacguuaacgcagcaucgcca

SEQ ID NO: 3614861 - RNA, 15 nt, Salmonella enterica enterica serovar Typhi
gacguuaucucgcca

SEQ ID NO: 3614862 - RNA, 20 nt, Salmonella enterica enterica serovar Typhi
gacguuaucucgccaggaac

SEQ ID NO: 3614863 - RNA, 17 nt, Salmonella enterica enterica serovar Typhi
gacguucaauucauaga

SEQ ID NO: 3614864 - RNA, 13 nt, Salmonella enterica enterica serovar Typhi
gacguuccgcgac

SEQ ID NO: 3614865 - RNA, 15 nt, Salmonella enterica enterica serovar Typhi
gacguucgacccgca

SEQ ID NO: 3614866 - RNA, 19 nt, Salmonella enterica enterica serovar Typhi
gacguucgcgaugcagcac

SEQ ID NO: 3614867 - RNA, 18 nt, Salmonella enterica enterica serovar Typhi
gacguugaaaaaacgggc

SEQ ID NO: 3614868 - RNA, 20 nt, Salmonella enterica enterica serovar Typhi
gacguuuaugccgccauccg

SEQ ID NO: 3614869 - RNA, 22 nt, Salmonella enterica enterica serovar Typhi
gacuaaaaagcgcguccccggu

SEQ ID NO: 3614870 - RNA, 15 nt, Salmonella enterica enterica serovar Typhi
gacuacguucaucag

SEQ ID NO: 3614871 - RNA, 16 nt, Salmonella enterica enterica serovar Typhi
gacuacguucaucagg

SEQ ID NO: 3614872 - RNA, 21 nt, Salmonella enterica enterica serovar Typhi
gacuauacccaaaauaauucg

SEQ ID NO: 3614873 - RNA, 18 nt, Salmonella enterica enterica serovar Typhi
gacuauccguccucuuuc

SEQ ID NO: 3614874 - RNA, 18 nt, Salmonella enterica enterica serovar Typhi
gacuauuccgcaaacgcc

SEQ ID NO: 3614875 - RNA, 14 nt, Salmonella enterica enterica serovar Typhi
gacuauucuucccc

SEQ ID NO: 3614876 - RNA, 15 nt, Salmonella enterica enterica serovar Typhi
gacuauugcugagcu

SEQ ID NO: 3614877 - RNA, 21 nt, Salmonella enterica enterica serovar Typhi
gacucaaacagauagccauca

SEQ ID NO: 3614878 - RNA, 13 nt, Salmonella enterica enterica serovar Typhi
gacucaaagaaaa

SEQ ID NO: 3614879 - RNA, 22 nt, Salmonella enterica enterica serovar Typhi
gacucacauaacaaaaccagca

SEQ ID NO: 3614880 - RNA, 13 nt, Salmonella enterica enterica serovar Typhi
gacucagccaggu

SEQ ID NO: 3614881 - RNA, 13 nt, Salmonella enterica enterica serovar Typhi
gacucagggugac

SEQ ID NO: 3614882 - RNA, 22 nt, Salmonella enterica enterica serovar Typhi
gacucaggguuuuacgcuggac

SEQ ID NO: 3614883 - RNA, 12 nt, Salmonella enterica enterica serovar Typhi
gacucauccagc

SEQ ID NO: 3614884 - RNA, 17 nt, Salmonella enterica enterica serovar Typhi
gacucaucgccgcaaug

SEQ ID NO: 3614885 - RNA, 19 nt, Salmonella enterica enterica serovar Typhi
gacucaucgccgcaaugac

SEQ ID NO: 3614886 - RNA, 14 nt, Salmonella enterica enterica serovar Typhi
gacucauggacaaa

SEQ ID NO: 3614887 - RNA, 20 nt, Salmonella enterica enterica serovar Typhi
gacucauucagcaacugcgu

SEQ ID NO: 3614888 - RNA, 22 nt, Salmonella enterica enterica serovar Typhi
gacuccagcaacgcugcauccu

SEQ ID NO: 3614889 - RNA, 22 nt, Salmonella enterica enterica serovar Typhi
gacuccccacaaucccgccaga

SEQ ID NO: 3614890 - RNA, 22 nt, Salmonella enterica enterica serovar Typhi
gacuccggauagagaucuuccg

SEQ ID NO: 3614891 - RNA, 14 nt, Salmonella enterica enterica serovar Typhi
gacuccggcagcau

SEQ ID NO: 3614892 - RNA, 16 nt, Salmonella enterica enterica serovar Typhi
gagacauugccuucca

SEQ ID NO: 3614893 - RNA, 18 nt, Salmonella enterica enterica serovar Typhi
gagacauugccuuccagg

SEQ ID NO: 3614894 - RNA, 21 nt, Salmonella enterica enterica serovar Typhi
gagacauugguuucaugcauc

SEQ ID NO: 3614895 - RNA, 15 nt, Salmonella enterica enterica serovar Typhi
gagaccaucaacagc

SEQ ID NO: 3614896 - RNA, 14 nt, Salmonella enterica enterica serovar Typhi
gagaccuaaagucu

SEQ ID NO: 3614897 - RNA, 20 nt, Salmonella enterica enterica serovar Typhi
gagacgcguaaaucagauug

SEQ ID NO: 3614898 - RNA, 18 nt, Salmonella enterica enterica serovar Typhi
gagacgcuggaaaauuuc

SEQ ID NO: 3614899 - RNA, 18 nt, Salmonella enterica enterica serovar Typhi
gagacgguaggccggaua

SEQ ID NO: 3614900 - RNA, 22 nt, Salmonella enterica enterica serovar Typhi
gagacguucauuucuuccagca

SEQ ID NO: 3614901 - RNA, 13 nt, Salmonella enterica enterica serovar Typhi
gagacucaaagaa

SEQ ID NO: 3614902 - RNA, 13 nt, Salmonella enterica enterica serovar Typhi
gagacugauaaug

SEQ ID NO: 3614903 - RNA, 13 nt, Salmonella enterica enterica serovar Typhi
gagacugccgccg

SEQ ID NO: 3614904 - RNA, 15 nt, Salmonella enterica enterica serovar Typhi
gagacuguuugucuc

SEQ ID NO: 3614905 - RNA, 18 nt, Salmonella enterica enterica serovar Typhi
gagagaaaaaaauccagu

SEQ ID NO: 3614906 - RNA, 14 nt, Salmonella enterica enterica serovar Typhi
gagagaaacaacac

SEQ ID NO: 3614907 - RNA, 22 nt, Salmonella enterica enterica serovar Typhi
gagagacguucauuucuuccag

SEQ ID NO: 3614908 - RNA, 15 nt, Salmonella enterica enterica serovar Typhi
gagagagcgcuucca

SEQ ID NO: 3614909 - RNA, 13 nt, Salmonella enterica enterica serovar Typhi
gagagcaacuggc

SEQ ID NO: 3614910 - RNA, 20 nt, Salmonella enterica enterica serovar Typhi
gagagcaauggcguggcgcu

SEQ ID NO: 3614911 - RNA, 15 nt, Salmonella enterica enterica serovar Typhi
gagagcagcgccagc

SEQ ID NO: 3614912 - RNA, 16 nt, Salmonella enterica enterica serovar Typhi
gagagcguauccagca

SEQ ID NO: 3614913 - RNA, 18 nt, Salmonella enterica enterica serovar Typhi
gagagcguauccagcacc

SEQ ID NO: 3614914 - RNA, 19 nt, Salmonella enterica enterica serovar Typhi
gagagcguauccagcaccu

SEQ ID NO: 3614915 - RNA, 15 nt, Salmonella enterica enterica serovar Typhi
gagagcgucaugaaa

SEQ ID NO: 3614916 - RNA, 19 nt, Salmonella enterica enterica serovar Typhi
gagaggccaccagcgccag

SEQ ID NO: 3614917 - RNA, 19 nt, Salmonella enterica enterica serovar Typhi
gagaguaaaaccggcacau

SEQ ID NO: 3614918 - RNA, 20 nt, Salmonella enterica enterica serovar Typhi
gagaguaaaaccggcacauc

SEQ ID NO: 3614919 - RNA, 17 nt, Salmonella enterica enterica serovar Typhi
gagaguugcuuuccguu

SEQ ID NO: 3614920 - RNA, 13 nt, Salmonella enterica enterica serovar Typhi
gagauagcgaggc

SEQ ID NO: 3614921 - RNA, 15 nt, Salmonella enterica enterica serovar Typhi
gagauagcggugccu

SEQ ID NO: 3614922 - RNA, 13 nt, Salmonella enterica enterica serovar Typhi
gagaucagcggau

SEQ ID NO: 3614923 - RNA, 18 nt, Salmonella enterica enterica serovar Typhi
gagaucaucggaacggau

SEQ ID NO: 3614924 - RNA, 14 nt, Salmonella enterica enterica serovar Typhi
gagauccaguauau

SEQ ID NO: 3614925 - RNA, 14 nt, Salmonella enterica enterica serovar Typhi
gagauccauaagau

SEQ ID NO: 3614926 - RNA, 22 nt, Salmonella enterica enterica serovar Typhi
gagauccgggcuggcaaacagg

SEQ ID NO: 3614927 - RNA, 21 nt, Salmonella enterica enterica serovar Typhi
gagaucgguaauuuccacgcc

SEQ ID NO: 3614928 - RNA, 13 nt, Salmonella enterica enterica serovar Typhi
gagaucuccagau

SEQ ID NO: 3614929 - RNA, 18 nt, Salmonella enterica enterica serovar Typhi
gagaugcagacaauuucc

SEQ ID NO: 3614930 - RNA, 14 nt, Salmonella enterica enterica serovar Typhi
gagaugcaggccaa

SEQ ID NO: 3614931 - RNA, 20 nt, Salmonella enterica enterica serovar Typhi
gagauguuuuaccaguacaa

SEQ ID NO: 3614932 - RNA, 20 nt, Salmonella enterica enterica serovar Typhi
gagauuacugcgugcuggcg

SEQ ID NO: 3614933 - RNA, 15 nt, Salmonella enterica enterica serovar Typhi
gagauucaauaaugu

SEQ ID NO: 3614934 - RNA, 14 nt, Salmonella enterica enterica serovar Typhi
gagauucugcaggc

SEQ ID NO: 3614935 - RNA, 17 nt, Salmonella enterica enterica serovar Typhi
gagauucugcaggccaa

SEQ ID NO: 3614936 - RNA, 17 nt, Salmonella enterica enterica serovar Typhi
gagcaaaaccagacgcc

SEQ ID NO: 3614937 - RNA, 20 nt, Salmonella enterica enterica serovar Typhi
gagcaaaccgacccaaaaau

SEQ ID NO: 3614938 - RNA, 14 nt, Salmonella enterica enterica serovar Typhi
gagcaaauacugga

SEQ ID NO: 3614939 - RNA, 20 nt, Salmonella enterica enterica serovar Typhi
gagcaaauacuggaaaaaac

SEQ ID NO: 3614940 - RNA, 22 nt, Salmonella enterica enterica serovar Typhi
gagcaaauacuggaaaaaacgg

SEQ ID NO: 3614941 - RNA, 20 nt, Salmonella enterica enterica serovar Typhi
gagcaacguuuugcacagug

SEQ ID NO: 3614942 - RNA, 12 nt, Salmonella enterica enterica serovar Typhi
gagcaauaacgu

SEQ ID NO: 3614943 - RNA, 19 nt, Salmonella enterica enterica serovar Typhi
gagcacaccauaucuuuca

SEQ ID NO: 3614944 - RNA, 18 nt, Salmonella enterica enterica serovar Typhi
gagcacgcggugccgaug

SEQ ID NO: 3614945 - RNA, 18 nt, Salmonella enterica enterica serovar Typhi
gagcacguaggccugaua

SEQ ID NO: 3614946 - RNA, 13 nt, Salmonella enterica enterica serovar Typhi
gagcacugcccag

SEQ ID NO: 3614947 - RNA, 22 nt, Salmonella enterica enterica serovar Typhi
gagcacuuuuuccuccugcgga

SEQ ID NO: 3614948 - RNA, 17 nt, Salmonella enterica enterica serovar Typhi
gagcagaacaaguucuu

SEQ ID NO: 3614949 - RNA, 17 nt, Salmonella enterica enterica serovar Typhi
gagcagaaguaaauccg

SEQ ID NO: 3614950 - RNA, 18 nt, Salmonella enterica enterica serovar Typhi
gagcagauuuuucgccag

SEQ ID NO: 3614951 - RNA, 16 nt, Salmonella enterica enterica serovar Typhi
gagcagcaacccugcc

SEQ ID NO: 3614952 - RNA, 13 nt, Salmonella enterica enterica serovar Typhi
gagcagcgaaaga

SEQ ID NO: 3614953 - RNA, 16 nt, Salmonella enterica enterica serovar Typhi
gagcagcuuggcggcu

SEQ ID NO: 3614954 - RNA, 14 nt, Salmonella enterica enterica serovar Typhi
gagcaggaaaaguc

SEQ ID NO: 3614955 - RNA, 16 nt, Salmonella enterica enterica serovar Typhi
gagcaggaaccacauc

SEQ ID NO: 3614956 - RNA, 17 nt, Salmonella enterica enterica serovar Typhi
gagcaggacgcgcgcga

SEQ ID NO: 3614957 - RNA, 13 nt, Salmonella enterica enterica serovar Typhi
gagcaggggccgg

SEQ ID NO: 3614958 - RNA, 15 nt, Salmonella enterica enterica serovar Typhi
gagcagucguugcgc

SEQ ID NO: 3614959 - RNA, 19 nt, Salmonella enterica enterica serovar Typhi
gagcagucguugcgccugu

SEQ ID NO: 3614960 - RNA, 20 nt, Salmonella enterica enterica serovar Typhi
gagcagucguugcgccuguu

SEQ ID NO: 3614961 - RNA, 19 nt, Salmonella enterica enterica serovar Typhi
gagcagugauuaugcuccc

SEQ ID NO: 3614962 - RNA, 16 nt, Salmonella enterica enterica serovar Typhi
gagcaguucagcagca

SEQ ID NO: 3614963 - RNA, 23 nt, Salmonella enterica enterica serovar Typhi
gagcauaucgacggucaggcugu

SEQ ID NO: 3614964 - RNA, 20 nt, Salmonella enterica enterica serovar Typhi
gagcaucaucugccauuucu

SEQ ID NO: 3614965 - RNA, 22 nt, Salmonella enterica enterica serovar Typhi
gagcaugguccggugcguucug

SEQ ID NO: 3614966 - RNA, 16 nt, Salmonella enterica enterica serovar Typhi
gagcauuuccgcagcc

SEQ ID NO: 3614967 - RNA, 21 nt, Salmonella enterica enterica serovar Typhi
gagccacgcggcaucaggcau

SEQ ID NO: 3614968 - RNA, 14 nt, Salmonella enterica enterica serovar Typhi
gagccacuauccag

SEQ ID NO: 3614969 - RNA, 22 nt, Salmonella enterica enterica serovar Typhi
gagccacuauccagucagcguu

SEQ ID NO: 3614970 - RNA, 22 nt, Salmonella enterica enterica serovar Typhi
gagccauaacaacuauuuuucc

SEQ ID NO: 3614971 - RNA, 15 nt, Salmonella enterica enterica serovar Typhi
gagccauuaaugcag

SEQ ID NO: 3614972 - RNA, 13 nt, Salmonella enterica enterica serovar Typhi
gagcccaguagcc

SEQ ID NO: 3614973 - RNA, 18 nt, Salmonella enterica enterica serovar Typhi
gagccgaaauccaccagc

SEQ ID NO: 3614974 - RNA, 17 nt, Salmonella enterica enterica serovar Typhi
gagccgauauccggaua

SEQ ID NO: 3614975 - RNA, 14 nt, Salmonella enterica enterica serovar Typhi
gagccgccauccgg

SEQ ID NO: 3614976 - RNA, 13 nt, Salmonella enterica enterica serovar Typhi
gagccgcugcuca

SEQ ID NO: 3614977 - RNA, 14 nt, Salmonella enterica enterica serovar Typhi
gagccgucgccggc

SEQ ID NO: 3614978 - RNA, 16 nt, Salmonella enterica enterica serovar Typhi
gagguuucuucaucaa

SEQ ID NO: 3614979 - RNA, 16 nt, Salmonella enterica enterica serovar Typhi
gagguuuucucaucca

SEQ ID NO: 3614980 - RNA, 20 nt, Salmonella enterica enterica serovar Typhi
gagguuuuucugaugcgccu

SEQ ID NO: 3614981 - RNA, 20 nt, Salmonella enterica enterica serovar Typhi
gaguaaaaccggcacaucca

SEQ ID NO: 3614982 - RNA, 15 nt, Salmonella enterica enterica serovar Typhi
gaguaaagccugccc

SEQ ID NO: 3614983 - RNA, 17 nt, Salmonella enterica enterica serovar Typhi
gaguaacgggcagcggc

SEQ ID NO: 3614984 - RNA, 18 nt, Salmonella enterica enterica serovar Typhi
gaguaaugacaaaaauua

SEQ ID NO: 3614985 - RNA, 20 nt, Salmonella enterica enterica serovar Typhi
gaguaauguucaguuuuucc

SEQ ID NO: 3614986 - RNA, 23 nt, Salmonella enterica enterica serovar Typhi
gaguaauguucaguuuuuccagc

SEQ ID NO: 3614987 - RNA, 19 nt, Salmonella enterica enterica serovar Typhi
gaguagcugagcgucaggc

SEQ ID NO: 3614988 - RNA, 20 nt, Salmonella enterica enterica serovar Typhi
gaguauagcggcguuuauau

SEQ ID NO: 3614989 - RNA, 15 nt, Salmonella enterica enterica serovar Typhi
gagucaaggcaucca

SEQ ID NO: 3614990 - RNA, 18 nt, Salmonella enterica enterica serovar Typhi
gagucagaaacggccugg

SEQ ID NO: 3614991 - RNA, 14 nt, Salmonella enterica enterica serovar Typhi
gaguccagcggcag

SEQ ID NO: 3614992 - RNA, 20 nt, Salmonella enterica enterica serovar Typhi
gaguccauauccguacauaa

SEQ ID NO: 3614993 - RNA, 22 nt, Salmonella enterica enterica serovar Typhi
gagucgacugguaggccugaua

SEQ ID NO: 3614994 - RNA, 16 nt, Salmonella enterica enterica serovar Typhi
gagucgcagcggcggu

SEQ ID NO: 3614995 - RNA, 19 nt, Salmonella enterica enterica serovar Typhi
gagucggaucaugaaaaau

SEQ ID NO: 3614996 - RNA, 12 nt, Salmonella enterica enterica serovar Typhi
gagucguuaucc

SEQ ID NO: 3614997 - RNA, 23 nt, Salmonella enterica enterica serovar Typhi
gagucguuauccagaucuucaga

SEQ ID NO: 3614998 - RNA, 14 nt, Salmonella enterica enterica serovar Typhi
gagugaaaugguug

SEQ ID NO: 3614999 - RNA, 13 nt, Salmonella enterica enterica serovar Typhi
gaguggaaucagc

SEQ ID NO: 3615000 - RNA, 17 nt, Salmonella enterica enterica serovar Typhi
gaguggagcggucgaca

SEQ ID NO: 3615001 - RNA, 22 nt, Salmonella enterica enterica serovar Typhi
gaguggagcggucgacagccac

SEQ ID NO: 3615002 - RNA, 12 nt, Salmonella enterica enterica serovar Typhi
gaguggcggcgc

SEQ ID NO: 3615003 - RNA, 17 nt, Salmonella enterica enterica serovar Typhi
gaguuaaugccaucauc

SEQ ID NO: 3615004 - RNA, 18 nt, Salmonella enterica enterica serovar Typhi
gaguuaaugccaucauca

SEQ ID NO: 3615005 - RNA, 20 nt, Salmonella enterica enterica serovar Typhi
gaguuaaugccaucaucagu

SEQ ID NO: 3615006 - RNA, 12 nt, Salmonella enterica enterica serovar Typhi
gaguuccuccug

SEQ ID NO: 3615007 - RNA, 15 nt, Salmonella enterica enterica serovar Typhi
gaguucgguuaacug

SEQ ID NO: 3615008 - RNA, 23 nt, Salmonella enterica enterica serovar Typhi
gaguugcuuaaaagcggcaaggg

SEQ ID NO: 3615009 - RNA, 23 nt, Salmonella enterica enterica serovar Typhi
gaguuggcauucgaauccuccug

SEQ ID NO: 3615010 - RNA, 14 nt, Salmonella enterica enterica serovar Typhi
gaguuugucaucca

SEQ ID NO: 3615011 - RNA, 17 nt, Salmonella enterica enterica serovar Typhi
gaguuuuuuauggcaga

SEQ ID NO: 3615012 - RNA, 16 nt, Salmonella enterica enterica serovar Typhi
gauaaaaaaaguaucc

SEQ ID NO: 3615013 - RNA, 18 nt, Salmonella enterica enterica serovar Typhi
gauaaaaacacccgcacc

SEQ ID NO: 3615014 - RNA, 21 nt, Salmonella enterica enterica serovar Typhi
gauaaaaacccaccagcgcca

SEQ ID NO: 3615015 - RNA, 16 nt, Salmonella enterica enterica serovar Typhi
gauaaaaagacagaua

SEQ ID NO: 3615016 - RNA, 19 nt, Salmonella enterica enterica serovar Typhi
gauaaaauccgaaaugacc

SEQ ID NO: 3615017 - RNA, 19 nt, Salmonella enterica enterica serovar Typhi
gauaaaauucccggcggaa

SEQ ID NO: 3615018 - RNA, 13 nt, Salmonella enterica enterica serovar Typhi
gauaaaauuguua

SEQ ID NO: 3615019 - RNA, 18 nt, Salmonella enterica enterica serovar Typhi
gauaaacagguaaaacaa

SEQ ID NO: 3615020 - RNA, 22 nt, Salmonella enterica enterica serovar Typhi
gauaaacggcuuuaguucagca

SEQ ID NO: 3615021 - RNA, 18 nt, Salmonella enterica enterica serovar Typhi
gauaaacgggaaguaagg

SEQ ID NO: 3615022 - RNA, 19 nt, Salmonella enterica enterica serovar Typhi
gauaaacugacaucccccu

SEQ ID NO: 3615023 - RNA, 14 nt, Salmonella enterica enterica serovar Typhi
gauaaacugcgcca

SEQ ID NO: 3615024 - RNA, 16 nt, Salmonella enterica enterica serovar Typhi
gauaaagaacgcgccg

SEQ ID NO: 3615025 - RNA, 21 nt, Salmonella enterica enterica serovar Typhi
gauaaagaacgcgccgaccau

SEQ ID NO: 3615026 - RNA, 20 nt, Salmonella enterica enterica serovar Typhi
gauaaagaccggcacaaccg

SEQ ID NO: 3615027 - RNA, 14 nt, Salmonella enterica enterica serovar Typhi
gauaaagcagcgac

SEQ ID NO: 3615028 - RNA, 15 nt, Salmonella enterica enterica serovar Typhi
gauaaagcagcgaca

SEQ ID NO: 3615029 - RNA, 17 nt, Salmonella enterica enterica serovar Typhi
gauaaagcgaauaacau

SEQ ID NO: 3615030 - RNA, 22 nt, Salmonella enterica enterica serovar Typhi
gauaaagcgcucaugccacgcc

SEQ ID NO: 3615031 - RNA, 18 nt, Salmonella enterica enterica serovar Typhi
gauaaagcugacgcgccu

SEQ ID NO: 3615032 - RNA, 19 nt, Salmonella enterica enterica serovar Typhi
gauaaagcugaguaaggac

SEQ ID NO: 3615033 - RNA, 16 nt, Salmonella enterica enterica serovar Typhi
gauaaagcuucugcgc

SEQ ID NO: 3615034 - RNA, 18 nt, Salmonella enterica enterica serovar Typhi
gauaaagguacuuucccc

SEQ ID NO: 3615035 - RNA, 19 nt, Salmonella enterica enterica serovar Typhi
gauaaaguacggcgcgcca

SEQ ID NO: 3615036 - RNA, 16 nt, Salmonella enterica enterica serovar Typhi
gauaaagugacgaggc

SEQ ID NO: 3615037 - RNA, 22 nt, Salmonella enterica enterica serovar Typhi
gauaaaguuagcguuauggaag

SEQ ID NO: 3615038 - RNA, 12 nt, Salmonella enterica enterica serovar Typhi
gauaaauaagag

SEQ ID NO: 3615039 - RNA, 20 nt, Salmonella enterica enterica serovar Typhi
gauaaauguuuacuucgcuu

SEQ ID NO: 3615040 - RNA, 14 nt, Salmonella enterica enterica serovar Typhi
gauaaauucugucu

SEQ ID NO: 3615041 - RNA, 20 nt, Salmonella enterica enterica serovar Typhi
gauaacaccagcgauccaga

SEQ ID NO: 3615042 - RNA, 20 nt, Salmonella enterica enterica serovar Typhi
gauaacaccgcauggcuggc

SEQ ID NO: 3615043 - RNA, 11 nt, Salmonella enterica enterica serovar Typhi
gauaaccagaa

SEQ ID NO: 3615044 - RNA, 12 nt, Salmonella enterica enterica serovar Typhi
gauaaccagguc

SEQ ID NO: 3615045 - RNA, 14 nt, Salmonella enterica enterica serovar Typhi
gauaaccaggucac

SEQ ID NO: 3615046 - RNA, 20 nt, Salmonella enterica enterica serovar Typhi
gauaaccccguucgacaacg

SEQ ID NO: 3615047 - RNA, 14 nt, Salmonella enterica enterica serovar Typhi
gauaaccgccgcca

SEQ ID NO: 3615048 - RNA, 19 nt, Salmonella enterica enterica serovar Typhi
gauaaccgcguucauacgc

SEQ ID NO: 3615049 - RNA, 23 nt, Salmonella enterica enterica serovar Typhi
gauaaccuauuuugcaaaacuga

SEQ ID NO: 3615050 - RNA, 18 nt, Salmonella enterica enterica serovar Typhi
gauaaccuguaaauaaua

SEQ ID NO: 3615051 - RNA, 16 nt, Salmonella enterica enterica serovar Typhi
gauaaccuuccggcac

SEQ ID NO: 3615052 - RNA, 15 nt, Salmonella enterica enterica serovar Typhi
gauaacgaaaagggu

SEQ ID NO: 3615053 - RNA, 14 nt, Salmonella enterica enterica serovar Typhi
gauaacgaaccauc

SEQ ID NO: 3615054 - RNA, 19 nt, Salmonella enterica enterica serovar Typhi
gauaacgaauuaagcggau

SEQ ID NO: 3615055 - RNA, 22 nt, Salmonella enterica enterica serovar Typhi
gauaacgcgauggccaaauaac

SEQ ID NO: 3615056 - RNA, 16 nt, Salmonella enterica enterica serovar Typhi
gauaacgcgcuggcgg

SEQ ID NO: 3615057 - RNA, 22 nt, Salmonella enterica enterica serovar Typhi
gauaacgcuaugcuuauccggc

SEQ ID NO: 3615058 - RNA, 18 nt, Salmonella enterica enterica serovar Typhi
gauaacggcgcaaagaca

SEQ ID NO: 3615059 - RNA, 11 nt, Salmonella enterica enterica serovar Typhi
gauaacgugcg

SEQ ID NO: 3615060 - RNA, 20 nt, Salmonella enterica enterica serovar Typhi
gauaacugaagguuuuuccc

SEQ ID NO: 3615061 - RNA, 14 nt, Salmonella enterica enterica serovar Typhi
gauaacuuucgggu

SEQ ID NO: 3615062 - RNA, 15 nt, Salmonella enterica enterica serovar Typhi
gauaagagaaaauac

SEQ ID NO: 3615063 - RNA, 20 nt, Salmonella enterica enterica serovar Typhi
gauaagcaacgcgccauccg

SEQ ID NO: 3615064 - RNA, 23 nt, Salmonella enterica enterica serovar Typhi
gauacuaaagggaucuuccugcg

SEQ ID NO: 3615065 - RNA, 18 nt, Salmonella enterica enterica serovar Typhi
gauacucagccccaggcc

SEQ ID NO: 3615066 - RNA, 20 nt, Salmonella enterica enterica serovar Typhi
gauacuccauugucggcagc

SEQ ID NO: 3615067 - RNA, 17 nt, Salmonella enterica enterica serovar Typhi
gauacugcaacgccaga

SEQ ID NO: 3615068 - RNA, 21 nt, Salmonella enterica enterica serovar Typhi
gauacugcaacgccagaugcg

SEQ ID NO: 3615069 - RNA, 21 nt, Salmonella enterica enterica serovar Typhi
gauacugccgcccaucgccac

SEQ ID NO: 3615070 - RNA, 22 nt, Salmonella enterica enterica serovar Typhi
gauacugcgcucuaucaccgcc

SEQ ID NO: 3615071 - RNA, 18 nt, Salmonella enterica enterica serovar Typhi
gauacugcuccggcgcga

SEQ ID NO: 3615072 - RNA, 21 nt, Salmonella enterica enterica serovar Typhi
gauacuggaagugauccuuca

SEQ ID NO: 3615073 - RNA, 14 nt, Salmonella enterica enterica serovar Typhi
gauacuguuuuugc

SEQ ID NO: 3615074 - RNA, 19 nt, Salmonella enterica enterica serovar Typhi
gauagaaccacgcaaaggc

SEQ ID NO: 3615075 - RNA, 16 nt, Salmonella enterica enterica serovar Typhi
gauagaaguuaugcau

SEQ ID NO: 3615076 - RNA, 22 nt, Salmonella enterica enterica serovar Typhi
gauagagguuaccgggcuaaac

SEQ ID NO: 3615077 - RNA, 23 nt, Salmonella enterica enterica serovar Typhi
gauagauuugauucguuuaagua

SEQ ID NO: 3615078 - RNA, 21 nt, Salmonella enterica enterica serovar Typhi
gauagcaaucauccugauuuu

SEQ ID NO: 3615079 - RNA, 14 nt, Salmonella enterica enterica serovar Typhi
gauagcaucuuccu

SEQ ID NO: 3615080 - RNA, 22 nt, Salmonella enterica enterica serovar Typhi
gauagcccgccagcaccagcag

SEQ ID NO: 3615081 - RNA, 12 nt, Salmonella enterica enterica serovar Typhi
gauagccgccag

SEQ ID NO: 3615082 - RNA, 17 nt, Salmonella enterica enterica serovar Typhi
gauagccguucuccagc

SEQ ID NO: 3615083 - RNA, 11 nt, Salmonella enterica enterica serovar Typhi
gauagccuuau

SEQ ID NO: 3615084 - RNA, 17 nt, Salmonella enterica enterica serovar Typhi
gauagcgaggcagcagg

SEQ ID NO: 3615085 - RNA, 19 nt, Salmonella enterica enterica serovar Typhi
gauagcgccauggagaaac

SEQ ID NO: 3615086 - RNA, 23 nt, Salmonella enterica enterica serovar Typhi
gauagcgccccaaagcgcauccg

SEQ ID NO: 3615087 - RNA, 13 nt, Salmonella enterica enterica serovar Typhi
gauagcgccgcau

SEQ ID NO: 3615088 - RNA, 20 nt, Salmonella enterica enterica serovar Typhi
gauagcgcgccagcaccagg

SEQ ID NO: 3615089 - RNA, 17 nt, Salmonella enterica enterica serovar Typhi
gauagcgggcaaugcca

SEQ ID NO: 3615090 - RNA, 15 nt, Salmonella enterica enterica serovar Typhi
gauagcguagcgcca

SEQ ID NO: 3615091 - RNA, 14 nt, Salmonella enterica enterica serovar Typhi
gauagcgucaacgc

SEQ ID NO: 3615092 - RNA, 15 nt, Salmonella enterica enterica serovar Typhi
gauagcgucaacgcu

SEQ ID NO: 3615093 - RNA, 15 nt, Salmonella enterica enterica serovar Typhi
gauagcguuuuccag

SEQ ID NO: 3615094 - RNA, 16 nt, Salmonella enterica enterica serovar Typhi
gauagcguuuuccagc

SEQ ID NO: 3615095 - RNA, 23 nt, Salmonella enterica enterica serovar Typhi
gauagcuuguuguuuauccugca

SEQ ID NO: 3615096 - RNA, 18 nt, Salmonella enterica enterica serovar Typhi
gauagcuuuguauauguu

SEQ ID NO: 3615097 - RNA, 22 nt, Salmonella enterica enterica serovar Typhi
gauaggcgcgucauaaccgcag

SEQ ID NO: 3615098 - RNA, 13 nt, Salmonella enterica enterica serovar Typhi
gauagggcagcag

SEQ ID NO: 3615099 - RNA, 14 nt, Salmonella enterica enterica serovar Typhi
gauagggcagcagu

SEQ ID NO: 3615100 - RNA, 15 nt, Salmonella enterica enterica serovar Typhi
gauagggcagcaguu

SEQ ID NO: 3615101 - RNA, 16 nt, Salmonella enterica enterica serovar Typhi
gauagggcagcaguuc

SEQ ID NO: 3615102 - RNA, 22 nt, Salmonella enterica enterica serovar Typhi
gauagguucaauaugccaggca

SEQ ID NO: 3615103 - RNA, 13 nt, Salmonella enterica enterica serovar Typhi
gauagucaggcga

SEQ ID NO: 3615104 - RNA, 18 nt, Salmonella enterica enterica serovar Typhi
gauagucauugacagcaa

SEQ ID NO: 3615105 - RNA, 22 nt, Salmonella enterica enterica serovar Typhi
gauagucgcgauucgggccgca

SEQ ID NO: 3615106 - RNA, 14 nt, Salmonella enterica enterica serovar Typhi
gauagucuucaagc

SEQ ID NO: 3615107 - RNA, 14 nt, Salmonella enterica enterica serovar Typhi
gauagugccugccg

SEQ ID NO: 3615108 - RNA, 19 nt, Salmonella enterica enterica serovar Typhi
gauagugcugcgcaaauac

SEQ ID NO: 3615109 - RNA, 18 nt, Salmonella enterica enterica serovar Typhi
gauaguguaaacgcgcca

SEQ ID NO: 3615110 - RNA, 19 nt, Salmonella enterica enterica serovar Typhi
gauaguguucgcggcuggu

SEQ ID NO: 3615111 - RNA, 18 nt, Salmonella enterica enterica serovar Typhi
gauaguugagcagcgcga

SEQ ID NO: 3615112 - RNA, 20 nt, Salmonella enterica enterica serovar Typhi
gauaguuuaaauccagcgcg

SEQ ID NO: 3615113 - RNA, 16 nt, Salmonella enterica enterica serovar Typhi
gauauaacccaguuca

SEQ ID NO: 3615114 - RNA, 17 nt, Salmonella enterica enterica serovar Typhi
gauauaacccucauccc

SEQ ID NO: 3615115 - RNA, 23 nt, Salmonella enterica enterica serovar Typhi
gauauagaguccagccauaauca

SEQ ID NO: 3615116 - RNA, 12 nt, Salmonella enterica enterica serovar Typhi
gauauagcgcca

SEQ ID NO: 3615117 - RNA, 16 nt, Salmonella enterica enterica serovar Typhi
gauauagcgccaugcg

SEQ ID NO: 3615118 - RNA, 19 nt, Salmonella enterica enterica serovar Typhi
gauauagcggugcguuucc

SEQ ID NO: 3615119 - RNA, 21 nt, Salmonella enterica enterica serovar Typhi
gauauagcugcgauccagguc

SEQ ID NO: 3615120 - RNA, 14 nt, Salmonella enterica enterica serovar Typhi
gauauagucgccca

SEQ ID NO: 3615121 - RNA, 18 nt, Salmonella enterica enterica serovar Typhi
gauauaucgcgucaucaa

SEQ ID NO: 3615122 - RNA, 23 nt, Salmonella enterica enterica serovar Typhi
gauauaucuucaucguuucugcc

SEQ ID NO: 3615123 - RNA, 13 nt, Salmonella enterica enterica serovar Typhi
gauauaugcaaaa

SEQ ID NO: 3615124 - RNA, 17 nt, Salmonella enterica enterica serovar Typhi
gauauauggcgggaaau

SEQ ID NO: 3615125 - RNA, 14 nt, Salmonella enterica enterica serovar Typhi
gauauauuuuccgu

SEQ ID NO: 3615126 - RNA, 16 nt, Salmonella enterica enterica serovar Typhi
gauaucaaacacaaau

SEQ ID NO: 3615127 - RNA, 20 nt, Salmonella enterica enterica serovar Typhi
gauaucauucucuacgccca

SEQ ID NO: 3615128 - RNA, 20 nt, Salmonella enterica enterica serovar Typhi
gauauccaccaccugauucu

SEQ ID NO: 3615129 - RNA, 21 nt, Salmonella enterica enterica serovar Typhi
gauauccagcaccucaucacc

SEQ ID NO: 3615130 - RNA, 13 nt, Salmonella enterica enterica serovar Typhi
gauauccagcaua

SEQ ID NO: 3615131 - RNA, 22 nt, Salmonella enterica enterica serovar Typhi
gauauccauugggggguuagug

SEQ ID NO: 3615132 - RNA, 22 nt, Salmonella enterica enterica serovar Typhi
gauauccgcgcucaacacauaa

SEQ ID NO: 3615133 - RNA, 21 nt, Salmonella enterica enterica serovar Typhi
gauauccucuuuucgaacgcc

SEQ ID NO: 3615134 - RNA, 23 nt, Salmonella enterica enterica serovar Typhi
gauaucgucauuaacgggaaacu

SEQ ID NO: 3615135 - RNA, 21 nt, Salmonella enterica enterica serovar Typhi
gauaucuucauagcuuagcug

SEQ ID NO: 3615136 - RNA, 23 nt, Salmonella enterica enterica serovar Typhi
gauaucuuccagcgcguccagcc

SEQ ID NO: 3615137 - RNA, 14 nt, Salmonella enterica enterica serovar Typhi
gauaugaauaauuu

SEQ ID NO: 3615138 - RNA, 23 nt, Salmonella enterica enterica serovar Typhi
gauaugaauaauuucggcggcgc

SEQ ID NO: 3615139 - RNA, 13 nt, Salmonella enterica enterica serovar Typhi
gauaugcagcagc

SEQ ID NO: 3615140 - RNA, 17 nt, Salmonella enterica enterica serovar Typhi
gauaugcagcagccagu

SEQ ID NO: 3615141 - RNA, 19 nt, Salmonella enterica enterica serovar Typhi
gauaugcgacgaaagcggc

SEQ ID NO: 3615142 - RNA, 18 nt, Salmonella enterica enterica serovar Typhi
gauaugcuugccggaugc

SEQ ID NO: 3615143 - RNA, 17 nt, Salmonella enterica enterica serovar Typhi
gauauggaugcgcugcu

SEQ ID NO: 3615144 - RNA, 14 nt, Salmonella enterica enterica serovar Typhi
gauauggcggcggc

SEQ ID NO: 3615145 - RNA, 13 nt, Salmonella enterica enterica serovar Typhi
gauauuacagauc

SEQ ID NO: 3615146 - RNA, 15 nt, Salmonella enterica enterica serovar Typhi
gauauuccauacagu

SEQ ID NO: 3615147 - RNA, 15 nt, Salmonella enterica enterica serovar Typhi
gauauucugcacgca

SEQ ID NO: 3615148 - RNA, 22 nt, Salmonella enterica enterica serovar Typhi
gauauugccgaccgccagcaga

SEQ ID NO: 3615149 - RNA, 20 nt, Salmonella enterica enterica serovar Typhi
gaucgcggcaaccguaucca

SEQ ID NO: 3615150 - RNA, 13 nt, Salmonella enterica enterica serovar Typhi
gaucgcuccauuc

SEQ ID NO: 3615151 - RNA, 20 nt, Salmonella enterica enterica serovar Typhi
gaucgcuggugcccgguacg

SEQ ID NO: 3615152 - RNA, 13 nt, Salmonella enterica enterica serovar Typhi
gaucggaacgcga

SEQ ID NO: 3615153 - RNA, 18 nt, Salmonella enterica enterica serovar Typhi
gaucggaagacuggcgca

SEQ ID NO: 3615154 - RNA, 18 nt, Salmonella enterica enterica serovar Typhi
gaucggcaaacagcuuca

SEQ ID NO: 3615155 - RNA, 21 nt, Salmonella enterica enterica serovar Typhi
gaucggccagauaguggcuga

SEQ ID NO: 3615156 - RNA, 14 nt, Salmonella enterica enterica serovar Typhi
gaucggcuggcgca

SEQ ID NO: 3615157 - RNA, 17 nt, Salmonella enterica enterica serovar Typhi
gaucggcuuuaucuuua

SEQ ID NO: 3615158 - RNA, 14 nt, Salmonella enterica enterica serovar Typhi
gaucgguuuauccc

SEQ ID NO: 3615159 - RNA, 15 nt, Salmonella enterica enterica serovar Typhi
gaucguaggcggcgg

SEQ ID NO: 3615160 - RNA, 17 nt, Salmonella enterica enterica serovar Typhi
gaucguaugcgccuguu

SEQ ID NO: 3615161 - RNA, 22 nt, Salmonella enterica enterica serovar Typhi
gaucgucgcgaucgcgccagcc

SEQ ID NO: 3615162 - RNA, 17 nt, Salmonella enterica enterica serovar Typhi
gaucgucgggauaagcg

SEQ ID NO: 3615163 - RNA, 24 nt, Salmonella enterica enterica serovar Typhi
gaucgugccaugaccauucacacu

SEQ ID NO: 3615164 - RNA, 15 nt, Salmonella enterica enterica serovar Typhi
gaucgugccguccgg

SEQ ID NO: 3615165 - RNA, 19 nt, Salmonella enterica enterica serovar Typhi
gaucguuauuaaacagaca

SEQ ID NO: 3615166 - RNA, 14 nt, Salmonella enterica enterica serovar Typhi
gaucuaaagccagu

SEQ ID NO: 3615167 - RNA, 19 nt, Salmonella enterica enterica serovar Typhi
gaucuaaagccaguuucuc

SEQ ID NO: 3615168 - RNA, 15 nt, Salmonella enterica enterica serovar Typhi
gaucuacaaucgucu

SEQ ID NO: 3615169 - RNA, 21 nt, Salmonella enterica enterica serovar Typhi
gaucuacgcuauuuccagaaa

SEQ ID NO: 3615170 - RNA, 11 nt, Salmonella enterica enterica serovar Typhi
gaucuaucuga

SEQ ID NO: 3615171 - RNA, 23 nt, Salmonella enterica enterica serovar Typhi
gaucucauaaacgccuggaguga

SEQ ID NO: 3615172 - RNA, 12 nt, Salmonella enterica enterica serovar Typhi
gaucucauacca

SEQ ID NO: 3615173 - RNA, 15 nt, Salmonella enterica enterica serovar Typhi
gaucucaugcaacug

SEQ ID NO: 3615174 - RNA, 14 nt, Salmonella enterica enterica serovar Typhi
gaucucgucgccgg

SEQ ID NO: 3615175 - RNA, 22 nt, Salmonella enterica enterica serovar Typhi
gaucucuugcauaauauccagg

SEQ ID NO: 3615176 - RNA, 18 nt, Salmonella enterica enterica serovar Typhi
gaucugcuuaugaucgcc

SEQ ID NO: 3615177 - RNA, 20 nt, Salmonella enterica enterica serovar Typhi
gaucugcuugagcaggcaga

SEQ ID NO: 3615178 - RNA, 13 nt, Salmonella enterica enterica serovar Typhi
gaucuggacgcca

SEQ ID NO: 3615179 - RNA, 20 nt, Salmonella enterica enterica serovar Typhi
gaucuggcgcuuuuccagca

SEQ ID NO: 3615180 - RNA, 15 nt, Salmonella enterica enterica serovar Typhi
gaucuguaggccgga

SEQ ID NO: 3615181 - RNA, 21 nt, Salmonella enterica enterica serovar Typhi
gaucuguguacuuuuaacgcc

SEQ ID NO: 3615182 - RNA, 18 nt, Salmonella enterica enterica serovar Typhi
gaucuuaucuuucagcgc

SEQ ID NO: 3615183 - RNA, 12 nt, Salmonella enterica enterica serovar Typhi
gaucuucauccc

SEQ ID NO: 3615184 - RNA, 18 nt, Salmonella enterica enterica serovar Typhi
gaucuucaucccauccgg

SEQ ID NO: 3615185 - RNA, 12 nt, Salmonella enterica enterica serovar Typhi
gaucuuccacua

SEQ ID NO: 3615186 - RNA, 23 nt, Salmonella enterica enterica serovar Typhi
gaucuuccugcgcgccaaaccgu

SEQ ID NO: 3615187 - RNA, 14 nt, Salmonella enterica enterica serovar Typhi
gaucuuuuugcucc

SEQ ID NO: 3615188 - RNA, 11 nt, Salmonella enterica enterica serovar Typhi
gaugaaaaaga

SEQ ID NO: 3615189 - RNA, 20 nt, Salmonella enterica enterica serovar Typhi
gaugaaaaguacgcaaacag

SEQ ID NO: 3615190 - RNA, 20 nt, Salmonella enterica enterica serovar Typhi
gaugaaccauaucaaacagg

SEQ ID NO: 3615191 - RNA, 17 nt, Salmonella enterica enterica serovar Typhi
gaugaccauaaaugaaa

SEQ ID NO: 3615192 - RNA, 20 nt, Salmonella enterica enterica serovar Typhi
gaugacgcuucgcuuauccg

SEQ ID NO: 3615193 - RNA, 17 nt, Salmonella enterica enterica serovar Typhi
gaugacggcagcgcguu

SEQ ID NO: 3615194 - RNA, 19 nt, Salmonella enterica enterica serovar Typhi
gaugacggcaggggcguga

SEQ ID NO: 3615195 - RNA, 19 nt, Salmonella enterica enterica serovar Typhi
gaugacucccaguccggua

SEQ ID NO: 3615196 - RNA, 19 nt, Salmonella enterica enterica serovar Typhi
gaugagauccgggcuggca

SEQ ID NO: 3615197 - RNA, 15 nt, Salmonella enterica enterica serovar Typhi
gaugagcaggccagg

SEQ ID NO: 3615198 - RNA, 21 nt, Salmonella enterica enterica serovar Typhi
gaugagcguuagcgccauccg

SEQ ID NO: 3615199 - RNA, 18 nt, Salmonella enterica enterica serovar Typhi
gaugagcucaaauaugau

SEQ ID NO: 3615200 - RNA, 22 nt, Salmonella enterica enterica serovar Typhi
gaugaggaccguuugugccggg

SEQ ID NO: 3615201 - RNA, 19 nt, Salmonella enterica enterica serovar Typhi
gaugaggcgcagccgccau

SEQ ID NO: 3615202 - RNA, 17 nt, Salmonella enterica enterica serovar Typhi
gaugaguauauagcgcu

SEQ ID NO: 3615203 - RNA, 13 nt, Salmonella enterica enterica serovar Typhi
gaugauauccagc

SEQ ID NO: 3615204 - RNA, 15 nt, Salmonella enterica enterica serovar Typhi
gaugaucuucagccc

SEQ ID NO: 3615205 - RNA, 12 nt, Salmonella enterica enterica serovar Typhi
gaugaucuucau

SEQ ID NO: 3615206 - RNA, 22 nt, Salmonella enterica enterica serovar Typhi
gaugaugcguuuguuggagauc

SEQ ID NO: 3615207 - RNA, 18 nt, Salmonella enterica enterica serovar Typhi
gaugauggaacagacgcc

SEQ ID NO: 3615208 - RNA, 14 nt, Salmonella enterica enterica serovar Typhi
gaugauguacaggu

SEQ ID NO: 3615209 - RNA, 23 nt, Salmonella enterica enterica serovar Typhi
gaugauguuugugaccccggccu

SEQ ID NO: 3615210 - RNA, 16 nt, Salmonella enterica enterica serovar Typhi
gaugauuauuguuaaa

SEQ ID NO: 3615211 - RNA, 13 nt, Salmonella enterica enterica serovar Typhi
gaugauucacccu

SEQ ID NO: 3615212 - RNA, 19 nt, Salmonella enterica enterica serovar Typhi
gaugauuggccuccaccgu

SEQ ID NO: 3615213 - RNA, 13 nt, Salmonella enterica enterica serovar Typhi
gaugcaaauguca

SEQ ID NO: 3615214 - RNA, 15 nt, Salmonella enterica enterica serovar Typhi
gaugcaaugcagaug

SEQ ID NO: 3615215 - RNA, 16 nt, Salmonella enterica enterica serovar Typhi
gaugcaccuuucuccu

SEQ ID NO: 3615216 - RNA, 20 nt, Salmonella enterica enterica serovar Typhi
gaugcaggccaagcagcgcc

SEQ ID NO: 3615217 - RNA, 14 nt, Salmonella enterica enterica serovar Typhi
gaugcaggcgccug

SEQ ID NO: 3615218 - RNA, 15 nt, Salmonella enterica enterica serovar Typhi
gaugcauaaaaaaac

SEQ ID NO: 3615219 - RNA, 23 nt, Salmonella enterica enterica serovar Typhi
gaugccaaacaucgcucgcgcca

SEQ ID NO: 3615220 - RNA, 11 nt, Salmonella enterica enterica serovar Typhi
gaugccagaug

SEQ ID NO: 3615221 - RNA, 13 nt, Salmonella enterica enterica serovar Typhi
gaugcccauacgg

SEQ ID NO: 3615222 - RNA, 21 nt, Salmonella enterica enterica serovar Typhi
gaugccccaucucuuucagaa

SEQ ID NO: 3615223 - RNA, 19 nt, Salmonella enterica enterica serovar Typhi
gaugccgccgcaacgcgca

SEQ ID NO: 3615224 - RNA, 18 nt, Salmonella enterica enterica serovar Typhi
gaugccggauaauacgaa

SEQ ID NO: 3615225 - RNA, 11 nt, Salmonella enterica enterica serovar Typhi
gaugccguaag

SEQ ID NO: 3615226 - RNA, 15 nt, Salmonella enterica enterica serovar Typhi
gaugccgucgacgcc

SEQ ID NO: 3615227 - RNA, 17 nt, Salmonella enterica enterica serovar Typhi
gaugccguugaccauau

SEQ ID NO: 3615228 - RNA, 20 nt, Salmonella enterica enterica serovar Typhi
gaugccuuguaagccggaua

SEQ ID NO: 3615229 - RNA, 15 nt, Salmonella enterica enterica serovar Typhi
gaugcgaaucuucau

SEQ ID NO: 3615230 - RNA, 15 nt, Salmonella enterica enterica serovar Typhi
gaugcgacucggugc

SEQ ID NO: 3615231 - RNA, 14 nt, Salmonella enterica enterica serovar Typhi
gaugcgccagccag

SEQ ID NO: 3615232 - RNA, 18 nt, Salmonella enterica enterica serovar Typhi
gaugcgccaguucagcgu

SEQ ID NO: 3615233 - RNA, 16 nt, Salmonella enterica enterica serovar Typhi
gaugcgccauccacca

SEQ ID NO: 3615234 - RNA, 14 nt, Salmonella enterica enterica serovar Typhi
gaugcgccauccca

SEQ ID NO: 3615235 - RNA, 20 nt, Salmonella enterica enterica serovar Typhi
gauguccaggcgacaugaca

SEQ ID NO: 3615236 - RNA, 16 nt, Salmonella enterica enterica serovar Typhi
gauguccgcagccgca

SEQ ID NO: 3615237 - RNA, 17 nt, Salmonella enterica enterica serovar Typhi
gauguccgcagccgcau

SEQ ID NO: 3615238 - RNA, 14 nt, Salmonella enterica enterica serovar Typhi
gaugucgccacgcc

SEQ ID NO: 3615239 - RNA, 15 nt, Salmonella enterica enterica serovar Typhi
gaugucgccacgccg

SEQ ID NO: 3615240 - RNA, 23 nt, Salmonella enterica enterica serovar Typhi
gaugucggcuuacgccuuauccg

SEQ ID NO: 3615241 - RNA, 14 nt, Salmonella enterica enterica serovar Typhi
gaugucggucauca

SEQ ID NO: 3615242 - RNA, 20 nt, Salmonella enterica enterica serovar Typhi
gaugugaccuuugugcagga

SEQ ID NO: 3615243 - RNA, 22 nt, Salmonella enterica enterica serovar Typhi
gaugugaccuuugugcaggauc

SEQ ID NO: 3615244 - RNA, 13 nt, Salmonella enterica enterica serovar Typhi
gaugugauaaaug

SEQ ID NO: 3615245 - RNA, 19 nt, Salmonella enterica enterica serovar Typhi
gaugugcuuuuuauuuuuc

SEQ ID NO: 3615246 - RNA, 23 nt, Salmonella enterica enterica serovar Typhi
gaugugucuauuuauugaagaug

SEQ ID NO: 3615247 - RNA, 17 nt, Salmonella enterica enterica serovar Typhi
gauguuacgacccagcg

SEQ ID NO: 3615248 - RNA, 16 nt, Salmonella enterica enterica serovar Typhi
gauguugauacagaaa

SEQ ID NO: 3615249 - RNA, 15 nt, Salmonella enterica enterica serovar Typhi
gauuaacagcgccau

SEQ ID NO: 3615250 - RNA, 13 nt, Salmonella enterica enterica serovar Typhi
gauuaaccagcag

SEQ ID NO: 3615251 - RNA, 21 nt, Salmonella enterica enterica serovar Typhi
gauuaacccggucauccagcg

SEQ ID NO: 3615252 - RNA, 15 nt, Salmonella enterica enterica serovar Typhi
gauuaacggcaaaaa

SEQ ID NO: 3615253 - RNA, 15 nt, Salmonella enterica enterica serovar Typhi
gauuaaggcguuauc

SEQ ID NO: 3615254 - RNA, 17 nt, Salmonella enterica enterica serovar Typhi
gauuaauaaccaauaau

SEQ ID NO: 3615255 - RNA, 20 nt, Salmonella enterica enterica serovar Typhi
gauuaauaauugagcgcaaa

SEQ ID NO: 3615256 - RNA, 16 nt, Salmonella enterica enterica serovar Typhi
gauuaauacaucacuu

SEQ ID NO: 3615257 - RNA, 16 nt, Salmonella enterica enterica serovar Typhi
gauuaaucgucauccc

SEQ ID NO: 3615258 - RNA, 17 nt, Salmonella enterica enterica serovar Typhi
gauuaaugauuugcuuu

SEQ ID NO: 3615259 - RNA, 21 nt, Salmonella enterica enterica serovar Typhi
gauuaaugauuugcuuuauuu

SEQ ID NO: 3615260 - RNA, 15 nt, Salmonella enterica enterica serovar Typhi
gauuacccguuguua

SEQ ID NO: 3615261 - RNA, 22 nt, Salmonella enterica enterica serovar Typhi
gauuaccgggauuuccauauua

SEQ ID NO: 3615262 - RNA, 20 nt, Salmonella enterica enterica serovar Typhi
gauuacuucaggcugccaac

SEQ ID NO: 3615263 - RNA, 14 nt, Salmonella enterica enterica serovar Typhi
gauuagcagagcgg

SEQ ID NO: 3615264 - RNA, 13 nt, Salmonella enterica enterica serovar Typhi
gauuagccccagc

SEQ ID NO: 3615265 - RNA, 21 nt, Salmonella enterica enterica serovar Typhi
gauuagcgacagcgcuauccg

SEQ ID NO: 3615266 - RNA, 16 nt, Salmonella enterica enterica serovar Typhi
gauuagcucauacgcu

SEQ ID NO: 3615267 - RNA, 17 nt, Salmonella enterica enterica serovar Typhi
gauuaggguucacggcg

SEQ ID NO: 3615268 - RNA, 17 nt, Salmonella enterica enterica serovar Typhi
gauuauuucauuaaucu

SEQ ID NO: 3615269 - RNA, 18 nt, Salmonella enterica enterica serovar Typhi
gauuauuuuaucaucagc

SEQ ID NO: 3615270 - RNA, 20 nt, Salmonella enterica enterica serovar Typhi
gauuauuuuaucaucagcac

SEQ ID NO: 3615271 - RNA, 15 nt, Salmonella enterica enterica serovar Typhi
gauuauuuucacgcc

SEQ ID NO: 3615272 - RNA, 14 nt, Salmonella enterica enterica serovar Typhi
gauucaagcgggug

SEQ ID NO: 3615273 - RNA, 21 nt, Salmonella enterica enterica serovar Typhi
gauucaauauugaacauuuuu

SEQ ID NO: 3615274 - RNA, 17 nt, Salmonella enterica enterica serovar Typhi
gauucaccaacugcuga

SEQ ID NO: 3615275 - RNA, 14 nt, Salmonella enterica enterica serovar Typhi
gauucaccaccacc

SEQ ID NO: 3615276 - RNA, 16 nt, Salmonella enterica enterica serovar Typhi
gauucaggccgccagc

SEQ ID NO: 3615277 - RNA, 17 nt, Salmonella enterica enterica serovar Typhi
gauucaugaucuuuccu

SEQ ID NO: 3615278 - RNA, 20 nt, Salmonella enterica enterica serovar Typhi
gauucccagugcgcggucau

SEQ ID NO: 3615279 - RNA, 16 nt, Salmonella enterica enterica serovar Typhi
gauuccccaccaggaa

SEQ ID NO: 3615280 - RNA, 22 nt, Salmonella enterica enterica serovar Typhi
gauuccggacaacgcaaacugu

SEQ ID NO: 3615281 - RNA, 16 nt, Salmonella enterica enterica serovar Typhi
gauuccgucaugguga

SEQ ID NO: 3615282 - RNA, 21 nt, Salmonella enterica enterica serovar Typhi
gauuccgugguuuguugcgcg

SEQ ID NO: 3615283 - RNA, 17 nt, Salmonella enterica enterica serovar Typhi
gauucgagcgcagcgag

SEQ ID NO: 3615284 - RNA, 13 nt, Salmonella enterica enterica serovar Typhi
gauucgccagcgu

SEQ ID NO: 3615285 - RNA, 14 nt, Salmonella enterica enterica serovar Typhi
gauucgcccacgga

SEQ ID NO: 3615286 - RNA, 16 nt, Salmonella enterica enterica serovar Typhi
gauucgccguucuguu

SEQ ID NO: 3615287 - RNA, 20 nt, Salmonella enterica enterica serovar Typhi
gauucgcuaauaauucugua

SEQ ID NO: 3615288 - RNA, 14 nt, Salmonella enterica enterica serovar Typhi
gauucggacucaua

SEQ ID NO: 3615289 - RNA, 18 nt, Salmonella enterica enterica serovar Typhi
gauucgugacaucaagcc

SEQ ID NO: 3615290 - RNA, 20 nt, Salmonella enterica enterica serovar Typhi
gauucguuuuuacacugaag

SEQ ID NO: 3615291 - RNA, 15 nt, Salmonella enterica enterica serovar Typhi
gauucugccaguuca

SEQ ID NO: 3615292 - RNA, 15 nt, Salmonella enterica enterica serovar Typhi
gauugaaacgaaaac

SEQ ID NO: 3615293 - RNA, 22 nt, Salmonella enterica enterica serovar Typhi
gauugaaacucgccaugccauc

SEQ ID NO: 3615294 - RNA, 13 nt, Salmonella enterica enterica serovar Typhi
gauugaauaaugc

SEQ ID NO: 3615295 - RNA, 16 nt, Salmonella enterica enterica serovar Typhi
gauugacgguuugucu

SEQ ID NO: 3615296 - RNA, 17 nt, Salmonella enterica enterica serovar Typhi
gauugagcguuucccgc

SEQ ID NO: 3615297 - RNA, 20 nt, Salmonella enterica enterica serovar Typhi
gauugaggcggguaauuugc

SEQ ID NO: 3615298 - RNA, 21 nt, Salmonella enterica enterica serovar Typhi
gauugaggcggguaauuugcg

SEQ ID NO: 3615299 - RNA, 21 nt, Salmonella enterica enterica serovar Typhi
gauugagggggaggcggcgag

SEQ ID NO: 3615300 - RNA, 17 nt, Salmonella enterica enterica serovar Typhi
gauugauuuuguaaucu

SEQ ID NO: 3615301 - RNA, 14 nt, Salmonella enterica enterica serovar Typhi
gauugcaagaauau

SEQ ID NO: 3615302 - RNA, 22 nt, Salmonella enterica enterica serovar Typhi
gauugcauaucgcuaaaccaaa

SEQ ID NO: 3615303 - RNA, 20 nt, Salmonella enterica enterica serovar Typhi
gauugcccuccagccauaau

SEQ ID NO: 3615304 - RNA, 22 nt, Salmonella enterica enterica serovar Typhi
gauugccgccaucuuuacccug

SEQ ID NO: 3615305 - RNA, 17 nt, Salmonella enterica enterica serovar Typhi
gauuggaucggcgcuga

SEQ ID NO: 3615306 - RNA, 13 nt, Salmonella enterica enterica serovar Typhi
gauuggucugauu

SEQ ID NO: 3615307 - RNA, 18 nt, Salmonella enterica enterica serovar Typhi
gauuuaaaacaagcagua

SEQ ID NO: 3615308 - RNA, 16 nt, Salmonella enterica enterica serovar Typhi
gauuuaagcuuaauuu

SEQ ID NO: 3615309 - RNA, 20 nt, Salmonella enterica enterica serovar Typhi
gauuuacaaccgcaccggau

SEQ ID NO: 3615310 - RNA, 19 nt, Salmonella enterica enterica serovar Typhi
gauuuaucacccagagauu

SEQ ID NO: 3615311 - RNA, 15 nt, Salmonella enterica enterica serovar Typhi
gauuuaucacguccu

SEQ ID NO: 3615312 - RNA, 22 nt, Salmonella enterica enterica serovar Typhi
gauuuaucuucucuaucagcgc

SEQ ID NO: 3615313 - RNA, 12 nt, Salmonella enterica enterica serovar Typhi
gauuuaugaaua

SEQ ID NO: 3615314 - RNA, 21 nt, Salmonella enterica enterica serovar Typhi
gauuuauguaccgucaucgcc

SEQ ID NO: 3615315 - RNA, 18 nt, Salmonella enterica enterica serovar Typhi
gauuuauuuugaauuuuu

SEQ ID NO: 3615316 - RNA, 16 nt, Salmonella enterica enterica serovar Typhi
gauuucaucaggcuga

SEQ ID NO: 3615317 - RNA, 14 nt, Salmonella enterica enterica serovar Typhi
gauuucauccucuu

SEQ ID NO: 3615318 - RNA, 13 nt, Salmonella enterica enterica serovar Typhi
gauuuccagcgcc

SEQ ID NO: 3615319 - RNA, 14 nt, Salmonella enterica enterica serovar Typhi
gauuuccagcgccg

SEQ ID NO: 3615320 - RNA, 16 nt, Salmonella enterica enterica serovar Typhi
gauuuccauauuaacg

SEQ ID NO: 3615321 - RNA, 14 nt, Salmonella enterica enterica serovar Typhi
gcaagaaacaggcu

SEQ ID NO: 3615322 - RNA, 14 nt, Salmonella enterica enterica serovar Typhi
gcaagaaacaucau

SEQ ID NO: 3615323 - RNA, 19 nt, Salmonella enterica enterica serovar Typhi
gcaagaaccgcuuuuccug

SEQ ID NO: 3615324 - RNA, 13 nt, Salmonella enterica enterica serovar Typhi
gcaagaaguuccg

SEQ ID NO: 3615325 - RNA, 16 nt, Salmonella enterica enterica serovar Typhi
gcaagaauuaaauaac

SEQ ID NO: 3615326 - RNA, 22 nt, Salmonella enterica enterica serovar Typhi
gcaagacacagcgucgcgcgau

SEQ ID NO: 3615327 - RNA, 15 nt, Salmonella enterica enterica serovar Typhi
gcaagacgaaaaaug

SEQ ID NO: 3615328 - RNA, 17 nt, Salmonella enterica enterica serovar Typhi
gcaagacgaaaaaugaa

SEQ ID NO: 3615329 - RNA, 14 nt, Salmonella enterica enterica serovar Typhi
gcaagagaaauaac

SEQ ID NO: 3615330 - RNA, 15 nt, Salmonella enterica enterica serovar Typhi
gcaagcagcauaaug

SEQ ID NO: 3615331 - RNA, 17 nt, Salmonella enterica enterica serovar Typhi
gcaagcauaaaaaacau

SEQ ID NO: 3615332 - RNA, 22 nt, Salmonella enterica enterica serovar Typhi
gcaagcaucugauauaucuuca

SEQ ID NO: 3615333 - RNA, 19 nt, Salmonella enterica enterica serovar Typhi
gcaagccgaacucuuccac

SEQ ID NO: 3615334 - RNA, 14 nt, Salmonella enterica enterica serovar Typhi
gcaagcgaagcgcc

SEQ ID NO: 3615335 - RNA, 14 nt, Salmonella enterica enterica serovar Typhi
gcaagcgccagcau

SEQ ID NO: 3615336 - RNA, 19 nt, Salmonella enterica enterica serovar Typhi
gcaagcguaagagaacagg

SEQ ID NO: 3615337 - RNA, 15 nt, Salmonella enterica enterica serovar Typhi
gcaagcucagcggca

SEQ ID NO: 3615338 - RNA, 19 nt, Salmonella enterica enterica serovar Typhi
gcaaggaaaaccaguaacg

SEQ ID NO: 3615339 - RNA, 18 nt, Salmonella enterica enterica serovar Typhi
gcaaggaaauauuaauua

SEQ ID NO: 3615340 - RNA, 13 nt, Salmonella enterica enterica serovar Typhi
gcaaggccgagcg

SEQ ID NO: 3615341 - RNA, 14 nt, Salmonella enterica enterica serovar Typhi
gcaaguauacuuau

SEQ ID NO: 3615342 - RNA, 13 nt, Salmonella enterica enterica serovar Typhi
gcaaguaugaaaa

SEQ ID NO: 3615343 - RNA, 16 nt, Salmonella enterica enterica serovar Typhi
gcaaguauuggcugcc

SEQ ID NO: 3615344 - RNA, 14 nt, Salmonella enterica enterica serovar Typhi
gcaagucaccauca

SEQ ID NO: 3615345 - RNA, 18 nt, Salmonella enterica enterica serovar Typhi
gcaagucgcgggcgcuaa

SEQ ID NO: 3615346 - RNA, 19 nt, Salmonella enterica enterica serovar Typhi
gcaaguucuuguuucaucg

SEQ ID NO: 3615347 - RNA, 18 nt, Salmonella enterica enterica serovar Typhi
gcaaguugcgccacugcc

SEQ ID NO: 3615348 - RNA, 19 nt, Salmonella enterica enterica serovar Typhi
gcaauaaaaauaucauuaa

SEQ ID NO: 3615349 - RNA, 14 nt, Salmonella enterica enterica serovar Typhi
gcaauaaaaggaau

SEQ ID NO: 3615350 - RNA, 24 nt, Salmonella enterica enterica serovar Typhi
gcaauaaacuaaguaaggaggaau

SEQ ID NO: 3615351 - RNA, 19 nt, Salmonella enterica enterica serovar Typhi
gcaauaaacucccgcauau

SEQ ID NO: 3615352 - RNA, 22 nt, Salmonella enterica enterica serovar Typhi
gcaauaaacucccgcauauauu

SEQ ID NO: 3615353 - RNA, 18 nt, Salmonella enterica enterica serovar Typhi
gcaauaaagcagggcggc

SEQ ID NO: 3615354 - RNA, 17 nt, Salmonella enterica enterica serovar Typhi
gcaauaacaccggcggc

SEQ ID NO: 3615355 - RNA, 13 nt, Salmonella enterica enterica serovar Typhi
gcaauaauccgcu

SEQ ID NO: 3615356 - RNA, 16 nt, Salmonella enterica enterica serovar Typhi
gcaauaccaauuaccg

SEQ ID NO: 3615357 - RNA, 14 nt, Salmonella enterica enterica serovar Typhi
gcaauaccuguaaa

SEQ ID NO: 3615358 - RNA, 15 nt, Salmonella enterica enterica serovar Typhi
gcaauacuguaagcc

SEQ ID NO: 3615359 - RNA, 14 nt, Salmonella enterica enterica serovar Typhi
gcaauagaguaaug

SEQ ID NO: 3615360 - RNA, 15 nt, Salmonella enterica enterica serovar Typhi
gcaauagaguaauga

SEQ ID NO: 3615361 - RNA, 22 nt, Salmonella enterica enterica serovar Typhi
gcaauagcgacguuaucucgcc

SEQ ID NO: 3615362 - RNA, 23 nt, Salmonella enterica enterica serovar Typhi
gcaauagcgacguuaucucgcca

SEQ ID NO: 3615363 - RNA, 15 nt, Salmonella enterica enterica serovar Typhi
gcaauagcgcgucgu

SEQ ID NO: 3615364 - RNA, 23 nt, Salmonella enterica enterica serovar Typhi
gcaauagguuugaccagauaauc

SEQ ID NO: 3615365 - RNA, 13 nt, Salmonella enterica enterica serovar Typhi
gcaauauccuccg

SEQ ID NO: 3615366 - RNA, 19 nt, Salmonella enterica enterica serovar Typhi
gcaauaugucuuaaacagc

SEQ ID NO: 3615367 - RNA, 22 nt, Salmonella enterica enterica serovar Typhi
gcaauaugucuuaaacagcgau

SEQ ID NO: 3615368 - RNA, 22 nt, Salmonella enterica enterica serovar Typhi
gcaauauuaaugucaugcgcca

SEQ ID NO: 3615369 - RNA, 23 nt, Salmonella enterica enterica serovar Typhi
gcaauauucaugccagaagcaaa

SEQ ID NO: 3615370 - RNA, 14 nt, Salmonella enterica enterica serovar Typhi
gcaauauugccgca

SEQ ID NO: 3615371 - RNA, 17 nt, Salmonella enterica enterica serovar Typhi
gcaauauuguuaaccag

SEQ ID NO: 3615372 - RNA, 18 nt, Salmonella enterica enterica serovar Typhi
gcaauauuguuaaccagg

SEQ ID NO: 3615373 - RNA, 21 nt, Salmonella enterica enterica serovar Typhi
gcaaucaauacagagauauua

SEQ ID NO: 3615374 - RNA, 16 nt, Salmonella enterica enterica serovar Typhi
gcaaucacauacagca

SEQ ID NO: 3615375 - RNA, 15 nt, Salmonella enterica enterica serovar Typhi
gcaaucacgcguuau

SEQ ID NO: 3615376 - RNA, 16 nt, Salmonella enterica enterica serovar Typhi
gcaaucacuuccgccu

SEQ ID NO: 3615377 - RNA, 20 nt, Salmonella enterica enterica serovar Typhi
gcaaucaguacgcgcgcggc

SEQ ID NO: 3615378 - RNA, 21 nt, Salmonella enterica enterica serovar Typhi
gcaaucaguacgcgcgcggcg

SEQ ID NO: 3615379 - RNA, 15 nt, Salmonella enterica enterica serovar Typhi
gcaaucaucagaccg

SEQ ID NO: 3615380 - RNA, 14 nt, Salmonella enterica enterica serovar Typhi
gcaaucaugacaga

SEQ ID NO: 3615381 - RNA, 11 nt, Salmonella enterica enterica serovar Typhi
gcaauccgcgc

SEQ ID NO: 3615382 - RNA, 15 nt, Salmonella enterica enterica serovar Typhi
gcaaucucacugccc

SEQ ID NO: 3615383 - RNA, 12 nt, Salmonella enterica enterica serovar Typhi
gcaaucucuuua

SEQ ID NO: 3615384 - RNA, 11 nt, Salmonella enterica enterica serovar Typhi
gcaaucuggcg

SEQ ID NO: 3615385 - RNA, 15 nt, Salmonella enterica enterica serovar Typhi
gcaaucuuugccgca

SEQ ID NO: 3615386 - RNA, 13 nt, Salmonella enterica enterica serovar Typhi
gcaaugaacagca

SEQ ID NO: 3615387 - RNA, 12 nt, Salmonella enterica enterica serovar Typhi
gcaaugaccaca

SEQ ID NO: 3615388 - RNA, 17 nt, Salmonella enterica enterica serovar Typhi
gcaaugauaacggcgcc

SEQ ID NO: 3615389 - RNA, 18 nt, Salmonella enterica enterica serovar Typhi
gcaaugauaacggcgcca

SEQ ID NO: 3615390 - RNA, 12 nt, Salmonella enterica enterica serovar Typhi
gcaaugccacca

SEQ ID NO: 3615391 - RNA, 21 nt, Salmonella enterica enterica serovar Typhi
gcaaugccauauuuaccuuuu

SEQ ID NO: 3615392 - RNA, 18 nt, Salmonella enterica enterica serovar Typhi
gcaaugcccgguuuuuua

SEQ ID NO: 3615393 - RNA, 16 nt, Salmonella enterica enterica serovar Typhi
gcaaugccgccgccag

SEQ ID NO: 3615394 - RNA, 18 nt, Salmonella enterica enterica serovar Typhi
gcaaugccuaccggcggc

SEQ ID NO: 3615395 - RNA, 21 nt, Salmonella enterica enterica serovar Typhi
gcaaugcgcuuuuuuugcccu

SEQ ID NO: 3615396 - RNA, 23 nt, Salmonella enterica enterica serovar Typhi
gcaaugcugacgacauucagcac

SEQ ID NO: 3615397 - RNA, 18 nt, Salmonella enterica enterica serovar Typhi
gcaauggccgcagcgcca

SEQ ID NO: 3615398 - RNA, 20 nt, Salmonella enterica enterica serovar Typhi
gcaauggccgcagcgccaua

SEQ ID NO: 3615399 - RNA, 18 nt, Salmonella enterica enterica serovar Typhi
gcaaugggggcuugcgcc

SEQ ID NO: 3615400 - RNA, 24 nt, Salmonella enterica enterica serovar Typhi
gcaaugucaucguuugcgcuacgc

SEQ ID NO: 3615401 - RNA, 21 nt, Salmonella enterica enterica serovar Typhi
gcaaugugcgccagaauugcc

SEQ ID NO: 3615402 - RNA, 18 nt, Salmonella enterica enterica serovar Typhi
gcaauguucaauaucaaa

SEQ ID NO: 3615403 - RNA, 17 nt, Salmonella enterica enterica serovar Typhi
gcaauguuccccugaug

SEQ ID NO: 3615404 - RNA, 20 nt, Salmonella enterica enterica serovar Typhi
gcaauguuccccugaugcgu

SEQ ID NO: 3615405 - RNA, 17 nt, Salmonella enterica enterica serovar Typhi
gcaauuccgcuuucuuc

SEQ ID NO: 3615406 - RNA, 14 nt, Salmonella enterica enterica serovar Typhi
gcaauuccggucau

SEQ ID NO: 3615407 - RNA, 16 nt, Salmonella enterica enterica serovar Typhi
gcaccucuuuaugcgg

SEQ ID NO: 3615408 - RNA, 21 nt, Salmonella enterica enterica serovar Typhi
gcaccugauagugaucgccaa

SEQ ID NO: 3615409 - RNA, 13 nt, Salmonella enterica enterica serovar Typhi
gcaccugggcaau

SEQ ID NO: 3615410 - RNA, 17 nt, Salmonella enterica enterica serovar Typhi
gcaccuggguauuccac

SEQ ID NO: 3615411 - RNA, 15 nt, Salmonella enterica enterica serovar Typhi
gcaccuucaacagcu

SEQ ID NO: 3615412 - RNA, 20 nt, Salmonella enterica enterica serovar Typhi
gcaccuucaacagcucgcca

SEQ ID NO: 3615413 - RNA, 22 nt, Salmonella enterica enterica serovar Typhi
gcaccuucaacagcucgccaug

SEQ ID NO: 3615414 - RNA, 14 nt, Salmonella enterica enterica serovar Typhi
gcaccuucucuccu

SEQ ID NO: 3615415 - RNA, 13 nt, Salmonella enterica enterica serovar Typhi
gcacgaaaaauaa

SEQ ID NO: 3615416 - RNA, 15 nt, Salmonella enterica enterica serovar Typhi
gcacgaaaaauaaaa

SEQ ID NO: 3615417 - RNA, 18 nt, Salmonella enterica enterica serovar Typhi
gcacgaacauaccggagc

SEQ ID NO: 3615418 - RNA, 15 nt, Salmonella enterica enterica serovar Typhi
gcacgacacaaaagc

SEQ ID NO: 3615419 - RNA, 17 nt, Salmonella enterica enterica serovar Typhi
gcacgacacaaaagcau

SEQ ID NO: 3615420 - RNA, 16 nt, Salmonella enterica enterica serovar Typhi
gcacgacagugcuaua

SEQ ID NO: 3615421 - RNA, 21 nt, Salmonella enterica enterica serovar Typhi
gcacgaugcauaugcacagcg

SEQ ID NO: 3615422 - RNA, 16 nt, Salmonella enterica enterica serovar Typhi
gcacgccacauugacc

SEQ ID NO: 3615423 - RNA, 15 nt, Salmonella enterica enterica serovar Typhi
gcacgccaucgccug

SEQ ID NO: 3615424 - RNA, 15 nt, Salmonella enterica enterica serovar Typhi
gcacgccgcccgccu

SEQ ID NO: 3615425 - RNA, 14 nt, Salmonella enterica enterica serovar Typhi
gcacgccgcguuuu

SEQ ID NO: 3615426 - RNA, 15 nt, Salmonella enterica enterica serovar Typhi
gcacgccggccccgc

SEQ ID NO: 3615427 - RNA, 22 nt, Salmonella enterica enterica serovar Typhi
gcacgcgacgcgccagccagcg

SEQ ID NO: 3615428 - RNA, 21 nt, Salmonella enterica enterica serovar Typhi
gcacgcgcagcaucucaucca

SEQ ID NO: 3615429 - RNA, 20 nt, Salmonella enterica enterica serovar Typhi
gcacgcgccgaaugcguuuu

SEQ ID NO: 3615430 - RNA, 21 nt, Salmonella enterica enterica serovar Typhi
gcacgcgggccaauccagcua

SEQ ID NO: 3615431 - RNA, 17 nt, Salmonella enterica enterica serovar Typhi
gcacgcgucaucggcgc

SEQ ID NO: 3615432 - RNA, 22 nt, Salmonella enterica enterica serovar Typhi
gcacgcuaaagcgcuggcggcg

SEQ ID NO: 3615433 - RNA, 22 nt, Salmonella enterica enterica serovar Typhi
gcacgcuauauuccagccagga

SEQ ID NO: 3615434 - RNA, 23 nt, Salmonella enterica enterica serovar Typhi
gcacgcuccugcuccugcggcgu

SEQ ID NO: 3615435 - RNA, 17 nt, Salmonella enterica enterica serovar Typhi
gcacgcuuuuuugcugg

SEQ ID NO: 3615436 - RNA, 22 nt, Salmonella enterica enterica serovar Typhi
gcacgcuuuuuugcuggcuggc

SEQ ID NO: 3615437 - RNA, 16 nt, Salmonella enterica enterica serovar Typhi
gcacggaugcaucaug

SEQ ID NO: 3615438 - RNA, 17 nt, Salmonella enterica enterica serovar Typhi
gcacggcaagcgcggcg

SEQ ID NO: 3615439 - RNA, 17 nt, Salmonella enterica enterica serovar Typhi
gcacggucaaucaucag

SEQ ID NO: 3615440 - RNA, 22 nt, Salmonella enterica enterica serovar Typhi
gcacguagccccuaucuggugc

SEQ ID NO: 3615441 - RNA, 20 nt, Salmonella enterica enterica serovar Typhi
gcacgucauuacgguauuua

SEQ ID NO: 3615442 - RNA, 18 nt, Salmonella enterica enterica serovar Typhi
gcacguccagauacgcgc

SEQ ID NO: 3615443 - RNA, 15 nt, Salmonella enterica enterica serovar Typhi
gcacgucgucccagg

SEQ ID NO: 3615444 - RNA, 22 nt, Salmonella enterica enterica serovar Typhi
gcacuaaagcguugcaggcgau

SEQ ID NO: 3615445 - RNA, 16 nt, Salmonella enterica enterica serovar Typhi
gcacuaacagcagcag

SEQ ID NO: 3615446 - RNA, 19 nt, Salmonella enterica enterica serovar Typhi
gcacuacggauggcccugc

SEQ ID NO: 3615447 - RNA, 18 nt, Salmonella enterica enterica serovar Typhi
gcacuacggcaaacacaa

SEQ ID NO: 3615448 - RNA, 17 nt, Salmonella enterica enterica serovar Typhi
gcacuacggcaaacgcu

SEQ ID NO: 3615449 - RNA, 21 nt, Salmonella enterica enterica serovar Typhi
gcacuacggcaaacgcuggug

SEQ ID NO: 3615450 - RNA, 19 nt, Salmonella enterica enterica serovar Typhi
gcacuaucgggcauuucag

SEQ ID NO: 3615451 - RNA, 13 nt, Salmonella enterica enterica serovar Typhi
gcacucagaaaau

SEQ ID NO: 3615452 - RNA, 15 nt, Salmonella enterica enterica serovar Typhi
gcacucagaaaauua

SEQ ID NO: 3615453 - RNA, 18 nt, Salmonella enterica enterica serovar Typhi
gcacuccccggcuugcgg

SEQ ID NO: 3615454 - RNA, 21 nt, Salmonella enterica enterica serovar Typhi
gcacuccggcucgcacauauc

SEQ ID NO: 3615455 - RNA, 17 nt, Salmonella enterica enterica serovar Typhi
gcacugaauuuacgccg

SEQ ID NO: 3615456 - RNA, 14 nt, Salmonella enterica enterica serovar Typhi
gcacugacuuacag

SEQ ID NO: 3615457 - RNA, 17 nt, Salmonella enterica enterica serovar Typhi
gcacugcaccuggucga

SEQ ID NO: 3615458 - RNA, 15 nt, Salmonella enterica enterica serovar Typhi
gcacugcaggcggga

SEQ ID NO: 3615459 - RNA, 12 nt, Salmonella enterica enterica serovar Typhi
gcacugcugcug

SEQ ID NO: 3615460 - RNA, 18 nt, Salmonella enterica enterica serovar Typhi
gcacugcugcugaaagaa

SEQ ID NO: 3615461 - RNA, 18 nt, Salmonella enterica enterica serovar Typhi
gcacuggcgccugcgccu

SEQ ID NO: 3615462 - RNA, 21 nt, Salmonella enterica enterica serovar Typhi
gcacuggcuuacucgcccugc

SEQ ID NO: 3615463 - RNA, 19 nt, Salmonella enterica enterica serovar Typhi
gcacuucacccaucgccag

SEQ ID NO: 3615464 - RNA, 15 nt, Salmonella enterica enterica serovar Typhi
gcacuuccagccacg

SEQ ID NO: 3615465 - RNA, 17 nt, Salmonella enterica enterica serovar Typhi
gcacuuccucucccacu

SEQ ID NO: 3615466 - RNA, 18 nt, Salmonella enterica enterica serovar Typhi
gcacuuuaagcggcagcu

SEQ ID NO: 3615467 - RNA, 16 nt, Salmonella enterica enterica serovar Typhi
gcacuuucagaccacu

SEQ ID NO: 3615468 - RNA, 12 nt, Salmonella enterica enterica serovar Typhi
gcacuuucauug

SEQ ID NO: 3615469 - RNA, 16 nt, Salmonella enterica enterica serovar Typhi
gcacuuucauugccgu

SEQ ID NO: 3615470 - RNA, 13 nt, Salmonella enterica enterica serovar Typhi
gcacuuuuaucgg

SEQ ID NO: 3615471 - RNA, 15 nt, Salmonella enterica enterica serovar Typhi
gcacuuuuccagcca

SEQ ID NO: 3615472 - RNA, 15 nt, Salmonella enterica enterica serovar Typhi
gcacuuuucccgcca

SEQ ID NO: 3615473 - RNA, 16 nt, Salmonella enterica enterica serovar Typhi
gcacuuuugccaggcg

SEQ ID NO: 3615474 - RNA, 23 nt, Salmonella enterica enterica serovar Typhi
gcagaaaauuaugaauaaccauc

SEQ ID NO: 3615475 - RNA, 15 nt, Salmonella enterica enterica serovar Typhi
gcagaaaggugaaaa

SEQ ID NO: 3615476 - RNA, 22 nt, Salmonella enterica enterica serovar Typhi
gcagaacaaacagaccgccaug

SEQ ID NO: 3615477 - RNA, 15 nt, Salmonella enterica enterica serovar Typhi
gcagaagacagaagc

SEQ ID NO: 3615478 - RNA, 20 nt, Salmonella enterica enterica serovar Typhi
gcagaagacagaagcugaga

SEQ ID NO: 3615479 - RNA, 14 nt, Salmonella enterica enterica serovar Typhi
gcagaagcagaccg

SEQ ID NO: 3615480 - RNA, 16 nt, Salmonella enterica enterica serovar Typhi
gcagaauauuuuucuc

SEQ ID NO: 3615481 - RNA, 21 nt, Salmonella enterica enterica serovar Typhi
gcagaauauuuuucucagcca

SEQ ID NO: 3615482 - RNA, 19 nt, Salmonella enterica enterica serovar Typhi
gcagaaucaggcacaaccc

SEQ ID NO: 3615483 - RNA, 18 nt, Salmonella enterica enterica serovar Typhi
gcagaaucauuaauacac

SEQ ID NO: 3615484 - RNA, 23 nt, Salmonella enterica enterica serovar Typhi
gcagaauggcgauuaacgcauag

SEQ ID NO: 3615485 - RNA, 19 nt, Salmonella enterica enterica serovar Typhi
gcagaauuaacucaucaca

SEQ ID NO: 3615486 - RNA, 22 nt, Salmonella enterica enterica serovar Typhi
gcagaauuaacucaucacagcc

SEQ ID NO: 3615487 - RNA, 23 nt, Salmonella enterica enterica serovar Typhi
gcagaauuaacucaucacagcca

SEQ ID NO: 3615488 - RNA, 20 nt, Salmonella enterica enterica serovar Typhi
gcagacaaaaaaccggaggc

SEQ ID NO: 3615489 - RNA, 20 nt, Salmonella enterica enterica serovar Typhi
gcagacaauuuccgccgcca

SEQ ID NO: 3615490 - RNA, 23 nt, Salmonella enterica enterica serovar Typhi
gcagacaugaccgcacagcagac

SEQ ID NO: 3615491 - RNA, 15 nt, Salmonella enterica enterica serovar Typhi
gcagaccgagcgcau

SEQ ID NO: 3615492 - RNA, 16 nt, Salmonella enterica enterica serovar Typhi
gcagcgagcaccgauc

SEQ ID NO: 3615493 - RNA, 15 nt, Salmonella enterica enterica serovar Typhi
gcagcgauagacugu

SEQ ID NO: 3615494 - RNA, 15 nt, Salmonella enterica enterica serovar Typhi
gcagcgauauuucuc

SEQ ID NO: 3615495 - RNA, 14 nt, Salmonella enterica enterica serovar Typhi
gcagcgcaccugcc

SEQ ID NO: 3615496 - RNA, 20 nt, Salmonella enterica enterica serovar Typhi
gcagcgcauccaccagaccc

SEQ ID NO: 3615497 - RNA, 13 nt, Salmonella enterica enterica serovar Typhi
gcagcgccagcga

SEQ ID NO: 3615498 - RNA, 15 nt, Salmonella enterica enterica serovar Typhi
gcagcgccagugacg

SEQ ID NO: 3615499 - RNA, 13 nt, Salmonella enterica enterica serovar Typhi
gcagcgccaucca

SEQ ID NO: 3615500 - RNA, 16 nt, Salmonella enterica enterica serovar Typhi
gcagcgccauccggca

SEQ ID NO: 3615501 - RNA, 21 nt, Salmonella enterica enterica serovar Typhi
gcagcgccauugagcauucua

SEQ ID NO: 3615502 - RNA, 15 nt, Salmonella enterica enterica serovar Typhi
gcagcgccccgccgc

SEQ ID NO: 3615503 - RNA, 13 nt, Salmonella enterica enterica serovar Typhi
gcagcgccgccug

SEQ ID NO: 3615504 - RNA, 15 nt, Salmonella enterica enterica serovar Typhi
gcagcgcgauggcgu

SEQ ID NO: 3615505 - RNA, 18 nt, Salmonella enterica enterica serovar Typhi
gcagcgcgcgacccagcg

SEQ ID NO: 3615506 - RNA, 20 nt, Salmonella enterica enterica serovar Typhi
gcagcgcgcgacccagcgca

SEQ ID NO: 3615507 - RNA, 13 nt, Salmonella enterica enterica serovar Typhi
gcagcgcggccug

SEQ ID NO: 3615508 - RNA, 14 nt, Salmonella enterica enterica serovar Typhi
gcagcgcggccugc

SEQ ID NO: 3615509 - RNA, 18 nt, Salmonella enterica enterica serovar Typhi
gcagcgcugagucauccu

SEQ ID NO: 3615510 - RNA, 14 nt, Salmonella enterica enterica serovar Typhi
gcagcgcuuucacc

SEQ ID NO: 3615511 - RNA, 13 nt, Salmonella enterica enterica serovar Typhi
gcagcggcaguga

SEQ ID NO: 3615512 - RNA, 14 nt, Salmonella enterica enterica serovar Typhi
gcagcggcauuggc

SEQ ID NO: 3615513 - RNA, 19 nt, Salmonella enterica enterica serovar Typhi
gcagcggcgacaccagcgu

SEQ ID NO: 3615514 - RNA, 11 nt, Salmonella enterica enterica serovar Typhi
gcagcggcggu

SEQ ID NO: 3615515 - RNA, 13 nt, Salmonella enterica enterica serovar Typhi
gcagcggcgguua

SEQ ID NO: 3615516 - RNA, 17 nt, Salmonella enterica enterica serovar Typhi
gcagcggcgguuauccg

SEQ ID NO: 3615517 - RNA, 20 nt, Salmonella enterica enterica serovar Typhi
gcagcggcguaucuuccagc

SEQ ID NO: 3615518 - RNA, 21 nt, Salmonella enterica enterica serovar Typhi
gcagcggcguaucuuccagcg

SEQ ID NO: 3615519 - RNA, 15 nt, Salmonella enterica enterica serovar Typhi
gcagcggcugcgccu

SEQ ID NO: 3615520 - RNA, 21 nt, Salmonella enterica enterica serovar Typhi
gcagcggucaggggucagcgu

SEQ ID NO: 3615521 - RNA, 17 nt, Salmonella enterica enterica serovar Typhi
gcagcguaauacaggcg

SEQ ID NO: 3615522 - RNA, 19 nt, Salmonella enterica enterica serovar Typhi
gcagcguaauacaggcgau

SEQ ID NO: 3615523 - RNA, 19 nt, Salmonella enterica enterica serovar Typhi
gcagcguauugagcuggau

SEQ ID NO: 3615524 - RNA, 19 nt, Salmonella enterica enterica serovar Typhi
gcagcgucagcccaagcug

SEQ ID NO: 3615525 - RNA, 22 nt, Salmonella enterica enterica serovar Typhi
gcagcgucugcccuccugaaua

SEQ ID NO: 3615526 - RNA, 20 nt, Salmonella enterica enterica serovar Typhi
gcagcgugaaacgcccuucc

SEQ ID NO: 3615527 - RNA, 19 nt, Salmonella enterica enterica serovar Typhi
gcagcgugccuucaaauau

SEQ ID NO: 3615528 - RNA, 21 nt, Salmonella enterica enterica serovar Typhi
gcagcgugguuuccggcagcu

SEQ ID NO: 3615529 - RNA, 19 nt, Salmonella enterica enterica serovar Typhi
gcagcguugcuuuguaugu

SEQ ID NO: 3615530 - RNA, 23 nt, Salmonella enterica enterica serovar Typhi
gcagcguuugacggauuuuuuuc

SEQ ID NO: 3615531 - RNA, 20 nt, Salmonella enterica enterica serovar Typhi
gcagcucaagcgccgcgaua

SEQ ID NO: 3615532 - RNA, 16 nt, Salmonella enterica enterica serovar Typhi
gcagcuccgcaauuuc

SEQ ID NO: 3615533 - RNA, 22 nt, Salmonella enterica enterica serovar Typhi
gcagcuccuuuuaauaaagaaa

SEQ ID NO: 3615534 - RNA, 23 nt, Salmonella enterica enterica serovar Typhi
gcagcuccuuuuaauaaagaaag

SEQ ID NO: 3615535 - RNA, 22 nt, Salmonella enterica enterica serovar Typhi
gcagcucugccuguagcagcgc

SEQ ID NO: 3615536 - RNA, 16 nt, Salmonella enterica enterica serovar Typhi
gcagcugccacaccac

SEQ ID NO: 3615537 - RNA, 22 nt, Salmonella enterica enterica serovar Typhi
gcagcugcuguaugauuucacc

SEQ ID NO: 3615538 - RNA, 20 nt, Salmonella enterica enterica serovar Typhi
gcagcugcuuaacuucugca

SEQ ID NO: 3615539 - RNA, 16 nt, Salmonella enterica enterica serovar Typhi
gcagcugggccugcuc

SEQ ID NO: 3615540 - RNA, 15 nt, Salmonella enterica enterica serovar Typhi
gcagcuuaucuuuuu

SEQ ID NO: 3615541 - RNA, 14 nt, Salmonella enterica enterica serovar Typhi
gcagcuuauuccag

SEQ ID NO: 3615542 - RNA, 16 nt, Salmonella enterica enterica serovar Typhi
gcagcuucacgcgcug

SEQ ID NO: 3615543 - RNA, 19 nt, Salmonella enterica enterica serovar Typhi
gcagcuucagcaucaucuc

SEQ ID NO: 3615544 - RNA, 15 nt, Salmonella enterica enterica serovar Typhi
gcagcuuggcggcuu

SEQ ID NO: 3615545 - RNA, 24 nt, Salmonella enterica enterica serovar Typhi
gcaggaaggaauuaugcagacgcu

SEQ ID NO: 3615546 - RNA, 15 nt, Salmonella enterica enterica serovar Typhi
gcaggaaggcgugca

SEQ ID NO: 3615547 - RNA, 15 nt, Salmonella enterica enterica serovar Typhi
gcaggacaaccccua

SEQ ID NO: 3615548 - RNA, 19 nt, Salmonella enterica enterica serovar Typhi
gcaggagagccagaagaau

SEQ ID NO: 3615549 - RNA, 20 nt, Salmonella enterica enterica serovar Typhi
gcaggagcggagagagcgcu

SEQ ID NO: 3615550 - RNA, 12 nt, Salmonella enterica enterica serovar Typhi
gcaggaggcgcg

SEQ ID NO: 3615551 - RNA, 18 nt, Salmonella enterica enterica serovar Typhi
gcaggauccccaucccaa

SEQ ID NO: 3615552 - RNA, 13 nt, Salmonella enterica enterica serovar Typhi
gcaggcaaaucaa

SEQ ID NO: 3615553 - RNA, 23 nt, Salmonella enterica enterica serovar Typhi
gcaggcaauauaccgucaguacc

SEQ ID NO: 3615554 - RNA, 21 nt, Salmonella enterica enterica serovar Typhi
gcaggcacuguggugugccug

SEQ ID NO: 3615555 - RNA, 13 nt, Salmonella enterica enterica serovar Typhi
gcaggcagcgcca

SEQ ID NO: 3615556 - RNA, 18 nt, Salmonella enterica enterica serovar Typhi
gcaggcauaaaaaagagg

SEQ ID NO: 3615557 - RNA, 13 nt, Salmonella enterica enterica serovar Typhi
gcaggcauggcca

SEQ ID NO: 3615558 - RNA, 12 nt, Salmonella enterica enterica serovar Typhi
gcaggccggaua

SEQ ID NO: 3615559 - RNA, 20 nt, Salmonella enterica enterica serovar Typhi
gcaggccggauaaggcauuu

SEQ ID NO: 3615560 - RNA, 18 nt, Salmonella enterica enterica serovar Typhi
gcaggccuggcuggauga

SEQ ID NO: 3615561 - RNA, 21 nt, Salmonella enterica enterica serovar Typhi
gcaggcgaccucgcagguacg

SEQ ID NO: 3615562 - RNA, 18 nt, Salmonella enterica enterica serovar Typhi
gcaggcgauagccccagu

SEQ ID NO: 3615563 - RNA, 21 nt, Salmonella enterica enterica serovar Typhi
gcaggcgauagccccaguaaa

SEQ ID NO: 3615564 - RNA, 20 nt, Salmonella enterica enterica serovar Typhi
gcaggcgcgaccucaucaaa

SEQ ID NO: 3615565 - RNA, 23 nt, Salmonella enterica enterica serovar Typhi
gcaggcgcggcaaugccgcgcuu

SEQ ID NO: 3615566 - RNA, 23 nt, Salmonella enterica enterica serovar Typhi
gcaggcggcaaaaaaugcauuga

SEQ ID NO: 3615567 - RNA, 16 nt, Salmonella enterica enterica serovar Typhi
gcaggcggcuucgcau

SEQ ID NO: 3615568 - RNA, 19 nt, Salmonella enterica enterica serovar Typhi
gcaggcgggugcgcagccc

SEQ ID NO: 3615569 - RNA, 20 nt, Salmonella enterica enterica serovar Typhi
gcaggcgggugcgcagcccc

SEQ ID NO: 3615570 - RNA, 20 nt, Salmonella enterica enterica serovar Typhi
gcaggcgucauagccgcgcg

SEQ ID NO: 3615571 - RNA, 22 nt, Salmonella enterica enterica serovar Typhi
gcaggcgucauagccgcgcguc

SEQ ID NO: 3615572 - RNA, 13 nt, Salmonella enterica enterica serovar Typhi
gcaggcguuucaa

SEQ ID NO: 3615573 - RNA, 17 nt, Salmonella enterica enterica serovar Typhi
gcaggcucaccagccca

SEQ ID NO: 3615574 - RNA, 16 nt, Salmonella enterica enterica serovar Typhi
gcaggcucuuuuucuc

SEQ ID NO: 3615575 - RNA, 21 nt, Salmonella enterica enterica serovar Typhi
gcaggcuggagagcaacgcca

SEQ ID NO: 3615576 - RNA, 17 nt, Salmonella enterica enterica serovar Typhi
gcaggcuuccacgcacg

SEQ ID NO: 3615577 - RNA, 21 nt, Salmonella enterica enterica serovar Typhi
gcauagauaacgaugugacug

SEQ ID NO: 3615578 - RNA, 16 nt, Salmonella enterica enterica serovar Typhi
gcauagccccagcgca

SEQ ID NO: 3615579 - RNA, 23 nt, Salmonella enterica enterica serovar Typhi
gcauagccggauaauuuauccag

SEQ ID NO: 3615580 - RNA, 22 nt, Salmonella enterica enterica serovar Typhi
gcauaguccugccgacaggcag

SEQ ID NO: 3615581 - RNA, 18 nt, Salmonella enterica enterica serovar Typhi
gcauauaagagacgccaa

SEQ ID NO: 3615582 - RNA, 17 nt, Salmonella enterica enterica serovar Typhi
gcauauagugcgugaca

SEQ ID NO: 3615583 - RNA, 14 nt, Salmonella enterica enterica serovar Typhi
gcauauccagcgcc

SEQ ID NO: 3615584 - RNA, 15 nt, Salmonella enterica enterica serovar Typhi
gcauauccagcgccu

SEQ ID NO: 3615585 - RNA, 19 nt, Salmonella enterica enterica serovar Typhi
gcauauccagcgccugcgc

SEQ ID NO: 3615586 - RNA, 13 nt, Salmonella enterica enterica serovar Typhi
gcauaucgcccug

SEQ ID NO: 3615587 - RNA, 12 nt, Salmonella enterica enterica serovar Typhi
gcauaucgccgc

SEQ ID NO: 3615588 - RNA, 23 nt, Salmonella enterica enterica serovar Typhi
gcauaucuggcgaggcuuugucc

SEQ ID NO: 3615589 - RNA, 12 nt, Salmonella enterica enterica serovar Typhi
gcauauuaacag

SEQ ID NO: 3615590 - RNA, 15 nt, Salmonella enterica enterica serovar Typhi
gcauauuucuaauga

SEQ ID NO: 3615591 - RNA, 23 nt, Salmonella enterica enterica serovar Typhi
gcauauuugccccuuccgccacg

SEQ ID NO: 3615592 - RNA, 13 nt, Salmonella enterica enterica serovar Typhi
gcaucaaauaccu

SEQ ID NO: 3615593 - RNA, 22 nt, Salmonella enterica enterica serovar Typhi
gcaucaacguuguccagcggcc

SEQ ID NO: 3615594 - RNA, 22 nt, Salmonella enterica enterica serovar Typhi
gcaucaagcugcuggcgagcag

SEQ ID NO: 3615595 - RNA, 23 nt, Salmonella enterica enterica serovar Typhi
gcaucaagcugcuggcgagcagg

SEQ ID NO: 3615596 - RNA, 17 nt, Salmonella enterica enterica serovar Typhi
gcaucaauaaaaucacc

SEQ ID NO: 3615597 - RNA, 18 nt, Salmonella enterica enterica serovar Typhi
gcaucaaugcccagcgca

SEQ ID NO: 3615598 - RNA, 17 nt, Salmonella enterica enterica serovar Typhi
gcaucacaaugaccucu

SEQ ID NO: 3615599 - RNA, 14 nt, Salmonella enterica enterica serovar Typhi
gcaucacaugcggg

SEQ ID NO: 3615600 - RNA, 15 nt, Salmonella enterica enterica serovar Typhi
gcaucacggcagcac

SEQ ID NO: 3615601 - RNA, 15 nt, Salmonella enterica enterica serovar Typhi
gcaucagaaaaaccu

SEQ ID NO: 3615602 - RNA, 16 nt, Salmonella enterica enterica serovar Typhi
gcaucagaacaaacuu

SEQ ID NO: 3615603 - RNA, 16 nt, Salmonella enterica enterica serovar Typhi
gcaucagacuacuuuu

SEQ ID NO: 3615604 - RNA, 16 nt, Salmonella enterica enterica serovar Typhi
gcaucagacuguuacg

SEQ ID NO: 3615605 - RNA, 22 nt, Salmonella enterica enterica serovar Typhi
gcaucaggaaauccuggauacg

SEQ ID NO: 3615606 - RNA, 23 nt, Salmonella enterica enterica serovar Typhi
gcaucauauaaccacgaaaauua

SEQ ID NO: 3615607 - RNA, 11 nt, Salmonella enterica enterica serovar Typhi
gcaucaucaaa

SEQ ID NO: 3615608 - RNA, 21 nt, Salmonella enterica enterica serovar Typhi
gcaucauccccaccgcugaug

SEQ ID NO: 3615609 - RNA, 22 nt, Salmonella enterica enterica serovar Typhi
gcaucaugggcucaucaaacag

SEQ ID NO: 3615610 - RNA, 17 nt, Salmonella enterica enterica serovar Typhi
gcauccagacccacagc

SEQ ID NO: 3615611 - RNA, 15 nt, Salmonella enterica enterica serovar Typhi
gcauccagcacgagc

SEQ ID NO: 3615612 - RNA, 17 nt, Salmonella enterica enterica serovar Typhi
gcauccagcacgagcgc

SEQ ID NO: 3615613 - RNA, 15 nt, Salmonella enterica enterica serovar Typhi
gcauccaguuucuuc

SEQ ID NO: 3615614 - RNA, 14 nt, Salmonella enterica enterica serovar Typhi
gcauccccugcagg

SEQ ID NO: 3615615 - RNA, 15 nt, Salmonella enterica enterica serovar Typhi
gcaucccgcaggcgg

SEQ ID NO: 3615616 - RNA, 21 nt, Salmonella enterica enterica serovar Typhi
gcaucccgcuggcgccaccgc

SEQ ID NO: 3615617 - RNA, 11 nt, Salmonella enterica enterica serovar Typhi
gcaucccggca

SEQ ID NO: 3615618 - RNA, 16 nt, Salmonella enterica enterica serovar Typhi
gcaucccggucaacgu

SEQ ID NO: 3615619 - RNA, 20 nt, Salmonella enterica enterica serovar Typhi
gcaucccggugucaaagcgc

SEQ ID NO: 3615620 - RNA, 17 nt, Salmonella enterica enterica serovar Typhi
gcaucccgucccaccac

SEQ ID NO: 3615621 - RNA, 13 nt, Salmonella enterica enterica serovar Typhi
gcaucccguuaug

SEQ ID NO: 3615622 - RNA, 14 nt, Salmonella enterica enterica serovar Typhi
gcauccgccgccgc

SEQ ID NO: 3615623 - RNA, 14 nt, Salmonella enterica enterica serovar Typhi
gcauccgcgcaaua

SEQ ID NO: 3615624 - RNA, 23 nt, Salmonella enterica enterica serovar Typhi
gcauccgcggcgcuuugcuucuc

SEQ ID NO: 3615625 - RNA, 16 nt, Salmonella enterica enterica serovar Typhi
gcauccggaaucgccg

SEQ ID NO: 3615626 - RNA, 15 nt, Salmonella enterica enterica serovar Typhi
gcauccggacgccag

SEQ ID NO: 3615627 - RNA, 16 nt, Salmonella enterica enterica serovar Typhi
gcauccggcaauucaa

SEQ ID NO: 3615628 - RNA, 18 nt, Salmonella enterica enterica serovar Typhi
gcauccguagcuucagcu

SEQ ID NO: 3615629 - RNA, 13 nt, Salmonella enterica enterica serovar Typhi
gcauccucuuucc

SEQ ID NO: 3615630 - RNA, 23 nt, Salmonella enterica enterica serovar Typhi
gcauccugacuauugcugagcug

SEQ ID NO: 3615631 - RNA, 18 nt, Salmonella enterica enterica serovar Typhi
gcauccuuaugcagaaau

SEQ ID NO: 3615632 - RNA, 23 nt, Salmonella enterica enterica serovar Typhi
gcauccuuaugggucacauccag

SEQ ID NO: 3615633 - RNA, 20 nt, Salmonella enterica enterica serovar Typhi
gcaucgacauccgauuucau

SEQ ID NO: 3615634 - RNA, 12 nt, Salmonella enterica enterica serovar Typhi
gcaucgaccagg

SEQ ID NO: 3615635 - RNA, 16 nt, Salmonella enterica enterica serovar Typhi
gcaucgacguucagca

SEQ ID NO: 3615636 - RNA, 19 nt, Salmonella enterica enterica serovar Typhi
gcaucgacguucagcauau

SEQ ID NO: 3615637 - RNA, 18 nt, Salmonella enterica enterica serovar Typhi
gcaucgauauaagcgccg

SEQ ID NO: 3615638 - RNA, 15 nt, Salmonella enterica enterica serovar Typhi
gcaucgauuccgccu

SEQ ID NO: 3615639 - RNA, 21 nt, Salmonella enterica enterica serovar Typhi
gcaucgauuuuucaucuucag

SEQ ID NO: 3615640 - RNA, 12 nt, Salmonella enterica enterica serovar Typhi
gcaucgccgccc

SEQ ID NO: 3615641 - RNA, 15 nt, Salmonella enterica enterica serovar Typhi
gcaucgccgcccagu

SEQ ID NO: 3615642 - RNA, 19 nt, Salmonella enterica enterica serovar Typhi
gcaucgccgcggcgcuggc

SEQ ID NO: 3615643 - RNA, 13 nt, Salmonella enterica enterica serovar Typhi
gcaucgcggucag

SEQ ID NO: 3615644 - RNA, 19 nt, Salmonella enterica enterica serovar Typhi
gcaucgcguuauugaccau

SEQ ID NO: 3615645 - RNA, 13 nt, Salmonella enterica enterica serovar Typhi
gcaucggaaccgg

SEQ ID NO: 3615646 - RNA, 15 nt, Salmonella enterica enterica serovar Typhi
gcaucggcagcgcca

SEQ ID NO: 3615647 - RNA, 17 nt, Salmonella enterica enterica serovar Typhi
gcaucggcagcgccagu

SEQ ID NO: 3615648 - RNA, 21 nt, Salmonella enterica enterica serovar Typhi
gcaucggcagcgucaggcuua

SEQ ID NO: 3615649 - RNA, 13 nt, Salmonella enterica enterica serovar Typhi
gcaucggcaucaa

SEQ ID NO: 3615650 - RNA, 18 nt, Salmonella enterica enterica serovar Typhi
gcaucgggccguccggca

SEQ ID NO: 3615651 - RNA, 22 nt, Salmonella enterica enterica serovar Typhi
gcaucgguagaaugaauguagc

SEQ ID NO: 3615652 - RNA, 14 nt, Salmonella enterica enterica serovar Typhi
gcaucguagucagg

SEQ ID NO: 3615653 - RNA, 14 nt, Salmonella enterica enterica serovar Typhi
gcaucgugagcgcg

SEQ ID NO: 3615654 - RNA, 22 nt, Salmonella enterica enterica serovar Typhi
gcaucguuaucauuaucgccaa

SEQ ID NO: 3615655 - RNA, 22 nt, Salmonella enterica enterica serovar Typhi
gcaucguuugcaguuccgcaau

SEQ ID NO: 3615656 - RNA, 18 nt, Salmonella enterica enterica serovar Typhi
gcaucuaccgcauacuga

SEQ ID NO: 3615657 - RNA, 14 nt, Salmonella enterica enterica serovar Typhi
gcaucuccagcgca

SEQ ID NO: 3615658 - RNA, 20 nt, Salmonella enterica enterica serovar Typhi
gcaucucgccauaauuguuc

SEQ ID NO: 3615659 - RNA, 19 nt, Salmonella enterica enterica serovar Typhi
gcaucugggcugagaaaaa

SEQ ID NO: 3615660 - RNA, 12 nt, Salmonella enterica enterica serovar Typhi
gcaucugucauc

SEQ ID NO: 3615661 - RNA, 17 nt, Salmonella enterica enterica serovar Typhi
gcaucuuacugaccggc

SEQ ID NO: 3615662 - RNA, 12 nt, Salmonella enterica enterica serovar Typhi
gcaucuuauauu

SEQ ID NO: 3615663 - RNA, 21 nt, Salmonella enterica enterica serovar Typhi
gccaaauuuucaaccacggau

SEQ ID NO: 3615664 - RNA, 20 nt, Salmonella enterica enterica serovar Typhi
gccaacaacaggccgccgag

SEQ ID NO: 3615665 - RNA, 21 nt, Salmonella enterica enterica serovar Typhi
gccaacagccgcccacaaccg

SEQ ID NO: 3615666 - RNA, 20 nt, Salmonella enterica enterica serovar Typhi
gccaaccaccgcggagaucg

SEQ ID NO: 3615667 - RNA, 21 nt, Salmonella enterica enterica serovar Typhi
gccaaccagcgcuuugcggcu

SEQ ID NO: 3615668 - RNA, 19 nt, Salmonella enterica enterica serovar Typhi
gccaaccaguaccgucauu

SEQ ID NO: 3615669 - RNA, 18 nt, Salmonella enterica enterica serovar Typhi
gccaaccgccacaauauc

SEQ ID NO: 3615670 - RNA, 21 nt, Salmonella enterica enterica serovar Typhi
gccaaccgugagcgcgccgca

SEQ ID NO: 3615671 - RNA, 22 nt, Salmonella enterica enterica serovar Typhi
gccaacgaccggcgcagcgccc

SEQ ID NO: 3615672 - RNA, 18 nt, Salmonella enterica enterica serovar Typhi
gccaacgagaauaagacc

SEQ ID NO: 3615673 - RNA, 16 nt, Salmonella enterica enterica serovar Typhi
gccaacgauacagcac

SEQ ID NO: 3615674 - RNA, 15 nt, Salmonella enterica enterica serovar Typhi
gccaacgccagcagc

SEQ ID NO: 3615675 - RNA, 14 nt, Salmonella enterica enterica serovar Typhi
gccaacgccgguug

SEQ ID NO: 3615676 - RNA, 21 nt, Salmonella enterica enterica serovar Typhi
gccaacgggcggugugauuaa

SEQ ID NO: 3615677 - RNA, 17 nt, Salmonella enterica enterica serovar Typhi
gccaacguccgccguca

SEQ ID NO: 3615678 - RNA, 14 nt, Salmonella enterica enterica serovar Typhi
gccaacuuuuucuu

SEQ ID NO: 3615679 - RNA, 18 nt, Salmonella enterica enterica serovar Typhi
gccaacuuuuugcgcaau

SEQ ID NO: 3615680 - RNA, 17 nt, Salmonella enterica enterica serovar Typhi
gccaagcagcgccacgc

SEQ ID NO: 3615681 - RNA, 18 nt, Salmonella enterica enterica serovar Typhi
gccaagcagcgccacgcc

SEQ ID NO: 3615682 - RNA, 24 nt, Salmonella enterica enterica serovar Typhi
gccaagcgccuguucaacaugcug

SEQ ID NO: 3615683 - RNA, 17 nt, Salmonella enterica enterica serovar Typhi
gccaagcgcggcagcag

SEQ ID NO: 3615684 - RNA, 19 nt, Salmonella enterica enterica serovar Typhi
gccaagcgcggcagcagcu

SEQ ID NO: 3615685 - RNA, 21 nt, Salmonella enterica enterica serovar Typhi
gccaagcggcaucucgccaaa

SEQ ID NO: 3615686 - RNA, 16 nt, Salmonella enterica enterica serovar Typhi
gccaagcugcagaauc

SEQ ID NO: 3615687 - RNA, 17 nt, Salmonella enterica enterica serovar Typhi
gccaaggcaucugcgca

SEQ ID NO: 3615688 - RNA, 17 nt, Salmonella enterica enterica serovar Typhi
gccaauaacgccuggug

SEQ ID NO: 3615689 - RNA, 18 nt, Salmonella enterica enterica serovar Typhi
gccaauaaucaaaugauu

SEQ ID NO: 3615690 - RNA, 19 nt, Salmonella enterica enterica serovar Typhi
gccaauaauuaguuuuacc

SEQ ID NO: 3615691 - RNA, 24 nt, Salmonella enterica enterica serovar Typhi
gccaauacgggagagcguauccag

SEQ ID NO: 3615692 - RNA, 18 nt, Salmonella enterica enterica serovar Typhi
gccaauauugacguuaaa

SEQ ID NO: 3615693 - RNA, 19 nt, Salmonella enterica enterica serovar Typhi
gccaaucaacgccgccagg

SEQ ID NO: 3615694 - RNA, 20 nt, Salmonella enterica enterica serovar Typhi
gccaaucaccgccagcaacg

SEQ ID NO: 3615695 - RNA, 22 nt, Salmonella enterica enterica serovar Typhi
gccaauccugcacccgccuuac

SEQ ID NO: 3615696 - RNA, 14 nt, Salmonella enterica enterica serovar Typhi
gccaaucgccgccg

SEQ ID NO: 3615697 - RNA, 19 nt, Salmonella enterica enterica serovar Typhi
gccaaucgccgccgccaga

SEQ ID NO: 3615698 - RNA, 15 nt, Salmonella enterica enterica serovar Typhi
gccaaugaaauaauu

SEQ ID NO: 3615699 - RNA, 19 nt, Salmonella enterica enterica serovar Typhi
gccaaugaacucgccucgc

SEQ ID NO: 3615700 - RNA, 18 nt, Salmonella enterica enterica serovar Typhi
gccaaugccggacgccac

SEQ ID NO: 3615701 - RNA, 22 nt, Salmonella enterica enterica serovar Typhi
gccaaugccggacgccaccacg

SEQ ID NO: 3615702 - RNA, 20 nt, Salmonella enterica enterica serovar Typhi
gccaaugcgaaaauacuccc

SEQ ID NO: 3615703 - RNA, 21 nt, Salmonella enterica enterica serovar Typhi
gccaauguacguaaaaccagc

SEQ ID NO: 3615704 - RNA, 15 nt, Salmonella enterica enterica serovar Typhi
gccaauuccgccaua

SEQ ID NO: 3615705 - RNA, 16 nt, Salmonella enterica enterica serovar Typhi
gccaauuccgccauaa

SEQ ID NO: 3615706 - RNA, 13 nt, Salmonella enterica enterica serovar Typhi
gccacaaacugcg

SEQ ID NO: 3615707 - RNA, 14 nt, Salmonella enterica enterica serovar Typhi
gccacaacagaagc

SEQ ID NO: 3615708 - RNA, 18 nt, Salmonella enterica enterica serovar Typhi
gccacaacagaagcggcc

SEQ ID NO: 3615709 - RNA, 21 nt, Salmonella enterica enterica serovar Typhi
gccacaaccgcccccaacuga

SEQ ID NO: 3615710 - RNA, 23 nt, Salmonella enterica enterica serovar Typhi
gccacaacggcaauuuuuacaaa

SEQ ID NO: 3615711 - RNA, 15 nt, Salmonella enterica enterica serovar Typhi
gccacaacguugacc

SEQ ID NO: 3615712 - RNA, 12 nt, Salmonella enterica enterica serovar Typhi
gccacaaugaca

SEQ ID NO: 3615713 - RNA, 17 nt, Salmonella enterica enterica serovar Typhi
gccacaauggcaggcag

SEQ ID NO: 3615714 - RNA, 16 nt, Salmonella enterica enterica serovar Typhi
gccacaauugccagca

SEQ ID NO: 3615715 - RNA, 18 nt, Salmonella enterica enterica serovar Typhi
gccacaauugccagcagg

SEQ ID NO: 3615716 - RNA, 18 nt, Salmonella enterica enterica serovar Typhi
gccacaccacaugcgagc

SEQ ID NO: 3615717 - RNA, 16 nt, Salmonella enterica enterica serovar Typhi
gccacacucucuccag

SEQ ID NO: 3615718 - RNA, 21 nt, Salmonella enterica enterica serovar Typhi
gccacagauuaugcaguucuu

SEQ ID NO: 3615719 - RNA, 12 nt, Salmonella enterica enterica serovar Typhi
gccacagccauc

SEQ ID NO: 3615720 - RNA, 19 nt, Salmonella enterica enterica serovar Typhi
gccacagccauccgacgcc

SEQ ID NO: 3615721 - RNA, 15 nt, Salmonella enterica enterica serovar Typhi
gccacagcgccagac

SEQ ID NO: 3615722 - RNA, 20 nt, Salmonella enterica enterica serovar Typhi
gccacagcgccagacacugg

SEQ ID NO: 3615723 - RNA, 13 nt, Salmonella enterica enterica serovar Typhi
gccacagcggaau

SEQ ID NO: 3615724 - RNA, 20 nt, Salmonella enterica enterica serovar Typhi
gccacagcgguauaucugua

SEQ ID NO: 3615725 - RNA, 20 nt, Salmonella enterica enterica serovar Typhi
gccacaggcggcauggguaa

SEQ ID NO: 3615726 - RNA, 15 nt, Salmonella enterica enterica serovar Typhi
gccacauacugcuuu

SEQ ID NO: 3615727 - RNA, 13 nt, Salmonella enterica enterica serovar Typhi
gccacaucgccag

SEQ ID NO: 3615728 - RNA, 13 nt, Salmonella enterica enterica serovar Typhi
gccacaucguuac

SEQ ID NO: 3615729 - RNA, 22 nt, Salmonella enterica enterica serovar Typhi
gccacaugauguuguucgucuu

SEQ ID NO: 3615730 - RNA, 13 nt, Salmonella enterica enterica serovar Typhi
gccacaugcggca

SEQ ID NO: 3615731 - RNA, 19 nt, Salmonella enterica enterica serovar Typhi
gccacauuguaugcaagaa

SEQ ID NO: 3615732 - RNA, 19 nt, Salmonella enterica enterica serovar Typhi
gccaccacaaacgccguca

SEQ ID NO: 3615733 - RNA, 19 nt, Salmonella enterica enterica serovar Typhi
gccaccacagucaucgcgc

SEQ ID NO: 3615734 - RNA, 15 nt, Salmonella enterica enterica serovar Typhi
gccaccacauaccgu

SEQ ID NO: 3615735 - RNA, 13 nt, Salmonella enterica enterica serovar Typhi
gccaccacucggc

SEQ ID NO: 3615736 - RNA, 15 nt, Salmonella enterica enterica serovar Typhi
gccaccagcacagcc

SEQ ID NO: 3615737 - RNA, 21 nt, Salmonella enterica enterica serovar Typhi
gccaccagcgccagcggcugc

SEQ ID NO: 3615738 - RNA, 16 nt, Salmonella enterica enterica serovar Typhi
gccaccagcguaccgg

SEQ ID NO: 3615739 - RNA, 13 nt, Salmonella enterica enterica serovar Typhi
gccaccauaucuu

SEQ ID NO: 3615740 - RNA, 14 nt, Salmonella enterica enterica serovar Typhi
gccaccaucacuac

SEQ ID NO: 3615741 - RNA, 17 nt, Salmonella enterica enterica serovar Typhi
gccaccauccgacaaca

SEQ ID NO: 3615742 - RNA, 17 nt, Salmonella enterica enterica serovar Typhi
gccaccaucgucgccag

SEQ ID NO: 3615743 - RNA, 22 nt, Salmonella enterica enterica serovar Typhi
gccaccaucgucgccagaccca

SEQ ID NO: 3615744 - RNA, 18 nt, Salmonella enterica enterica serovar Typhi
gccaccaucuuuuuugcg

SEQ ID NO: 3615745 - RNA, 17 nt, Salmonella enterica enterica serovar Typhi
gccacccacuucgccgg

SEQ ID NO: 3615746 - RNA, 15 nt, Salmonella enterica enterica serovar Typhi
gccaccccaaaucuc

SEQ ID NO: 3615747 - RNA, 14 nt, Salmonella enterica enterica serovar Typhi
gccacccgacaagg

SEQ ID NO: 3615748 - RNA, 19 nt, Salmonella enterica enterica serovar Typhi
gccagaucgaacagcggca

SEQ ID NO: 3615749 - RNA, 17 nt, Salmonella enterica enterica serovar Typhi
gccagaucgauacgcca

SEQ ID NO: 3615750 - RNA, 18 nt, Salmonella enterica enterica serovar Typhi
gccagaucgauacgccac

SEQ ID NO: 3615751 - RNA, 18 nt, Salmonella enterica enterica serovar Typhi
gccagauggauaaccugc

SEQ ID NO: 3615752 - RNA, 19 nt, Salmonella enterica enterica serovar Typhi
gccagaugguaagcauagc

SEQ ID NO: 3615753 - RNA, 22 nt, Salmonella enterica enterica serovar Typhi
gccagauuaucggccagcgcca

SEQ ID NO: 3615754 - RNA, 23 nt, Salmonella enterica enterica serovar Typhi
gccagauuuuccaggccgccagc

SEQ ID NO: 3615755 - RNA, 22 nt, Salmonella enterica enterica serovar Typhi
gccagcaaaaucaccaucacga

SEQ ID NO: 3615756 - RNA, 16 nt, Salmonella enterica enterica serovar Typhi
gccagcaacccaccug

SEQ ID NO: 3615757 - RNA, 20 nt, Salmonella enterica enterica serovar Typhi
gccagcaacguuaaggccgc

SEQ ID NO: 3615758 - RNA, 13 nt, Salmonella enterica enterica serovar Typhi
gccagcaauaaca

SEQ ID NO: 3615759 - RNA, 14 nt, Salmonella enterica enterica serovar Typhi
gccagcaccacuac

SEQ ID NO: 3615760 - RNA, 14 nt, Salmonella enterica enterica serovar Typhi
gccagcaccagcag

SEQ ID NO: 3615761 - RNA, 19 nt, Salmonella enterica enterica serovar Typhi
gccagcaccagcagcgcau

SEQ ID NO: 3615762 - RNA, 15 nt, Salmonella enterica enterica serovar Typhi
gccagcaccagcagu

SEQ ID NO: 3615763 - RNA, 20 nt, Salmonella enterica enterica serovar Typhi
gccagcagcauaaaaccgcc

SEQ ID NO: 3615764 - RNA, 19 nt, Salmonella enterica enterica serovar Typhi
gccagcagcgcaccugccc

SEQ ID NO: 3615765 - RNA, 22 nt, Salmonella enterica enterica serovar Typhi
gccagcagcguuuugcgcguaa

SEQ ID NO: 3615766 - RNA, 16 nt, Salmonella enterica enterica serovar Typhi
gccagcagguuaaaca

SEQ ID NO: 3615767 - RNA, 20 nt, Salmonella enterica enterica serovar Typhi
gccagcaguuuuucaaucuu

SEQ ID NO: 3615768 - RNA, 13 nt, Salmonella enterica enterica serovar Typhi
gccagcauauaaa

SEQ ID NO: 3615769 - RNA, 21 nt, Salmonella enterica enterica serovar Typhi
gccagcaucaugggcucauca

SEQ ID NO: 3615770 - RNA, 23 nt, Salmonella enterica enterica serovar Typhi
gccagcaucgauuuuucaucuuc

SEQ ID NO: 3615771 - RNA, 16 nt, Salmonella enterica enterica serovar Typhi
gccagcaucggcagcg

SEQ ID NO: 3615772 - RNA, 16 nt, Salmonella enterica enterica serovar Typhi
gccagcaugguuaaaa

SEQ ID NO: 3615773 - RNA, 16 nt, Salmonella enterica enterica serovar Typhi
gccagcauuuccagcu

SEQ ID NO: 3615774 - RNA, 17 nt, Salmonella enterica enterica serovar Typhi
gccagcauuuccagcug

SEQ ID NO: 3615775 - RNA, 18 nt, Salmonella enterica enterica serovar Typhi
gccagcauuuccagcugg

SEQ ID NO: 3615776 - RNA, 17 nt, Salmonella enterica enterica serovar Typhi
gccagccagcgccacca

SEQ ID NO: 3615777 - RNA, 19 nt, Salmonella enterica enterica serovar Typhi
gccagccagucgccaggca

SEQ ID NO: 3615778 - RNA, 21 nt, Salmonella enterica enterica serovar Typhi
gccagccagucgccaggcaag

SEQ ID NO: 3615779 - RNA, 16 nt, Salmonella enterica enterica serovar Typhi
gccagccauccccaua

SEQ ID NO: 3615780 - RNA, 23 nt, Salmonella enterica enterica serovar Typhi
gccagccauggcccaaaagguag

SEQ ID NO: 3615781 - RNA, 13 nt, Salmonella enterica enterica serovar Typhi
gccagccauuaaa

SEQ ID NO: 3615782 - RNA, 17 nt, Salmonella enterica enterica serovar Typhi
gccagccauucaccacu

SEQ ID NO: 3615783 - RNA, 16 nt, Salmonella enterica enterica serovar Typhi
gccagccccaccgucc

SEQ ID NO: 3615784 - RNA, 14 nt, Salmonella enterica enterica serovar Typhi
gccagccccagccc

SEQ ID NO: 3615785 - RNA, 20 nt, Salmonella enterica enterica serovar Typhi
gccagccccugcggauuacg

SEQ ID NO: 3615786 - RNA, 22 nt, Salmonella enterica enterica serovar Typhi
gccagcccgacuaccggcacca

SEQ ID NO: 3615787 - RNA, 21 nt, Salmonella enterica enterica serovar Typhi
gccagcccucuucuucuuccg

SEQ ID NO: 3615788 - RNA, 22 nt, Salmonella enterica enterica serovar Typhi
gccagccgacgcucuuccucaa

SEQ ID NO: 3615789 - RNA, 21 nt, Salmonella enterica enterica serovar Typhi
gccagccgauuuuucggcacg

SEQ ID NO: 3615790 - RNA, 18 nt, Salmonella enterica enterica serovar Typhi
gccagccgccaaaaauau

SEQ ID NO: 3615791 - RNA, 13 nt, Salmonella enterica enterica serovar Typhi
gccagccgccgcc

SEQ ID NO: 3615792 - RNA, 14 nt, Salmonella enterica enterica serovar Typhi
gccagccgccgccg

SEQ ID NO: 3615793 - RNA, 20 nt, Salmonella enterica enterica serovar Typhi
gccagccgcgccaucuccuc

SEQ ID NO: 3615794 - RNA, 19 nt, Salmonella enterica enterica serovar Typhi
gccagccggauacugcgcu

SEQ ID NO: 3615795 - RNA, 16 nt, Salmonella enterica enterica serovar Typhi
gccagccuaucgccau

SEQ ID NO: 3615796 - RNA, 21 nt, Salmonella enterica enterica serovar Typhi
gccagccugaacaucuuccag

SEQ ID NO: 3615797 - RNA, 23 nt, Salmonella enterica enterica serovar Typhi
gccagccugugaucggagaaaua

SEQ ID NO: 3615798 - RNA, 19 nt, Salmonella enterica enterica serovar Typhi
gccagcgacaacgcuuccg

SEQ ID NO: 3615799 - RNA, 22 nt, Salmonella enterica enterica serovar Typhi
gccagcgacaacgcuuccggcg

SEQ ID NO: 3615800 - RNA, 17 nt, Salmonella enterica enterica serovar Typhi
gccagcgacaucccaga

SEQ ID NO: 3615801 - RNA, 21 nt, Salmonella enterica enterica serovar Typhi
gccagcgaccaccgucccagu

SEQ ID NO: 3615802 - RNA, 14 nt, Salmonella enterica enterica serovar Typhi
gccagcgacgcaug

SEQ ID NO: 3615803 - RNA, 17 nt, Salmonella enterica enterica serovar Typhi
gccagcgacugguguua

SEQ ID NO: 3615804 - RNA, 14 nt, Salmonella enterica enterica serovar Typhi
gccagcgagaaguc

SEQ ID NO: 3615805 - RNA, 22 nt, Salmonella enterica enterica serovar Typhi
gccagcgauccugcggcauuag

SEQ ID NO: 3615806 - RNA, 21 nt, Salmonella enterica enterica serovar Typhi
gccagcgauuccgucaggaac

SEQ ID NO: 3615807 - RNA, 14 nt, Salmonella enterica enterica serovar Typhi
gccagcgcauacuu

SEQ ID NO: 3615808 - RNA, 14 nt, Salmonella enterica enterica serovar Typhi
gccagcgcauccac

SEQ ID NO: 3615809 - RNA, 23 nt, Salmonella enterica enterica serovar Typhi
gccagcgccaccaaagccaggcc

SEQ ID NO: 3615810 - RNA, 14 nt, Salmonella enterica enterica serovar Typhi
gccagcgccagcgu

SEQ ID NO: 3615811 - RNA, 13 nt, Salmonella enterica enterica serovar Typhi
gccagcgccgccg

SEQ ID NO: 3615812 - RNA, 22 nt, Salmonella enterica enterica serovar Typhi
gccagcgcguuuuccauuuuac

SEQ ID NO: 3615813 - RNA, 20 nt, Salmonella enterica enterica serovar Typhi
gccagcgcuaauugugcggg

SEQ ID NO: 3615814 - RNA, 12 nt, Salmonella enterica enterica serovar Typhi
gccagcgcugag

SEQ ID NO: 3615815 - RNA, 18 nt, Salmonella enterica enterica serovar Typhi
gccagcgcugagaugacc

SEQ ID NO: 3615816 - RNA, 22 nt, Salmonella enterica enterica serovar Typhi
gccagcgcugcauuugcugccg

SEQ ID NO: 3615817 - RNA, 18 nt, Salmonella enterica enterica serovar Typhi
gccagcggaucgcgucca

SEQ ID NO: 3615818 - RNA, 16 nt, Salmonella enterica enterica serovar Typhi
gccagcggccagccau

SEQ ID NO: 3615819 - RNA, 18 nt, Salmonella enterica enterica serovar Typhi
gccagcggccagcguacc

SEQ ID NO: 3615820 - RNA, 13 nt, Salmonella enterica enterica serovar Typhi
gccagcggcggcu

SEQ ID NO: 3615821 - RNA, 21 nt, Salmonella enterica enterica serovar Typhi
gccagcggcguuuuuuccugc

SEQ ID NO: 3615822 - RNA, 15 nt, Salmonella enterica enterica serovar Typhi
gccagcgggcgcagu

SEQ ID NO: 3615823 - RNA, 15 nt, Salmonella enterica enterica serovar Typhi
gccagcgggcgucga

SEQ ID NO: 3615824 - RNA, 22 nt, Salmonella enterica enterica serovar Typhi
gccagcggucgcggagaucauc

SEQ ID NO: 3615825 - RNA, 21 nt, Salmonella enterica enterica serovar Typhi
gccagcguaaucggcaggcca

SEQ ID NO: 3615826 - RNA, 16 nt, Salmonella enterica enterica serovar Typhi
gccagcgucgcugauu

SEQ ID NO: 3615827 - RNA, 20 nt, Salmonella enterica enterica serovar Typhi
gccagcgucucagcaggcgg

SEQ ID NO: 3615828 - RNA, 18 nt, Salmonella enterica enterica serovar Typhi
gccagcgugacccagaca

SEQ ID NO: 3615829 - RNA, 19 nt, Salmonella enterica enterica serovar Typhi
gccagcguuagcacauugg

SEQ ID NO: 3615830 - RNA, 16 nt, Salmonella enterica enterica serovar Typhi
gccagcguugaccagc

SEQ ID NO: 3615831 - RNA, 18 nt, Salmonella enterica enterica serovar Typhi
gccagcuacaccugggcu

SEQ ID NO: 3615832 - RNA, 20 nt, Salmonella enterica enterica serovar Typhi
gccagcuacaccugggcuug

SEQ ID NO: 3615833 - RNA, 23 nt, Salmonella enterica enterica serovar Typhi
gccauagacgguugcaugauuaa

SEQ ID NO: 3615834 - RNA, 13 nt, Salmonella enterica enterica serovar Typhi
gccauagcgggca

SEQ ID NO: 3615835 - RNA, 23 nt, Salmonella enterica enterica serovar Typhi
gccauauaaauuucauccaugcc

SEQ ID NO: 3615836 - RNA, 21 nt, Salmonella enterica enterica serovar Typhi
gccauaucaccgcugacugaa

SEQ ID NO: 3615837 - RNA, 18 nt, Salmonella enterica enterica serovar Typhi
gccauauggcauucgcag

SEQ ID NO: 3615838 - RNA, 20 nt, Salmonella enterica enterica serovar Typhi
gccauauuaugcuggccugc

SEQ ID NO: 3615839 - RNA, 20 nt, Salmonella enterica enterica serovar Typhi
gccauauuguucaguuucaa

SEQ ID NO: 3615840 - RNA, 18 nt, Salmonella enterica enterica serovar Typhi
gccauauuuaccuuuucc

SEQ ID NO: 3615841 - RNA, 20 nt, Salmonella enterica enterica serovar Typhi
gccauauuuuuccagcgccu

SEQ ID NO: 3615842 - RNA, 19 nt, Salmonella enterica enterica serovar Typhi
gccauauuuuuucaggaag

SEQ ID NO: 3615843 - RNA, 18 nt, Salmonella enterica enterica serovar Typhi
gccaucacaccaacgcug

SEQ ID NO: 3615844 - RNA, 21 nt, Salmonella enterica enterica serovar Typhi
gccaucacguccugauagcaa

SEQ ID NO: 3615845 - RNA, 23 nt, Salmonella enterica enterica serovar Typhi
gccaucagacucucaaugcccau

SEQ ID NO: 3615846 - RNA, 17 nt, Salmonella enterica enterica serovar Typhi
gccaucagcaaaauacc

SEQ ID NO: 3615847 - RNA, 15 nt, Salmonella enterica enterica serovar Typhi
gccaucaggaaauuc

SEQ ID NO: 3615848 - RNA, 17 nt, Salmonella enterica enterica serovar Typhi
gccaucaggcagauuaa

SEQ ID NO: 3615849 - RNA, 23 nt, Salmonella enterica enterica serovar Typhi
gccaucaggcaguuuauccggcg

SEQ ID NO: 3615850 - RNA, 17 nt, Salmonella enterica enterica serovar Typhi
gccaucaggcaucugaa

SEQ ID NO: 3615851 - RNA, 19 nt, Salmonella enterica enterica serovar Typhi
gccaucaggcaugccaaac

SEQ ID NO: 3615852 - RNA, 19 nt, Salmonella enterica enterica serovar Typhi
gccaucaggccccccuugu

SEQ ID NO: 3615853 - RNA, 21 nt, Salmonella enterica enterica serovar Typhi
gccaucaguaaaggaugccac

SEQ ID NO: 3615854 - RNA, 14 nt, Salmonella enterica enterica serovar Typhi
gccaucaguucggc

SEQ ID NO: 3615855 - RNA, 19 nt, Salmonella enterica enterica serovar Typhi
gccaucauuaauuuacuga

SEQ ID NO: 3615856 - RNA, 19 nt, Salmonella enterica enterica serovar Typhi
gccauccaucuccggcauc

SEQ ID NO: 3615857 - RNA, 19 nt, Salmonella enterica enterica serovar Typhi
gccaucccaugcaccaguc

SEQ ID NO: 3615858 - RNA, 14 nt, Salmonella enterica enterica serovar Typhi
gccaucccggcgac

SEQ ID NO: 3615859 - RNA, 17 nt, Salmonella enterica enterica serovar Typhi
gccaucccggcgacagc

SEQ ID NO: 3615860 - RNA, 17 nt, Salmonella enterica enterica serovar Typhi
gccauccgacaaccggc

SEQ ID NO: 3615861 - RNA, 11 nt, Salmonella enterica enterica serovar Typhi
gccauccggca

SEQ ID NO: 3615862 - RNA, 20 nt, Salmonella enterica enterica serovar Typhi
gccauccggcaaauccucca

SEQ ID NO: 3615863 - RNA, 16 nt, Salmonella enterica enterica serovar Typhi
gccauccggcaauuaa

SEQ ID NO: 3615864 - RNA, 13 nt, Salmonella enterica enterica serovar Typhi
gccauccggcaca

SEQ ID NO: 3615865 - RNA, 17 nt, Salmonella enterica enterica serovar Typhi
gccauccggcaucacgu

SEQ ID NO: 3615866 - RNA, 18 nt, Salmonella enterica enterica serovar Typhi
gccauccggcaucucuuc

SEQ ID NO: 3615867 - RNA, 14 nt, Salmonella enterica enterica serovar Typhi
gccauccugcaccg

SEQ ID NO: 3615868 - RNA, 23 nt, Salmonella enterica enterica serovar Typhi
gccauccugcgugccguugacca

SEQ ID NO: 3615869 - RNA, 22 nt, Salmonella enterica enterica serovar Typhi
gccaucgacagcgccauauaaa

SEQ ID NO: 3615870 - RNA, 14 nt, Salmonella enterica enterica serovar Typhi
gccaucgcggcgca

SEQ ID NO: 3615871 - RNA, 21 nt, Salmonella enterica enterica serovar Typhi
gccaucggcgccggggugcug

SEQ ID NO: 3615872 - RNA, 21 nt, Salmonella enterica enterica serovar Typhi
gccaucggcuaagccaaaaau

SEQ ID NO: 3615873 - RNA, 18 nt, Salmonella enterica enterica serovar Typhi
gccaucggcuuuggcaaa

SEQ ID NO: 3615874 - RNA, 16 nt, Salmonella enterica enterica serovar Typhi
gccaucgucaccggau

SEQ ID NO: 3615875 - RNA, 17 nt, Salmonella enterica enterica serovar Typhi
gccaucgucaccggauc

SEQ ID NO: 3615876 - RNA, 14 nt, Salmonella enterica enterica serovar Typhi
gccaucguccagcc

SEQ ID NO: 3615877 - RNA, 15 nt, Salmonella enterica enterica serovar Typhi
gccaucguccagcca

SEQ ID NO: 3615878 - RNA, 14 nt, Salmonella enterica enterica serovar Typhi
gccaucucauucgc

SEQ ID NO: 3615879 - RNA, 17 nt, Salmonella enterica enterica serovar Typhi
gccaucuccaucauuuc

SEQ ID NO: 3615880 - RNA, 15 nt, Salmonella enterica enterica serovar Typhi
gccaucuccggcagc

SEQ ID NO: 3615881 - RNA, 13 nt, Salmonella enterica enterica serovar Typhi
gccaucuccugcg

SEQ ID NO: 3615882 - RNA, 17 nt, Salmonella enterica enterica serovar Typhi
gccaucugcuccggcgu

SEQ ID NO: 3615883 - RNA, 17 nt, Salmonella enterica enterica serovar Typhi
gccaucuggccuggcga

SEQ ID NO: 3615884 - RNA, 16 nt, Salmonella enterica enterica serovar Typhi
gccaucuucacgcagc

SEQ ID NO: 3615885 - RNA, 13 nt, Salmonella enterica enterica serovar Typhi
gccaucuuccagc

SEQ ID NO: 3615886 - RNA, 14 nt, Salmonella enterica enterica serovar Typhi
gccaucuuccagca

SEQ ID NO: 3615887 - RNA, 17 nt, Salmonella enterica enterica serovar Typhi
gccaucuuccagcauca

SEQ ID NO: 3615888 - RNA, 12 nt, Salmonella enterica enterica serovar Typhi
gccaucuuccuc

SEQ ID NO: 3615889 - RNA, 15 nt, Salmonella enterica enterica serovar Typhi
gccaucuuccucaca

SEQ ID NO: 3615890 - RNA, 21 nt, Salmonella enterica enterica serovar Typhi
gccaucuuucuuuucgcguuu

SEQ ID NO: 3615891 - RNA, 20 nt, Salmonella enterica enterica serovar Typhi
gccaugagacgcguaaauca

SEQ ID NO: 3615892 - RNA, 18 nt, Salmonella enterica enterica serovar Typhi
gccaugagccuguauggg

SEQ ID NO: 3615893 - RNA, 21 nt, Salmonella enterica enterica serovar Typhi
gccaugaucgccgccaucggc

SEQ ID NO: 3615894 - RNA, 19 nt, Salmonella enterica enterica serovar Typhi
gccaugaugagcgccauau

SEQ ID NO: 3615895 - RNA, 12 nt, Salmonella enterica enterica serovar Typhi
gccaugauucau

SEQ ID NO: 3615896 - RNA, 23 nt, Salmonella enterica enterica serovar Typhi
gccaugcaccacgacggccggac

SEQ ID NO: 3615897 - RNA, 14 nt, Salmonella enterica enterica serovar Typhi
gccaugcauaugaa

SEQ ID NO: 3615898 - RNA, 14 nt, Salmonella enterica enterica serovar Typhi
gccaugccagcagu

SEQ ID NO: 3615899 - RNA, 15 nt, Salmonella enterica enterica serovar Typhi
gccaugccagcaguu

SEQ ID NO: 3615900 - RNA, 14 nt, Salmonella enterica enterica serovar Typhi
gccaugccaucggc

SEQ ID NO: 3615901 - RNA, 17 nt, Salmonella enterica enterica serovar Typhi
gccaugcuauucagcag

SEQ ID NO: 3615902 - RNA, 19 nt, Salmonella enterica enterica serovar Typhi
gccaugcuauucagcaguu

SEQ ID NO: 3615903 - RNA, 14 nt, Salmonella enterica enterica serovar Typhi
gccaugcucaucca

SEQ ID NO: 3615904 - RNA, 16 nt, Salmonella enterica enterica serovar Typhi
gccaugcucauccaac

SEQ ID NO: 3615905 - RNA, 22 nt, Salmonella enterica enterica serovar Typhi
gccaugcucauccaacugcgcc

SEQ ID NO: 3615906 - RNA, 17 nt, Salmonella enterica enterica serovar Typhi
gccaugcugugugacca

SEQ ID NO: 3615907 - RNA, 22 nt, Salmonella enterica enterica serovar Typhi
gccaugcugugugaccagcagu

SEQ ID NO: 3615908 - RNA, 14 nt, Salmonella enterica enterica serovar Typhi
gccauggagaaaca

SEQ ID NO: 3615909 - RNA, 13 nt, Salmonella enterica enterica serovar Typhi
gccauggcccuuu

SEQ ID NO: 3615910 - RNA, 19 nt, Salmonella enterica enterica serovar Typhi
gccauggcccuuuugcccg

SEQ ID NO: 3615911 - RNA, 15 nt, Salmonella enterica enterica serovar Typhi
gccauggccgcagcc

SEQ ID NO: 3615912 - RNA, 16 nt, Salmonella enterica enterica serovar Typhi
gccauguuaauaccag

SEQ ID NO: 3615913 - RNA, 21 nt, Salmonella enterica enterica serovar Typhi
gccauguuaauaccagcgcca

SEQ ID NO: 3615914 - RNA, 15 nt, Salmonella enterica enterica serovar Typhi
gccauguuccucaca

SEQ ID NO: 3615915 - RNA, 19 nt, Salmonella enterica enterica serovar Typhi
gccauuaaugcaggcagca

SEQ ID NO: 3615916 - RNA, 16 nt, Salmonella enterica enterica serovar Typhi
gccauuaugcaggccg

SEQ ID NO: 3615917 - RNA, 13 nt, Salmonella enterica enterica serovar Typhi
gccauuauuuauu

SEQ ID NO: 3615918 - RNA, 23 nt, Salmonella enterica enterica serovar Typhi
gccauucauuaaaauugaacgga

SEQ ID NO: 3615919 - RNA, 14 nt, Salmonella enterica enterica serovar Typhi
gcccauuccgccug

SEQ ID NO: 3615920 - RNA, 16 nt, Salmonella enterica enterica serovar Typhi
gcccauugccacccau

SEQ ID NO: 3615921 - RNA, 19 nt, Salmonella enterica enterica serovar Typhi
gcccauuuaacagauaauu

SEQ ID NO: 3615922 - RNA, 13 nt, Salmonella enterica enterica serovar Typhi
gccccaacgcgcu

SEQ ID NO: 3615923 - RNA, 13 nt, Salmonella enterica enterica serovar Typhi
gccccaauaccac

SEQ ID NO: 3615924 - RNA, 18 nt, Salmonella enterica enterica serovar Typhi
gccccacacggccaccau

SEQ ID NO: 3615925 - RNA, 12 nt, Salmonella enterica enterica serovar Typhi
gccccaccgcca

SEQ ID NO: 3615926 - RNA, 14 nt, Salmonella enterica enterica serovar Typhi
gccccaccgccaga

SEQ ID NO: 3615927 - RNA, 11 nt, Salmonella enterica enterica serovar Typhi
gccccacuggc

SEQ ID NO: 3615928 - RNA, 13 nt, Salmonella enterica enterica serovar Typhi
gccccacuggccc

SEQ ID NO: 3615929 - RNA, 12 nt, Salmonella enterica enterica serovar Typhi
gccccagcacca

SEQ ID NO: 3615930 - RNA, 19 nt, Salmonella enterica enterica serovar Typhi
gccccagcaccaacgccgc

SEQ ID NO: 3615931 - RNA, 16 nt, Salmonella enterica enterica serovar Typhi
gccccagcaccagagc

SEQ ID NO: 3615932 - RNA, 21 nt, Salmonella enterica enterica serovar Typhi
gccccagcauauuuuccggcg

SEQ ID NO: 3615933 - RNA, 13 nt, Salmonella enterica enterica serovar Typhi
gccccagccugga

SEQ ID NO: 3615934 - RNA, 11 nt, Salmonella enterica enterica serovar Typhi
gccccagcgcc

SEQ ID NO: 3615935 - RNA, 14 nt, Salmonella enterica enterica serovar Typhi
gccccagcgccagc

SEQ ID NO: 3615936 - RNA, 14 nt, Salmonella enterica enterica serovar Typhi
gccccaucacggga

SEQ ID NO: 3615937 - RNA, 12 nt, Salmonella enterica enterica serovar Typhi
gccccaucagca

SEQ ID NO: 3615938 - RNA, 17 nt, Salmonella enterica enterica serovar Typhi
gccccauguggccagcg

SEQ ID NO: 3615939 - RNA, 22 nt, Salmonella enterica enterica serovar Typhi
gccccauuguucuuucauuuua

SEQ ID NO: 3615940 - RNA, 15 nt, Salmonella enterica enterica serovar Typhi
gcccccaugccgccu

SEQ ID NO: 3615941 - RNA, 22 nt, Salmonella enterica enterica serovar Typhi
gccccccgguagccacacccau

SEQ ID NO: 3615942 - RNA, 19 nt, Salmonella enterica enterica serovar Typhi
gcccccgauucaaucuggu

SEQ ID NO: 3615943 - RNA, 14 nt, Salmonella enterica enterica serovar Typhi
gcccccgcgcaggc

SEQ ID NO: 3615944 - RNA, 16 nt, Salmonella enterica enterica serovar Typhi
gcccccggccauagcg

SEQ ID NO: 3615945 - RNA, 13 nt, Salmonella enterica enterica serovar Typhi
gcccccucggcag

SEQ ID NO: 3615946 - RNA, 16 nt, Salmonella enterica enterica serovar Typhi
gcccccugccagcgcu

SEQ ID NO: 3615947 - RNA, 15 nt, Salmonella enterica enterica serovar Typhi
gccccgacaucagau

SEQ ID NO: 3615948 - RNA, 17 nt, Salmonella enterica enterica serovar Typhi
gccccgccacagccgca

SEQ ID NO: 3615949 - RNA, 12 nt, Salmonella enterica enterica serovar Typhi
gccccgccgcgc

SEQ ID NO: 3615950 - RNA, 22 nt, Salmonella enterica enterica serovar Typhi
gccccgcuucccgaaaggaagc

SEQ ID NO: 3615951 - RNA, 14 nt, Salmonella enterica enterica serovar Typhi
gccccggcgcgcgc

SEQ ID NO: 3615952 - RNA, 12 nt, Salmonella enterica enterica serovar Typhi
gccccggcggcg

SEQ ID NO: 3615953 - RNA, 23 nt, Salmonella enterica enterica serovar Typhi
gccccgggcgaccacccgcgacc

SEQ ID NO: 3615954 - RNA, 17 nt, Salmonella enterica enterica serovar Typhi
gccccggucaacgcgcc

SEQ ID NO: 3615955 - RNA, 18 nt, Salmonella enterica enterica serovar Typhi
gccccggucaacgcgccg

SEQ ID NO: 3615956 - RNA, 20 nt, Salmonella enterica enterica serovar Typhi
gccccggucaacgcgccgcc

SEQ ID NO: 3615957 - RNA, 16 nt, Salmonella enterica enterica serovar Typhi
gccccggugagcgccg

SEQ ID NO: 3615958 - RNA, 17 nt, Salmonella enterica enterica serovar Typhi
gccccggugagcgccgc

SEQ ID NO: 3615959 - RNA, 22 nt, Salmonella enterica enterica serovar Typhi
gccccggugcuuucuccugcgg

SEQ ID NO: 3615960 - RNA, 15 nt, Salmonella enterica enterica serovar Typhi
gccccguaucauuag

SEQ ID NO: 3615961 - RNA, 23 nt, Salmonella enterica enterica serovar Typhi
gccccguaucauuaggcggcgga

SEQ ID NO: 3615962 - RNA, 23 nt, Salmonella enterica enterica serovar Typhi
gccccgucagucgccagaaggca

SEQ ID NO: 3615963 - RNA, 16 nt, Salmonella enterica enterica serovar Typhi
gccccuaaggcagcaa

SEQ ID NO: 3615964 - RNA, 20 nt, Salmonella enterica enterica serovar Typhi
gccccucaauuauguauuuc

SEQ ID NO: 3615965 - RNA, 12 nt, Salmonella enterica enterica serovar Typhi
gccccucccuga

SEQ ID NO: 3615966 - RNA, 20 nt, Salmonella enterica enterica serovar Typhi
gccccucgcuaaugcccggc

SEQ ID NO: 3615967 - RNA, 23 nt, Salmonella enterica enterica serovar Typhi
gccccucgucuucgaccgccaua

SEQ ID NO: 3615968 - RNA, 18 nt, Salmonella enterica enterica serovar Typhi
gccccucuugcagcaaga

SEQ ID NO: 3615969 - RNA, 12 nt, Salmonella enterica enterica serovar Typhi
gccccugacgcu

SEQ ID NO: 3615970 - RNA, 21 nt, Salmonella enterica enterica serovar Typhi
gccccugagcaaucaguucuc

SEQ ID NO: 3615971 - RNA, 14 nt, Salmonella enterica enterica serovar Typhi
gccccugcuggcga

SEQ ID NO: 3615972 - RNA, 23 nt, Salmonella enterica enterica serovar Typhi
gccccugcuggcgaaccaccagc

SEQ ID NO: 3615973 - RNA, 19 nt, Salmonella enterica enterica serovar Typhi
gccccuguggaaucagucg

SEQ ID NO: 3615974 - RNA, 22 nt, Salmonella enterica enterica serovar Typhi
gcccgaaagcaauacuguaagc

SEQ ID NO: 3615975 - RNA, 11 nt, Salmonella enterica enterica serovar Typhi
gcccgaaucgc

SEQ ID NO: 3615976 - RNA, 13 nt, Salmonella enterica enterica serovar Typhi
gcccgaaucgccg

SEQ ID NO: 3615977 - RNA, 18 nt, Salmonella enterica enterica serovar Typhi
gcccgaccacgcccagcu

SEQ ID NO: 3615978 - RNA, 13 nt, Salmonella enterica enterica serovar Typhi
gcccgacgcgcca

SEQ ID NO: 3615979 - RNA, 21 nt, Salmonella enterica enterica serovar Typhi
gcccgacgcgccacuuccagc

SEQ ID NO: 3615980 - RNA, 18 nt, Salmonella enterica enterica serovar Typhi
gcccgagcgacgcccugc

SEQ ID NO: 3615981 - RNA, 13 nt, Salmonella enterica enterica serovar Typhi
gcccgauaaacaa

SEQ ID NO: 3615982 - RNA, 16 nt, Salmonella enterica enterica serovar Typhi
gcccgauaaaucgcau

SEQ ID NO: 3615983 - RNA, 12 nt, Salmonella enterica enterica serovar Typhi
gcccgauagcgu

SEQ ID NO: 3615984 - RNA, 19 nt, Salmonella enterica enterica serovar Typhi
gcccgauagcguaaagaaa

SEQ ID NO: 3615985 - RNA, 21 nt, Salmonella enterica enterica serovar Typhi
gcccgauggcgcugcgcgcau

SEQ ID NO: 3615986 - RNA, 17 nt, Salmonella enterica enterica serovar Typhi
gcccgauggcgcugcgu

SEQ ID NO: 3615987 - RNA, 13 nt, Salmonella enterica enterica serovar Typhi
gcccgcagaucug

SEQ ID NO: 3615988 - RNA, 16 nt, Salmonella enterica enterica serovar Typhi
gcccgcauucgcggca

SEQ ID NO: 3615989 - RNA, 12 nt, Salmonella enterica enterica serovar Typhi
gcccgccagcac

SEQ ID NO: 3615990 - RNA, 14 nt, Salmonella enterica enterica serovar Typhi
gcccgccagcacag

SEQ ID NO: 3615991 - RNA, 14 nt, Salmonella enterica enterica serovar Typhi
gcccgccagcacca

SEQ ID NO: 3615992 - RNA, 13 nt, Salmonella enterica enterica serovar Typhi
gcccgccagcggg

SEQ ID NO: 3615993 - RNA, 14 nt, Salmonella enterica enterica serovar Typhi
gcccgcccagcauu

SEQ ID NO: 3615994 - RNA, 16 nt, Salmonella enterica enterica serovar Typhi
gcccgccugagcgcgc

SEQ ID NO: 3615995 - RNA, 17 nt, Salmonella enterica enterica serovar Typhi
gcccgcguaacagcggu

SEQ ID NO: 3615996 - RNA, 21 nt, Salmonella enterica enterica serovar Typhi
gcccgcuaucaccgcccaaug

SEQ ID NO: 3615997 - RNA, 14 nt, Salmonella enterica enterica serovar Typhi
gcccgcucguuuca

SEQ ID NO: 3615998 - RNA, 18 nt, Salmonella enterica enterica serovar Typhi
gcccgcuguccgcccagu

SEQ ID NO: 3615999 - RNA, 22 nt, Salmonella enterica enterica serovar Typhi
gcccgcuucacgcgcggcuacu

SEQ ID NO: 3616000 - RNA, 14 nt, Salmonella enterica enterica serovar Typhi
gcccgcuuuaccga

SEQ ID NO: 3616001 - RNA, 20 nt, Salmonella enterica enterica serovar Typhi
gcccggaaauaaacgccagu

SEQ ID NO: 3616002 - RNA, 21 nt, Salmonella enterica enterica serovar Typhi
gcccggacaaggcgcgccagc

SEQ ID NO: 3616003 - RNA, 19 nt, Salmonella enterica enterica serovar Typhi
gcccggacaucauccccgg

SEQ ID NO: 3616004 - RNA, 21 nt, Salmonella enterica enterica serovar Typhi
gcccggaugauuaucaucuau

SEQ ID NO: 3616005 - RNA, 19 nt, Salmonella enterica enterica serovar Typhi
gccgacccccuccuuguaa

SEQ ID NO: 3616006 - RNA, 17 nt, Salmonella enterica enterica serovar Typhi
gccgaccgccagcagag

SEQ ID NO: 3616007 - RNA, 20 nt, Salmonella enterica enterica serovar Typhi
gccgaccgccagcagagcga

SEQ ID NO: 3616008 - RNA, 22 nt, Salmonella enterica enterica serovar Typhi
gccgaccgccaggucggcuuuu

SEQ ID NO: 3616009 - RNA, 12 nt, Salmonella enterica enterica serovar Typhi
gccgaccgccga

SEQ ID NO: 3616010 - RNA, 16 nt, Salmonella enterica enterica serovar Typhi
gccgacgauuugcgcu

SEQ ID NO: 3616011 - RNA, 18 nt, Salmonella enterica enterica serovar Typhi
gccgacgcauuucuccug

SEQ ID NO: 3616012 - RNA, 23 nt, Salmonella enterica enterica serovar Typhi
gccgacgcauuucuccugauuaa

SEQ ID NO: 3616013 - RNA, 20 nt, Salmonella enterica enterica serovar Typhi
gccgacgccacccagcgaac

SEQ ID NO: 3616014 - RNA, 16 nt, Salmonella enterica enterica serovar Typhi
gccgacgccagccauu

SEQ ID NO: 3616015 - RNA, 18 nt, Salmonella enterica enterica serovar Typhi
gccgacguuaucgccgac

SEQ ID NO: 3616016 - RNA, 12 nt, Salmonella enterica enterica serovar Typhi
gccgacucacgc

SEQ ID NO: 3616017 - RNA, 14 nt, Salmonella enterica enterica serovar Typhi
gccgacucgcgcaa

SEQ ID NO: 3616018 - RNA, 19 nt, Salmonella enterica enterica serovar Typhi
gccgacuuuacggccuagc

SEQ ID NO: 3616019 - RNA, 22 nt, Salmonella enterica enterica serovar Typhi
gccgacuuuacggccuagcugc

SEQ ID NO: 3616020 - RNA, 22 nt, Salmonella enterica enterica serovar Typhi
gccgagacgcugcacacgcugg

SEQ ID NO: 3616021 - RNA, 18 nt, Salmonella enterica enterica serovar Typhi
gccgagaguccagcgcca

SEQ ID NO: 3616022 - RNA, 16 nt, Salmonella enterica enterica serovar Typhi
gccgagcaacagaaac

SEQ ID NO: 3616023 - RNA, 19 nt, Salmonella enterica enterica serovar Typhi
gccgagcauuuccgcagcc

SEQ ID NO: 3616024 - RNA, 20 nt, Salmonella enterica enterica serovar Typhi
gccgagcauuuccgcagcca

SEQ ID NO: 3616025 - RNA, 16 nt, Salmonella enterica enterica serovar Typhi
gccgaggcauucagcc

SEQ ID NO: 3616026 - RNA, 22 nt, Salmonella enterica enterica serovar Typhi
gccgagucgguaagucugauaa

SEQ ID NO: 3616027 - RNA, 20 nt, Salmonella enterica enterica serovar Typhi
gccgagucgguuuuauuaac

SEQ ID NO: 3616028 - RNA, 16 nt, Salmonella enterica enterica serovar Typhi
gccgauaaauccuccg

SEQ ID NO: 3616029 - RNA, 22 nt, Salmonella enterica enterica serovar Typhi
gccgauaaccagcgcgccgcca

SEQ ID NO: 3616030 - RNA, 19 nt, Salmonella enterica enterica serovar Typhi
gccgauaauaaacgcgcca

SEQ ID NO: 3616031 - RNA, 18 nt, Salmonella enterica enterica serovar Typhi
gccgauagcaucgcugau

SEQ ID NO: 3616032 - RNA, 16 nt, Salmonella enterica enterica serovar Typhi
gccgauauugccuuca

SEQ ID NO: 3616033 - RNA, 20 nt, Salmonella enterica enterica serovar Typhi
gccgauauugcggccuuccu

SEQ ID NO: 3616034 - RNA, 17 nt, Salmonella enterica enterica serovar Typhi
gccgaucaccagcgcau

SEQ ID NO: 3616035 - RNA, 20 nt, Salmonella enterica enterica serovar Typhi
gccgaucaucccgcccagca

SEQ ID NO: 3616036 - RNA, 18 nt, Salmonella enterica enterica serovar Typhi
gccgaugacucccagucc

SEQ ID NO: 3616037 - RNA, 14 nt, Salmonella enterica enterica serovar Typhi
gccgaugccgccga

SEQ ID NO: 3616038 - RNA, 18 nt, Salmonella enterica enterica serovar Typhi
gccgauggcuaaagcgcu

SEQ ID NO: 3616039 - RNA, 16 nt, Salmonella enterica enterica serovar Typhi
gccgauggucgcgcca

SEQ ID NO: 3616040 - RNA, 13 nt, Salmonella enterica enterica serovar Typhi
gccgauuucauuc

SEQ ID NO: 3616041 - RNA, 14 nt, Salmonella enterica enterica serovar Typhi
gccgauuuuucggc

SEQ ID NO: 3616042 - RNA, 12 nt, Salmonella enterica enterica serovar Typhi
gccgcaaaagcc

SEQ ID NO: 3616043 - RNA, 15 nt, Salmonella enterica enterica serovar Typhi
gccgcaaacagcacg

SEQ ID NO: 3616044 - RNA, 17 nt, Salmonella enterica enterica serovar Typhi
gccgcaaacagcacgcc

SEQ ID NO: 3616045 - RNA, 14 nt, Salmonella enterica enterica serovar Typhi
gccgcaaacgccga

SEQ ID NO: 3616046 - RNA, 22 nt, Salmonella enterica enterica serovar Typhi
gccgcaaacgccugcuccgucc

SEQ ID NO: 3616047 - RNA, 18 nt, Salmonella enterica enterica serovar Typhi
gccgcaacccgauaagcu

SEQ ID NO: 3616048 - RNA, 12 nt, Salmonella enterica enterica serovar Typhi
gccgcaacggcu

SEQ ID NO: 3616049 - RNA, 15 nt, Salmonella enterica enterica serovar Typhi
gccgcaaggacgcca

SEQ ID NO: 3616050 - RNA, 20 nt, Salmonella enterica enterica serovar Typhi
gccgcaauaguuaauguuga

SEQ ID NO: 3616051 - RNA, 21 nt, Salmonella enterica enterica serovar Typhi
gccgcaaucacuucauacgaa

SEQ ID NO: 3616052 - RNA, 18 nt, Salmonella enterica enterica serovar Typhi
gccgcaaugaccacaaau

SEQ ID NO: 3616053 - RNA, 21 nt, Salmonella enterica enterica serovar Typhi
gccgcaaugaccacaaauucu

SEQ ID NO: 3616054 - RNA, 18 nt, Salmonella enterica enterica serovar Typhi
gccgcaauuccugacugc

SEQ ID NO: 3616055 - RNA, 21 nt, Salmonella enterica enterica serovar Typhi
gccgcaauugguaauuaaagg

SEQ ID NO: 3616056 - RNA, 16 nt, Salmonella enterica enterica serovar Typhi
gccgcacaaaauuuug

SEQ ID NO: 3616057 - RNA, 17 nt, Salmonella enterica enterica serovar Typhi
gccgcacaccagcgcau

SEQ ID NO: 3616058 - RNA, 15 nt, Salmonella enterica enterica serovar Typhi
gccgcacgcaccgua

SEQ ID NO: 3616059 - RNA, 16 nt, Salmonella enterica enterica serovar Typhi
gccgcacgccugcggc

SEQ ID NO: 3616060 - RNA, 16 nt, Salmonella enterica enterica serovar Typhi
gccgcacuccccagaa

SEQ ID NO: 3616061 - RNA, 22 nt, Salmonella enterica enterica serovar Typhi
gccgcagaaaauggucugccag

SEQ ID NO: 3616062 - RNA, 14 nt, Salmonella enterica enterica serovar Typhi
gccgcagcccgccc

SEQ ID NO: 3616063 - RNA, 15 nt, Salmonella enterica enterica serovar Typhi
gccgcagcccgccca

SEQ ID NO: 3616064 - RNA, 18 nt, Salmonella enterica enterica serovar Typhi
gccgcagccgcucagggu

SEQ ID NO: 3616065 - RNA, 15 nt, Salmonella enterica enterica serovar Typhi
gccgcagcgccauaa

SEQ ID NO: 3616066 - RNA, 12 nt, Salmonella enterica enterica serovar Typhi
gccgcagcgccg

SEQ ID NO: 3616067 - RNA, 17 nt, Salmonella enterica enterica serovar Typhi
gccgcagcuccaugucu

SEQ ID NO: 3616068 - RNA, 16 nt, Salmonella enterica enterica serovar Typhi
gccgcaggacagcgac

SEQ ID NO: 3616069 - RNA, 20 nt, Salmonella enterica enterica serovar Typhi
gccgcauaauucaucuuccg

SEQ ID NO: 3616070 - RNA, 23 nt, Salmonella enterica enterica serovar Typhi
gccgcaucauaguuuuuccccau

SEQ ID NO: 3616071 - RNA, 18 nt, Salmonella enterica enterica serovar Typhi
gccgcauccuguuuuuuc

SEQ ID NO: 3616072 - RNA, 23 nt, Salmonella enterica enterica serovar Typhi
gccgcaucgauaucuuuauucgc

SEQ ID NO: 3616073 - RNA, 19 nt, Salmonella enterica enterica serovar Typhi
gccgccaaacugcgcgccg

SEQ ID NO: 3616074 - RNA, 20 nt, Salmonella enterica enterica serovar Typhi
gccgccaaacugcgcgccgc

SEQ ID NO: 3616075 - RNA, 14 nt, Salmonella enterica enterica serovar Typhi
gccgccaaagcgcc

SEQ ID NO: 3616076 - RNA, 16 nt, Salmonella enterica enterica serovar Typhi
gccgccaacgccagca

SEQ ID NO: 3616077 - RNA, 17 nt, Salmonella enterica enterica serovar Typhi
gccgccaauaggggcgg

SEQ ID NO: 3616078 - RNA, 14 nt, Salmonella enterica enterica serovar Typhi
gccgccaccgccuc

SEQ ID NO: 3616079 - RNA, 12 nt, Salmonella enterica enterica serovar Typhi
gccgccagcgac

SEQ ID NO: 3616080 - RNA, 11 nt, Salmonella enterica enterica serovar Typhi
gccgccagcgu

SEQ ID NO: 3616081 - RNA, 19 nt, Salmonella enterica enterica serovar Typhi
gccgccagcucaugcgcgg

SEQ ID NO: 3616082 - RNA, 13 nt, Salmonella enterica enterica serovar Typhi
gccgccaggaacg

SEQ ID NO: 3616083 - RNA, 17 nt, Salmonella enterica enterica serovar Typhi
gccgccaggcaaauucu

SEQ ID NO: 3616084 - RNA, 20 nt, Salmonella enterica enterica serovar Typhi
gccgccaguugcucaacauu

SEQ ID NO: 3616085 - RNA, 12 nt, Salmonella enterica enterica serovar Typhi
gccgccauccgg

SEQ ID NO: 3616086 - RNA, 13 nt, Salmonella enterica enterica serovar Typhi
gccgccauccggc

SEQ ID NO: 3616087 - RNA, 14 nt, Salmonella enterica enterica serovar Typhi
gccgccauccggca

SEQ ID NO: 3616088 - RNA, 17 nt, Salmonella enterica enterica serovar Typhi
gccgccauccggcaaac

SEQ ID NO: 3616089 - RNA, 15 nt, Salmonella enterica enterica serovar Typhi
gccgccauccggcac

SEQ ID NO: 3616090 - RNA, 16 nt, Salmonella enterica enterica serovar Typhi
gccgccauccggcauu

SEQ ID NO: 3616091 - RNA, 17 nt, Salmonella enterica enterica serovar Typhi
gccgcuuccggcaggua

SEQ ID NO: 3616092 - RNA, 15 nt, Salmonella enterica enterica serovar Typhi
gccgcuuuaccgccu

SEQ ID NO: 3616093 - RNA, 20 nt, Salmonella enterica enterica serovar Typhi
gccgcuuugcgaacagcgca

SEQ ID NO: 3616094 - RNA, 16 nt, Salmonella enterica enterica serovar Typhi
gccgcuuuugccgcga

SEQ ID NO: 3616095 - RNA, 19 nt, Salmonella enterica enterica serovar Typhi
gccgcuuuugccgcgacuu

SEQ ID NO: 3616096 - RNA, 19 nt, Salmonella enterica enterica serovar Typhi
gccggaaaagcgcuggcug

SEQ ID NO: 3616097 - RNA, 16 nt, Salmonella enterica enterica serovar Typhi
gccggaaagaauaauc

SEQ ID NO: 3616098 - RNA, 17 nt, Salmonella enterica enterica serovar Typhi
gccggaaagaauaaucg

SEQ ID NO: 3616099 - RNA, 22 nt, Salmonella enterica enterica serovar Typhi
gccggaaaggauauaagcgcca

SEQ ID NO: 3616100 - RNA, 20 nt, Salmonella enterica enterica serovar Typhi
gccggaaaggcgcaacgucg

SEQ ID NO: 3616101 - RNA, 21 nt, Salmonella enterica enterica serovar Typhi
gccggaaagggugcccgccug

SEQ ID NO: 3616102 - RNA, 23 nt, Salmonella enterica enterica serovar Typhi
gccggaagcgauugucggcgccg

SEQ ID NO: 3616103 - RNA, 20 nt, Salmonella enterica enterica serovar Typhi
gccggaaucgcgauccagcc

SEQ ID NO: 3616104 - RNA, 14 nt, Salmonella enterica enterica serovar Typhi
gccggacaggcgac

SEQ ID NO: 3616105 - RNA, 12 nt, Salmonella enterica enterica serovar Typhi
gccggaccugcg

SEQ ID NO: 3616106 - RNA, 16 nt, Salmonella enterica enterica serovar Typhi
gccggacgccacgcuc

SEQ ID NO: 3616107 - RNA, 21 nt, Salmonella enterica enterica serovar Typhi
gccggacguaccuugccgaau

SEQ ID NO: 3616108 - RNA, 12 nt, Salmonella enterica enterica serovar Typhi
gccggagagggg

SEQ ID NO: 3616109 - RNA, 19 nt, Salmonella enterica enterica serovar Typhi
gccggagaguucauaacgc

SEQ ID NO: 3616110 - RNA, 13 nt, Salmonella enterica enterica serovar Typhi
gccggagcgucau

SEQ ID NO: 3616111 - RNA, 18 nt, Salmonella enterica enterica serovar Typhi
gccggagggcgaacuggc

SEQ ID NO: 3616112 - RNA, 16 nt, Salmonella enterica enterica serovar Typhi
gccggagguuuuucug

SEQ ID NO: 3616113 - RNA, 22 nt, Salmonella enterica enterica serovar Typhi
gccggauaagacgcgcagcggc

SEQ ID NO: 3616114 - RNA, 19 nt, Salmonella enterica enterica serovar Typhi
gccggauaagacgcuacgc

SEQ ID NO: 3616115 - RNA, 16 nt, Salmonella enterica enterica serovar Typhi
gccggauaagagaauc

SEQ ID NO: 3616116 - RNA, 21 nt, Salmonella enterica enterica serovar Typhi
gccggauaagcauuagcgcca

SEQ ID NO: 3616117 - RNA, 15 nt, Salmonella enterica enterica serovar Typhi
gccggauaagcgcag

SEQ ID NO: 3616118 - RNA, 16 nt, Salmonella enterica enterica serovar Typhi
gccggauaagcgcagc

SEQ ID NO: 3616119 - RNA, 20 nt, Salmonella enterica enterica serovar Typhi
gccggauaagcgcagcgcca

SEQ ID NO: 3616120 - RNA, 21 nt, Salmonella enterica enterica serovar Typhi
gccggauaagcggcagcgcca

SEQ ID NO: 3616121 - RNA, 19 nt, Salmonella enterica enterica serovar Typhi
gccggauaagcguagcgca

SEQ ID NO: 3616122 - RNA, 21 nt, Salmonella enterica enterica serovar Typhi
gccggauaagcguagcgccau

SEQ ID NO: 3616123 - RNA, 17 nt, Salmonella enterica enterica serovar Typhi
gccggauaagcguuagc

SEQ ID NO: 3616124 - RNA, 16 nt, Salmonella enterica enterica serovar Typhi
gccggauaaggccacg

SEQ ID NO: 3616125 - RNA, 17 nt, Salmonella enterica enterica serovar Typhi
gccggauaaggccacgc

SEQ ID NO: 3616126 - RNA, 21 nt, Salmonella enterica enterica serovar Typhi
gccggauaaggcgcuugugau

SEQ ID NO: 3616127 - RNA, 17 nt, Salmonella enterica enterica serovar Typhi
gccggauagggcguaag

SEQ ID NO: 3616128 - RNA, 20 nt, Salmonella enterica enterica serovar Typhi
gccggauaucgcuauccggc

SEQ ID NO: 3616129 - RNA, 21 nt, Salmonella enterica enterica serovar Typhi
gccggauauggcguccggcca

SEQ ID NO: 3616130 - RNA, 18 nt, Salmonella enterica enterica serovar Typhi
gccggaucgggcuuccag

SEQ ID NO: 3616131 - RNA, 21 nt, Salmonella enterica enterica serovar Typhi
gccggaugagcguuagcgcca

SEQ ID NO: 3616132 - RNA, 22 nt, Salmonella enterica enterica serovar Typhi
gccggaugaggcgcagccgcca

SEQ ID NO: 3616133 - RNA, 14 nt, Salmonella enterica enterica serovar Typhi
gccggaugcagucu

SEQ ID NO: 3616134 - RNA, 12 nt, Salmonella enterica enterica serovar Typhi
gccggauggcgc

SEQ ID NO: 3616135 - RNA, 13 nt, Salmonella enterica enterica serovar Typhi
gccggauggcgcu

SEQ ID NO: 3616136 - RNA, 21 nt, Salmonella enterica enterica serovar Typhi
gccggauggcgcuuugcuuau

SEQ ID NO: 3616137 - RNA, 14 nt, Salmonella enterica enterica serovar Typhi
gccggauggcggcg

SEQ ID NO: 3616138 - RNA, 17 nt, Salmonella enterica enterica serovar Typhi
gccggauggcggcugcg

SEQ ID NO: 3616139 - RNA, 18 nt, Salmonella enterica enterica serovar Typhi
gccggaugugagcgcauc

SEQ ID NO: 3616140 - RNA, 22 nt, Salmonella enterica enterica serovar Typhi
gccggauuuuacauagcagcaa

SEQ ID NO: 3616141 - RNA, 14 nt, Salmonella enterica enterica serovar Typhi
gccggcaaagccau

SEQ ID NO: 3616142 - RNA, 16 nt, Salmonella enterica enterica serovar Typhi
gccggcaaagguugcc

SEQ ID NO: 3616143 - RNA, 20 nt, Salmonella enterica enterica serovar Typhi
gccggcaaagguugccgcaa

SEQ ID NO: 3616144 - RNA, 18 nt, Salmonella enterica enterica serovar Typhi
gccggcaacacccgccga

SEQ ID NO: 3616145 - RNA, 22 nt, Salmonella enterica enterica serovar Typhi
gccggcagacgauagcggguga

SEQ ID NO: 3616146 - RNA, 12 nt, Salmonella enterica enterica serovar Typhi
gccggcagcagc

SEQ ID NO: 3616147 - RNA, 13 nt, Salmonella enterica enterica serovar Typhi
gccggcagcagcu

SEQ ID NO: 3616148 - RNA, 16 nt, Salmonella enterica enterica serovar Typhi
gccggcaggcagcgcc

SEQ ID NO: 3616149 - RNA, 17 nt, Salmonella enterica enterica serovar Typhi
gccggcaggcagcgcca

SEQ ID NO: 3616150 - RNA, 23 nt, Salmonella enterica enterica serovar Typhi
gccggcaucauucugcaggcggg

SEQ ID NO: 3616151 - RNA, 15 nt, Salmonella enterica enterica serovar Typhi
gccggccugauaagc

SEQ ID NO: 3616152 - RNA, 18 nt, Salmonella enterica enterica serovar Typhi
gccggcgaccaugccagc

SEQ ID NO: 3616153 - RNA, 18 nt, Salmonella enterica enterica serovar Typhi
gccggcgauaacccgcgc

SEQ ID NO: 3616154 - RNA, 12 nt, Salmonella enterica enterica serovar Typhi
gccggcgcagcg

SEQ ID NO: 3616155 - RNA, 19 nt, Salmonella enterica enterica serovar Typhi
gccggcgcguaauuccgca

SEQ ID NO: 3616156 - RNA, 21 nt, Salmonella enterica enterica serovar Typhi
gccggcggaaaaaagcagcau

SEQ ID NO: 3616157 - RNA, 23 nt, Salmonella enterica enterica serovar Typhi
gccggcgucgaucagcgcguaga

SEQ ID NO: 3616158 - RNA, 14 nt, Salmonella enterica enterica serovar Typhi
gccggcguuccgca

SEQ ID NO: 3616159 - RNA, 18 nt, Salmonella enterica enterica serovar Typhi
gccggcuuaccagcgggc

SEQ ID NO: 3616160 - RNA, 17 nt, Salmonella enterica enterica serovar Typhi
gccgggaucugauacgg

SEQ ID NO: 3616161 - RNA, 21 nt, Salmonella enterica enterica serovar Typhi
gccgggcagacaucgccgugc

SEQ ID NO: 3616162 - RNA, 18 nt, Salmonella enterica enterica serovar Typhi
gccgggcauaaacuaauc

SEQ ID NO: 3616163 - RNA, 15 nt, Salmonella enterica enterica serovar Typhi
gccgggcuauccggc

SEQ ID NO: 3616164 - RNA, 21 nt, Salmonella enterica enterica serovar Typhi
gccgggcuauccggcuguucg

SEQ ID NO: 3616165 - RNA, 13 nt, Salmonella enterica enterica serovar Typhi
gccggggcgcugg

SEQ ID NO: 3616166 - RNA, 14 nt, Salmonella enterica enterica serovar Typhi
gccggggcgcuggc

SEQ ID NO: 3616167 - RNA, 16 nt, Salmonella enterica enterica serovar Typhi
gccggggcuggcggcg

SEQ ID NO: 3616168 - RNA, 15 nt, Salmonella enterica enterica serovar Typhi
gccggguaaacgcag

SEQ ID NO: 3616169 - RNA, 20 nt, Salmonella enterica enterica serovar Typhi
gccggguaaacgcagcguca

SEQ ID NO: 3616170 - RNA, 18 nt, Salmonella enterica enterica serovar Typhi
gccgggugacgcuuacgc

SEQ ID NO: 3616171 - RNA, 23 nt, Salmonella enterica enterica serovar Typhi
gccgguaagaagaaccagcgcga

SEQ ID NO: 3616172 - RNA, 21 nt, Salmonella enterica enterica serovar Typhi
gccgguaaucgaucccgccgc

SEQ ID NO: 3616173 - RNA, 15 nt, Salmonella enterica enterica serovar Typhi
gccgguacgcagcag

SEQ ID NO: 3616174 - RNA, 17 nt, Salmonella enterica enterica serovar Typhi
gccgguacgcagcaggc

SEQ ID NO: 3616175 - RNA, 19 nt, Salmonella enterica enterica serovar Typhi
gccgguacuggagaccggc

SEQ ID NO: 3616176 - RNA, 13 nt, Salmonella enterica enterica serovar Typhi
gccuaaauguucc

SEQ ID NO: 3616177 - RNA, 14 nt, Salmonella enterica enterica serovar Typhi
gccuaaauuuaacu

SEQ ID NO: 3616178 - RNA, 15 nt, Salmonella enterica enterica serovar Typhi
gccuaacgccagcau

SEQ ID NO: 3616179 - RNA, 24 nt, Salmonella enterica enterica serovar Typhi
gccuaagaucggguggccuaacgc

SEQ ID NO: 3616180 - RNA, 12 nt, Salmonella enterica enterica serovar Typhi
gccuaagcccac

SEQ ID NO: 3616181 - RNA, 15 nt, Salmonella enterica enterica serovar Typhi
gccuaaugagccaga

SEQ ID NO: 3616182 - RNA, 21 nt, Salmonella enterica enterica serovar Typhi
gccuacaaaaucgcccaggcc

SEQ ID NO: 3616183 - RNA, 22 nt, Salmonella enterica enterica serovar Typhi
gccuacaaaaucgcccaggccu

SEQ ID NO: 3616184 - RNA, 16 nt, Salmonella enterica enterica serovar Typhi
gccuacagaacugcac

SEQ ID NO: 3616185 - RNA, 13 nt, Salmonella enterica enterica serovar Typhi
gccuacauccggc

SEQ ID NO: 3616186 - RNA, 15 nt, Salmonella enterica enterica serovar Typhi
gccuacauccggcuc

SEQ ID NO: 3616187 - RNA, 14 nt, Salmonella enterica enterica serovar Typhi
gccuaccagcacau

SEQ ID NO: 3616188 - RNA, 17 nt, Salmonella enterica enterica serovar Typhi
gccuaccaguuguuguc

SEQ ID NO: 3616189 - RNA, 18 nt, Salmonella enterica enterica serovar Typhi
gccuacccgcgugcggac

SEQ ID NO: 3616190 - RNA, 19 nt, Salmonella enterica enterica serovar Typhi
gccuaccggaauacacaau

SEQ ID NO: 3616191 - RNA, 16 nt, Salmonella enterica enterica serovar Typhi
gccuaccugccgccau

SEQ ID NO: 3616192 - RNA, 17 nt, Salmonella enterica enterica serovar Typhi
gccuaccugccgccaua

SEQ ID NO: 3616193 - RNA, 18 nt, Salmonella enterica enterica serovar Typhi
gccuacgcgcucacggca

SEQ ID NO: 3616194 - RNA, 24 nt, Salmonella enterica enterica serovar Typhi
gccuacggaaagcuguuguugcuc

SEQ ID NO: 3616195 - RNA, 19 nt, Salmonella enterica enterica serovar Typhi
gccuacggcuaccgccugu

SEQ ID NO: 3616196 - RNA, 23 nt, Salmonella enterica enterica serovar Typhi
gccuacggcuaccgccuguuuaa

SEQ ID NO: 3616197 - RNA, 23 nt, Salmonella enterica enterica serovar Typhi
gccuacgugcucucaccaucaua

SEQ ID NO: 3616198 - RNA, 18 nt, Salmonella enterica enterica serovar Typhi
gccuacugcccuacgcuu

SEQ ID NO: 3616199 - RNA, 14 nt, Salmonella enterica enterica serovar Typhi
gccuagcgcgcgca

SEQ ID NO: 3616200 - RNA, 18 nt, Salmonella enterica enterica serovar Typhi
gccuagcgcgcgcaguuu

SEQ ID NO: 3616201 - RNA, 23 nt, Salmonella enterica enterica serovar Typhi
gccuaucaccgcgaugaccauca

SEQ ID NO: 3616202 - RNA, 14 nt, Salmonella enterica enterica serovar Typhi
gccuaucaugcugc

SEQ ID NO: 3616203 - RNA, 12 nt, Salmonella enterica enterica serovar Typhi
gccuaucgccau

SEQ ID NO: 3616204 - RNA, 14 nt, Salmonella enterica enterica serovar Typhi
gccuaucgccauau

SEQ ID NO: 3616205 - RNA, 19 nt, Salmonella enterica enterica serovar Typhi
gccuauuuucucuuccaca

SEQ ID NO: 3616206 - RNA, 15 nt, Salmonella enterica enterica serovar Typhi
gccucaaaaccgggc

SEQ ID NO: 3616207 - RNA, 22 nt, Salmonella enterica enterica serovar Typhi
gccucaacaaguccuucuuccc

SEQ ID NO: 3616208 - RNA, 21 nt, Salmonella enterica enterica serovar Typhi
gccucaaccaacggcgcuggc

SEQ ID NO: 3616209 - RNA, 21 nt, Salmonella enterica enterica serovar Typhi
gccucacccugaaauccggcu

SEQ ID NO: 3616210 - RNA, 16 nt, Salmonella enterica enterica serovar Typhi
gccucacguagaucuu

SEQ ID NO: 3616211 - RNA, 21 nt, Salmonella enterica enterica serovar Typhi
gccucauccccugacgcgcgc

SEQ ID NO: 3616212 - RNA, 19 nt, Salmonella enterica enterica serovar Typhi
gccucauccgcauagcgca

SEQ ID NO: 3616213 - RNA, 16 nt, Salmonella enterica enterica serovar Typhi
gccucaucggcguugc

SEQ ID NO: 3616214 - RNA, 14 nt, Salmonella enterica enterica serovar Typhi
gccucaucugcuuc

SEQ ID NO: 3616215 - RNA, 11 nt, Salmonella enterica enterica serovar Typhi
gccucauugau

SEQ ID NO: 3616216 - RNA, 12 nt, Salmonella enterica enterica serovar Typhi
gccuccagcagc

SEQ ID NO: 3616217 - RNA, 17 nt, Salmonella enterica enterica serovar Typhi
gccuccagcgggcuggc

SEQ ID NO: 3616218 - RNA, 17 nt, Salmonella enterica enterica serovar Typhi
gccucccccucaaucgg

SEQ ID NO: 3616219 - RNA, 12 nt, Salmonella enterica enterica serovar Typhi
gccucccugccu

SEQ ID NO: 3616220 - RNA, 21 nt, Salmonella enterica enterica serovar Typhi
gccuccgcguagcccagcgcc

SEQ ID NO: 3616221 - RNA, 18 nt, Salmonella enterica enterica serovar Typhi
gccuccggaucgacagca

SEQ ID NO: 3616222 - RNA, 18 nt, Salmonella enterica enterica serovar Typhi
gccuccggaugacgccgc

SEQ ID NO: 3616223 - RNA, 12 nt, Salmonella enterica enterica serovar Typhi
gccuccggcaga

SEQ ID NO: 3616224 - RNA, 19 nt, Salmonella enterica enterica serovar Typhi
gccuccggcggugaagcag

SEQ ID NO: 3616225 - RNA, 23 nt, Salmonella enterica enterica serovar Typhi
gccuccggguuucacugcgugau

SEQ ID NO: 3616226 - RNA, 16 nt, Salmonella enterica enterica serovar Typhi
gccuccguaugaccgc

SEQ ID NO: 3616227 - RNA, 20 nt, Salmonella enterica enterica serovar Typhi
gccuccuggcuuaccugcuc

SEQ ID NO: 3616228 - RNA, 18 nt, Salmonella enterica enterica serovar Typhi
gccucgccaaagcgcugc

SEQ ID NO: 3616229 - RNA, 16 nt, Salmonella enterica enterica serovar Typhi
gccucgcgauccgcca

SEQ ID NO: 3616230 - RNA, 17 nt, Salmonella enterica enterica serovar Typhi
gccucgcgauccgccag

SEQ ID NO: 3616231 - RNA, 21 nt, Salmonella enterica enterica serovar Typhi
gccucgcucucuuucaccagc

SEQ ID NO: 3616232 - RNA, 22 nt, Salmonella enterica enterica serovar Typhi
gccucgcugauacgcaccagcu

SEQ ID NO: 3616233 - RNA, 16 nt, Salmonella enterica enterica serovar Typhi
gccucggcgacguccg

SEQ ID NO: 3616234 - RNA, 17 nt, Salmonella enterica enterica serovar Typhi
gccucggguggcaucug

SEQ ID NO: 3616235 - RNA, 17 nt, Salmonella enterica enterica serovar Typhi
gccucguccugcaauuu

SEQ ID NO: 3616236 - RNA, 17 nt, Salmonella enterica enterica serovar Typhi
gccucuacccaugaagc

SEQ ID NO: 3616237 - RNA, 13 nt, Salmonella enterica enterica serovar Typhi
gccucucccgaac

SEQ ID NO: 3616238 - RNA, 18 nt, Salmonella enterica enterica serovar Typhi
gccucucguaagagaggc

SEQ ID NO: 3616239 - RNA, 16 nt, Salmonella enterica enterica serovar Typhi
gccucugauuuuucca

SEQ ID NO: 3616240 - RNA, 14 nt, Salmonella enterica enterica serovar Typhi
gccucuuacagggc

SEQ ID NO: 3616241 - RNA, 14 nt, Salmonella enterica enterica serovar Typhi
gccucuuccgccug

SEQ ID NO: 3616242 - RNA, 22 nt, Salmonella enterica enterica serovar Typhi
gccucuuggaugauuuucuucu

SEQ ID NO: 3616243 - RNA, 13 nt, Salmonella enterica enterica serovar Typhi
gccucuuucagau

SEQ ID NO: 3616244 - RNA, 18 nt, Salmonella enterica enterica serovar Typhi
gccucuuucagaucgccg

SEQ ID NO: 3616245 - RNA, 22 nt, Salmonella enterica enterica serovar Typhi
gccucuuuugucguccccugga

SEQ ID NO: 3616246 - RNA, 21 nt, Salmonella enterica enterica serovar Typhi
gccucuuuuuucgccacgcca

SEQ ID NO: 3616247 - RNA, 21 nt, Salmonella enterica enterica serovar Typhi
gccugaagccagcaaucagcc

SEQ ID NO: 3616248 - RNA, 13 nt, Salmonella enterica enterica serovar Typhi
gccugaauaauga

SEQ ID NO: 3616249 - RNA, 15 nt, Salmonella enterica enterica serovar Typhi
gccugaauaaugacc

SEQ ID NO: 3616250 - RNA, 16 nt, Salmonella enterica enterica serovar Typhi
gccugaauaaugaccu

SEQ ID NO: 3616251 - RNA, 18 nt, Salmonella enterica enterica serovar Typhi
gccugaaugcacugcuga

SEQ ID NO: 3616252 - RNA, 22 nt, Salmonella enterica enterica serovar Typhi
gccugaaugcagaccucugcuu

SEQ ID NO: 3616253 - RNA, 18 nt, Salmonella enterica enterica serovar Typhi
gccugacaaugacgcuuc

SEQ ID NO: 3616254 - RNA, 17 nt, Salmonella enterica enterica serovar Typhi
gccugacagcaaugagc

SEQ ID NO: 3616255 - RNA, 20 nt, Salmonella enterica enterica serovar Typhi
gccugacgaaagucauccag

SEQ ID NO: 3616256 - RNA, 18 nt, Salmonella enterica enterica serovar Typhi
gccugacgaauagcgcgc

SEQ ID NO: 3616257 - RNA, 18 nt, Salmonella enterica enterica serovar Typhi
gccugacggcgcugucac

SEQ ID NO: 3616258 - RNA, 17 nt, Salmonella enterica enterica serovar Typhi
gccugacuccggguaac

SEQ ID NO: 3616259 - RNA, 12 nt, Salmonella enterica enterica serovar Typhi
gccugagcgcga

SEQ ID NO: 3616260 - RNA, 18 nt, Salmonella enterica enterica serovar Typhi
gccugagcgcgcagcugg

SEQ ID NO: 3616261 - RNA, 20 nt, Salmonella enterica enterica serovar Typhi
gccugauaaauaugucggcc

SEQ ID NO: 3616262 - RNA, 18 nt, Salmonella enterica enterica serovar Typhi
gccugucuccucagcagg

SEQ ID NO: 3616263 - RNA, 21 nt, Salmonella enterica enterica serovar Typhi
gccugugcuuucgccaccagc

SEQ ID NO: 3616264 - RNA, 14 nt, Salmonella enterica enterica serovar Typhi
gccuguguaaugaa

SEQ ID NO: 3616265 - RNA, 15 nt, Salmonella enterica enterica serovar Typhi
gccuguuagggcgcg

SEQ ID NO: 3616266 - RNA, 20 nt, Salmonella enterica enterica serovar Typhi
gccuguuccggcgaggacug

SEQ ID NO: 3616267 - RNA, 19 nt, Salmonella enterica enterica serovar Typhi
gccuguucuucaguaauuu

SEQ ID NO: 3616268 - RNA, 19 nt, Salmonella enterica enterica serovar Typhi
gccuguugcgggccagcag

SEQ ID NO: 3616269 - RNA, 23 nt, Salmonella enterica enterica serovar Typhi
gccuguuuaaugauucuguguuu

SEQ ID NO: 3616270 - RNA, 17 nt, Salmonella enterica enterica serovar Typhi
gccuguuuacugacgcc

SEQ ID NO: 3616271 - RNA, 22 nt, Salmonella enterica enterica serovar Typhi
gccuuaaaaaggacaagcugau

SEQ ID NO: 3616272 - RNA, 23 nt, Salmonella enterica enterica serovar Typhi
gccuuacaggcgcaucagaaaaa

SEQ ID NO: 3616273 - RNA, 22 nt, Salmonella enterica enterica serovar Typhi
gccuuacccaaccgugcuucac

SEQ ID NO: 3616274 - RNA, 13 nt, Salmonella enterica enterica serovar Typhi
gccuuacccgacc

SEQ ID NO: 3616275 - RNA, 14 nt, Salmonella enterica enterica serovar Typhi
gccuuacccggccu

SEQ ID NO: 3616276 - RNA, 12 nt, Salmonella enterica enterica serovar Typhi
gccuuagcgccc

SEQ ID NO: 3616277 - RNA, 19 nt, Salmonella enterica enterica serovar Typhi
gccuuauccgaccuacaga

SEQ ID NO: 3616278 - RNA, 13 nt, Salmonella enterica enterica serovar Typhi
gccuuauccggcc

SEQ ID NO: 3616279 - RNA, 14 nt, Salmonella enterica enterica serovar Typhi
gccuuauccggccu

SEQ ID NO: 3616280 - RNA, 22 nt, Salmonella enterica enterica serovar Typhi
gccuuauccggccuacaacuca

SEQ ID NO: 3616281 - RNA, 18 nt, Salmonella enterica enterica serovar Typhi
gccuuauccggccuacac

SEQ ID NO: 3616282 - RNA, 19 nt, Salmonella enterica enterica serovar Typhi
gccuuauccggccuacaga

SEQ ID NO: 3616283 - RNA, 18 nt, Salmonella enterica enterica serovar Typhi
gccuuauccggccuacgu

SEQ ID NO: 3616284 - RNA, 14 nt, Salmonella enterica enterica serovar Typhi
gccuuauccggcgu

SEQ ID NO: 3616285 - RNA, 19 nt, Salmonella enterica enterica serovar Typhi
gccuuauuuuucagcgcca

SEQ ID NO: 3616286 - RNA, 14 nt, Salmonella enterica enterica serovar Typhi
gccuucaaucagca

SEQ ID NO: 3616287 - RNA, 17 nt, Salmonella enterica enterica serovar Typhi
gccuucacacugcgccg

SEQ ID NO: 3616288 - RNA, 20 nt, Salmonella enterica enterica serovar Typhi
gccuucacacugcgccgcca

SEQ ID NO: 3616289 - RNA, 15 nt, Salmonella enterica enterica serovar Typhi
gccuucaggcaucag

SEQ ID NO: 3616290 - RNA, 13 nt, Salmonella enterica enterica serovar Typhi
gccuucagguuuu

SEQ ID NO: 3616291 - RNA, 22 nt, Salmonella enterica enterica serovar Typhi
gccuucauauuaaauuccggcu

SEQ ID NO: 3616292 - RNA, 12 nt, Salmonella enterica enterica serovar Typhi
gccuuccacggc

SEQ ID NO: 3616293 - RNA, 16 nt, Salmonella enterica enterica serovar Typhi
gccuuccagaaauaaa

SEQ ID NO: 3616294 - RNA, 20 nt, Salmonella enterica enterica serovar Typhi
gccuuccguccacaucgcga

SEQ ID NO: 3616295 - RNA, 16 nt, Salmonella enterica enterica serovar Typhi
gccuuccuccagcauc

SEQ ID NO: 3616296 - RNA, 22 nt, Salmonella enterica enterica serovar Typhi
gccuuccuccagcaucaggugg

SEQ ID NO: 3616297 - RNA, 17 nt, Salmonella enterica enterica serovar Typhi
gccuuccuccaguaauu

SEQ ID NO: 3616298 - RNA, 14 nt, Salmonella enterica enterica serovar Typhi
gccuuccuggucug

SEQ ID NO: 3616299 - RNA, 21 nt, Salmonella enterica enterica serovar Typhi
gccuucgccgcccaaccagcc

SEQ ID NO: 3616300 - RNA, 14 nt, Salmonella enterica enterica serovar Typhi
gccuucgccgccgc

SEQ ID NO: 3616301 - RNA, 15 nt, Salmonella enterica enterica serovar Typhi
gccuucgccuucacg

SEQ ID NO: 3616302 - RNA, 20 nt, Salmonella enterica enterica serovar Typhi
gccuucgcggugaucccagg

SEQ ID NO: 3616303 - RNA, 13 nt, Salmonella enterica enterica serovar Typhi
gccuucggccuga

SEQ ID NO: 3616304 - RNA, 15 nt, Salmonella enterica enterica serovar Typhi
gccuucggcgcuggg

SEQ ID NO: 3616305 - RNA, 19 nt, Salmonella enterica enterica serovar Typhi
gccuucggcgucgugcugg

SEQ ID NO: 3616306 - RNA, 15 nt, Salmonella enterica enterica serovar Typhi
gccuucuucaucuuc

SEQ ID NO: 3616307 - RNA, 14 nt, Salmonella enterica enterica serovar Typhi
gccuucuuccguca

SEQ ID NO: 3616308 - RNA, 22 nt, Salmonella enterica enterica serovar Typhi
gccuugaaguuauccagcgccc

SEQ ID NO: 3616309 - RNA, 21 nt, Salmonella enterica enterica serovar Typhi
gccuugagcaaaacaccgcuc

SEQ ID NO: 3616310 - RNA, 16 nt, Salmonella enterica enterica serovar Typhi
gccuugauaccgccgc

SEQ ID NO: 3616311 - RNA, 20 nt, Salmonella enterica enterica serovar Typhi
gccuugauccuguaacgcau

SEQ ID NO: 3616312 - RNA, 14 nt, Salmonella enterica enterica serovar Typhi
gccuugcaaaccgg

SEQ ID NO: 3616313 - RNA, 13 nt, Salmonella enterica enterica serovar Typhi
gccuugccgccag

SEQ ID NO: 3616314 - RNA, 14 nt, Salmonella enterica enterica serovar Typhi
gccuugccgccagc

SEQ ID NO: 3616315 - RNA, 16 nt, Salmonella enterica enterica serovar Typhi
gccuugcggcgccagg

SEQ ID NO: 3616316 - RNA, 17 nt, Salmonella enterica enterica serovar Typhi
gccuugcggcgccagga

SEQ ID NO: 3616317 - RNA, 21 nt, Salmonella enterica enterica serovar Typhi
gccuugcuggccuguucaagu

SEQ ID NO: 3616318 - RNA, 21 nt, Salmonella enterica enterica serovar Typhi
gccuuguaggccugauagcac

SEQ ID NO: 3616319 - RNA, 14 nt, Salmonella enterica enterica serovar Typhi
gccuuguccggcgu

SEQ ID NO: 3616320 - RNA, 20 nt, Salmonella enterica enterica serovar Typhi
gccuugugucacauuuucuu

SEQ ID NO: 3616321 - RNA, 19 nt, Salmonella enterica enterica serovar Typhi
gccuuuacccuuacggcca

SEQ ID NO: 3616322 - RNA, 21 nt, Salmonella enterica enterica serovar Typhi
gccuuuacugaaucucagaua

SEQ ID NO: 3616323 - RNA, 14 nt, Salmonella enterica enterica serovar Typhi
gccuuuauccagcg

SEQ ID NO: 3616324 - RNA, 13 nt, Salmonella enterica enterica serovar Typhi
gccuuuauuucaa

SEQ ID NO: 3616325 - RNA, 17 nt, Salmonella enterica enterica serovar Typhi
gccuuucagaugguuug

SEQ ID NO: 3616326 - RNA, 18 nt, Salmonella enterica enterica serovar Typhi
gccuuucggcagcgggau

SEQ ID NO: 3616327 - RNA, 18 nt, Salmonella enterica enterica serovar Typhi
gccuuucuccauggucag

SEQ ID NO: 3616328 - RNA, 16 nt, Salmonella enterica enterica serovar Typhi
gccuuugcguaccgca

SEQ ID NO: 3616329 - RNA, 12 nt, Salmonella enterica enterica serovar Typhi
gccuuuggccug

SEQ ID NO: 3616330 - RNA, 15 nt, Salmonella enterica enterica serovar Typhi
gccuuuggccuggag

SEQ ID NO: 3616331 - RNA, 23 nt, Salmonella enterica enterica serovar Typhi
gccuuuuaucaaugcacugacuu

SEQ ID NO: 3616332 - RNA, 22 nt, Salmonella enterica enterica serovar Typhi
gccuuuucauauggaagcuguu

SEQ ID NO: 3616333 - RNA, 20 nt, Salmonella enterica enterica serovar Typhi
gccuuuucccccagcauuuu

SEQ ID NO: 3616334 - RNA, 15 nt, Salmonella enterica enterica serovar Typhi
gccuuuuucccacug

SEQ ID NO: 3616335 - RNA, 20 nt, Salmonella enterica enterica serovar Typhi
gccuuuuugcagcgcggcca

SEQ ID NO: 3616336 - RNA, 17 nt, Salmonella enterica enterica serovar Typhi
gccuuuuuuaauccagg

SEQ ID NO: 3616337 - RNA, 22 nt, Salmonella enterica enterica serovar Typhi
gccuuuuuuauacuccagcaga

SEQ ID NO: 3616338 - RNA, 23 nt, Salmonella enterica enterica serovar Typhi
gccuuuuuuauacuccagcagac

SEQ ID NO: 3616339 - RNA, 18 nt, Salmonella enterica enterica serovar Typhi
gccuuuuuucaccugcaa

SEQ ID NO: 3616340 - RNA, 23 nt, Salmonella enterica enterica serovar Typhi
gccuuuuuuuuaccguuugucuu

SEQ ID NO: 3616341 - RNA, 12 nt, Salmonella enterica enterica serovar Typhi
gcgaaaaagccg

SEQ ID NO: 3616342 - RNA, 18 nt, Salmonella enterica enterica serovar Typhi
gcgaaaaaguucacgcuu

SEQ ID NO: 3616343 - RNA, 23 nt, Salmonella enterica enterica serovar Typhi
gcgaaaaauaggauggcgcagca

SEQ ID NO: 3616344 - RNA, 15 nt, Salmonella enterica enterica serovar Typhi
gcgaaaacagcuggc

SEQ ID NO: 3616345 - RNA, 12 nt, Salmonella enterica enterica serovar Typhi
gcgaaaaccagc

SEQ ID NO: 3616346 - RNA, 22 nt, Salmonella enterica enterica serovar Typhi
gcgaaaaccagcgccgccagau

SEQ ID NO: 3616347 - RNA, 21 nt, Salmonella enterica enterica serovar Typhi
gcgaccaguuauucggcauau

SEQ ID NO: 3616348 - RNA, 20 nt, Salmonella enterica enterica serovar Typhi
gcgaccaguucaccggcggc

SEQ ID NO: 3616349 - RNA, 21 nt, Salmonella enterica enterica serovar Typhi
gcgaccgcaucaaugcccagc

SEQ ID NO: 3616350 - RNA, 16 nt, Salmonella enterica enterica serovar Typhi
gcgaccgccgcugguc

SEQ ID NO: 3616351 - RNA, 19 nt, Salmonella enterica enterica serovar Typhi
gcgaccgcgccacggccaa

SEQ ID NO: 3616352 - RNA, 13 nt, Salmonella enterica enterica serovar Typhi
gcgaccggcagcc

SEQ ID NO: 3616353 - RNA, 15 nt, Salmonella enterica enterica serovar Typhi
gcgaccucaucaaac

SEQ ID NO: 3616354 - RNA, 24 nt, Salmonella enterica enterica serovar Typhi
gcgaccuguagaugaaacucgcug

SEQ ID NO: 3616355 - RNA, 16 nt, Salmonella enterica enterica serovar Typhi
gcgaccuuaccggcga

SEQ ID NO: 3616356 - RNA, 17 nt, Salmonella enterica enterica serovar Typhi
gcgaccuuaccggcgac

SEQ ID NO: 3616357 - RNA, 13 nt, Salmonella enterica enterica serovar Typhi
gcgaccuucuccc

SEQ ID NO: 3616358 - RNA, 15 nt, Salmonella enterica enterica serovar Typhi
gcgacgaaucagcga

SEQ ID NO: 3616359 - RNA, 16 nt, Salmonella enterica enterica serovar Typhi
gcgacgacacggcgca

SEQ ID NO: 3616360 - RNA, 18 nt, Salmonella enterica enterica serovar Typhi
gcgacgacacggcgcaga

SEQ ID NO: 3616361 - RNA, 13 nt, Salmonella enterica enterica serovar Typhi
gcgacgacgccag

SEQ ID NO: 3616362 - RNA, 17 nt, Salmonella enterica enterica serovar Typhi
gcgacgacgccagccag

SEQ ID NO: 3616363 - RNA, 18 nt, Salmonella enterica enterica serovar Typhi
gcgacgacgccagccagc

SEQ ID NO: 3616364 - RNA, 19 nt, Salmonella enterica enterica serovar Typhi
gcgacgacgccagccagcc

SEQ ID NO: 3616365 - RNA, 22 nt, Salmonella enterica enterica serovar Typhi
gcgacgacuucacccgcgggcg

SEQ ID NO: 3616366 - RNA, 18 nt, Salmonella enterica enterica serovar Typhi
gcgacgauaaaucgguuc

SEQ ID NO: 3616367 - RNA, 15 nt, Salmonella enterica enterica serovar Typhi
gcgacgaucagcgcc

SEQ ID NO: 3616368 - RNA, 18 nt, Salmonella enterica enterica serovar Typhi
gcgacgaucagcgccacg

SEQ ID NO: 3616369 - RNA, 12 nt, Salmonella enterica enterica serovar Typhi
gcgacgaugcgc

SEQ ID NO: 3616370 - RNA, 20 nt, Salmonella enterica enterica serovar Typhi
gcgacgccaaucggcgucuu

SEQ ID NO: 3616371 - RNA, 17 nt, Salmonella enterica enterica serovar Typhi
gcgacgcgccagccagc

SEQ ID NO: 3616372 - RNA, 16 nt, Salmonella enterica enterica serovar Typhi
gcgacgcgcgagcgca

SEQ ID NO: 3616373 - RNA, 16 nt, Salmonella enterica enterica serovar Typhi
gcgacgcggcgaguua

SEQ ID NO: 3616374 - RNA, 16 nt, Salmonella enterica enterica serovar Typhi
gcgacggaccggcagc

SEQ ID NO: 3616375 - RNA, 16 nt, Salmonella enterica enterica serovar Typhi
gcgacggagcgugcug

SEQ ID NO: 3616376 - RNA, 16 nt, Salmonella enterica enterica serovar Typhi
gcgacggcccaacagc

SEQ ID NO: 3616377 - RNA, 15 nt, Salmonella enterica enterica serovar Typhi
gcgacggcgcuggcu

SEQ ID NO: 3616378 - RNA, 13 nt, Salmonella enterica enterica serovar Typhi
gcgacggcggcgu

SEQ ID NO: 3616379 - RNA, 17 nt, Salmonella enterica enterica serovar Typhi
gcgacggcguaagcgcu

SEQ ID NO: 3616380 - RNA, 18 nt, Salmonella enterica enterica serovar Typhi
gcgacggcguauucggca

SEQ ID NO: 3616381 - RNA, 16 nt, Salmonella enterica enterica serovar Typhi
gcgacgguccuggcca

SEQ ID NO: 3616382 - RNA, 18 nt, Salmonella enterica enterica serovar Typhi
gcgacguauuacgcaggc

SEQ ID NO: 3616383 - RNA, 12 nt, Salmonella enterica enterica serovar Typhi
gcgacguuaucu

SEQ ID NO: 3616384 - RNA, 20 nt, Salmonella enterica enterica serovar Typhi
gcgacguuaucucgccagga

SEQ ID NO: 3616385 - RNA, 14 nt, Salmonella enterica enterica serovar Typhi
gcgacguuccgcga

SEQ ID NO: 3616386 - RNA, 14 nt, Salmonella enterica enterica serovar Typhi
gcgacuaaccugau

SEQ ID NO: 3616387 - RNA, 18 nt, Salmonella enterica enterica serovar Typhi
gcgacuaacgucuuaucc

SEQ ID NO: 3616388 - RNA, 22 nt, Salmonella enterica enterica serovar Typhi
gcgacuaccguucacggcgaua

SEQ ID NO: 3616389 - RNA, 20 nt, Salmonella enterica enterica serovar Typhi
gcgacucuguauuuaauacc

SEQ ID NO: 3616390 - RNA, 23 nt, Salmonella enterica enterica serovar Typhi
gcgacugaucaggcuaaagugcg

SEQ ID NO: 3616391 - RNA, 12 nt, Salmonella enterica enterica serovar Typhi
gcgacugccgca

SEQ ID NO: 3616392 - RNA, 18 nt, Salmonella enterica enterica serovar Typhi
gcgacuggaacgucauca

SEQ ID NO: 3616393 - RNA, 17 nt, Salmonella enterica enterica serovar Typhi
gcgacuucauucaggca

SEQ ID NO: 3616394 - RNA, 23 nt, Salmonella enterica enterica serovar Typhi
gcgacuuccgucuccggacguuu

SEQ ID NO: 3616395 - RNA, 15 nt, Salmonella enterica enterica serovar Typhi
gcgacuuuaaucacc

SEQ ID NO: 3616396 - RNA, 21 nt, Salmonella enterica enterica serovar Typhi
gcgacuuucacgaaaccggcg

SEQ ID NO: 3616397 - RNA, 20 nt, Salmonella enterica enterica serovar Typhi
gcgacuuuccgccaccagau

SEQ ID NO: 3616398 - RNA, 12 nt, Salmonella enterica enterica serovar Typhi
gcgacuuuggcu

SEQ ID NO: 3616399 - RNA, 18 nt, Salmonella enterica enterica serovar Typhi
gcgacuuuuuucacccag

SEQ ID NO: 3616400 - RNA, 11 nt, Salmonella enterica enterica serovar Typhi
gcgagaaaaaa

SEQ ID NO: 3616401 - RNA, 22 nt, Salmonella enterica enterica serovar Typhi
gcgagaacugcugcauccgcgc

SEQ ID NO: 3616402 - RNA, 15 nt, Salmonella enterica enterica serovar Typhi
gcgagaagcugggcg

SEQ ID NO: 3616403 - RNA, 22 nt, Salmonella enterica enterica serovar Typhi
gcgagaaggcuuugccauacgc

SEQ ID NO: 3616404 - RNA, 13 nt, Salmonella enterica enterica serovar Typhi
gcgagaccauauu

SEQ ID NO: 3616405 - RNA, 14 nt, Salmonella enterica enterica serovar Typhi
gcgagacgccuggg

SEQ ID NO: 3616406 - RNA, 15 nt, Salmonella enterica enterica serovar Typhi
gcgagagaaaaaaau

SEQ ID NO: 3616407 - RNA, 20 nt, Salmonella enterica enterica serovar Typhi
gcgagcaaaacccggugcgg

SEQ ID NO: 3616408 - RNA, 20 nt, Salmonella enterica enterica serovar Typhi
gcgagcacuuuuuccuccug

SEQ ID NO: 3616409 - RNA, 23 nt, Salmonella enterica enterica serovar Typhi
gcgagcaggaaccacaucgcgac

SEQ ID NO: 3616410 - RNA, 18 nt, Salmonella enterica enterica serovar Typhi
gcgagcaguucagcagca

SEQ ID NO: 3616411 - RNA, 11 nt, Salmonella enterica enterica serovar Typhi
gcgagcccugu

SEQ ID NO: 3616412 - RNA, 15 nt, Salmonella enterica enterica serovar Typhi
gcgagccuucaacaa

SEQ ID NO: 3616413 - RNA, 19 nt, Salmonella enterica enterica serovar Typhi
gcgagcgcauacgcugucc

SEQ ID NO: 3616414 - RNA, 19 nt, Salmonella enterica enterica serovar Typhi
gcgaggaaaacgcuucuac

SEQ ID NO: 3616415 - RNA, 20 nt, Salmonella enterica enterica serovar Typhi
gcgaggaaaaucgcugcgcc

SEQ ID NO: 3616416 - RNA, 22 nt, Salmonella enterica enterica serovar Typhi
gcgaggaacaucagccagcagc

SEQ ID NO: 3616417 - RNA, 21 nt, Salmonella enterica enterica serovar Typhi
gcgaggugguucauaauaccu

SEQ ID NO: 3616418 - RNA, 20 nt, Salmonella enterica enterica serovar Typhi
gcgagguucccgccgccauu

SEQ ID NO: 3616419 - RNA, 16 nt, Salmonella enterica enterica serovar Typhi
gcgaguacgcacaaca

SEQ ID NO: 3616420 - RNA, 14 nt, Salmonella enterica enterica serovar Typhi
gcgaguagcgcagc

SEQ ID NO: 3616421 - RNA, 18 nt, Salmonella enterica enterica serovar Typhi
gcgagucagacaccagcc

SEQ ID NO: 3616422 - RNA, 20 nt, Salmonella enterica enterica serovar Typhi
gcgaguccgcuuuucguccc

SEQ ID NO: 3616423 - RNA, 14 nt, Salmonella enterica enterica serovar Typhi
gcgagugccugcug

SEQ ID NO: 3616424 - RNA, 23 nt, Salmonella enterica enterica serovar Typhi
gcgauaaaaacccaccagcgcca

SEQ ID NO: 3616425 - RNA, 18 nt, Salmonella enterica enterica serovar Typhi
gcgauaaaaauauccgcc

SEQ ID NO: 3616426 - RNA, 21 nt, Salmonella enterica enterica serovar Typhi
gcgauaaaaauauccgccauc

SEQ ID NO: 3616427 - RNA, 19 nt, Salmonella enterica enterica serovar Typhi
gcgauaaaaccaccuacgc

SEQ ID NO: 3616428 - RNA, 13 nt, Salmonella enterica enterica serovar Typhi
gcgauaaacgauc

SEQ ID NO: 3616429 - RNA, 19 nt, Salmonella enterica enterica serovar Typhi
gcgauaaccgccgccgcgc

SEQ ID NO: 3616430 - RNA, 14 nt, Salmonella enterica enterica serovar Typhi
gcgauaagcgucuu

SEQ ID NO: 3616431 - RNA, 17 nt, Salmonella enterica enterica serovar Typhi
gcgauaaggauaucuug

SEQ ID NO: 3616432 - RNA, 20 nt, Salmonella enterica enterica serovar Typhi
gcgauaaggucgcuauccag

SEQ ID NO: 3616433 - RNA, 21 nt, Salmonella enterica enterica serovar Typhi
gcgauaaggucgcuauccagc

SEQ ID NO: 3616434 - RNA, 17 nt, Salmonella enterica enterica serovar Typhi
gcgauaccgugacugac

SEQ ID NO: 3616435 - RNA, 19 nt, Salmonella enterica enterica serovar Typhi
gcgauaccgugacugacca

SEQ ID NO: 3616436 - RNA, 20 nt, Salmonella enterica enterica serovar Typhi
gcgauaccgugacugaccaa

SEQ ID NO: 3616437 - RNA, 15 nt, Salmonella enterica enterica serovar Typhi
gcgauacgcagcacc

SEQ ID NO: 3616438 - RNA, 15 nt, Salmonella enterica enterica serovar Typhi
gcgauacguaggccu

SEQ ID NO: 3616439 - RNA, 15 nt, Salmonella enterica enterica serovar Typhi
gcgauacucucgcag

SEQ ID NO: 3616440 - RNA, 19 nt, Salmonella enterica enterica serovar Typhi
gcgauacucucgcagcgaa

SEQ ID NO: 3616441 - RNA, 18 nt, Salmonella enterica enterica serovar Typhi
gcgauacucugcccgccg

SEQ ID NO: 3616442 - RNA, 17 nt, Salmonella enterica enterica serovar Typhi
gcgauagaccacgccau

SEQ ID NO: 3616443 - RNA, 13 nt, Salmonella enterica enterica serovar Typhi
gcgauagcugcug

SEQ ID NO: 3616444 - RNA, 17 nt, Salmonella enterica enterica serovar Typhi
gcgauauccgugccgcc

SEQ ID NO: 3616445 - RNA, 16 nt, Salmonella enterica enterica serovar Typhi
gcgauauucgggcgca

SEQ ID NO: 3616446 - RNA, 15 nt, Salmonella enterica enterica serovar Typhi
gcgaucaagacaaaa

SEQ ID NO: 3616447 - RNA, 15 nt, Salmonella enterica enterica serovar Typhi
gcgaucacuaccgcc

SEQ ID NO: 3616448 - RNA, 13 nt, Salmonella enterica enterica serovar Typhi
gcgaucagcgcca

SEQ ID NO: 3616449 - RNA, 15 nt, Salmonella enterica enterica serovar Typhi
gcgaucagcgccacc

SEQ ID NO: 3616450 - RNA, 17 nt, Salmonella enterica enterica serovar Typhi
gcgaucagcgccaccac

SEQ ID NO: 3616451 - RNA, 15 nt, Salmonella enterica enterica serovar Typhi
gcgaucaggcgucag

SEQ ID NO: 3616452 - RNA, 21 nt, Salmonella enterica enterica serovar Typhi
gcgauccacaaucgucgugcc

SEQ ID NO: 3616453 - RNA, 22 nt, Salmonella enterica enterica serovar Typhi
gcgauccacaaucgucgugccu

SEQ ID NO: 3616454 - RNA, 20 nt, Salmonella enterica enterica serovar Typhi
gcgauccagccccagcgcca

SEQ ID NO: 3616455 - RNA, 21 nt, Salmonella enterica enterica serovar Typhi
gcgauccagccccagcgccag

SEQ ID NO: 3616456 - RNA, 17 nt, Salmonella enterica enterica serovar Typhi
gcgauccaggucuuccg

SEQ ID NO: 3616457 - RNA, 22 nt, Salmonella enterica enterica serovar Typhi
gcgaucccaguugaucggccag

SEQ ID NO: 3616458 - RNA, 21 nt, Salmonella enterica enterica serovar Typhi
gcgauccgcgagacgccuggg

SEQ ID NO: 3616459 - RNA, 16 nt, Salmonella enterica enterica serovar Typhi
gcgaucgagcgcaaua

SEQ ID NO: 3616460 - RNA, 21 nt, Salmonella enterica enterica serovar Typhi
gcgaucgccgucguucagcca

SEQ ID NO: 3616461 - RNA, 12 nt, Salmonella enterica enterica serovar Typhi
gcgaucgcgcca

SEQ ID NO: 3616462 - RNA, 14 nt, Salmonella enterica enterica serovar Typhi
gcgaucgcgccagc

SEQ ID NO: 3616463 - RNA, 12 nt, Salmonella enterica enterica serovar Typhi
gcgaucgcgccg

SEQ ID NO: 3616464 - RNA, 13 nt, Salmonella enterica enterica serovar Typhi
gcgaucgcuucca

SEQ ID NO: 3616465 - RNA, 16 nt, Salmonella enterica enterica serovar Typhi
gcgaucggcuguaccu

SEQ ID NO: 3616466 - RNA, 17 nt, Salmonella enterica enterica serovar Typhi
gcgaucucuuuggccag

SEQ ID NO: 3616467 - RNA, 14 nt, Salmonella enterica enterica serovar Typhi
gcgaucugucgccg

SEQ ID NO: 3616468 - RNA, 12 nt, Salmonella enterica enterica serovar Typhi
gcgaugagcgcc

SEQ ID NO: 3616469 - RNA, 14 nt, Salmonella enterica enterica serovar Typhi
gcgaugagcgccag

SEQ ID NO: 3616470 - RNA, 19 nt, Salmonella enterica enterica serovar Typhi
gcgaugagcgccagcaaca

SEQ ID NO: 3616471 - RNA, 23 nt, Salmonella enterica enterica serovar Typhi
gcgaugaguaaaauuuuuuucau

SEQ ID NO: 3616472 - RNA, 17 nt, Salmonella enterica enterica serovar Typhi
gcgaugcgaccgcgcca

SEQ ID NO: 3616473 - RNA, 14 nt, Salmonella enterica enterica serovar Typhi
gcgaugcugcucca

SEQ ID NO: 3616474 - RNA, 20 nt, Salmonella enterica enterica serovar Typhi
gcgaugcugcuccaucuccg

SEQ ID NO: 3616475 - RNA, 18 nt, Salmonella enterica enterica serovar Typhi
gcgauggggcaagcucag

SEQ ID NO: 3616476 - RNA, 16 nt, Salmonella enterica enterica serovar Typhi
gcgauggugcggcgca

SEQ ID NO: 3616477 - RNA, 16 nt, Salmonella enterica enterica serovar Typhi
gcgauguccgguccgg

SEQ ID NO: 3616478 - RNA, 20 nt, Salmonella enterica enterica serovar Typhi
gcgaugugcccgagugacug

SEQ ID NO: 3616479 - RNA, 19 nt, Salmonella enterica enterica serovar Typhi
gcgauguuuacugcggcgc

SEQ ID NO: 3616480 - RNA, 22 nt, Salmonella enterica enterica serovar Typhi
gcgauguuuacugcggcgcaac

SEQ ID NO: 3616481 - RNA, 22 nt, Salmonella enterica enterica serovar Typhi
gcgauguuuucccucgccccgg

SEQ ID NO: 3616482 - RNA, 17 nt, Salmonella enterica enterica serovar Typhi
gcgauuagcccgggacu

SEQ ID NO: 3616483 - RNA, 18 nt, Salmonella enterica enterica serovar Typhi
gcgauuccggacaacgca

SEQ ID NO: 3616484 - RNA, 18 nt, Salmonella enterica enterica serovar Typhi
gcgauuccgguuccggcg

SEQ ID NO: 3616485 - RNA, 19 nt, Salmonella enterica enterica serovar Typhi
gcgauuuauagagcagcac

SEQ ID NO: 3616486 - RNA, 20 nt, Salmonella enterica enterica serovar Typhi
gcgauuuauagagcagcacg

SEQ ID NO: 3616487 - RNA, 18 nt, Salmonella enterica enterica serovar Typhi
gcgauuuauagagcgcca

SEQ ID NO: 3616488 - RNA, 12 nt, Salmonella enterica enterica serovar Typhi
gcgauuuccagc

SEQ ID NO: 3616489 - RNA, 16 nt, Salmonella enterica enterica serovar Typhi
gcgauuuccagcgccg

SEQ ID NO: 3616490 - RNA, 16 nt, Salmonella enterica enterica serovar Typhi
gcgauuuccuguguua

SEQ ID NO: 3616491 - RNA, 14 nt, Salmonella enterica enterica serovar Typhi
gcgauuuucagcac

SEQ ID NO: 3616492 - RNA, 17 nt, Salmonella enterica enterica serovar Typhi
gcgauuuucagcaccuu

SEQ ID NO: 3616493 - RNA, 13 nt, Salmonella enterica enterica serovar Typhi
gcgauuuucucgc

SEQ ID NO: 3616494 - RNA, 24 nt, Salmonella enterica enterica serovar Typhi
gcgauuuuuuuccgcccgccuucu

SEQ ID NO: 3616495 - RNA, 14 nt, Salmonella enterica enterica serovar Typhi
gcgcaaaagcgcgc

SEQ ID NO: 3616496 - RNA, 16 nt, Salmonella enterica enterica serovar Typhi
gcgcaaaagcgcgccc

SEQ ID NO: 3616497 - RNA, 21 nt, Salmonella enterica enterica serovar Typhi
gcgcaaaaucgcaaacgccag

SEQ ID NO: 3616498 - RNA, 15 nt, Salmonella enterica enterica serovar Typhi
gcgcaaacaacccgg

SEQ ID NO: 3616499 - RNA, 21 nt, Salmonella enterica enterica serovar Typhi
gcgcaaacaguacgcccgccu

SEQ ID NO: 3616500 - RNA, 12 nt, Salmonella enterica enterica serovar Typhi
gcgcaaacggcg

SEQ ID NO: 3616501 - RNA, 14 nt, Salmonella enterica enterica serovar Typhi
gcgcaaacguaacc

SEQ ID NO: 3616502 - RNA, 22 nt, Salmonella enterica enterica serovar Typhi
gcgcaaacuucacauuuuuauc

SEQ ID NO: 3616503 - RNA, 14 nt, Salmonella enterica enterica serovar Typhi
gcgcaaaugccggu

SEQ ID NO: 3616504 - RNA, 17 nt, Salmonella enterica enterica serovar Typhi
gcgcaaccgcaucacgc

SEQ ID NO: 3616505 - RNA, 13 nt, Salmonella enterica enterica serovar Typhi
gcgcaaccggcgu

SEQ ID NO: 3616506 - RNA, 22 nt, Salmonella enterica enterica serovar Typhi
gcgcaaccuccgcggggaucgg

SEQ ID NO: 3616507 - RNA, 19 nt, Salmonella enterica enterica serovar Typhi
gcgcaacgcgcaucaacgc

SEQ ID NO: 3616508 - RNA, 21 nt, Salmonella enterica enterica serovar Typhi
gcgcaacgucgccauccggca

SEQ ID NO: 3616509 - RNA, 17 nt, Salmonella enterica enterica serovar Typhi
gcgcaacuggcgccgga

SEQ ID NO: 3616510 - RNA, 15 nt, Salmonella enterica enterica serovar Typhi
gcgcaaggccgagcg

SEQ ID NO: 3616511 - RNA, 21 nt, Salmonella enterica enterica serovar Typhi
gcgcaauaaauucgaaauaaa

SEQ ID NO: 3616512 - RNA, 16 nt, Salmonella enterica enterica serovar Typhi
gcgcaauaccuguaaa

SEQ ID NO: 3616513 - RNA, 16 nt, Salmonella enterica enterica serovar Typhi
gcgcaauaugcggcgc

SEQ ID NO: 3616514 - RNA, 14 nt, Salmonella enterica enterica serovar Typhi
gcgcaauaugguau

SEQ ID NO: 3616515 - RNA, 22 nt, Salmonella enterica enterica serovar Typhi
gcgcaauauuguuaaccaggcc

SEQ ID NO: 3616516 - RNA, 22 nt, Salmonella enterica enterica serovar Typhi
gcgcaaucgguaaaggucgccg

SEQ ID NO: 3616517 - RNA, 19 nt, Salmonella enterica enterica serovar Typhi
gcgcacacaauagcaaucu

SEQ ID NO: 3616518 - RNA, 16 nt, Salmonella enterica enterica serovar Typhi
gcgcacaggccuucau

SEQ ID NO: 3616519 - RNA, 12 nt, Salmonella enterica enterica serovar Typhi
gcgccagcagca

SEQ ID NO: 3616520 - RNA, 12 nt, Salmonella enterica enterica serovar Typhi
gcgccagcaggu

SEQ ID NO: 3616521 - RNA, 14 nt, Salmonella enterica enterica serovar Typhi
gcgccagcaguggg

SEQ ID NO: 3616522 - RNA, 14 nt, Salmonella enterica enterica serovar Typhi
gcgccagccagcgc

SEQ ID NO: 3616523 - RNA, 20 nt, Salmonella enterica enterica serovar Typhi
gcgccagccagucgccaggc

SEQ ID NO: 3616524 - RNA, 22 nt, Salmonella enterica enterica serovar Typhi
gcgccagccauagcagcaaauu

SEQ ID NO: 3616525 - RNA, 15 nt, Salmonella enterica enterica serovar Typhi
gcgccagcccugcga

SEQ ID NO: 3616526 - RNA, 23 nt, Salmonella enterica enterica serovar Typhi
gcgccagccgucaaacaucgcgc

SEQ ID NO: 3616527 - RNA, 14 nt, Salmonella enterica enterica serovar Typhi
gcgccagccuuccc

SEQ ID NO: 3616528 - RNA, 20 nt, Salmonella enterica enterica serovar Typhi
gcgccagcgaccaccguccc

SEQ ID NO: 3616529 - RNA, 12 nt, Salmonella enterica enterica serovar Typhi
gcgccagcgacg

SEQ ID NO: 3616530 - RNA, 17 nt, Salmonella enterica enterica serovar Typhi
gcgccagcgauggggca

SEQ ID NO: 3616531 - RNA, 12 nt, Salmonella enterica enterica serovar Typhi
gcgccagcgcau

SEQ ID NO: 3616532 - RNA, 15 nt, Salmonella enterica enterica serovar Typhi
gcgccagcgccgccu

SEQ ID NO: 3616533 - RNA, 16 nt, Salmonella enterica enterica serovar Typhi
gcgccagcgccgccuc

SEQ ID NO: 3616534 - RNA, 23 nt, Salmonella enterica enterica serovar Typhi
gcgccagcggauugccauacacg

SEQ ID NO: 3616535 - RNA, 15 nt, Salmonella enterica enterica serovar Typhi
gcgccagcggcggcu

SEQ ID NO: 3616536 - RNA, 14 nt, Salmonella enterica enterica serovar Typhi
gcgccagcggcugc

SEQ ID NO: 3616537 - RNA, 15 nt, Salmonella enterica enterica serovar Typhi
gcgccagcggcugcu

SEQ ID NO: 3616538 - RNA, 21 nt, Salmonella enterica enterica serovar Typhi
gcgccagcgugcuaagcugga

SEQ ID NO: 3616539 - RNA, 22 nt, Salmonella enterica enterica serovar Typhi
gcgccagcucaucgggcgaagc

SEQ ID NO: 3616540 - RNA, 15 nt, Salmonella enterica enterica serovar Typhi
gcgccagcucaugca

SEQ ID NO: 3616541 - RNA, 15 nt, Salmonella enterica enterica serovar Typhi
gcgccagcugcguca

SEQ ID NO: 3616542 - RNA, 19 nt, Salmonella enterica enterica serovar Typhi
gcgccagcuuucggcgagc

SEQ ID NO: 3616543 - RNA, 13 nt, Salmonella enterica enterica serovar Typhi
gcgccaggaaacu

SEQ ID NO: 3616544 - RNA, 15 nt, Salmonella enterica enterica serovar Typhi
gcgccaggaaacucg

SEQ ID NO: 3616545 - RNA, 16 nt, Salmonella enterica enterica serovar Typhi
gcgccaggccauugcu

SEQ ID NO: 3616546 - RNA, 17 nt, Salmonella enterica enterica serovar Typhi
gcgccaggccauugcug

SEQ ID NO: 3616547 - RNA, 16 nt, Salmonella enterica enterica serovar Typhi
gcgccagguaaguuca

SEQ ID NO: 3616548 - RNA, 13 nt, Salmonella enterica enterica serovar Typhi
gcgccagguauac

SEQ ID NO: 3616549 - RNA, 21 nt, Salmonella enterica enterica serovar Typhi
gcgccaguuuuuccuguuccu

SEQ ID NO: 3616550 - RNA, 12 nt, Salmonella enterica enterica serovar Typhi
gcgccauaaaaa

SEQ ID NO: 3616551 - RNA, 19 nt, Salmonella enterica enterica serovar Typhi
gcgccauacuuacugcugu

SEQ ID NO: 3616552 - RNA, 19 nt, Salmonella enterica enterica serovar Typhi
gcgccauaguccauuacgc

SEQ ID NO: 3616553 - RNA, 22 nt, Salmonella enterica enterica serovar Typhi
gcgccauauccucgcugggcca

SEQ ID NO: 3616554 - RNA, 16 nt, Salmonella enterica enterica serovar Typhi
gcgccaucaggcacaa

SEQ ID NO: 3616555 - RNA, 13 nt, Salmonella enterica enterica serovar Typhi
gcgccaucaggcc

SEQ ID NO: 3616556 - RNA, 13 nt, Salmonella enterica enterica serovar Typhi
gcgccaucaggcu

SEQ ID NO: 3616557 - RNA, 19 nt, Salmonella enterica enterica serovar Typhi
gcgccaucaugcagccggc

SEQ ID NO: 3616558 - RNA, 18 nt, Salmonella enterica enterica serovar Typhi
gcgccauccaccaggcau

SEQ ID NO: 3616559 - RNA, 23 nt, Salmonella enterica enterica serovar Typhi
gcgccaucccaugcaccaguccc

SEQ ID NO: 3616560 - RNA, 16 nt, Salmonella enterica enterica serovar Typhi
gcgccauccggcacac

SEQ ID NO: 3616561 - RNA, 15 nt, Salmonella enterica enterica serovar Typhi
gcgccauccggcgcu

SEQ ID NO: 3616562 - RNA, 17 nt, Salmonella enterica enterica serovar Typhi
gcgccauccggcgcuga

SEQ ID NO: 3616563 - RNA, 21 nt, Salmonella enterica enterica serovar Typhi
gcgccauccugccgcaccagu

SEQ ID NO: 3616564 - RNA, 11 nt, Salmonella enterica enterica serovar Typhi
gcgccaucggc

SEQ ID NO: 3616565 - RNA, 19 nt, Salmonella enterica enterica serovar Typhi
gcgccaugcggaaucacgc

SEQ ID NO: 3616566 - RNA, 22 nt, Salmonella enterica enterica serovar Typhi
gcgccauguucauaaagugcca

SEQ ID NO: 3616567 - RNA, 23 nt, Salmonella enterica enterica serovar Typhi
gcgccauguugcguaaauaaaua

SEQ ID NO: 3616568 - RNA, 21 nt, Salmonella enterica enterica serovar Typhi
gcgccauuaacgccaugacgc

SEQ ID NO: 3616569 - RNA, 15 nt, Salmonella enterica enterica serovar Typhi
gcgccauuuccagcc

SEQ ID NO: 3616570 - RNA, 22 nt, Salmonella enterica enterica serovar Typhi
gcgcccaaugcuuagucagccu

SEQ ID NO: 3616571 - RNA, 15 nt, Salmonella enterica enterica serovar Typhi
gcgcccacgcgcggc

SEQ ID NO: 3616572 - RNA, 23 nt, Salmonella enterica enterica serovar Typhi
gcgcccacgcgcggcaucauuua

SEQ ID NO: 3616573 - RNA, 13 nt, Salmonella enterica enterica serovar Typhi
gcgcccagcagca

SEQ ID NO: 3616574 - RNA, 16 nt, Salmonella enterica enterica serovar Typhi
gcgcccagcagcagaa

SEQ ID NO: 3616575 - RNA, 13 nt, Salmonella enterica enterica serovar Typhi
gcgcccagcgccg

SEQ ID NO: 3616576 - RNA, 14 nt, Salmonella enterica enterica serovar Typhi
gcgcccaucaucau

SEQ ID NO: 3616577 - RNA, 16 nt, Salmonella enterica enterica serovar Typhi
gcgcccauccgcccac

SEQ ID NO: 3616578 - RNA, 14 nt, Salmonella enterica enterica serovar Typhi
gcgcccaucuccag

SEQ ID NO: 3616579 - RNA, 16 nt, Salmonella enterica enterica serovar Typhi
gcgcccaucuccagcc

SEQ ID NO: 3616580 - RNA, 15 nt, Salmonella enterica enterica serovar Typhi
gcgcccauuccgccu

SEQ ID NO: 3616581 - RNA, 12 nt, Salmonella enterica enterica serovar Typhi
gcgccccagcac

SEQ ID NO: 3616582 - RNA, 13 nt, Salmonella enterica enterica serovar Typhi
gcgccccagcaca

SEQ ID NO: 3616583 - RNA, 15 nt, Salmonella enterica enterica serovar Typhi
gcgccccaguaacgu

SEQ ID NO: 3616584 - RNA, 12 nt, Salmonella enterica enterica serovar Typhi
gcgcccccagca

SEQ ID NO: 3616585 - RNA, 24 nt, Salmonella enterica enterica serovar Typhi
gcgcccccagcaaaccggcaugaa

SEQ ID NO: 3616586 - RNA, 13 nt, Salmonella enterica enterica serovar Typhi
gcgccccggcggc

SEQ ID NO: 3616587 - RNA, 17 nt, Salmonella enterica enterica serovar Typhi
gcgcccgagcgacgccc

SEQ ID NO: 3616588 - RNA, 19 nt, Salmonella enterica enterica serovar Typhi
gcgcccgccaucgcccggc

SEQ ID NO: 3616589 - RNA, 22 nt, Salmonella enterica enterica serovar Typhi
gcgcccgccugcuguaaccccu

SEQ ID NO: 3616590 - RNA, 13 nt, Salmonella enterica enterica serovar Typhi
gcgcccuauccag

SEQ ID NO: 3616591 - RNA, 15 nt, Salmonella enterica enterica serovar Typhi
gcgcccugcgggccg

SEQ ID NO: 3616592 - RNA, 23 nt, Salmonella enterica enterica serovar Typhi
gcgcccugggcuucgucgagcag

SEQ ID NO: 3616593 - RNA, 14 nt, Salmonella enterica enterica serovar Typhi
gcgcccuuccguca

SEQ ID NO: 3616594 - RNA, 14 nt, Salmonella enterica enterica serovar Typhi
gcgccgacaggcuc

SEQ ID NO: 3616595 - RNA, 20 nt, Salmonella enterica enterica serovar Typhi
gcgccgacauagcugaacaa

SEQ ID NO: 3616596 - RNA, 16 nt, Salmonella enterica enterica serovar Typhi
gcgccgacaucgccac

SEQ ID NO: 3616597 - RNA, 19 nt, Salmonella enterica enterica serovar Typhi
gcgccgacaucgccaccgc

SEQ ID NO: 3616598 - RNA, 18 nt, Salmonella enterica enterica serovar Typhi
gcgccgacuuuacggccu

SEQ ID NO: 3616599 - RNA, 19 nt, Salmonella enterica enterica serovar Typhi
gcgccgaguagcugagcgu

SEQ ID NO: 3616600 - RNA, 20 nt, Salmonella enterica enterica serovar Typhi
gcgccgauaaauccuccggc

SEQ ID NO: 3616601 - RNA, 15 nt, Salmonella enterica enterica serovar Typhi
gcgccgaucaucccg

SEQ ID NO: 3616602 - RNA, 16 nt, Salmonella enterica enterica serovar Typhi
gcgccgaucaucccgc

SEQ ID NO: 3616603 - RNA, 22 nt, Salmonella enterica enterica serovar Typhi
gcgccgcaaaggaucaucggcc

SEQ ID NO: 3616604 - RNA, 14 nt, Salmonella enterica enterica serovar Typhi
gcgccgcagcgccg

SEQ ID NO: 3616605 - RNA, 12 nt, Salmonella enterica enterica serovar Typhi
gcgcgccagcgc

SEQ ID NO: 3616606 - RNA, 13 nt, Salmonella enterica enterica serovar Typhi
gcgcgccaugaga

SEQ ID NO: 3616607 - RNA, 21 nt, Salmonella enterica enterica serovar Typhi
gcgcgcccaguccuuccggcg

SEQ ID NO: 3616608 - RNA, 23 nt, Salmonella enterica enterica serovar Typhi
gcgcgccgaaaauauacaccuga

SEQ ID NO: 3616609 - RNA, 13 nt, Salmonella enterica enterica serovar Typhi
gcgcgccgcagcg

SEQ ID NO: 3616610 - RNA, 12 nt, Salmonella enterica enterica serovar Typhi
gcgcgccgccuc

SEQ ID NO: 3616611 - RNA, 15 nt, Salmonella enterica enterica serovar Typhi
gcgcgccgcgcagca

SEQ ID NO: 3616612 - RNA, 15 nt, Salmonella enterica enterica serovar Typhi
gcgcgccguaaacaa

SEQ ID NO: 3616613 - RNA, 14 nt, Salmonella enterica enterica serovar Typhi
gcgcgcgcaaagcg

SEQ ID NO: 3616614 - RNA, 13 nt, Salmonella enterica enterica serovar Typhi
gcgcgcgcgccug

SEQ ID NO: 3616615 - RNA, 13 nt, Salmonella enterica enterica serovar Typhi
gcgcgcgggcgau

SEQ ID NO: 3616616 - RNA, 17 nt, Salmonella enterica enterica serovar Typhi
gcgcgcguuaugccgac

SEQ ID NO: 3616617 - RNA, 12 nt, Salmonella enterica enterica serovar Typhi
gcgcgcuccaga

SEQ ID NO: 3616618 - RNA, 16 nt, Salmonella enterica enterica serovar Typhi
gcgcgcugagcggcuc

SEQ ID NO: 3616619 - RNA, 14 nt, Salmonella enterica enterica serovar Typhi
gcgcgcugccgccc

SEQ ID NO: 3616620 - RNA, 17 nt, Salmonella enterica enterica serovar Typhi
gcgcgcuugcauugcuc

SEQ ID NO: 3616621 - RNA, 18 nt, Salmonella enterica enterica serovar Typhi
gcgcgcuuucaccgccuc

SEQ ID NO: 3616622 - RNA, 23 nt, Salmonella enterica enterica serovar Typhi
gcgcgcuuuccacaaucccggca

SEQ ID NO: 3616623 - RNA, 14 nt, Salmonella enterica enterica serovar Typhi
gcgcggaucgccau

SEQ ID NO: 3616624 - RNA, 13 nt, Salmonella enterica enterica serovar Typhi
gcgcggcagaccg

SEQ ID NO: 3616625 - RNA, 19 nt, Salmonella enterica enterica serovar Typhi
gcgcggcaguucaggcucg

SEQ ID NO: 3616626 - RNA, 16 nt, Salmonella enterica enterica serovar Typhi
gcgcggcaucauuuac

SEQ ID NO: 3616627 - RNA, 17 nt, Salmonella enterica enterica serovar Typhi
gcgcggcaucgccgccc

SEQ ID NO: 3616628 - RNA, 20 nt, Salmonella enterica enterica serovar Typhi
gcgcggcaucgccgcccagu

SEQ ID NO: 3616629 - RNA, 13 nt, Salmonella enterica enterica serovar Typhi
gcgcggccagcgc

SEQ ID NO: 3616630 - RNA, 14 nt, Salmonella enterica enterica serovar Typhi
gcgcggccccauca

SEQ ID NO: 3616631 - RNA, 21 nt, Salmonella enterica enterica serovar Typhi
gcgcggccucauggcggugcu

SEQ ID NO: 3616632 - RNA, 17 nt, Salmonella enterica enterica serovar Typhi
gcgcggccugcgccagg

SEQ ID NO: 3616633 - RNA, 17 nt, Salmonella enterica enterica serovar Typhi
gcgcggcgaaauaggcc

SEQ ID NO: 3616634 - RNA, 10 nt, Salmonella enterica enterica serovar Typhi
gcgcggcgga

SEQ ID NO: 3616635 - RNA, 22 nt, Salmonella enterica enterica serovar Typhi
gcgcggcggacaacgcuccagc

SEQ ID NO: 3616636 - RNA, 17 nt, Salmonella enterica enterica serovar Typhi
gcgcggcguucugcgcc

SEQ ID NO: 3616637 - RNA, 21 nt, Salmonella enterica enterica serovar Typhi
gcgcgggauaucgcuggucgg

SEQ ID NO: 3616638 - RNA, 19 nt, Salmonella enterica enterica serovar Typhi
gcgcgggcguauagccagg

SEQ ID NO: 3616639 - RNA, 14 nt, Salmonella enterica enterica serovar Typhi
gcgcggggaacaca

SEQ ID NO: 3616640 - RNA, 15 nt, Salmonella enterica enterica serovar Typhi
gcgcggggaacacag

SEQ ID NO: 3616641 - RNA, 13 nt, Salmonella enterica enterica serovar Typhi
gcgcggucaacgu

SEQ ID NO: 3616642 - RNA, 19 nt, Salmonella enterica enterica serovar Typhi
gcgcguaaguuugcguacu

SEQ ID NO: 3616643 - RNA, 13 nt, Salmonella enterica enterica serovar Typhi
gcgcguauccgcc

SEQ ID NO: 3616644 - RNA, 20 nt, Salmonella enterica enterica serovar Typhi
gcgcgucacaacagccggaa

SEQ ID NO: 3616645 - RNA, 22 nt, Salmonella enterica enterica serovar Typhi
gcgcgucacaauaucgagauga

SEQ ID NO: 3616646 - RNA, 16 nt, Salmonella enterica enterica serovar Typhi
gcgcguccacggcggg

SEQ ID NO: 3616647 - RNA, 12 nt, Salmonella enterica enterica serovar Typhi
gcgcguccagac

SEQ ID NO: 3616648 - RNA, 17 nt, Salmonella enterica enterica serovar Typhi
gcgcguccucacacuga

SEQ ID NO: 3616649 - RNA, 17 nt, Salmonella enterica enterica serovar Typhi
gcgcguccuuauaaugc

SEQ ID NO: 3616650 - RNA, 13 nt, Salmonella enterica enterica serovar Typhi
gcgcgucgaauga

SEQ ID NO: 3616651 - RNA, 18 nt, Salmonella enterica enterica serovar Typhi
gcgcgucgaaugacgcgc

SEQ ID NO: 3616652 - RNA, 15 nt, Salmonella enterica enterica serovar Typhi
gcgcgucgaccauac

SEQ ID NO: 3616653 - RNA, 13 nt, Salmonella enterica enterica serovar Typhi
gcgcgucgccuga

SEQ ID NO: 3616654 - RNA, 13 nt, Salmonella enterica enterica serovar Typhi
gcgcgugcggcgg

SEQ ID NO: 3616655 - RNA, 13 nt, Salmonella enterica enterica serovar Typhi
gcgcguggcuucc

SEQ ID NO: 3616656 - RNA, 15 nt, Salmonella enterica enterica serovar Typhi
gcgcguucgccguca

SEQ ID NO: 3616657 - RNA, 14 nt, Salmonella enterica enterica serovar Typhi
gcgcguucugcucc

SEQ ID NO: 3616658 - RNA, 22 nt, Salmonella enterica enterica serovar Typhi
gcgcguugccaucggcgggcgu

SEQ ID NO: 3616659 - RNA, 23 nt, Salmonella enterica enterica serovar Typhi
gcgcguuguccaacugucgccau

SEQ ID NO: 3616660 - RNA, 15 nt, Salmonella enterica enterica serovar Typhi
gcgcguuuagcgcca

SEQ ID NO: 3616661 - RNA, 20 nt, Salmonella enterica enterica serovar Typhi
gcgcguuuagcgccagcagc

SEQ ID NO: 3616662 - RNA, 17 nt, Salmonella enterica enterica serovar Typhi
gcgcguuuuccaucauc

SEQ ID NO: 3616663 - RNA, 13 nt, Salmonella enterica enterica serovar Typhi
gcgcuaaaccggc

SEQ ID NO: 3616664 - RNA, 13 nt, Salmonella enterica enterica serovar Typhi
gcgcuaaccagcg

SEQ ID NO: 3616665 - RNA, 21 nt, Salmonella enterica enterica serovar Typhi
gcgcuaauguacgccuaaaaa

SEQ ID NO: 3616666 - RNA, 17 nt, Salmonella enterica enterica serovar Typhi
gcgcuaauguggauagu

SEQ ID NO: 3616667 - RNA, 12 nt, Salmonella enterica enterica serovar Typhi
gcgcuaccagcg

SEQ ID NO: 3616668 - RNA, 13 nt, Salmonella enterica enterica serovar Typhi
gcgcuaccagcgc

SEQ ID NO: 3616669 - RNA, 20 nt, Salmonella enterica enterica serovar Typhi
gcgcuacgcuuaucaggccu

SEQ ID NO: 3616670 - RNA, 20 nt, Salmonella enterica enterica serovar Typhi
gcgcuacgcuuaucgggccu

SEQ ID NO: 3616671 - RNA, 19 nt, Salmonella enterica enterica serovar Typhi
gcgcuagcgcuuacccgac

SEQ ID NO: 3616672 - RNA, 17 nt, Salmonella enterica enterica serovar Typhi
gcgcuagcuggcagggg

SEQ ID NO: 3616673 - RNA, 23 nt, Salmonella enterica enterica serovar Typhi
gcgcuaucaggaagaacacgccg

SEQ ID NO: 3616674 - RNA, 12 nt, Salmonella enterica enterica serovar Typhi
gcgcuaucaggc

SEQ ID NO: 3616675 - RNA, 13 nt, Salmonella enterica enterica serovar Typhi
gcgcuauccggca

SEQ ID NO: 3616676 - RNA, 13 nt, Salmonella enterica enterica serovar Typhi
gcgcuauccggcc

SEQ ID NO: 3616677 - RNA, 16 nt, Salmonella enterica enterica serovar Typhi
gcgcuaucgguaucau

SEQ ID NO: 3616678 - RNA, 18 nt, Salmonella enterica enterica serovar Typhi
gcgcuaugcgcuccagga

SEQ ID NO: 3616679 - RNA, 17 nt, Salmonella enterica enterica serovar Typhi
gcgcuauucccaggcaa

SEQ ID NO: 3616680 - RNA, 23 nt, Salmonella enterica enterica serovar Typhi
gcgcuauucccaggcaaaugauu

SEQ ID NO: 3616681 - RNA, 18 nt, Salmonella enterica enterica serovar Typhi
gcgcuauuuucaugguau

SEQ ID NO: 3616682 - RNA, 15 nt, Salmonella enterica enterica serovar Typhi
gcgcucaauagccag

SEQ ID NO: 3616683 - RNA, 14 nt, Salmonella enterica enterica serovar Typhi
gcgcucaaucagaa

SEQ ID NO: 3616684 - RNA, 19 nt, Salmonella enterica enterica serovar Typhi
gcgcucaccuccgccacua

SEQ ID NO: 3616685 - RNA, 15 nt, Salmonella enterica enterica serovar Typhi
gcgcucacgcggcgc

SEQ ID NO: 3616686 - RNA, 21 nt, Salmonella enterica enterica serovar Typhi
gcgcucacgcuuauccggccu

SEQ ID NO: 3616687 - RNA, 11 nt, Salmonella enterica enterica serovar Typhi
gcgcucaggca

SEQ ID NO: 3616688 - RNA, 20 nt, Salmonella enterica enterica serovar Typhi
gcgcucauacgaucgcgcac

SEQ ID NO: 3616689 - RNA, 21 nt, Salmonella enterica enterica serovar Typhi
gcgcucauauacccugcggcg

SEQ ID NO: 3616690 - RNA, 13 nt, Salmonella enterica enterica serovar Typhi
gcgcucaucaggc

SEQ ID NO: 3616691 - RNA, 20 nt, Salmonella enterica enterica serovar Typhi
gcgcucaugcgccuggcggu

SEQ ID NO: 3616692 - RNA, 20 nt, Salmonella enterica enterica serovar Typhi
gcggaaaggacguucuucuc

SEQ ID NO: 3616693 - RNA, 16 nt, Salmonella enterica enterica serovar Typhi
gcggaaauguagcccc

SEQ ID NO: 3616694 - RNA, 19 nt, Salmonella enterica enterica serovar Typhi
gcggaaauuagcccgcuuc

SEQ ID NO: 3616695 - RNA, 23 nt, Salmonella enterica enterica serovar Typhi
gcggaaauuagcccgcuucacgc

SEQ ID NO: 3616696 - RNA, 13 nt, Salmonella enterica enterica serovar Typhi
gcggaacaccagc

SEQ ID NO: 3616697 - RNA, 16 nt, Salmonella enterica enterica serovar Typhi
gcggaaccagccaugc

SEQ ID NO: 3616698 - RNA, 13 nt, Salmonella enterica enterica serovar Typhi
gcggaaccauuuu

SEQ ID NO: 3616699 - RNA, 13 nt, Salmonella enterica enterica serovar Typhi
gcggaagaggcgc

SEQ ID NO: 3616700 - RNA, 14 nt, Salmonella enterica enterica serovar Typhi
gcggaagaggcgcc

SEQ ID NO: 3616701 - RNA, 20 nt, Salmonella enterica enterica serovar Typhi
gcggaagcgaauggcggcac

SEQ ID NO: 3616702 - RNA, 23 nt, Salmonella enterica enterica serovar Typhi
gcggaagggauucccauccgugc

SEQ ID NO: 3616703 - RNA, 15 nt, Salmonella enterica enterica serovar Typhi
gcggaaguagagaac

SEQ ID NO: 3616704 - RNA, 22 nt, Salmonella enterica enterica serovar Typhi
gcggaaguagagaaccaacguc

SEQ ID NO: 3616705 - RNA, 21 nt, Salmonella enterica enterica serovar Typhi
gcggaaguagccuccggcggu

SEQ ID NO: 3616706 - RNA, 20 nt, Salmonella enterica enterica serovar Typhi
gcggaauaaucagucgcagc

SEQ ID NO: 3616707 - RNA, 14 nt, Salmonella enterica enterica serovar Typhi
gcggaauagacggc

SEQ ID NO: 3616708 - RNA, 19 nt, Salmonella enterica enterica serovar Typhi
gcggaaucacgcauauccc

SEQ ID NO: 3616709 - RNA, 20 nt, Salmonella enterica enterica serovar Typhi
gcggaaucgucacagacccc

SEQ ID NO: 3616710 - RNA, 19 nt, Salmonella enterica enterica serovar Typhi
gcggaauggcgggcgcagg

SEQ ID NO: 3616711 - RNA, 21 nt, Salmonella enterica enterica serovar Typhi
gcggaauucccacaucgcgau

SEQ ID NO: 3616712 - RNA, 16 nt, Salmonella enterica enterica serovar Typhi
gcggacacccgcagcc

SEQ ID NO: 3616713 - RNA, 18 nt, Salmonella enterica enterica serovar Typhi
gcggacacccgcagccag

SEQ ID NO: 3616714 - RNA, 14 nt, Salmonella enterica enterica serovar Typhi
gcggacaugcgcau

SEQ ID NO: 3616715 - RNA, 14 nt, Salmonella enterica enterica serovar Typhi
gcggacaugguaau

SEQ ID NO: 3616716 - RNA, 17 nt, Salmonella enterica enterica serovar Typhi
gcggaccagcgugcgcu

SEQ ID NO: 3616717 - RNA, 13 nt, Salmonella enterica enterica serovar Typhi
gcggacgcagcuc

SEQ ID NO: 3616718 - RNA, 13 nt, Salmonella enterica enterica serovar Typhi
gcggacgggcggu

SEQ ID NO: 3616719 - RNA, 19 nt, Salmonella enterica enterica serovar Typhi
gcggacguagcggcgccgg

SEQ ID NO: 3616720 - RNA, 19 nt, Salmonella enterica enterica serovar Typhi
gcggagaagacgccgccgc

SEQ ID NO: 3616721 - RNA, 20 nt, Salmonella enterica enterica serovar Typhi
gcggagagaucgacagcgcg

SEQ ID NO: 3616722 - RNA, 20 nt, Salmonella enterica enterica serovar Typhi
gcggagauacccuuaugaua

SEQ ID NO: 3616723 - RNA, 16 nt, Salmonella enterica enterica serovar Typhi
gcggagaucgcucccg

SEQ ID NO: 3616724 - RNA, 18 nt, Salmonella enterica enterica serovar Typhi
gcggagccgccauccggc

SEQ ID NO: 3616725 - RNA, 19 nt, Salmonella enterica enterica serovar Typhi
gcggagguuucuuuuucua

SEQ ID NO: 3616726 - RNA, 23 nt, Salmonella enterica enterica serovar Typhi
gcggaguaaacugugugagcgcc

SEQ ID NO: 3616727 - RNA, 22 nt, Salmonella enterica enterica serovar Typhi
gcggauaaauagugacgccgcc

SEQ ID NO: 3616728 - RNA, 23 nt, Salmonella enterica enterica serovar Typhi
gcggauaacgcggguuagcgccg

SEQ ID NO: 3616729 - RNA, 19 nt, Salmonella enterica enterica serovar Typhi
gcggauaagauagcaggcg

SEQ ID NO: 3616730 - RNA, 19 nt, Salmonella enterica enterica serovar Typhi
gcggauaagcccggcggag

SEQ ID NO: 3616731 - RNA, 18 nt, Salmonella enterica enterica serovar Typhi
gcggauacagcggcgcgc

SEQ ID NO: 3616732 - RNA, 20 nt, Salmonella enterica enterica serovar Typhi
gcggauacagcggcgcgcca

SEQ ID NO: 3616733 - RNA, 17 nt, Salmonella enterica enterica serovar Typhi
gcggauaugcagcagcc

SEQ ID NO: 3616734 - RNA, 22 nt, Salmonella enterica enterica serovar Typhi
gcggaucaaacuccgcgcuggc

SEQ ID NO: 3616735 - RNA, 23 nt, Salmonella enterica enterica serovar Typhi
gcggaucaaacuccgcgcuggca

SEQ ID NO: 3616736 - RNA, 18 nt, Salmonella enterica enterica serovar Typhi
gcggaucagacggcugac

SEQ ID NO: 3616737 - RNA, 13 nt, Salmonella enterica enterica serovar Typhi
gcggaucgccauc

SEQ ID NO: 3616738 - RNA, 15 nt, Salmonella enterica enterica serovar Typhi
gcggaucggcgcaga

SEQ ID NO: 3616739 - RNA, 22 nt, Salmonella enterica enterica serovar Typhi
gcggaugcgccauccaccaggc

SEQ ID NO: 3616740 - RNA, 12 nt, Salmonella enterica enterica serovar Typhi
gcggauggcgcu

SEQ ID NO: 3616741 - RNA, 19 nt, Salmonella enterica enterica serovar Typhi
gcggaugguggcguaaaua

SEQ ID NO: 3616742 - RNA, 19 nt, Salmonella enterica enterica serovar Typhi
gcggaugucggucaucagg

SEQ ID NO: 3616743 - RNA, 19 nt, Salmonella enterica enterica serovar Typhi
gcggauuaucguccggcau

SEQ ID NO: 3616744 - RNA, 20 nt, Salmonella enterica enterica serovar Typhi
gcggauuccaguagcgcgcc

SEQ ID NO: 3616745 - RNA, 17 nt, Salmonella enterica enterica serovar Typhi
gcggauugauuuuucug

SEQ ID NO: 3616746 - RNA, 18 nt, Salmonella enterica enterica serovar Typhi
gcggauugccauacacgc

SEQ ID NO: 3616747 - RNA, 22 nt, Salmonella enterica enterica serovar Typhi
gcggcaaaaaauauagccauuu

SEQ ID NO: 3616748 - RNA, 16 nt, Salmonella enterica enterica serovar Typhi
gcggcaaaauugauuc

SEQ ID NO: 3616749 - RNA, 16 nt, Salmonella enterica enterica serovar Typhi
gcggcaaagauaaucu

SEQ ID NO: 3616750 - RNA, 18 nt, Salmonella enterica enterica serovar Typhi
gcggcaagaucauccggg

SEQ ID NO: 3616751 - RNA, 18 nt, Salmonella enterica enterica serovar Typhi
gcggcaaggucugcgccc

SEQ ID NO: 3616752 - RNA, 23 nt, Salmonella enterica enterica serovar Typhi
gcggcaaugagcggccagcgggc

SEQ ID NO: 3616753 - RNA, 15 nt, Salmonella enterica enterica serovar Typhi
gcggcaauuuguagc

SEQ ID NO: 3616754 - RNA, 20 nt, Salmonella enterica enterica serovar Typhi
gcggcaccagcgaugcgcgc

SEQ ID NO: 3616755 - RNA, 22 nt, Salmonella enterica enterica serovar Typhi
gcggcacguauucggcuuaccc

SEQ ID NO: 3616756 - RNA, 21 nt, Salmonella enterica enterica serovar Typhi
gcggcacuucgauaaacgccu

SEQ ID NO: 3616757 - RNA, 21 nt, Salmonella enterica enterica serovar Typhi
gcggcagauaucgcugaccaa

SEQ ID NO: 3616758 - RNA, 19 nt, Salmonella enterica enterica serovar Typhi
gcggcagcgccauccggca

SEQ ID NO: 3616759 - RNA, 16 nt, Salmonella enterica enterica serovar Typhi
gcggcagcucugccug

SEQ ID NO: 3616760 - RNA, 19 nt, Salmonella enterica enterica serovar Typhi
gcggcagcuucagccaguc

SEQ ID NO: 3616761 - RNA, 15 nt, Salmonella enterica enterica serovar Typhi
gcggcaggaucccca

SEQ ID NO: 3616762 - RNA, 16 nt, Salmonella enterica enterica serovar Typhi
gcggcaggauccccau

SEQ ID NO: 3616763 - RNA, 13 nt, Salmonella enterica enterica serovar Typhi
gcggcaggcaaaa

SEQ ID NO: 3616764 - RNA, 21 nt, Salmonella enterica enterica serovar Typhi
gcggcaguacgagcauccaga

SEQ ID NO: 3616765 - RNA, 21 nt, Salmonella enterica enterica serovar Typhi
gcggcagucccaaugcggaaa

SEQ ID NO: 3616766 - RNA, 20 nt, Salmonella enterica enterica serovar Typhi
gcggcaguucaggcucgcaa

SEQ ID NO: 3616767 - RNA, 14 nt, Salmonella enterica enterica serovar Typhi
gcggcaguuccggc

SEQ ID NO: 3616768 - RNA, 15 nt, Salmonella enterica enterica serovar Typhi
gcggcaguuccggcg

SEQ ID NO: 3616769 - RNA, 21 nt, Salmonella enterica enterica serovar Typhi
gcggcaguugaacucgauaac

SEQ ID NO: 3616770 - RNA, 20 nt, Salmonella enterica enterica serovar Typhi
gcggcauacuuucgcgcggc

SEQ ID NO: 3616771 - RNA, 14 nt, Salmonella enterica enterica serovar Typhi
gcggcaucaggcau

SEQ ID NO: 3616772 - RNA, 16 nt, Salmonella enterica enterica serovar Typhi
gcggcaucaggcauag

SEQ ID NO: 3616773 - RNA, 20 nt, Salmonella enterica enterica serovar Typhi
gcggcaucauaaaucgacau

SEQ ID NO: 3616774 - RNA, 19 nt, Salmonella enterica enterica serovar Typhi
gcggcaucgaacgggcgau

SEQ ID NO: 3616775 - RNA, 13 nt, Salmonella enterica enterica serovar Typhi
gcggcaucguccg

SEQ ID NO: 3616776 - RNA, 19 nt, Salmonella enterica enterica serovar Typhi
gcggcaucucgccaaacca

SEQ ID NO: 3616777 - RNA, 18 nt, Salmonella enterica enterica serovar Typhi
gcguaaucggcaggccaa

SEQ ID NO: 3616778 - RNA, 23 nt, Salmonella enterica enterica serovar Typhi
gcguaaugacuggcuuugcgcca

SEQ ID NO: 3616779 - RNA, 16 nt, Salmonella enterica enterica serovar Typhi
gcguaaugagcgucgc

SEQ ID NO: 3616780 - RNA, 17 nt, Salmonella enterica enterica serovar Typhi
gcguaaugcgccaggca

SEQ ID NO: 3616781 - RNA, 13 nt, Salmonella enterica enterica serovar Typhi
gcguaauuauuac

SEQ ID NO: 3616782 - RNA, 22 nt, Salmonella enterica enterica serovar Typhi
gcguaauuuugccacccacuuc

SEQ ID NO: 3616783 - RNA, 17 nt, Salmonella enterica enterica serovar Typhi
gcguaauuuuuccaguu

SEQ ID NO: 3616784 - RNA, 18 nt, Salmonella enterica enterica serovar Typhi
gcguacaauggcaggcau

SEQ ID NO: 3616785 - RNA, 13 nt, Salmonella enterica enterica serovar Typhi
gcguacagcgcca

SEQ ID NO: 3616786 - RNA, 15 nt, Salmonella enterica enterica serovar Typhi
gcguacaggcggaaa

SEQ ID NO: 3616787 - RNA, 23 nt, Salmonella enterica enterica serovar Typhi
gcguacauugccggauggcggcg

SEQ ID NO: 3616788 - RNA, 15 nt, Salmonella enterica enterica serovar Typhi
gcguaccacgccgca

SEQ ID NO: 3616789 - RNA, 20 nt, Salmonella enterica enterica serovar Typhi
gcguaccagaaacagcgcgc

SEQ ID NO: 3616790 - RNA, 15 nt, Salmonella enterica enterica serovar Typhi
gcguaccgcgcgccc

SEQ ID NO: 3616791 - RNA, 17 nt, Salmonella enterica enterica serovar Typhi
gcguaccgucucggccu

SEQ ID NO: 3616792 - RNA, 19 nt, Salmonella enterica enterica serovar Typhi
gcguacugcccguggcgga

SEQ ID NO: 3616793 - RNA, 19 nt, Salmonella enterica enterica serovar Typhi
gcguacuuucacuaccacu

SEQ ID NO: 3616794 - RNA, 14 nt, Salmonella enterica enterica serovar Typhi
gcguagcccagcgc

SEQ ID NO: 3616795 - RNA, 16 nt, Salmonella enterica enterica serovar Typhi
gcguagcccagcgccg

SEQ ID NO: 3616796 - RNA, 22 nt, Salmonella enterica enterica serovar Typhi
gcguagcgagucaaaccucacg

SEQ ID NO: 3616797 - RNA, 14 nt, Salmonella enterica enterica serovar Typhi
gcguagcgcguuca

SEQ ID NO: 3616798 - RNA, 18 nt, Salmonella enterica enterica serovar Typhi
gcguagcucgcccagcac

SEQ ID NO: 3616799 - RNA, 18 nt, Salmonella enterica enterica serovar Typhi
gcguaggguagaucacgc

SEQ ID NO: 3616800 - RNA, 16 nt, Salmonella enterica enterica serovar Typhi
gcguagguaagauauu

SEQ ID NO: 3616801 - RNA, 15 nt, Salmonella enterica enterica serovar Typhi
gcguagucucccucc

SEQ ID NO: 3616802 - RNA, 16 nt, Salmonella enterica enterica serovar Typhi
gcguauaacgccgccc

SEQ ID NO: 3616803 - RNA, 12 nt, Salmonella enterica enterica serovar Typhi
gcguauccagca

SEQ ID NO: 3616804 - RNA, 20 nt, Salmonella enterica enterica serovar Typhi
gcguaucucauugauggucg

SEQ ID NO: 3616805 - RNA, 14 nt, Salmonella enterica enterica serovar Typhi
gcguauugagcgca

SEQ ID NO: 3616806 - RNA, 13 nt, Salmonella enterica enterica serovar Typhi
gcgucaaaacagg

SEQ ID NO: 3616807 - RNA, 15 nt, Salmonella enterica enterica serovar Typhi
gcgucaaagcacaug

SEQ ID NO: 3616808 - RNA, 18 nt, Salmonella enterica enterica serovar Typhi
gcgucaaaguugcaucaa

SEQ ID NO: 3616809 - RNA, 19 nt, Salmonella enterica enterica serovar Typhi
gcgucaaauagagaaaaua

SEQ ID NO: 3616810 - RNA, 15 nt, Salmonella enterica enterica serovar Typhi
gcgucaaaucgccga

SEQ ID NO: 3616811 - RNA, 13 nt, Salmonella enterica enterica serovar Typhi
gcgucaacgccac

SEQ ID NO: 3616812 - RNA, 13 nt, Salmonella enterica enterica serovar Typhi
gcgucaauauuaa

SEQ ID NO: 3616813 - RNA, 17 nt, Salmonella enterica enterica serovar Typhi
gcgucacaaaaacaccc

SEQ ID NO: 3616814 - RNA, 13 nt, Salmonella enterica enterica serovar Typhi
gcgucacaacagc

SEQ ID NO: 3616815 - RNA, 14 nt, Salmonella enterica enterica serovar Typhi
gcgucacccgccgg

SEQ ID NO: 3616816 - RNA, 18 nt, Salmonella enterica enterica serovar Typhi
gcgucacccgccggcagc

SEQ ID NO: 3616817 - RNA, 21 nt, Salmonella enterica enterica serovar Typhi
gcgucacccgccggcagcagc

SEQ ID NO: 3616818 - RNA, 12 nt, Salmonella enterica enterica serovar Typhi
gcgucagcagag

SEQ ID NO: 3616819 - RNA, 16 nt, Salmonella enterica enterica serovar Typhi
gcgucagcccaagcug

SEQ ID NO: 3616820 - RNA, 22 nt, Salmonella enterica enterica serovar Typhi
gcgucagcccaagcugacggau

SEQ ID NO: 3616821 - RNA, 13 nt, Salmonella enterica enterica serovar Typhi
gcgucagcgcggc

SEQ ID NO: 3616822 - RNA, 17 nt, Salmonella enterica enterica serovar Typhi
gcgucagcgugcgguaa

SEQ ID NO: 3616823 - RNA, 15 nt, Salmonella enterica enterica serovar Typhi
gcgucaggacggcga

SEQ ID NO: 3616824 - RNA, 16 nt, Salmonella enterica enterica serovar Typhi
gcgucaggccaggguu

SEQ ID NO: 3616825 - RNA, 12 nt, Salmonella enterica enterica serovar Typhi
gcgucaggcgau

SEQ ID NO: 3616826 - RNA, 16 nt, Salmonella enterica enterica serovar Typhi
gcgucaggcuguuguu

SEQ ID NO: 3616827 - RNA, 19 nt, Salmonella enterica enterica serovar Typhi
gcgucauaguuuuccagcc

SEQ ID NO: 3616828 - RNA, 17 nt, Salmonella enterica enterica serovar Typhi
gcgucaucauugcgcca

SEQ ID NO: 3616829 - RNA, 22 nt, Salmonella enterica enterica serovar Typhi
gcgucauccaguguuaagaaga

SEQ ID NO: 3616830 - RNA, 14 nt, Salmonella enterica enterica serovar Typhi
gcgucauccggcau

SEQ ID NO: 3616831 - RNA, 22 nt, Salmonella enterica enterica serovar Typhi
gcgucaucgacauuaacaaugc

SEQ ID NO: 3616832 - RNA, 20 nt, Salmonella enterica enterica serovar Typhi
gcgucaucgcuccagacggc

SEQ ID NO: 3616833 - RNA, 17 nt, Salmonella enterica enterica serovar Typhi
gcgucaucggcgcgcug

SEQ ID NO: 3616834 - RNA, 20 nt, Salmonella enterica enterica serovar Typhi
gcgucauggcuaaucgccac

SEQ ID NO: 3616835 - RNA, 22 nt, Salmonella enterica enterica serovar Typhi
gcguccaacuggcuuucaucca

SEQ ID NO: 3616836 - RNA, 23 nt, Salmonella enterica enterica serovar Typhi
gcguccacuuucucggcuuucca

SEQ ID NO: 3616837 - RNA, 15 nt, Salmonella enterica enterica serovar Typhi
gcguccagaggaucu

SEQ ID NO: 3616838 - RNA, 22 nt, Salmonella enterica enterica serovar Typhi
gcguccagcccguccagauaau

SEQ ID NO: 3616839 - RNA, 15 nt, Salmonella enterica enterica serovar Typhi
gcguccccguucuga

SEQ ID NO: 3616840 - RNA, 12 nt, Salmonella enterica enterica serovar Typhi
gcgucccggcaa

SEQ ID NO: 3616841 - RNA, 14 nt, Salmonella enterica enterica serovar Typhi
gcgucccucuccag

SEQ ID NO: 3616842 - RNA, 14 nt, Salmonella enterica enterica serovar Typhi
gcguccgccaucgc

SEQ ID NO: 3616843 - RNA, 15 nt, Salmonella enterica enterica serovar Typhi
gcguccgccaucgcc

SEQ ID NO: 3616844 - RNA, 17 nt, Salmonella enterica enterica serovar Typhi
gcgucgaucagcgcgua

SEQ ID NO: 3616845 - RNA, 21 nt, Salmonella enterica enterica serovar Typhi
gcgucgccaaagcagcugcug

SEQ ID NO: 3616846 - RNA, 11 nt, Salmonella enterica enterica serovar Typhi
gcgucgccaua

SEQ ID NO: 3616847 - RNA, 16 nt, Salmonella enterica enterica serovar Typhi
gcgucgccauaaagcu

SEQ ID NO: 3616848 - RNA, 19 nt, Salmonella enterica enterica serovar Typhi
gcgucgccauaaagcugua

SEQ ID NO: 3616849 - RNA, 19 nt, Salmonella enterica enterica serovar Typhi
gcgucgccccaaucgccag

SEQ ID NO: 3616850 - RNA, 14 nt, Salmonella enterica enterica serovar Typhi
gcgucgcgcauggc

SEQ ID NO: 3616851 - RNA, 17 nt, Salmonella enterica enterica serovar Typhi
gcgucgcguaccagcgc

SEQ ID NO: 3616852 - RNA, 19 nt, Salmonella enterica enterica serovar Typhi
gcgucgcguaccagcgccc

SEQ ID NO: 3616853 - RNA, 17 nt, Salmonella enterica enterica serovar Typhi
gcgucggacauuuuguu

SEQ ID NO: 3616854 - RNA, 17 nt, Salmonella enterica enterica serovar Typhi
gcgucggcaccauuccc

SEQ ID NO: 3616855 - RNA, 14 nt, Salmonella enterica enterica serovar Typhi
gcgucgggccgcgc

SEQ ID NO: 3616856 - RNA, 23 nt, Salmonella enterica enterica serovar Typhi
gcgucgucauagcguugauaugc

SEQ ID NO: 3616857 - RNA, 16 nt, Salmonella enterica enterica serovar Typhi
gcgucguuccgucagu

SEQ ID NO: 3616858 - RNA, 17 nt, Salmonella enterica enterica serovar Typhi
gcgucguuccgucagug

SEQ ID NO: 3616859 - RNA, 20 nt, Salmonella enterica enterica serovar Typhi
gcgucguuggcauggucagc

SEQ ID NO: 3616860 - RNA, 15 nt, Salmonella enterica enterica serovar Typhi
gcgucucaagcuuuu

SEQ ID NO: 3616861 - RNA, 17 nt, Salmonella enterica enterica serovar Typhi
gcgucucagcaggcggc

SEQ ID NO: 3616862 - RNA, 17 nt, Salmonella enterica enterica serovar Typhi
gcgucucaucaaaaagg

SEQ ID NO: 3616863 - RNA, 18 nt, Salmonella enterica enterica serovar Typhi
gcguuucuagaugaugau

SEQ ID NO: 3616864 - RNA, 21 nt, Salmonella enterica enterica serovar Typhi
gcguuucucuugugcuuccag

SEQ ID NO: 3616865 - RNA, 20 nt, Salmonella enterica enterica serovar Typhi
gcguuugauuugcgcgucgu

SEQ ID NO: 3616866 - RNA, 16 nt, Salmonella enterica enterica serovar Typhi
gcguuugcgccgccau

SEQ ID NO: 3616867 - RNA, 18 nt, Salmonella enterica enterica serovar Typhi
gcguuuuacguacccgcu

SEQ ID NO: 3616868 - RNA, 14 nt, Salmonella enterica enterica serovar Typhi
gcguuuuagcgcca

SEQ ID NO: 3616869 - RNA, 13 nt, Salmonella enterica enterica serovar Typhi
gcguuuuauccgu

SEQ ID NO: 3616870 - RNA, 21 nt, Salmonella enterica enterica serovar Typhi
gcguuuucauuagccgccagc

SEQ ID NO: 3616871 - RNA, 13 nt, Salmonella enterica enterica serovar Typhi
gcguuuuccagcu

SEQ ID NO: 3616872 - RNA, 13 nt, Salmonella enterica enterica serovar Typhi
gcguuuugcgcgu

SEQ ID NO: 3616873 - RNA, 18 nt, Salmonella enterica enterica serovar Typhi
gcguuuuuucaucggcag

SEQ ID NO: 3616874 - RNA, 18 nt, Salmonella enterica enterica serovar Typhi
gcuaaaaacagcgcaaua

SEQ ID NO: 3616875 - RNA, 21 nt, Salmonella enterica enterica serovar Typhi
gcuaaaacacccgcaaacuaa

SEQ ID NO: 3616876 - RNA, 17 nt, Salmonella enterica enterica serovar Typhi
gcuaaacaauuugccca

SEQ ID NO: 3616877 - RNA, 20 nt, Salmonella enterica enterica serovar Typhi
gcuaaacaauuugcccagcg

SEQ ID NO: 3616878 - RNA, 14 nt, Salmonella enterica enterica serovar Typhi
gcuaaacagcaaau

SEQ ID NO: 3616879 - RNA, 22 nt, Salmonella enterica enterica serovar Typhi
gcuaaaccacaugaccagcgcc

SEQ ID NO: 3616880 - RNA, 19 nt, Salmonella enterica enterica serovar Typhi
gcuaaaccgucauuuacca

SEQ ID NO: 3616881 - RNA, 13 nt, Salmonella enterica enterica serovar Typhi
gcuaaagcacggg

SEQ ID NO: 3616882 - RNA, 14 nt, Salmonella enterica enterica serovar Typhi
gcuaaagcaucggg

SEQ ID NO: 3616883 - RNA, 14 nt, Salmonella enterica enterica serovar Typhi
gcuaaagcgcuggc

SEQ ID NO: 3616884 - RNA, 17 nt, Salmonella enterica enterica serovar Typhi
gcuaaagcgcuggcggc

SEQ ID NO: 3616885 - RNA, 18 nt, Salmonella enterica enterica serovar Typhi
gcuaaagcgcuggcggcg

SEQ ID NO: 3616886 - RNA, 15 nt, Salmonella enterica enterica serovar Typhi
gcuaaaucagugaug

SEQ ID NO: 3616887 - RNA, 23 nt, Salmonella enterica enterica serovar Typhi
gcuaaaugacaaauagaagccac

SEQ ID NO: 3616888 - RNA, 13 nt, Salmonella enterica enterica serovar Typhi
gcuaacagugaaa

SEQ ID NO: 3616889 - RNA, 16 nt, Salmonella enterica enterica serovar Typhi
gcuaaccuguucagcc

SEQ ID NO: 3616890 - RNA, 22 nt, Salmonella enterica enterica serovar Typhi
gcuaacgccugauccggccuac

SEQ ID NO: 3616891 - RNA, 14 nt, Salmonella enterica enterica serovar Typhi
gcuaacgccuugaa

SEQ ID NO: 3616892 - RNA, 17 nt, Salmonella enterica enterica serovar Typhi
gcuaacgcgccccaggu

SEQ ID NO: 3616893 - RNA, 20 nt, Salmonella enterica enterica serovar Typhi
gcuaacgcuuauccggccua

SEQ ID NO: 3616894 - RNA, 18 nt, Salmonella enterica enterica serovar Typhi
gcuaacggcaccagcaac

SEQ ID NO: 3616895 - RNA, 19 nt, Salmonella enterica enterica serovar Typhi
gcuaacggcaccagcaaca

SEQ ID NO: 3616896 - RNA, 20 nt, Salmonella enterica enterica serovar Typhi
gcuaagcagaacggcgauac

SEQ ID NO: 3616897 - RNA, 20 nt, Salmonella enterica enterica serovar Typhi
gcuaagcgcccguagcucag

SEQ ID NO: 3616898 - RNA, 12 nt, Salmonella enterica enterica serovar Typhi
gcuaauaauucu

SEQ ID NO: 3616899 - RNA, 11 nt, Salmonella enterica enterica serovar Typhi
gcuaauaucca

SEQ ID NO: 3616900 - RNA, 20 nt, Salmonella enterica enterica serovar Typhi
gcuaauaugaauuauuuucu

SEQ ID NO: 3616901 - RNA, 16 nt, Salmonella enterica enterica serovar Typhi
gcuaauaugccaggcu

SEQ ID NO: 3616902 - RNA, 18 nt, Salmonella enterica enterica serovar Typhi
gcuaauccccccuuuuuu

SEQ ID NO: 3616903 - RNA, 18 nt, Salmonella enterica enterica serovar Typhi
gcuaaucccgcucgccag

SEQ ID NO: 3616904 - RNA, 21 nt, Salmonella enterica enterica serovar Typhi
gcuaaucgugauaaauugcug

SEQ ID NO: 3616905 - RNA, 14 nt, Salmonella enterica enterica serovar Typhi
gcuaaugauuaucu

SEQ ID NO: 3616906 - RNA, 18 nt, Salmonella enterica enterica serovar Typhi
gcuaaugauuaucuuuuu

SEQ ID NO: 3616907 - RNA, 16 nt, Salmonella enterica enterica serovar Typhi
gcuaauggcuuauugg

SEQ ID NO: 3616908 - RNA, 11 nt, Salmonella enterica enterica serovar Typhi
gcuaauguacg

SEQ ID NO: 3616909 - RNA, 20 nt, Salmonella enterica enterica serovar Typhi
gcuaauguacgccuaaaaau

SEQ ID NO: 3616910 - RNA, 16 nt, Salmonella enterica enterica serovar Typhi
gcuaauuggcuuaccu

SEQ ID NO: 3616911 - RNA, 17 nt, Salmonella enterica enterica serovar Typhi
gcuaauuuucagggugg

SEQ ID NO: 3616912 - RNA, 19 nt, Salmonella enterica enterica serovar Typhi
gcuacacgcgaauagccag

SEQ ID NO: 3616913 - RNA, 20 nt, Salmonella enterica enterica serovar Typhi
gcuacagacaucuuugccaa

SEQ ID NO: 3616914 - RNA, 15 nt, Salmonella enterica enterica serovar Typhi
gcuacauccgccagc

SEQ ID NO: 3616915 - RNA, 20 nt, Salmonella enterica enterica serovar Typhi
gcuaccacagaaaucgccgg

SEQ ID NO: 3616916 - RNA, 17 nt, Salmonella enterica enterica serovar Typhi
gcuaccaggcaaagcuc

SEQ ID NO: 3616917 - RNA, 16 nt, Salmonella enterica enterica serovar Typhi
gcuacccgcugacgcu

SEQ ID NO: 3616918 - RNA, 19 nt, Salmonella enterica enterica serovar Typhi
gcuaccgccacuuugcuuu

SEQ ID NO: 3616919 - RNA, 16 nt, Salmonella enterica enterica serovar Typhi
gcuaccgggcaaacau

SEQ ID NO: 3616920 - RNA, 16 nt, Salmonella enterica enterica serovar Typhi
gcuaccguccaaauca

SEQ ID NO: 3616921 - RNA, 16 nt, Salmonella enterica enterica serovar Typhi
gcuaccgucgccgaca

SEQ ID NO: 3616922 - RNA, 22 nt, Salmonella enterica enterica serovar Typhi
gcuaccucguaucccgccuggc

SEQ ID NO: 3616923 - RNA, 22 nt, Salmonella enterica enterica serovar Typhi
gcuacgauaaagcugaguaagg

SEQ ID NO: 3616924 - RNA, 23 nt, Salmonella enterica enterica serovar Typhi
gcuacgauaaagcugaguaagga

SEQ ID NO: 3616925 - RNA, 16 nt, Salmonella enterica enterica serovar Typhi
gcuacgccuuacccga

SEQ ID NO: 3616926 - RNA, 16 nt, Salmonella enterica enterica serovar Typhi
gcuacgccuuauccgg

SEQ ID NO: 3616927 - RNA, 21 nt, Salmonella enterica enterica serovar Typhi
gcuacgccuuauccggccuac

SEQ ID NO: 3616928 - RNA, 14 nt, Salmonella enterica enterica serovar Typhi
gcuacgcgucgcca

SEQ ID NO: 3616929 - RNA, 22 nt, Salmonella enterica enterica serovar Typhi
gcuacgcugcgcguucugcucc

SEQ ID NO: 3616930 - RNA, 17 nt, Salmonella enterica enterica serovar Typhi
gcuacgcuuaucaggcc

SEQ ID NO: 3616931 - RNA, 19 nt, Salmonella enterica enterica serovar Typhi
gcuacgcuuaucaggccua

SEQ ID NO: 3616932 - RNA, 20 nt, Salmonella enterica enterica serovar Typhi
gcuacgcuuaucaggccuac

SEQ ID NO: 3616933 - RNA, 23 nt, Salmonella enterica enterica serovar Typhi
gcuacgcuuaucgggccuacgag

SEQ ID NO: 3616934 - RNA, 20 nt, Salmonella enterica enterica serovar Typhi
gcuacggaguucgccgccgg

SEQ ID NO: 3616935 - RNA, 21 nt, Salmonella enterica enterica serovar Typhi
gcuacgucgucgaucgcgcca

SEQ ID NO: 3616936 - RNA, 15 nt, Salmonella enterica enterica serovar Typhi
gcuacguuuaucugg

SEQ ID NO: 3616937 - RNA, 19 nt, Salmonella enterica enterica serovar Typhi
gcuacguuuaucuggcuua

SEQ ID NO: 3616938 - RNA, 18 nt, Salmonella enterica enterica serovar Typhi
gcuacucaggagaucggc

SEQ ID NO: 3616939 - RNA, 23 nt, Salmonella enterica enterica serovar Typhi
gcuagcugugguugcccgcaggc

SEQ ID NO: 3616940 - RNA, 14 nt, Salmonella enterica enterica serovar Typhi
gcuauaaaguuccc

SEQ ID NO: 3616941 - RNA, 21 nt, Salmonella enterica enterica serovar Typhi
gcuauaccaggguucgcuggc

SEQ ID NO: 3616942 - RNA, 16 nt, Salmonella enterica enterica serovar Typhi
gcuauaccgcccgcgc

SEQ ID NO: 3616943 - RNA, 14 nt, Salmonella enterica enterica serovar Typhi
gcuauacgcggcgu

SEQ ID NO: 3616944 - RNA, 14 nt, Salmonella enterica enterica serovar Typhi
gcuauagaaugcaa

SEQ ID NO: 3616945 - RNA, 18 nt, Salmonella enterica enterica serovar Typhi
gcuauagaaugcaagcag

SEQ ID NO: 3616946 - RNA, 12 nt, Salmonella enterica enterica serovar Typhi
gcuauagcucag

SEQ ID NO: 3616947 - RNA, 22 nt, Salmonella enterica enterica serovar Typhi
gcuauaguggauggcccacugu

SEQ ID NO: 3616948 - RNA, 22 nt, Salmonella enterica enterica serovar Typhi
gcuaucaacgccuccaggcuac

SEQ ID NO: 3616949 - RNA, 20 nt, Salmonella enterica enterica serovar Typhi
gcuaucaagauaaaaagaca

SEQ ID NO: 3616950 - RNA, 20 nt, Salmonella enterica enterica serovar Typhi
gcuaucaggaagaacacgcc

SEQ ID NO: 3616951 - RNA, 16 nt, Salmonella enterica enterica serovar Typhi
gcuaucaggccuacaa

SEQ ID NO: 3616952 - RNA, 18 nt, Salmonella enterica enterica serovar Typhi
gcuauccacgcagacgcc

SEQ ID NO: 3616953 - RNA, 17 nt, Salmonella enterica enterica serovar Typhi
gcuauccagcaguaaau

SEQ ID NO: 3616954 - RNA, 15 nt, Salmonella enterica enterica serovar Typhi
gcuauccaucgccgc

SEQ ID NO: 3616955 - RNA, 14 nt, Salmonella enterica enterica serovar Typhi
gcuaucccaggcgg

SEQ ID NO: 3616956 - RNA, 14 nt, Salmonella enterica enterica serovar Typhi
gcuaucccgaugcu

SEQ ID NO: 3616957 - RNA, 23 nt, Salmonella enterica enterica serovar Typhi
gcuaucccgaugcucagggcauc

SEQ ID NO: 3616958 - RNA, 14 nt, Salmonella enterica enterica serovar Typhi
gcuauccgccgcca

SEQ ID NO: 3616959 - RNA, 20 nt, Salmonella enterica enterica serovar Typhi
gcuauccgccgccagccaua

SEQ ID NO: 3616960 - RNA, 14 nt, Salmonella enterica enterica serovar Typhi
gcuaucgaccagca

SEQ ID NO: 3616961 - RNA, 17 nt, Salmonella enterica enterica serovar Typhi
gcuaucgagaaugguuu

SEQ ID NO: 3616962 - RNA, 19 nt, Salmonella enterica enterica serovar Typhi
gcuaucgcuuuaacgcugc

SEQ ID NO: 3616963 - RNA, 23 nt, Salmonella enterica enterica serovar Typhi
gcuaucggaaacuauccuggccu

SEQ ID NO: 3616964 - RNA, 21 nt, Salmonella enterica enterica serovar Typhi
gcuaucgggcguuaaaaguac

SEQ ID NO: 3616965 - RNA, 16 nt, Salmonella enterica enterica serovar Typhi
gcuaucugacagccaa

SEQ ID NO: 3616966 - RNA, 22 nt, Salmonella enterica enterica serovar Typhi
gcuaucugacagccaaacugcu

SEQ ID NO: 3616967 - RNA, 17 nt, Salmonella enterica enterica serovar Typhi
gcuaugaagcuggagcc

SEQ ID NO: 3616968 - RNA, 22 nt, Salmonella enterica enterica serovar Typhi
gcuaugccggaggauauuuauu

SEQ ID NO: 3616969 - RNA, 13 nt, Salmonella enterica enterica serovar Typhi
gcuaugcgccagu

SEQ ID NO: 3616970 - RNA, 20 nt, Salmonella enterica enterica serovar Typhi
gcuaugcggcguuaauggcc

SEQ ID NO: 3616971 - RNA, 14 nt, Salmonella enterica enterica serovar Typhi
gcuaugcuuaccau

SEQ ID NO: 3616972 - RNA, 21 nt, Salmonella enterica enterica serovar Typhi
gcuaugcuuaccaucuggccu

SEQ ID NO: 3616973 - RNA, 17 nt, Salmonella enterica enterica serovar Typhi
gcuauggcaacaaagcc

SEQ ID NO: 3616974 - RNA, 21 nt, Salmonella enterica enterica serovar Typhi
gcuauggccguuuacgagcca

SEQ ID NO: 3616975 - RNA, 17 nt, Salmonella enterica enterica serovar Typhi
gcuaugggaagggugac

SEQ ID NO: 3616976 - RNA, 22 nt, Salmonella enterica enterica serovar Typhi
gcuauuaaucugugagcacagg

SEQ ID NO: 3616977 - RNA, 23 nt, Salmonella enterica enterica serovar Typhi
gcuauuaccggcuggaagcccaa

SEQ ID NO: 3616978 - RNA, 22 nt, Salmonella enterica enterica serovar Typhi
gcuauucauuauuuuuaaauaa

SEQ ID NO: 3616979 - RNA, 19 nt, Salmonella enterica enterica serovar Typhi
gcuauuccucgaucgccug

SEQ ID NO: 3616980 - RNA, 12 nt, Salmonella enterica enterica serovar Typhi
gcuauuuaaccc

SEQ ID NO: 3616981 - RNA, 18 nt, Salmonella enterica enterica serovar Typhi
gcuauuuaacccugguuu

SEQ ID NO: 3616982 - RNA, 20 nt, Salmonella enterica enterica serovar Typhi
gcuauuuuuugcuggcggca

SEQ ID NO: 3616983 - RNA, 17 nt, Salmonella enterica enterica serovar Typhi
gcucaaaguuaccggca

SEQ ID NO: 3616984 - RNA, 13 nt, Salmonella enterica enterica serovar Typhi
gcucaaauaugau

SEQ ID NO: 3616985 - RNA, 20 nt, Salmonella enterica enterica serovar Typhi
gcucaaauaugauaugugua

SEQ ID NO: 3616986 - RNA, 16 nt, Salmonella enterica enterica serovar Typhi
gcucaaccgcgcggcg

SEQ ID NO: 3616987 - RNA, 22 nt, Salmonella enterica enterica serovar Typhi
gcucaaccgcgcggcguucugc

SEQ ID NO: 3616988 - RNA, 20 nt, Salmonella enterica enterica serovar Typhi
gcucaacgcccucaaguaaa

SEQ ID NO: 3616989 - RNA, 15 nt, Salmonella enterica enterica serovar Typhi
gcucaacuuccagag

SEQ ID NO: 3616990 - RNA, 19 nt, Salmonella enterica enterica serovar Typhi
gcucaagccagguugcgcc

SEQ ID NO: 3616991 - RNA, 16 nt, Salmonella enterica enterica serovar Typhi
gcucaagcgccgcgau

SEQ ID NO: 3616992 - RNA, 19 nt, Salmonella enterica enterica serovar Typhi
gcucaauaccuuaguaaaa

SEQ ID NO: 3616993 - RNA, 14 nt, Salmonella enterica enterica serovar Typhi
gcucaauccaggug

SEQ ID NO: 3616994 - RNA, 20 nt, Salmonella enterica enterica serovar Typhi
gcucaauguagcgucagccg

SEQ ID NO: 3616995 - RNA, 14 nt, Salmonella enterica enterica serovar Typhi
gcucaauuuuuuuc

SEQ ID NO: 3616996 - RNA, 21 nt, Salmonella enterica enterica serovar Typhi
gcucacauucauugccgccag

SEQ ID NO: 3616997 - RNA, 13 nt, Salmonella enterica enterica serovar Typhi
gcucaccagccca

SEQ ID NO: 3616998 - RNA, 15 nt, Salmonella enterica enterica serovar Typhi
gcucaccagcccaac

SEQ ID NO: 3616999 - RNA, 15 nt, Salmonella enterica enterica serovar Typhi
gcucaccgacuccuc

SEQ ID NO: 3617000 - RNA, 22 nt, Salmonella enterica enterica serovar Typhi
gcucaccgagacugcccggcau

SEQ ID NO: 3617001 - RNA, 23 nt, Salmonella enterica enterica serovar Typhi
gcucaccgagacugcccggcaua

SEQ ID NO: 3617002 - RNA, 13 nt, Salmonella enterica enterica serovar Typhi
gcucacgcuggug

SEQ ID NO: 3617003 - RNA, 15 nt, Salmonella enterica enterica serovar Typhi
gcucacggcacgccc

SEQ ID NO: 3617004 - RNA, 20 nt, Salmonella enterica enterica serovar Typhi
gcucacggcacgcccuucgu

SEQ ID NO: 3617005 - RNA, 22 nt, Salmonella enterica enterica serovar Typhi
gcucacugcuaaggagauaacu

SEQ ID NO: 3617006 - RNA, 18 nt, Salmonella enterica enterica serovar Typhi
gcucacuuuucuuuccug

SEQ ID NO: 3617007 - RNA, 15 nt, Salmonella enterica enterica serovar Typhi
gcucagaaauauuca

SEQ ID NO: 3617008 - RNA, 20 nt, Salmonella enterica enterica serovar Typhi
gcucagaaccucaucccggc

SEQ ID NO: 3617009 - RNA, 19 nt, Salmonella enterica enterica serovar Typhi
gcucagaccauauucacgc

SEQ ID NO: 3617010 - RNA, 13 nt, Salmonella enterica enterica serovar Typhi
gcucagaccgauc

SEQ ID NO: 3617011 - RNA, 15 nt, Salmonella enterica enterica serovar Typhi
gcucagccagaaacg

SEQ ID NO: 3617012 - RNA, 16 nt, Salmonella enterica enterica serovar Typhi
gcucagcgcggcagcc

SEQ ID NO: 3617013 - RNA, 13 nt, Salmonella enterica enterica serovar Typhi
gcucagcggcaau

SEQ ID NO: 3617014 - RNA, 14 nt, Salmonella enterica enterica serovar Typhi
gcucagcggcggcg

SEQ ID NO: 3617015 - RNA, 19 nt, Salmonella enterica enterica serovar Typhi
gcucagcggcggcgggaac

SEQ ID NO: 3617016 - RNA, 19 nt, Salmonella enterica enterica serovar Typhi
gcucaggagcgccugacag

SEQ ID NO: 3617017 - RNA, 14 nt, Salmonella enterica enterica serovar Typhi
gcucaggcgcgaau

SEQ ID NO: 3617018 - RNA, 13 nt, Salmonella enterica enterica serovar Typhi
gcucagggucaga

SEQ ID NO: 3617019 - RNA, 23 nt, Salmonella enterica enterica serovar Typhi
gcucagggucagaauacagaauc

SEQ ID NO: 3617020 - RNA, 22 nt, Salmonella enterica enterica serovar Typhi
gcucaggguuuucuaccgcagc

SEQ ID NO: 3617021 - RNA, 18 nt, Salmonella enterica enterica serovar Typhi
gcucauacgaucgcgcac

SEQ ID NO: 3617022 - RNA, 14 nt, Salmonella enterica enterica serovar Typhi
gcucaucagcgcca

SEQ ID NO: 3617023 - RNA, 19 nt, Salmonella enterica enterica serovar Typhi
gcucaucagcgccauugcu

SEQ ID NO: 3617024 - RNA, 13 nt, Salmonella enterica enterica serovar Typhi
gcucaucucaagc

SEQ ID NO: 3617025 - RNA, 15 nt, Salmonella enterica enterica serovar Typhi
gcucaugacaucgcc

SEQ ID NO: 3617026 - RNA, 21 nt, Salmonella enterica enterica serovar Typhi
gcucaugauagggcagcaguu

SEQ ID NO: 3617027 - RNA, 19 nt, Salmonella enterica enterica serovar Typhi
gcucaugugcagcauccag

SEQ ID NO: 3617028 - RNA, 23 nt, Salmonella enterica enterica serovar Typhi
gcucaugugcagcauccagcuca

SEQ ID NO: 3617029 - RNA, 18 nt, Salmonella enterica enterica serovar Typhi
gcucauuaacgacaacuu

SEQ ID NO: 3617030 - RNA, 15 nt, Salmonella enterica enterica serovar Typhi
gcucauuauuuggau

SEQ ID NO: 3617031 - RNA, 17 nt, Salmonella enterica enterica serovar Typhi
gcucauuuuauccaaca

SEQ ID NO: 3617032 - RNA, 13 nt, Salmonella enterica enterica serovar Typhi
gcuccaauaaaua

SEQ ID NO: 3617033 - RNA, 12 nt, Salmonella enterica enterica serovar Typhi
gcugaauaaccc

SEQ ID NO: 3617034 - RNA, 17 nt, Salmonella enterica enterica serovar Typhi
gcugaauagccagcccc

SEQ ID NO: 3617035 - RNA, 18 nt, Salmonella enterica enterica serovar Typhi
gcugaaugcuucgccacg

SEQ ID NO: 3617036 - RNA, 12 nt, Salmonella enterica enterica serovar Typhi
gcugaauguucu

SEQ ID NO: 3617037 - RNA, 17 nt, Salmonella enterica enterica serovar Typhi
gcugacaaacccuguau

SEQ ID NO: 3617038 - RNA, 19 nt, Salmonella enterica enterica serovar Typhi
gcugacaaagguugcgcca

SEQ ID NO: 3617039 - RNA, 20 nt, Salmonella enterica enterica serovar Typhi
gcugacaaagguugcgccaa

SEQ ID NO: 3617040 - RNA, 16 nt, Salmonella enterica enterica serovar Typhi
gcugacaaucagcaca

SEQ ID NO: 3617041 - RNA, 15 nt, Salmonella enterica enterica serovar Typhi
gcugacaaucugcug

SEQ ID NO: 3617042 - RNA, 12 nt, Salmonella enterica enterica serovar Typhi
gcugacagcauc

SEQ ID NO: 3617043 - RNA, 22 nt, Salmonella enterica enterica serovar Typhi
gcugacaggauacccggcucgc

SEQ ID NO: 3617044 - RNA, 23 nt, Salmonella enterica enterica serovar Typhi
gcugacaucguguauaccaaaaa

SEQ ID NO: 3617045 - RNA, 19 nt, Salmonella enterica enterica serovar Typhi
gcugaccaacgucagcauc

SEQ ID NO: 3617046 - RNA, 18 nt, Salmonella enterica enterica serovar Typhi
gcugaccugaacgccuac

SEQ ID NO: 3617047 - RNA, 16 nt, Salmonella enterica enterica serovar Typhi
gcugacgacauucagc

SEQ ID NO: 3617048 - RNA, 19 nt, Salmonella enterica enterica serovar Typhi
gcugacgacauucagcaca

SEQ ID NO: 3617049 - RNA, 14 nt, Salmonella enterica enterica serovar Typhi
gcugacgaccccag

SEQ ID NO: 3617050 - RNA, 15 nt, Salmonella enterica enterica serovar Typhi
gcugacgacgccagc

SEQ ID NO: 3617051 - RNA, 17 nt, Salmonella enterica enterica serovar Typhi
gcugacgacgccagccc

SEQ ID NO: 3617052 - RNA, 16 nt, Salmonella enterica enterica serovar Typhi
gcugacgcagcaguuc

SEQ ID NO: 3617053 - RNA, 17 nt, Salmonella enterica enterica serovar Typhi
gcugacgcagcaguucc

SEQ ID NO: 3617054 - RNA, 15 nt, Salmonella enterica enterica serovar Typhi
gcugacgcccaucag

SEQ ID NO: 3617055 - RNA, 16 nt, Salmonella enterica enterica serovar Typhi
gcugacgcccaucagc

SEQ ID NO: 3617056 - RNA, 20 nt, Salmonella enterica enterica serovar Typhi
gcugacgcccaucagcaucc

SEQ ID NO: 3617057 - RNA, 16 nt, Salmonella enterica enterica serovar Typhi
gcugacgcgaucgccg

SEQ ID NO: 3617058 - RNA, 16 nt, Salmonella enterica enterica serovar Typhi
gcugacgcgccuggau

SEQ ID NO: 3617059 - RNA, 17 nt, Salmonella enterica enterica serovar Typhi
gcugacggagcuggcac

SEQ ID NO: 3617060 - RNA, 15 nt, Salmonella enterica enterica serovar Typhi
gcugacggauacgcu

SEQ ID NO: 3617061 - RNA, 18 nt, Salmonella enterica enterica serovar Typhi
gcugacguuacgcggcgc

SEQ ID NO: 3617062 - RNA, 21 nt, Salmonella enterica enterica serovar Typhi
gcugacguucgacccgcaaug

SEQ ID NO: 3617063 - RNA, 12 nt, Salmonella enterica enterica serovar Typhi
gcugacugccgu

SEQ ID NO: 3617064 - RNA, 13 nt, Salmonella enterica enterica serovar Typhi
gcugagaaaaaua

SEQ ID NO: 3617065 - RNA, 16 nt, Salmonella enterica enterica serovar Typhi
gcugagcuaaucaccc

SEQ ID NO: 3617066 - RNA, 14 nt, Salmonella enterica enterica serovar Typhi
gcugaggaucaccc

SEQ ID NO: 3617067 - RNA, 18 nt, Salmonella enterica enterica serovar Typhi
gcugaggauggcgcggca

SEQ ID NO: 3617068 - RNA, 14 nt, Salmonella enterica enterica serovar Typhi
gcugaguuucuccc

SEQ ID NO: 3617069 - RNA, 20 nt, Salmonella enterica enterica serovar Typhi
gcugauaagcuaguaaagaa

SEQ ID NO: 3617070 - RNA, 13 nt, Salmonella enterica enterica serovar Typhi
gcugauaauacug

SEQ ID NO: 3617071 - RNA, 14 nt, Salmonella enterica enterica serovar Typhi
gcugauacgcacca

SEQ ID NO: 3617072 - RNA, 16 nt, Salmonella enterica enterica serovar Typhi
gcugauaggccuggau

SEQ ID NO: 3617073 - RNA, 15 nt, Salmonella enterica enterica serovar Typhi
gcugaucaaugcgca

SEQ ID NO: 3617074 - RNA, 16 nt, Salmonella enterica enterica serovar Typhi
gcugaucccgcgcgcc

SEQ ID NO: 3617075 - RNA, 22 nt, Salmonella enterica enterica serovar Typhi
gcugaucgcgagaguaagccca

SEQ ID NO: 3617076 - RNA, 17 nt, Salmonella enterica enterica serovar Typhi
gcugaucgugauaggcc

SEQ ID NO: 3617077 - RNA, 23 nt, Salmonella enterica enterica serovar Typhi
gcugaugcccagguuagcagcca

SEQ ID NO: 3617078 - RNA, 12 nt, Salmonella enterica enterica serovar Typhi
gcugaugguuuc

SEQ ID NO: 3617079 - RNA, 16 nt, Salmonella enterica enterica serovar Typhi
gcugauguccgcagcc

SEQ ID NO: 3617080 - RNA, 19 nt, Salmonella enterica enterica serovar Typhi
gcugauuccggcgcaucca

SEQ ID NO: 3617081 - RNA, 15 nt, Salmonella enterica enterica serovar Typhi
gcugauuuguuaucu

SEQ ID NO: 3617082 - RNA, 20 nt, Salmonella enterica enterica serovar Typhi
gcugauuuguuaucuacagu

SEQ ID NO: 3617083 - RNA, 17 nt, Salmonella enterica enterica serovar Typhi
gcugcaaaucaccacau

SEQ ID NO: 3617084 - RNA, 15 nt, Salmonella enterica enterica serovar Typhi
gcugcaacucuccca

SEQ ID NO: 3617085 - RNA, 20 nt, Salmonella enterica enterica serovar Typhi
gcugcacccggagagaaaca

SEQ ID NO: 3617086 - RNA, 21 nt, Salmonella enterica enterica serovar Typhi
gcugcagcuuaggauucgcca

SEQ ID NO: 3617087 - RNA, 16 nt, Salmonella enterica enterica serovar Typhi
gcugcauaaugcgcga

SEQ ID NO: 3617088 - RNA, 20 nt, Salmonella enterica enterica serovar Typhi
gcugcauccuguaccaccac

SEQ ID NO: 3617089 - RNA, 14 nt, Salmonella enterica enterica serovar Typhi
gcugccacacucuc

SEQ ID NO: 3617090 - RNA, 19 nt, Salmonella enterica enterica serovar Typhi
gcugccacacucucuccag

SEQ ID NO: 3617091 - RNA, 13 nt, Salmonella enterica enterica serovar Typhi
gcugccagcgccg

SEQ ID NO: 3617092 - RNA, 18 nt, Salmonella enterica enterica serovar Typhi
gcugccagcugcgucagc

SEQ ID NO: 3617093 - RNA, 12 nt, Salmonella enterica enterica serovar Typhi
gcugccaucagg

SEQ ID NO: 3617094 - RNA, 17 nt, Salmonella enterica enterica serovar Typhi
gcugccauuaucaccau

SEQ ID NO: 3617095 - RNA, 15 nt, Salmonella enterica enterica serovar Typhi
gcugcccgccgccgg

SEQ ID NO: 3617096 - RNA, 21 nt, Salmonella enterica enterica serovar Typhi
gcugcccugcgguagcuccag

SEQ ID NO: 3617097 - RNA, 22 nt, Salmonella enterica enterica serovar Typhi
gcugccgacaacgccuccugcc

SEQ ID NO: 3617098 - RNA, 15 nt, Salmonella enterica enterica serovar Typhi
gcugccgaccuggcu

SEQ ID NO: 3617099 - RNA, 22 nt, Salmonella enterica enterica serovar Typhi
gcugccgauagcaucgcugaug

SEQ ID NO: 3617100 - RNA, 21 nt, Salmonella enterica enterica serovar Typhi
gcugccgccauuugcgcggcu

SEQ ID NO: 3617101 - RNA, 15 nt, Salmonella enterica enterica serovar Typhi
gcugccgcccuuucc

SEQ ID NO: 3617102 - RNA, 18 nt, Salmonella enterica enterica serovar Typhi
gcugccgucccagcggau

SEQ ID NO: 3617103 - RNA, 14 nt, Salmonella enterica enterica serovar Typhi
gcugccucuuuguu

SEQ ID NO: 3617104 - RNA, 14 nt, Salmonella enterica enterica serovar Typhi
gcugccugccggau

SEQ ID NO: 3617105 - RNA, 13 nt, Salmonella enterica enterica serovar Typhi
gcugccuuauccg

SEQ ID NO: 3617106 - RNA, 13 nt, Salmonella enterica enterica serovar Typhi
gcugcgacaacaa

SEQ ID NO: 3617107 - RNA, 15 nt, Salmonella enterica enterica serovar Typhi
gcugcgacagcgaac

SEQ ID NO: 3617108 - RNA, 18 nt, Salmonella enterica enterica serovar Typhi
gcugcgauaaugaagcau

SEQ ID NO: 3617109 - RNA, 13 nt, Salmonella enterica enterica serovar Typhi
gcugcgccagcgc

SEQ ID NO: 3617110 - RNA, 14 nt, Salmonella enterica enterica serovar Typhi
gcugcgccagcgca

SEQ ID NO: 3617111 - RNA, 21 nt, Salmonella enterica enterica serovar Typhi
gcugcgccauauccucgcugg

SEQ ID NO: 3617112 - RNA, 23 nt, Salmonella enterica enterica serovar Typhi
gcugcgccauauccucgcugggc

SEQ ID NO: 3617113 - RNA, 12 nt, Salmonella enterica enterica serovar Typhi
gcugcgccgcgc

SEQ ID NO: 3617114 - RNA, 22 nt, Salmonella enterica enterica serovar Typhi
gcugcgccugaaaggcacgcuc

SEQ ID NO: 3617115 - RNA, 22 nt, Salmonella enterica enterica serovar Typhi
gcugcgccuggaaaaaagcgcc

SEQ ID NO: 3617116 - RNA, 14 nt, Salmonella enterica enterica serovar Typhi
gcugcgcugccagc

SEQ ID NO: 3617117 - RNA, 19 nt, Salmonella enterica enterica serovar Typhi
gcugcgcuuaucaggccua

SEQ ID NO: 3617118 - RNA, 20 nt, Salmonella enterica enterica serovar Typhi
gcugcgcuuaucaggccuac

SEQ ID NO: 3617119 - RNA, 15 nt, Salmonella enterica enterica serovar Typhi
gcuguccagccgccc

SEQ ID NO: 3617120 - RNA, 14 nt, Salmonella enterica enterica serovar Typhi
gcuguccagucaaa

SEQ ID NO: 3617121 - RNA, 12 nt, Salmonella enterica enterica serovar Typhi
gcugucccagag

SEQ ID NO: 3617122 - RNA, 14 nt, Salmonella enterica enterica serovar Typhi
gcugucccagaguu

SEQ ID NO: 3617123 - RNA, 18 nt, Salmonella enterica enterica serovar Typhi
gcugucccagugucaacu

SEQ ID NO: 3617124 - RNA, 18 nt, Salmonella enterica enterica serovar Typhi
gcuguccuuaaccagcuc

SEQ ID NO: 3617125 - RNA, 20 nt, Salmonella enterica enterica serovar Typhi
gcugucgacaauaaauugcg

SEQ ID NO: 3617126 - RNA, 16 nt, Salmonella enterica enterica serovar Typhi
gcugucggucagauuc

SEQ ID NO: 3617127 - RNA, 21 nt, Salmonella enterica enterica serovar Typhi
gcugucggucaggcugcggac

SEQ ID NO: 3617128 - RNA, 20 nt, Salmonella enterica enterica serovar Typhi
gcugucuaauugacggccac

SEQ ID NO: 3617129 - RNA, 23 nt, Salmonella enterica enterica serovar Typhi
gcugugcaacaucuuaccggugc

SEQ ID NO: 3617130 - RNA, 22 nt, Salmonella enterica enterica serovar Typhi
gcugugcagacugcacuuccug

SEQ ID NO: 3617131 - RNA, 15 nt, Salmonella enterica enterica serovar Typhi
gcugugcauaaauaa

SEQ ID NO: 3617132 - RNA, 13 nt, Salmonella enterica enterica serovar Typhi
gcugugccugccu

SEQ ID NO: 3617133 - RNA, 14 nt, Salmonella enterica enterica serovar Typhi
gcugugccugccug

SEQ ID NO: 3617134 - RNA, 18 nt, Salmonella enterica enterica serovar Typhi
gcugugcgagaccaucaa

SEQ ID NO: 3617135 - RNA, 16 nt, Salmonella enterica enterica serovar Typhi
gcugugcuaucaggcc

SEQ ID NO: 3617136 - RNA, 15 nt, Salmonella enterica enterica serovar Typhi
gcuguggaaacugug

SEQ ID NO: 3617137 - RNA, 16 nt, Salmonella enterica enterica serovar Typhi
gcuguggaaacugugc

SEQ ID NO: 3617138 - RNA, 16 nt, Salmonella enterica enterica serovar Typhi
gcuguggccaggcacg

SEQ ID NO: 3617139 - RNA, 15 nt, Salmonella enterica enterica serovar Typhi
gcuguggucgucugg

SEQ ID NO: 3617140 - RNA, 13 nt, Salmonella enterica enterica serovar Typhi
gcugugugaccag

SEQ ID NO: 3617141 - RNA, 16 nt, Salmonella enterica enterica serovar Typhi
gcugugugaccagcag

SEQ ID NO: 3617142 - RNA, 17 nt, Salmonella enterica enterica serovar Typhi
gcuguuaaccuugcgcc

SEQ ID NO: 3617143 - RNA, 17 nt, Salmonella enterica enterica serovar Typhi
gcuguuaaucucauaaa

SEQ ID NO: 3617144 - RNA, 23 nt, Salmonella enterica enterica serovar Typhi
gcuguuaccaaugccaaaaaaac

SEQ ID NO: 3617145 - RNA, 16 nt, Salmonella enterica enterica serovar Typhi
gcuguuaccguaagcg

SEQ ID NO: 3617146 - RNA, 15 nt, Salmonella enterica enterica serovar Typhi
gcuguuaguaagcug

SEQ ID NO: 3617147 - RNA, 17 nt, Salmonella enterica enterica serovar Typhi
gcuguuaguaagcuggg

SEQ ID NO: 3617148 - RNA, 22 nt, Salmonella enterica enterica serovar Typhi
gcuguucaaucacugaugccac

SEQ ID NO: 3617149 - RNA, 21 nt, Salmonella enterica enterica serovar Typhi
gcuguuccaccaacgaccauc

SEQ ID NO: 3617150 - RNA, 13 nt, Salmonella enterica enterica serovar Typhi
gcuguuccacggg

SEQ ID NO: 3617151 - RNA, 18 nt, Salmonella enterica enterica serovar Typhi
gcuguugaggaaauucug

SEQ ID NO: 3617152 - RNA, 18 nt, Salmonella enterica enterica serovar Typhi
gcuguugucgauauuaaa

SEQ ID NO: 3617153 - RNA, 23 nt, Salmonella enterica enterica serovar Typhi
gcuguugugucccggcccauacu

SEQ ID NO: 3617154 - RNA, 15 nt, Salmonella enterica enterica serovar Typhi
gcuguuguuccagau

SEQ ID NO: 3617155 - RNA, 20 nt, Salmonella enterica enterica serovar Typhi
gcuguuuaaagguuauccgc

SEQ ID NO: 3617156 - RNA, 21 nt, Salmonella enterica enterica serovar Typhi
gcuguuuagccgucucgguuc

SEQ ID NO: 3617157 - RNA, 18 nt, Salmonella enterica enterica serovar Typhi
gcuguuuauccacaggcg

SEQ ID NO: 3617158 - RNA, 15 nt, Salmonella enterica enterica serovar Typhi
gcuguuucuggucau

SEQ ID NO: 3617159 - RNA, 16 nt, Salmonella enterica enterica serovar Typhi
gcuguuuuucaucauc

SEQ ID NO: 3617160 - RNA, 21 nt, Salmonella enterica enterica serovar Typhi
gcuguuuuucaucaucaucca

SEQ ID NO: 3617161 - RNA, 13 nt, Salmonella enterica enterica serovar Typhi
gcuuaaaaaaucc

SEQ ID NO: 3617162 - RNA, 15 nt, Salmonella enterica enterica serovar Typhi
gcuuaaaaaauccug

SEQ ID NO: 3617163 - RNA, 16 nt, Salmonella enterica enterica serovar Typhi
gcuuaaaagcggcaag

SEQ ID NO: 3617164 - RNA, 19 nt, Salmonella enterica enterica serovar Typhi
gcuuaaacaguauuuaugu

SEQ ID NO: 3617165 - RNA, 20 nt, Salmonella enterica enterica serovar Typhi
gcuuaaacauauacugcugu

SEQ ID NO: 3617166 - RNA, 19 nt, Salmonella enterica enterica serovar Typhi
gcuuaaaucgcggcgcuga

SEQ ID NO: 3617167 - RNA, 18 nt, Salmonella enterica enterica serovar Typhi
gcuuaacagaauugcgcc

SEQ ID NO: 3617168 - RNA, 19 nt, Salmonella enterica enterica serovar Typhi
gcuuaacgaugcggagaua

SEQ ID NO: 3617169 - RNA, 19 nt, Salmonella enterica enterica serovar Typhi
gcuuaacggcccaggcauc

SEQ ID NO: 3617170 - RNA, 19 nt, Salmonella enterica enterica serovar Typhi
gcuuaagcuuugcaccacu

SEQ ID NO: 3617171 - RNA, 21 nt, Salmonella enterica enterica serovar Typhi
gcuuaauaauaagcggccuau

SEQ ID NO: 3617172 - RNA, 21 nt, Salmonella enterica enterica serovar Typhi
gcuuaauacgcagaucuuuuu

SEQ ID NO: 3617173 - RNA, 22 nt, Salmonella enterica enterica serovar Typhi
gcuuaaugcccggcccgucauc

SEQ ID NO: 3617174 - RNA, 21 nt, Salmonella enterica enterica serovar Typhi
gcuuaaugcucugcugugcca

SEQ ID NO: 3617175 - RNA, 18 nt, Salmonella enterica enterica serovar Typhi
gcuuaauggcgucaauca

SEQ ID NO: 3617176 - RNA, 17 nt, Salmonella enterica enterica serovar Typhi
gcuuacaauuuaucugc

SEQ ID NO: 3617177 - RNA, 18 nt, Salmonella enterica enterica serovar Typhi
gcuuacacacccggccua

SEQ ID NO: 3617178 - RNA, 19 nt, Salmonella enterica enterica serovar Typhi
gcuuacacacccggccuau

SEQ ID NO: 3617179 - RNA, 16 nt, Salmonella enterica enterica serovar Typhi
gcuuacacagacugcu

SEQ ID NO: 3617180 - RNA, 13 nt, Salmonella enterica enterica serovar Typhi
gcuuaccagaccg

SEQ ID NO: 3617181 - RNA, 14 nt, Salmonella enterica enterica serovar Typhi
gcuuaccaggccua

SEQ ID NO: 3617182 - RNA, 17 nt, Salmonella enterica enterica serovar Typhi
gcuuaccgggccuacag

SEQ ID NO: 3617183 - RNA, 19 nt, Salmonella enterica enterica serovar Typhi
gcuuaccguaucccaccau

SEQ ID NO: 3617184 - RNA, 23 nt, Salmonella enterica enterica serovar Typhi
gcuuaccuuguucuuccauugcu

SEQ ID NO: 3617185 - RNA, 17 nt, Salmonella enterica enterica serovar Typhi
gcuuacgcggcgcgcuc

SEQ ID NO: 3617186 - RNA, 17 nt, Salmonella enterica enterica serovar Typhi
gcuuacggcaaacugaa

SEQ ID NO: 3617187 - RNA, 23 nt, Salmonella enterica enterica serovar Typhi
gcuuacggccauggaacauccuc

SEQ ID NO: 3617188 - RNA, 21 nt, Salmonella enterica enterica serovar Typhi
gcuuacuuuccaaaauccagg

SEQ ID NO: 3617189 - RNA, 22 nt, Salmonella enterica enterica serovar Typhi
gcuuagaacucacgcucaagau

SEQ ID NO: 3617190 - RNA, 12 nt, Salmonella enterica enterica serovar Typhi
gcuuagcuuccc

SEQ ID NO: 3617191 - RNA, 20 nt, Salmonella enterica enterica serovar Typhi
gcuuauagcuacguagcgca

SEQ ID NO: 3617192 - RNA, 14 nt, Salmonella enterica enterica serovar Typhi
gcuuaucaggccua

SEQ ID NO: 3617193 - RNA, 16 nt, Salmonella enterica enterica serovar Typhi
gcuuaucaggccuaca

SEQ ID NO: 3617194 - RNA, 17 nt, Salmonella enterica enterica serovar Typhi
gcuuaucaggccuacau

SEQ ID NO: 3617195 - RNA, 18 nt, Salmonella enterica enterica serovar Typhi
gcuuaucaggccuaccag

SEQ ID NO: 3617196 - RNA, 21 nt, Salmonella enterica enterica serovar Typhi
gcuuaucaguccccacauuac

SEQ ID NO: 3617197 - RNA, 22 nt, Salmonella enterica enterica serovar Typhi
gcuuauccccauucugcugaug

SEQ ID NO: 3617198 - RNA, 12 nt, Salmonella enterica enterica serovar Typhi
gcuuauccggcc

SEQ ID NO: 3617199 - RNA, 14 nt, Salmonella enterica enterica serovar Typhi
gcuuauccggccua

SEQ ID NO: 3617200 - RNA, 17 nt, Salmonella enterica enterica serovar Typhi
gcuuauccggccuacga

SEQ ID NO: 3617201 - RNA, 19 nt, Salmonella enterica enterica serovar Typhi
gcuuauccggccuacgcuu

SEQ ID NO: 3617202 - RNA, 17 nt, Salmonella enterica enterica serovar Typhi
gcuuauccggccuacgg

SEQ ID NO: 3617203 - RNA, 17 nt, Salmonella enterica enterica serovar Typhi
gcuuauccggccugcac

SEQ ID NO: 3617204 - RNA, 19 nt, Salmonella enterica enterica serovar Typhi
gcuugcccgauggcgcugc

SEQ ID NO: 3617205 - RNA, 14 nt, Salmonella enterica enterica serovar Typhi
gcuugcccggccgu

SEQ ID NO: 3617206 - RNA, 21 nt, Salmonella enterica enterica serovar Typhi
gcuugcccggccuacauucau

SEQ ID NO: 3617207 - RNA, 21 nt, Salmonella enterica enterica serovar Typhi
gcuugccgucgucauaagcaa

SEQ ID NO: 3617208 - RNA, 12 nt, Salmonella enterica enterica serovar Typhi
gcuugccugcuu

SEQ ID NO: 3617209 - RNA, 14 nt, Salmonella enterica enterica serovar Typhi
gcuugcgccgccau

SEQ ID NO: 3617210 - RNA, 22 nt, Salmonella enterica enterica serovar Typhi
gcuugcgccgccauccggccug

SEQ ID NO: 3617211 - RNA, 14 nt, Salmonella enterica enterica serovar Typhi
gcuugcggguuuug

SEQ ID NO: 3617212 - RNA, 16 nt, Salmonella enterica enterica serovar Typhi
gcuugcugcguaaaag

SEQ ID NO: 3617213 - RNA, 20 nt, Salmonella enterica enterica serovar Typhi
gcuuggccaguggggcugcu

SEQ ID NO: 3617214 - RNA, 17 nt, Salmonella enterica enterica serovar Typhi
gcuuguaaauugcgcca

SEQ ID NO: 3617215 - RNA, 14 nt, Salmonella enterica enterica serovar Typhi
gcuugucacgaagc

SEQ ID NO: 3617216 - RNA, 16 nt, Salmonella enterica enterica serovar Typhi
gcuugucauccugcuc

SEQ ID NO: 3617217 - RNA, 16 nt, Salmonella enterica enterica serovar Typhi
gcuugucgccaugcac

SEQ ID NO: 3617218 - RNA, 15 nt, Salmonella enterica enterica serovar Typhi
gcuuguuaucuggca

SEQ ID NO: 3617219 - RNA, 19 nt, Salmonella enterica enterica serovar Typhi
gcuuguuguuuauccugca

SEQ ID NO: 3617220 - RNA, 22 nt, Salmonella enterica enterica serovar Typhi
gcuuguuuacgcccucaucggc

SEQ ID NO: 3617221 - RNA, 18 nt, Salmonella enterica enterica serovar Typhi
gcuuguuucacuguagcu

SEQ ID NO: 3617222 - RNA, 16 nt, Salmonella enterica enterica serovar Typhi
gcuuuaaauucagcac

SEQ ID NO: 3617223 - RNA, 15 nt, Salmonella enterica enterica serovar Typhi
gcuuuaaucaccaug

SEQ ID NO: 3617224 - RNA, 23 nt, Salmonella enterica enterica serovar Typhi
gcuuuaaucacccgcgccagcag

SEQ ID NO: 3617225 - RNA, 20 nt, Salmonella enterica enterica serovar Typhi
gcuuuaaucaguucauagcc

SEQ ID NO: 3617226 - RNA, 19 nt, Salmonella enterica enterica serovar Typhi
gcuuuaaugcuuuccagcc

SEQ ID NO: 3617227 - RNA, 22 nt, Salmonella enterica enterica serovar Typhi
gcuuuacccgggccaucuuuuu

SEQ ID NO: 3617228 - RNA, 15 nt, Salmonella enterica enterica serovar Typhi
gcuuuaccgggccua

SEQ ID NO: 3617229 - RNA, 12 nt, Salmonella enterica enterica serovar Typhi
gcuuuagcuuua

SEQ ID NO: 3617230 - RNA, 15 nt, Salmonella enterica enterica serovar Typhi
gcuuuagggcuuccu

SEQ ID NO: 3617231 - RNA, 16 nt, Salmonella enterica enterica serovar Typhi
gcuuuaggguaucauu

SEQ ID NO: 3617232 - RNA, 13 nt, Salmonella enterica enterica serovar Typhi
gcuuuaugcacgc

SEQ ID NO: 3617233 - RNA, 22 nt, Salmonella enterica enterica serovar Typhi
gcuuuaugcagucgguagcuuu

SEQ ID NO: 3617234 - RNA, 17 nt, Salmonella enterica enterica serovar Typhi
gcuuuaugcgcuuccag

SEQ ID NO: 3617235 - RNA, 16 nt, Salmonella enterica enterica serovar Typhi
gcuuuauuuuacaacu

SEQ ID NO: 3617236 - RNA, 16 nt, Salmonella enterica enterica serovar Typhi
gcuuucaauaaaucaa

SEQ ID NO: 3617237 - RNA, 18 nt, Salmonella enterica enterica serovar Typhi
gcuuucacaccguuaucc

SEQ ID NO: 3617238 - RNA, 18 nt, Salmonella enterica enterica serovar Typhi
gcuuucacgccauuggca

SEQ ID NO: 3617239 - RNA, 17 nt, Salmonella enterica enterica serovar Typhi
gcuuucagauuagccag

SEQ ID NO: 3617240 - RNA, 19 nt, Salmonella enterica enterica serovar Typhi
gcuuucaguaauaauauaa

SEQ ID NO: 3617241 - RNA, 22 nt, Salmonella enterica enterica serovar Typhi
gcuuucaucauaucuucccgau

SEQ ID NO: 3617242 - RNA, 21 nt, Salmonella enterica enterica serovar Typhi
gcuuucauccaauaacguaac

SEQ ID NO: 3617243 - RNA, 22 nt, Salmonella enterica enterica serovar Typhi
gcuuucccguuucagccccuug

SEQ ID NO: 3617244 - RNA, 15 nt, Salmonella enterica enterica serovar Typhi
gcuuucccuucagau

SEQ ID NO: 3617245 - RNA, 19 nt, Salmonella enterica enterica serovar Typhi
gcuuuccggcgcuuccugc

SEQ ID NO: 3617246 - RNA, 22 nt, Salmonella enterica enterica serovar Typhi
gcuuuccggcgcuuccugcagu

SEQ ID NO: 3617247 - RNA, 14 nt, Salmonella enterica enterica serovar Typhi
gcuuuccgggguga

SEQ ID NO: 3617248 - RNA, 20 nt, Salmonella enterica enterica serovar Typhi
gcuuucgauaaucugacgcg

SEQ ID NO: 3617249 - RNA, 22 nt, Salmonella enterica enterica serovar Typhi
gcuuucggucguuugccgugca

SEQ ID NO: 3617250 - RNA, 20 nt, Salmonella enterica enterica serovar Typhi
gcuuucugaauuucacgcuu

SEQ ID NO: 3617251 - RNA, 15 nt, Salmonella enterica enterica serovar Typhi
gcuuucugagccgcc

SEQ ID NO: 3617252 - RNA, 14 nt, Salmonella enterica enterica serovar Typhi
gcuuucuguugaua

SEQ ID NO: 3617253 - RNA, 19 nt, Salmonella enterica enterica serovar Typhi
gcuuucuguugauacagua

SEQ ID NO: 3617254 - RNA, 23 nt, Salmonella enterica enterica serovar Typhi
gcuuucuuccagguuaacccaca

SEQ ID NO: 3617255 - RNA, 23 nt, Salmonella enterica enterica serovar Typhi
gcuuucuucccuccccugcgccu

SEQ ID NO: 3617256 - RNA, 14 nt, Salmonella enterica enterica serovar Typhi
gcuuucuucguuag

SEQ ID NO: 3617257 - RNA, 10 nt, Salmonella enterica enterica serovar Typhi
gcuuucuucu

SEQ ID NO: 3617258 - RNA, 11 nt, Salmonella enterica enterica serovar Typhi
gcuuugagcgu

SEQ ID NO: 3617259 - RNA, 19 nt, Salmonella enterica enterica serovar Typhi
gcuuugauauagggcuuga

SEQ ID NO: 3617260 - RNA, 19 nt, Salmonella enterica enterica serovar Typhi
gcuuugcaauguucaauau

SEQ ID NO: 3617261 - RNA, 17 nt, Salmonella enterica enterica serovar Typhi
gcuuugccgccaucaug

SEQ ID NO: 3617262 - RNA, 15 nt, Salmonella enterica enterica serovar Typhi
gcuuugcgccacuuc

SEQ ID NO: 3617263 - RNA, 16 nt, Salmonella enterica enterica serovar Typhi
gcuuugcgccggcagu

SEQ ID NO: 3617264 - RNA, 17 nt, Salmonella enterica enterica serovar Typhi
gcuuugcguaaaaaaca

SEQ ID NO: 3617265 - RNA, 19 nt, Salmonella enterica enterica serovar Typhi
gcuuuguuuccacugagcu

SEQ ID NO: 3617266 - RNA, 18 nt, Salmonella enterica enterica serovar Typhi
gcuuuguuuuccagauuc

SEQ ID NO: 3617267 - RNA, 19 nt, Salmonella enterica enterica serovar Typhi
gcuuuuaguuacgcacgcc

SEQ ID NO: 3617268 - RNA, 21 nt, Salmonella enterica enterica serovar Typhi
gcuuuuaguuguacaaacugu

SEQ ID NO: 3617269 - RNA, 23 nt, Salmonella enterica enterica serovar Typhi
gcuuuuaucggcgucgcggcaau

SEQ ID NO: 3617270 - RNA, 20 nt, Salmonella enterica enterica serovar Typhi
gcuuuuauguuacccagccu

SEQ ID NO: 3617271 - RNA, 14 nt, Salmonella enterica enterica serovar Typhi
gcuuuucauuuguu

SEQ ID NO: 3617272 - RNA, 18 nt, Salmonella enterica enterica serovar Typhi
gcuuuuccuguucuggcu

SEQ ID NO: 3617273 - RNA, 23 nt, Salmonella enterica enterica serovar Typhi
gcuuuucgcuuaaacauauacug

SEQ ID NO: 3617274 - RNA, 21 nt, Salmonella enterica enterica serovar Typhi
gcuuuugaauuugaaggacug

SEQ ID NO: 3617275 - RNA, 22 nt, Salmonella enterica enterica serovar Typhi
gcuuuugccgcgcccagcgccg

SEQ ID NO: 3617276 - RNA, 22 nt, Salmonella enterica enterica serovar Typhi
gcuuuuucauucugcuuaccag

SEQ ID NO: 3617277 - RNA, 15 nt, Salmonella enterica enterica serovar Typhi
gcuuuuuccagcauu

SEQ ID NO: 3617278 - RNA, 15 nt, Salmonella enterica enterica serovar Typhi
gcuuuuugccgggcg

SEQ ID NO: 3617279 - RNA, 14 nt, Salmonella enterica enterica serovar Typhi
gcuuuuuuaucuau

SEQ ID NO: 3617280 - RNA, 17 nt, Salmonella enterica enterica serovar Typhi
gcuuuuuuauuguuucu

SEQ ID NO: 3617281 - RNA, 15 nt, Salmonella enterica enterica serovar Typhi
gcuuuuuucaccuuu

SEQ ID NO: 3617282 - RNA, 15 nt, Salmonella enterica enterica serovar Typhi
gcuuuuuucucugcu

SEQ ID NO: 3617283 - RNA, 13 nt, Salmonella enterica enterica serovar Typhi
ggaaaaaaagaau

SEQ ID NO: 3617284 - RNA, 23 nt, Salmonella enterica enterica serovar Typhi
ggaaaaaagcgcccagcgccgga

SEQ ID NO: 3617285 - RNA, 20 nt, Salmonella enterica enterica serovar Typhi
ggaaaaaauacugauaaaaa

SEQ ID NO: 3617286 - RNA, 16 nt, Salmonella enterica enterica serovar Typhi
ggaaaaccccaucccg

SEQ ID NO: 3617287 - RNA, 23 nt, Salmonella enterica enterica serovar Typhi
ggaaaaccuuaccgucagccacu

SEQ ID NO: 3617288 - RNA, 13 nt, Salmonella enterica enterica serovar Typhi
ggaaaacgcgcug

SEQ ID NO: 3617289 - RNA, 13 nt, Salmonella enterica enterica serovar Typhi
ggacauaaacgcc

SEQ ID NO: 3617290 - RNA, 17 nt, Salmonella enterica enterica serovar Typhi
ggacauauuccagaagc

SEQ ID NO: 3617291 - RNA, 14 nt, Salmonella enterica enterica serovar Typhi
ggacaucaaaggca

SEQ ID NO: 3617292 - RNA, 12 nt, Salmonella enterica enterica serovar Typhi
ggacaucgccau

SEQ ID NO: 3617293 - RNA, 23 nt, Salmonella enterica enterica serovar Typhi
ggacauggucaccaugacgcagg

SEQ ID NO: 3617294 - RNA, 18 nt, Salmonella enterica enterica serovar Typhi
ggaccaugauaucgccaa

SEQ ID NO: 3617295 - RNA, 20 nt, Salmonella enterica enterica serovar Typhi
ggaccggcaaucgccugcaa

SEQ ID NO: 3617296 - RNA, 12 nt, Salmonella enterica enterica serovar Typhi
ggaccguacuca

SEQ ID NO: 3617297 - RNA, 19 nt, Salmonella enterica enterica serovar Typhi
ggaccguguucaugcagcc

SEQ ID NO: 3617298 - RNA, 23 nt, Salmonella enterica enterica serovar Typhi
ggaccuguguauucugcgccagc

SEQ ID NO: 3617299 - RNA, 22 nt, Salmonella enterica enterica serovar Typhi
ggacgaacaacaucagacagua

SEQ ID NO: 3617300 - RNA, 21 nt, Salmonella enterica enterica serovar Typhi
ggacgaaugcgaaaaguaaag

SEQ ID NO: 3617301 - RNA, 19 nt, Salmonella enterica enterica serovar Typhi
ggacgcaagagcguccagu

SEQ ID NO: 3617302 - RNA, 13 nt, Salmonella enterica enterica serovar Typhi
ggacgcacccugu

SEQ ID NO: 3617303 - RNA, 18 nt, Salmonella enterica enterica serovar Typhi
ggacgcagaccaaaguca

SEQ ID NO: 3617304 - RNA, 15 nt, Salmonella enterica enterica serovar Typhi
ggacgcaucaucuca

SEQ ID NO: 3617305 - RNA, 15 nt, Salmonella enterica enterica serovar Typhi
ggacgccaccacgcc

SEQ ID NO: 3617306 - RNA, 18 nt, Salmonella enterica enterica serovar Typhi
ggacgcugacgccaggcc

SEQ ID NO: 3617307 - RNA, 13 nt, Salmonella enterica enterica serovar Typhi
ggacggcaucagg

SEQ ID NO: 3617308 - RNA, 21 nt, Salmonella enterica enterica serovar Typhi
ggacggcuaauaugccaggcu

SEQ ID NO: 3617309 - RNA, 20 nt, Salmonella enterica enterica serovar Typhi
ggacggguauuacugauaaa

SEQ ID NO: 3617310 - RNA, 17 nt, Salmonella enterica enterica serovar Typhi
ggacuauaggcaaugau

SEQ ID NO: 3617311 - RNA, 17 nt, Salmonella enterica enterica serovar Typhi
ggacuaucgaaagagca

SEQ ID NO: 3617312 - RNA, 21 nt, Salmonella enterica enterica serovar Typhi
ggacucaccguuacaaauagc

SEQ ID NO: 3617313 - RNA, 22 nt, Salmonella enterica enterica serovar Typhi
ggacucaucgguuaacacauau

SEQ ID NO: 3617314 - RNA, 15 nt, Salmonella enterica enterica serovar Typhi
ggacucccaggugug

SEQ ID NO: 3617315 - RNA, 16 nt, Salmonella enterica enterica serovar Typhi
ggacucgccuuucucc

SEQ ID NO: 3617316 - RNA, 23 nt, Salmonella enterica enterica serovar Typhi
ggacugacugagccacugcugaa

SEQ ID NO: 3617317 - RNA, 13 nt, Salmonella enterica enterica serovar Typhi
ggacugauacagc

SEQ ID NO: 3617318 - RNA, 13 nt, Salmonella enterica enterica serovar Typhi
ggacugccuaacu

SEQ ID NO: 3617319 - RNA, 16 nt, Salmonella enterica enterica serovar Typhi
ggacugcggccugcaa

SEQ ID NO: 3617320 - RNA, 21 nt, Salmonella enterica enterica serovar Typhi
ggacuggagguacauugccag

SEQ ID NO: 3617321 - RNA, 14 nt, Salmonella enterica enterica serovar Typhi
ggagaaaacgcggc

SEQ ID NO: 3617322 - RNA, 14 nt, Salmonella enterica enterica serovar Typhi
ggagaacggcacaa

SEQ ID NO: 3617323 - RNA, 21 nt, Salmonella enterica enterica serovar Typhi
ggagacggccacccaucccca

SEQ ID NO: 3617324 - RNA, 13 nt, Salmonella enterica enterica serovar Typhi
ggagagcaguccu

SEQ ID NO: 3617325 - RNA, 21 nt, Salmonella enterica enterica serovar Typhi
ggagagcggauaauccgccac

SEQ ID NO: 3617326 - RNA, 18 nt, Salmonella enterica enterica serovar Typhi
ggagaggcguucaugccu

SEQ ID NO: 3617327 - RNA, 22 nt, Salmonella enterica enterica serovar Typhi
ggagagguuagcgcagggggga

SEQ ID NO: 3617328 - RNA, 13 nt, Salmonella enterica enterica serovar Typhi
ggagaucagcaug

SEQ ID NO: 3617329 - RNA, 17 nt, Salmonella enterica enterica serovar Typhi
ggagauuaacagcgcga

SEQ ID NO: 3617330 - RNA, 17 nt, Salmonella enterica enterica serovar Typhi
ggagauuucauccucuu

SEQ ID NO: 3617331 - RNA, 18 nt, Salmonella enterica enterica serovar Typhi
ggagcagacuguaaaucu

SEQ ID NO: 3617332 - RNA, 19 nt, Salmonella enterica enterica serovar Typhi
ggagcagacuguaaaucug

SEQ ID NO: 3617333 - RNA, 21 nt, Salmonella enterica enterica serovar Typhi
ggagcauagauaacuauguga

SEQ ID NO: 3617334 - RNA, 21 nt, Salmonella enterica enterica serovar Typhi
ggagccaguuuucgacauauu

SEQ ID NO: 3617335 - RNA, 13 nt, Salmonella enterica enterica serovar Typhi
ggagcccaguagc

SEQ ID NO: 3617336 - RNA, 23 nt, Salmonella enterica enterica serovar Typhi
ggagccucugcgggacgcaucau

SEQ ID NO: 3617337 - RNA, 19 nt, Salmonella enterica enterica serovar Typhi
ggagccucuucuggcuccc

SEQ ID NO: 3617338 - RNA, 22 nt, Salmonella enterica enterica serovar Typhi
ggagcgaagaauucgcaaugug

SEQ ID NO: 3617339 - RNA, 14 nt, Salmonella enterica enterica serovar Typhi
ggagcgcuucgcuu

SEQ ID NO: 3617340 - RNA, 22 nt, Salmonella enterica enterica serovar Typhi
ggagcgugcucauuugcggcgu

SEQ ID NO: 3617341 - RNA, 19 nt, Salmonella enterica enterica serovar Typhi
ggagcugacugcaaaucug

SEQ ID NO: 3617342 - RNA, 16 nt, Salmonella enterica enterica serovar Typhi
ggaggccugaauaaug

SEQ ID NO: 3617343 - RNA, 23 nt, Salmonella enterica enterica serovar Typhi
ggaggcgugagcgaacaggucgc

SEQ ID NO: 3617344 - RNA, 19 nt, Salmonella enterica enterica serovar Typhi
ggagggguuuucgccagca

SEQ ID NO: 3617345 - RNA, 19 nt, Salmonella enterica enterica serovar Typhi
ggagguauccuccugccag

SEQ ID NO: 3617346 - RNA, 23 nt, Salmonella enterica enterica serovar Typhi
ggagguauccuccugccaggcgc

SEQ ID NO: 3617347 - RNA, 14 nt, Salmonella enterica enterica serovar Typhi
ggaggugcucuccc

SEQ ID NO: 3617348 - RNA, 23 nt, Salmonella enterica enterica serovar Typhi
ggaggugcugguggugggcggca

SEQ ID NO: 3617349 - RNA, 23 nt, Salmonella enterica enterica serovar Typhi
ggaguaguguaauaccacugccc

SEQ ID NO: 3617350 - RNA, 22 nt, Salmonella enterica enterica serovar Typhi
ggaguauuuaccuacuguggug

SEQ ID NO: 3617351 - RNA, 19 nt, Salmonella enterica enterica serovar Typhi
ggaguccagcaacugcgcg

SEQ ID NO: 3617352 - RNA, 16 nt, Salmonella enterica enterica serovar Typhi
ggaguggcgaaauugg

SEQ ID NO: 3617353 - RNA, 15 nt, Salmonella enterica enterica serovar Typhi
ggauaaaaucgccaa

SEQ ID NO: 3617354 - RNA, 16 nt, Salmonella enterica enterica serovar Typhi
ggauaaacaccggaau

SEQ ID NO: 3617355 - RNA, 22 nt, Salmonella enterica enterica serovar Typhi
ggauaaauagugacgccgccau

SEQ ID NO: 3617356 - RNA, 20 nt, Salmonella enterica enterica serovar Typhi
ggauaacauguggcuggggc

SEQ ID NO: 3617357 - RNA, 15 nt, Salmonella enterica enterica serovar Typhi
ggauaacggcgcaaa

SEQ ID NO: 3617358 - RNA, 19 nt, Salmonella enterica enterica serovar Typhi
ggauaacggcgcaaagaca

SEQ ID NO: 3617359 - RNA, 22 nt, Salmonella enterica enterica serovar Typhi
ggauaacggcgcgaaagcgccu

SEQ ID NO: 3617360 - RNA, 17 nt, Salmonella enterica enterica serovar Typhi
ggauaacguucuuuuga

SEQ ID NO: 3617361 - RNA, 20 nt, Salmonella enterica enterica serovar Typhi
ggauaagauagcaggcgauu

SEQ ID NO: 3617362 - RNA, 19 nt, Salmonella enterica enterica serovar Typhi
ggauaagcauuagcgccau

SEQ ID NO: 3617363 - RNA, 19 nt, Salmonella enterica enterica serovar Typhi
ggauaagcccggcggaggc

SEQ ID NO: 3617364 - RNA, 21 nt, Salmonella enterica enterica serovar Typhi
ggauaagcgaugcgcggaugc

SEQ ID NO: 3617365 - RNA, 17 nt, Salmonella enterica enterica serovar Typhi
ggauaagcgcagcgcca

SEQ ID NO: 3617366 - RNA, 14 nt, Salmonella enterica enterica serovar Typhi
ggauaagcggcagc

SEQ ID NO: 3617367 - RNA, 19 nt, Salmonella enterica enterica serovar Typhi
ggauaagcggcagcgccau

SEQ ID NO: 3617368 - RNA, 18 nt, Salmonella enterica enterica serovar Typhi
ggauaagcguagcgccau

SEQ ID NO: 3617369 - RNA, 17 nt, Salmonella enterica enterica serovar Typhi
ggauaagcgugcgccau

SEQ ID NO: 3617370 - RNA, 23 nt, Salmonella enterica enterica serovar Typhi
ggauaaggcauuuaugccgccau

SEQ ID NO: 3617371 - RNA, 14 nt, Salmonella enterica enterica serovar Typhi
ggauaaggcgcagc

SEQ ID NO: 3617372 - RNA, 20 nt, Salmonella enterica enterica serovar Typhi
ggauaaggcgcagccgccau

SEQ ID NO: 3617373 - RNA, 20 nt, Salmonella enterica enterica serovar Typhi
ggauaaggcgcuagccgcau

SEQ ID NO: 3617374 - RNA, 16 nt, Salmonella enterica enterica serovar Typhi
ggauugauauccagcu

SEQ ID NO: 3617375 - RNA, 21 nt, Salmonella enterica enterica serovar Typhi
ggauuggauaaaucggucauu

SEQ ID NO: 3617376 - RNA, 14 nt, Salmonella enterica enterica serovar Typhi
ggauuggucugauu

SEQ ID NO: 3617377 - RNA, 15 nt, Salmonella enterica enterica serovar Typhi
ggauuguuuuuuagc

SEQ ID NO: 3617378 - RNA, 20 nt, Salmonella enterica enterica serovar Typhi
ggauuuaaaccgccccgacu

SEQ ID NO: 3617379 - RNA, 11 nt, Salmonella enterica enterica serovar Typhi
ggauuuuaaau

SEQ ID NO: 3617380 - RNA, 21 nt, Salmonella enterica enterica serovar Typhi
ggcaaaacgccgcagaaaaug

SEQ ID NO: 3617381 - RNA, 23 nt, Salmonella enterica enterica serovar Typhi
ggcaaacacaaucacgcccagcg

SEQ ID NO: 3617382 - RNA, 18 nt, Salmonella enterica enterica serovar Typhi
ggcaaaccauguacccuc

SEQ ID NO: 3617383 - RNA, 15 nt, Salmonella enterica enterica serovar Typhi
ggcaaaccccugcuc

SEQ ID NO: 3617384 - RNA, 17 nt, Salmonella enterica enterica serovar Typhi
ggcaaacggcgccagcu

SEQ ID NO: 3617385 - RNA, 20 nt, Salmonella enterica enterica serovar Typhi
ggcaaacggcgccagcucau

SEQ ID NO: 3617386 - RNA, 18 nt, Salmonella enterica enterica serovar Typhi
ggcaaacgguuaauacug

SEQ ID NO: 3617387 - RNA, 11 nt, Salmonella enterica enterica serovar Typhi
ggcaaagaccg

SEQ ID NO: 3617388 - RNA, 22 nt, Salmonella enterica enterica serovar Typhi
ggcaaagcucaacgcaggcugg

SEQ ID NO: 3617389 - RNA, 16 nt, Salmonella enterica enterica serovar Typhi
ggcaaaggaaugcuuu

SEQ ID NO: 3617390 - RNA, 11 nt, Salmonella enterica enterica serovar Typhi
ggcaaagguug

SEQ ID NO: 3617391 - RNA, 12 nt, Salmonella enterica enterica serovar Typhi
ggcaaauaccgu

SEQ ID NO: 3617392 - RNA, 18 nt, Salmonella enterica enterica serovar Typhi
ggcaaauucuuuucacgc

SEQ ID NO: 3617393 - RNA, 12 nt, Salmonella enterica enterica serovar Typhi
ggcaacagccau

SEQ ID NO: 3617394 - RNA, 23 nt, Salmonella enterica enterica serovar Typhi
ggcaacagccauuuuaaaaauau

SEQ ID NO: 3617395 - RNA, 14 nt, Salmonella enterica enterica serovar Typhi
ggcaacauaaauaa

SEQ ID NO: 3617396 - RNA, 19 nt, Salmonella enterica enterica serovar Typhi
ggcaacauggacaccggaa

SEQ ID NO: 3617397 - RNA, 16 nt, Salmonella enterica enterica serovar Typhi
ggcaaccaccagcagu

SEQ ID NO: 3617398 - RNA, 17 nt, Salmonella enterica enterica serovar Typhi
ggcaacccgcuccagaa

SEQ ID NO: 3617399 - RNA, 18 nt, Salmonella enterica enterica serovar Typhi
ggcaacgacccgaagggc

SEQ ID NO: 3617400 - RNA, 13 nt, Salmonella enterica enterica serovar Typhi
ggcaacgccagag

SEQ ID NO: 3617401 - RNA, 20 nt, Salmonella enterica enterica serovar Typhi
ggcaacgccagagcgucuca

SEQ ID NO: 3617402 - RNA, 16 nt, Salmonella enterica enterica serovar Typhi
ggcaacgccgccagcu

SEQ ID NO: 3617403 - RNA, 19 nt, Salmonella enterica enterica serovar Typhi
ggcaacggccagcgcaggc

SEQ ID NO: 3617404 - RNA, 20 nt, Salmonella enterica enterica serovar Typhi
ggcaacggccagcgcaggcu

SEQ ID NO: 3617405 - RNA, 17 nt, Salmonella enterica enterica serovar Typhi
ggcaagaauuucaauca

SEQ ID NO: 3617406 - RNA, 22 nt, Salmonella enterica enterica serovar Typhi
ggcaagagauucaggccgccag

SEQ ID NO: 3617407 - RNA, 17 nt, Salmonella enterica enterica serovar Typhi
ggcaagaugcccgucgg

SEQ ID NO: 3617408 - RNA, 19 nt, Salmonella enterica enterica serovar Typhi
ggcaagauuaaccagcagu

SEQ ID NO: 3617409 - RNA, 13 nt, Salmonella enterica enterica serovar Typhi
ggcaagccagcau

SEQ ID NO: 3617410 - RNA, 19 nt, Salmonella enterica enterica serovar Typhi
ggcaagccgaucagcgugu

SEQ ID NO: 3617411 - RNA, 15 nt, Salmonella enterica enterica serovar Typhi
ggcaagcgaagcgcu

SEQ ID NO: 3617412 - RNA, 19 nt, Salmonella enterica enterica serovar Typhi
ggcaaguucuuguuucauc

SEQ ID NO: 3617413 - RNA, 12 nt, Salmonella enterica enterica serovar Typhi
ggcaauaaacuc

SEQ ID NO: 3617414 - RNA, 14 nt, Salmonella enterica enterica serovar Typhi
ggcaauaaaguuua

SEQ ID NO: 3617415 - RNA, 14 nt, Salmonella enterica enterica serovar Typhi
ggcaauagaccagc

SEQ ID NO: 3617416 - RNA, 23 nt, Salmonella enterica enterica serovar Typhi
ggcaauagaccagcggcccgcgc

SEQ ID NO: 3617417 - RNA, 18 nt, Salmonella enterica enterica serovar Typhi
ggcaauagccuuuaucgg

SEQ ID NO: 3617418 - RNA, 14 nt, Salmonella enterica enterica serovar Typhi
ggcaauaucaugaa

SEQ ID NO: 3617419 - RNA, 21 nt, Salmonella enterica enterica serovar Typhi
ggcaauauccuccggcguaaa

SEQ ID NO: 3617420 - RNA, 19 nt, Salmonella enterica enterica serovar Typhi
ggcaauaugcuguuuaugg

SEQ ID NO: 3617421 - RNA, 13 nt, Salmonella enterica enterica serovar Typhi
ggcaauauguuua

SEQ ID NO: 3617422 - RNA, 15 nt, Salmonella enterica enterica serovar Typhi
ggcaauauguuuaaa

SEQ ID NO: 3617423 - RNA, 12 nt, Salmonella enterica enterica serovar Typhi
ggcaaucaguac

SEQ ID NO: 3617424 - RNA, 18 nt, Salmonella enterica enterica serovar Typhi
ggcaauccauuaauggcg

SEQ ID NO: 3617425 - RNA, 22 nt, Salmonella enterica enterica serovar Typhi
ggcaaucgacguugaucgccau

SEQ ID NO: 3617426 - RNA, 20 nt, Salmonella enterica enterica serovar Typhi
ggcaaucgcuuccagcgccg

SEQ ID NO: 3617427 - RNA, 15 nt, Salmonella enterica enterica serovar Typhi
ggcaaucuuuaacgc

SEQ ID NO: 3617428 - RNA, 17 nt, Salmonella enterica enterica serovar Typhi
ggcaaugacgguaagca

SEQ ID NO: 3617429 - RNA, 15 nt, Salmonella enterica enterica serovar Typhi
ggcaaugaucagcga

SEQ ID NO: 3617430 - RNA, 20 nt, Salmonella enterica enterica serovar Typhi
ggcaaugaugguagacaggc

SEQ ID NO: 3617431 - RNA, 19 nt, Salmonella enterica enterica serovar Typhi
ggcaaugcccccucggcag

SEQ ID NO: 3617432 - RNA, 13 nt, Salmonella enterica enterica serovar Typhi
ggcaauuaacauu

SEQ ID NO: 3617433 - RNA, 23 nt, Salmonella enterica enterica serovar Typhi
ggcaauucaaucacuugaagccu

SEQ ID NO: 3617434 - RNA, 21 nt, Salmonella enterica enterica serovar Typhi
ggcaauucgcguucagaaaug

SEQ ID NO: 3617435 - RNA, 16 nt, Salmonella enterica enterica serovar Typhi
ggcaauuucucgcucg

SEQ ID NO: 3617436 - RNA, 22 nt, Salmonella enterica enterica serovar Typhi
ggcaauuugacuacaaagcugg

SEQ ID NO: 3617437 - RNA, 21 nt, Salmonella enterica enterica serovar Typhi
ggcaauuuuuacaaauuuaaa

SEQ ID NO: 3617438 - RNA, 14 nt, Salmonella enterica enterica serovar Typhi
ggcacaaccuggcu

SEQ ID NO: 3617439 - RNA, 19 nt, Salmonella enterica enterica serovar Typhi
ggcacaaccuggcuugccg

SEQ ID NO: 3617440 - RNA, 21 nt, Salmonella enterica enterica serovar Typhi
ggcacaaccuggcuugccggg

SEQ ID NO: 3617441 - RNA, 17 nt, Salmonella enterica enterica serovar Typhi
ggcacaacggccagcaa

SEQ ID NO: 3617442 - RNA, 14 nt, Salmonella enterica enterica serovar Typhi
ggcacaauagcgcu

SEQ ID NO: 3617443 - RNA, 14 nt, Salmonella enterica enterica serovar Typhi
ggcacacaggccgc

SEQ ID NO: 3617444 - RNA, 19 nt, Salmonella enterica enterica serovar Typhi
ggcaccacgaccagacugg

SEQ ID NO: 3617445 - RNA, 12 nt, Salmonella enterica enterica serovar Typhi
ggcaccacguca

SEQ ID NO: 3617446 - RNA, 12 nt, Salmonella enterica enterica serovar Typhi
ggcaccagcgua

SEQ ID NO: 3617447 - RNA, 22 nt, Salmonella enterica enterica serovar Typhi
ggcaccauaauuuccguagcga

SEQ ID NO: 3617448 - RNA, 15 nt, Salmonella enterica enterica serovar Typhi
ggcaccgguuuuuga

SEQ ID NO: 3617449 - RNA, 15 nt, Salmonella enterica enterica serovar Typhi
ggcaccucguccaga

SEQ ID NO: 3617450 - RNA, 23 nt, Salmonella enterica enterica serovar Typhi
ggcacgcuccugcuccugcggcg

SEQ ID NO: 3617451 - RNA, 22 nt, Salmonella enterica enterica serovar Typhi
ggcacucaccucuuccgccagg

SEQ ID NO: 3617452 - RNA, 20 nt, Salmonella enterica enterica serovar Typhi
ggcacugacucuuccgggcg

SEQ ID NO: 3617453 - RNA, 14 nt, Salmonella enterica enterica serovar Typhi
ggcacugcaggcgg

SEQ ID NO: 3617454 - RNA, 23 nt, Salmonella enterica enterica serovar Typhi
ggcacugcgcuuauccggccuac

SEQ ID NO: 3617455 - RNA, 23 nt, Salmonella enterica enterica serovar Typhi
ggcacuuuccgguuuccauggca

SEQ ID NO: 3617456 - RNA, 21 nt, Salmonella enterica enterica serovar Typhi
ggcagaaaaaguagaaaaggu

SEQ ID NO: 3617457 - RNA, 18 nt, Salmonella enterica enterica serovar Typhi
ggcagaaaaaucagcauu

SEQ ID NO: 3617458 - RNA, 10 nt, Salmonella enterica enterica serovar Typhi
ggcagaaccu

SEQ ID NO: 3617459 - RNA, 11 nt, Salmonella enterica enterica serovar Typhi
ggcagaauaaa

SEQ ID NO: 3617460 - RNA, 21 nt, Salmonella enterica enterica serovar Typhi
ggccaagcgccuguucaacau

SEQ ID NO: 3617461 - RNA, 21 nt, Salmonella enterica enterica serovar Typhi
ggccaauccagcuacuggcca

SEQ ID NO: 3617462 - RNA, 22 nt, Salmonella enterica enterica serovar Typhi
ggccaaugccgccuuuaucgac

SEQ ID NO: 3617463 - RNA, 22 nt, Salmonella enterica enterica serovar Typhi
ggccaauggcucaacuccgccg

SEQ ID NO: 3617464 - RNA, 19 nt, Salmonella enterica enterica serovar Typhi
ggccacaauugccagcagg

SEQ ID NO: 3617465 - RNA, 14 nt, Salmonella enterica enterica serovar Typhi
ggccacagcgccag

SEQ ID NO: 3617466 - RNA, 18 nt, Salmonella enterica enterica serovar Typhi
ggccacagcgccagacac

SEQ ID NO: 3617467 - RNA, 14 nt, Salmonella enterica enterica serovar Typhi
ggccaccagcgcca

SEQ ID NO: 3617468 - RNA, 15 nt, Salmonella enterica enterica serovar Typhi
ggccaccagcgccag

SEQ ID NO: 3617469 - RNA, 23 nt, Salmonella enterica enterica serovar Typhi
ggccagauagcgcagcacgguaa

SEQ ID NO: 3617470 - RNA, 18 nt, Salmonella enterica enterica serovar Typhi
ggccagauaguggcugag

SEQ ID NO: 3617471 - RNA, 15 nt, Salmonella enterica enterica serovar Typhi
ggccagauggcaaac

SEQ ID NO: 3617472 - RNA, 14 nt, Salmonella enterica enterica serovar Typhi
ggccagauucuuag

SEQ ID NO: 3617473 - RNA, 19 nt, Salmonella enterica enterica serovar Typhi
ggccagcgaaaaccagcgc

SEQ ID NO: 3617474 - RNA, 20 nt, Salmonella enterica enterica serovar Typhi
ggccagcgaaaaccagcgcc

SEQ ID NO: 3617475 - RNA, 16 nt, Salmonella enterica enterica serovar Typhi
ggccagcgcaggcugg

SEQ ID NO: 3617476 - RNA, 20 nt, Salmonella enterica enterica serovar Typhi
ggccagcguggaugaacuca

SEQ ID NO: 3617477 - RNA, 16 nt, Salmonella enterica enterica serovar Typhi
ggccagcuacaccugg

SEQ ID NO: 3617478 - RNA, 16 nt, Salmonella enterica enterica serovar Typhi
ggccaggcacguuaaa

SEQ ID NO: 3617479 - RNA, 21 nt, Salmonella enterica enterica serovar Typhi
ggccaggcacguuaaacaccu

SEQ ID NO: 3617480 - RNA, 16 nt, Salmonella enterica enterica serovar Typhi
ggccaggcauccggcc

SEQ ID NO: 3617481 - RNA, 16 nt, Salmonella enterica enterica serovar Typhi
ggccaggcauugauaa

SEQ ID NO: 3617482 - RNA, 16 nt, Salmonella enterica enterica serovar Typhi
ggccaguagcgggggc

SEQ ID NO: 3617483 - RNA, 21 nt, Salmonella enterica enterica serovar Typhi
ggccaguagcgggggccggcu

SEQ ID NO: 3617484 - RNA, 20 nt, Salmonella enterica enterica serovar Typhi
ggccaguaucgcgccgccaa

SEQ ID NO: 3617485 - RNA, 15 nt, Salmonella enterica enterica serovar Typhi
ggccagucgacagac

SEQ ID NO: 3617486 - RNA, 14 nt, Salmonella enterica enterica serovar Typhi
ggccaguuuccuga

SEQ ID NO: 3617487 - RNA, 12 nt, Salmonella enterica enterica serovar Typhi
ggccaucaacuu

SEQ ID NO: 3617488 - RNA, 21 nt, Salmonella enterica enterica serovar Typhi
ggccaucaacuucucgcaggc

SEQ ID NO: 3617489 - RNA, 22 nt, Salmonella enterica enterica serovar Typhi
ggccaucgccgcagagaauaac

SEQ ID NO: 3617490 - RNA, 17 nt, Salmonella enterica enterica serovar Typhi
ggccaucuuccagcauc

SEQ ID NO: 3617491 - RNA, 23 nt, Salmonella enterica enterica serovar Typhi
ggccaugauccugguccggcagg

SEQ ID NO: 3617492 - RNA, 17 nt, Salmonella enterica enterica serovar Typhi
ggccauuaacacacaau

SEQ ID NO: 3617493 - RNA, 19 nt, Salmonella enterica enterica serovar Typhi
ggccauuaagcuucgugag

SEQ ID NO: 3617494 - RNA, 15 nt, Salmonella enterica enterica serovar Typhi
ggccauuaccgcccu

SEQ ID NO: 3617495 - RNA, 17 nt, Salmonella enterica enterica serovar Typhi
ggccauugaagucccuu

SEQ ID NO: 3617496 - RNA, 15 nt, Salmonella enterica enterica serovar Typhi
ggccauuugucucuu

SEQ ID NO: 3617497 - RNA, 16 nt, Salmonella enterica enterica serovar Typhi
ggcccacgcgcagaga

SEQ ID NO: 3617498 - RNA, 17 nt, Salmonella enterica enterica serovar Typhi
ggcccagcgcgguggcg

SEQ ID NO: 3617499 - RNA, 20 nt, Salmonella enterica enterica serovar Typhi
ggcccagcuaaaccacggaa

SEQ ID NO: 3617500 - RNA, 21 nt, Salmonella enterica enterica serovar Typhi
ggcccagcuuaguaaccccag

SEQ ID NO: 3617501 - RNA, 21 nt, Salmonella enterica enterica serovar Typhi
ggcccaggccauuaaccuugc

SEQ ID NO: 3617502 - RNA, 18 nt, Salmonella enterica enterica serovar Typhi
ggcccauaaacaggucac

SEQ ID NO: 3617503 - RNA, 15 nt, Salmonella enterica enterica serovar Typhi
ggccccaauuugcug

SEQ ID NO: 3617504 - RNA, 23 nt, Salmonella enterica enterica serovar Typhi
ggcccccuguuccagggcuucca

SEQ ID NO: 3617505 - RNA, 21 nt, Salmonella enterica enterica serovar Typhi
ggcccgaagggcgagcguagc

SEQ ID NO: 3617506 - RNA, 18 nt, Salmonella enterica enterica serovar Typhi
ggcccgccgcuggcuggc

SEQ ID NO: 3617507 - RNA, 14 nt, Salmonella enterica enterica serovar Typhi
ggcccgcggcgacg

SEQ ID NO: 3617508 - RNA, 22 nt, Salmonella enterica enterica serovar Typhi
ggcccgguaagcacaacgcauu

SEQ ID NO: 3617509 - RNA, 17 nt, Salmonella enterica enterica serovar Typhi
ggcccgguaagcgcagc

SEQ ID NO: 3617510 - RNA, 20 nt, Salmonella enterica enterica serovar Typhi
ggcccgguaagcgcagcgcc

SEQ ID NO: 3617511 - RNA, 21 nt, Salmonella enterica enterica serovar Typhi
ggcccgguaagcgcuagcgcc

SEQ ID NO: 3617512 - RNA, 15 nt, Salmonella enterica enterica serovar Typhi
ggcccgguggcgcca

SEQ ID NO: 3617513 - RNA, 20 nt, Salmonella enterica enterica serovar Typhi
ggcccgguggcguggcgcca

SEQ ID NO: 3617514 - RNA, 17 nt, Salmonella enterica enterica serovar Typhi
ggcccgguugucccggu

SEQ ID NO: 3617515 - RNA, 20 nt, Salmonella enterica enterica serovar Typhi
ggccgaaggaagauagcggg

SEQ ID NO: 3617516 - RNA, 14 nt, Salmonella enterica enterica serovar Typhi
ggccgacaaaaauu

SEQ ID NO: 3617517 - RNA, 15 nt, Salmonella enterica enterica serovar Typhi
ggccgacaggcggcc

SEQ ID NO: 3617518 - RNA, 17 nt, Salmonella enterica enterica serovar Typhi
ggccgacaggcggccgc

SEQ ID NO: 3617519 - RNA, 16 nt, Salmonella enterica enterica serovar Typhi
ggccgacgauaaacag

SEQ ID NO: 3617520 - RNA, 14 nt, Salmonella enterica enterica serovar Typhi
ggccgacggcauaa

SEQ ID NO: 3617521 - RNA, 14 nt, Salmonella enterica enterica serovar Typhi
ggccgagaggcuga

SEQ ID NO: 3617522 - RNA, 19 nt, Salmonella enterica enterica serovar Typhi
ggccgagaguccagcgcca

SEQ ID NO: 3617523 - RNA, 19 nt, Salmonella enterica enterica serovar Typhi
ggccgauauugcggccuuc

SEQ ID NO: 3617524 - RNA, 16 nt, Salmonella enterica enterica serovar Typhi
ggccgauuucauucag

SEQ ID NO: 3617525 - RNA, 13 nt, Salmonella enterica enterica serovar Typhi
ggccgcagcgcca

SEQ ID NO: 3617526 - RNA, 18 nt, Salmonella enterica enterica serovar Typhi
ggccgccaaugacaauaa

SEQ ID NO: 3617527 - RNA, 15 nt, Salmonella enterica enterica serovar Typhi
ggccgccaccgccuc

SEQ ID NO: 3617528 - RNA, 12 nt, Salmonella enterica enterica serovar Typhi
ggccgccagcgc

SEQ ID NO: 3617529 - RNA, 22 nt, Salmonella enterica enterica serovar Typhi
ggccgccagcgugacccagaca

SEQ ID NO: 3617530 - RNA, 12 nt, Salmonella enterica enterica serovar Typhi
ggccgccagggg

SEQ ID NO: 3617531 - RNA, 13 nt, Salmonella enterica enterica serovar Typhi
ggccgccgagcug

SEQ ID NO: 3617532 - RNA, 16 nt, Salmonella enterica enterica serovar Typhi
ggccgccgcacaggcg

SEQ ID NO: 3617533 - RNA, 16 nt, Salmonella enterica enterica serovar Typhi
ggccgccgcagcagau

SEQ ID NO: 3617534 - RNA, 16 nt, Salmonella enterica enterica serovar Typhi
ggccgcuauccucgcc

SEQ ID NO: 3617535 - RNA, 23 nt, Salmonella enterica enterica serovar Typhi
ggccgcuaucugcuccgccagca

SEQ ID NO: 3617536 - RNA, 12 nt, Salmonella enterica enterica serovar Typhi
ggccgcucgccu

SEQ ID NO: 3617537 - RNA, 14 nt, Salmonella enterica enterica serovar Typhi
ggccgcucgccugc

SEQ ID NO: 3617538 - RNA, 21 nt, Salmonella enterica enterica serovar Typhi
ggccgcuuugcgaacagcgca

SEQ ID NO: 3617539 - RNA, 23 nt, Salmonella enterica enterica serovar Typhi
ggccggaaaggauauaagcgcca

SEQ ID NO: 3617540 - RNA, 18 nt, Salmonella enterica enterica serovar Typhi
ggccggaauacguaauac

SEQ ID NO: 3617541 - RNA, 23 nt, Salmonella enterica enterica serovar Typhi
ggccggauaagacgcuacgcguc

SEQ ID NO: 3617542 - RNA, 20 nt, Salmonella enterica enterica serovar Typhi
ggccggauaagcauagcguu

SEQ ID NO: 3617543 - RNA, 18 nt, Salmonella enterica enterica serovar Typhi
ggccggauaagcgcagcg

SEQ ID NO: 3617544 - RNA, 22 nt, Salmonella enterica enterica serovar Typhi
ggccggauaagcggcagcgcca

SEQ ID NO: 3617545 - RNA, 17 nt, Salmonella enterica enterica serovar Typhi
ggcgaguucucgcucuu

SEQ ID NO: 3617546 - RNA, 20 nt, Salmonella enterica enterica serovar Typhi
ggcgaguuuggugcccgcgu

SEQ ID NO: 3617547 - RNA, 20 nt, Salmonella enterica enterica serovar Typhi
ggcgauaaaaauauccgcca

SEQ ID NO: 3617548 - RNA, 23 nt, Salmonella enterica enterica serovar Typhi
ggcgauaaaccaacagccgccug

SEQ ID NO: 3617549 - RNA, 18 nt, Salmonella enterica enterica serovar Typhi
ggcgauaaccucucaccg

SEQ ID NO: 3617550 - RNA, 21 nt, Salmonella enterica enterica serovar Typhi
ggcgauaccgguacggaacgu

SEQ ID NO: 3617551 - RNA, 17 nt, Salmonella enterica enterica serovar Typhi
ggcgauagcgccccaaa

SEQ ID NO: 3617552 - RNA, 14 nt, Salmonella enterica enterica serovar Typhi
ggcgaucaccacgc

SEQ ID NO: 3617553 - RNA, 15 nt, Salmonella enterica enterica serovar Typhi
ggcgaucagcgccac

SEQ ID NO: 3617554 - RNA, 17 nt, Salmonella enterica enterica serovar Typhi
ggcgaucagcgccacca

SEQ ID NO: 3617555 - RNA, 19 nt, Salmonella enterica enterica serovar Typhi
ggcgaucagcgccaccaca

SEQ ID NO: 3617556 - RNA, 12 nt, Salmonella enterica enterica serovar Typhi
ggcgaucgcaca

SEQ ID NO: 3617557 - RNA, 15 nt, Salmonella enterica enterica serovar Typhi
ggcgauggcucgccc

SEQ ID NO: 3617558 - RNA, 20 nt, Salmonella enterica enterica serovar Typhi
ggcgauguaacgccuuugcc

SEQ ID NO: 3617559 - RNA, 15 nt, Salmonella enterica enterica serovar Typhi
ggcgauguuggcgcc

SEQ ID NO: 3617560 - RNA, 19 nt, Salmonella enterica enterica serovar Typhi
ggcgauuuauagagcagca

SEQ ID NO: 3617561 - RNA, 13 nt, Salmonella enterica enterica serovar Typhi
ggcgauuuucacc

SEQ ID NO: 3617562 - RNA, 13 nt, Salmonella enterica enterica serovar Typhi
ggcgauuuucagc

SEQ ID NO: 3617563 - RNA, 22 nt, Salmonella enterica enterica serovar Typhi
ggcgauuuuuaggccaaacuua

SEQ ID NO: 3617564 - RNA, 22 nt, Salmonella enterica enterica serovar Typhi
ggcgcaaacgcgugcugguguc

SEQ ID NO: 3617565 - RNA, 11 nt, Salmonella enterica enterica serovar Typhi
ggcgcaaaucg

SEQ ID NO: 3617566 - RNA, 23 nt, Salmonella enterica enterica serovar Typhi
ggcgcaaaucgccaucagcgcga

SEQ ID NO: 3617567 - RNA, 17 nt, Salmonella enterica enterica serovar Typhi
ggcgcaaauggcugcga

SEQ ID NO: 3617568 - RNA, 20 nt, Salmonella enterica enterica serovar Typhi
ggcgcaacguuugccagcgu

SEQ ID NO: 3617569 - RNA, 19 nt, Salmonella enterica enterica serovar Typhi
ggcgcaaucuuugccgcaa

SEQ ID NO: 3617570 - RNA, 14 nt, Salmonella enterica enterica serovar Typhi
ggcgcacagcgcca

SEQ ID NO: 3617571 - RNA, 17 nt, Salmonella enterica enterica serovar Typhi
ggcgcacauuuacgcca

SEQ ID NO: 3617572 - RNA, 19 nt, Salmonella enterica enterica serovar Typhi
ggcgcacauuuacgccagc

SEQ ID NO: 3617573 - RNA, 22 nt, Salmonella enterica enterica serovar Typhi
ggcgcacauuuacgccagccag

SEQ ID NO: 3617574 - RNA, 18 nt, Salmonella enterica enterica serovar Typhi
ggcgcaccaaagugcgcc

SEQ ID NO: 3617575 - RNA, 21 nt, Salmonella enterica enterica serovar Typhi
ggcgcacgcgucaucggcgcg

SEQ ID NO: 3617576 - RNA, 14 nt, Salmonella enterica enterica serovar Typhi
ggcgcagagugagc

SEQ ID NO: 3617577 - RNA, 22 nt, Salmonella enterica enterica serovar Typhi
ggcgcagccgccauccggcaca

SEQ ID NO: 3617578 - RNA, 16 nt, Salmonella enterica enterica serovar Typhi
ggcgcagcgcccagca

SEQ ID NO: 3617579 - RNA, 13 nt, Salmonella enterica enterica serovar Typhi
ggcgcagcgcggg

SEQ ID NO: 3617580 - RNA, 11 nt, Salmonella enterica enterica serovar Typhi
ggcgcaggcaa

SEQ ID NO: 3617581 - RNA, 20 nt, Salmonella enterica enterica serovar Typhi
ggcgcaggggcauuuuccgg

SEQ ID NO: 3617582 - RNA, 21 nt, Salmonella enterica enterica serovar Typhi
ggcgcaguauggcgaccagga

SEQ ID NO: 3617583 - RNA, 22 nt, Salmonella enterica enterica serovar Typhi
ggcgcaguccagaugcgccaga

SEQ ID NO: 3617584 - RNA, 14 nt, Salmonella enterica enterica serovar Typhi
ggcgcaguggcggg

SEQ ID NO: 3617585 - RNA, 16 nt, Salmonella enterica enterica serovar Typhi
ggcgcaguucgccgcc

SEQ ID NO: 3617586 - RNA, 20 nt, Salmonella enterica enterica serovar Typhi
ggcgcaguucgccgccagga

SEQ ID NO: 3617587 - RNA, 21 nt, Salmonella enterica enterica serovar Typhi
ggcgcaguuuacgcagcgccu

SEQ ID NO: 3617588 - RNA, 22 nt, Salmonella enterica enterica serovar Typhi
ggcgcaguuuacgcagcgccuu

SEQ ID NO: 3617589 - RNA, 23 nt, Salmonella enterica enterica serovar Typhi
ggcgcauaaugacguccaggccg

SEQ ID NO: 3617590 - RNA, 18 nt, Salmonella enterica enterica serovar Typhi
ggcgcauacgaucugaca

SEQ ID NO: 3617591 - RNA, 14 nt, Salmonella enterica enterica serovar Typhi
ggcgcauaucgccc

SEQ ID NO: 3617592 - RNA, 12 nt, Salmonella enterica enterica serovar Typhi
ggcgcaucagaa

SEQ ID NO: 3617593 - RNA, 19 nt, Salmonella enterica enterica serovar Typhi
ggcgcauucucugucgccg

SEQ ID NO: 3617594 - RNA, 21 nt, Salmonella enterica enterica serovar Typhi
ggcgcauuuucggcagcgcga

SEQ ID NO: 3617595 - RNA, 16 nt, Salmonella enterica enterica serovar Typhi
ggcgccaaucaccgcc

SEQ ID NO: 3617596 - RNA, 17 nt, Salmonella enterica enterica serovar Typhi
ggcgccaaucaccgcca

SEQ ID NO: 3617597 - RNA, 20 nt, Salmonella enterica enterica serovar Typhi
ggcgccaaucaccgccagca

SEQ ID NO: 3617598 - RNA, 22 nt, Salmonella enterica enterica serovar Typhi
ggcgccacccaacaucauguua

SEQ ID NO: 3617599 - RNA, 23 nt, Salmonella enterica enterica serovar Typhi
ggcgccagagagcguuucuacgc

SEQ ID NO: 3617600 - RNA, 12 nt, Salmonella enterica enterica serovar Typhi
ggcgccaucaug

SEQ ID NO: 3617601 - RNA, 14 nt, Salmonella enterica enterica serovar Typhi
ggcgccaucgccuc

SEQ ID NO: 3617602 - RNA, 15 nt, Salmonella enterica enterica serovar Typhi
ggcgccaucgccucc

SEQ ID NO: 3617603 - RNA, 17 nt, Salmonella enterica enterica serovar Typhi
ggcgccaucgccuccag

SEQ ID NO: 3617604 - RNA, 22 nt, Salmonella enterica enterica serovar Typhi
ggcgccaucgccuccagacugg

SEQ ID NO: 3617605 - RNA, 21 nt, Salmonella enterica enterica serovar Typhi
ggcgccauuggcucggcguca

SEQ ID NO: 3617606 - RNA, 17 nt, Salmonella enterica enterica serovar Typhi
ggcgccgaagcaggcgg

SEQ ID NO: 3617607 - RNA, 18 nt, Salmonella enterica enterica serovar Typhi
ggcgccgaagcaggcgga

SEQ ID NO: 3617608 - RNA, 21 nt, Salmonella enterica enterica serovar Typhi
ggcgccgauaacacggcuggc

SEQ ID NO: 3617609 - RNA, 16 nt, Salmonella enterica enterica serovar Typhi
ggcgccgcaaaccaga

SEQ ID NO: 3617610 - RNA, 19 nt, Salmonella enterica enterica serovar Typhi
ggcgccggagucgacggcg

SEQ ID NO: 3617611 - RNA, 23 nt, Salmonella enterica enterica serovar Typhi
ggcgccggauggcggcugcgccu

SEQ ID NO: 3617612 - RNA, 12 nt, Salmonella enterica enterica serovar Typhi
ggcgccggcgcg

SEQ ID NO: 3617613 - RNA, 16 nt, Salmonella enterica enterica serovar Typhi
ggcgccggggcagcaa

SEQ ID NO: 3617614 - RNA, 17 nt, Salmonella enterica enterica serovar Typhi
ggcgccggggcagcaau

SEQ ID NO: 3617615 - RNA, 15 nt, Salmonella enterica enterica serovar Typhi
ggcgccucgcgcggc

SEQ ID NO: 3617616 - RNA, 14 nt, Salmonella enterica enterica serovar Typhi
ggcgccuuguccgg

SEQ ID NO: 3617617 - RNA, 18 nt, Salmonella enterica enterica serovar Typhi
ggcgcgaaaacagcuggc

SEQ ID NO: 3617618 - RNA, 22 nt, Salmonella enterica enterica serovar Typhi
ggcgcgaaacugcugccgcagc

SEQ ID NO: 3617619 - RNA, 15 nt, Salmonella enterica enterica serovar Typhi
ggcgcgaaagcgccu

SEQ ID NO: 3617620 - RNA, 22 nt, Salmonella enterica enterica serovar Typhi
ggcgcgaacgccuuauccggcc

SEQ ID NO: 3617621 - RNA, 22 nt, Salmonella enterica enterica serovar Typhi
ggcgcgacuuuaaucaccugcc

SEQ ID NO: 3617622 - RNA, 20 nt, Salmonella enterica enterica serovar Typhi
ggcgcgccaauaaagcuuga

SEQ ID NO: 3617623 - RNA, 12 nt, Salmonella enterica enterica serovar Typhi
ggcgcgcccggc

SEQ ID NO: 3617624 - RNA, 13 nt, Salmonella enterica enterica serovar Typhi
ggcgcgcgcgcca

SEQ ID NO: 3617625 - RNA, 15 nt, Salmonella enterica enterica serovar Typhi
ggcgcgcguggcuuc

SEQ ID NO: 3617626 - RNA, 15 nt, Salmonella enterica enterica serovar Typhi
ggcgcgcuuaucugg

SEQ ID NO: 3617627 - RNA, 13 nt, Salmonella enterica enterica serovar Typhi
ggcgcggaaggga

SEQ ID NO: 3617628 - RNA, 19 nt, Salmonella enterica enterica serovar Typhi
ggcgcgucacaacagccgg

SEQ ID NO: 3617629 - RNA, 12 nt, Salmonella enterica enterica serovar Typhi
ggcgcguccagc

SEQ ID NO: 3617630 - RNA, 21 nt, Salmonella enterica enterica serovar Typhi
ggcguaaaagcgauaaagaca

SEQ ID NO: 3617631 - RNA, 21 nt, Salmonella enterica enterica serovar Typhi
ggcguaaaugugcgccagccu

SEQ ID NO: 3617632 - RNA, 13 nt, Salmonella enterica enterica serovar Typhi
ggcguaagaaaag

SEQ ID NO: 3617633 - RNA, 15 nt, Salmonella enterica enterica serovar Typhi
ggcguaagcgacauc

SEQ ID NO: 3617634 - RNA, 23 nt, Salmonella enterica enterica serovar Typhi
ggcguaauaugaauauccgccgc

SEQ ID NO: 3617635 - RNA, 15 nt, Salmonella enterica enterica serovar Typhi
ggcguaauggcggga

SEQ ID NO: 3617636 - RNA, 18 nt, Salmonella enterica enterica serovar Typhi
ggcguacacuucauccgg

SEQ ID NO: 3617637 - RNA, 12 nt, Salmonella enterica enterica serovar Typhi
ggcguaccagaa

SEQ ID NO: 3617638 - RNA, 14 nt, Salmonella enterica enterica serovar Typhi
ggcguacgggcaaa

SEQ ID NO: 3617639 - RNA, 21 nt, Salmonella enterica enterica serovar Typhi
ggcguacuaaauaggcggcau

SEQ ID NO: 3617640 - RNA, 13 nt, Salmonella enterica enterica serovar Typhi
ggcguagccgccg

SEQ ID NO: 3617641 - RNA, 16 nt, Salmonella enterica enterica serovar Typhi
ggcguagcgagaaggc

SEQ ID NO: 3617642 - RNA, 17 nt, Salmonella enterica enterica serovar Typhi
ggcguagcgcgcggaua

SEQ ID NO: 3617643 - RNA, 14 nt, Salmonella enterica enterica serovar Typhi
ggcguagucagcga

SEQ ID NO: 3617644 - RNA, 17 nt, Salmonella enterica enterica serovar Typhi
ggcguauagccaggcag

SEQ ID NO: 3617645 - RNA, 17 nt, Salmonella enterica enterica serovar Typhi
ggcguauagccgccccc

SEQ ID NO: 3617646 - RNA, 17 nt, Salmonella enterica enterica serovar Typhi
ggcguaucuuccagcgu

SEQ ID NO: 3617647 - RNA, 17 nt, Salmonella enterica enterica serovar Typhi
ggcguauucgcaucggu

SEQ ID NO: 3617648 - RNA, 20 nt, Salmonella enterica enterica serovar Typhi
ggcguauucgcccggcagga

SEQ ID NO: 3617649 - RNA, 21 nt, Salmonella enterica enterica serovar Typhi
ggcgucaacguuuuucagccg

SEQ ID NO: 3617650 - RNA, 20 nt, Salmonella enterica enterica serovar Typhi
ggcgucacccgccggcagca

SEQ ID NO: 3617651 - RNA, 21 nt, Salmonella enterica enterica serovar Typhi
ggcguccggccacuauuucgg

SEQ ID NO: 3617652 - RNA, 21 nt, Salmonella enterica enterica serovar Typhi
ggcgucgugcugggcgcgccu

SEQ ID NO: 3617653 - RNA, 19 nt, Salmonella enterica enterica serovar Typhi
ggcgugacaccgguuugcg

SEQ ID NO: 3617654 - RNA, 14 nt, Salmonella enterica enterica serovar Typhi
ggcgugacgcgcca

SEQ ID NO: 3617655 - RNA, 16 nt, Salmonella enterica enterica serovar Typhi
ggcgugccgggcuggc

SEQ ID NO: 3617656 - RNA, 17 nt, Salmonella enterica enterica serovar Typhi
ggcgugccgggcuggcg

SEQ ID NO: 3617657 - RNA, 17 nt, Salmonella enterica enterica serovar Typhi
ggcguggugucucgucg

SEQ ID NO: 3617658 - RNA, 17 nt, Salmonella enterica enterica serovar Typhi
ggcguguugaaauccuc

SEQ ID NO: 3617659 - RNA, 22 nt, Salmonella enterica enterica serovar Typhi
ggcguuaaucaccggcgcgggc

SEQ ID NO: 3617660 - RNA, 23 nt, Salmonella enterica enterica serovar Typhi
ggcguuaaugcgcgcuucuucau

SEQ ID NO: 3617661 - RNA, 18 nt, Salmonella enterica enterica serovar Typhi
ggcguuacccgucuggcg

SEQ ID NO: 3617662 - RNA, 19 nt, Salmonella enterica enterica serovar Typhi
ggcguuaccggcaggcugg

SEQ ID NO: 3617663 - RNA, 18 nt, Salmonella enterica enterica serovar Typhi
ggcguuaucuugacauga

SEQ ID NO: 3617664 - RNA, 12 nt, Salmonella enterica enterica serovar Typhi
ggcguucucccg

SEQ ID NO: 3617665 - RNA, 19 nt, Salmonella enterica enterica serovar Typhi
ggcguugcgcccaggccaa

SEQ ID NO: 3617666 - RNA, 20 nt, Salmonella enterica enterica serovar Typhi
ggcguugcgccgccaggcau

SEQ ID NO: 3617667 - RNA, 15 nt, Salmonella enterica enterica serovar Typhi
ggcguuggcuaucgc

SEQ ID NO: 3617668 - RNA, 21 nt, Salmonella enterica enterica serovar Typhi
ggcguuuacgcugcuauccgg

SEQ ID NO: 3617669 - RNA, 19 nt, Salmonella enterica enterica serovar Typhi
ggcguuuauauaaaaauag

SEQ ID NO: 3617670 - RNA, 20 nt, Salmonella enterica enterica serovar Typhi
ggcguuuucauuagccgcca

SEQ ID NO: 3617671 - RNA, 17 nt, Salmonella enterica enterica serovar Typhi
ggcuaagccaaaaauaa

SEQ ID NO: 3617672 - RNA, 21 nt, Salmonella enterica enterica serovar Typhi
ggcuaccgggcaaacauuagc

SEQ ID NO: 3617673 - RNA, 18 nt, Salmonella enterica enterica serovar Typhi
ggcuagcgccuuauccgg

SEQ ID NO: 3617674 - RNA, 21 nt, Salmonella enterica enterica serovar Typhi
ggcuaucgcacuggcgccugc

SEQ ID NO: 3617675 - RNA, 15 nt, Salmonella enterica enterica serovar Typhi
ggcuaugaagagaaa

SEQ ID NO: 3617676 - RNA, 18 nt, Salmonella enterica enterica serovar Typhi
ggcucagcauagcgcuga

SEQ ID NO: 3617677 - RNA, 13 nt, Salmonella enterica enterica serovar Typhi
ggcucauauuauc

SEQ ID NO: 3617678 - RNA, 22 nt, Salmonella enterica enterica serovar Typhi
ggcucaucaaacagcggcacuu

SEQ ID NO: 3617679 - RNA, 16 nt, Salmonella enterica enterica serovar Typhi
ggcucaucagcgccau

SEQ ID NO: 3617680 - RNA, 23 nt, Salmonella enterica enterica serovar Typhi
ggcucauuuuauccaacagcgca

SEQ ID NO: 3617681 - RNA, 13 nt, Salmonella enterica enterica serovar Typhi
ggcuccaaguauu

SEQ ID NO: 3617682 - RNA, 14 nt, Salmonella enterica enterica serovar Typhi
ggcuccagcgccag

SEQ ID NO: 3617683 - RNA, 18 nt, Salmonella enterica enterica serovar Typhi
ggcuccagcgccagcucc

SEQ ID NO: 3617684 - RNA, 20 nt, Salmonella enterica enterica serovar Typhi
ggcuccagcgccagcuccau

SEQ ID NO: 3617685 - RNA, 16 nt, Salmonella enterica enterica serovar Typhi
ggcucccacucuucca

SEQ ID NO: 3617686 - RNA, 23 nt, Salmonella enterica enterica serovar Typhi
ggcuccgagacucaaagaaaaca

SEQ ID NO: 3617687 - RNA, 20 nt, Salmonella enterica enterica serovar Typhi
ggcuccuggugagguuucag

SEQ ID NO: 3617688 - RNA, 20 nt, Salmonella enterica enterica serovar Typhi
ggcuccuguugguuauacgg

SEQ ID NO: 3617689 - RNA, 15 nt, Salmonella enterica enterica serovar Typhi
ggcuccuuuuuugua

SEQ ID NO: 3617690 - RNA, 13 nt, Salmonella enterica enterica serovar Typhi
ggcucguuuuugu

SEQ ID NO: 3617691 - RNA, 16 nt, Salmonella enterica enterica serovar Typhi
ggcucuaaaaaggaaa

SEQ ID NO: 3617692 - RNA, 19 nt, Salmonella enterica enterica serovar Typhi
ggcucuaaauuagcucccg

SEQ ID NO: 3617693 - RNA, 13 nt, Salmonella enterica enterica serovar Typhi
ggcucuacucgcg

SEQ ID NO: 3617694 - RNA, 22 nt, Salmonella enterica enterica serovar Typhi
ggcugacguuacgcggcgcgcc

SEQ ID NO: 3617695 - RNA, 13 nt, Salmonella enterica enterica serovar Typhi
ggcugagaaaaau

SEQ ID NO: 3617696 - RNA, 15 nt, Salmonella enterica enterica serovar Typhi
ggcugagaaaaauac

SEQ ID NO: 3617697 - RNA, 15 nt, Salmonella enterica enterica serovar Typhi
ggcugagaaucaccu

SEQ ID NO: 3617698 - RNA, 20 nt, Salmonella enterica enterica serovar Typhi
ggcugagcguagaccgccca

SEQ ID NO: 3617699 - RNA, 15 nt, Salmonella enterica enterica serovar Typhi
ggcugaguucaggca

SEQ ID NO: 3617700 - RNA, 13 nt, Salmonella enterica enterica serovar Typhi
ggcugauggcgaa

SEQ ID NO: 3617701 - RNA, 21 nt, Salmonella enterica enterica serovar Typhi
ggcugcacccggagagaaaca

SEQ ID NO: 3617702 - RNA, 13 nt, Salmonella enterica enterica serovar Typhi
ggcugccacacgu

SEQ ID NO: 3617703 - RNA, 15 nt, Salmonella enterica enterica serovar Typhi
ggcugccacacguca

SEQ ID NO: 3617704 - RNA, 14 nt, Salmonella enterica enterica serovar Typhi
ggcugccaucaggc

SEQ ID NO: 3617705 - RNA, 16 nt, Salmonella enterica enterica serovar Typhi
ggcugccccagacgcc

SEQ ID NO: 3617706 - RNA, 13 nt, Salmonella enterica enterica serovar Typhi
ggcugcccugcgg

SEQ ID NO: 3617707 - RNA, 19 nt, Salmonella enterica enterica serovar Typhi
ggcugccgacaacgccucc

SEQ ID NO: 3617708 - RNA, 12 nt, Salmonella enterica enterica serovar Typhi
ggcugccgccau

SEQ ID NO: 3617709 - RNA, 18 nt, Salmonella enterica enterica serovar Typhi
ggcugcgcgggagauggc

SEQ ID NO: 3617710 - RNA, 14 nt, Salmonella enterica enterica serovar Typhi
ggcugcggcaaacu

SEQ ID NO: 3617711 - RNA, 18 nt, Salmonella enterica enterica serovar Typhi
ggcugcguaaaaucagca

SEQ ID NO: 3617712 - RNA, 11 nt, Salmonella enterica enterica serovar Typhi
ggcugcguaac

SEQ ID NO: 3617713 - RNA, 11 nt, Salmonella enterica enterica serovar Typhi
ggcugcucggg

SEQ ID NO: 3617714 - RNA, 12 nt, Salmonella enterica enterica serovar Typhi
ggcuggccacug

SEQ ID NO: 3617715 - RNA, 16 nt, Salmonella enterica enterica serovar Typhi
ggcuguaccuuaaccg

SEQ ID NO: 3617716 - RNA, 20 nt, Salmonella enterica enterica serovar Typhi
gggccugagcgcgcagcugg

SEQ ID NO: 3617717 - RNA, 23 nt, Salmonella enterica enterica serovar Typhi
gggcgaaaacggcgcaggcaaau

SEQ ID NO: 3617718 - RNA, 21 nt, Salmonella enterica enterica serovar Typhi
gggcgaacccaucagggaaaa

SEQ ID NO: 3617719 - RNA, 18 nt, Salmonella enterica enterica serovar Typhi
gggcgacaccgcaaaccg

SEQ ID NO: 3617720 - RNA, 22 nt, Salmonella enterica enterica serovar Typhi
gggcgaggucaucuuucagaug

SEQ ID NO: 3617721 - RNA, 13 nt, Salmonella enterica enterica serovar Typhi
gggcgauaaacca

SEQ ID NO: 3617722 - RNA, 23 nt, Salmonella enterica enterica serovar Typhi
gggcgauaaaccagccccacggu

SEQ ID NO: 3617723 - RNA, 13 nt, Salmonella enterica enterica serovar Typhi
gggcgaugcgcga

SEQ ID NO: 3617724 - RNA, 22 nt, Salmonella enterica enterica serovar Typhi
gggcgcaaaaucgcaaacgcca

SEQ ID NO: 3617725 - RNA, 15 nt, Salmonella enterica enterica serovar Typhi
gggcgcaugaggccu

SEQ ID NO: 3617726 - RNA, 13 nt, Salmonella enterica enterica serovar Typhi
gggcgcugauuuu

SEQ ID NO: 3617727 - RNA, 15 nt, Salmonella enterica enterica serovar Typhi
gggcguccacuuucu

SEQ ID NO: 3617728 - RNA, 15 nt, Salmonella enterica enterica serovar Typhi
gggcgugacgcgcca

SEQ ID NO: 3617729 - RNA, 21 nt, Salmonella enterica enterica serovar Typhi
gggcgugucgccggggcgcug

SEQ ID NO: 3617730 - RNA, 21 nt, Salmonella enterica enterica serovar Typhi
gggcguugcugcacgucgcgc

SEQ ID NO: 3617731 - RNA, 22 nt, Salmonella enterica enterica serovar Typhi
gggcguuugcgcgcgccacgca

SEQ ID NO: 3617732 - RNA, 17 nt, Salmonella enterica enterica serovar Typhi
gggcguuuguuguagcc

SEQ ID NO: 3617733 - RNA, 14 nt, Salmonella enterica enterica serovar Typhi
gggcuccugcgccg

SEQ ID NO: 3617734 - RNA, 15 nt, Salmonella enterica enterica serovar Typhi
gggcugccaucaggc

SEQ ID NO: 3617735 - RNA, 13 nt, Salmonella enterica enterica serovar Typhi
gggcugcggcaaa

SEQ ID NO: 3617736 - RNA, 12 nt, Salmonella enterica enterica serovar Typhi
gggcuuaaucag

SEQ ID NO: 3617737 - RNA, 16 nt, Salmonella enterica enterica serovar Typhi
gggcuucagauguuug

SEQ ID NO: 3617738 - RNA, 20 nt, Salmonella enterica enterica serovar Typhi
gggcuuccacccgggaagcc

SEQ ID NO: 3617739 - RNA, 13 nt, Salmonella enterica enterica serovar Typhi
gggcuuuauccug

SEQ ID NO: 3617740 - RNA, 23 nt, Salmonella enterica enterica serovar Typhi
gggcuuucccguuucagccccuu

SEQ ID NO: 3617741 - RNA, 22 nt, Salmonella enterica enterica serovar Typhi
ggggaaaauauuagcggcggca

SEQ ID NO: 3617742 - RNA, 17 nt, Salmonella enterica enterica serovar Typhi
ggggaauguuuggcgcc

SEQ ID NO: 3617743 - RNA, 14 nt, Salmonella enterica enterica serovar Typhi
ggggaguccauuuc

SEQ ID NO: 3617744 - RNA, 15 nt, Salmonella enterica enterica serovar Typhi
ggggaucgguuuauc

SEQ ID NO: 3617745 - RNA, 18 nt, Salmonella enterica enterica serovar Typhi
ggggaugauuuucaggca

SEQ ID NO: 3617746 - RNA, 14 nt, Salmonella enterica enterica serovar Typhi
ggggcauuuuccgg

SEQ ID NO: 3617747 - RNA, 18 nt, Salmonella enterica enterica serovar Typhi
ggggccacaggcggcaug

SEQ ID NO: 3617748 - RNA, 14 nt, Salmonella enterica enterica serovar Typhi
ggggccgggaaaga

SEQ ID NO: 3617749 - RNA, 14 nt, Salmonella enterica enterica serovar Typhi
ggggcgacagcccc

SEQ ID NO: 3617750 - RNA, 13 nt, Salmonella enterica enterica serovar Typhi
ggggcgaccggcu

SEQ ID NO: 3617751 - RNA, 12 nt, Salmonella enterica enterica serovar Typhi
ggggcgcagaag

SEQ ID NO: 3617752 - RNA, 14 nt, Salmonella enterica enterica serovar Typhi
ggggcuccugcgcc

SEQ ID NO: 3617753 - RNA, 14 nt, Salmonella enterica enterica serovar Typhi
ggggcuuaacccac

SEQ ID NO: 3617754 - RNA, 17 nt, Salmonella enterica enterica serovar Typhi
gggggaacggcagacag

SEQ ID NO: 3617755 - RNA, 19 nt, Salmonella enterica enterica serovar Typhi
gggggauagcgacggggcg

SEQ ID NO: 3617756 - RNA, 20 nt, Salmonella enterica enterica serovar Typhi
gggggccugauggcgcugcg

SEQ ID NO: 3617757 - RNA, 22 nt, Salmonella enterica enterica serovar Typhi
ggggguaacguuguccagcaga

SEQ ID NO: 3617758 - RNA, 18 nt, Salmonella enterica enterica serovar Typhi
gggguauucgcggccaga

SEQ ID NO: 3617759 - RNA, 19 nt, Salmonella enterica enterica serovar Typhi
ggggucggcgcuaaugugg

SEQ ID NO: 3617760 - RNA, 20 nt, Salmonella enterica enterica serovar Typhi
ggggucucuacgcggcgggc

SEQ ID NO: 3617761 - RNA, 15 nt, Salmonella enterica enterica serovar Typhi
gggguguuacgccau

SEQ ID NO: 3617762 - RNA, 22 nt, Salmonella enterica enterica serovar Typhi
gggguucaauagcacaucagcc

SEQ ID NO: 3617763 - RNA, 16 nt, Salmonella enterica enterica serovar Typhi
gggguuuuggccggac

SEQ ID NO: 3617764 - RNA, 19 nt, Salmonella enterica enterica serovar Typhi
ggguaaaaauauggcgggc

SEQ ID NO: 3617765 - RNA, 21 nt, Salmonella enterica enterica serovar Typhi
ggguaaauagacuguugaaag

SEQ ID NO: 3617766 - RNA, 18 nt, Salmonella enterica enterica serovar Typhi
ggguaagcgcuagcgcca

SEQ ID NO: 3617767 - RNA, 12 nt, Salmonella enterica enterica serovar Typhi
ggguaauaacgg

SEQ ID NO: 3617768 - RNA, 11 nt, Salmonella enterica enterica serovar Typhi
ggguaauacug

SEQ ID NO: 3617769 - RNA, 14 nt, Salmonella enterica enterica serovar Typhi
ggguaauggucagc

SEQ ID NO: 3617770 - RNA, 14 nt, Salmonella enterica enterica serovar Typhi
ggguagaaaaaggu

SEQ ID NO: 3617771 - RNA, 20 nt, Salmonella enterica enterica serovar Typhi
ggguagccguuuaaaagcgg

SEQ ID NO: 3617772 - RNA, 13 nt, Salmonella enterica enterica serovar Typhi
ggguaggccggau

SEQ ID NO: 3617773 - RNA, 11 nt, Salmonella enterica enterica serovar Typhi
ggguaguuuug

SEQ ID NO: 3617774 - RNA, 16 nt, Salmonella enterica enterica serovar Typhi
ggguaucccgacgcac

SEQ ID NO: 3617775 - RNA, 21 nt, Salmonella enterica enterica serovar Typhi
ggguaucuaacccgcucagac

SEQ ID NO: 3617776 - RNA, 16 nt, Salmonella enterica enterica serovar Typhi
ggguauugaauccaua

SEQ ID NO: 3617777 - RNA, 23 nt, Salmonella enterica enterica serovar Typhi
ggguauuuuagcgguaagagcgu

SEQ ID NO: 3617778 - RNA, 19 nt, Salmonella enterica enterica serovar Typhi
ggguauuuuuuagcgccaa

SEQ ID NO: 3617779 - RNA, 24 nt, Salmonella enterica enterica serovar Typhi
gggucacauccagacagccgacgg

SEQ ID NO: 3617780 - RNA, 17 nt, Salmonella enterica enterica serovar Typhi
gggucaguacgcgcgua

SEQ ID NO: 3617781 - RNA, 18 nt, Salmonella enterica enterica serovar Typhi
gggucgccgcgcccagca

SEQ ID NO: 3617782 - RNA, 19 nt, Salmonella enterica enterica serovar Typhi
gggucguacuaaagagcgc

SEQ ID NO: 3617783 - RNA, 11 nt, Salmonella enterica enterica serovar Typhi
gggucuuccag

SEQ ID NO: 3617784 - RNA, 21 nt, Salmonella enterica enterica serovar Typhi
gggugaauauuuguuggaaau

SEQ ID NO: 3617785 - RNA, 13 nt, Salmonella enterica enterica serovar Typhi
gggugaugcgcca

SEQ ID NO: 3617786 - RNA, 14 nt, Salmonella enterica enterica serovar Typhi
gggugcaaagaaac

SEQ ID NO: 3617787 - RNA, 22 nt, Salmonella enterica enterica serovar Typhi
gggugcaaagaaacguucaucc

SEQ ID NO: 3617788 - RNA, 17 nt, Salmonella enterica enterica serovar Typhi
gggugcaaauccaucuc

SEQ ID NO: 3617789 - RNA, 14 nt, Salmonella enterica enterica serovar Typhi
gggugcgcagcccc

SEQ ID NO: 3617790 - RNA, 12 nt, Salmonella enterica enterica serovar Typhi
gggugcgcgucg

SEQ ID NO: 3617791 - RNA, 20 nt, Salmonella enterica enterica serovar Typhi
gggugguuucccugaccagu

SEQ ID NO: 3617792 - RNA, 13 nt, Salmonella enterica enterica serovar Typhi
ggguuaaaccagc

SEQ ID NO: 3617793 - RNA, 15 nt, Salmonella enterica enterica serovar Typhi
ggguuaaagcccuga

SEQ ID NO: 3617794 - RNA, 13 nt, Salmonella enterica enterica serovar Typhi
ggguuaacgcgcc

SEQ ID NO: 3617795 - RNA, 14 nt, Salmonella enterica enterica serovar Typhi
ggguuaauggcagc

SEQ ID NO: 3617796 - RNA, 13 nt, Salmonella enterica enterica serovar Typhi
ggguuauuuccgc

SEQ ID NO: 3617797 - RNA, 13 nt, Salmonella enterica enterica serovar Typhi
ggguucacugcca

SEQ ID NO: 3617798 - RNA, 19 nt, Salmonella enterica enterica serovar Typhi
ggguucguuaacccggcau

SEQ ID NO: 3617799 - RNA, 15 nt, Salmonella enterica enterica serovar Typhi
ggguugagcgaguca

SEQ ID NO: 3617800 - RNA, 21 nt, Salmonella enterica enterica serovar Typhi
ggguugagcgagucagacacc

SEQ ID NO: 3617801 - RNA, 22 nt, Salmonella enterica enterica serovar Typhi
ggguugcacauuguugcaggga

SEQ ID NO: 3617802 - RNA, 23 nt, Salmonella enterica enterica serovar Typhi
ggucagcauuucauccauuaaac

SEQ ID NO: 3617803 - RNA, 20 nt, Salmonella enterica enterica serovar Typhi
ggucagccgguuuauccgca

SEQ ID NO: 3617804 - RNA, 19 nt, Salmonella enterica enterica serovar Typhi
ggucagcucacgcgccagc

SEQ ID NO: 3617805 - RNA, 21 nt, Salmonella enterica enterica serovar Typhi
ggucagcucacgcgccagcac

SEQ ID NO: 3617806 - RNA, 14 nt, Salmonella enterica enterica serovar Typhi
ggucaggaagacuu

SEQ ID NO: 3617807 - RNA, 13 nt, Salmonella enterica enterica serovar Typhi
ggucaggccagcc

SEQ ID NO: 3617808 - RNA, 13 nt, Salmonella enterica enterica serovar Typhi
ggucaggcuaaau

SEQ ID NO: 3617809 - RNA, 21 nt, Salmonella enterica enterica serovar Typhi
ggucaggcucaggaaaacaaa

SEQ ID NO: 3617810 - RNA, 20 nt, Salmonella enterica enterica serovar Typhi
ggucaggcugcggacauuaa

SEQ ID NO: 3617811 - RNA, 15 nt, Salmonella enterica enterica serovar Typhi
ggucaguacgcgcgu

SEQ ID NO: 3617812 - RNA, 13 nt, Salmonella enterica enterica serovar Typhi
ggucauacugugc

SEQ ID NO: 3617813 - RNA, 19 nt, Salmonella enterica enterica serovar Typhi
ggucauacugugcgugaug

SEQ ID NO: 3617814 - RNA, 16 nt, Salmonella enterica enterica serovar Typhi
ggucaucaccuccagc

SEQ ID NO: 3617815 - RNA, 19 nt, Salmonella enterica enterica serovar Typhi
ggucaucaccuccagcacg

SEQ ID NO: 3617816 - RNA, 17 nt, Salmonella enterica enterica serovar Typhi
ggucaucgcggccagca

SEQ ID NO: 3617817 - RNA, 18 nt, Salmonella enterica enterica serovar Typhi
ggucauucaggacggugg

SEQ ID NO: 3617818 - RNA, 19 nt, Salmonella enterica enterica serovar Typhi
ggucauucauugucuuuuu

SEQ ID NO: 3617819 - RNA, 15 nt, Salmonella enterica enterica serovar Typhi
ggucauuuuacugcg

SEQ ID NO: 3617820 - RNA, 23 nt, Salmonella enterica enterica serovar Typhi
gguccucugauaagucccggacc

SEQ ID NO: 3617821 - RNA, 12 nt, Salmonella enterica enterica serovar Typhi
ggucgccagcau

SEQ ID NO: 3617822 - RNA, 13 nt, Salmonella enterica enterica serovar Typhi
ggucgccagcgcc

SEQ ID NO: 3617823 - RNA, 17 nt, Salmonella enterica enterica serovar Typhi
ggucgcgacggccagca

SEQ ID NO: 3617824 - RNA, 19 nt, Salmonella enterica enterica serovar Typhi
ggucgcgguggguagcggc

SEQ ID NO: 3617825 - RNA, 16 nt, Salmonella enterica enterica serovar Typhi
ggucggcuccugguga

SEQ ID NO: 3617826 - RNA, 17 nt, Salmonella enterica enterica serovar Typhi
ggucguaaugagcacuu

SEQ ID NO: 3617827 - RNA, 13 nt, Salmonella enterica enterica serovar Typhi
ggucgucagccgu

SEQ ID NO: 3617828 - RNA, 19 nt, Salmonella enterica enterica serovar Typhi
ggucgucugaaagcgacuc

SEQ ID NO: 3617829 - RNA, 13 nt, Salmonella enterica enterica serovar Typhi
ggucuccaucaga

SEQ ID NO: 3617830 - RNA, 21 nt, Salmonella enterica enterica serovar Typhi
ggucuccgccuggaacccagg

SEQ ID NO: 3617831 - RNA, 21 nt, Salmonella enterica enterica serovar Typhi
ggucucucgugcaggccggau

SEQ ID NO: 3617832 - RNA, 16 nt, Salmonella enterica enterica serovar Typhi
ggucucuuaaugccag

SEQ ID NO: 3617833 - RNA, 17 nt, Salmonella enterica enterica serovar Typhi
ggucucuuaaugccagc

SEQ ID NO: 3617834 - RNA, 20 nt, Salmonella enterica enterica serovar Typhi
ggucucuuaaugccagcggc

SEQ ID NO: 3617835 - RNA, 20 nt, Salmonella enterica enterica serovar Typhi
ggucucuucaugcauaaccg

SEQ ID NO: 3617836 - RNA, 17 nt, Salmonella enterica enterica serovar Typhi
ggucugacaacuauugc

SEQ ID NO: 3617837 - RNA, 23 nt, Salmonella enterica enterica serovar Typhi
ggucugcauucaggccucugcuu

SEQ ID NO: 3617838 - RNA, 19 nt, Salmonella enterica enterica serovar Typhi
ggucugcgcgccgcaggcc

SEQ ID NO: 3617839 - RNA, 22 nt, Salmonella enterica enterica serovar Typhi
ggucuggauuacaaaaauagac

SEQ ID NO: 3617840 - RNA, 22 nt, Salmonella enterica enterica serovar Typhi
ggugaaaaaagccggacgggcg

SEQ ID NO: 3617841 - RNA, 16 nt, Salmonella enterica enterica serovar Typhi
ggugaaaaaucauuau

SEQ ID NO: 3617842 - RNA, 19 nt, Salmonella enterica enterica serovar Typhi
ggugaaaaaucauuaucac

SEQ ID NO: 3617843 - RNA, 20 nt, Salmonella enterica enterica serovar Typhi
ggugaaaaaucauuaucacu

SEQ ID NO: 3617844 - RNA, 16 nt, Salmonella enterica enterica serovar Typhi
ggugaaauaggggaga

SEQ ID NO: 3617845 - RNA, 13 nt, Salmonella enterica enterica serovar Typhi
ggugaaaucacgc

SEQ ID NO: 3617846 - RNA, 21 nt, Salmonella enterica enterica serovar Typhi
ggugaacaaaggcagccaaca

SEQ ID NO: 3617847 - RNA, 15 nt, Salmonella enterica enterica serovar Typhi
ggugaagaaaaagaa

SEQ ID NO: 3617848 - RNA, 19 nt, Salmonella enterica enterica serovar Typhi
ggugaagaaaaagaagcca

SEQ ID NO: 3617849 - RNA, 20 nt, Salmonella enterica enterica serovar Typhi
ggugaaggcaaaacaccaua

SEQ ID NO: 3617850 - RNA, 17 nt, Salmonella enterica enterica serovar Typhi
ggugaauaacuucacgc

SEQ ID NO: 3617851 - RNA, 16 nt, Salmonella enterica enterica serovar Typhi
ggugaauaccaaagcc

SEQ ID NO: 3617852 - RNA, 22 nt, Salmonella enterica enterica serovar Typhi
ggugaauaccagcggcaaacag

SEQ ID NO: 3617853 - RNA, 22 nt, Salmonella enterica enterica serovar Typhi
ggugacaguccgggccgugaca

SEQ ID NO: 3617854 - RNA, 22 nt, Salmonella enterica enterica serovar Typhi
ggugacgaagaucgcguacagc

SEQ ID NO: 3617855 - RNA, 17 nt, Salmonella enterica enterica serovar Typhi
ggugacggaaaccagca

SEQ ID NO: 3617856 - RNA, 23 nt, Salmonella enterica enterica serovar Typhi
ggugagaucgguaauuuccacgc

SEQ ID NO: 3617857 - RNA, 22 nt, Salmonella enterica enterica serovar Typhi
ggugaguaauaacaaaaaacau

SEQ ID NO: 3617858 - RNA, 14 nt, Salmonella enterica enterica serovar Typhi
ggugauagcccguu

SEQ ID NO: 3617859 - RNA, 15 nt, Salmonella enterica enterica serovar Typhi
ggugauccagcaauc

SEQ ID NO: 3617860 - RNA, 14 nt, Salmonella enterica enterica serovar Typhi
ggugaucugcgccg

SEQ ID NO: 3617861 - RNA, 23 nt, Salmonella enterica enterica serovar Typhi
ggugaucuggccaauuuuucaca

SEQ ID NO: 3617862 - RNA, 23 nt, Salmonella enterica enterica serovar Typhi
ggugaugacgcgcaggccgucaa

SEQ ID NO: 3617863 - RNA, 16 nt, Salmonella enterica enterica serovar Typhi
ggugaugcgcaacguu

SEQ ID NO: 3617864 - RNA, 19 nt, Salmonella enterica enterica serovar Typhi
ggugauuaacagcgccauc

SEQ ID NO: 3617865 - RNA, 15 nt, Salmonella enterica enterica serovar Typhi
ggugcaaaacguuug

SEQ ID NO: 3617866 - RNA, 15 nt, Salmonella enterica enterica serovar Typhi
ggugcagaccucugc

SEQ ID NO: 3617867 - RNA, 16 nt, Salmonella enterica enterica serovar Typhi
ggugcagaccucugca

SEQ ID NO: 3617868 - RNA, 17 nt, Salmonella enterica enterica serovar Typhi
ggugcagcccgucggcg

SEQ ID NO: 3617869 - RNA, 23 nt, Salmonella enterica enterica serovar Typhi
ggugcauuuuuaucaucugcaug

SEQ ID NO: 3617870 - RNA, 17 nt, Salmonella enterica enterica serovar Typhi
ggugccauuccagccgg

SEQ ID NO: 3617871 - RNA, 17 nt, Salmonella enterica enterica serovar Typhi
ggugcccgcaaaaccuu

SEQ ID NO: 3617872 - RNA, 17 nt, Salmonella enterica enterica serovar Typhi
ggugccgaaaucaucaa

SEQ ID NO: 3617873 - RNA, 15 nt, Salmonella enterica enterica serovar Typhi
ggugccgacgccagc

SEQ ID NO: 3617874 - RNA, 14 nt, Salmonella enterica enterica serovar Typhi
ggugcgacgccaga

SEQ ID NO: 3617875 - RNA, 15 nt, Salmonella enterica enterica serovar Typhi
ggugcgcagccccag

SEQ ID NO: 3617876 - RNA, 20 nt, Salmonella enterica enterica serovar Typhi
ggugcgcagccccagcgcca

SEQ ID NO: 3617877 - RNA, 14 nt, Salmonella enterica enterica serovar Typhi
ggugcgccccagca

SEQ ID NO: 3617878 - RNA, 16 nt, Salmonella enterica enterica serovar Typhi
ggugcgccccagcaug

SEQ ID NO: 3617879 - RNA, 22 nt, Salmonella enterica enterica serovar Typhi
ggugcguccgguagagaacgaa

SEQ ID NO: 3617880 - RNA, 14 nt, Salmonella enterica enterica serovar Typhi
ggugcucaauaaaa

SEQ ID NO: 3617881 - RNA, 17 nt, Salmonella enterica enterica serovar Typhi
ggugcucucccagcuga

SEQ ID NO: 3617882 - RNA, 20 nt, Salmonella enterica enterica serovar Typhi
ggugcuguagcugcccggau

SEQ ID NO: 3617883 - RNA, 18 nt, Salmonella enterica enterica serovar Typhi
ggugcuuagcuggccaau

SEQ ID NO: 3617884 - RNA, 13 nt, Salmonella enterica enterica serovar Typhi
ggugcuuaucuga

SEQ ID NO: 3617885 - RNA, 18 nt, Salmonella enterica enterica serovar Typhi
gguggaucccccuggccc

SEQ ID NO: 3617886 - RNA, 14 nt, Salmonella enterica enterica serovar Typhi
gguggccgggggcg

SEQ ID NO: 3617887 - RNA, 19 nt, Salmonella enterica enterica serovar Typhi
guaaacucacccaggcgau

SEQ ID NO: 3617888 - RNA, 16 nt, Salmonella enterica enterica serovar Typhi
guaaacuuccgccagc

SEQ ID NO: 3617889 - RNA, 22 nt, Salmonella enterica enterica serovar Typhi
guaaagacaccguucuggcugc

SEQ ID NO: 3617890 - RNA, 18 nt, Salmonella enterica enterica serovar Typhi
guaaagaccgggcgcggu

SEQ ID NO: 3617891 - RNA, 22 nt, Salmonella enterica enterica serovar Typhi
guaaagauuuguuucaucgccu

SEQ ID NO: 3617892 - RNA, 18 nt, Salmonella enterica enterica serovar Typhi
guaaagcaccaucgcaaa

SEQ ID NO: 3617893 - RNA, 14 nt, Salmonella enterica enterica serovar Typhi
guaaagcagugcag

SEQ ID NO: 3617894 - RNA, 14 nt, Salmonella enterica enterica serovar Typhi
guaaagcauggcug

SEQ ID NO: 3617895 - RNA, 21 nt, Salmonella enterica enterica serovar Typhi
guaaagccgccauccggcauu

SEQ ID NO: 3617896 - RNA, 19 nt, Salmonella enterica enterica serovar Typhi
guaaaggcguagaucucua

SEQ ID NO: 3617897 - RNA, 16 nt, Salmonella enterica enterica serovar Typhi
guaaaggggagcccag

SEQ ID NO: 3617898 - RNA, 22 nt, Salmonella enterica enterica serovar Typhi
guaaauagaaaauaauucuuaa

SEQ ID NO: 3617899 - RNA, 13 nt, Salmonella enterica enterica serovar Typhi
guaaauagcccgg

SEQ ID NO: 3617900 - RNA, 17 nt, Salmonella enterica enterica serovar Typhi
guaaaucagaauaccgc

SEQ ID NO: 3617901 - RNA, 22 nt, Salmonella enterica enterica serovar Typhi
guaaaucauuuguacaaaaaau

SEQ ID NO: 3617902 - RNA, 21 nt, Salmonella enterica enterica serovar Typhi
guaaaucgcgagccuucaaca

SEQ ID NO: 3617903 - RNA, 22 nt, Salmonella enterica enterica serovar Typhi
guaaaucugccgucaucgacuu

SEQ ID NO: 3617904 - RNA, 16 nt, Salmonella enterica enterica serovar Typhi
guaaaugacgccagac

SEQ ID NO: 3617905 - RNA, 20 nt, Salmonella enterica enterica serovar Typhi
guaaaugccacuauagauga

SEQ ID NO: 3617906 - RNA, 19 nt, Salmonella enterica enterica serovar Typhi
guaaaugccuuauccggcc

SEQ ID NO: 3617907 - RNA, 21 nt, Salmonella enterica enterica serovar Typhi
guaaauucucuauacugcuga

SEQ ID NO: 3617908 - RNA, 14 nt, Salmonella enterica enterica serovar Typhi
guaaauugacugga

SEQ ID NO: 3617909 - RNA, 13 nt, Salmonella enterica enterica serovar Typhi
guaaauuuauggu

SEQ ID NO: 3617910 - RNA, 16 nt, Salmonella enterica enterica serovar Typhi
guaaauuuaugguucc

SEQ ID NO: 3617911 - RNA, 20 nt, Salmonella enterica enterica serovar Typhi
guaaauuucaacccgaucgc

SEQ ID NO: 3617912 - RNA, 23 nt, Salmonella enterica enterica serovar Typhi
guaaauuucaacccgaucgccau

SEQ ID NO: 3617913 - RNA, 18 nt, Salmonella enterica enterica serovar Typhi
guaacaacuguuuuucac

SEQ ID NO: 3617914 - RNA, 14 nt, Salmonella enterica enterica serovar Typhi
guaacacaaucagg

SEQ ID NO: 3617915 - RNA, 16 nt, Salmonella enterica enterica serovar Typhi
guaacaggcaccagcg

SEQ ID NO: 3617916 - RNA, 18 nt, Salmonella enterica enterica serovar Typhi
guaacaguauccgacgca

SEQ ID NO: 3617917 - RNA, 17 nt, Salmonella enterica enterica serovar Typhi
guaacauacaaaaagua

SEQ ID NO: 3617918 - RNA, 14 nt, Salmonella enterica enterica serovar Typhi
guaacauauuuuua

SEQ ID NO: 3617919 - RNA, 20 nt, Salmonella enterica enterica serovar Typhi
guaacauccuggguuugcug

SEQ ID NO: 3617920 - RNA, 16 nt, Salmonella enterica enterica serovar Typhi
guaaccagucguuauc

SEQ ID NO: 3617921 - RNA, 17 nt, Salmonella enterica enterica serovar Typhi
guaacccgauacccuga

SEQ ID NO: 3617922 - RNA, 23 nt, Salmonella enterica enterica serovar Typhi
guaaccgaacuggguaugcagug

SEQ ID NO: 3617923 - RNA, 18 nt, Salmonella enterica enterica serovar Typhi
guaaccgcaaaugccauc

SEQ ID NO: 3617924 - RNA, 14 nt, Salmonella enterica enterica serovar Typhi
guaaccgccacagc

SEQ ID NO: 3617925 - RNA, 15 nt, Salmonella enterica enterica serovar Typhi
guaaccgccacagca

SEQ ID NO: 3617926 - RNA, 18 nt, Salmonella enterica enterica serovar Typhi
guaaccuauuuuacaaaa

SEQ ID NO: 3617927 - RNA, 16 nt, Salmonella enterica enterica serovar Typhi
guaacgauaaaaugca

SEQ ID NO: 3617928 - RNA, 14 nt, Salmonella enterica enterica serovar Typhi
guaacgccuccacc

SEQ ID NO: 3617929 - RNA, 16 nt, Salmonella enterica enterica serovar Typhi
guaacgccuuugcccg

SEQ ID NO: 3617930 - RNA, 15 nt, Salmonella enterica enterica serovar Typhi
guaacgcucuuaccg

SEQ ID NO: 3617931 - RNA, 16 nt, Salmonella enterica enterica serovar Typhi
guaacggacucaggcc

SEQ ID NO: 3617932 - RNA, 18 nt, Salmonella enterica enterica serovar Typhi
guaacggacucaggccuu

SEQ ID NO: 3617933 - RNA, 17 nt, Salmonella enterica enterica serovar Typhi
guaacgggcaucgccgc

SEQ ID NO: 3617934 - RNA, 21 nt, Salmonella enterica enterica serovar Typhi
guaacgguguuucaucuucau

SEQ ID NO: 3617935 - RNA, 17 nt, Salmonella enterica enterica serovar Typhi
guaacguaaauacccag

SEQ ID NO: 3617936 - RNA, 14 nt, Salmonella enterica enterica serovar Typhi
guaacuauuucuau

SEQ ID NO: 3617937 - RNA, 21 nt, Salmonella enterica enterica serovar Typhi
guaacugcaccuuuuuuucca

SEQ ID NO: 3617938 - RNA, 23 nt, Salmonella enterica enterica serovar Typhi
guaacugcaccuuuuuuuccagc

SEQ ID NO: 3617939 - RNA, 18 nt, Salmonella enterica enterica serovar Typhi
guaacugcgguaaauaau

SEQ ID NO: 3617940 - RNA, 14 nt, Salmonella enterica enterica serovar Typhi
guaacugucagauc

SEQ ID NO: 3617941 - RNA, 14 nt, Salmonella enterica enterica serovar Typhi
guaacuucacgcca

SEQ ID NO: 3617942 - RNA, 17 nt, Salmonella enterica enterica serovar Typhi
guaacuucacgccaucg

SEQ ID NO: 3617943 - RNA, 18 nt, Salmonella enterica enterica serovar Typhi
guaagaaaaacagcgaga

SEQ ID NO: 3617944 - RNA, 21 nt, Salmonella enterica enterica serovar Typhi
guaagaagaaccagcgcgaca

SEQ ID NO: 3617945 - RNA, 17 nt, Salmonella enterica enterica serovar Typhi
guaagaaugcgcgucag

SEQ ID NO: 3617946 - RNA, 22 nt, Salmonella enterica enterica serovar Typhi
guaagaauuauuaccaaugagc

SEQ ID NO: 3617947 - RNA, 15 nt, Salmonella enterica enterica serovar Typhi
guaagagagccuuac

SEQ ID NO: 3617948 - RNA, 20 nt, Salmonella enterica enterica serovar Typhi
guaagagagccuuacaggcg

SEQ ID NO: 3617949 - RNA, 17 nt, Salmonella enterica enterica serovar Typhi
guaagagcguuacccag

SEQ ID NO: 3617950 - RNA, 19 nt, Salmonella enterica enterica serovar Typhi
guaagagcguuacccagac

SEQ ID NO: 3617951 - RNA, 19 nt, Salmonella enterica enterica serovar Typhi
guaagaucccagggcggcg

SEQ ID NO: 3617952 - RNA, 14 nt, Salmonella enterica enterica serovar Typhi
guaagcacaacgca

SEQ ID NO: 3617953 - RNA, 22 nt, Salmonella enterica enterica serovar Typhi
guaagcauagcgccuucaggca

SEQ ID NO: 3617954 - RNA, 23 nt, Salmonella enterica enterica serovar Typhi
guaagcccauggcaggcagcaca

SEQ ID NO: 3617955 - RNA, 15 nt, Salmonella enterica enterica serovar Typhi
guaagcgccugcugc

SEQ ID NO: 3617956 - RNA, 19 nt, Salmonella enterica enterica serovar Typhi
guaagcguagcgccguccg

SEQ ID NO: 3617957 - RNA, 15 nt, Salmonella enterica enterica serovar Typhi
guaagcuauuacaaa

SEQ ID NO: 3617958 - RNA, 16 nt, Salmonella enterica enterica serovar Typhi
guaagcuauuacaaaa

SEQ ID NO: 3617959 - RNA, 16 nt, Salmonella enterica enterica serovar Typhi
guaagcuauuccugua

SEQ ID NO: 3617960 - RNA, 13 nt, Salmonella enterica enterica serovar Typhi
guaaggcagcgau

SEQ ID NO: 3617961 - RNA, 20 nt, Salmonella enterica enterica serovar Typhi
guaaggcauuaauauccagu

SEQ ID NO: 3617962 - RNA, 21 nt, Salmonella enterica enterica serovar Typhi
guaagggaggugcucucccag

SEQ ID NO: 3617963 - RNA, 22 nt, Salmonella enterica enterica serovar Typhi
guaagggcuggaaaaucacgcu

SEQ ID NO: 3617964 - RNA, 13 nt, Salmonella enterica enterica serovar Typhi
guaagguccaggg

SEQ ID NO: 3617965 - RNA, 14 nt, Salmonella enterica enterica serovar Typhi
guaagucgaccagu

SEQ ID NO: 3617966 - RNA, 19 nt, Salmonella enterica enterica serovar Typhi
guaagucgccgcagcucca

SEQ ID NO: 3617967 - RNA, 17 nt, Salmonella enterica enterica serovar Typhi
guaaguuaaaacgccau

SEQ ID NO: 3617968 - RNA, 22 nt, Salmonella enterica enterica serovar Typhi
guaaguuugcguacucagcaga

SEQ ID NO: 3617969 - RNA, 15 nt, Salmonella enterica enterica serovar Typhi
guaauaaagcguagc

SEQ ID NO: 3617970 - RNA, 21 nt, Salmonella enterica enterica serovar Typhi
guaauaacaaaaaacauauau

SEQ ID NO: 3617971 - RNA, 23 nt, Salmonella enterica enterica serovar Typhi
guaauaacaaaaaacauauaucu

SEQ ID NO: 3617972 - RNA, 17 nt, Salmonella enterica enterica serovar Typhi
guacgcgacugaucagg

SEQ ID NO: 3617973 - RNA, 20 nt, Salmonella enterica enterica serovar Typhi
guacgcgcaaccgcaucacg

SEQ ID NO: 3617974 - RNA, 22 nt, Salmonella enterica enterica serovar Typhi
guacgcgcgucguauaugccaa

SEQ ID NO: 3617975 - RNA, 15 nt, Salmonella enterica enterica serovar Typhi
guacgcggucgccug

SEQ ID NO: 3617976 - RNA, 18 nt, Salmonella enterica enterica serovar Typhi
guacgcuuuggcaggccu

SEQ ID NO: 3617977 - RNA, 14 nt, Salmonella enterica enterica serovar Typhi
guacggauauuggc

SEQ ID NO: 3617978 - RNA, 14 nt, Salmonella enterica enterica serovar Typhi
guacggauggcguc

SEQ ID NO: 3617979 - RNA, 18 nt, Salmonella enterica enterica serovar Typhi
guacggccaccaggccug

SEQ ID NO: 3617980 - RNA, 13 nt, Salmonella enterica enterica serovar Typhi
guacggcgcgcca

SEQ ID NO: 3617981 - RNA, 23 nt, Salmonella enterica enterica serovar Typhi
guacggcuuucuuucuccagcgu

SEQ ID NO: 3617982 - RNA, 16 nt, Salmonella enterica enterica serovar Typhi
guacgggcaaagcgac

SEQ ID NO: 3617983 - RNA, 18 nt, Salmonella enterica enterica serovar Typhi
guacggguauuccagggc

SEQ ID NO: 3617984 - RNA, 18 nt, Salmonella enterica enterica serovar Typhi
guacguaaugugaaaaac

SEQ ID NO: 3617985 - RNA, 15 nt, Salmonella enterica enterica serovar Typhi
guacgucgcauacuu

SEQ ID NO: 3617986 - RNA, 20 nt, Salmonella enterica enterica serovar Typhi
guacgucggauggccgguua

SEQ ID NO: 3617987 - RNA, 18 nt, Salmonella enterica enterica serovar Typhi
guacucaccaguccggca

SEQ ID NO: 3617988 - RNA, 16 nt, Salmonella enterica enterica serovar Typhi
guacucuaggcgcugc

SEQ ID NO: 3617989 - RNA, 16 nt, Salmonella enterica enterica serovar Typhi
guacucuuccagcugc

SEQ ID NO: 3617990 - RNA, 22 nt, Salmonella enterica enterica serovar Typhi
guacuggaucaccugaaugcaa

SEQ ID NO: 3617991 - RNA, 22 nt, Salmonella enterica enterica serovar Typhi
guacuucagcauacaggucuuu

SEQ ID NO: 3617992 - RNA, 13 nt, Salmonella enterica enterica serovar Typhi
guacuuucaaaua

SEQ ID NO: 3617993 - RNA, 22 nt, Salmonella enterica enterica serovar Typhi
guacuuucacuaccacuuucuu

SEQ ID NO: 3617994 - RNA, 15 nt, Salmonella enterica enterica serovar Typhi
guacuuucuacaaau

SEQ ID NO: 3617995 - RNA, 22 nt, Salmonella enterica enterica serovar Typhi
guacuuuucauccacagcgcca

SEQ ID NO: 3617996 - RNA, 16 nt, Salmonella enterica enterica serovar Typhi
guagaaaaagguaacu

SEQ ID NO: 3617997 - RNA, 21 nt, Salmonella enterica enterica serovar Typhi
guagaacaccacgcgaccaug

SEQ ID NO: 3617998 - RNA, 24 nt, Salmonella enterica enterica serovar Typhi
guagaacguauuauuauuacgcau

SEQ ID NO: 3617999 - RNA, 22 nt, Salmonella enterica enterica serovar Typhi
guagacccggcauugaaacgca

SEQ ID NO: 3618000 - RNA, 21 nt, Salmonella enterica enterica serovar Typhi
guagacuggguaagcgcagcg

SEQ ID NO: 3618001 - RNA, 19 nt, Salmonella enterica enterica serovar Typhi
guagagcaucgcggcauca

SEQ ID NO: 3618002 - RNA, 14 nt, Salmonella enterica enterica serovar Typhi
guagauaagcgcca

SEQ ID NO: 3618003 - RNA, 21 nt, Salmonella enterica enterica serovar Typhi
guagauacugaccaagcguca

SEQ ID NO: 3618004 - RNA, 12 nt, Salmonella enterica enterica serovar Typhi
guagaucaccag

SEQ ID NO: 3618005 - RNA, 16 nt, Salmonella enterica enterica serovar Typhi
guagaucacgccagcg

SEQ ID NO: 3618006 - RNA, 12 nt, Salmonella enterica enterica serovar Typhi
guagaucgccag

SEQ ID NO: 3618007 - RNA, 20 nt, Salmonella enterica enterica serovar Typhi
guagauggcgcuaaaaccgu

SEQ ID NO: 3618008 - RNA, 23 nt, Salmonella enterica enterica serovar Typhi
guagcaacccuggcgcuuuaaac

SEQ ID NO: 3618009 - RNA, 15 nt, Salmonella enterica enterica serovar Typhi
guagcacaucgcugg

SEQ ID NO: 3618010 - RNA, 19 nt, Salmonella enterica enterica serovar Typhi
guagcagacagccgaucag

SEQ ID NO: 3618011 - RNA, 12 nt, Salmonella enterica enterica serovar Typhi
guagcagcgcca

SEQ ID NO: 3618012 - RNA, 14 nt, Salmonella enterica enterica serovar Typhi
guagcagcgccagc

SEQ ID NO: 3618013 - RNA, 17 nt, Salmonella enterica enterica serovar Typhi
guagcaguggagaggcc

SEQ ID NO: 3618014 - RNA, 14 nt, Salmonella enterica enterica serovar Typhi
guagcauaaucagg

SEQ ID NO: 3618015 - RNA, 20 nt, Salmonella enterica enterica serovar Typhi
guagccaaaauuuacgggga

SEQ ID NO: 3618016 - RNA, 12 nt, Salmonella enterica enterica serovar Typhi
guagccacagcg

SEQ ID NO: 3618017 - RNA, 17 nt, Salmonella enterica enterica serovar Typhi
guagccacgcccgccgc

SEQ ID NO: 3618018 - RNA, 19 nt, Salmonella enterica enterica serovar Typhi
guagccacgcccgccgccu

SEQ ID NO: 3618019 - RNA, 20 nt, Salmonella enterica enterica serovar Typhi
guagccagagcgcgcuggca

SEQ ID NO: 3618020 - RNA, 23 nt, Salmonella enterica enterica serovar Typhi
guagccagccaaacaauaucccg

SEQ ID NO: 3618021 - RNA, 18 nt, Salmonella enterica enterica serovar Typhi
guagcccagcgccgcauc

SEQ ID NO: 3618022 - RNA, 15 nt, Salmonella enterica enterica serovar Typhi
guagccccuaucugg

SEQ ID NO: 3618023 - RNA, 16 nt, Salmonella enterica enterica serovar Typhi
guagcccgcuuuaccg

SEQ ID NO: 3618024 - RNA, 20 nt, Salmonella enterica enterica serovar Typhi
guagccgcagaaccauuucc

SEQ ID NO: 3618025 - RNA, 17 nt, Salmonella enterica enterica serovar Typhi
guagccgcgcgccgccu

SEQ ID NO: 3618026 - RNA, 14 nt, Salmonella enterica enterica serovar Typhi
guagcgacugauaa

SEQ ID NO: 3618027 - RNA, 20 nt, Salmonella enterica enterica serovar Typhi
guagcgagaagccgauggaa

SEQ ID NO: 3618028 - RNA, 16 nt, Salmonella enterica enterica serovar Typhi
guagcgccaucaggca

SEQ ID NO: 3618029 - RNA, 17 nt, Salmonella enterica enterica serovar Typhi
guagcgccaucaggcau

SEQ ID NO: 3618030 - RNA, 21 nt, Salmonella enterica enterica serovar Typhi
guagcgccugugcuuucgcca

SEQ ID NO: 3618031 - RNA, 13 nt, Salmonella enterica enterica serovar Typhi
guagcgcgcgcua

SEQ ID NO: 3618032 - RNA, 14 nt, Salmonella enterica enterica serovar Typhi
guagcgcggcagcg

SEQ ID NO: 3618033 - RNA, 20 nt, Salmonella enterica enterica serovar Typhi
guagcggaaccagccaugcc

SEQ ID NO: 3618034 - RNA, 19 nt, Salmonella enterica enterica serovar Typhi
guagcggauugccgcgcuc

SEQ ID NO: 3618035 - RNA, 21 nt, Salmonella enterica enterica serovar Typhi
guagcggcaacagcaccagaa

SEQ ID NO: 3618036 - RNA, 20 nt, Salmonella enterica enterica serovar Typhi
guagcgucaauacaccucgg

SEQ ID NO: 3618037 - RNA, 20 nt, Salmonella enterica enterica serovar Typhi
guagcucaagcccgcgucgu

SEQ ID NO: 3618038 - RNA, 17 nt, Salmonella enterica enterica serovar Typhi
guagcuccagacaggac

SEQ ID NO: 3618039 - RNA, 14 nt, Salmonella enterica enterica serovar Typhi
guagcuccagaccu

SEQ ID NO: 3618040 - RNA, 16 nt, Salmonella enterica enterica serovar Typhi
guagcugagcgucagg

SEQ ID NO: 3618041 - RNA, 14 nt, Salmonella enterica enterica serovar Typhi
guagcuggcugccg

SEQ ID NO: 3618042 - RNA, 14 nt, Salmonella enterica enterica serovar Typhi
guagcuucugucug

SEQ ID NO: 3618043 - RNA, 16 nt, Salmonella enterica enterica serovar Typhi
guagcuugaaagcgca

SEQ ID NO: 3618044 - RNA, 18 nt, Salmonella enterica enterica serovar Typhi
guagcuugaaagcgcaaa

SEQ ID NO: 3618045 - RNA, 16 nt, Salmonella enterica enterica serovar Typhi
guagcuuuuccgcugg

SEQ ID NO: 3618046 - RNA, 21 nt, Salmonella enterica enterica serovar Typhi
guaggcccgguaagcgcagcg

SEQ ID NO: 3618047 - RNA, 13 nt, Salmonella enterica enterica serovar Typhi
guaggccggauaa

SEQ ID NO: 3618048 - RNA, 18 nt, Salmonella enterica enterica serovar Typhi
guaggccggauaaggcau

SEQ ID NO: 3618049 - RNA, 19 nt, Salmonella enterica enterica serovar Typhi
guaggccggauaaggcauu

SEQ ID NO: 3618050 - RNA, 15 nt, Salmonella enterica enterica serovar Typhi
guaggccggaucagg

SEQ ID NO: 3618051 - RNA, 19 nt, Salmonella enterica enterica serovar Typhi
guaggccugauaagcgcag

SEQ ID NO: 3618052 - RNA, 19 nt, Salmonella enterica enterica serovar Typhi
guaggccugauaagcguag

SEQ ID NO: 3618053 - RNA, 13 nt, Salmonella enterica enterica serovar Typhi
guaggcuucaacc

SEQ ID NO: 3618054 - RNA, 18 nt, Salmonella enterica enterica serovar Typhi
guagggcugccaucaggc

SEQ ID NO: 3618055 - RNA, 21 nt, Salmonella enterica enterica serovar Typhi
guagggcugccaucaggcagu

SEQ ID NO: 3618056 - RNA, 15 nt, Salmonella enterica enterica serovar Typhi
guaggguacagcgcg

SEQ ID NO: 3618057 - RNA, 18 nt, Salmonella enterica enterica serovar Typhi
guaggguagaucacgcca

SEQ ID NO: 3618058 - RNA, 21 nt, Salmonella enterica enterica serovar Typhi
gucaaauucacccguuauuca

SEQ ID NO: 3618059 - RNA, 18 nt, Salmonella enterica enterica serovar Typhi
gucaacaaugcuuucacc

SEQ ID NO: 3618060 - RNA, 16 nt, Salmonella enterica enterica serovar Typhi
gucaacacgcagaccc

SEQ ID NO: 3618061 - RNA, 22 nt, Salmonella enterica enterica serovar Typhi
gucaacauagcuauauuuagcc

SEQ ID NO: 3618062 - RNA, 16 nt, Salmonella enterica enterica serovar Typhi
gucaaccaugaucacu

SEQ ID NO: 3618063 - RNA, 22 nt, Salmonella enterica enterica serovar Typhi
gucaacgaggugaauaaauccu

SEQ ID NO: 3618064 - RNA, 23 nt, Salmonella enterica enterica serovar Typhi
gucaacgcacuguaacgcacugg

SEQ ID NO: 3618065 - RNA, 16 nt, Salmonella enterica enterica serovar Typhi
gucaacgccaagcgcg

SEQ ID NO: 3618066 - RNA, 21 nt, Salmonella enterica enterica serovar Typhi
gucaacguccaguucguucug

SEQ ID NO: 3618067 - RNA, 16 nt, Salmonella enterica enterica serovar Typhi
gucaacucgcacagua

SEQ ID NO: 3618068 - RNA, 17 nt, Salmonella enterica enterica serovar Typhi
gucaacugcucuaccaa

SEQ ID NO: 3618069 - RNA, 16 nt, Salmonella enterica enterica serovar Typhi
gucaagaucccucacc

SEQ ID NO: 3618070 - RNA, 21 nt, Salmonella enterica enterica serovar Typhi
gucaagaucgcgcagcaggcc

SEQ ID NO: 3618071 - RNA, 14 nt, Salmonella enterica enterica serovar Typhi
gucaauaagccaga

SEQ ID NO: 3618072 - RNA, 20 nt, Salmonella enterica enterica serovar Typhi
gucaauaagugauccauacu

SEQ ID NO: 3618073 - RNA, 16 nt, Salmonella enterica enterica serovar Typhi
gucaauauuaaugcug

SEQ ID NO: 3618074 - RNA, 12 nt, Salmonella enterica enterica serovar Typhi
gucaaucaucag

SEQ ID NO: 3618075 - RNA, 15 nt, Salmonella enterica enterica serovar Typhi
gucaaugaucaguuu

SEQ ID NO: 3618076 - RNA, 19 nt, Salmonella enterica enterica serovar Typhi
gucaaugaucaguuugucg

SEQ ID NO: 3618077 - RNA, 17 nt, Salmonella enterica enterica serovar Typhi
gucaaugccuggcagac

SEQ ID NO: 3618078 - RNA, 15 nt, Salmonella enterica enterica serovar Typhi
gucaauggcgcuguc

SEQ ID NO: 3618079 - RNA, 20 nt, Salmonella enterica enterica serovar Typhi
gucaauggcgcugucggcgc

SEQ ID NO: 3618080 - RNA, 20 nt, Salmonella enterica enterica serovar Typhi
gucacaaaggccagcagcag

SEQ ID NO: 3618081 - RNA, 21 nt, Salmonella enterica enterica serovar Typhi
gucacaaucguucucaggaag

SEQ ID NO: 3618082 - RNA, 17 nt, Salmonella enterica enterica serovar Typhi
gucacagauccagacau

SEQ ID NO: 3618083 - RNA, 12 nt, Salmonella enterica enterica serovar Typhi
gucacauccaga

SEQ ID NO: 3618084 - RNA, 14 nt, Salmonella enterica enterica serovar Typhi
gucacauccagaca

SEQ ID NO: 3618085 - RNA, 20 nt, Salmonella enterica enterica serovar Typhi
gucacauggcgaaaaucacu

SEQ ID NO: 3618086 - RNA, 19 nt, Salmonella enterica enterica serovar Typhi
gucacccgccggcagcagc

SEQ ID NO: 3618087 - RNA, 20 nt, Salmonella enterica enterica serovar Typhi
gucacccgccggcagcagcu

SEQ ID NO: 3618088 - RNA, 17 nt, Salmonella enterica enterica serovar Typhi
gucacccgcguaucauu

SEQ ID NO: 3618089 - RNA, 22 nt, Salmonella enterica enterica serovar Typhi
gucacccgcuuuuccuguucug

SEQ ID NO: 3618090 - RNA, 18 nt, Salmonella enterica enterica serovar Typhi
gucaccgaauagcgacaa

SEQ ID NO: 3618091 - RNA, 14 nt, Salmonella enterica enterica serovar Typhi
gucaccgggcgcug

SEQ ID NO: 3618092 - RNA, 18 nt, Salmonella enterica enterica serovar Typhi
gucaccucuuucgccgcu

SEQ ID NO: 3618093 - RNA, 15 nt, Salmonella enterica enterica serovar Typhi
gucaccugauagcgg

SEQ ID NO: 3618094 - RNA, 19 nt, Salmonella enterica enterica serovar Typhi
gucacgauaaccaggucac

SEQ ID NO: 3618095 - RNA, 13 nt, Salmonella enterica enterica serovar Typhi
gucacgauagcgc

SEQ ID NO: 3618096 - RNA, 16 nt, Salmonella enterica enterica serovar Typhi
gucacgauccgcaaau

SEQ ID NO: 3618097 - RNA, 22 nt, Salmonella enterica enterica serovar Typhi
gucacgcaugucguauccccag

SEQ ID NO: 3618098 - RNA, 20 nt, Salmonella enterica enterica serovar Typhi
gucacgccggguacauauac

SEQ ID NO: 3618099 - RNA, 18 nt, Salmonella enterica enterica serovar Typhi
gucacgcgcaaagcugcg

SEQ ID NO: 3618100 - RNA, 17 nt, Salmonella enterica enterica serovar Typhi
gucacguucgucgccgg

SEQ ID NO: 3618101 - RNA, 18 nt, Salmonella enterica enterica serovar Typhi
gucacuccggcugcacca

SEQ ID NO: 3618102 - RNA, 20 nt, Salmonella enterica enterica serovar Typhi
gucacugaccggcguuuuua

SEQ ID NO: 3618103 - RNA, 19 nt, Salmonella enterica enterica serovar Typhi
gucacuuacuuucuugcca

SEQ ID NO: 3618104 - RNA, 16 nt, Salmonella enterica enterica serovar Typhi
gucacuucaaccuuua

SEQ ID NO: 3618105 - RNA, 23 nt, Salmonella enterica enterica serovar Typhi
gucacuucaaccuuuaucuguug

SEQ ID NO: 3618106 - RNA, 17 nt, Salmonella enterica enterica serovar Typhi
gucagaggaauucucca

SEQ ID NO: 3618107 - RNA, 13 nt, Salmonella enterica enterica serovar Typhi
gucagcaagauua

SEQ ID NO: 3618108 - RNA, 15 nt, Salmonella enterica enterica serovar Typhi
gucagcaauuaacaa

SEQ ID NO: 3618109 - RNA, 14 nt, Salmonella enterica enterica serovar Typhi
gucagcagcaccgg

SEQ ID NO: 3618110 - RNA, 11 nt, Salmonella enterica enterica serovar Typhi
gucagcaucaa

SEQ ID NO: 3618111 - RNA, 16 nt, Salmonella enterica enterica serovar Typhi
gucagcauuucaucca

SEQ ID NO: 3618112 - RNA, 19 nt, Salmonella enterica enterica serovar Typhi
gucagccacgguucacggc

SEQ ID NO: 3618113 - RNA, 12 nt, Salmonella enterica enterica serovar Typhi
gucagccuugac

SEQ ID NO: 3618114 - RNA, 14 nt, Salmonella enterica enterica serovar Typhi
gucagcgcgagcgu

SEQ ID NO: 3618115 - RNA, 16 nt, Salmonella enterica enterica serovar Typhi
gucagcgcggcuucca

SEQ ID NO: 3618116 - RNA, 21 nt, Salmonella enterica enterica serovar Typhi
gucagcgggguucagaccaga

SEQ ID NO: 3618117 - RNA, 16 nt, Salmonella enterica enterica serovar Typhi
gucagcucacgcgcca

SEQ ID NO: 3618118 - RNA, 13 nt, Salmonella enterica enterica serovar Typhi
gucagcuuccugc

SEQ ID NO: 3618119 - RNA, 22 nt, Salmonella enterica enterica serovar Typhi
gucaggaagcggacuaccugcc

SEQ ID NO: 3618120 - RNA, 22 nt, Salmonella enterica enterica serovar Typhi
gucaggauaaaauccugcacgc

SEQ ID NO: 3618121 - RNA, 13 nt, Salmonella enterica enterica serovar Typhi
gucaggaugcuga

SEQ ID NO: 3618122 - RNA, 22 nt, Salmonella enterica enterica serovar Typhi
gucaggaugggcuucuucacua

SEQ ID NO: 3618123 - RNA, 12 nt, Salmonella enterica enterica serovar Typhi
gucaggcaacag

SEQ ID NO: 3618124 - RNA, 15 nt, Salmonella enterica enterica serovar Typhi
gucaggcagaaauaa

SEQ ID NO: 3618125 - RNA, 19 nt, Salmonella enterica enterica serovar Typhi
gucaggccacugcccugga

SEQ ID NO: 3618126 - RNA, 22 nt, Salmonella enterica enterica serovar Typhi
gucaggccacugcccuggaaga

SEQ ID NO: 3618127 - RNA, 20 nt, Salmonella enterica enterica serovar Typhi
gucaggccgccgcacaggcg

SEQ ID NO: 3618128 - RNA, 13 nt, Salmonella enterica enterica serovar Typhi
gucaggcggcugc

SEQ ID NO: 3618129 - RNA, 12 nt, Salmonella enterica enterica serovar Typhi
gucaggcuaaau

SEQ ID NO: 3618130 - RNA, 15 nt, Salmonella enterica enterica serovar Typhi
gucaggcucuaauaa

SEQ ID NO: 3618131 - RNA, 14 nt, Salmonella enterica enterica serovar Typhi
gucagggcaaggcg

SEQ ID NO: 3618132 - RNA, 15 nt, Salmonella enterica enterica serovar Typhi
gucagggcgcggcgc

SEQ ID NO: 3618133 - RNA, 16 nt, Salmonella enterica enterica serovar Typhi
gucagggcgcggcgca

SEQ ID NO: 3618134 - RNA, 21 nt, Salmonella enterica enterica serovar Typhi
gucagggcgcggcgcaacuuu

SEQ ID NO: 3618135 - RNA, 23 nt, Salmonella enterica enterica serovar Typhi
gucagggcgcggcgcaacuuuuu

SEQ ID NO: 3618136 - RNA, 19 nt, Salmonella enterica enterica serovar Typhi
gucagggugaauaccagcg

SEQ ID NO: 3618137 - RNA, 21 nt, Salmonella enterica enterica serovar Typhi
gucagggugaauaccagcggc

SEQ ID NO: 3618138 - RNA, 19 nt, Salmonella enterica enterica serovar Typhi
gucaguagcguucuuucca

SEQ ID NO: 3618139 - RNA, 14 nt, Salmonella enterica enterica serovar Typhi
gucaguccaccugu

SEQ ID NO: 3618140 - RNA, 12 nt, Salmonella enterica enterica serovar Typhi
gucaguuccaua

SEQ ID NO: 3618141 - RNA, 12 nt, Salmonella enterica enterica serovar Typhi
gucauaaaacug

SEQ ID NO: 3618142 - RNA, 22 nt, Salmonella enterica enterica serovar Typhi
gucauaaauacacgaggccacg

SEQ ID NO: 3618143 - RNA, 14 nt, Salmonella enterica enterica serovar Typhi
gucauaaucgccgu

SEQ ID NO: 3618144 - RNA, 15 nt, Salmonella enterica enterica serovar Typhi
guccggcaucgugau

SEQ ID NO: 3618145 - RNA, 17 nt, Salmonella enterica enterica serovar Typhi
guccggccccaaacugg

SEQ ID NO: 3618146 - RNA, 23 nt, Salmonella enterica enterica serovar Typhi
guccggcgaacaaacucuuucac

SEQ ID NO: 3618147 - RNA, 20 nt, Salmonella enterica enterica serovar Typhi
guccggcguuuuagcgccau

SEQ ID NO: 3618148 - RNA, 15 nt, Salmonella enterica enterica serovar Typhi
guccgggaaggacgc

SEQ ID NO: 3618149 - RNA, 17 nt, Salmonella enterica enterica serovar Typhi
guccggguucagcgaca

SEQ ID NO: 3618150 - RNA, 12 nt, Salmonella enterica enterica serovar Typhi
guccgguggcga

SEQ ID NO: 3618151 - RNA, 16 nt, Salmonella enterica enterica serovar Typhi
guccgguugcaguaca

SEQ ID NO: 3618152 - RNA, 20 nt, Salmonella enterica enterica serovar Typhi
guccgguugcaguacaggca

SEQ ID NO: 3618153 - RNA, 20 nt, Salmonella enterica enterica serovar Typhi
guccguuaccccuuuuucaa

SEQ ID NO: 3618154 - RNA, 21 nt, Salmonella enterica enterica serovar Typhi
guccucacacugauggcagac

SEQ ID NO: 3618155 - RNA, 14 nt, Salmonella enterica enterica serovar Typhi
guccuccaacgugc

SEQ ID NO: 3618156 - RNA, 17 nt, Salmonella enterica enterica serovar Typhi
guccuccaacgugcaga

SEQ ID NO: 3618157 - RNA, 22 nt, Salmonella enterica enterica serovar Typhi
guccucggcaacauaccgggua

SEQ ID NO: 3618158 - RNA, 14 nt, Salmonella enterica enterica serovar Typhi
guccugaucggcgg

SEQ ID NO: 3618159 - RNA, 16 nt, Salmonella enterica enterica serovar Typhi
guccugaucggcggcc

SEQ ID NO: 3618160 - RNA, 18 nt, Salmonella enterica enterica serovar Typhi
guccugccgcuacuccgc

SEQ ID NO: 3618161 - RNA, 16 nt, Salmonella enterica enterica serovar Typhi
guccugucccugccag

SEQ ID NO: 3618162 - RNA, 17 nt, Salmonella enterica enterica serovar Typhi
guccuucacaaacuucu

SEQ ID NO: 3618163 - RNA, 13 nt, Salmonella enterica enterica serovar Typhi
guccuucuccuuc

SEQ ID NO: 3618164 - RNA, 22 nt, Salmonella enterica enterica serovar Typhi
guccuuuacugcgccagccugc

SEQ ID NO: 3618165 - RNA, 23 nt, Salmonella enterica enterica serovar Typhi
gucgaagagcacuuugguaaaac

SEQ ID NO: 3618166 - RNA, 19 nt, Salmonella enterica enterica serovar Typhi
gucgaauuccgccugcugu

SEQ ID NO: 3618167 - RNA, 22 nt, Salmonella enterica enterica serovar Typhi
gucgacauaauuuccggccagu

SEQ ID NO: 3618168 - RNA, 19 nt, Salmonella enterica enterica serovar Typhi
gucgaccgcagaccggaug

SEQ ID NO: 3618169 - RNA, 17 nt, Salmonella enterica enterica serovar Typhi
gucgacgccuuccacuu

SEQ ID NO: 3618170 - RNA, 16 nt, Salmonella enterica enterica serovar Typhi
gucgacgucuuucuua

SEQ ID NO: 3618171 - RNA, 17 nt, Salmonella enterica enterica serovar Typhi
gucgacugguaggccug

SEQ ID NO: 3618172 - RNA, 18 nt, Salmonella enterica enterica serovar Typhi
gucgacugguaggccuga

SEQ ID NO: 3618173 - RNA, 19 nt, Salmonella enterica enterica serovar Typhi
gucgagaaaccgcucgccg

SEQ ID NO: 3618174 - RNA, 20 nt, Salmonella enterica enterica serovar Typhi
gucgagauacugcaacgcca

SEQ ID NO: 3618175 - RNA, 14 nt, Salmonella enterica enterica serovar Typhi
gucgaggaagcugc

SEQ ID NO: 3618176 - RNA, 17 nt, Salmonella enterica enterica serovar Typhi
gucgauaaaauccucua

SEQ ID NO: 3618177 - RNA, 16 nt, Salmonella enterica enterica serovar Typhi
gucgaucacgguggug

SEQ ID NO: 3618178 - RNA, 15 nt, Salmonella enterica enterica serovar Typhi
gucgaugauuuucaa

SEQ ID NO: 3618179 - RNA, 17 nt, Salmonella enterica enterica serovar Typhi
gucgaugauuuucaagc

SEQ ID NO: 3618180 - RNA, 16 nt, Salmonella enterica enterica serovar Typhi
gucgauuuugccuuca

SEQ ID NO: 3618181 - RNA, 18 nt, Salmonella enterica enterica serovar Typhi
gucgcaaucuggcgcaau

SEQ ID NO: 3618182 - RNA, 14 nt, Salmonella enterica enterica serovar Typhi
gucgcacuccucug

SEQ ID NO: 3618183 - RNA, 18 nt, Salmonella enterica enterica serovar Typhi
gucgcagaugagcgguaa

SEQ ID NO: 3618184 - RNA, 16 nt, Salmonella enterica enterica serovar Typhi
gucgcagcaaacggca

SEQ ID NO: 3618185 - RNA, 15 nt, Salmonella enterica enterica serovar Typhi
gucgcagcggcugcg

SEQ ID NO: 3618186 - RNA, 13 nt, Salmonella enterica enterica serovar Typhi
gucgcauacuucc

SEQ ID NO: 3618187 - RNA, 17 nt, Salmonella enterica enterica serovar Typhi
gucgcauacuuccucac

SEQ ID NO: 3618188 - RNA, 22 nt, Salmonella enterica enterica serovar Typhi
gucgcauccauauaagcgguau

SEQ ID NO: 3618189 - RNA, 13 nt, Salmonella enterica enterica serovar Typhi
gucgcauccgcgu

SEQ ID NO: 3618190 - RNA, 19 nt, Salmonella enterica enterica serovar Typhi
gucgcauccuuaugcagaa

SEQ ID NO: 3618191 - RNA, 18 nt, Salmonella enterica enterica serovar Typhi
gucgccaagcuguggaaa

SEQ ID NO: 3618192 - RNA, 19 nt, Salmonella enterica enterica serovar Typhi
gucgccaccaugcugguug

SEQ ID NO: 3618193 - RNA, 18 nt, Salmonella enterica enterica serovar Typhi
gucgccacgcgacgccag

SEQ ID NO: 3618194 - RNA, 23 nt, Salmonella enterica enterica serovar Typhi
gucgccagacccagcgcuaacgg

SEQ ID NO: 3618195 - RNA, 12 nt, Salmonella enterica enterica serovar Typhi
gucgccaggcaa

SEQ ID NO: 3618196 - RNA, 23 nt, Salmonella enterica enterica serovar Typhi
gucgccaggcaagguuaacguca

SEQ ID NO: 3618197 - RNA, 19 nt, Salmonella enterica enterica serovar Typhi
gucgccauaaagcuguacc

SEQ ID NO: 3618198 - RNA, 21 nt, Salmonella enterica enterica serovar Typhi
gucgccauauccaagccccuc

SEQ ID NO: 3618199 - RNA, 13 nt, Salmonella enterica enterica serovar Typhi
gucgccauccuga

SEQ ID NO: 3618200 - RNA, 17 nt, Salmonella enterica enterica serovar Typhi
gucgccccaaucgccag

SEQ ID NO: 3618201 - RNA, 23 nt, Salmonella enterica enterica serovar Typhi
gucgcccgcuaacggcaccagca

SEQ ID NO: 3618202 - RNA, 18 nt, Salmonella enterica enterica serovar Typhi
gucgccgccaaagcgccc

SEQ ID NO: 3618203 - RNA, 15 nt, Salmonella enterica enterica serovar Typhi
gucgccgcccaucgg

SEQ ID NO: 3618204 - RNA, 15 nt, Salmonella enterica enterica serovar Typhi
gucgccgcgcccagc

SEQ ID NO: 3618205 - RNA, 22 nt, Salmonella enterica enterica serovar Typhi
gucgccgcgcccagcagcagaa

SEQ ID NO: 3618206 - RNA, 12 nt, Salmonella enterica enterica serovar Typhi
gucgccggccug

SEQ ID NO: 3618207 - RNA, 18 nt, Salmonella enterica enterica serovar Typhi
gucgccggggcgcuggcg

SEQ ID NO: 3618208 - RNA, 18 nt, Salmonella enterica enterica serovar Typhi
gucgcgacguccgccaac

SEQ ID NO: 3618209 - RNA, 14 nt, Salmonella enterica enterica serovar Typhi
gucgcgauccgcga

SEQ ID NO: 3618210 - RNA, 20 nt, Salmonella enterica enterica serovar Typhi
gucgcgcauggcagggcgau

SEQ ID NO: 3618211 - RNA, 13 nt, Salmonella enterica enterica serovar Typhi
gucgcgccagcga

SEQ ID NO: 3618212 - RNA, 20 nt, Salmonella enterica enterica serovar Typhi
gucgcgccauguugcguaaa

SEQ ID NO: 3618213 - RNA, 16 nt, Salmonella enterica enterica serovar Typhi
gucgcgcccuccucca

SEQ ID NO: 3618214 - RNA, 16 nt, Salmonella enterica enterica serovar Typhi
gucgcgcgccgccugc

SEQ ID NO: 3618215 - RNA, 18 nt, Salmonella enterica enterica serovar Typhi
gucgcggauaugcagcag

SEQ ID NO: 3618216 - RNA, 14 nt, Salmonella enterica enterica serovar Typhi
gucgcggccaccgc

SEQ ID NO: 3618217 - RNA, 22 nt, Salmonella enterica enterica serovar Typhi
gucgcggcucaccagcugacgc

SEQ ID NO: 3618218 - RNA, 14 nt, Salmonella enterica enterica serovar Typhi
gucgcggcuuucag

SEQ ID NO: 3618219 - RNA, 15 nt, Salmonella enterica enterica serovar Typhi
gucgcggcuuucagc

SEQ ID NO: 3618220 - RNA, 19 nt, Salmonella enterica enterica serovar Typhi
gucgcgguacuucugaccc

SEQ ID NO: 3618221 - RNA, 15 nt, Salmonella enterica enterica serovar Typhi
gucgcgguuaaggau

SEQ ID NO: 3618222 - RNA, 18 nt, Salmonella enterica enterica serovar Typhi
gucgcgguugucggcgcg

SEQ ID NO: 3618223 - RNA, 14 nt, Salmonella enterica enterica serovar Typhi
gucgcguagcgaug

SEQ ID NO: 3618224 - RNA, 21 nt, Salmonella enterica enterica serovar Typhi
gucgcuaaaacccaccaccuc

SEQ ID NO: 3618225 - RNA, 22 nt, Salmonella enterica enterica serovar Typhi
gucgcuaccacagaaaucgccg

SEQ ID NO: 3618226 - RNA, 16 nt, Salmonella enterica enterica serovar Typhi
gucgcuauggugcggg

SEQ ID NO: 3618227 - RNA, 18 nt, Salmonella enterica enterica serovar Typhi
gucgcucagaauagggau

SEQ ID NO: 3618228 - RNA, 14 nt, Salmonella enterica enterica serovar Typhi
gucgcuccggaacg

SEQ ID NO: 3618229 - RNA, 16 nt, Salmonella enterica enterica serovar Typhi
gucgcucuaucgccug

SEQ ID NO: 3618230 - RNA, 22 nt, Salmonella enterica enterica serovar Typhi
gucugcgcugggccgggccuga

SEQ ID NO: 3618231 - RNA, 12 nt, Salmonella enterica enterica serovar Typhi
gucugcucagaa

SEQ ID NO: 3618232 - RNA, 13 nt, Salmonella enterica enterica serovar Typhi
gucugcuggccaa

SEQ ID NO: 3618233 - RNA, 23 nt, Salmonella enterica enterica serovar Typhi
gucugcugggcgauuucacgaau

SEQ ID NO: 3618234 - RNA, 17 nt, Salmonella enterica enterica serovar Typhi
gucuggauaccccgcac

SEQ ID NO: 3618235 - RNA, 13 nt, Salmonella enterica enterica serovar Typhi
gucuggauauaaa

SEQ ID NO: 3618236 - RNA, 23 nt, Salmonella enterica enterica serovar Typhi
gucuggccauuaucgaucugagc

SEQ ID NO: 3618237 - RNA, 20 nt, Salmonella enterica enterica serovar Typhi
gucuggcgugccgggcuggc

SEQ ID NO: 3618238 - RNA, 13 nt, Salmonella enterica enterica serovar Typhi
gucuggggaacaa

SEQ ID NO: 3618239 - RNA, 18 nt, Salmonella enterica enterica serovar Typhi
gucuggguuugcagcaga

SEQ ID NO: 3618240 - RNA, 19 nt, Salmonella enterica enterica serovar Typhi
gucugguacggccaccagg

SEQ ID NO: 3618241 - RNA, 20 nt, Salmonella enterica enterica serovar Typhi
gucugguacggccaccaggc

SEQ ID NO: 3618242 - RNA, 20 nt, Salmonella enterica enterica serovar Typhi
gucugguaucugucaugcgg

SEQ ID NO: 3618243 - RNA, 13 nt, Salmonella enterica enterica serovar Typhi
gucugucaggacu

SEQ ID NO: 3618244 - RNA, 21 nt, Salmonella enterica enterica serovar Typhi
gucuguucguagcccauagca

SEQ ID NO: 3618245 - RNA, 14 nt, Salmonella enterica enterica serovar Typhi
gucuguuucaacgc

SEQ ID NO: 3618246 - RNA, 13 nt, Salmonella enterica enterica serovar Typhi
gucuuaaauauga

SEQ ID NO: 3618247 - RNA, 18 nt, Salmonella enterica enterica serovar Typhi
gucuuaaccuuuuguauc

SEQ ID NO: 3618248 - RNA, 17 nt, Salmonella enterica enterica serovar Typhi
gucuuacacuuagcaca

SEQ ID NO: 3618249 - RNA, 14 nt, Salmonella enterica enterica serovar Typhi
gucuuauuauuauu

SEQ ID NO: 3618250 - RNA, 19 nt, Salmonella enterica enterica serovar Typhi
gucuucaacguuccuucag

SEQ ID NO: 3618251 - RNA, 18 nt, Salmonella enterica enterica serovar Typhi
gucuucaggucauucagg

SEQ ID NO: 3618252 - RNA, 14 nt, Salmonella enterica enterica serovar Typhi
gucuucaucagcca

SEQ ID NO: 3618253 - RNA, 16 nt, Salmonella enterica enterica serovar Typhi
gucuucaucagccagc

SEQ ID NO: 3618254 - RNA, 18 nt, Salmonella enterica enterica serovar Typhi
gucuucaucagccagcau

SEQ ID NO: 3618255 - RNA, 12 nt, Salmonella enterica enterica serovar Typhi
gucuucaucuau

SEQ ID NO: 3618256 - RNA, 16 nt, Salmonella enterica enterica serovar Typhi
gucuuccuucguuacu

SEQ ID NO: 3618257 - RNA, 16 nt, Salmonella enterica enterica serovar Typhi
gucuucgaccgccaua

SEQ ID NO: 3618258 - RNA, 15 nt, Salmonella enterica enterica serovar Typhi
gucuucugccagcaa

SEQ ID NO: 3618259 - RNA, 18 nt, Salmonella enterica enterica serovar Typhi
gucuucuuaguaacauaa

SEQ ID NO: 3618260 - RNA, 23 nt, Salmonella enterica enterica serovar Typhi
gucuucuucuucgcgcauuucug

SEQ ID NO: 3618261 - RNA, 21 nt, Salmonella enterica enterica serovar Typhi
gucuugguauggauggcuggg

SEQ ID NO: 3618262 - RNA, 14 nt, Salmonella enterica enterica serovar Typhi
gucuugucaggcuc

SEQ ID NO: 3618263 - RNA, 18 nt, Salmonella enterica enterica serovar Typhi
gucuuuauucaucaucuu

SEQ ID NO: 3618264 - RNA, 19 nt, Salmonella enterica enterica serovar Typhi
gucuuuauucaucaucuug

SEQ ID NO: 3618265 - RNA, 15 nt, Salmonella enterica enterica serovar Typhi
gucuuucuucgcugc

SEQ ID NO: 3618266 - RNA, 13 nt, Salmonella enterica enterica serovar Typhi
gucuuugcugccg

SEQ ID NO: 3618267 - RNA, 18 nt, Salmonella enterica enterica serovar Typhi
gucuuuguugguauucau

SEQ ID NO: 3618268 - RNA, 21 nt, Salmonella enterica enterica serovar Typhi
gucuuuugaauaguaacuggc

SEQ ID NO: 3618269 - RNA, 14 nt, Salmonella enterica enterica serovar Typhi
gucuuuuucaucuu

SEQ ID NO: 3618270 - RNA, 15 nt, Salmonella enterica enterica serovar Typhi
gucuuuuucaucuuu

SEQ ID NO: 3618271 - RNA, 22 nt, Salmonella enterica enterica serovar Typhi
gugaaaaaauaucgcugcccag

SEQ ID NO: 3618272 - RNA, 21 nt, Salmonella enterica enterica serovar Typhi
gugaaaaacgggagauuguua

SEQ ID NO: 3618273 - RNA, 20 nt, Salmonella enterica enterica serovar Typhi
gugaaaagcgggggcgacag

SEQ ID NO: 3618274 - RNA, 14 nt, Salmonella enterica enterica serovar Typhi
gugaaaagcuuaga

SEQ ID NO: 3618275 - RNA, 17 nt, Salmonella enterica enterica serovar Typhi
gugaaaccggcgcgccu

SEQ ID NO: 3618276 - RNA, 16 nt, Salmonella enterica enterica serovar Typhi
gugaaacguguuuauc

SEQ ID NO: 3618277 - RNA, 14 nt, Salmonella enterica enterica serovar Typhi
gugaaacuguuuua

SEQ ID NO: 3618278 - RNA, 17 nt, Salmonella enterica enterica serovar Typhi
gugaaagcgcuugauaa

SEQ ID NO: 3618279 - RNA, 21 nt, Salmonella enterica enterica serovar Typhi
gugaaauaaacguaccgauga

SEQ ID NO: 3618280 - RNA, 18 nt, Salmonella enterica enterica serovar Typhi
gugaaauuauuccuuauc

SEQ ID NO: 3618281 - RNA, 21 nt, Salmonella enterica enterica serovar Typhi
gugaaauuauuccuuaucaca

SEQ ID NO: 3618282 - RNA, 16 nt, Salmonella enterica enterica serovar Typhi
gugaacaccacugaaa

SEQ ID NO: 3618283 - RNA, 14 nt, Salmonella enterica enterica serovar Typhi
gugaaccagcaucc

SEQ ID NO: 3618284 - RNA, 15 nt, Salmonella enterica enterica serovar Typhi
gugaaccauggcaac

SEQ ID NO: 3618285 - RNA, 16 nt, Salmonella enterica enterica serovar Typhi
gugaaccauggcaaca

SEQ ID NO: 3618286 - RNA, 20 nt, Salmonella enterica enterica serovar Typhi
gugaaccauggcaacaugga

SEQ ID NO: 3618287 - RNA, 13 nt, Salmonella enterica enterica serovar Typhi
gugaaccgguaaa

SEQ ID NO: 3618288 - RNA, 14 nt, Salmonella enterica enterica serovar Typhi
gugaaccgguaaag

SEQ ID NO: 3618289 - RNA, 19 nt, Salmonella enterica enterica serovar Typhi
gugaacgccuuauccggcc

SEQ ID NO: 3618290 - RNA, 12 nt, Salmonella enterica enterica serovar Typhi
gugaagaaaaag

SEQ ID NO: 3618291 - RNA, 16 nt, Salmonella enterica enterica serovar Typhi
gugaagaaucccccau

SEQ ID NO: 3618292 - RNA, 16 nt, Salmonella enterica enterica serovar Typhi
gugaagacgacgggaa

SEQ ID NO: 3618293 - RNA, 15 nt, Salmonella enterica enterica serovar Typhi
gugaagauuagcaga

SEQ ID NO: 3618294 - RNA, 21 nt, Salmonella enterica enterica serovar Typhi
gugaagauuauucucgcacuu

SEQ ID NO: 3618295 - RNA, 17 nt, Salmonella enterica enterica serovar Typhi
gugaaggcaaaacacca

SEQ ID NO: 3618296 - RNA, 17 nt, Salmonella enterica enterica serovar Typhi
gugaauagguauguagu

SEQ ID NO: 3618297 - RNA, 21 nt, Salmonella enterica enterica serovar Typhi
gugaauaugaucugcacaaca

SEQ ID NO: 3618298 - RNA, 21 nt, Salmonella enterica enterica serovar Typhi
gugaauaugaucugcgcaaca

SEQ ID NO: 3618299 - RNA, 14 nt, Salmonella enterica enterica serovar Typhi
gugaauauggaaag

SEQ ID NO: 3618300 - RNA, 19 nt, Salmonella enterica enterica serovar Typhi
gugaaucgacggcaauauu

SEQ ID NO: 3618301 - RNA, 17 nt, Salmonella enterica enterica serovar Typhi
gugaaugcacuguuucu

SEQ ID NO: 3618302 - RNA, 17 nt, Salmonella enterica enterica serovar Typhi
gugaauuucugcugcca

SEQ ID NO: 3618303 - RNA, 20 nt, Salmonella enterica enterica serovar Typhi
gugacauuuaucuuccggca

SEQ ID NO: 3618304 - RNA, 14 nt, Salmonella enterica enterica serovar Typhi
gugaccccggccuc

SEQ ID NO: 3618305 - RNA, 12 nt, Salmonella enterica enterica serovar Typhi
gugacccgccgc

SEQ ID NO: 3618306 - RNA, 16 nt, Salmonella enterica enterica serovar Typhi
gugacccgccgccagc

SEQ ID NO: 3618307 - RNA, 19 nt, Salmonella enterica enterica serovar Typhi
gugacccgccgccagcacc

SEQ ID NO: 3618308 - RNA, 15 nt, Salmonella enterica enterica serovar Typhi
gugaccgauaaaaaa

SEQ ID NO: 3618309 - RNA, 12 nt, Salmonella enterica enterica serovar Typhi
gugaccugcuga

SEQ ID NO: 3618310 - RNA, 14 nt, Salmonella enterica enterica serovar Typhi
gugaccugcugacu

SEQ ID NO: 3618311 - RNA, 17 nt, Salmonella enterica enterica serovar Typhi
gugaccuuucaacggau

SEQ ID NO: 3618312 - RNA, 21 nt, Salmonella enterica enterica serovar Typhi
gugacgaagaucgcguacagc

SEQ ID NO: 3618313 - RNA, 19 nt, Salmonella enterica enterica serovar Typhi
gugacgccgccauccggua

SEQ ID NO: 3618314 - RNA, 23 nt, Salmonella enterica enterica serovar Typhi
gugacgucaagaucgcgcagcag

SEQ ID NO: 3618315 - RNA, 13 nt, Salmonella enterica enterica serovar Typhi
gugacuaaaagac

SEQ ID NO: 3618316 - RNA, 23 nt, Salmonella enterica enterica serovar Typhi
gugccgaagucaaaggccaguaa

SEQ ID NO: 3618317 - RNA, 15 nt, Salmonella enterica enterica serovar Typhi
gugccgacgccagcc

SEQ ID NO: 3618318 - RNA, 19 nt, Salmonella enterica enterica serovar Typhi
gugccggaaagacggcagc

SEQ ID NO: 3618319 - RNA, 15 nt, Salmonella enterica enterica serovar Typhi
gugccggguucugcg

SEQ ID NO: 3618320 - RNA, 12 nt, Salmonella enterica enterica serovar Typhi
gugccgguggga

SEQ ID NO: 3618321 - RNA, 16 nt, Salmonella enterica enterica serovar Typhi
gugccguguaaggcaa

SEQ ID NO: 3618322 - RNA, 21 nt, Salmonella enterica enterica serovar Typhi
gugccguuaaucgauaagcca

SEQ ID NO: 3618323 - RNA, 14 nt, Salmonella enterica enterica serovar Typhi
gugccugccgccuc

SEQ ID NO: 3618324 - RNA, 17 nt, Salmonella enterica enterica serovar Typhi
gugccugccuguggcug

SEQ ID NO: 3618325 - RNA, 15 nt, Salmonella enterica enterica serovar Typhi
gugccugcgcuuacg

SEQ ID NO: 3618326 - RNA, 18 nt, Salmonella enterica enterica serovar Typhi
gugccugcuccgccaggg

SEQ ID NO: 3618327 - RNA, 11 nt, Salmonella enterica enterica serovar Typhi
gugccugcugg

SEQ ID NO: 3618328 - RNA, 13 nt, Salmonella enterica enterica serovar Typhi
gugcgacguaggc

SEQ ID NO: 3618329 - RNA, 21 nt, Salmonella enterica enterica serovar Typhi
gugcgaguucaagucucgccu

SEQ ID NO: 3618330 - RNA, 16 nt, Salmonella enterica enterica serovar Typhi
gugcgcaauuccagca

SEQ ID NO: 3618331 - RNA, 18 nt, Salmonella enterica enterica serovar Typhi
gugcgcagccccagcgcc

SEQ ID NO: 3618332 - RNA, 18 nt, Salmonella enterica enterica serovar Typhi
gugcgccagccuuauccc

SEQ ID NO: 3618333 - RNA, 13 nt, Salmonella enterica enterica serovar Typhi
gugcgccauccgg

SEQ ID NO: 3618334 - RNA, 12 nt, Salmonella enterica enterica serovar Typhi
gugcgccccagc

SEQ ID NO: 3618335 - RNA, 13 nt, Salmonella enterica enterica serovar Typhi
gugcgccccaggu

SEQ ID NO: 3618336 - RNA, 13 nt, Salmonella enterica enterica serovar Typhi
gugcgccugcugc

SEQ ID NO: 3618337 - RNA, 13 nt, Salmonella enterica enterica serovar Typhi
gugcgcgcgggcg

SEQ ID NO: 3618338 - RNA, 15 nt, Salmonella enterica enterica serovar Typhi
gugcgcggcgaaaaa

SEQ ID NO: 3618339 - RNA, 20 nt, Salmonella enterica enterica serovar Typhi
gugcggccuaaaucgcugcu

SEQ ID NO: 3618340 - RNA, 19 nt, Salmonella enterica enterica serovar Typhi
gugcggcugggcgaggcca

SEQ ID NO: 3618341 - RNA, 20 nt, Salmonella enterica enterica serovar Typhi
gugcggugguauagaauacu

SEQ ID NO: 3618342 - RNA, 15 nt, Salmonella enterica enterica serovar Typhi
gugcgguuuuccuga

SEQ ID NO: 3618343 - RNA, 17 nt, Salmonella enterica enterica serovar Typhi
gugcguggcccgcacug

SEQ ID NO: 3618344 - RNA, 13 nt, Salmonella enterica enterica serovar Typhi
gugcuacugcugg

SEQ ID NO: 3618345 - RNA, 22 nt, Salmonella enterica enterica serovar Typhi
gugcuauacaguaaaacgccaa

SEQ ID NO: 3618346 - RNA, 18 nt, Salmonella enterica enterica serovar Typhi
gugcuaucaggccuacaa

SEQ ID NO: 3618347 - RNA, 18 nt, Salmonella enterica enterica serovar Typhi
gugcucauuugcggcguc

SEQ ID NO: 3618348 - RNA, 11 nt, Salmonella enterica enterica serovar Typhi
gugcuccagcg

SEQ ID NO: 3618349 - RNA, 20 nt, Salmonella enterica enterica serovar Typhi
gugcucgaaauccucacggu

SEQ ID NO: 3618350 - RNA, 14 nt, Salmonella enterica enterica serovar Typhi
gugcucgcggcgga

SEQ ID NO: 3618351 - RNA, 21 nt, Salmonella enterica enterica serovar Typhi
gugcucucccagcugagcuaa

SEQ ID NO: 3618352 - RNA, 17 nt, Salmonella enterica enterica serovar Typhi
gugcugcgcaaauacgu

SEQ ID NO: 3618353 - RNA, 17 nt, Salmonella enterica enterica serovar Typhi
gugcuggauggcagaca

SEQ ID NO: 3618354 - RNA, 13 nt, Salmonella enterica enterica serovar Typhi
gugcuggcgcuga

SEQ ID NO: 3618355 - RNA, 23 nt, Salmonella enterica enterica serovar Typhi
gugcuggcggaaguagccuccgg

SEQ ID NO: 3618356 - RNA, 13 nt, Salmonella enterica enterica serovar Typhi
gugcugguggugg

SEQ ID NO: 3618357 - RNA, 14 nt, Salmonella enterica enterica serovar Typhi
gugcuggugguggg

SEQ ID NO: 3618358 - RNA, 14 nt, Salmonella enterica enterica serovar Typhi
gugcuuccagcucc

SEQ ID NO: 3618359 - RNA, 15 nt, Salmonella enterica enterica serovar Typhi
gugcuuccagcucca

SEQ ID NO: 3618360 - RNA, 19 nt, Salmonella enterica enterica serovar Typhi
gugcuugagcugcgguggu

SEQ ID NO: 3618361 - RNA, 14 nt, Salmonella enterica enterica serovar Typhi
guggaaaacagcau

SEQ ID NO: 3618362 - RNA, 16 nt, Salmonella enterica enterica serovar Typhi
guggaaaacagcgccg

SEQ ID NO: 3618363 - RNA, 19 nt, Salmonella enterica enterica serovar Typhi
guggaaaguaccaaaacag

SEQ ID NO: 3618364 - RNA, 22 nt, Salmonella enterica enterica serovar Typhi
guggaacuuuaucgcgcggcga

SEQ ID NO: 3618365 - RNA, 13 nt, Salmonella enterica enterica serovar Typhi
guggaaucagcca

SEQ ID NO: 3618366 - RNA, 15 nt, Salmonella enterica enterica serovar Typhi
guggaaucagccagg

SEQ ID NO: 3618367 - RNA, 22 nt, Salmonella enterica enterica serovar Typhi
guggacaucgccauuccaagaa

SEQ ID NO: 3618368 - RNA, 22 nt, Salmonella enterica enterica serovar Typhi
guggagaggccaccagcgccag

SEQ ID NO: 3618369 - RNA, 18 nt, Salmonella enterica enterica serovar Typhi
guggagggguauuuaucc

SEQ ID NO: 3618370 - RNA, 22 nt, Salmonella enterica enterica serovar Typhi
guggauaguguucgcggcuggu

SEQ ID NO: 3618371 - RNA, 19 nt, Salmonella enterica enterica serovar Typhi
guggaucucgucgccggug

SEQ ID NO: 3618372 - RNA, 14 nt, Salmonella enterica enterica serovar Typhi
guggcaccugcugu

SEQ ID NO: 3618373 - RNA, 19 nt, Salmonella enterica enterica serovar Typhi
guggcaccugcuguaucac

SEQ ID NO: 3618374 - RNA, 14 nt, Salmonella enterica enterica serovar Typhi
guggcaucuuauca

SEQ ID NO: 3618375 - RNA, 17 nt, Salmonella enterica enterica serovar Typhi
guggcaugcccggugau

SEQ ID NO: 3618376 - RNA, 18 nt, Salmonella enterica enterica serovar Typhi
guggccagcaugcccgcc

SEQ ID NO: 3618377 - RNA, 15 nt, Salmonella enterica enterica serovar Typhi
guggccaucuuccag

SEQ ID NO: 3618378 - RNA, 16 nt, Salmonella enterica enterica serovar Typhi
guggccaucuuccagc

SEQ ID NO: 3618379 - RNA, 16 nt, Salmonella enterica enterica serovar Typhi
guggcccagcgcggug

SEQ ID NO: 3618380 - RNA, 22 nt, Salmonella enterica enterica serovar Typhi
guggccgagaguccagcgccag

SEQ ID NO: 3618381 - RNA, 23 nt, Salmonella enterica enterica serovar Typhi
guggccgauauggccguuuucau

SEQ ID NO: 3618382 - RNA, 19 nt, Salmonella enterica enterica serovar Typhi
guggccgauauugccuuca

SEQ ID NO: 3618383 - RNA, 17 nt, Salmonella enterica enterica serovar Typhi
guggccugcagagcggc

SEQ ID NO: 3618384 - RNA, 21 nt, Salmonella enterica enterica serovar Typhi
guggcgaaauugguagacgca

SEQ ID NO: 3618385 - RNA, 22 nt, Salmonella enterica enterica serovar Typhi
guggcgaacaggcucagcgcca

SEQ ID NO: 3618386 - RNA, 22 nt, Salmonella enterica enterica serovar Typhi
guggcgacgccuauucucgccg

SEQ ID NO: 3618387 - RNA, 20 nt, Salmonella enterica enterica serovar Typhi
guggcgacgcguggcaucuu

SEQ ID NO: 3618388 - RNA, 22 nt, Salmonella enterica enterica serovar Typhi
guggcgaucaguggcgccgcaa

SEQ ID NO: 3618389 - RNA, 19 nt, Salmonella enterica enterica serovar Typhi
guggcgcuagcgcuuaccc

SEQ ID NO: 3618390 - RNA, 23 nt, Salmonella enterica enterica serovar Typhi
guggcgcugcgcuuaccgggccu

SEQ ID NO: 3618391 - RNA, 20 nt, Salmonella enterica enterica serovar Typhi
guggcgcuggccgaauagcu

SEQ ID NO: 3618392 - RNA, 19 nt, Salmonella enterica enterica serovar Typhi
guggcgcugucgcuuaccg

SEQ ID NO: 3618393 - RNA, 21 nt, Salmonella enterica enterica serovar Typhi
guggcgcuguucuugcugcug

SEQ ID NO: 3618394 - RNA, 15 nt, Salmonella enterica enterica serovar Typhi
guggcggaauuggua

SEQ ID NO: 3618395 - RNA, 14 nt, Salmonella enterica enterica serovar Typhi
guggcggcaaaaaa

SEQ ID NO: 3618396 - RNA, 14 nt, Salmonella enterica enterica serovar Typhi
guggcgucggcugu

SEQ ID NO: 3618397 - RNA, 21 nt, Salmonella enterica enterica serovar Typhi
guggcuauagcucaguuggua

SEQ ID NO: 3618398 - RNA, 16 nt, Salmonella enterica enterica serovar Typhi
gugggcggcaccagcg

SEQ ID NO: 3618399 - RNA, 22 nt, Salmonella enterica enterica serovar Typhi
guggggaauguauuucagacuu

SEQ ID NO: 3618400 - RNA, 16 nt, Salmonella enterica enterica serovar Typhi
guggguuccagcgcca

SEQ ID NO: 3618401 - RNA, 17 nt, Salmonella enterica enterica serovar Typhi
gugguacaccaguacau

SEQ ID NO: 3618402 - RNA, 17 nt, Salmonella enterica enterica serovar Typhi
guuaauaccagcgccaa

SEQ ID NO: 3618403 - RNA, 18 nt, Salmonella enterica enterica serovar Typhi
guuaauaccguggucucc

SEQ ID NO: 3618404 - RNA, 12 nt, Salmonella enterica enterica serovar Typhi
guuaauacgccg

SEQ ID NO: 3618405 - RNA, 11 nt, Salmonella enterica enterica serovar Typhi
guuaauacuga

SEQ ID NO: 3618406 - RNA, 15 nt, Salmonella enterica enterica serovar Typhi
guuaauauacauuca

SEQ ID NO: 3618407 - RNA, 19 nt, Salmonella enterica enterica serovar Typhi
guuaauauccuucagcguu

SEQ ID NO: 3618408 - RNA, 19 nt, Salmonella enterica enterica serovar Typhi
guuaauccagagcggauaa

SEQ ID NO: 3618409 - RNA, 21 nt, Salmonella enterica enterica serovar Typhi
guuaauccagagcggauaaau

SEQ ID NO: 3618410 - RNA, 16 nt, Salmonella enterica enterica serovar Typhi
guuaaugccaucauca

SEQ ID NO: 3618411 - RNA, 20 nt, Salmonella enterica enterica serovar Typhi
guuaaugcuguccugcaaaa

SEQ ID NO: 3618412 - RNA, 11 nt, Salmonella enterica enterica serovar Typhi
guuaauuucuu

SEQ ID NO: 3618413 - RNA, 14 nt, Salmonella enterica enterica serovar Typhi
guuacagacgcugc

SEQ ID NO: 3618414 - RNA, 17 nt, Salmonella enterica enterica serovar Typhi
guuacaggcuccaagua

SEQ ID NO: 3618415 - RNA, 20 nt, Salmonella enterica enterica serovar Typhi
guuaccaaugccaaaaaaac

SEQ ID NO: 3618416 - RNA, 13 nt, Salmonella enterica enterica serovar Typhi
guuaccagcauca

SEQ ID NO: 3618417 - RNA, 16 nt, Salmonella enterica enterica serovar Typhi
guuaccccgcagcgaa

SEQ ID NO: 3618418 - RNA, 14 nt, Salmonella enterica enterica serovar Typhi
guuacccgccaguc

SEQ ID NO: 3618419 - RNA, 21 nt, Salmonella enterica enterica serovar Typhi
guuaccgccggcuucgucuuu

SEQ ID NO: 3618420 - RNA, 24 nt, Salmonella enterica enterica serovar Typhi
guuaccgggcaaacggcacuacag

SEQ ID NO: 3618421 - RNA, 18 nt, Salmonella enterica enterica serovar Typhi
guuaccguaaucaucgcg

SEQ ID NO: 3618422 - RNA, 16 nt, Salmonella enterica enterica serovar Typhi
guuaccguuuaacgca

SEQ ID NO: 3618423 - RNA, 23 nt, Salmonella enterica enterica serovar Typhi
guuaccucaaaaaccaguugcca

SEQ ID NO: 3618424 - RNA, 19 nt, Salmonella enterica enterica serovar Typhi
guuaccucguuucacgucc

SEQ ID NO: 3618425 - RNA, 13 nt, Salmonella enterica enterica serovar Typhi
guuacgcgccacg

SEQ ID NO: 3618426 - RNA, 16 nt, Salmonella enterica enterica serovar Typhi
guuacgcgcugcaaau

SEQ ID NO: 3618427 - RNA, 24 nt, Salmonella enterica enterica serovar Typhi
guuacgcgcugcaaauacugcuuu

SEQ ID NO: 3618428 - RNA, 23 nt, Salmonella enterica enterica serovar Typhi
guuacgggaacagaauuaccugg

SEQ ID NO: 3618429 - RNA, 14 nt, Salmonella enterica enterica serovar Typhi
guuacucuuccucc

SEQ ID NO: 3618430 - RNA, 16 nt, Salmonella enterica enterica serovar Typhi
guuacugcauuccgcg

SEQ ID NO: 3618431 - RNA, 15 nt, Salmonella enterica enterica serovar Typhi
guuacuggcgaccgg

SEQ ID NO: 3618432 - RNA, 14 nt, Salmonella enterica enterica serovar Typhi
guuacugguuuuuu

SEQ ID NO: 3618433 - RNA, 22 nt, Salmonella enterica enterica serovar Typhi
guuagagcacaucacucauaau

SEQ ID NO: 3618434 - RNA, 14 nt, Salmonella enterica enterica serovar Typhi
guuagauauuaaua

SEQ ID NO: 3618435 - RNA, 15 nt, Salmonella enterica enterica serovar Typhi
guuagcaaaaaugcc

SEQ ID NO: 3618436 - RNA, 14 nt, Salmonella enterica enterica serovar Typhi
guuagcaacacaga

SEQ ID NO: 3618437 - RNA, 17 nt, Salmonella enterica enterica serovar Typhi
guuagcgccauccggca

SEQ ID NO: 3618438 - RNA, 16 nt, Salmonella enterica enterica serovar Typhi
guuagcgucaguaaac

SEQ ID NO: 3618439 - RNA, 20 nt, Salmonella enterica enterica serovar Typhi
guuagcucaacgcaucgcug

SEQ ID NO: 3618440 - RNA, 14 nt, Salmonella enterica enterica serovar Typhi
guuagggcgcggcu

SEQ ID NO: 3618441 - RNA, 17 nt, Salmonella enterica enterica serovar Typhi
guuagggcgcggcuggu

SEQ ID NO: 3618442 - RNA, 19 nt, Salmonella enterica enterica serovar Typhi
guuaggguagaaaaaggua

SEQ ID NO: 3618443 - RNA, 22 nt, Salmonella enterica enterica serovar Typhi
guuagugacguuaucugucagc

SEQ ID NO: 3618444 - RNA, 18 nt, Salmonella enterica enterica serovar Typhi
guuauaaauccccgccgc

SEQ ID NO: 3618445 - RNA, 22 nt, Salmonella enterica enterica serovar Typhi
guuauaaauuuauuuuuugcug

SEQ ID NO: 3618446 - RNA, 22 nt, Salmonella enterica enterica serovar Typhi
guuauaaccgaugcagccugga

SEQ ID NO: 3618447 - RNA, 22 nt, Salmonella enterica enterica serovar Typhi
guuauaaggccugccguccuga

SEQ ID NO: 3618448 - RNA, 14 nt, Salmonella enterica enterica serovar Typhi
guuauacagugcca

SEQ ID NO: 3618449 - RNA, 21 nt, Salmonella enterica enterica serovar Typhi
guuauagacgccggucaugcc

SEQ ID NO: 3618450 - RNA, 21 nt, Salmonella enterica enterica serovar Typhi
guuauauauuuuucagcuucu

SEQ ID NO: 3618451 - RNA, 11 nt, Salmonella enterica enterica serovar Typhi
guuauaugaau

SEQ ID NO: 3618452 - RNA, 14 nt, Salmonella enterica enterica serovar Typhi
guuauaugaauaaa

SEQ ID NO: 3618453 - RNA, 19 nt, Salmonella enterica enterica serovar Typhi
guuauccagcaaccaggua

SEQ ID NO: 3618454 - RNA, 19 nt, Salmonella enterica enterica serovar Typhi
guuauccgccggagggcga

SEQ ID NO: 3618455 - RNA, 20 nt, Salmonella enterica enterica serovar Typhi
guuaucucgccaggaaccgc

SEQ ID NO: 3618456 - RNA, 14 nt, Salmonella enterica enterica serovar Typhi
guuaucucuauuga

SEQ ID NO: 3618457 - RNA, 20 nt, Salmonella enterica enterica serovar Typhi
guuaucugacauauacaaac

SEQ ID NO: 3618458 - RNA, 15 nt, Salmonella enterica enterica serovar Typhi
guuaucugaccuaca

SEQ ID NO: 3618459 - RNA, 21 nt, Salmonella enterica enterica serovar Typhi
guuaugcaaguucgaauagcc

SEQ ID NO: 3618460 - RNA, 20 nt, Salmonella enterica enterica serovar Typhi
guuaugccgacaguuuuacc

SEQ ID NO: 3618461 - RNA, 15 nt, Salmonella enterica enterica serovar Typhi
guuauggcaggcgaa

SEQ ID NO: 3618462 - RNA, 15 nt, Salmonella enterica enterica serovar Typhi
guuauguccuuccag

SEQ ID NO: 3618463 - RNA, 15 nt, Salmonella enterica enterica serovar Typhi
guuauucagcaggag

SEQ ID NO: 3618464 - RNA, 14 nt, Salmonella enterica enterica serovar Typhi
guuauucgcuggcc

SEQ ID NO: 3618465 - RNA, 18 nt, Salmonella enterica enterica serovar Typhi
guuauuugugauuuucug

SEQ ID NO: 3618466 - RNA, 22 nt, Salmonella enterica enterica serovar Typhi
guuauuuuccugaaaaaauucc

SEQ ID NO: 3618467 - RNA, 15 nt, Salmonella enterica enterica serovar Typhi
guucaaacaucagcg

SEQ ID NO: 3618468 - RNA, 15 nt, Salmonella enterica enterica serovar Typhi
guucaaaucgaugcc

SEQ ID NO: 3618469 - RNA, 16 nt, Salmonella enterica enterica serovar Typhi
guucaaaucgaugcca

SEQ ID NO: 3618470 - RNA, 23 nt, Salmonella enterica enterica serovar Typhi
guucaacggcaaaucgcgguaaa

SEQ ID NO: 3618471 - RNA, 14 nt, Salmonella enterica enterica serovar Typhi
guucaagucucgcc

SEQ ID NO: 3618472 - RNA, 23 nt, Salmonella enterica enterica serovar Typhi
guucaauacccuuuucuuuaaac

SEQ ID NO: 3618473 - RNA, 18 nt, Salmonella enterica enterica serovar Typhi
guucaauagagcgcagca

SEQ ID NO: 3618474 - RNA, 23 nt, Salmonella enterica enterica serovar Typhi
guucaauagagcgcagcaaaacg

SEQ ID NO: 3618475 - RNA, 23 nt, Salmonella enterica enterica serovar Typhi
guucaaugagcguccagucgggc

SEQ ID NO: 3618476 - RNA, 15 nt, Salmonella enterica enterica serovar Typhi
guucacagauugcug

SEQ ID NO: 3618477 - RNA, 20 nt, Salmonella enterica enterica serovar Typhi
guucaccaccacccagugcc

SEQ ID NO: 3618478 - RNA, 22 nt, Salmonella enterica enterica serovar Typhi
guucaccaccacccagugccac

SEQ ID NO: 3618479 - RNA, 21 nt, Salmonella enterica enterica serovar Typhi
guucaccguuuaaaaacauca

SEQ ID NO: 3618480 - RNA, 20 nt, Salmonella enterica enterica serovar Typhi
guucacgccaaauaauguaa

SEQ ID NO: 3618481 - RNA, 20 nt, Salmonella enterica enterica serovar Typhi
guucacgccgccauccgaca

SEQ ID NO: 3618482 - RNA, 17 nt, Salmonella enterica enterica serovar Typhi
guucacgcgacggccca

SEQ ID NO: 3618483 - RNA, 15 nt, Salmonella enterica enterica serovar Typhi
guucacguaaucgcc

SEQ ID NO: 3618484 - RNA, 21 nt, Salmonella enterica enterica serovar Typhi
guucacuaacgcggcaucaag

SEQ ID NO: 3618485 - RNA, 16 nt, Salmonella enterica enterica serovar Typhi
guucacuccuaagaga

SEQ ID NO: 3618486 - RNA, 18 nt, Salmonella enterica enterica serovar Typhi
guucagauaggcgcgaaa

SEQ ID NO: 3618487 - RNA, 18 nt, Salmonella enterica enterica serovar Typhi
guucuaaacguucaucuu

SEQ ID NO: 3618488 - RNA, 19 nt, Salmonella enterica enterica serovar Typhi
guucuaaacguucaucuuc

SEQ ID NO: 3618489 - RNA, 14 nt, Salmonella enterica enterica serovar Typhi
guucuaucuuucag

SEQ ID NO: 3618490 - RNA, 17 nt, Salmonella enterica enterica serovar Typhi
guucucgcgccgccugc

SEQ ID NO: 3618491 - RNA, 17 nt, Salmonella enterica enterica serovar Typhi
guucucgcucuuccagu

SEQ ID NO: 3618492 - RNA, 13 nt, Salmonella enterica enterica serovar Typhi
guucugacgcgac

SEQ ID NO: 3618493 - RNA, 22 nt, Salmonella enterica enterica serovar Typhi
guucugcauaucgccuugcugc

SEQ ID NO: 3618494 - RNA, 20 nt, Salmonella enterica enterica serovar Typhi
guucugcgccauuuccagcc

SEQ ID NO: 3618495 - RNA, 20 nt, Salmonella enterica enterica serovar Typhi
guucugcgucgcgcauggca

SEQ ID NO: 3618496 - RNA, 17 nt, Salmonella enterica enterica serovar Typhi
guucuguaggcugugca

SEQ ID NO: 3618497 - RNA, 16 nt, Salmonella enterica enterica serovar Typhi
guucuucgccguuauc

SEQ ID NO: 3618498 - RNA, 21 nt, Salmonella enterica enterica serovar Typhi
guucuucgccguuaucggccu

SEQ ID NO: 3618499 - RNA, 15 nt, Salmonella enterica enterica serovar Typhi
guucuugccgccauc

SEQ ID NO: 3618500 - RNA, 14 nt, Salmonella enterica enterica serovar Typhi
guucuuuccaguuc

SEQ ID NO: 3618501 - RNA, 14 nt, Salmonella enterica enterica serovar Typhi
guugaaagccccgg

SEQ ID NO: 3618502 - RNA, 13 nt, Salmonella enterica enterica serovar Typhi
guugaacaauggu

SEQ ID NO: 3618503 - RNA, 18 nt, Salmonella enterica enterica serovar Typhi
guugaauaucgcuuuuuc

SEQ ID NO: 3618504 - RNA, 12 nt, Salmonella enterica enterica serovar Typhi
guugaccacauc

SEQ ID NO: 3618505 - RNA, 19 nt, Salmonella enterica enterica serovar Typhi
guugaccugaucggccagc

SEQ ID NO: 3618506 - RNA, 20 nt, Salmonella enterica enterica serovar Typhi
guugacggcuaccccggcgc

SEQ ID NO: 3618507 - RNA, 13 nt, Salmonella enterica enterica serovar Typhi
guugacgggcgac

SEQ ID NO: 3618508 - RNA, 18 nt, Salmonella enterica enterica serovar Typhi
guugacugcgcuccgacu

SEQ ID NO: 3618509 - RNA, 17 nt, Salmonella enterica enterica serovar Typhi
guugacuuacaaaaaau

SEQ ID NO: 3618510 - RNA, 14 nt, Salmonella enterica enterica serovar Typhi
guugagauuggccc

SEQ ID NO: 3618511 - RNA, 19 nt, Salmonella enterica enterica serovar Typhi
guugagccauuccagcgua

SEQ ID NO: 3618512 - RNA, 21 nt, Salmonella enterica enterica serovar Typhi
guugagcgcuugcugcguaaa

SEQ ID NO: 3618513 - RNA, 19 nt, Salmonella enterica enterica serovar Typhi
guugauacaggaauaacca

SEQ ID NO: 3618514 - RNA, 14 nt, Salmonella enterica enterica serovar Typhi
guugauaccggagg

SEQ ID NO: 3618515 - RNA, 16 nt, Salmonella enterica enterica serovar Typhi
guugaucggccagcaa

SEQ ID NO: 3618516 - RNA, 17 nt, Salmonella enterica enterica serovar Typhi
guugaucggccagcaag

SEQ ID NO: 3618517 - RNA, 18 nt, Salmonella enterica enterica serovar Typhi
guugaucguaaagcgcau

SEQ ID NO: 3618518 - RNA, 18 nt, Salmonella enterica enterica serovar Typhi
guugaucugguucacaga

SEQ ID NO: 3618519 - RNA, 20 nt, Salmonella enterica enterica serovar Typhi
guugauuaucacccacagga

SEQ ID NO: 3618520 - RNA, 18 nt, Salmonella enterica enterica serovar Typhi
guugauuuuaugaugcau

SEQ ID NO: 3618521 - RNA, 19 nt, Salmonella enterica enterica serovar Typhi
guugcaguuuuaccguaaa

SEQ ID NO: 3618522 - RNA, 20 nt, Salmonella enterica enterica serovar Typhi
guugcaucuuaucaggccga

SEQ ID NO: 3618523 - RNA, 13 nt, Salmonella enterica enterica serovar Typhi
guugccacaggcu

SEQ ID NO: 3618524 - RNA, 18 nt, Salmonella enterica enterica serovar Typhi
guugccaggguucaaccu

SEQ ID NO: 3618525 - RNA, 18 nt, Salmonella enterica enterica serovar Typhi
guugccaguacagcagcg

SEQ ID NO: 3618526 - RNA, 18 nt, Salmonella enterica enterica serovar Typhi
guugcccgguggcgcugc

SEQ ID NO: 3618527 - RNA, 23 nt, Salmonella enterica enterica serovar Typhi
guugcccugcuugucgaucauca

SEQ ID NO: 3618528 - RNA, 17 nt, Salmonella enterica enterica serovar Typhi
guugccgaugacuccca

SEQ ID NO: 3618529 - RNA, 22 nt, Salmonella enterica enterica serovar Typhi
guugccgcccguuuuuuccagc

SEQ ID NO: 3618530 - RNA, 22 nt, Salmonella enterica enterica serovar Typhi
guugccggaaacgaaucuuuua

SEQ ID NO: 3618531 - RNA, 16 nt, Salmonella enterica enterica serovar Typhi
guugcgaauaaacaca

SEQ ID NO: 3618532 - RNA, 21 nt, Salmonella enterica enterica serovar Typhi
guugcgcaagcacugaaugcu

SEQ ID NO: 3618533 - RNA, 14 nt, Salmonella enterica enterica serovar Typhi
guugcgcccaucau

SEQ ID NO: 3618534 - RNA, 19 nt, Salmonella enterica enterica serovar Typhi
guugcgggccagcagccag

SEQ ID NO: 3618535 - RNA, 18 nt, Salmonella enterica enterica serovar Typhi
guugcguguuguacagca

SEQ ID NO: 3618536 - RNA, 13 nt, Salmonella enterica enterica serovar Typhi
guugcuaaaucca

SEQ ID NO: 3618537 - RNA, 22 nt, Salmonella enterica enterica serovar Typhi
guugcuauugauauuacccaac

SEQ ID NO: 3618538 - RNA, 13 nt, Salmonella enterica enterica serovar Typhi
guugcuucugucc

SEQ ID NO: 3618539 - RNA, 16 nt, Salmonella enterica enterica serovar Typhi
guugcuuuauaaaaag

SEQ ID NO: 3618540 - RNA, 16 nt, Salmonella enterica enterica serovar Typhi
guuggaguaauguuca

SEQ ID NO: 3618541 - RNA, 19 nt, Salmonella enterica enterica serovar Typhi
guuggcaacgucuugccau

SEQ ID NO: 3618542 - RNA, 17 nt, Salmonella enterica enterica serovar Typhi
guuggcauccugcgggu

SEQ ID NO: 3618543 - RNA, 18 nt, Salmonella enterica enterica serovar Typhi
guuggcgaaggcggcggc

SEQ ID NO: 3618544 - RNA, 15 nt, Salmonella enterica enterica serovar Typhi
guuggcgauuuccag

SEQ ID NO: 3618545 - RNA, 19 nt, Salmonella enterica enterica serovar Typhi
guuggcgccaaaaccgcuc

SEQ ID NO: 3618546 - RNA, 23 nt, Salmonella enterica enterica serovar Typhi
guugggauaaugucgacgcgcuc

SEQ ID NO: 3618547 - RNA, 23 nt, Salmonella enterica enterica serovar Typhi
guugggcuuccgucggcuggaag

SEQ ID NO: 3618548 - RNA, 13 nt, Salmonella enterica enterica serovar Typhi
guuggggucguca

SEQ ID NO: 3618549 - RNA, 20 nt, Salmonella enterica enterica serovar Typhi
guugguaaauuuaugguucc

SEQ ID NO: 3618550 - RNA, 21 nt, Salmonella enterica enterica serovar Typhi
guuggucacaaaggccagcag

SEQ ID NO: 3618551 - RNA, 22 nt, Salmonella enterica enterica serovar Typhi
guuggucacaaaggccagcagc

SEQ ID NO: 3618552 - RNA, 14 nt, Salmonella enterica enterica serovar Typhi
guugguuguagcac

SEQ ID NO: 3618553 - RNA, 22 nt, Salmonella enterica enterica serovar Typhi
guuguacggaugggguaucgcc

SEQ ID NO: 3618554 - RNA, 15 nt, Salmonella enterica enterica serovar Typhi
guugucaaaaaauca

SEQ ID NO: 3618555 - RNA, 17 nt, Salmonella enterica enterica serovar Typhi
guugucggggcuuuaau

SEQ ID NO: 3618556 - RNA, 22 nt, Salmonella enterica enterica serovar Typhi
guugugcagaaucauuaauaca

SEQ ID NO: 3618557 - RNA, 15 nt, Salmonella enterica enterica serovar Typhi
guuguuaauuugauu

SEQ ID NO: 3618558 - RNA, 14 nt, Salmonella enterica enterica serovar Typhi
guuguuccagcagc

SEQ ID NO: 3618559 - RNA, 12 nt, Salmonella enterica enterica serovar Typhi
guuguucugggu

SEQ ID NO: 3618560 - RNA, 21 nt, Salmonella enterica enterica serovar Typhi
guuguucuuuuuauggcgggg

SEQ ID NO: 3618561 - RNA, 18 nt, Salmonella enterica enterica serovar Typhi
guuguuucugccuuuaac

SEQ ID NO: 3618562 - RNA, 18 nt, Salmonella enterica enterica serovar Typhi
guuguuuggguaacacaa

SEQ ID NO: 3618563 - RNA, 15 nt, Salmonella enterica enterica serovar Typhi
guuuaaaagcggaua

SEQ ID NO: 3618564 - RNA, 13 nt, Salmonella enterica enterica serovar Typhi
guuuaaagcgcuc

SEQ ID NO: 3618565 - RNA, 14 nt, Salmonella enterica enterica serovar Typhi
guuuaaauccagcg

SEQ ID NO: 3618566 - RNA, 21 nt, Salmonella enterica enterica serovar Typhi
guuuaaccguuccaacgcguu

SEQ ID NO: 3618567 - RNA, 22 nt, Salmonella enterica enterica serovar Typhi
guuuaacguuucauggaaauca

SEQ ID NO: 3618568 - RNA, 16 nt, Salmonella enterica enterica serovar Typhi
guuuaaguaagguaaa

SEQ ID NO: 3618569 - RNA, 19 nt, Salmonella enterica enterica serovar Typhi
guuuaauaccgcguaaaaa

SEQ ID NO: 3618570 - RNA, 23 nt, Salmonella enterica enterica serovar Typhi
guuuaaucucuucaucuguggca

SEQ ID NO: 3618571 - RNA, 19 nt, Salmonella enterica enterica serovar Typhi
guuuaaugcuuucaauacu

SEQ ID NO: 3618572 - RNA, 18 nt, Salmonella enterica enterica serovar Typhi
guuugcugacaaucugcu

SEQ ID NO: 3618573 - RNA, 15 nt, Salmonella enterica enterica serovar Typhi
guuuggcaaucaaau

SEQ ID NO: 3618574 - RNA, 21 nt, Salmonella enterica enterica serovar Typhi
guuuggcaaucaaauccagcu

SEQ ID NO: 3618575 - RNA, 22 nt, Salmonella enterica enterica serovar Typhi
guuuggcaaucaaauccagcuc

SEQ ID NO: 3618576 - RNA, 17 nt, Salmonella enterica enterica serovar Typhi
guuuggccugcugcggu

SEQ ID NO: 3618577 - RNA, 14 nt, Salmonella enterica enterica serovar Typhi
guuuguaaaaauag

SEQ ID NO: 3618578 - RNA, 14 nt, Salmonella enterica enterica serovar Typhi
guuuguaaaauaca

SEQ ID NO: 3618579 - RNA, 14 nt, Salmonella enterica enterica serovar Typhi
guuugucauccaga

SEQ ID NO: 3618580 - RNA, 13 nt, Salmonella enterica enterica serovar Typhi
guuugucucaggu

SEQ ID NO: 3618581 - RNA, 18 nt, Salmonella enterica enterica serovar Typhi
guuugucuucugccagca

SEQ ID NO: 3618582 - RNA, 18 nt, Salmonella enterica enterica serovar Typhi
guuugugguugguagccc

SEQ ID NO: 3618583 - RNA, 15 nt, Salmonella enterica enterica serovar Typhi
guuuguuuaauuuug

SEQ ID NO: 3618584 - RNA, 19 nt, Salmonella enterica enterica serovar Typhi
guuuuaauacacgauaaac

SEQ ID NO: 3618585 - RNA, 14 nt, Salmonella enterica enterica serovar Typhi
guuuuaaucuuuua

SEQ ID NO: 3618586 - RNA, 13 nt, Salmonella enterica enterica serovar Typhi
guuuuaauuccug

SEQ ID NO: 3618587 - RNA, 18 nt, Salmonella enterica enterica serovar Typhi
guuuuaccgcccgacgga

SEQ ID NO: 3618588 - RNA, 17 nt, Salmonella enterica enterica serovar Typhi
guuuuacgccgcuaaaa

SEQ ID NO: 3618589 - RNA, 17 nt, Salmonella enterica enterica serovar Typhi
guuuuacuuccuguagc

SEQ ID NO: 3618590 - RNA, 22 nt, Salmonella enterica enterica serovar Typhi
guuuuacuuuuuuaaauguuuu

SEQ ID NO: 3618591 - RNA, 16 nt, Salmonella enterica enterica serovar Typhi
guuuuauaagccgauc

SEQ ID NO: 3618592 - RNA, 22 nt, Salmonella enterica enterica serovar Typhi
guuuuauccguuuccgcaauaa

SEQ ID NO: 3618593 - RNA, 15 nt, Salmonella enterica enterica serovar Typhi
guuuucaucgguggc

SEQ ID NO: 3618594 - RNA, 13 nt, Salmonella enterica enterica serovar Typhi
guuuucauuagcc

SEQ ID NO: 3618595 - RNA, 22 nt, Salmonella enterica enterica serovar Typhi
guuuuccaggugcugccacauc

SEQ ID NO: 3618596 - RNA, 14 nt, Salmonella enterica enterica serovar Typhi
guuuucgcagaguc

SEQ ID NO: 3618597 - RNA, 18 nt, Salmonella enterica enterica serovar Typhi
guuuucgucccagcgcac

SEQ ID NO: 3618598 - RNA, 16 nt, Salmonella enterica enterica serovar Typhi
guuuucucauccagcu

SEQ ID NO: 3618599 - RNA, 13 nt, Salmonella enterica enterica serovar Typhi
guuuucugagcgg

SEQ ID NO: 3618600 - RNA, 21 nt, Salmonella enterica enterica serovar Typhi
guuuucugagcggucgugcca

SEQ ID NO: 3618601 - RNA, 17 nt, Salmonella enterica enterica serovar Typhi
guuuucuguacagcguc

SEQ ID NO: 3618602 - RNA, 14 nt, Salmonella enterica enterica serovar Typhi
guuuugcagcgcca

SEQ ID NO: 3618603 - RNA, 12 nt, Salmonella enterica enterica serovar Typhi
guuuugcucagu

SEQ ID NO: 3618604 - RNA, 12 nt, Salmonella enterica enterica serovar Typhi
guuuugcugaug

SEQ ID NO: 3618605 - RNA, 15 nt, Salmonella enterica enterica serovar Typhi
guuuugcuggaauuu

SEQ ID NO: 3618606 - RNA, 16 nt, Salmonella enterica enterica serovar Typhi
guuuugcugucugggu

SEQ ID NO: 3618607 - RNA, 15 nt, Salmonella enterica enterica serovar Typhi
guuuuggcagcgccc

SEQ ID NO: 3618608 - RNA, 18 nt, Salmonella enterica enterica serovar Typhi
guuuuggguaaauaccag

SEQ ID NO: 3618609 - RNA, 20 nt, Salmonella enterica enterica serovar Typhi
guuuugguaucuucugacgg

SEQ ID NO: 3618610 - RNA, 15 nt, Salmonella enterica enterica serovar Typhi
guuuugucaucagau

SEQ ID NO: 3618611 - RNA, 18 nt, Salmonella enterica enterica serovar Typhi
guuuuuacacugaagccu

SEQ ID NO: 3618612 - RNA, 21 nt, Salmonella enterica enterica serovar Typhi
guuuuuagccuguuauucaau

SEQ ID NO: 3618613 - RNA, 19 nt, Salmonella enterica enterica serovar Typhi
guuuuuagugacagacauu

SEQ ID NO: 3618614 - RNA, 15 nt, Salmonella enterica enterica serovar Typhi
guuuuuaucuuucuu

SEQ ID NO: 3618615 - RNA, 16 nt, Salmonella enterica enterica serovar Typhi
guuuuuccccaucaug

SEQ ID NO: 3618616 - RNA, 19 nt, Salmonella enterica enterica serovar Typhi
guuuuuccgugaaugccaa

SEQ ID NO: 3618617 - RNA, 18 nt, Salmonella enterica enterica serovar Typhi
guuuuuccuuucugcgcc

SEQ ID NO: 3618618 - RNA, 19 nt, Salmonella enterica enterica serovar Typhi
guuuuuccuuucugcgcca

SEQ ID NO: 3618619 - RNA, 17 nt, Salmonella enterica enterica serovar Typhi
guuuuucgaaaauuucg

SEQ ID NO: 3618620 - RNA, 18 nt, Salmonella enterica enterica serovar Typhi
guuuuucgccgaccaucc

SEQ ID NO: 3618621 - RNA, 14 nt, Salmonella enterica enterica serovar Typhi
guuuuucucaucaa

SEQ ID NO: 3618622 - RNA, 18 nt, Salmonella enterica enterica serovar Typhi
guuuuugcgccauugccg

SEQ ID NO: 3618623 - RNA, 22 nt, Salmonella enterica enterica serovar Typhi
guuuuuggaaacuaugcaaaac

SEQ ID NO: 3618624 - RNA, 22 nt, Salmonella enterica enterica serovar Typhi
guuuuuuaaccguucuuccugg

SEQ ID NO: 3618625 - RNA, 13 nt, Salmonella enterica enterica serovar Typhi
guuuuuucaucuc

SEQ ID NO: 3618626 - RNA, 14 nt, Salmonella enterica enterica serovar Typhi
guuuuuucguucca

SEQ ID NO: 3618627 - RNA, 17 nt, Salmonella enterica enterica serovar Typhi
guuuuuuguugauuuua

SEQ ID NO: 3618628 - RNA, 12 nt, Salmonella enterica enterica serovar Typhi
uaaaaaaauaaa

SEQ ID NO: 3618629 - RNA, 12 nt, Salmonella enterica enterica serovar Typhi
uaaaaaacauca

SEQ ID NO: 3618630 - RNA, 15 nt, Salmonella enterica enterica serovar Typhi
uaaaaaagaggaaug

SEQ ID NO: 3618631 - RNA, 21 nt, Salmonella enterica enterica serovar Typhi
uaaaaaagccguauuuuauuu

SEQ ID NO: 3618632 - RNA, 13 nt, Salmonella enterica enterica serovar Typhi
uaaaaaagcugcg

SEQ ID NO: 3618633 - RNA, 11 nt, Salmonella enterica enterica serovar Typhi
uaaaaaaggca

SEQ ID NO: 3618634 - RNA, 23 nt, Salmonella enterica enterica serovar Typhi
uaaaaaaggcagaagaaucugcc

SEQ ID NO: 3618635 - RNA, 17 nt, Salmonella enterica enterica serovar Typhi
uaaaaaauccugcacuu

SEQ ID NO: 3618636 - RNA, 15 nt, Salmonella enterica enterica serovar Typhi
uaaaaacaauaaaua

SEQ ID NO: 3618637 - RNA, 20 nt, Salmonella enterica enterica serovar Typhi
uaaaaacaauaaauaacgug

SEQ ID NO: 3618638 - RNA, 10 nt, Salmonella enterica enterica serovar Typhi
uaaaaaccag

SEQ ID NO: 3618639 - RNA, 17 nt, Salmonella enterica enterica serovar Typhi
uaaaaaccagaauuucc

SEQ ID NO: 3618640 - RNA, 12 nt, Salmonella enterica enterica serovar Typhi
uaaaaaccaggc

SEQ ID NO: 3618641 - RNA, 15 nt, Salmonella enterica enterica serovar Typhi
uaaaaacccaccagc

SEQ ID NO: 3618642 - RNA, 16 nt, Salmonella enterica enterica serovar Typhi
uaaaaacccaccagcg

SEQ ID NO: 3618643 - RNA, 18 nt, Salmonella enterica enterica serovar Typhi
uaaaaacggguaggccgg

SEQ ID NO: 3618644 - RNA, 18 nt, Salmonella enterica enterica serovar Typhi
uaaaaacugcuaaaagaa

SEQ ID NO: 3618645 - RNA, 22 nt, Salmonella enterica enterica serovar Typhi
uaaaaagcacaucagcaaauga

SEQ ID NO: 3618646 - RNA, 18 nt, Salmonella enterica enterica serovar Typhi
uaaaaagccagcguaaau

SEQ ID NO: 3618647 - RNA, 17 nt, Salmonella enterica enterica serovar Typhi
uaaaaagcgucaguaaa

SEQ ID NO: 3618648 - RNA, 19 nt, Salmonella enterica enterica serovar Typhi
uaaaaagcgucaguaaaag

SEQ ID NO: 3618649 - RNA, 11 nt, Salmonella enterica enterica serovar Typhi
uaaaaaggaaa

SEQ ID NO: 3618650 - RNA, 16 nt, Salmonella enterica enterica serovar Typhi
uaaaaauauccgccau

SEQ ID NO: 3618651 - RNA, 21 nt, Salmonella enterica enterica serovar Typhi
uaaaaauauggcgggccugug

SEQ ID NO: 3618652 - RNA, 20 nt, Salmonella enterica enterica serovar Typhi
uaaaaauauggggguaaaca

SEQ ID NO: 3618653 - RNA, 20 nt, Salmonella enterica enterica serovar Typhi
uaaaaauucaaaaaagcagu

SEQ ID NO: 3618654 - RNA, 17 nt, Salmonella enterica enterica serovar Typhi
uaaaaauuguuccugua

SEQ ID NO: 3618655 - RNA, 21 nt, Salmonella enterica enterica serovar Typhi
uaaaacaccgguugcgcaacc

SEQ ID NO: 3618656 - RNA, 17 nt, Salmonella enterica enterica serovar Typhi
uaaaaccggcacaucca

SEQ ID NO: 3618657 - RNA, 22 nt, Salmonella enterica enterica serovar Typhi
uaaaaccggucuggcucacuga

SEQ ID NO: 3618658 - RNA, 20 nt, Salmonella enterica enterica serovar Typhi
uaaagccucucguaagagag

SEQ ID NO: 3618659 - RNA, 13 nt, Salmonella enterica enterica serovar Typhi
uaaagccuucaug

SEQ ID NO: 3618660 - RNA, 18 nt, Salmonella enterica enterica serovar Typhi
uaaagccuucaugcuucu

SEQ ID NO: 3618661 - RNA, 15 nt, Salmonella enterica enterica serovar Typhi
uaaagcgaauaacau

SEQ ID NO: 3618662 - RNA, 16 nt, Salmonella enterica enterica serovar Typhi
uaaagcgccacaacgu

SEQ ID NO: 3618663 - RNA, 21 nt, Salmonella enterica enterica serovar Typhi
uaaagcgcgggccugccuguu

SEQ ID NO: 3618664 - RNA, 22 nt, Salmonella enterica enterica serovar Typhi
uaaagcgcgggccugccuguuu

SEQ ID NO: 3618665 - RNA, 19 nt, Salmonella enterica enterica serovar Typhi
uaaagcgcucguuauaauu

SEQ ID NO: 3618666 - RNA, 22 nt, Salmonella enterica enterica serovar Typhi
uaaagcgcuggcggcgacgaua

SEQ ID NO: 3618667 - RNA, 18 nt, Salmonella enterica enterica serovar Typhi
uaaagcggucuuucaaca

SEQ ID NO: 3618668 - RNA, 14 nt, Salmonella enterica enterica serovar Typhi
uaaaggaugccacu

SEQ ID NO: 3618669 - RNA, 13 nt, Salmonella enterica enterica serovar Typhi
uaaaggcgaaacc

SEQ ID NO: 3618670 - RNA, 21 nt, Salmonella enterica enterica serovar Typhi
uaaaguacggcgcgccaauaa

SEQ ID NO: 3618671 - RNA, 18 nt, Salmonella enterica enterica serovar Typhi
uaaaguccugcgucgcuu

SEQ ID NO: 3618672 - RNA, 14 nt, Salmonella enterica enterica serovar Typhi
uaaagugaguguua

SEQ ID NO: 3618673 - RNA, 15 nt, Salmonella enterica enterica serovar Typhi
uaaaguguuaucaug

SEQ ID NO: 3618674 - RNA, 17 nt, Salmonella enterica enterica serovar Typhi
uaaaguuuuucauaucc

SEQ ID NO: 3618675 - RNA, 12 nt, Salmonella enterica enterica serovar Typhi
uaaauaaacagc

SEQ ID NO: 3618676 - RNA, 22 nt, Salmonella enterica enterica serovar Typhi
uaaauaaauaguaaauagaaaa

SEQ ID NO: 3618677 - RNA, 16 nt, Salmonella enterica enterica serovar Typhi
uaaauaacaaaugaag

SEQ ID NO: 3618678 - RNA, 14 nt, Salmonella enterica enterica serovar Typhi
uaaauaacaggaau

SEQ ID NO: 3618679 - RNA, 17 nt, Salmonella enterica enterica serovar Typhi
uaaauaaccgguaacug

SEQ ID NO: 3618680 - RNA, 13 nt, Salmonella enterica enterica serovar Typhi
uaaauaauucacg

SEQ ID NO: 3618681 - RNA, 13 nt, Salmonella enterica enterica serovar Typhi
uaaauaauuuugu

SEQ ID NO: 3618682 - RNA, 19 nt, Salmonella enterica enterica serovar Typhi
uaaauacaauucaacucac

SEQ ID NO: 3618683 - RNA, 22 nt, Salmonella enterica enterica serovar Typhi
uaaauacaccaaacgaauuuaa

SEQ ID NO: 3618684 - RNA, 15 nt, Salmonella enterica enterica serovar Typhi
uaaauaccaggcacu

SEQ ID NO: 3618685 - RNA, 18 nt, Salmonella enterica enterica serovar Typhi
uaaauaccgcaauaaaca

SEQ ID NO: 3618686 - RNA, 20 nt, Salmonella enterica enterica serovar Typhi
uaaauaccuucgugaugugg

SEQ ID NO: 3618687 - RNA, 17 nt, Salmonella enterica enterica serovar Typhi
uaaauacgccgccagca

SEQ ID NO: 3618688 - RNA, 13 nt, Salmonella enterica enterica serovar Typhi
uaaauagaaaaua

SEQ ID NO: 3618689 - RNA, 14 nt, Salmonella enterica enterica serovar Typhi
uaaauagcaauuau

SEQ ID NO: 3618690 - RNA, 14 nt, Salmonella enterica enterica serovar Typhi
uaaauagccagcau

SEQ ID NO: 3618691 - RNA, 20 nt, Salmonella enterica enterica serovar Typhi
uaaauaggagaugcacggau

SEQ ID NO: 3618692 - RNA, 16 nt, Salmonella enterica enterica serovar Typhi
uaaauaggcgccgccg

SEQ ID NO: 3618693 - RNA, 14 nt, Salmonella enterica enterica serovar Typhi
uaaauaggcggcau

SEQ ID NO: 3618694 - RNA, 16 nt, Salmonella enterica enterica serovar Typhi
uaaauaguaaauagaa

SEQ ID NO: 3618695 - RNA, 16 nt, Salmonella enterica enterica serovar Typhi
uaaauauaagaucuau

SEQ ID NO: 3618696 - RNA, 16 nt, Salmonella enterica enterica serovar Typhi
uaaauaugaaagagaa

SEQ ID NO: 3618697 - RNA, 22 nt, Salmonella enterica enterica serovar Typhi
uaaauaugaaagagaaaucuca

SEQ ID NO: 3618698 - RNA, 17 nt, Salmonella enterica enterica serovar Typhi
uaaauauucaucaaaau

SEQ ID NO: 3618699 - RNA, 20 nt, Salmonella enterica enterica serovar Typhi
uaaauauuggcggcaaagaa

SEQ ID NO: 3618700 - RNA, 15 nt, Salmonella enterica enterica serovar Typhi
uaaaucagauaacaa

SEQ ID NO: 3618701 - RNA, 17 nt, Salmonella enterica enterica serovar Typhi
uaaaucagcacacgcca

SEQ ID NO: 3618702 - RNA, 10 nt, Salmonella enterica enterica serovar Typhi
uaaaucagcc

SEQ ID NO: 3618703 - RNA, 12 nt, Salmonella enterica enterica serovar Typhi
uaaaucagcgau

SEQ ID NO: 3618704 - RNA, 16 nt, Salmonella enterica enterica serovar Typhi
uaaaucagcgcggcaa

SEQ ID NO: 3618705 - RNA, 20 nt, Salmonella enterica enterica serovar Typhi
uaaaucagcgcggcaaggau

SEQ ID NO: 3618706 - RNA, 23 nt, Salmonella enterica enterica serovar Typhi
uaaaucagcuuugcggccagcau

SEQ ID NO: 3618707 - RNA, 15 nt, Salmonella enterica enterica serovar Typhi
uaaaucaggaaaaag

SEQ ID NO: 3618708 - RNA, 17 nt, Salmonella enterica enterica serovar Typhi
uaaaucaggccaagcaa

SEQ ID NO: 3618709 - RNA, 14 nt, Salmonella enterica enterica serovar Typhi
uaaaucaucauaau

SEQ ID NO: 3618710 - RNA, 15 nt, Salmonella enterica enterica serovar Typhi
uaaaucauuacuuau

SEQ ID NO: 3618711 - RNA, 19 nt, Salmonella enterica enterica serovar Typhi
uaaaucauuacuuauauuu

SEQ ID NO: 3618712 - RNA, 19 nt, Salmonella enterica enterica serovar Typhi
uaaaucauuuguacaaaaa

SEQ ID NO: 3618713 - RNA, 21 nt, Salmonella enterica enterica serovar Typhi
uaaauccaauagacuucacuu

SEQ ID NO: 3618714 - RNA, 16 nt, Salmonella enterica enterica serovar Typhi
uaaauccagccucucc

SEQ ID NO: 3618715 - RNA, 19 nt, Salmonella enterica enterica serovar Typhi
uaaaucccggcgauuaaua

SEQ ID NO: 3618716 - RNA, 14 nt, Salmonella enterica enterica serovar Typhi
uaaauccggcgcuu

SEQ ID NO: 3618717 - RNA, 19 nt, Salmonella enterica enterica serovar Typhi
uaaauccguuaagcccuga

SEQ ID NO: 3618718 - RNA, 14 nt, Salmonella enterica enterica serovar Typhi
uaaauccuucgccg

SEQ ID NO: 3618719 - RNA, 14 nt, Salmonella enterica enterica serovar Typhi
uaaaucgcggcgcu

SEQ ID NO: 3618720 - RNA, 14 nt, Salmonella enterica enterica serovar Typhi
uaaaucugccguca

SEQ ID NO: 3618721 - RNA, 22 nt, Salmonella enterica enterica serovar Typhi
uaaaucugccgucaucgacuuc

SEQ ID NO: 3618722 - RNA, 14 nt, Salmonella enterica enterica serovar Typhi
uaaaugaacuuaca

SEQ ID NO: 3618723 - RNA, 14 nt, Salmonella enterica enterica serovar Typhi
uaaaugaauuauuu

SEQ ID NO: 3618724 - RNA, 20 nt, Salmonella enterica enterica serovar Typhi
uaaaugaauuauuuuuucau

SEQ ID NO: 3618725 - RNA, 17 nt, Salmonella enterica enterica serovar Typhi
uaaaugcuugcuuuagc

SEQ ID NO: 3618726 - RNA, 15 nt, Salmonella enterica enterica serovar Typhi
uaaaugggcaggaga

SEQ ID NO: 3618727 - RNA, 13 nt, Salmonella enterica enterica serovar Typhi
uaaaugucaggau

SEQ ID NO: 3618728 - RNA, 19 nt, Salmonella enterica enterica serovar Typhi
uaaaugucugaauauuaaa

SEQ ID NO: 3618729 - RNA, 20 nt, Salmonella enterica enterica serovar Typhi
uaaauuaaacagcuguaaau

SEQ ID NO: 3618730 - RNA, 20 nt, Salmonella enterica enterica serovar Typhi
uaaauuaaugauuaaaauaa

SEQ ID NO: 3618731 - RNA, 14 nt, Salmonella enterica enterica serovar Typhi
uaaauucauauuua

SEQ ID NO: 3618732 - RNA, 19 nt, Salmonella enterica enterica serovar Typhi
uaaauucauauuuaaauau

SEQ ID NO: 3618733 - RNA, 18 nt, Salmonella enterica enterica serovar Typhi
uaaauuccggcucgccuu

SEQ ID NO: 3618734 - RNA, 14 nt, Salmonella enterica enterica serovar Typhi
uaaauucucuauac

SEQ ID NO: 3618735 - RNA, 16 nt, Salmonella enterica enterica serovar Typhi
uaaauucugucucaau

SEQ ID NO: 3618736 - RNA, 15 nt, Salmonella enterica enterica serovar Typhi
uaaauugaguggaca

SEQ ID NO: 3618737 - RNA, 13 nt, Salmonella enterica enterica serovar Typhi
uaaauuuacucag

SEQ ID NO: 3618738 - RNA, 22 nt, Salmonella enterica enterica serovar Typhi
uaaauuuaugguuccugaaaua

SEQ ID NO: 3618739 - RNA, 17 nt, Salmonella enterica enterica serovar Typhi
uaaauuuauuuuuugcu

SEQ ID NO: 3618740 - RNA, 15 nt, Salmonella enterica enterica serovar Typhi
uaaauuuuuuaacag

SEQ ID NO: 3618741 - RNA, 13 nt, Salmonella enterica enterica serovar Typhi
uaacaaaaaacau

SEQ ID NO: 3618742 - RNA, 14 nt, Salmonella enterica enterica serovar Typhi
uaacaaaaaacaua

SEQ ID NO: 3618743 - RNA, 20 nt, Salmonella enterica enterica serovar Typhi
uaacaaaccgguaaucccuu

SEQ ID NO: 3618744 - RNA, 20 nt, Salmonella enterica enterica serovar Typhi
uaacgcgaauccgccauagc

SEQ ID NO: 3618745 - RNA, 23 nt, Salmonella enterica enterica serovar Typhi
uaacgcgcuggaugcgcaaaugc

SEQ ID NO: 3618746 - RNA, 17 nt, Salmonella enterica enterica serovar Typhi
uaacgcggguuagcgcc

SEQ ID NO: 3618747 - RNA, 18 nt, Salmonella enterica enterica serovar Typhi
uaacgcguaaucuuccac

SEQ ID NO: 3618748 - RNA, 20 nt, Salmonella enterica enterica serovar Typhi
uaacgcguacccggcuuaca

SEQ ID NO: 3618749 - RNA, 23 nt, Salmonella enterica enterica serovar Typhi
uaacgcguccaacuggcuuucau

SEQ ID NO: 3618750 - RNA, 23 nt, Salmonella enterica enterica serovar Typhi
uaacgcguguucuuuuucgccuu

SEQ ID NO: 3618751 - RNA, 13 nt, Salmonella enterica enterica serovar Typhi
uaacgcugcaaag

SEQ ID NO: 3618752 - RNA, 16 nt, Salmonella enterica enterica serovar Typhi
uaacggaaaagcauug

SEQ ID NO: 3618753 - RNA, 17 nt, Salmonella enterica enterica serovar Typhi
uaacggaaaagcauugc

SEQ ID NO: 3618754 - RNA, 13 nt, Salmonella enterica enterica serovar Typhi
uaacggaaucaga

SEQ ID NO: 3618755 - RNA, 16 nt, Salmonella enterica enterica serovar Typhi
uaacggcaaaaacguu

SEQ ID NO: 3618756 - RNA, 19 nt, Salmonella enterica enterica serovar Typhi
uaacggcgccacgcccacg

SEQ ID NO: 3618757 - RNA, 22 nt, Salmonella enterica enterica serovar Typhi
uaacggcugacgcccaucagca

SEQ ID NO: 3618758 - RNA, 23 nt, Salmonella enterica enterica serovar Typhi
uaacggucauaucgucaucgguc

SEQ ID NO: 3618759 - RNA, 19 nt, Salmonella enterica enterica serovar Typhi
uaacguacagguugugcau

SEQ ID NO: 3618760 - RNA, 17 nt, Salmonella enterica enterica serovar Typhi
uaacguauuucuuuugc

SEQ ID NO: 3618761 - RNA, 22 nt, Salmonella enterica enterica serovar Typhi
uaacgucgcgguuacagucuuu

SEQ ID NO: 3618762 - RNA, 19 nt, Salmonella enterica enterica serovar Typhi
uaacgucguaaauuccugc

SEQ ID NO: 3618763 - RNA, 22 nt, Salmonella enterica enterica serovar Typhi
uaacguguuuucgauuucauuc

SEQ ID NO: 3618764 - RNA, 13 nt, Salmonella enterica enterica serovar Typhi
uaacguuuaaacu

SEQ ID NO: 3618765 - RNA, 13 nt, Salmonella enterica enterica serovar Typhi
uaacguuuucagu

SEQ ID NO: 3618766 - RNA, 22 nt, Salmonella enterica enterica serovar Typhi
uaacuaauuguuuguagaaagu

SEQ ID NO: 3618767 - RNA, 16 nt, Salmonella enterica enterica serovar Typhi
uaacuacaauacucac

SEQ ID NO: 3618768 - RNA, 20 nt, Salmonella enterica enterica serovar Typhi
uaacuauaauugcuuuuuuc

SEQ ID NO: 3618769 - RNA, 18 nt, Salmonella enterica enterica serovar Typhi
uaacucaauagcggugcu

SEQ ID NO: 3618770 - RNA, 23 nt, Salmonella enterica enterica serovar Typhi
uaacuccagugcagaaaguguga

SEQ ID NO: 3618771 - RNA, 21 nt, Salmonella enterica enterica serovar Typhi
uaacuccccgccccagcagca

SEQ ID NO: 3618772 - RNA, 19 nt, Salmonella enterica enterica serovar Typhi
uaacuccuucuaauuccag

SEQ ID NO: 3618773 - RNA, 14 nt, Salmonella enterica enterica serovar Typhi
uaacucguccuguu

SEQ ID NO: 3618774 - RNA, 13 nt, Salmonella enterica enterica serovar Typhi
uaacucuucaucg

SEQ ID NO: 3618775 - RNA, 23 nt, Salmonella enterica enterica serovar Typhi
uaacucuuuuucagcaaauacag

SEQ ID NO: 3618776 - RNA, 23 nt, Salmonella enterica enterica serovar Typhi
uaacugaacuuccguaaaaagaa

SEQ ID NO: 3618777 - RNA, 17 nt, Salmonella enterica enterica serovar Typhi
uaacugaagguuuuucc

SEQ ID NO: 3618778 - RNA, 12 nt, Salmonella enterica enterica serovar Typhi
uaacugacagac

SEQ ID NO: 3618779 - RNA, 13 nt, Salmonella enterica enterica serovar Typhi
uaacugacagacu

SEQ ID NO: 3618780 - RNA, 16 nt, Salmonella enterica enterica serovar Typhi
uaacugacucugccuc

SEQ ID NO: 3618781 - RNA, 15 nt, Salmonella enterica enterica serovar Typhi
uaacugcaaacgcgg

SEQ ID NO: 3618782 - RNA, 21 nt, Salmonella enterica enterica serovar Typhi
uaacugcaaaucuucggcaaa

SEQ ID NO: 3618783 - RNA, 16 nt, Salmonella enterica enterica serovar Typhi
uaacugccagaacgcu

SEQ ID NO: 3618784 - RNA, 18 nt, Salmonella enterica enterica serovar Typhi
uaacugcccguuacgcau

SEQ ID NO: 3618785 - RNA, 21 nt, Salmonella enterica enterica serovar Typhi
uaacugcccguuacgcauuuc

SEQ ID NO: 3618786 - RNA, 11 nt, Salmonella enterica enterica serovar Typhi
uaacugcggua

SEQ ID NO: 3618787 - RNA, 13 nt, Salmonella enterica enterica serovar Typhi
uaacuggaaaaag

SEQ ID NO: 3618788 - RNA, 21 nt, Salmonella enterica enterica serovar Typhi
uaacuggaaaaagaccaauac

SEQ ID NO: 3618789 - RNA, 12 nt, Salmonella enterica enterica serovar Typhi
uaacugucagau

SEQ ID NO: 3618790 - RNA, 18 nt, Salmonella enterica enterica serovar Typhi
uaacuuaaacgccggauu

SEQ ID NO: 3618791 - RNA, 16 nt, Salmonella enterica enterica serovar Typhi
uaacuuauugauuuuc

SEQ ID NO: 3618792 - RNA, 23 nt, Salmonella enterica enterica serovar Typhi
uaacuuccuuugccuuucuuauu

SEQ ID NO: 3618793 - RNA, 18 nt, Salmonella enterica enterica serovar Typhi
uaacuucgcgguuagaaa

SEQ ID NO: 3618794 - RNA, 16 nt, Salmonella enterica enterica serovar Typhi
uaacuucggccagcga

SEQ ID NO: 3618795 - RNA, 14 nt, Salmonella enterica enterica serovar Typhi
uaacuucuccgcca

SEQ ID NO: 3618796 - RNA, 23 nt, Salmonella enterica enterica serovar Typhi
uaacuucuugguaccaaacagca

SEQ ID NO: 3618797 - RNA, 13 nt, Salmonella enterica enterica serovar Typhi
uaagaacgagaac

SEQ ID NO: 3618798 - RNA, 21 nt, Salmonella enterica enterica serovar Typhi
uaagaaucagaugcucaucaa

SEQ ID NO: 3618799 - RNA, 21 nt, Salmonella enterica enterica serovar Typhi
uaagaaugcgcgucaggccag

SEQ ID NO: 3618800 - RNA, 12 nt, Salmonella enterica enterica serovar Typhi
uaagaauuaaca

SEQ ID NO: 3618801 - RNA, 14 nt, Salmonella enterica enterica serovar Typhi
uaagaccagcauca

SEQ ID NO: 3618802 - RNA, 18 nt, Salmonella enterica enterica serovar Typhi
uaagaccgguacgcaacg

SEQ ID NO: 3618803 - RNA, 19 nt, Salmonella enterica enterica serovar Typhi
uaagaccgguacgcaacgc

SEQ ID NO: 3618804 - RNA, 14 nt, Salmonella enterica enterica serovar Typhi
uaagagacugacaa

SEQ ID NO: 3618805 - RNA, 22 nt, Salmonella enterica enterica serovar Typhi
uaagagagccuuacaggcgcau

SEQ ID NO: 3618806 - RNA, 16 nt, Salmonella enterica enterica serovar Typhi
uaagagcguuacccag

SEQ ID NO: 3618807 - RNA, 23 nt, Salmonella enterica enterica serovar Typhi
uaagagcguuacccagacagcaa

SEQ ID NO: 3618808 - RNA, 14 nt, Salmonella enterica enterica serovar Typhi
uaagagcuggccgg

SEQ ID NO: 3618809 - RNA, 16 nt, Salmonella enterica enterica serovar Typhi
uaagaggcauaaaaaa

SEQ ID NO: 3618810 - RNA, 20 nt, Salmonella enterica enterica serovar Typhi
uaagaggguggcgagcaacu

SEQ ID NO: 3618811 - RNA, 19 nt, Salmonella enterica enterica serovar Typhi
uaagaguccauucggccug

SEQ ID NO: 3618812 - RNA, 20 nt, Salmonella enterica enterica serovar Typhi
uaagauauuuuguuuuaaau

SEQ ID NO: 3618813 - RNA, 18 nt, Salmonella enterica enterica serovar Typhi
uaagaucggguggccuaa

SEQ ID NO: 3618814 - RNA, 12 nt, Salmonella enterica enterica serovar Typhi
uaagauguuuua

SEQ ID NO: 3618815 - RNA, 23 nt, Salmonella enterica enterica serovar Typhi
uaagauucccccgcaugaaaugc

SEQ ID NO: 3618816 - RNA, 16 nt, Salmonella enterica enterica serovar Typhi
uaagauuuacaacaga

SEQ ID NO: 3618817 - RNA, 21 nt, Salmonella enterica enterica serovar Typhi
uaagcaacugauuaaucugcc

SEQ ID NO: 3618818 - RNA, 20 nt, Salmonella enterica enterica serovar Typhi
uaagcaacuugaaguaugaa

SEQ ID NO: 3618819 - RNA, 14 nt, Salmonella enterica enterica serovar Typhi
uaagcaagcgccau

SEQ ID NO: 3618820 - RNA, 14 nt, Salmonella enterica enterica serovar Typhi
uaagcaauauggcu

SEQ ID NO: 3618821 - RNA, 22 nt, Salmonella enterica enterica serovar Typhi
uaagcaauccauuuuaaauaca

SEQ ID NO: 3618822 - RNA, 23 nt, Salmonella enterica enterica serovar Typhi
uaagcaauccauuuuaaauacac

SEQ ID NO: 3618823 - RNA, 12 nt, Salmonella enterica enterica serovar Typhi
uaagcaauuaau

SEQ ID NO: 3618824 - RNA, 13 nt, Salmonella enterica enterica serovar Typhi
uaagcacaccauu

SEQ ID NO: 3618825 - RNA, 14 nt, Salmonella enterica enterica serovar Typhi
uaagcacaggccau

SEQ ID NO: 3618826 - RNA, 20 nt, Salmonella enterica enterica serovar Typhi
uaagcacgggcuugaauaac

SEQ ID NO: 3618827 - RNA, 20 nt, Salmonella enterica enterica serovar Typhi
uaagcagcugcuuaacuucu

SEQ ID NO: 3618828 - RNA, 15 nt, Salmonella enterica enterica serovar Typhi
uaagcauccaggaag

SEQ ID NO: 3618829 - RNA, 17 nt, Salmonella enterica enterica serovar Typhi
uaauaugcgcaaucacc

SEQ ID NO: 3618830 - RNA, 19 nt, Salmonella enterica enterica serovar Typhi
uaauaugcgcaaucaccuc

SEQ ID NO: 3618831 - RNA, 16 nt, Salmonella enterica enterica serovar Typhi
uaauauuaagcagcuu

SEQ ID NO: 3618832 - RNA, 20 nt, Salmonella enterica enterica serovar Typhi
uaauauuaagcagcuuaucg

SEQ ID NO: 3618833 - RNA, 20 nt, Salmonella enterica enterica serovar Typhi
uaauauugaccgcuuuuucc

SEQ ID NO: 3618834 - RNA, 15 nt, Salmonella enterica enterica serovar Typhi
uaaucaacucuccuu

SEQ ID NO: 3618835 - RNA, 21 nt, Salmonella enterica enterica serovar Typhi
uaaucaacugcgccacaucau

SEQ ID NO: 3618836 - RNA, 20 nt, Salmonella enterica enterica serovar Typhi
uaaucaauaaguuuuuucuu

SEQ ID NO: 3618837 - RNA, 16 nt, Salmonella enterica enterica serovar Typhi
uaaucacaucauuaaa

SEQ ID NO: 3618838 - RNA, 12 nt, Salmonella enterica enterica serovar Typhi
uaaucaccagcc

SEQ ID NO: 3618839 - RNA, 19 nt, Salmonella enterica enterica serovar Typhi
uaaucaccagcccgaaucc

SEQ ID NO: 3618840 - RNA, 15 nt, Salmonella enterica enterica serovar Typhi
uaaucaccagcgcau

SEQ ID NO: 3618841 - RNA, 14 nt, Salmonella enterica enterica serovar Typhi
uaaucacugcaccu

SEQ ID NO: 3618842 - RNA, 13 nt, Salmonella enterica enterica serovar Typhi
uaaucagcacauu

SEQ ID NO: 3618843 - RNA, 19 nt, Salmonella enterica enterica serovar Typhi
uaaucagcacauucagcag

SEQ ID NO: 3618844 - RNA, 21 nt, Salmonella enterica enterica serovar Typhi
uaaucaggacaucaaaggcag

SEQ ID NO: 3618845 - RNA, 20 nt, Salmonella enterica enterica serovar Typhi
uaaucaggcauucagcgggu

SEQ ID NO: 3618846 - RNA, 15 nt, Salmonella enterica enterica serovar Typhi
uaaucaggguaauaa

SEQ ID NO: 3618847 - RNA, 16 nt, Salmonella enterica enterica serovar Typhi
uaaucauauaagaaau

SEQ ID NO: 3618848 - RNA, 20 nt, Salmonella enterica enterica serovar Typhi
uaaucauauaagaaauaguu

SEQ ID NO: 3618849 - RNA, 13 nt, Salmonella enterica enterica serovar Typhi
uaaucaucaugcu

SEQ ID NO: 3618850 - RNA, 18 nt, Salmonella enterica enterica serovar Typhi
uaauccaggaauuuuccc

SEQ ID NO: 3618851 - RNA, 19 nt, Salmonella enterica enterica serovar Typhi
uaauccaggaauuuuccca

SEQ ID NO: 3618852 - RNA, 18 nt, Salmonella enterica enterica serovar Typhi
uaaucccgaaucacuuac

SEQ ID NO: 3618853 - RNA, 17 nt, Salmonella enterica enterica serovar Typhi
uaaucccgccagccuua

SEQ ID NO: 3618854 - RNA, 18 nt, Salmonella enterica enterica serovar Typhi
uaaucccuucuuuuacug

SEQ ID NO: 3618855 - RNA, 18 nt, Salmonella enterica enterica serovar Typhi
uaauccgcugcaacuccc

SEQ ID NO: 3618856 - RNA, 20 nt, Salmonella enterica enterica serovar Typhi
uaauccggcaacugccgggg

SEQ ID NO: 3618857 - RNA, 20 nt, Salmonella enterica enterica serovar Typhi
uaauccuuguccauguaaac

SEQ ID NO: 3618858 - RNA, 14 nt, Salmonella enterica enterica serovar Typhi
uaaucgaaucgccu

SEQ ID NO: 3618859 - RNA, 20 nt, Salmonella enterica enterica serovar Typhi
uaaucgaaucgccucaacca

SEQ ID NO: 3618860 - RNA, 21 nt, Salmonella enterica enterica serovar Typhi
uaaucgagacuguuugacacu

SEQ ID NO: 3618861 - RNA, 22 nt, Salmonella enterica enterica serovar Typhi
uaaucgagcccagacuuuccag

SEQ ID NO: 3618862 - RNA, 15 nt, Salmonella enterica enterica serovar Typhi
uaaucgauaagccag

SEQ ID NO: 3618863 - RNA, 18 nt, Salmonella enterica enterica serovar Typhi
uaaucgauaagccagcga

SEQ ID NO: 3618864 - RNA, 18 nt, Salmonella enterica enterica serovar Typhi
uaaucgauauaauuuuau

SEQ ID NO: 3618865 - RNA, 21 nt, Salmonella enterica enterica serovar Typhi
uaaucgccugcauauuagcaa

SEQ ID NO: 3618866 - RNA, 20 nt, Salmonella enterica enterica serovar Typhi
uaaucgcgauuuuuuuccgc

SEQ ID NO: 3618867 - RNA, 13 nt, Salmonella enterica enterica serovar Typhi
uaaucgcgcgcuu

SEQ ID NO: 3618868 - RNA, 17 nt, Salmonella enterica enterica serovar Typhi
uaaucggcaggccaacg

SEQ ID NO: 3618869 - RNA, 17 nt, Salmonella enterica enterica serovar Typhi
uaaucggcgucauuuuc

SEQ ID NO: 3618870 - RNA, 13 nt, Salmonella enterica enterica serovar Typhi
uaaucgucauccc

SEQ ID NO: 3618871 - RNA, 15 nt, Salmonella enterica enterica serovar Typhi
uaaucuaaaauuauu

SEQ ID NO: 3618872 - RNA, 13 nt, Salmonella enterica enterica serovar Typhi
uaaucuacaaacg

SEQ ID NO: 3618873 - RNA, 18 nt, Salmonella enterica enterica serovar Typhi
uaaucugaauaccuugau

SEQ ID NO: 3618874 - RNA, 22 nt, Salmonella enterica enterica serovar Typhi
uaaucugaauaccuugauaacu

SEQ ID NO: 3618875 - RNA, 15 nt, Salmonella enterica enterica serovar Typhi
uaaucugccagcuua

SEQ ID NO: 3618876 - RNA, 23 nt, Salmonella enterica enterica serovar Typhi
uaaucugccagcuuaaaucgcgg

SEQ ID NO: 3618877 - RNA, 19 nt, Salmonella enterica enterica serovar Typhi
uaaucugucgcuaaagcac

SEQ ID NO: 3618878 - RNA, 21 nt, Salmonella enterica enterica serovar Typhi
uaaucugugauugaauucacc

SEQ ID NO: 3618879 - RNA, 14 nt, Salmonella enterica enterica serovar Typhi
uaaucuuauccagc

SEQ ID NO: 3618880 - RNA, 23 nt, Salmonella enterica enterica serovar Typhi
uaaucuuauccagcguuaaaaua

SEQ ID NO: 3618881 - RNA, 14 nt, Salmonella enterica enterica serovar Typhi
uaaucuuuucauau

SEQ ID NO: 3618882 - RNA, 20 nt, Salmonella enterica enterica serovar Typhi
uaaugaaaucgucgccaaca

SEQ ID NO: 3618883 - RNA, 19 nt, Salmonella enterica enterica serovar Typhi
uaaugaagacguugaauau

SEQ ID NO: 3618884 - RNA, 19 nt, Salmonella enterica enterica serovar Typhi
uaaugaagcauaaaaagac

SEQ ID NO: 3618885 - RNA, 16 nt, Salmonella enterica enterica serovar Typhi
uaaugacauagugcaa

SEQ ID NO: 3618886 - RNA, 15 nt, Salmonella enterica enterica serovar Typhi
uaaugacauccagag

SEQ ID NO: 3618887 - RNA, 16 nt, Salmonella enterica enterica serovar Typhi
uaaugacuaauuauua

SEQ ID NO: 3618888 - RNA, 17 nt, Salmonella enterica enterica serovar Typhi
uaaugacuaauuauuau

SEQ ID NO: 3618889 - RNA, 19 nt, Salmonella enterica enterica serovar Typhi
uaaugagcgucgccagacc

SEQ ID NO: 3618890 - RNA, 19 nt, Salmonella enterica enterica serovar Typhi
uaaugaguagaacguauua

SEQ ID NO: 3618891 - RNA, 16 nt, Salmonella enterica enterica serovar Typhi
uaaugauuaaaauaaa

SEQ ID NO: 3618892 - RNA, 16 nt, Salmonella enterica enterica serovar Typhi
uaaugauuguccagcc

SEQ ID NO: 3618893 - RNA, 21 nt, Salmonella enterica enterica serovar Typhi
uaaugcaauaaacuaaguaag

SEQ ID NO: 3618894 - RNA, 21 nt, Salmonella enterica enterica serovar Typhi
uaaugcaauauuacaaagcag

SEQ ID NO: 3618895 - RNA, 21 nt, Salmonella enterica enterica serovar Typhi
uaaugcagcgucugcccuccu

SEQ ID NO: 3618896 - RNA, 19 nt, Salmonella enterica enterica serovar Typhi
uaaugcaggcagcacugcu

SEQ ID NO: 3618897 - RNA, 15 nt, Salmonella enterica enterica serovar Typhi
uaaugcauggcagau

SEQ ID NO: 3618898 - RNA, 15 nt, Salmonella enterica enterica serovar Typhi
uaaugcauuggccag

SEQ ID NO: 3618899 - RNA, 15 nt, Salmonella enterica enterica serovar Typhi
uaaugcccaccgugg

SEQ ID NO: 3618900 - RNA, 15 nt, Salmonella enterica enterica serovar Typhi
uaaugcccgauggcg

SEQ ID NO: 3618901 - RNA, 20 nt, Salmonella enterica enterica serovar Typhi
uaaugcccggcgcggcauca

SEQ ID NO: 3618902 - RNA, 16 nt, Salmonella enterica enterica serovar Typhi
uaaugccuucugaaaa

SEQ ID NO: 3618903 - RNA, 16 nt, Salmonella enterica enterica serovar Typhi
uaaugcgaugccgcac

SEQ ID NO: 3618904 - RNA, 17 nt, Salmonella enterica enterica serovar Typhi
uaaugcgcgcuucuuca

SEQ ID NO: 3618905 - RNA, 20 nt, Salmonella enterica enterica serovar Typhi
uaaugcucuuaaaaugaucg

SEQ ID NO: 3618906 - RNA, 20 nt, Salmonella enterica enterica serovar Typhi
uaaugcuuauccggccuaca

SEQ ID NO: 3618907 - RNA, 15 nt, Salmonella enterica enterica serovar Typhi
uaaugcuuuaaaugc

SEQ ID NO: 3618908 - RNA, 17 nt, Salmonella enterica enterica serovar Typhi
uaaugcuuuaaaugccu

SEQ ID NO: 3618909 - RNA, 11 nt, Salmonella enterica enterica serovar Typhi
uaaugcuuuug

SEQ ID NO: 3618910 - RNA, 17 nt, Salmonella enterica enterica serovar Typhi
uaauggaacugccuggc

SEQ ID NO: 3618911 - RNA, 18 nt, Salmonella enterica enterica serovar Typhi
uaauggcagaauaaaaca

SEQ ID NO: 3618912 - RNA, 19 nt, Salmonella enterica enterica serovar Typhi
uaauggcagaauaaaacag

SEQ ID NO: 3618913 - RNA, 12 nt, Salmonella enterica enterica serovar Typhi
uaauggcccagu

SEQ ID NO: 3618914 - RNA, 17 nt, Salmonella enterica enterica serovar Typhi
uaauggcgccgauaaca

SEQ ID NO: 3618915 - RNA, 14 nt, Salmonella enterica enterica serovar Typhi
uacagccaaaaaua

SEQ ID NO: 3618916 - RNA, 17 nt, Salmonella enterica enterica serovar Typhi
uacagccaaaucagcag

SEQ ID NO: 3618917 - RNA, 18 nt, Salmonella enterica enterica serovar Typhi
uacagccaaaucagcagg

SEQ ID NO: 3618918 - RNA, 21 nt, Salmonella enterica enterica serovar Typhi
uacagccaaaucagcaggaca

SEQ ID NO: 3618919 - RNA, 13 nt, Salmonella enterica enterica serovar Typhi
uacagcgccauga

SEQ ID NO: 3618920 - RNA, 15 nt, Salmonella enterica enterica serovar Typhi
uacagcguguucaug

SEQ ID NO: 3618921 - RNA, 13 nt, Salmonella enterica enterica serovar Typhi
uacaggcaucuuc

SEQ ID NO: 3618922 - RNA, 17 nt, Salmonella enterica enterica serovar Typhi
uacaggcaucuuccagc

SEQ ID NO: 3618923 - RNA, 20 nt, Salmonella enterica enterica serovar Typhi
uacaggcgcaucagaaaaac

SEQ ID NO: 3618924 - RNA, 22 nt, Salmonella enterica enterica serovar Typhi
uacaggcgcaucagaaaaaccu

SEQ ID NO: 3618925 - RNA, 15 nt, Salmonella enterica enterica serovar Typhi
uacaggcggaaauca

SEQ ID NO: 3618926 - RNA, 18 nt, Salmonella enterica enterica serovar Typhi
uacaggcuuaacacccgg

SEQ ID NO: 3618927 - RNA, 14 nt, Salmonella enterica enterica serovar Typhi
uacagguguuaauc

SEQ ID NO: 3618928 - RNA, 13 nt, Salmonella enterica enterica serovar Typhi
uacaguuaccaca

SEQ ID NO: 3618929 - RNA, 14 nt, Salmonella enterica enterica serovar Typhi
uacauacauaccac

SEQ ID NO: 3618930 - RNA, 22 nt, Salmonella enterica enterica serovar Typhi
uacauaggcaauauccuccggc

SEQ ID NO: 3618931 - RNA, 22 nt, Salmonella enterica enterica serovar Typhi
uacauauuauuaugucauagca

SEQ ID NO: 3618932 - RNA, 12 nt, Salmonella enterica enterica serovar Typhi
uacauauuguuu

SEQ ID NO: 3618933 - RNA, 18 nt, Salmonella enterica enterica serovar Typhi
uacauccggcucaagagu

SEQ ID NO: 3618934 - RNA, 13 nt, Salmonella enterica enterica serovar Typhi
uacaucgcgcuga

SEQ ID NO: 3618935 - RNA, 14 nt, Salmonella enterica enterica serovar Typhi
uacaucgucugcuu

SEQ ID NO: 3618936 - RNA, 14 nt, Salmonella enterica enterica serovar Typhi
uacaucuacuucag

SEQ ID NO: 3618937 - RNA, 12 nt, Salmonella enterica enterica serovar Typhi
uacaucuuccau

SEQ ID NO: 3618938 - RNA, 14 nt, Salmonella enterica enterica serovar Typhi
uacaugaauaauaa

SEQ ID NO: 3618939 - RNA, 17 nt, Salmonella enterica enterica serovar Typhi
uacaugccguuaauaau

SEQ ID NO: 3618940 - RNA, 18 nt, Salmonella enterica enterica serovar Typhi
uacauucgcucaggacag

SEQ ID NO: 3618941 - RNA, 13 nt, Salmonella enterica enterica serovar Typhi
uacauugccaguc

SEQ ID NO: 3618942 - RNA, 18 nt, Salmonella enterica enterica serovar Typhi
uacauuucgucaucgcuu

SEQ ID NO: 3618943 - RNA, 22 nt, Salmonella enterica enterica serovar Typhi
uacauuugaauaauucuguacc

SEQ ID NO: 3618944 - RNA, 15 nt, Salmonella enterica enterica serovar Typhi
uacauuuuccaugcc

SEQ ID NO: 3618945 - RNA, 22 nt, Salmonella enterica enterica serovar Typhi
uacauuuucguaaaauauauau

SEQ ID NO: 3618946 - RNA, 19 nt, Salmonella enterica enterica serovar Typhi
uacauuuuuacaguuacca

SEQ ID NO: 3618947 - RNA, 14 nt, Salmonella enterica enterica serovar Typhi
uacauuuuuuucuu

SEQ ID NO: 3618948 - RNA, 16 nt, Salmonella enterica enterica serovar Typhi
uaccaaaacagaaaag

SEQ ID NO: 3618949 - RNA, 18 nt, Salmonella enterica enterica serovar Typhi
uaccaaaacagaaaagau

SEQ ID NO: 3618950 - RNA, 14 nt, Salmonella enterica enterica serovar Typhi
uaccaaacagcaga

SEQ ID NO: 3618951 - RNA, 17 nt, Salmonella enterica enterica serovar Typhi
uaccaaagucaucaauu

SEQ ID NO: 3618952 - RNA, 19 nt, Salmonella enterica enterica serovar Typhi
uaccaaagugguuccaggc

SEQ ID NO: 3618953 - RNA, 15 nt, Salmonella enterica enterica serovar Typhi
uaccaaauauuucuu

SEQ ID NO: 3618954 - RNA, 21 nt, Salmonella enterica enterica serovar Typhi
uaccaaauauuucuuugucgc

SEQ ID NO: 3618955 - RNA, 19 nt, Salmonella enterica enterica serovar Typhi
uaccaaccgccagucaccc

SEQ ID NO: 3618956 - RNA, 20 nt, Salmonella enterica enterica serovar Typhi
uaccaaccgccagucacccu

SEQ ID NO: 3618957 - RNA, 15 nt, Salmonella enterica enterica serovar Typhi
uaccaacguaaauua

SEQ ID NO: 3618958 - RNA, 14 nt, Salmonella enterica enterica serovar Typhi
uaccaacugagcua

SEQ ID NO: 3618959 - RNA, 14 nt, Salmonella enterica enterica serovar Typhi
uaccaauacccagc

SEQ ID NO: 3618960 - RNA, 17 nt, Salmonella enterica enterica serovar Typhi
uaccaauacccagcgcc

SEQ ID NO: 3618961 - RNA, 19 nt, Salmonella enterica enterica serovar Typhi
uaccaaucgcggcgacauc

SEQ ID NO: 3618962 - RNA, 15 nt, Salmonella enterica enterica serovar Typhi
uaccaaugccaaaaa

SEQ ID NO: 3618963 - RNA, 18 nt, Salmonella enterica enterica serovar Typhi
uaccaauuccaccaccuc

SEQ ID NO: 3618964 - RNA, 22 nt, Salmonella enterica enterica serovar Typhi
uaccacaaauuuugauaaaaac

SEQ ID NO: 3618965 - RNA, 17 nt, Salmonella enterica enterica serovar Typhi
uaccacccagccagacg

SEQ ID NO: 3618966 - RNA, 16 nt, Salmonella enterica enterica serovar Typhi
uaccacgcagcggcau

SEQ ID NO: 3618967 - RNA, 20 nt, Salmonella enterica enterica serovar Typhi
uaccacgucugaagaaguuc

SEQ ID NO: 3618968 - RNA, 20 nt, Salmonella enterica enterica serovar Typhi
uaccacuucggcagaaaaag

SEQ ID NO: 3618969 - RNA, 22 nt, Salmonella enterica enterica serovar Typhi
uaccacuucggcagaaaaagua

SEQ ID NO: 3618970 - RNA, 14 nt, Salmonella enterica enterica serovar Typhi
uaccagaaucaucg

SEQ ID NO: 3618971 - RNA, 14 nt, Salmonella enterica enterica serovar Typhi
uaccagcagcgcca

SEQ ID NO: 3618972 - RNA, 16 nt, Salmonella enterica enterica serovar Typhi
uaccagcagcgccagc

SEQ ID NO: 3618973 - RNA, 17 nt, Salmonella enterica enterica serovar Typhi
uaccagcagcgccagcg

SEQ ID NO: 3618974 - RNA, 15 nt, Salmonella enterica enterica serovar Typhi
uaccagcaucgcguu

SEQ ID NO: 3618975 - RNA, 20 nt, Salmonella enterica enterica serovar Typhi
uaccagccgcgcccuaacag

SEQ ID NO: 3618976 - RNA, 23 nt, Salmonella enterica enterica serovar Typhi
uaccagccuucggacugcuggua

SEQ ID NO: 3618977 - RNA, 18 nt, Salmonella enterica enterica serovar Typhi
uaccagcgaaaugcgaau

SEQ ID NO: 3618978 - RNA, 12 nt, Salmonella enterica enterica serovar Typhi
uaccagcggcaa

SEQ ID NO: 3618979 - RNA, 14 nt, Salmonella enterica enterica serovar Typhi
uaccagcggcagcu

SEQ ID NO: 3618980 - RNA, 20 nt, Salmonella enterica enterica serovar Typhi
uaccaggcggcuuuuucauc

SEQ ID NO: 3618981 - RNA, 15 nt, Salmonella enterica enterica serovar Typhi
uaccaguaaugacgc

SEQ ID NO: 3618982 - RNA, 17 nt, Salmonella enterica enterica serovar Typhi
uaccaguaccgaaacca

SEQ ID NO: 3618983 - RNA, 20 nt, Salmonella enterica enterica serovar Typhi
uaccagucgacaguauagaa

SEQ ID NO: 3618984 - RNA, 14 nt, Salmonella enterica enterica serovar Typhi
uaccagugcagaug

SEQ ID NO: 3618985 - RNA, 22 nt, Salmonella enterica enterica serovar Typhi
uaccauaccggugcgccccagc

SEQ ID NO: 3618986 - RNA, 13 nt, Salmonella enterica enterica serovar Typhi
uaccauaucgccg

SEQ ID NO: 3618987 - RNA, 21 nt, Salmonella enterica enterica serovar Typhi
uaccauaucgccgcugccgcu

SEQ ID NO: 3618988 - RNA, 15 nt, Salmonella enterica enterica serovar Typhi
uaccaucaccugcug

SEQ ID NO: 3618989 - RNA, 16 nt, Salmonella enterica enterica serovar Typhi
uaccauccauuaaaau

SEQ ID NO: 3618990 - RNA, 13 nt, Salmonella enterica enterica serovar Typhi
uaccauucagcuu

SEQ ID NO: 3618991 - RNA, 14 nt, Salmonella enterica enterica serovar Typhi
uaccauucagcuua

SEQ ID NO: 3618992 - RNA, 21 nt, Salmonella enterica enterica serovar Typhi
uacccaaauuaauuuauugac

SEQ ID NO: 3618993 - RNA, 19 nt, Salmonella enterica enterica serovar Typhi
uacccaacaccagacugau

SEQ ID NO: 3618994 - RNA, 19 nt, Salmonella enterica enterica serovar Typhi
uacccaauugaauuuaaau

SEQ ID NO: 3618995 - RNA, 18 nt, Salmonella enterica enterica serovar Typhi
uacccagcgaaugcugca

SEQ ID NO: 3618996 - RNA, 22 nt, Salmonella enterica enterica serovar Typhi
uacccagcgccaacgccacugc

SEQ ID NO: 3618997 - RNA, 23 nt, Salmonella enterica enterica serovar Typhi
uacccagcgucccggcgucuacc

SEQ ID NO: 3618998 - RNA, 18 nt, Salmonella enterica enterica serovar Typhi
uacccaguaccauaccgg

SEQ ID NO: 3618999 - RNA, 20 nt, Salmonella enterica enterica serovar Typhi
uacccauuucuucuucaagc

SEQ ID NO: 3619000 - RNA, 20 nt, Salmonella enterica enterica serovar Typhi
uaccccaucauugacuucaa

SEQ ID NO: 3619001 - RNA, 12 nt, Salmonella enterica enterica serovar Typhi
uacgacgcgcca

SEQ ID NO: 3619002 - RNA, 16 nt, Salmonella enterica enterica serovar Typhi
uacgacugcacccauc

SEQ ID NO: 3619003 - RNA, 14 nt, Salmonella enterica enterica serovar Typhi
uacgagauaaaaac

SEQ ID NO: 3619004 - RNA, 23 nt, Salmonella enterica enterica serovar Typhi
uacgaggugggcucagcgaccug

SEQ ID NO: 3619005 - RNA, 14 nt, Salmonella enterica enterica serovar Typhi
uacgauaccccauc

SEQ ID NO: 3619006 - RNA, 17 nt, Salmonella enterica enterica serovar Typhi
uacgauagcaauuaaua

SEQ ID NO: 3619007 - RNA, 13 nt, Salmonella enterica enterica serovar Typhi
uacgauaucaucg

SEQ ID NO: 3619008 - RNA, 23 nt, Salmonella enterica enterica serovar Typhi
uacgaucgucuggcgagaacacg

SEQ ID NO: 3619009 - RNA, 13 nt, Salmonella enterica enterica serovar Typhi
uacgaucugacau

SEQ ID NO: 3619010 - RNA, 16 nt, Salmonella enterica enterica serovar Typhi
uacgaugcagcaccag

SEQ ID NO: 3619011 - RNA, 18 nt, Salmonella enterica enterica serovar Typhi
uacgauucagguuuugcu

SEQ ID NO: 3619012 - RNA, 23 nt, Salmonella enterica enterica serovar Typhi
uacgauucagguuuugcugauca

SEQ ID NO: 3619013 - RNA, 17 nt, Salmonella enterica enterica serovar Typhi
uacgauuucauuacgcc

SEQ ID NO: 3619014 - RNA, 17 nt, Salmonella enterica enterica serovar Typhi
uacgcaaaaaaagccau

SEQ ID NO: 3619015 - RNA, 12 nt, Salmonella enterica enterica serovar Typhi
uacgcaaaucac

SEQ ID NO: 3619016 - RNA, 13 nt, Salmonella enterica enterica serovar Typhi
uacgcaaggaaau

SEQ ID NO: 3619017 - RNA, 17 nt, Salmonella enterica enterica serovar Typhi
uacgcaaggaaauauua

SEQ ID NO: 3619018 - RNA, 22 nt, Salmonella enterica enterica serovar Typhi
uacgcaccagcucuacaucgcc

SEQ ID NO: 3619019 - RNA, 19 nt, Salmonella enterica enterica serovar Typhi
uacgcaccgucgagaaacc

SEQ ID NO: 3619020 - RNA, 18 nt, Salmonella enterica enterica serovar Typhi
uacgcagaucguauccag

SEQ ID NO: 3619021 - RNA, 20 nt, Salmonella enterica enterica serovar Typhi
uacgcagaucuuuuugcucc

SEQ ID NO: 3619022 - RNA, 14 nt, Salmonella enterica enterica serovar Typhi
uacgcagcaggcag

SEQ ID NO: 3619023 - RNA, 16 nt, Salmonella enterica enterica serovar Typhi
uacgcagccccauuug

SEQ ID NO: 3619024 - RNA, 17 nt, Salmonella enterica enterica serovar Typhi
uacgcagcuuaaagcca

SEQ ID NO: 3619025 - RNA, 19 nt, Salmonella enterica enterica serovar Typhi
uacgcagcuuaaagccaau

SEQ ID NO: 3619026 - RNA, 18 nt, Salmonella enterica enterica serovar Typhi
uacgcaggacuuucgcuu

SEQ ID NO: 3619027 - RNA, 14 nt, Salmonella enterica enterica serovar Typhi
uacgccaagcugca

SEQ ID NO: 3619028 - RNA, 17 nt, Salmonella enterica enterica serovar Typhi
uacgccacguuaucgcg

SEQ ID NO: 3619029 - RNA, 19 nt, Salmonella enterica enterica serovar Typhi
uacgccagcagacagguga

SEQ ID NO: 3619030 - RNA, 19 nt, Salmonella enterica enterica serovar Typhi
uacgccagccgucaugaug

SEQ ID NO: 3619031 - RNA, 18 nt, Salmonella enterica enterica serovar Typhi
uacgccaucuuucuuuuc

SEQ ID NO: 3619032 - RNA, 15 nt, Salmonella enterica enterica serovar Typhi
uacgccccacuuuca

SEQ ID NO: 3619033 - RNA, 18 nt, Salmonella enterica enterica serovar Typhi
uacgcccgugacgccagg

SEQ ID NO: 3619034 - RNA, 17 nt, Salmonella enterica enterica serovar Typhi
uacgcccuauccggccg

SEQ ID NO: 3619035 - RNA, 18 nt, Salmonella enterica enterica serovar Typhi
uacgcccucaucggcaaa

SEQ ID NO: 3619036 - RNA, 15 nt, Salmonella enterica enterica serovar Typhi
uacgccgccgcccag

SEQ ID NO: 3619037 - RNA, 20 nt, Salmonella enterica enterica serovar Typhi
uacgccgccgcccagauguu

SEQ ID NO: 3619038 - RNA, 16 nt, Salmonella enterica enterica serovar Typhi
uacgccguuccagccg

SEQ ID NO: 3619039 - RNA, 24 nt, Salmonella enterica enterica serovar Typhi
uacgccuaaauuuaacucguccug

SEQ ID NO: 3619040 - RNA, 14 nt, Salmonella enterica enterica serovar Typhi
uacgccucuuucag

SEQ ID NO: 3619041 - RNA, 13 nt, Salmonella enterica enterica serovar Typhi
uacgccugccugg

SEQ ID NO: 3619042 - RNA, 18 nt, Salmonella enterica enterica serovar Typhi
uacgccugugcuggcgaa

SEQ ID NO: 3619043 - RNA, 18 nt, Salmonella enterica enterica serovar Typhi
uacgcgauaaaaaacgcc

SEQ ID NO: 3619044 - RNA, 23 nt, Salmonella enterica enterica serovar Typhi
uacgcgauaaaaacccaccagcg

SEQ ID NO: 3619045 - RNA, 15 nt, Salmonella enterica enterica serovar Typhi
uacgcgccugccuga

SEQ ID NO: 3619046 - RNA, 16 nt, Salmonella enterica enterica serovar Typhi
uacgcgcgcggcguca

SEQ ID NO: 3619047 - RNA, 23 nt, Salmonella enterica enterica serovar Typhi
uacgcgcguaggucgcgaauagc

SEQ ID NO: 3619048 - RNA, 20 nt, Salmonella enterica enterica serovar Typhi
uacgcgcguucguugaugua

SEQ ID NO: 3619049 - RNA, 23 nt, Salmonella enterica enterica serovar Typhi
uacgcgcucaccgacuccucaac

SEQ ID NO: 3619050 - RNA, 23 nt, Salmonella enterica enterica serovar Typhi
uacgcgcucucauaagccgcguu

SEQ ID NO: 3619051 - RNA, 22 nt, Salmonella enterica enterica serovar Typhi
uacgcggcgcgcucuuuuucuu

SEQ ID NO: 3619052 - RNA, 17 nt, Salmonella enterica enterica serovar Typhi
uacgcgucaaagcacau

SEQ ID NO: 3619053 - RNA, 18 nt, Salmonella enterica enterica serovar Typhi
uacgcguuucacaaccuc

SEQ ID NO: 3619054 - RNA, 15 nt, Salmonella enterica enterica serovar Typhi
uacgcuauuuaaaaa

SEQ ID NO: 3619055 - RNA, 16 nt, Salmonella enterica enterica serovar Typhi
uacgcuauuuaaaaac

SEQ ID NO: 3619056 - RNA, 17 nt, Salmonella enterica enterica serovar Typhi
uacgcuccagcuggcug

SEQ ID NO: 3619057 - RNA, 19 nt, Salmonella enterica enterica serovar Typhi
uacgcuccugcgguacggc

SEQ ID NO: 3619058 - RNA, 14 nt, Salmonella enterica enterica serovar Typhi
uacgcucgcugaug

SEQ ID NO: 3619059 - RNA, 19 nt, Salmonella enterica enterica serovar Typhi
uacgcugcuauccggcaac

SEQ ID NO: 3619060 - RNA, 15 nt, Salmonella enterica enterica serovar Typhi
uacgcuggugcagcc

SEQ ID NO: 3619061 - RNA, 19 nt, Salmonella enterica enterica serovar Typhi
uacgcuuaucaggccuaca

SEQ ID NO: 3619062 - RNA, 17 nt, Salmonella enterica enterica serovar Typhi
uacgcuucguugccccg

SEQ ID NO: 3619063 - RNA, 19 nt, Salmonella enterica enterica serovar Typhi
uacgcuuuauucugucgcc

SEQ ID NO: 3619064 - RNA, 22 nt, Salmonella enterica enterica serovar Typhi
uacgcuuuauucugucgccacc

SEQ ID NO: 3619065 - RNA, 14 nt, Salmonella enterica enterica serovar Typhi
uacggaaaaaauac

SEQ ID NO: 3619066 - RNA, 15 nt, Salmonella enterica enterica serovar Typhi
uacggaaaaaauacu

SEQ ID NO: 3619067 - RNA, 20 nt, Salmonella enterica enterica serovar Typhi
uacggaaagcuguuguugcu

SEQ ID NO: 3619068 - RNA, 20 nt, Salmonella enterica enterica serovar Typhi
uacggacugcggccugcaaa

SEQ ID NO: 3619069 - RNA, 20 nt, Salmonella enterica enterica serovar Typhi
uacggauggcccugccgggg

SEQ ID NO: 3619070 - RNA, 21 nt, Salmonella enterica enterica serovar Typhi
uacggcaaacacaaucacgcc

SEQ ID NO: 3619071 - RNA, 22 nt, Salmonella enterica enterica serovar Typhi
uacggcaaacacaaucacgccc

SEQ ID NO: 3619072 - RNA, 23 nt, Salmonella enterica enterica serovar Typhi
uacggcaaacacaaucacgccca

SEQ ID NO: 3619073 - RNA, 15 nt, Salmonella enterica enterica serovar Typhi
uacggcaaacgcugg

SEQ ID NO: 3619074 - RNA, 17 nt, Salmonella enterica enterica serovar Typhi
uacggcaaacgcuggug

SEQ ID NO: 3619075 - RNA, 16 nt, Salmonella enterica enterica serovar Typhi
uacggcuccagcacau

SEQ ID NO: 3619076 - RNA, 14 nt, Salmonella enterica enterica serovar Typhi
uacggcugucagga

SEQ ID NO: 3619077 - RNA, 22 nt, Salmonella enterica enterica serovar Typhi
uacggcugucaggagccaccgg

SEQ ID NO: 3619078 - RNA, 13 nt, Salmonella enterica enterica serovar Typhi
uacggcuuccacu

SEQ ID NO: 3619079 - RNA, 16 nt, Salmonella enterica enterica serovar Typhi
uacgggaaugcgucgg

SEQ ID NO: 3619080 - RNA, 21 nt, Salmonella enterica enterica serovar Typhi
uacgggagagcguauccagca

SEQ ID NO: 3619081 - RNA, 20 nt, Salmonella enterica enterica serovar Typhi
uacgggaucgauauaucgcg

SEQ ID NO: 3619082 - RNA, 18 nt, Salmonella enterica enterica serovar Typhi
uacgggcaugaagaaaau

SEQ ID NO: 3619083 - RNA, 14 nt, Salmonella enterica enterica serovar Typhi
uacgguacugccca

SEQ ID NO: 3619084 - RNA, 15 nt, Salmonella enterica enterica serovar Typhi
uacgguuggccagca

SEQ ID NO: 3619085 - RNA, 12 nt, Salmonella enterica enterica serovar Typhi
uacguaaauaua

SEQ ID NO: 3619086 - RNA, 23 nt, Salmonella enterica enterica serovar Typhi
uagaaucaauuucucuuuuauua

SEQ ID NO: 3619087 - RNA, 19 nt, Salmonella enterica enterica serovar Typhi
uagaauuuucacuuauaaa

SEQ ID NO: 3619088 - RNA, 20 nt, Salmonella enterica enterica serovar Typhi
uagacaacaucccagaaaau

SEQ ID NO: 3619089 - RNA, 19 nt, Salmonella enterica enterica serovar Typhi
uagacagcaccaucaugca

SEQ ID NO: 3619090 - RNA, 18 nt, Salmonella enterica enterica serovar Typhi
uagaccugaaaucagccu

SEQ ID NO: 3619091 - RNA, 22 nt, Salmonella enterica enterica serovar Typhi
uagaccugaaaucagccugcua

SEQ ID NO: 3619092 - RNA, 22 nt, Salmonella enterica enterica serovar Typhi
uagacgacaucuuuuccugaag

SEQ ID NO: 3619093 - RNA, 17 nt, Salmonella enterica enterica serovar Typhi
uagacgccggucaugcc

SEQ ID NO: 3619094 - RNA, 18 nt, Salmonella enterica enterica serovar Typhi
uagacgcgcuagcuucag

SEQ ID NO: 3619095 - RNA, 15 nt, Salmonella enterica enterica serovar Typhi
uagacggccugcaaa

SEQ ID NO: 3619096 - RNA, 24 nt, Salmonella enterica enterica serovar Typhi
uagacggccugcaaacgaaucacc

SEQ ID NO: 3619097 - RNA, 21 nt, Salmonella enterica enterica serovar Typhi
uagacuggcgccgucacguuc

SEQ ID NO: 3619098 - RNA, 21 nt, Salmonella enterica enterica serovar Typhi
uagacuuuggcgcagucacag

SEQ ID NO: 3619099 - RNA, 13 nt, Salmonella enterica enterica serovar Typhi
uagagaaaauaac

SEQ ID NO: 3619100 - RNA, 14 nt, Salmonella enterica enterica serovar Typhi
uagagaaaauaaca

SEQ ID NO: 3619101 - RNA, 15 nt, Salmonella enterica enterica serovar Typhi
uagagaacagcauca

SEQ ID NO: 3619102 - RNA, 21 nt, Salmonella enterica enterica serovar Typhi
uagagaacagcaucaccggcc

SEQ ID NO: 3619103 - RNA, 16 nt, Salmonella enterica enterica serovar Typhi
uagagaccgcuuuagc

SEQ ID NO: 3619104 - RNA, 20 nt, Salmonella enterica enterica serovar Typhi
uagagaguaaaaccggcaca

SEQ ID NO: 3619105 - RNA, 15 nt, Salmonella enterica enterica serovar Typhi
uagagcaucgcggca

SEQ ID NO: 3619106 - RNA, 16 nt, Salmonella enterica enterica serovar Typhi
uagagguguuauggca

SEQ ID NO: 3619107 - RNA, 21 nt, Salmonella enterica enterica serovar Typhi
uagagugauccaccaccagca

SEQ ID NO: 3619108 - RNA, 16 nt, Salmonella enterica enterica serovar Typhi
uagagugcuucugcaa

SEQ ID NO: 3619109 - RNA, 15 nt, Salmonella enterica enterica serovar Typhi
uagauaacaccgcau

SEQ ID NO: 3619110 - RNA, 16 nt, Salmonella enterica enterica serovar Typhi
uagauaacuauaugcc

SEQ ID NO: 3619111 - RNA, 18 nt, Salmonella enterica enterica serovar Typhi
uagauaaguccuaacacc

SEQ ID NO: 3619112 - RNA, 14 nt, Salmonella enterica enterica serovar Typhi
uagauauuccccac

SEQ ID NO: 3619113 - RNA, 20 nt, Salmonella enterica enterica serovar Typhi
uagaugaaacucgcuguggc

SEQ ID NO: 3619114 - RNA, 22 nt, Salmonella enterica enterica serovar Typhi
uagauggcguaucgcuugauac

SEQ ID NO: 3619115 - RNA, 13 nt, Salmonella enterica enterica serovar Typhi
uagauuaaucacu

SEQ ID NO: 3619116 - RNA, 19 nt, Salmonella enterica enterica serovar Typhi
uagauucuaacauaaugaa

SEQ ID NO: 3619117 - RNA, 13 nt, Salmonella enterica enterica serovar Typhi
uagcaaaaaugcc

SEQ ID NO: 3619118 - RNA, 14 nt, Salmonella enterica enterica serovar Typhi
uagcaaaaaugccg

SEQ ID NO: 3619119 - RNA, 18 nt, Salmonella enterica enterica serovar Typhi
uagcaaagcguacaugaa

SEQ ID NO: 3619120 - RNA, 18 nt, Salmonella enterica enterica serovar Typhi
uagcaaauugcugauguu

SEQ ID NO: 3619121 - RNA, 20 nt, Salmonella enterica enterica serovar Typhi
uagcaacacagacuuugcac

SEQ ID NO: 3619122 - RNA, 13 nt, Salmonella enterica enterica serovar Typhi
uagcaacccacuu

SEQ ID NO: 3619123 - RNA, 20 nt, Salmonella enterica enterica serovar Typhi
uagcaaccucggcuugcuuc

SEQ ID NO: 3619124 - RNA, 15 nt, Salmonella enterica enterica serovar Typhi
uagcaacuuaauaau

SEQ ID NO: 3619125 - RNA, 14 nt, Salmonella enterica enterica serovar Typhi
uagcaaucucgcca

SEQ ID NO: 3619126 - RNA, 15 nt, Salmonella enterica enterica serovar Typhi
uagcaaucucgccaa

SEQ ID NO: 3619127 - RNA, 13 nt, Salmonella enterica enterica serovar Typhi
uagcaauuauauu

SEQ ID NO: 3619128 - RNA, 23 nt, Salmonella enterica enterica serovar Typhi
uagcaauuauauugcguaaaaac

SEQ ID NO: 3619129 - RNA, 19 nt, Salmonella enterica enterica serovar Typhi
uagcaauugccauaaaaac

SEQ ID NO: 3619130 - RNA, 13 nt, Salmonella enterica enterica serovar Typhi
uagcacaaagaau

SEQ ID NO: 3619131 - RNA, 12 nt, Salmonella enterica enterica serovar Typhi
uagcacagcgcu

SEQ ID NO: 3619132 - RNA, 21 nt, Salmonella enterica enterica serovar Typhi
uagcacccuucgcuauccauc

SEQ ID NO: 3619133 - RNA, 14 nt, Salmonella enterica enterica serovar Typhi
uagcacuacggcaa

SEQ ID NO: 3619134 - RNA, 19 nt, Salmonella enterica enterica serovar Typhi
uagcagcauaaacaucagc

SEQ ID NO: 3619135 - RNA, 19 nt, Salmonella enterica enterica serovar Typhi
uagcagcgaugacagcagg

SEQ ID NO: 3619136 - RNA, 14 nt, Salmonella enterica enterica serovar Typhi
uagcaguggagagg

SEQ ID NO: 3619137 - RNA, 13 nt, Salmonella enterica enterica serovar Typhi
uagcaguuuucac

SEQ ID NO: 3619138 - RNA, 21 nt, Salmonella enterica enterica serovar Typhi
uagcauaaaugcgaugaacau

SEQ ID NO: 3619139 - RNA, 17 nt, Salmonella enterica enterica serovar Typhi
uagcauaacguuuccuu

SEQ ID NO: 3619140 - RNA, 19 nt, Salmonella enterica enterica serovar Typhi
uagcauaacguuuccuuau

SEQ ID NO: 3619141 - RNA, 12 nt, Salmonella enterica enterica serovar Typhi
uagcaucaccag

SEQ ID NO: 3619142 - RNA, 20 nt, Salmonella enterica enterica serovar Typhi
uagcaucccgcaggcggcga

SEQ ID NO: 3619143 - RNA, 15 nt, Salmonella enterica enterica serovar Typhi
uagcaucucuucgac

SEQ ID NO: 3619144 - RNA, 16 nt, Salmonella enterica enterica serovar Typhi
uagcaucucuucgaca

SEQ ID NO: 3619145 - RNA, 11 nt, Salmonella enterica enterica serovar Typhi
uagcauucgcg

SEQ ID NO: 3619146 - RNA, 20 nt, Salmonella enterica enterica serovar Typhi
uagccaacacauaagccacu

SEQ ID NO: 3619147 - RNA, 17 nt, Salmonella enterica enterica serovar Typhi
uagccaauaacgucugg

SEQ ID NO: 3619148 - RNA, 18 nt, Salmonella enterica enterica serovar Typhi
uagccacagauuaugcag

SEQ ID NO: 3619149 - RNA, 19 nt, Salmonella enterica enterica serovar Typhi
uagccacuuaccaaucgcg

SEQ ID NO: 3619150 - RNA, 12 nt, Salmonella enterica enterica serovar Typhi
uagccagcauca

SEQ ID NO: 3619151 - RNA, 14 nt, Salmonella enterica enterica serovar Typhi
uagccagccauggc

SEQ ID NO: 3619152 - RNA, 20 nt, Salmonella enterica enterica serovar Typhi
uagccagccugaacgggugg

SEQ ID NO: 3619153 - RNA, 20 nt, Salmonella enterica enterica serovar Typhi
uagccagcgauccugcggca

SEQ ID NO: 3619154 - RNA, 20 nt, Salmonella enterica enterica serovar Typhi
uagccaguaccgaaaucauc

SEQ ID NO: 3619155 - RNA, 16 nt, Salmonella enterica enterica serovar Typhi
uagccaguuuuccgcc

SEQ ID NO: 3619156 - RNA, 15 nt, Salmonella enterica enterica serovar Typhi
uagccauucauuaaa

SEQ ID NO: 3619157 - RNA, 18 nt, Salmonella enterica enterica serovar Typhi
uagccauucauuaaaauu

SEQ ID NO: 3619158 - RNA, 13 nt, Salmonella enterica enterica serovar Typhi
uagcccacaggua

SEQ ID NO: 3619159 - RNA, 21 nt, Salmonella enterica enterica serovar Typhi
uagccccagaccgauauuuug

SEQ ID NO: 3619160 - RNA, 13 nt, Salmonella enterica enterica serovar Typhi
uagccccgucaug

SEQ ID NO: 3619161 - RNA, 22 nt, Salmonella enterica enterica serovar Typhi
uagcccgccagcaccagcagcg

SEQ ID NO: 3619162 - RNA, 23 nt, Salmonella enterica enterica serovar Typhi
uagcccgcuuuaccgaaaucggu

SEQ ID NO: 3619163 - RNA, 14 nt, Salmonella enterica enterica serovar Typhi
uagcccggcaggcu

SEQ ID NO: 3619164 - RNA, 16 nt, Salmonella enterica enterica serovar Typhi
uagcccggcaggcugg

SEQ ID NO: 3619165 - RNA, 16 nt, Salmonella enterica enterica serovar Typhi
uagcccguuaugccau

SEQ ID NO: 3619166 - RNA, 20 nt, Salmonella enterica enterica serovar Typhi
uagcccucgguggauaaauu

SEQ ID NO: 3619167 - RNA, 19 nt, Salmonella enterica enterica serovar Typhi
uagcccugagcccacagcg

SEQ ID NO: 3619168 - RNA, 15 nt, Salmonella enterica enterica serovar Typhi
uagccgacccgcauc

SEQ ID NO: 3619169 - RNA, 22 nt, Salmonella enterica enterica serovar Typhi
uagccgccagcuaauuuuacuu

SEQ ID NO: 3619170 - RNA, 19 nt, Salmonella enterica enterica serovar Typhi
uagccgcgcucaagcuggg

SEQ ID NO: 3619171 - RNA, 16 nt, Salmonella enterica enterica serovar Typhi
uagccgcugcccugac

SEQ ID NO: 3619172 - RNA, 20 nt, Salmonella enterica enterica serovar Typhi
uaggccggauaaggcguuca

SEQ ID NO: 3619173 - RNA, 20 nt, Salmonella enterica enterica serovar Typhi
uaggccggauaaggcguuua

SEQ ID NO: 3619174 - RNA, 13 nt, Salmonella enterica enterica serovar Typhi
uaggccggaucag

SEQ ID NO: 3619175 - RNA, 19 nt, Salmonella enterica enterica serovar Typhi
uaggccggaucaggcguua

SEQ ID NO: 3619176 - RNA, 20 nt, Salmonella enterica enterica serovar Typhi
uaggccggaugagcguuagc

SEQ ID NO: 3619177 - RNA, 23 nt, Salmonella enterica enterica serovar Typhi
uaggccggcgaagauccgcucac

SEQ ID NO: 3619178 - RNA, 13 nt, Salmonella enterica enterica serovar Typhi
uaggccugauaag

SEQ ID NO: 3619179 - RNA, 15 nt, Salmonella enterica enterica serovar Typhi
uaggccugauaagac

SEQ ID NO: 3619180 - RNA, 19 nt, Salmonella enterica enterica serovar Typhi
uaggccugauaagcgcagc

SEQ ID NO: 3619181 - RNA, 19 nt, Salmonella enterica enterica serovar Typhi
uaggccugguaagcguagc

SEQ ID NO: 3619182 - RNA, 17 nt, Salmonella enterica enterica serovar Typhi
uaggcgccgccgacaau

SEQ ID NO: 3619183 - RNA, 13 nt, Salmonella enterica enterica serovar Typhi
uaggcgguuucau

SEQ ID NO: 3619184 - RNA, 19 nt, Salmonella enterica enterica serovar Typhi
uaggcguuagaauaacguu

SEQ ID NO: 3619185 - RNA, 17 nt, Salmonella enterica enterica serovar Typhi
uaggcucuaacgcacgg

SEQ ID NO: 3619186 - RNA, 14 nt, Salmonella enterica enterica serovar Typhi
uaggcugaaagcgc

SEQ ID NO: 3619187 - RNA, 19 nt, Salmonella enterica enterica serovar Typhi
uaggcuuuucauucagcgc

SEQ ID NO: 3619188 - RNA, 19 nt, Salmonella enterica enterica serovar Typhi
uagggccgauaccggcaac

SEQ ID NO: 3619189 - RNA, 16 nt, Salmonella enterica enterica serovar Typhi
uagggccgggcagugc

SEQ ID NO: 3619190 - RNA, 20 nt, Salmonella enterica enterica serovar Typhi
uagggccgggcagugcucga

SEQ ID NO: 3619191 - RNA, 18 nt, Salmonella enterica enterica serovar Typhi
uagggcgcggcugguaag

SEQ ID NO: 3619192 - RNA, 17 nt, Salmonella enterica enterica serovar Typhi
uagggcuuacggguuca

SEQ ID NO: 3619193 - RNA, 16 nt, Salmonella enterica enterica serovar Typhi
uaggguagaucacgcc

SEQ ID NO: 3619194 - RNA, 18 nt, Salmonella enterica enterica serovar Typhi
uagggugcagugaaccau

SEQ ID NO: 3619195 - RNA, 15 nt, Salmonella enterica enterica serovar Typhi
uaggguggcuuucua

SEQ ID NO: 3619196 - RNA, 17 nt, Salmonella enterica enterica serovar Typhi
uaggguguuucgacccc

SEQ ID NO: 3619197 - RNA, 23 nt, Salmonella enterica enterica serovar Typhi
uaggguuaugauuucaggcauuu

SEQ ID NO: 3619198 - RNA, 14 nt, Salmonella enterica enterica serovar Typhi
uaggguugccagag

SEQ ID NO: 3619199 - RNA, 12 nt, Salmonella enterica enterica serovar Typhi
uaggucagcgau

SEQ ID NO: 3619200 - RNA, 20 nt, Salmonella enterica enterica serovar Typhi
uaggucggauaaggcguuua

SEQ ID NO: 3619201 - RNA, 20 nt, Salmonella enterica enterica serovar Typhi
uaggucggguaaggcguagc

SEQ ID NO: 3619202 - RNA, 18 nt, Salmonella enterica enterica serovar Typhi
uagguucguagcgcaaau

SEQ ID NO: 3619203 - RNA, 18 nt, Salmonella enterica enterica serovar Typhi
uagguucugcgaggugau

SEQ ID NO: 3619204 - RNA, 13 nt, Salmonella enterica enterica serovar Typhi
uaguaaagaaauu

SEQ ID NO: 3619205 - RNA, 13 nt, Salmonella enterica enterica serovar Typhi
uaguaacuuacaa

SEQ ID NO: 3619206 - RNA, 13 nt, Salmonella enterica enterica serovar Typhi
uaguaccgacacc

SEQ ID NO: 3619207 - RNA, 16 nt, Salmonella enterica enterica serovar Typhi
uaguacgcaaggaaau

SEQ ID NO: 3619208 - RNA, 20 nt, Salmonella enterica enterica serovar Typhi
uaguacgcaaggaaauauua

SEQ ID NO: 3619209 - RNA, 15 nt, Salmonella enterica enterica serovar Typhi
uaguacugaccagac

SEQ ID NO: 3619210 - RNA, 13 nt, Salmonella enterica enterica serovar Typhi
uaguagcuaauga

SEQ ID NO: 3619211 - RNA, 15 nt, Salmonella enterica enterica serovar Typhi
uaguauccauaauuu

SEQ ID NO: 3619212 - RNA, 20 nt, Salmonella enterica enterica serovar Typhi
uaguauggagcaggaaaaga

SEQ ID NO: 3619213 - RNA, 18 nt, Salmonella enterica enterica serovar Typhi
uaguauuuacaaaaaaga

SEQ ID NO: 3619214 - RNA, 17 nt, Salmonella enterica enterica serovar Typhi
uagucauaauuaaaaag

SEQ ID NO: 3619215 - RNA, 17 nt, Salmonella enterica enterica serovar Typhi
uagucauauucacggcc

SEQ ID NO: 3619216 - RNA, 19 nt, Salmonella enterica enterica serovar Typhi
uagucaucgccuucauccg

SEQ ID NO: 3619217 - RNA, 16 nt, Salmonella enterica enterica serovar Typhi
uagucauugacagcaa

SEQ ID NO: 3619218 - RNA, 15 nt, Salmonella enterica enterica serovar Typhi
uaguccauuacgcag

SEQ ID NO: 3619219 - RNA, 22 nt, Salmonella enterica enterica serovar Typhi
uaguccuuaccccugcggcuga

SEQ ID NO: 3619220 - RNA, 14 nt, Salmonella enterica enterica serovar Typhi
uagucgagggugau

SEQ ID NO: 3619221 - RNA, 16 nt, Salmonella enterica enterica serovar Typhi
uagucgauccccaacg

SEQ ID NO: 3619222 - RNA, 14 nt, Salmonella enterica enterica serovar Typhi
uagucgccgguaag

SEQ ID NO: 3619223 - RNA, 16 nt, Salmonella enterica enterica serovar Typhi
uagucggcaaugcucu

SEQ ID NO: 3619224 - RNA, 14 nt, Salmonella enterica enterica serovar Typhi
uagucguccgcgcc

SEQ ID NO: 3619225 - RNA, 12 nt, Salmonella enterica enterica serovar Typhi
uagucucccucc

SEQ ID NO: 3619226 - RNA, 15 nt, Salmonella enterica enterica serovar Typhi
uagucucccuccugc

SEQ ID NO: 3619227 - RNA, 12 nt, Salmonella enterica enterica serovar Typhi
uagucuccgcca

SEQ ID NO: 3619228 - RNA, 22 nt, Salmonella enterica enterica serovar Typhi
uagucuccugccaaugaaauaa

SEQ ID NO: 3619229 - RNA, 21 nt, Salmonella enterica enterica serovar Typhi
uagugcugcgcaaauacguug

SEQ ID NO: 3619230 - RNA, 12 nt, Salmonella enterica enterica serovar Typhi
uaguggaacugu

SEQ ID NO: 3619231 - RNA, 15 nt, Salmonella enterica enterica serovar Typhi
uaguggaucagcaga

SEQ ID NO: 3619232 - RNA, 14 nt, Salmonella enterica enterica serovar Typhi
uaguggcgaucuga

SEQ ID NO: 3619233 - RNA, 13 nt, Salmonella enterica enterica serovar Typhi
uaguguaauucuc

SEQ ID NO: 3619234 - RNA, 15 nt, Salmonella enterica enterica serovar Typhi
uagugugcugauugu

SEQ ID NO: 3619235 - RNA, 18 nt, Salmonella enterica enterica serovar Typhi
uaguuaaaggugguguua

SEQ ID NO: 3619236 - RNA, 20 nt, Salmonella enterica enterica serovar Typhi
uaguuaccguaaucaucgcg

SEQ ID NO: 3619237 - RNA, 19 nt, Salmonella enterica enterica serovar Typhi
uaguuacgcacgccagaua

SEQ ID NO: 3619238 - RNA, 20 nt, Salmonella enterica enterica serovar Typhi
uaguuauacauuuuuuucuu

SEQ ID NO: 3619239 - RNA, 18 nt, Salmonella enterica enterica serovar Typhi
uaguucaaguuuagaaaa

SEQ ID NO: 3619240 - RNA, 21 nt, Salmonella enterica enterica serovar Typhi
uaguucaaguuuagaaaaaau

SEQ ID NO: 3619241 - RNA, 17 nt, Salmonella enterica enterica serovar Typhi
uaguugaauaaccucaa

SEQ ID NO: 3619242 - RNA, 24 nt, Salmonella enterica enterica serovar Typhi
uaguuuauugagauaauuuaugau

SEQ ID NO: 3619243 - RNA, 22 nt, Salmonella enterica enterica serovar Typhi
uaguuuccgccgcgguauucau

SEQ ID NO: 3619244 - RNA, 23 nt, Salmonella enterica enterica serovar Typhi
uaguuuccgccgcgguauucaua

SEQ ID NO: 3619245 - RNA, 21 nt, Salmonella enterica enterica serovar Typhi
uaguuuccgguaaauccacaa

SEQ ID NO: 3619246 - RNA, 14 nt, Salmonella enterica enterica serovar Typhi
uaguuucuauuaaa

SEQ ID NO: 3619247 - RNA, 16 nt, Salmonella enterica enterica serovar Typhi
uaguuucuauuaaauc

SEQ ID NO: 3619248 - RNA, 18 nt, Salmonella enterica enterica serovar Typhi
uaguuucuauuaaaucag

SEQ ID NO: 3619249 - RNA, 19 nt, Salmonella enterica enterica serovar Typhi
uaguuucuauuaaaucaga

SEQ ID NO: 3619250 - RNA, 14 nt, Salmonella enterica enterica serovar Typhi
uaguuugcauaacc

SEQ ID NO: 3619251 - RNA, 20 nt, Salmonella enterica enterica serovar Typhi
uauaaaaaaugguuuuauuu

SEQ ID NO: 3619252 - RNA, 12 nt, Salmonella enterica enterica serovar Typhi
uauaaaaaccga

SEQ ID NO: 3619253 - RNA, 20 nt, Salmonella enterica enterica serovar Typhi
uauaaaacgucacaauacuu

SEQ ID NO: 3619254 - RNA, 14 nt, Salmonella enterica enterica serovar Typhi
uauaaacucagcaa

SEQ ID NO: 3619255 - RNA, 17 nt, Salmonella enterica enterica serovar Typhi
uauaaaguucccaugcu

SEQ ID NO: 3619256 - RNA, 11 nt, Salmonella enterica enterica serovar Typhi
uauaaauauag

SEQ ID NO: 3619257 - RNA, 14 nt, Salmonella enterica enterica serovar Typhi
uauaaauaucauug

SEQ ID NO: 3619258 - RNA, 21 nt, Salmonella enterica enterica serovar Typhi
uaucaccagcgauuacgccag

SEQ ID NO: 3619259 - RNA, 20 nt, Salmonella enterica enterica serovar Typhi
uaucaccaucuuuuugcuca

SEQ ID NO: 3619260 - RNA, 19 nt, Salmonella enterica enterica serovar Typhi
uaucaccgcugacugaacu

SEQ ID NO: 3619261 - RNA, 21 nt, Salmonella enterica enterica serovar Typhi
uaucacugguuauaugaauaa

SEQ ID NO: 3619262 - RNA, 14 nt, Salmonella enterica enterica serovar Typhi
uaucaggccgacaa

SEQ ID NO: 3619263 - RNA, 20 nt, Salmonella enterica enterica serovar Typhi
uaucaggccgacaaaugacg

SEQ ID NO: 3619264 - RNA, 23 nt, Salmonella enterica enterica serovar Typhi
uaucaggcugagcgacgguuuua

SEQ ID NO: 3619265 - RNA, 19 nt, Salmonella enterica enterica serovar Typhi
uaucagggcuuuuuucucg

SEQ ID NO: 3619266 - RNA, 23 nt, Salmonella enterica enterica serovar Typhi
uaucaggguuauuuccgcuggcc

SEQ ID NO: 3619267 - RNA, 15 nt, Salmonella enterica enterica serovar Typhi
uaucagguaacauau

SEQ ID NO: 3619268 - RNA, 16 nt, Salmonella enterica enterica serovar Typhi
uaucagguaacauauc

SEQ ID NO: 3619269 - RNA, 14 nt, Salmonella enterica enterica serovar Typhi
uaucauaaaaggcu

SEQ ID NO: 3619270 - RNA, 19 nt, Salmonella enterica enterica serovar Typhi
uaucauagacugcgcuuaa

SEQ ID NO: 3619271 - RNA, 20 nt, Salmonella enterica enterica serovar Typhi
uaucaugaaugccccagcgc

SEQ ID NO: 3619272 - RNA, 18 nt, Salmonella enterica enterica serovar Typhi
uaucaugcugaugacuaa

SEQ ID NO: 3619273 - RNA, 14 nt, Salmonella enterica enterica serovar Typhi
uauccacagcgaau

SEQ ID NO: 3619274 - RNA, 15 nt, Salmonella enterica enterica serovar Typhi
uauccaccgccagac

SEQ ID NO: 3619275 - RNA, 15 nt, Salmonella enterica enterica serovar Typhi
uauccaccugaucgu

SEQ ID NO: 3619276 - RNA, 18 nt, Salmonella enterica enterica serovar Typhi
uauccagaaucacaucgu

SEQ ID NO: 3619277 - RNA, 16 nt, Salmonella enterica enterica serovar Typhi
uauccagauagcgauc

SEQ ID NO: 3619278 - RNA, 12 nt, Salmonella enterica enterica serovar Typhi
uauccagcagcc

SEQ ID NO: 3619279 - RNA, 23 nt, Salmonella enterica enterica serovar Typhi
uauccagcagguaacguuucagu

SEQ ID NO: 3619280 - RNA, 18 nt, Salmonella enterica enterica serovar Typhi
uauccagcggcaaaggca

SEQ ID NO: 3619281 - RNA, 19 nt, Salmonella enterica enterica serovar Typhi
uauccagcggcaaaggcau

SEQ ID NO: 3619282 - RNA, 14 nt, Salmonella enterica enterica serovar Typhi
uauccaguugauga

SEQ ID NO: 3619283 - RNA, 15 nt, Salmonella enterica enterica serovar Typhi
uauccauacaagcgu

SEQ ID NO: 3619284 - RNA, 23 nt, Salmonella enterica enterica serovar Typhi
uauccaucagccaggguuuaauc

SEQ ID NO: 3619285 - RNA, 23 nt, Salmonella enterica enterica serovar Typhi
uaucccaaacgucguaaaaccug

SEQ ID NO: 3619286 - RNA, 21 nt, Salmonella enterica enterica serovar Typhi
uaucccauacguuuuuauuau

SEQ ID NO: 3619287 - RNA, 15 nt, Salmonella enterica enterica serovar Typhi
uaucccauugcguuc

SEQ ID NO: 3619288 - RNA, 14 nt, Salmonella enterica enterica serovar Typhi
uauccccgcuggcg

SEQ ID NO: 3619289 - RNA, 24 nt, Salmonella enterica enterica serovar Typhi
uauccccugacagagcucgucaaa

SEQ ID NO: 3619290 - RNA, 14 nt, Salmonella enterica enterica serovar Typhi
uaucccuauucuga

SEQ ID NO: 3619291 - RNA, 16 nt, Salmonella enterica enterica serovar Typhi
uaucccugcaaacuau

SEQ ID NO: 3619292 - RNA, 14 nt, Salmonella enterica enterica serovar Typhi
uaucccugcugagu

SEQ ID NO: 3619293 - RNA, 15 nt, Salmonella enterica enterica serovar Typhi
uaucccuuucaaaaa

SEQ ID NO: 3619294 - RNA, 16 nt, Salmonella enterica enterica serovar Typhi
uauccgacgcaacuca

SEQ ID NO: 3619295 - RNA, 18 nt, Salmonella enterica enterica serovar Typhi
uauccgcaacugaaacca

SEQ ID NO: 3619296 - RNA, 15 nt, Salmonella enterica enterica serovar Typhi
uauccgcauucuaaa

SEQ ID NO: 3619297 - RNA, 15 nt, Salmonella enterica enterica serovar Typhi
uauccgccauauccc

SEQ ID NO: 3619298 - RNA, 21 nt, Salmonella enterica enterica serovar Typhi
uauccgccaucgacagcgcca

SEQ ID NO: 3619299 - RNA, 18 nt, Salmonella enterica enterica serovar Typhi
uauccgccugcugacaaa

SEQ ID NO: 3619300 - RNA, 18 nt, Salmonella enterica enterica serovar Typhi
uauccggcaaaagaggcu

SEQ ID NO: 3619301 - RNA, 21 nt, Salmonella enterica enterica serovar Typhi
uauccggcacgguaaaccucu

SEQ ID NO: 3619302 - RNA, 20 nt, Salmonella enterica enterica serovar Typhi
uauccggcaucacaggcuua

SEQ ID NO: 3619303 - RNA, 13 nt, Salmonella enterica enterica serovar Typhi
uauccggccuaca

SEQ ID NO: 3619304 - RNA, 13 nt, Salmonella enterica enterica serovar Typhi
uauccggccuacg

SEQ ID NO: 3619305 - RNA, 14 nt, Salmonella enterica enterica serovar Typhi
uauccggcuuaucc

SEQ ID NO: 3619306 - RNA, 19 nt, Salmonella enterica enterica serovar Typhi
uauccguaauaugaugcag

SEQ ID NO: 3619307 - RNA, 16 nt, Salmonella enterica enterica serovar Typhi
uauccguccucuuucc

SEQ ID NO: 3619308 - RNA, 18 nt, Salmonella enterica enterica serovar Typhi
uauccguguggucgcggc

SEQ ID NO: 3619309 - RNA, 15 nt, Salmonella enterica enterica serovar Typhi
uauccuaaaucugcc

SEQ ID NO: 3619310 - RNA, 19 nt, Salmonella enterica enterica serovar Typhi
uauccuaaaucugccauca

SEQ ID NO: 3619311 - RNA, 19 nt, Salmonella enterica enterica serovar Typhi
uauccuaaugccacggcug

SEQ ID NO: 3619312 - RNA, 21 nt, Salmonella enterica enterica serovar Typhi
uauccucgcauccuccaucca

SEQ ID NO: 3619313 - RNA, 15 nt, Salmonella enterica enterica serovar Typhi
uauccuuaaguacaa

SEQ ID NO: 3619314 - RNA, 15 nt, Salmonella enterica enterica serovar Typhi
uaucgaaggucaggc

SEQ ID NO: 3619315 - RNA, 16 nt, Salmonella enterica enterica serovar Typhi
uaucgaaggucaggcc

SEQ ID NO: 3619316 - RNA, 23 nt, Salmonella enterica enterica serovar Typhi
uaucgaaggucaggccacugccc

SEQ ID NO: 3619317 - RNA, 13 nt, Salmonella enterica enterica serovar Typhi
uaucgagauaaug

SEQ ID NO: 3619318 - RNA, 21 nt, Salmonella enterica enterica serovar Typhi
uaucgauaaucaacaaugucg

SEQ ID NO: 3619319 - RNA, 16 nt, Salmonella enterica enterica serovar Typhi
uaucgauaucugccug

SEQ ID NO: 3619320 - RNA, 22 nt, Salmonella enterica enterica serovar Typhi
uaucgauggcagucgcaucaug

SEQ ID NO: 3619321 - RNA, 18 nt, Salmonella enterica enterica serovar Typhi
uaucgcacuggcgccugc

SEQ ID NO: 3619322 - RNA, 14 nt, Salmonella enterica enterica serovar Typhi
uaucgccaaaccag

SEQ ID NO: 3619323 - RNA, 15 nt, Salmonella enterica enterica serovar Typhi
uaucgcccagauggc

SEQ ID NO: 3619324 - RNA, 20 nt, Salmonella enterica enterica serovar Typhi
uaucgccgaaagcgaucaca

SEQ ID NO: 3619325 - RNA, 21 nt, Salmonella enterica enterica serovar Typhi
uaucgccgaaagcgaucacau

SEQ ID NO: 3619326 - RNA, 19 nt, Salmonella enterica enterica serovar Typhi
uaucgccgacaaacaguga

SEQ ID NO: 3619327 - RNA, 14 nt, Salmonella enterica enterica serovar Typhi
uaucgccgaucaca

SEQ ID NO: 3619328 - RNA, 21 nt, Salmonella enterica enterica serovar Typhi
uaucgccgcccguuuccgcua

SEQ ID NO: 3619329 - RNA, 19 nt, Salmonella enterica enterica serovar Typhi
uaucgccguaaccgccugc

SEQ ID NO: 3619330 - RNA, 15 nt, Salmonella enterica enterica serovar Typhi
uaucgccuggagcug

SEQ ID NO: 3619331 - RNA, 17 nt, Salmonella enterica enterica serovar Typhi
uaucgcgccagguauac

SEQ ID NO: 3619332 - RNA, 23 nt, Salmonella enterica enterica serovar Typhi
uaucgcgccgccaauauccauuu

SEQ ID NO: 3619333 - RNA, 20 nt, Salmonella enterica enterica serovar Typhi
uaucgcgccggacagcagca

SEQ ID NO: 3619334 - RNA, 15 nt, Salmonella enterica enterica serovar Typhi
uaucgcgucaucaaa

SEQ ID NO: 3619335 - RNA, 14 nt, Salmonella enterica enterica serovar Typhi
uaucgcuccggaac

SEQ ID NO: 3619336 - RNA, 23 nt, Salmonella enterica enterica serovar Typhi
uaucgcucgucgcgacguccgcc

SEQ ID NO: 3619337 - RNA, 14 nt, Salmonella enterica enterica serovar Typhi
uaucgcugcccaga

SEQ ID NO: 3619338 - RNA, 17 nt, Salmonella enterica enterica serovar Typhi
uaucgcuugauacgcca

SEQ ID NO: 3619339 - RNA, 17 nt, Salmonella enterica enterica serovar Typhi
uaucgcuuuaaucaguu

SEQ ID NO: 3619340 - RNA, 17 nt, Salmonella enterica enterica serovar Typhi
uaucggaaguauacauc

SEQ ID NO: 3619341 - RNA, 20 nt, Salmonella enterica enterica serovar Typhi
uaucggcaauauugccgcac

SEQ ID NO: 3619342 - RNA, 13 nt, Salmonella enterica enterica serovar Typhi
uaucggccagcgc

SEQ ID NO: 3619343 - RNA, 21 nt, Salmonella enterica enterica serovar Typhi
uaugucaguaauauauuacga

SEQ ID NO: 3619344 - RNA, 19 nt, Salmonella enterica enterica serovar Typhi
uaugugcaucggcacagcg

SEQ ID NO: 3619345 - RNA, 20 nt, Salmonella enterica enterica serovar Typhi
uaugugccgcccaggccuga

SEQ ID NO: 3619346 - RNA, 19 nt, Salmonella enterica enterica serovar Typhi
uauguuaacgccgauuaau

SEQ ID NO: 3619347 - RNA, 21 nt, Salmonella enterica enterica serovar Typhi
uauguuaacgccgauuaaugc

SEQ ID NO: 3619348 - RNA, 14 nt, Salmonella enterica enterica serovar Typhi
uauguuauuuacaa

SEQ ID NO: 3619349 - RNA, 19 nt, Salmonella enterica enterica serovar Typhi
uauguuccuggauagauuu

SEQ ID NO: 3619350 - RNA, 16 nt, Salmonella enterica enterica serovar Typhi
uauguuguugagacgg

SEQ ID NO: 3619351 - RNA, 19 nt, Salmonella enterica enterica serovar Typhi
uauuaaaguucagccgaua

SEQ ID NO: 3619352 - RNA, 12 nt, Salmonella enterica enterica serovar Typhi
uauuaaauaaau

SEQ ID NO: 3619353 - RNA, 16 nt, Salmonella enterica enterica serovar Typhi
uauuaaauuccggcuc

SEQ ID NO: 3619354 - RNA, 15 nt, Salmonella enterica enterica serovar Typhi
uauuaaucuuuacac

SEQ ID NO: 3619355 - RNA, 19 nt, Salmonella enterica enterica serovar Typhi
uauuaauuaaggaugaacu

SEQ ID NO: 3619356 - RNA, 13 nt, Salmonella enterica enterica serovar Typhi
uauuacaacguuc

SEQ ID NO: 3619357 - RNA, 14 nt, Salmonella enterica enterica serovar Typhi
uauuacaagaaagu

SEQ ID NO: 3619358 - RNA, 16 nt, Salmonella enterica enterica serovar Typhi
uauuacaagcaguuaa

SEQ ID NO: 3619359 - RNA, 20 nt, Salmonella enterica enterica serovar Typhi
uauuacaaguaauaaaauaa

SEQ ID NO: 3619360 - RNA, 23 nt, Salmonella enterica enterica serovar Typhi
uauuacagacagucuggauauaa

SEQ ID NO: 3619361 - RNA, 21 nt, Salmonella enterica enterica serovar Typhi
uauuacagaucuugugaguaa

SEQ ID NO: 3619362 - RNA, 16 nt, Salmonella enterica enterica serovar Typhi
uauuacauagaaaaua

SEQ ID NO: 3619363 - RNA, 18 nt, Salmonella enterica enterica serovar Typhi
uauuacauagaaaauaua

SEQ ID NO: 3619364 - RNA, 16 nt, Salmonella enterica enterica serovar Typhi
uauuacaugccguuaa

SEQ ID NO: 3619365 - RNA, 15 nt, Salmonella enterica enterica serovar Typhi
uauuaccaaugagcu

SEQ ID NO: 3619366 - RNA, 15 nt, Salmonella enterica enterica serovar Typhi
uauuaccuccugcau

SEQ ID NO: 3619367 - RNA, 16 nt, Salmonella enterica enterica serovar Typhi
uauuaccucgcgcuua

SEQ ID NO: 3619368 - RNA, 15 nt, Salmonella enterica enterica serovar Typhi
uauuacugauaaagu

SEQ ID NO: 3619369 - RNA, 16 nt, Salmonella enterica enterica serovar Typhi
uauuacuggaucauac

SEQ ID NO: 3619370 - RNA, 14 nt, Salmonella enterica enterica serovar Typhi
uauuacuuuccagc

SEQ ID NO: 3619371 - RNA, 20 nt, Salmonella enterica enterica serovar Typhi
uauuagaauucccuauguaa

SEQ ID NO: 3619372 - RNA, 15 nt, Salmonella enterica enterica serovar Typhi
uauuagccaaagcgg

SEQ ID NO: 3619373 - RNA, 18 nt, Salmonella enterica enterica serovar Typhi
uauuagccaaagcgguaa

SEQ ID NO: 3619374 - RNA, 16 nt, Salmonella enterica enterica serovar Typhi
uauuagcguuuuuacc

SEQ ID NO: 3619375 - RNA, 18 nt, Salmonella enterica enterica serovar Typhi
uauuaggcacuaccaccu

SEQ ID NO: 3619376 - RNA, 11 nt, Salmonella enterica enterica serovar Typhi
uauuauaaaau

SEQ ID NO: 3619377 - RNA, 13 nt, Salmonella enterica enterica serovar Typhi
uauuauaaaauaa

SEQ ID NO: 3619378 - RNA, 14 nt, Salmonella enterica enterica serovar Typhi
uauuauauuuaaaa

SEQ ID NO: 3619379 - RNA, 14 nt, Salmonella enterica enterica serovar Typhi
uauuaucaaaucuu

SEQ ID NO: 3619380 - RNA, 22 nt, Salmonella enterica enterica serovar Typhi
uauuaucaaaucuucauuucau

SEQ ID NO: 3619381 - RNA, 15 nt, Salmonella enterica enterica serovar Typhi
uauuaucggcgucau

SEQ ID NO: 3619382 - RNA, 15 nt, Salmonella enterica enterica serovar Typhi
uauuaucugauucaa

SEQ ID NO: 3619383 - RNA, 18 nt, Salmonella enterica enterica serovar Typhi
uauuaucugauucaauua

SEQ ID NO: 3619384 - RNA, 20 nt, Salmonella enterica enterica serovar Typhi
uauuaucugauucaauuaau

SEQ ID NO: 3619385 - RNA, 19 nt, Salmonella enterica enterica serovar Typhi
uauuauuacgcaucauaua

SEQ ID NO: 3619386 - RNA, 19 nt, Salmonella enterica enterica serovar Typhi
uauuauuagaggucagaau

SEQ ID NO: 3619387 - RNA, 13 nt, Salmonella enterica enterica serovar Typhi
uauuauuauauag

SEQ ID NO: 3619388 - RNA, 16 nt, Salmonella enterica enterica serovar Typhi
uauuauuuugggaaug

SEQ ID NO: 3619389 - RNA, 22 nt, Salmonella enterica enterica serovar Typhi
uauuauuuugggaauggaaaca

SEQ ID NO: 3619390 - RNA, 19 nt, Salmonella enterica enterica serovar Typhi
uauucaaaauccgccaccg

SEQ ID NO: 3619391 - RNA, 12 nt, Salmonella enterica enterica serovar Typhi
uauucaauaaua

SEQ ID NO: 3619392 - RNA, 23 nt, Salmonella enterica enterica serovar Typhi
uauucaauaauauuaucauaaug

SEQ ID NO: 3619393 - RNA, 21 nt, Salmonella enterica enterica serovar Typhi
uauucacacgcucacccaguu

SEQ ID NO: 3619394 - RNA, 23 nt, Salmonella enterica enterica serovar Typhi
uauucaccucccugcaacagcac

SEQ ID NO: 3619395 - RNA, 23 nt, Salmonella enterica enterica serovar Typhi
uauucacgcagcuuauuggcaau

SEQ ID NO: 3619396 - RNA, 18 nt, Salmonella enterica enterica serovar Typhi
uauucacgcgaauuccuu

SEQ ID NO: 3619397 - RNA, 19 nt, Salmonella enterica enterica serovar Typhi
uauucacuuuccgaaucag

SEQ ID NO: 3619398 - RNA, 13 nt, Salmonella enterica enterica serovar Typhi
uauucagcaaaug

SEQ ID NO: 3619399 - RNA, 13 nt, Salmonella enterica enterica serovar Typhi
uauucaggccucc

SEQ ID NO: 3619400 - RNA, 17 nt, Salmonella enterica enterica serovar Typhi
uauucagggcuuuauuu

SEQ ID NO: 3619401 - RNA, 22 nt, Salmonella enterica enterica serovar Typhi
uauucauaacgccgaugccgcc

SEQ ID NO: 3619402 - RNA, 17 nt, Salmonella enterica enterica serovar Typhi
uauucaucaucuugucc

SEQ ID NO: 3619403 - RNA, 19 nt, Salmonella enterica enterica serovar Typhi
uauucaugccagaagcaaa

SEQ ID NO: 3619404 - RNA, 23 nt, Salmonella enterica enterica serovar Typhi
uauucauuacagguguuaaucau

SEQ ID NO: 3619405 - RNA, 22 nt, Salmonella enterica enterica serovar Typhi
uauucauuauuuuuaaauaacu

SEQ ID NO: 3619406 - RNA, 16 nt, Salmonella enterica enterica serovar Typhi
uauucauuuccagcac

SEQ ID NO: 3619407 - RNA, 16 nt, Salmonella enterica enterica serovar Typhi
uauuccaaaauaauaa

SEQ ID NO: 3619408 - RNA, 21 nt, Salmonella enterica enterica serovar Typhi
uauuccagccaggaauggcua

SEQ ID NO: 3619409 - RNA, 19 nt, Salmonella enterica enterica serovar Typhi
uauuccaguuaucacggua

SEQ ID NO: 3619410 - RNA, 16 nt, Salmonella enterica enterica serovar Typhi
uauucccaggcaaaug

SEQ ID NO: 3619411 - RNA, 11 nt, Salmonella enterica enterica serovar Typhi
uauucccggcc

SEQ ID NO: 3619412 - RNA, 16 nt, Salmonella enterica enterica serovar Typhi
uauucccguuccagcu

SEQ ID NO: 3619413 - RNA, 13 nt, Salmonella enterica enterica serovar Typhi
uauuccgaauacg

SEQ ID NO: 3619414 - RNA, 20 nt, Salmonella enterica enterica serovar Typhi
uauuccgagucgaucucuuu

SEQ ID NO: 3619415 - RNA, 20 nt, Salmonella enterica enterica serovar Typhi
uauuccggcaucguacgggc

SEQ ID NO: 3619416 - RNA, 16 nt, Salmonella enterica enterica serovar Typhi
uauuccggcgcuggcg

SEQ ID NO: 3619417 - RNA, 22 nt, Salmonella enterica enterica serovar Typhi
uauuccucggaggccagauuca

SEQ ID NO: 3619418 - RNA, 14 nt, Salmonella enterica enterica serovar Typhi
uauuccuuaucaca

SEQ ID NO: 3619419 - RNA, 20 nt, Salmonella enterica enterica serovar Typhi
uauuccuuguccgaugcaga

SEQ ID NO: 3619420 - RNA, 20 nt, Salmonella enterica enterica serovar Typhi
uauucgacuguuguucuuca

SEQ ID NO: 3619421 - RNA, 21 nt, Salmonella enterica enterica serovar Typhi
uauucgcaucgguaauuucaa

SEQ ID NO: 3619422 - RNA, 17 nt, Salmonella enterica enterica serovar Typhi
uauucgcgcccucauuc

SEQ ID NO: 3619423 - RNA, 13 nt, Salmonella enterica enterica serovar Typhi
uauucuauuccuu

SEQ ID NO: 3619424 - RNA, 20 nt, Salmonella enterica enterica serovar Typhi
uauucucaaccagccgauca

SEQ ID NO: 3619425 - RNA, 21 nt, Salmonella enterica enterica serovar Typhi
uauucugggcuuacuuuccaa

SEQ ID NO: 3619426 - RNA, 17 nt, Salmonella enterica enterica serovar Typhi
uauucuuccccuucacu

SEQ ID NO: 3619427 - RNA, 16 nt, Salmonella enterica enterica serovar Typhi
uauugaacauuuuuuc

SEQ ID NO: 3619428 - RNA, 20 nt, Salmonella enterica enterica serovar Typhi
uauugaacggcucaaaauaa

SEQ ID NO: 3619429 - RNA, 21 nt, Salmonella enterica enterica serovar Typhi
ucaaacaccugaaccagcgcc

SEQ ID NO: 3619430 - RNA, 16 nt, Salmonella enterica enterica serovar Typhi
ucaaacacgaccagcg

SEQ ID NO: 3619431 - RNA, 14 nt, Salmonella enterica enterica serovar Typhi
ucaaacacuucuaa

SEQ ID NO: 3619432 - RNA, 19 nt, Salmonella enterica enterica serovar Typhi
ucaaacaggcgaaaacgua

SEQ ID NO: 3619433 - RNA, 13 nt, Salmonella enterica enterica serovar Typhi
ucaaaccacgcug

SEQ ID NO: 3619434 - RNA, 14 nt, Salmonella enterica enterica serovar Typhi
ucaaaccagcuuuu

SEQ ID NO: 3619435 - RNA, 15 nt, Salmonella enterica enterica serovar Typhi
ucaaacccuuccgca

SEQ ID NO: 3619436 - RNA, 12 nt, Salmonella enterica enterica serovar Typhi
ucaaacgcagca

SEQ ID NO: 3619437 - RNA, 19 nt, Salmonella enterica enterica serovar Typhi
ucaaacgccgauggcgcca

SEQ ID NO: 3619438 - RNA, 21 nt, Salmonella enterica enterica serovar Typhi
ucaaacuccgcgcuggcaaua

SEQ ID NO: 3619439 - RNA, 22 nt, Salmonella enterica enterica serovar Typhi
ucaaacugacugaugcuggcgc

SEQ ID NO: 3619440 - RNA, 20 nt, Salmonella enterica enterica serovar Typhi
ucaaacuuuuaaauugaaga

SEQ ID NO: 3619441 - RNA, 13 nt, Salmonella enterica enterica serovar Typhi
ucaaagaaaacau

SEQ ID NO: 3619442 - RNA, 18 nt, Salmonella enterica enterica serovar Typhi
ucaaagaaaacuuucauu

SEQ ID NO: 3619443 - RNA, 16 nt, Salmonella enterica enterica serovar Typhi
ucaaagaccuccgccc

SEQ ID NO: 3619444 - RNA, 19 nt, Salmonella enterica enterica serovar Typhi
ucaaagccacacugcaucg

SEQ ID NO: 3619445 - RNA, 17 nt, Salmonella enterica enterica serovar Typhi
ucaaaggccugcaucaa

SEQ ID NO: 3619446 - RNA, 22 nt, Salmonella enterica enterica serovar Typhi
ucaaaggccugcaucaacaggc

SEQ ID NO: 3619447 - RNA, 22 nt, Salmonella enterica enterica serovar Typhi
ucaaaggcgcugaacgcauaca

SEQ ID NO: 3619448 - RNA, 19 nt, Salmonella enterica enterica serovar Typhi
ucaaaguugguucccagca

SEQ ID NO: 3619449 - RNA, 22 nt, Salmonella enterica enterica serovar Typhi
ucaaauaagacauggaguucca

SEQ ID NO: 3619450 - RNA, 12 nt, Salmonella enterica enterica serovar Typhi
ucaaauacgcua

SEQ ID NO: 3619451 - RNA, 17 nt, Salmonella enterica enterica serovar Typhi
ucaaauagagaaaauaa

SEQ ID NO: 3619452 - RNA, 12 nt, Salmonella enterica enterica serovar Typhi
ucaaauauauug

SEQ ID NO: 3619453 - RNA, 14 nt, Salmonella enterica enterica serovar Typhi
ucaaaugagaauag

SEQ ID NO: 3619454 - RNA, 17 nt, Salmonella enterica enterica serovar Typhi
ucaaaugaucguuuuuu

SEQ ID NO: 3619455 - RNA, 17 nt, Salmonella enterica enterica serovar Typhi
ucaaaugcgaaaaaaag

SEQ ID NO: 3619456 - RNA, 12 nt, Salmonella enterica enterica serovar Typhi
ucaaaugggauc

SEQ ID NO: 3619457 - RNA, 22 nt, Salmonella enterica enterica serovar Typhi
ucaaauguuguuugaaaaguga

SEQ ID NO: 3619458 - RNA, 21 nt, Salmonella enterica enterica serovar Typhi
ucaaauucacccguuauucau

SEQ ID NO: 3619459 - RNA, 17 nt, Salmonella enterica enterica serovar Typhi
ucaaauuccagcaauga

SEQ ID NO: 3619460 - RNA, 19 nt, Salmonella enterica enterica serovar Typhi
ucaacaacuucaaaauagg

SEQ ID NO: 3619461 - RNA, 14 nt, Salmonella enterica enterica serovar Typhi
ucaacacauuccau

SEQ ID NO: 3619462 - RNA, 20 nt, Salmonella enterica enterica serovar Typhi
ucaacacgcagacccaggcg

SEQ ID NO: 3619463 - RNA, 13 nt, Salmonella enterica enterica serovar Typhi
ucaacacgcgcac

SEQ ID NO: 3619464 - RNA, 16 nt, Salmonella enterica enterica serovar Typhi
ucaacagacauauccc

SEQ ID NO: 3619465 - RNA, 17 nt, Salmonella enterica enterica serovar Typhi
ucaacagcgcggcagac

SEQ ID NO: 3619466 - RNA, 17 nt, Salmonella enterica enterica serovar Typhi
ucaacagggguuccggc

SEQ ID NO: 3619467 - RNA, 19 nt, Salmonella enterica enterica serovar Typhi
ucaacagggguuccggcaa

SEQ ID NO: 3619468 - RNA, 23 nt, Salmonella enterica enterica serovar Typhi
ucaacauacgccgccagccacug

SEQ ID NO: 3619469 - RNA, 16 nt, Salmonella enterica enterica serovar Typhi
ucaacauacugauuuc

SEQ ID NO: 3619470 - RNA, 14 nt, Salmonella enterica enterica serovar Typhi
ucaacaucaucgga

SEQ ID NO: 3619471 - RNA, 19 nt, Salmonella enterica enterica serovar Typhi
ucaacaucauuaagccggg

SEQ ID NO: 3619472 - RNA, 16 nt, Salmonella enterica enterica serovar Typhi
ucaacauuauuaaaau

SEQ ID NO: 3619473 - RNA, 15 nt, Salmonella enterica enterica serovar Typhi
ucaaccaacggcgcu

SEQ ID NO: 3619474 - RNA, 20 nt, Salmonella enterica enterica serovar Typhi
ucaaccacggauaagccagc

SEQ ID NO: 3619475 - RNA, 17 nt, Salmonella enterica enterica serovar Typhi
ucaaccacucgcguacc

SEQ ID NO: 3619476 - RNA, 18 nt, Salmonella enterica enterica serovar Typhi
ucaaccaucaaaaaaaau

SEQ ID NO: 3619477 - RNA, 20 nt, Salmonella enterica enterica serovar Typhi
ucaaccaucaaaaaaaauag

SEQ ID NO: 3619478 - RNA, 17 nt, Salmonella enterica enterica serovar Typhi
ucaacccagcagcagau

SEQ ID NO: 3619479 - RNA, 18 nt, Salmonella enterica enterica serovar Typhi
ucaacccagcagcagaua

SEQ ID NO: 3619480 - RNA, 19 nt, Salmonella enterica enterica serovar Typhi
ucaacccaguuuuuauccu

SEQ ID NO: 3619481 - RNA, 20 nt, Salmonella enterica enterica serovar Typhi
ucaacccgaucgccauccug

SEQ ID NO: 3619482 - RNA, 20 nt, Salmonella enterica enterica serovar Typhi
ucaacccuauugccacaaua

SEQ ID NO: 3619483 - RNA, 15 nt, Salmonella enterica enterica serovar Typhi
ucaaccucuauaacu

SEQ ID NO: 3619484 - RNA, 15 nt, Salmonella enterica enterica serovar Typhi
ucaacgccaucuucc

SEQ ID NO: 3619485 - RNA, 16 nt, Salmonella enterica enterica serovar Typhi
ucaacgcccugcuccc

SEQ ID NO: 3619486 - RNA, 20 nt, Salmonella enterica enterica serovar Typhi
ucaacgccgcgcuucuggaa

SEQ ID NO: 3619487 - RNA, 23 nt, Salmonella enterica enterica serovar Typhi
ucaacgcgccgcucacaaccguc

SEQ ID NO: 3619488 - RNA, 15 nt, Salmonella enterica enterica serovar Typhi
ucaacggcaaaucgc

SEQ ID NO: 3619489 - RNA, 15 nt, Salmonella enterica enterica serovar Typhi
ucaacggucaaaaua

SEQ ID NO: 3619490 - RNA, 19 nt, Salmonella enterica enterica serovar Typhi
ucaacgguucgacggagau

SEQ ID NO: 3619491 - RNA, 17 nt, Salmonella enterica enterica serovar Typhi
ucaacguuguccagcgg

SEQ ID NO: 3619492 - RNA, 14 nt, Salmonella enterica enterica serovar Typhi
ucaacguuuuucag

SEQ ID NO: 3619493 - RNA, 21 nt, Salmonella enterica enterica serovar Typhi
ucaacuauuaaagcacaagaa

SEQ ID NO: 3619494 - RNA, 16 nt, Salmonella enterica enterica serovar Typhi
ucaacucaugccgcug

SEQ ID NO: 3619495 - RNA, 19 nt, Salmonella enterica enterica serovar Typhi
ucaacuccugcaucgauuc

SEQ ID NO: 3619496 - RNA, 21 nt, Salmonella enterica enterica serovar Typhi
ucaacuggaugacugaauuau

SEQ ID NO: 3619497 - RNA, 21 nt, Salmonella enterica enterica serovar Typhi
ucaacuguaccugauccagcu

SEQ ID NO: 3619498 - RNA, 23 nt, Salmonella enterica enterica serovar Typhi
ucaacuguaccugauccagcucu

SEQ ID NO: 3619499 - RNA, 16 nt, Salmonella enterica enterica serovar Typhi
ucaacugucgaucggu

SEQ ID NO: 3619500 - RNA, 20 nt, Salmonella enterica enterica serovar Typhi
ucaacuuauccauuagcgcc

SEQ ID NO: 3619501 - RNA, 18 nt, Salmonella enterica enterica serovar Typhi
ucaacuucucgcaggcca

SEQ ID NO: 3619502 - RNA, 16 nt, Salmonella enterica enterica serovar Typhi
ucaagaguaggccgga

SEQ ID NO: 3619503 - RNA, 14 nt, Salmonella enterica enterica serovar Typhi
ucaagauaaaaaga

SEQ ID NO: 3619504 - RNA, 17 nt, Salmonella enterica enterica serovar Typhi
ucaagaugauagccauu

SEQ ID NO: 3619505 - RNA, 23 nt, Salmonella enterica enterica serovar Typhi
ucaagaugcuacccgucgcgccc

SEQ ID NO: 3619506 - RNA, 18 nt, Salmonella enterica enterica serovar Typhi
ucaagccguuuuggcagc

SEQ ID NO: 3619507 - RNA, 12 nt, Salmonella enterica enterica serovar Typhi
ucaagcgauacg

SEQ ID NO: 3619508 - RNA, 13 nt, Salmonella enterica enterica serovar Typhi
ucaagcgcaauca

SEQ ID NO: 3619509 - RNA, 21 nt, Salmonella enterica enterica serovar Typhi
ucaagcgguagcguuauccag

SEQ ID NO: 3619510 - RNA, 23 nt, Salmonella enterica enterica serovar Typhi
ucaagcgguuugaaaauggcguu

SEQ ID NO: 3619511 - RNA, 22 nt, Salmonella enterica enterica serovar Typhi
ucaagcguuuccagaguacauu

SEQ ID NO: 3619512 - RNA, 21 nt, Salmonella enterica enterica serovar Typhi
ucaagcuggacgguaaccauu

SEQ ID NO: 3619513 - RNA, 16 nt, Salmonella enterica enterica serovar Typhi
ucaagcuuugcguaaa

SEQ ID NO: 3619514 - RNA, 20 nt, Salmonella enterica enterica serovar Typhi
ucaccacgggguuggcccuc

SEQ ID NO: 3619515 - RNA, 22 nt, Salmonella enterica enterica serovar Typhi
ucaccacgggguuggcccuccc

SEQ ID NO: 3619516 - RNA, 17 nt, Salmonella enterica enterica serovar Typhi
ucaccacuucaaacggu

SEQ ID NO: 3619517 - RNA, 19 nt, Salmonella enterica enterica serovar Typhi
ucaccagcgcauugacgau

SEQ ID NO: 3619518 - RNA, 22 nt, Salmonella enterica enterica serovar Typhi
ucaccaggcguaagaucccagg

SEQ ID NO: 3619519 - RNA, 23 nt, Salmonella enterica enterica serovar Typhi
ucaccaggucaaaauuaaucgcc

SEQ ID NO: 3619520 - RNA, 18 nt, Salmonella enterica enterica serovar Typhi
ucaccaguccggcagaaa

SEQ ID NO: 3619521 - RNA, 15 nt, Salmonella enterica enterica serovar Typhi
ucaccauaaaucauu

SEQ ID NO: 3619522 - RNA, 24 nt, Salmonella enterica enterica serovar Typhi
ucaccaucaguagcacaacgaguc

SEQ ID NO: 3619523 - RNA, 16 nt, Salmonella enterica enterica serovar Typhi
ucaccaucauaaagcc

SEQ ID NO: 3619524 - RNA, 17 nt, Salmonella enterica enterica serovar Typhi
ucaccaucauaaagccg

SEQ ID NO: 3619525 - RNA, 13 nt, Salmonella enterica enterica serovar Typhi
ucaccauuaauac

SEQ ID NO: 3619526 - RNA, 15 nt, Salmonella enterica enterica serovar Typhi
ucaccauucccagcg

SEQ ID NO: 3619527 - RNA, 16 nt, Salmonella enterica enterica serovar Typhi
ucaccauucccagcgc

SEQ ID NO: 3619528 - RNA, 18 nt, Salmonella enterica enterica serovar Typhi
ucacccaacauuuuuagc

SEQ ID NO: 3619529 - RNA, 16 nt, Salmonella enterica enterica serovar Typhi
ucacccaauaaauaau

SEQ ID NO: 3619530 - RNA, 18 nt, Salmonella enterica enterica serovar Typhi
ucacccacaggagccagu

SEQ ID NO: 3619531 - RNA, 14 nt, Salmonella enterica enterica serovar Typhi
ucacccacaucagc

SEQ ID NO: 3619532 - RNA, 22 nt, Salmonella enterica enterica serovar Typhi
ucacccacaucagcggcacaua

SEQ ID NO: 3619533 - RNA, 22 nt, Salmonella enterica enterica serovar Typhi
ucacccagacugugauggcggu

SEQ ID NO: 3619534 - RNA, 23 nt, Salmonella enterica enterica serovar Typhi
ucacccagagauuaauuacgcac

SEQ ID NO: 3619535 - RNA, 22 nt, Salmonella enterica enterica serovar Typhi
ucacccagaugcgaaucuucau

SEQ ID NO: 3619536 - RNA, 24 nt, Salmonella enterica enterica serovar Typhi
ucacccagucgcagccacccuggc

SEQ ID NO: 3619537 - RNA, 22 nt, Salmonella enterica enterica serovar Typhi
ucacccaugccgcgacgaaguc

SEQ ID NO: 3619538 - RNA, 16 nt, Salmonella enterica enterica serovar Typhi
ucacccauuuuauccu

SEQ ID NO: 3619539 - RNA, 20 nt, Salmonella enterica enterica serovar Typhi
ucaccccaacaaauagcaca

SEQ ID NO: 3619540 - RNA, 21 nt, Salmonella enterica enterica serovar Typhi
ucacccgaaucacugacggaa

SEQ ID NO: 3619541 - RNA, 14 nt, Salmonella enterica enterica serovar Typhi
ucacccgauaaaau

SEQ ID NO: 3619542 - RNA, 18 nt, Salmonella enterica enterica serovar Typhi
ucacccgccggcagcagc

SEQ ID NO: 3619543 - RNA, 19 nt, Salmonella enterica enterica serovar Typhi
ucacccgccggcagcagcu

SEQ ID NO: 3619544 - RNA, 17 nt, Salmonella enterica enterica serovar Typhi
ucacccgcgccagcagg

SEQ ID NO: 3619545 - RNA, 16 nt, Salmonella enterica enterica serovar Typhi
ucacccgcuuuuccug

SEQ ID NO: 3619546 - RNA, 16 nt, Salmonella enterica enterica serovar Typhi
ucacccggauacgcgg

SEQ ID NO: 3619547 - RNA, 18 nt, Salmonella enterica enterica serovar Typhi
ucacccggauacgcggca

SEQ ID NO: 3619548 - RNA, 17 nt, Salmonella enterica enterica serovar Typhi
ucacccuauaagcugcc

SEQ ID NO: 3619549 - RNA, 16 nt, Salmonella enterica enterica serovar Typhi
ucacccugaauuucaa

SEQ ID NO: 3619550 - RNA, 15 nt, Salmonella enterica enterica serovar Typhi
ucacccugcaacauu

SEQ ID NO: 3619551 - RNA, 14 nt, Salmonella enterica enterica serovar Typhi
ucaccgcaugacaa

SEQ ID NO: 3619552 - RNA, 13 nt, Salmonella enterica enterica serovar Typhi
ucaccgccagagc

SEQ ID NO: 3619553 - RNA, 21 nt, Salmonella enterica enterica serovar Typhi
ucaccgcccaaugcccccauc

SEQ ID NO: 3619554 - RNA, 21 nt, Salmonella enterica enterica serovar Typhi
ucaccgcggcaaccagcccau

SEQ ID NO: 3619555 - RNA, 19 nt, Salmonella enterica enterica serovar Typhi
ucaccggauacccagccac

SEQ ID NO: 3619556 - RNA, 22 nt, Salmonella enterica enterica serovar Typhi
ucaccggcuguauacacuuucc

SEQ ID NO: 3619557 - RNA, 18 nt, Salmonella enterica enterica serovar Typhi
ucaccguaauauaaucua

SEQ ID NO: 3619558 - RNA, 21 nt, Salmonella enterica enterica serovar Typhi
ucaccguauuaucaaaucuuc

SEQ ID NO: 3619559 - RNA, 18 nt, Salmonella enterica enterica serovar Typhi
ucaccguccgccaggccc

SEQ ID NO: 3619560 - RNA, 18 nt, Salmonella enterica enterica serovar Typhi
ucaccguggcaaaaucca

SEQ ID NO: 3619561 - RNA, 19 nt, Salmonella enterica enterica serovar Typhi
ucaccguggcaucaucaaa

SEQ ID NO: 3619562 - RNA, 19 nt, Salmonella enterica enterica serovar Typhi
ucaccguuuaaaaacauca

SEQ ID NO: 3619563 - RNA, 17 nt, Salmonella enterica enterica serovar Typhi
ucaccucaucaacgcca

SEQ ID NO: 3619564 - RNA, 19 nt, Salmonella enterica enterica serovar Typhi
ucaccucuaccggggcgcu

SEQ ID NO: 3619565 - RNA, 16 nt, Salmonella enterica enterica serovar Typhi
ucaccucuuccccggu

SEQ ID NO: 3619566 - RNA, 13 nt, Salmonella enterica enterica serovar Typhi
ucaccucuucgcu

SEQ ID NO: 3619567 - RNA, 20 nt, Salmonella enterica enterica serovar Typhi
ucaccucuuucuccacaucg

SEQ ID NO: 3619568 - RNA, 14 nt, Salmonella enterica enterica serovar Typhi
ucaccugauagcgg

SEQ ID NO: 3619569 - RNA, 14 nt, Salmonella enterica enterica serovar Typhi
ucaccugcaucacg

SEQ ID NO: 3619570 - RNA, 16 nt, Salmonella enterica enterica serovar Typhi
ucaccugccagggugc

SEQ ID NO: 3619571 - RNA, 18 nt, Salmonella enterica enterica serovar Typhi
ucaccuggaugcugccug

SEQ ID NO: 3619572 - RNA, 21 nt, Salmonella enterica enterica serovar Typhi
ucaccuggauuccuccaauuc

SEQ ID NO: 3619573 - RNA, 20 nt, Salmonella enterica enterica serovar Typhi
ucaccuucggucccaucgcg

SEQ ID NO: 3619574 - RNA, 20 nt, Salmonella enterica enterica serovar Typhi
ucaccuucggugaaaucacg

SEQ ID NO: 3619575 - RNA, 17 nt, Salmonella enterica enterica serovar Typhi
ucaccuucugcgcagga

SEQ ID NO: 3619576 - RNA, 18 nt, Salmonella enterica enterica serovar Typhi
ucaccuucugugaaaguu

SEQ ID NO: 3619577 - RNA, 22 nt, Salmonella enterica enterica serovar Typhi
ucaccuucugugaaaguuucag

SEQ ID NO: 3619578 - RNA, 22 nt, Salmonella enterica enterica serovar Typhi
ucaccuugcccuggaauuuuuc

SEQ ID NO: 3619579 - RNA, 19 nt, Salmonella enterica enterica serovar Typhi
ucaccuuguaccuccugau

SEQ ID NO: 3619580 - RNA, 21 nt, Salmonella enterica enterica serovar Typhi
ucaccuuuacuuaauucugcu

SEQ ID NO: 3619581 - RNA, 15 nt, Salmonella enterica enterica serovar Typhi
ucaccuuucauuuua

SEQ ID NO: 3619582 - RNA, 17 nt, Salmonella enterica enterica serovar Typhi
ucaccuuucugccaggu

SEQ ID NO: 3619583 - RNA, 17 nt, Salmonella enterica enterica serovar Typhi
ucacgaccaaccaacag

SEQ ID NO: 3619584 - RNA, 23 nt, Salmonella enterica enterica serovar Typhi
ucacgaccggcgaacguuggcug

SEQ ID NO: 3619585 - RNA, 17 nt, Salmonella enterica enterica serovar Typhi
ucacgacuuauugcacc

SEQ ID NO: 3619586 - RNA, 14 nt, Salmonella enterica enterica serovar Typhi
ucacgauaauguuu

SEQ ID NO: 3619587 - RNA, 18 nt, Salmonella enterica enterica serovar Typhi
ucacgauacuguugcagu

SEQ ID NO: 3619588 - RNA, 19 nt, Salmonella enterica enterica serovar Typhi
ucacgauaguuugccagag

SEQ ID NO: 3619589 - RNA, 19 nt, Salmonella enterica enterica serovar Typhi
ucacgauccgcaaauuacu

SEQ ID NO: 3619590 - RNA, 12 nt, Salmonella enterica enterica serovar Typhi
ucacgaucgcgg

SEQ ID NO: 3619591 - RNA, 17 nt, Salmonella enterica enterica serovar Typhi
ucacgcaaaugcagcgg

SEQ ID NO: 3619592 - RNA, 19 nt, Salmonella enterica enterica serovar Typhi
ucacgcaaaugcagcggaa

SEQ ID NO: 3619593 - RNA, 21 nt, Salmonella enterica enterica serovar Typhi
ucacgcagcgcauccaccaga

SEQ ID NO: 3619594 - RNA, 20 nt, Salmonella enterica enterica serovar Typhi
ucacgcagcgugaagcugcc

SEQ ID NO: 3619595 - RNA, 19 nt, Salmonella enterica enterica serovar Typhi
ucacgcauggcguugcugc

SEQ ID NO: 3619596 - RNA, 22 nt, Salmonella enterica enterica serovar Typhi
ucacgcauggcguugcugcaaa

SEQ ID NO: 3619597 - RNA, 22 nt, Salmonella enterica enterica serovar Typhi
ucacgcauugccacagccucag

SEQ ID NO: 3619598 - RNA, 20 nt, Salmonella enterica enterica serovar Typhi
ucacgccaucgacaaaggca

SEQ ID NO: 3619599 - RNA, 16 nt, Salmonella enterica enterica serovar Typhi
ucagacggacaucaga

SEQ ID NO: 3619600 - RNA, 17 nt, Salmonella enterica enterica serovar Typhi
ucagacguagcgccauc

SEQ ID NO: 3619601 - RNA, 18 nt, Salmonella enterica enterica serovar Typhi
ucagacguagcgccauca

SEQ ID NO: 3619602 - RNA, 20 nt, Salmonella enterica enterica serovar Typhi
ucagacucucaaugcccauc

SEQ ID NO: 3619603 - RNA, 22 nt, Salmonella enterica enterica serovar Typhi
ucagagcgucuuuuauccccac

SEQ ID NO: 3619604 - RNA, 21 nt, Salmonella enterica enterica serovar Typhi
ucagaggccuuuugcagcagc

SEQ ID NO: 3619605 - RNA, 22 nt, Salmonella enterica enterica serovar Typhi
ucagaggccuuuugcagcagcg

SEQ ID NO: 3619606 - RNA, 21 nt, Salmonella enterica enterica serovar Typhi
ucagauaaacagguaaaacaa

SEQ ID NO: 3619607 - RNA, 13 nt, Salmonella enterica enterica serovar Typhi
ucagauaaauaac

SEQ ID NO: 3619608 - RNA, 15 nt, Salmonella enterica enterica serovar Typhi
ucagauaacgaacca

SEQ ID NO: 3619609 - RNA, 22 nt, Salmonella enterica enterica serovar Typhi
ucagauaacgaaccaucauuaa

SEQ ID NO: 3619610 - RNA, 14 nt, Salmonella enterica enterica serovar Typhi
ucagauaauucuaa

SEQ ID NO: 3619611 - RNA, 15 nt, Salmonella enterica enterica serovar Typhi
ucagauaauucuaaa

SEQ ID NO: 3619612 - RNA, 14 nt, Salmonella enterica enterica serovar Typhi
ucagauauuccagc

SEQ ID NO: 3619613 - RNA, 15 nt, Salmonella enterica enterica serovar Typhi
ucagauauuccagcg

SEQ ID NO: 3619614 - RNA, 12 nt, Salmonella enterica enterica serovar Typhi
ucagauccuuuu

SEQ ID NO: 3619615 - RNA, 13 nt, Salmonella enterica enterica serovar Typhi
ucagauccuuuuu

SEQ ID NO: 3619616 - RNA, 20 nt, Salmonella enterica enterica serovar Typhi
ucagaucuuauaugagcggg

SEQ ID NO: 3619617 - RNA, 21 nt, Salmonella enterica enterica serovar Typhi
ucagauggugauagcgcgcca

SEQ ID NO: 3619618 - RNA, 13 nt, Salmonella enterica enterica serovar Typhi
ucagauuacccuc

SEQ ID NO: 3619619 - RNA, 18 nt, Salmonella enterica enterica serovar Typhi
ucagauuacccucugcgu

SEQ ID NO: 3619620 - RNA, 18 nt, Salmonella enterica enterica serovar Typhi
ucagauucagcauuggca

SEQ ID NO: 3619621 - RNA, 19 nt, Salmonella enterica enterica serovar Typhi
ucagauugaucaucaccga

SEQ ID NO: 3619622 - RNA, 17 nt, Salmonella enterica enterica serovar Typhi
ucagauugccacaggac

SEQ ID NO: 3619623 - RNA, 11 nt, Salmonella enterica enterica serovar Typhi
ucagcaaaaac

SEQ ID NO: 3619624 - RNA, 14 nt, Salmonella enterica enterica serovar Typhi
ucagcaaaaacauu

SEQ ID NO: 3619625 - RNA, 16 nt, Salmonella enterica enterica serovar Typhi
ucagcaaaauaccggc

SEQ ID NO: 3619626 - RNA, 17 nt, Salmonella enterica enterica serovar Typhi
ucagcaaaauaccggca

SEQ ID NO: 3619627 - RNA, 22 nt, Salmonella enterica enterica serovar Typhi
ucagcaaaauaccggcagcggu

SEQ ID NO: 3619628 - RNA, 15 nt, Salmonella enterica enterica serovar Typhi
ucagcaaaaucacgc

SEQ ID NO: 3619629 - RNA, 16 nt, Salmonella enterica enterica serovar Typhi
ucagcaacggaagcug

SEQ ID NO: 3619630 - RNA, 18 nt, Salmonella enterica enterica serovar Typhi
ucagcaacggaagcugac

SEQ ID NO: 3619631 - RNA, 13 nt, Salmonella enterica enterica serovar Typhi
ucagcaacugcgu

SEQ ID NO: 3619632 - RNA, 15 nt, Salmonella enterica enterica serovar Typhi
ucagcaacugcugcg

SEQ ID NO: 3619633 - RNA, 13 nt, Salmonella enterica enterica serovar Typhi
ucagcaagaaguu

SEQ ID NO: 3619634 - RNA, 16 nt, Salmonella enterica enterica serovar Typhi
ucagcaagaaguuccg

SEQ ID NO: 3619635 - RNA, 19 nt, Salmonella enterica enterica serovar Typhi
ucagcaagaaguuccgcuu

SEQ ID NO: 3619636 - RNA, 16 nt, Salmonella enterica enterica serovar Typhi
ucagcaagcgccagua

SEQ ID NO: 3619637 - RNA, 15 nt, Salmonella enterica enterica serovar Typhi
ucagcaauauuuugu

SEQ ID NO: 3619638 - RNA, 15 nt, Salmonella enterica enterica serovar Typhi
ucagcaaugauuuuu

SEQ ID NO: 3619639 - RNA, 17 nt, Salmonella enterica enterica serovar Typhi
ucagcaauuaacaaaua

SEQ ID NO: 3619640 - RNA, 18 nt, Salmonella enterica enterica serovar Typhi
ucagcaauuaacaaauaa

SEQ ID NO: 3619641 - RNA, 22 nt, Salmonella enterica enterica serovar Typhi
ucagcaauuaacaaauaaagcg

SEQ ID NO: 3619642 - RNA, 17 nt, Salmonella enterica enterica serovar Typhi
ucagcaauuucucgccc

SEQ ID NO: 3619643 - RNA, 16 nt, Salmonella enterica enterica serovar Typhi
ucagcacacuacacag

SEQ ID NO: 3619644 - RNA, 18 nt, Salmonella enterica enterica serovar Typhi
ucagcaccuccagcgccu

SEQ ID NO: 3619645 - RNA, 20 nt, Salmonella enterica enterica serovar Typhi
ucagcaccucuuugcggccu

SEQ ID NO: 3619646 - RNA, 17 nt, Salmonella enterica enterica serovar Typhi
ucagcagaggaaaacgu

SEQ ID NO: 3619647 - RNA, 18 nt, Salmonella enterica enterica serovar Typhi
ucagcagcaccgguuuuu

SEQ ID NO: 3619648 - RNA, 21 nt, Salmonella enterica enterica serovar Typhi
ucagcagcaccgguuuuuccg

SEQ ID NO: 3619649 - RNA, 20 nt, Salmonella enterica enterica serovar Typhi
ucagcaggcggcuucgcauc

SEQ ID NO: 3619650 - RNA, 21 nt, Salmonella enterica enterica serovar Typhi
ucagcauaauauccugcaccg

SEQ ID NO: 3619651 - RNA, 19 nt, Salmonella enterica enterica serovar Typhi
ucagcauccgcaagacacg

SEQ ID NO: 3619652 - RNA, 21 nt, Salmonella enterica enterica serovar Typhi
ucagcauguaccauugucaaa

SEQ ID NO: 3619653 - RNA, 19 nt, Salmonella enterica enterica serovar Typhi
ucagcauguuucuccugcc

SEQ ID NO: 3619654 - RNA, 23 nt, Salmonella enterica enterica serovar Typhi
ucagcauuacccccgccauaaug

SEQ ID NO: 3619655 - RNA, 16 nt, Salmonella enterica enterica serovar Typhi
ucagccacgacgcuca

SEQ ID NO: 3619656 - RNA, 15 nt, Salmonella enterica enterica serovar Typhi
ucagccagcgaucag

SEQ ID NO: 3619657 - RNA, 18 nt, Salmonella enterica enterica serovar Typhi
ucagccagcguaccagcg

SEQ ID NO: 3619658 - RNA, 14 nt, Salmonella enterica enterica serovar Typhi
ucagccaggucugc

SEQ ID NO: 3619659 - RNA, 20 nt, Salmonella enterica enterica serovar Typhi
ucagccaggucugcaccacg

SEQ ID NO: 3619660 - RNA, 17 nt, Salmonella enterica enterica serovar Typhi
ucagccccagcaccaga

SEQ ID NO: 3619661 - RNA, 18 nt, Salmonella enterica enterica serovar Typhi
ucagcccggacaucaucc

SEQ ID NO: 3619662 - RNA, 15 nt, Salmonella enterica enterica serovar Typhi
ucagcccuuauauca

SEQ ID NO: 3619663 - RNA, 19 nt, Salmonella enterica enterica serovar Typhi
ucagccgauaagaacucca

SEQ ID NO: 3619664 - RNA, 15 nt, Salmonella enterica enterica serovar Typhi
ucagccgccggugac

SEQ ID NO: 3619665 - RNA, 18 nt, Salmonella enterica enterica serovar Typhi
ucagccgcgcauagcugg

SEQ ID NO: 3619666 - RNA, 22 nt, Salmonella enterica enterica serovar Typhi
ucagccgcgcuaucaaaaugca

SEQ ID NO: 3619667 - RNA, 16 nt, Salmonella enterica enterica serovar Typhi
ucagccgggcgggaac

SEQ ID NO: 3619668 - RNA, 22 nt, Salmonella enterica enterica serovar Typhi
ucagccugaaagauuauuuuau

SEQ ID NO: 3619669 - RNA, 13 nt, Salmonella enterica enterica serovar Typhi
ucagccugcuaca

SEQ ID NO: 3619670 - RNA, 21 nt, Salmonella enterica enterica serovar Typhi
ucagccugugcaaccagcucu

SEQ ID NO: 3619671 - RNA, 23 nt, Salmonella enterica enterica serovar Typhi
ucagccuugaccgccugaucguu

SEQ ID NO: 3619672 - RNA, 14 nt, Salmonella enterica enterica serovar Typhi
ucagccuuuucaua

SEQ ID NO: 3619673 - RNA, 16 nt, Salmonella enterica enterica serovar Typhi
ucagccuuuucauaug

SEQ ID NO: 3619674 - RNA, 17 nt, Salmonella enterica enterica serovar Typhi
ucagcgaauaucucuau

SEQ ID NO: 3619675 - RNA, 20 nt, Salmonella enterica enterica serovar Typhi
ucagcgaccgucguguuacc

SEQ ID NO: 3619676 - RNA, 16 nt, Salmonella enterica enterica serovar Typhi
ucagcgauucaaacuc

SEQ ID NO: 3619677 - RNA, 15 nt, Salmonella enterica enterica serovar Typhi
ucagcgcauguuagc

SEQ ID NO: 3619678 - RNA, 14 nt, Salmonella enterica enterica serovar Typhi
ucagcgccaccaca

SEQ ID NO: 3619679 - RNA, 17 nt, Salmonella enterica enterica serovar Typhi
ucagcgccaccacaaac

SEQ ID NO: 3619680 - RNA, 20 nt, Salmonella enterica enterica serovar Typhi
ucagcgccaccacaaacgcc

SEQ ID NO: 3619681 - RNA, 21 nt, Salmonella enterica enterica serovar Typhi
ucagcgccacgcccaacauaa

SEQ ID NO: 3619682 - RNA, 18 nt, Salmonella enterica enterica serovar Typhi
ucagcgcccgauaaaucg

SEQ ID NO: 3619683 - RNA, 13 nt, Salmonella enterica enterica serovar Typhi
ucagcgccggauc

SEQ ID NO: 3619684 - RNA, 13 nt, Salmonella enterica enterica serovar Typhi
ucagcgcgccaau

SEQ ID NO: 3619685 - RNA, 15 nt, Salmonella enterica enterica serovar Typhi
ucaggucauacggca

SEQ ID NO: 3619686 - RNA, 16 nt, Salmonella enterica enterica serovar Typhi
ucaggucuauugccua

SEQ ID NO: 3619687 - RNA, 20 nt, Salmonella enterica enterica serovar Typhi
ucaggugaauaccaaagccc

SEQ ID NO: 3619688 - RNA, 19 nt, Salmonella enterica enterica serovar Typhi
ucaggugacaguccgggcc

SEQ ID NO: 3619689 - RNA, 23 nt, Salmonella enterica enterica serovar Typhi
ucaggugauugcccuccagccau

SEQ ID NO: 3619690 - RNA, 13 nt, Salmonella enterica enterica serovar Typhi
ucagguggaagaa

SEQ ID NO: 3619691 - RNA, 17 nt, Salmonella enterica enterica serovar Typhi
ucagguucgaauccugu

SEQ ID NO: 3619692 - RNA, 11 nt, Salmonella enterica enterica serovar Typhi
ucagguuuuuu

SEQ ID NO: 3619693 - RNA, 16 nt, Salmonella enterica enterica serovar Typhi
ucaguaaaagcccgcc

SEQ ID NO: 3619694 - RNA, 17 nt, Salmonella enterica enterica serovar Typhi
ucaguaaaucccgcauc

SEQ ID NO: 3619695 - RNA, 13 nt, Salmonella enterica enterica serovar Typhi
ucaguaagcguac

SEQ ID NO: 3619696 - RNA, 16 nt, Salmonella enterica enterica serovar Typhi
ucaguaauaauauaaa

SEQ ID NO: 3619697 - RNA, 18 nt, Salmonella enterica enterica serovar Typhi
ucaguacagccaaaaaua

SEQ ID NO: 3619698 - RNA, 17 nt, Salmonella enterica enterica serovar Typhi
ucaguacgucgcauacu

SEQ ID NO: 3619699 - RNA, 23 nt, Salmonella enterica enterica serovar Typhi
ucaguagcuuuuccgcuggaaua

SEQ ID NO: 3619700 - RNA, 16 nt, Salmonella enterica enterica serovar Typhi
ucaguaugaugaccug

SEQ ID NO: 3619701 - RNA, 22 nt, Salmonella enterica enterica serovar Typhi
ucagucccgggcuaaucgcaaa

SEQ ID NO: 3619702 - RNA, 21 nt, Salmonella enterica enterica serovar Typhi
ucaguccuuccgcuuuaagcg

SEQ ID NO: 3619703 - RNA, 20 nt, Salmonella enterica enterica serovar Typhi
ucagugaaaagcuggaggug

SEQ ID NO: 3619704 - RNA, 13 nt, Salmonella enterica enterica serovar Typhi
ucagugaacaccc

SEQ ID NO: 3619705 - RNA, 14 nt, Salmonella enterica enterica serovar Typhi
ucagugaacacccu

SEQ ID NO: 3619706 - RNA, 17 nt, Salmonella enterica enterica serovar Typhi
ucagugaacacccugcc

SEQ ID NO: 3619707 - RNA, 12 nt, Salmonella enterica enterica serovar Typhi
ucagugauaaag

SEQ ID NO: 3619708 - RNA, 14 nt, Salmonella enterica enterica serovar Typhi
ucagugauaaagcc

SEQ ID NO: 3619709 - RNA, 21 nt, Salmonella enterica enterica serovar Typhi
ucaguggaaaacagcauaaua

SEQ ID NO: 3619710 - RNA, 17 nt, Salmonella enterica enterica serovar Typhi
ucaguggcggcaaaaaa

SEQ ID NO: 3619711 - RNA, 12 nt, Salmonella enterica enterica serovar Typhi
ucaguucagaaa

SEQ ID NO: 3619712 - RNA, 14 nt, Salmonella enterica enterica serovar Typhi
ucaguucagaaacg

SEQ ID NO: 3619713 - RNA, 13 nt, Salmonella enterica enterica serovar Typhi
ucaguuccgccag

SEQ ID NO: 3619714 - RNA, 16 nt, Salmonella enterica enterica serovar Typhi
ucaguucggagaucag

SEQ ID NO: 3619715 - RNA, 15 nt, Salmonella enterica enterica serovar Typhi
ucaguuugucgguaa

SEQ ID NO: 3619716 - RNA, 21 nt, Salmonella enterica enterica serovar Typhi
ucauaaaaucaaucugcaugu

SEQ ID NO: 3619717 - RNA, 13 nt, Salmonella enterica enterica serovar Typhi
ucauaaagcgccc

SEQ ID NO: 3619718 - RNA, 22 nt, Salmonella enterica enterica serovar Typhi
ucauaaaggcuuuaaagcaggc

SEQ ID NO: 3619719 - RNA, 17 nt, Salmonella enterica enterica serovar Typhi
ucauaaaugcugucgcc

SEQ ID NO: 3619720 - RNA, 21 nt, Salmonella enterica enterica serovar Typhi
ucauaaccgcagucuccggua

SEQ ID NO: 3619721 - RNA, 17 nt, Salmonella enterica enterica serovar Typhi
ucauaacgaccaaacaa

SEQ ID NO: 3619722 - RNA, 13 nt, Salmonella enterica enterica serovar Typhi
ucauaauaagcgc

SEQ ID NO: 3619723 - RNA, 20 nt, Salmonella enterica enterica serovar Typhi
ucauaauaagcgcucaggca

SEQ ID NO: 3619724 - RNA, 13 nt, Salmonella enterica enterica serovar Typhi
ucauaaucaacgu

SEQ ID NO: 3619725 - RNA, 20 nt, Salmonella enterica enterica serovar Typhi
ucauaaugucccugccacgc

SEQ ID NO: 3619726 - RNA, 12 nt, Salmonella enterica enterica serovar Typhi
ucauaauguucg

SEQ ID NO: 3619727 - RNA, 15 nt, Salmonella enterica enterica serovar Typhi
ucauaauucagcuca

SEQ ID NO: 3619728 - RNA, 14 nt, Salmonella enterica enterica serovar Typhi
ucauacaccgcauc

SEQ ID NO: 3619729 - RNA, 21 nt, Salmonella enterica enterica serovar Typhi
ucauacauuugaauaauucug

SEQ ID NO: 3619730 - RNA, 13 nt, Salmonella enterica enterica serovar Typhi
ucauacccuucca

SEQ ID NO: 3619731 - RNA, 18 nt, Salmonella enterica enterica serovar Typhi
ucauacgcuuuacgcuua

SEQ ID NO: 3619732 - RNA, 14 nt, Salmonella enterica enterica serovar Typhi
ucauacgcuuucug

SEQ ID NO: 3619733 - RNA, 22 nt, Salmonella enterica enterica serovar Typhi
ucauacgcuuucugaauuuccu

SEQ ID NO: 3619734 - RNA, 18 nt, Salmonella enterica enterica serovar Typhi
ucauacggauauuacgcu

SEQ ID NO: 3619735 - RNA, 23 nt, Salmonella enterica enterica serovar Typhi
ucauacggcaugccaucucuuaa

SEQ ID NO: 3619736 - RNA, 14 nt, Salmonella enterica enterica serovar Typhi
ucauacuauuuccu

SEQ ID NO: 3619737 - RNA, 21 nt, Salmonella enterica enterica serovar Typhi
ucauagcccugauuaaagaua

SEQ ID NO: 3619738 - RNA, 18 nt, Salmonella enterica enterica serovar Typhi
ucauagccgacccgcauc

SEQ ID NO: 3619739 - RNA, 22 nt, Salmonella enterica enterica serovar Typhi
ucauagcggcuaccgcguaaug

SEQ ID NO: 3619740 - RNA, 20 nt, Salmonella enterica enterica serovar Typhi
ucauaggacugaucccacuu

SEQ ID NO: 3619741 - RNA, 15 nt, Salmonella enterica enterica serovar Typhi
ucauaggugaacaug

SEQ ID NO: 3619742 - RNA, 22 nt, Salmonella enterica enterica serovar Typhi
ucauagugccggugacaugaaa

SEQ ID NO: 3619743 - RNA, 14 nt, Salmonella enterica enterica serovar Typhi
ucauagugcgcgcg

SEQ ID NO: 3619744 - RNA, 16 nt, Salmonella enterica enterica serovar Typhi
ucauaguuuuccagcc

SEQ ID NO: 3619745 - RNA, 19 nt, Salmonella enterica enterica serovar Typhi
ucauauggaagcuguuaau

SEQ ID NO: 3619746 - RNA, 21 nt, Salmonella enterica enterica serovar Typhi
ucauauggaagcuguuaauuu

SEQ ID NO: 3619747 - RNA, 15 nt, Salmonella enterica enterica serovar Typhi
ucauaugugccgaug

SEQ ID NO: 3619748 - RNA, 18 nt, Salmonella enterica enterica serovar Typhi
ucauaugugccgauggcg

SEQ ID NO: 3619749 - RNA, 19 nt, Salmonella enterica enterica serovar Typhi
ucauauuaaauuccggcuc

SEQ ID NO: 3619750 - RNA, 19 nt, Salmonella enterica enterica serovar Typhi
ucauauuacauagaaaaua

SEQ ID NO: 3619751 - RNA, 20 nt, Salmonella enterica enterica serovar Typhi
ucauauuacauagaaaauau

SEQ ID NO: 3619752 - RNA, 15 nt, Salmonella enterica enterica serovar Typhi
ucauauugcgccgca

SEQ ID NO: 3619753 - RNA, 23 nt, Salmonella enterica enterica serovar Typhi
ucauauuugugaccaacaucauu

SEQ ID NO: 3619754 - RNA, 13 nt, Salmonella enterica enterica serovar Typhi
ucaucaaaaugca

SEQ ID NO: 3619755 - RNA, 13 nt, Salmonella enterica enterica serovar Typhi
ucaucaaauuauc

SEQ ID NO: 3619756 - RNA, 18 nt, Salmonella enterica enterica serovar Typhi
ucaucaaggaauacgggc

SEQ ID NO: 3619757 - RNA, 21 nt, Salmonella enterica enterica serovar Typhi
ucaucaauggauuuauggcac

SEQ ID NO: 3619758 - RNA, 20 nt, Salmonella enterica enterica serovar Typhi
ucaucacaucgcgcagcagg

SEQ ID NO: 3619759 - RNA, 18 nt, Salmonella enterica enterica serovar Typhi
ucaucacgaucgagucag

SEQ ID NO: 3619760 - RNA, 15 nt, Salmonella enterica enterica serovar Typhi
ucaucagaagaagac

SEQ ID NO: 3619761 - RNA, 17 nt, Salmonella enterica enterica serovar Typhi
ucaucagaccgagaccc

SEQ ID NO: 3619762 - RNA, 20 nt, Salmonella enterica enterica serovar Typhi
ucaucagaccgagacccagc

SEQ ID NO: 3619763 - RNA, 21 nt, Salmonella enterica enterica serovar Typhi
ucaucagaccgugaauaagau

SEQ ID NO: 3619764 - RNA, 15 nt, Salmonella enterica enterica serovar Typhi
ucaucagccagcauc

SEQ ID NO: 3619765 - RNA, 21 nt, Salmonella enterica enterica serovar Typhi
ucaucagccgaccaauugcag

SEQ ID NO: 3619766 - RNA, 22 nt, Salmonella enterica enterica serovar Typhi
ucaucagccguuacuuccccca

SEQ ID NO: 3619767 - RNA, 15 nt, Salmonella enterica enterica serovar Typhi
ucaucaggcaauaaa

SEQ ID NO: 3619768 - RNA, 21 nt, Salmonella enterica enterica serovar Typhi
ucaucaggccugcaaaccucu

SEQ ID NO: 3619769 - RNA, 13 nt, Salmonella enterica enterica serovar Typhi
ucaucaguaacug

SEQ ID NO: 3619770 - RNA, 14 nt, Salmonella enterica enterica serovar Typhi
ucaucaguaacuga

SEQ ID NO: 3619771 - RNA, 17 nt, Salmonella enterica enterica serovar Typhi
uccacaccggcgcauac

SEQ ID NO: 3619772 - RNA, 13 nt, Salmonella enterica enterica serovar Typhi
uccacaccguuac

SEQ ID NO: 3619773 - RNA, 16 nt, Salmonella enterica enterica serovar Typhi
uccacacguccauccg

SEQ ID NO: 3619774 - RNA, 15 nt, Salmonella enterica enterica serovar Typhi
uccacagauagucgc

SEQ ID NO: 3619775 - RNA, 20 nt, Salmonella enterica enterica serovar Typhi
uccacagguuaucgccgccc

SEQ ID NO: 3619776 - RNA, 23 nt, Salmonella enterica enterica serovar Typhi
uccacagguuaucgccgcccguu

SEQ ID NO: 3619777 - RNA, 15 nt, Salmonella enterica enterica serovar Typhi
uccacauaaaguagc

SEQ ID NO: 3619778 - RNA, 23 nt, Salmonella enterica enterica serovar Typhi
uccacauaggcguugauggcgua

SEQ ID NO: 3619779 - RNA, 13 nt, Salmonella enterica enterica serovar Typhi
uccacauccagcg

SEQ ID NO: 3619780 - RNA, 19 nt, Salmonella enterica enterica serovar Typhi
uccacauucguaacaugcu

SEQ ID NO: 3619781 - RNA, 21 nt, Salmonella enterica enterica serovar Typhi
uccacauugguuuugccauuc

SEQ ID NO: 3619782 - RNA, 16 nt, Salmonella enterica enterica serovar Typhi
uccaccaaccaggcaa

SEQ ID NO: 3619783 - RNA, 12 nt, Salmonella enterica enterica serovar Typhi
uccaccaccucc

SEQ ID NO: 3619784 - RNA, 22 nt, Salmonella enterica enterica serovar Typhi
uccaccacguuaccgcgcaguu

SEQ ID NO: 3619785 - RNA, 13 nt, Salmonella enterica enterica serovar Typhi
uccaccagcccau

SEQ ID NO: 3619786 - RNA, 19 nt, Salmonella enterica enterica serovar Typhi
uccaccagcccaucuuucg

SEQ ID NO: 3619787 - RNA, 13 nt, Salmonella enterica enterica serovar Typhi
uccaccagcgcca

SEQ ID NO: 3619788 - RNA, 16 nt, Salmonella enterica enterica serovar Typhi
uccaccagcuuaucug

SEQ ID NO: 3619789 - RNA, 18 nt, Salmonella enterica enterica serovar Typhi
uccaccagcuuaucugac

SEQ ID NO: 3619790 - RNA, 17 nt, Salmonella enterica enterica serovar Typhi
uccaccaggcaugcagc

SEQ ID NO: 3619791 - RNA, 21 nt, Salmonella enterica enterica serovar Typhi
uccaccccuugcgcguuucug

SEQ ID NO: 3619792 - RNA, 12 nt, Salmonella enterica enterica serovar Typhi
uccaccgccaga

SEQ ID NO: 3619793 - RNA, 19 nt, Salmonella enterica enterica serovar Typhi
uccaccgccagacgcccca

SEQ ID NO: 3619794 - RNA, 12 nt, Salmonella enterica enterica serovar Typhi
uccaccuggccc

SEQ ID NO: 3619795 - RNA, 13 nt, Salmonella enterica enterica serovar Typhi
uccacgacauccg

SEQ ID NO: 3619796 - RNA, 15 nt, Salmonella enterica enterica serovar Typhi
uccacgcacgccggc

SEQ ID NO: 3619797 - RNA, 22 nt, Salmonella enterica enterica serovar Typhi
uccacgccgcaaggacgccagu

SEQ ID NO: 3619798 - RNA, 20 nt, Salmonella enterica enterica serovar Typhi
uccacgcuauaaaguagcca

SEQ ID NO: 3619799 - RNA, 22 nt, Salmonella enterica enterica serovar Typhi
uccacgguaaaacacgccucca

SEQ ID NO: 3619800 - RNA, 10 nt, Salmonella enterica enterica serovar Typhi
uccacgguuc

SEQ ID NO: 3619801 - RNA, 21 nt, Salmonella enterica enterica serovar Typhi
uccacgucauaacgcgcauuc

SEQ ID NO: 3619802 - RNA, 17 nt, Salmonella enterica enterica serovar Typhi
uccacgucgcacgccau

SEQ ID NO: 3619803 - RNA, 16 nt, Salmonella enterica enterica serovar Typhi
uccacguuuuacuucc

SEQ ID NO: 3619804 - RNA, 15 nt, Salmonella enterica enterica serovar Typhi
uccacugguuguccg

SEQ ID NO: 3619805 - RNA, 22 nt, Salmonella enterica enterica serovar Typhi
uccacuguucguccauaaaggc

SEQ ID NO: 3619806 - RNA, 20 nt, Salmonella enterica enterica serovar Typhi
uccacuguuggcgaaggcgg

SEQ ID NO: 3619807 - RNA, 17 nt, Salmonella enterica enterica serovar Typhi
uccacuuucagcggcuu

SEQ ID NO: 3619808 - RNA, 23 nt, Salmonella enterica enterica serovar Typhi
uccacuuucucggcuuuccagcu

SEQ ID NO: 3619809 - RNA, 17 nt, Salmonella enterica enterica serovar Typhi
uccacuuugccuuuauu

SEQ ID NO: 3619810 - RNA, 24 nt, Salmonella enterica enterica serovar Typhi
uccagaacgaauuuacucgccaau

SEQ ID NO: 3619811 - RNA, 17 nt, Salmonella enterica enterica serovar Typhi
uccagaauacgaauauu

SEQ ID NO: 3619812 - RNA, 20 nt, Salmonella enterica enterica serovar Typhi
uccagaauguuccugcaaua

SEQ ID NO: 3619813 - RNA, 16 nt, Salmonella enterica enterica serovar Typhi
uccagacagccgacgg

SEQ ID NO: 3619814 - RNA, 12 nt, Salmonella enterica enterica serovar Typhi
uccagacagcuu

SEQ ID NO: 3619815 - RNA, 22 nt, Salmonella enterica enterica serovar Typhi
uccagaccaaacaugcggcuuu

SEQ ID NO: 3619816 - RNA, 14 nt, Salmonella enterica enterica serovar Typhi
uccagaccaagauc

SEQ ID NO: 3619817 - RNA, 14 nt, Salmonella enterica enterica serovar Typhi
uccagacccacagc

SEQ ID NO: 3619818 - RNA, 21 nt, Salmonella enterica enterica serovar Typhi
uccagacccagacggcgauac

SEQ ID NO: 3619819 - RNA, 13 nt, Salmonella enterica enterica serovar Typhi
uccagaccggcgc

SEQ ID NO: 3619820 - RNA, 22 nt, Salmonella enterica enterica serovar Typhi
uccagaggaucuggacgccaau

SEQ ID NO: 3619821 - RNA, 17 nt, Salmonella enterica enterica serovar Typhi
uccagaggcauuauugc

SEQ ID NO: 3619822 - RNA, 15 nt, Salmonella enterica enterica serovar Typhi
uccagaggcguugcc

SEQ ID NO: 3619823 - RNA, 18 nt, Salmonella enterica enterica serovar Typhi
uccagaguacauucucuu

SEQ ID NO: 3619824 - RNA, 19 nt, Salmonella enterica enterica serovar Typhi
uccagauagcgaucgccgc

SEQ ID NO: 3619825 - RNA, 18 nt, Salmonella enterica enterica serovar Typhi
uccagauagggccaggcg

SEQ ID NO: 3619826 - RNA, 17 nt, Salmonella enterica enterica serovar Typhi
uccagaucgcauaaaau

SEQ ID NO: 3619827 - RNA, 12 nt, Salmonella enterica enterica serovar Typhi
uccagaucuuca

SEQ ID NO: 3619828 - RNA, 14 nt, Salmonella enterica enterica serovar Typhi
uccagaucuucaga

SEQ ID NO: 3619829 - RNA, 16 nt, Salmonella enterica enterica serovar Typhi
uccagaugaagcgcau

SEQ ID NO: 3619830 - RNA, 20 nt, Salmonella enterica enterica serovar Typhi
uccagaugcgccagauucau

SEQ ID NO: 3619831 - RNA, 20 nt, Salmonella enterica enterica serovar Typhi
uccagaugcggcgccaacgc

SEQ ID NO: 3619832 - RNA, 21 nt, Salmonella enterica enterica serovar Typhi
uccagauugagacaaauaacu

SEQ ID NO: 3619833 - RNA, 20 nt, Salmonella enterica enterica serovar Typhi
uccagcaaaccuuccgccag

SEQ ID NO: 3619834 - RNA, 14 nt, Salmonella enterica enterica serovar Typhi
uccagcaacagaag

SEQ ID NO: 3619835 - RNA, 22 nt, Salmonella enterica enterica serovar Typhi
uccagcaccgcgaccaguucac

SEQ ID NO: 3619836 - RNA, 22 nt, Salmonella enterica enterica serovar Typhi
uccagcacgauauccagcaccu

SEQ ID NO: 3619837 - RNA, 13 nt, Salmonella enterica enterica serovar Typhi
uccagcacgccca

SEQ ID NO: 3619838 - RNA, 20 nt, Salmonella enterica enterica serovar Typhi
uccagcacgcgcugcgccgc

SEQ ID NO: 3619839 - RNA, 12 nt, Salmonella enterica enterica serovar Typhi
uccagcacggca

SEQ ID NO: 3619840 - RNA, 20 nt, Salmonella enterica enterica serovar Typhi
uccagcacggcauaagccuc

SEQ ID NO: 3619841 - RNA, 22 nt, Salmonella enterica enterica serovar Typhi
uccagcagacucauggacaaaa

SEQ ID NO: 3619842 - RNA, 14 nt, Salmonella enterica enterica serovar Typhi
uccagcagauuagc

SEQ ID NO: 3619843 - RNA, 13 nt, Salmonella enterica enterica serovar Typhi
uccagcagcacuu

SEQ ID NO: 3619844 - RNA, 13 nt, Salmonella enterica enterica serovar Typhi
uccagcagcgcau

SEQ ID NO: 3619845 - RNA, 18 nt, Salmonella enterica enterica serovar Typhi
uccagcagguggaucuga

SEQ ID NO: 3619846 - RNA, 12 nt, Salmonella enterica enterica serovar Typhi
uccagcaguguc

SEQ ID NO: 3619847 - RNA, 22 nt, Salmonella enterica enterica serovar Typhi
uccagcauaauaugaugcagac

SEQ ID NO: 3619848 - RNA, 13 nt, Salmonella enterica enterica serovar Typhi
uccagcauucuau

SEQ ID NO: 3619849 - RNA, 17 nt, Salmonella enterica enterica serovar Typhi
uccagccagcguuucug

SEQ ID NO: 3619850 - RNA, 23 nt, Salmonella enterica enterica serovar Typhi
uccagccagcguuucuggaagua

SEQ ID NO: 3619851 - RNA, 13 nt, Salmonella enterica enterica serovar Typhi
uccagccagggau

SEQ ID NO: 3619852 - RNA, 23 nt, Salmonella enterica enterica serovar Typhi
uccagccccagcgccagcugcgu

SEQ ID NO: 3619853 - RNA, 18 nt, Salmonella enterica enterica serovar Typhi
uccagccccuucgcuguc

SEQ ID NO: 3619854 - RNA, 22 nt, Salmonella enterica enterica serovar Typhi
uccagcccgccaauauccggca

SEQ ID NO: 3619855 - RNA, 16 nt, Salmonella enterica enterica serovar Typhi
uccagccgguguuaac

SEQ ID NO: 3619856 - RNA, 22 nt, Salmonella enterica enterica serovar Typhi
uccagccguuuaaucucuucau

SEQ ID NO: 3619857 - RNA, 21 nt, Salmonella enterica enterica serovar Typhi
uccaugccggcuuuccgcacc

SEQ ID NO: 3619858 - RNA, 17 nt, Salmonella enterica enterica serovar Typhi
uccaugccuuuggccug

SEQ ID NO: 3619859 - RNA, 21 nt, Salmonella enterica enterica serovar Typhi
uccaugccuuuggccuggaga

SEQ ID NO: 3619860 - RNA, 18 nt, Salmonella enterica enterica serovar Typhi
uccaugcuuucaauaaau

SEQ ID NO: 3619861 - RNA, 19 nt, Salmonella enterica enterica serovar Typhi
uccauguaaacuccauuaa

SEQ ID NO: 3619862 - RNA, 18 nt, Salmonella enterica enterica serovar Typhi
uccauguacgcaggcgac

SEQ ID NO: 3619863 - RNA, 16 nt, Salmonella enterica enterica serovar Typhi
uccaugucuugcuauc

SEQ ID NO: 3619864 - RNA, 19 nt, Salmonella enterica enterica serovar Typhi
uccauguugccaugguuca

SEQ ID NO: 3619865 - RNA, 22 nt, Salmonella enterica enterica serovar Typhi
uccauuagcgccugaugcacau

SEQ ID NO: 3619866 - RNA, 20 nt, Salmonella enterica enterica serovar Typhi
uccauucacacaauuuucuu

SEQ ID NO: 3619867 - RNA, 14 nt, Salmonella enterica enterica serovar Typhi
uccauucaucgauu

SEQ ID NO: 3619868 - RNA, 16 nt, Salmonella enterica enterica serovar Typhi
uccauuccagaacgaa

SEQ ID NO: 3619869 - RNA, 13 nt, Salmonella enterica enterica serovar Typhi
uccauucccagcu

SEQ ID NO: 3619870 - RNA, 19 nt, Salmonella enterica enterica serovar Typhi
uccauucggcgaaagaagc

SEQ ID NO: 3619871 - RNA, 22 nt, Salmonella enterica enterica serovar Typhi
uccauucucaucagaccgugaa

SEQ ID NO: 3619872 - RNA, 15 nt, Salmonella enterica enterica serovar Typhi
uccauuggccagaua

SEQ ID NO: 3619873 - RNA, 10 nt, Salmonella enterica enterica serovar Typhi
uccauuuccu

SEQ ID NO: 3619874 - RNA, 14 nt, Salmonella enterica enterica serovar Typhi
uccauuuuaaauac

SEQ ID NO: 3619875 - RNA, 12 nt, Salmonella enterica enterica serovar Typhi
uccauuuuccua

SEQ ID NO: 3619876 - RNA, 18 nt, Salmonella enterica enterica serovar Typhi
uccauuuuggggaaaaua

SEQ ID NO: 3619877 - RNA, 17 nt, Salmonella enterica enterica serovar Typhi
uccauuuuuuaucugac

SEQ ID NO: 3619878 - RNA, 15 nt, Salmonella enterica enterica serovar Typhi
ucccaacagcgagcu

SEQ ID NO: 3619879 - RNA, 18 nt, Salmonella enterica enterica serovar Typhi
ucccaacccgaccaggac

SEQ ID NO: 3619880 - RNA, 21 nt, Salmonella enterica enterica serovar Typhi
ucccaacccgaccaggacaaa

SEQ ID NO: 3619881 - RNA, 16 nt, Salmonella enterica enterica serovar Typhi
ucccaauaccggcgua

SEQ ID NO: 3619882 - RNA, 14 nt, Salmonella enterica enterica serovar Typhi
ucccacaccacacg

SEQ ID NO: 3619883 - RNA, 21 nt, Salmonella enterica enterica serovar Typhi
ucccacauacggcugaaaaau

SEQ ID NO: 3619884 - RNA, 13 nt, Salmonella enterica enterica serovar Typhi
ucccaccacgcag

SEQ ID NO: 3619885 - RNA, 13 nt, Salmonella enterica enterica serovar Typhi
ucccaccgggcca

SEQ ID NO: 3619886 - RNA, 14 nt, Salmonella enterica enterica serovar Typhi
ucccacgacauguu

SEQ ID NO: 3619887 - RNA, 15 nt, Salmonella enterica enterica serovar Typhi
ucccacgcauagucc

SEQ ID NO: 3619888 - RNA, 17 nt, Salmonella enterica enterica serovar Typhi
ucccacgggcgcaccau

SEQ ID NO: 3619889 - RNA, 20 nt, Salmonella enterica enterica serovar Typhi
ucccacucuucaaccggcag

SEQ ID NO: 3619890 - RNA, 13 nt, Salmonella enterica enterica serovar Typhi
ucccacucuucca

SEQ ID NO: 3619891 - RNA, 13 nt, Salmonella enterica enterica serovar Typhi
ucccagacaaaau

SEQ ID NO: 3619892 - RNA, 19 nt, Salmonella enterica enterica serovar Typhi
ucccagauuaaaucauccu

SEQ ID NO: 3619893 - RNA, 21 nt, Salmonella enterica enterica serovar Typhi
ucccagcaugagugauagcgc

SEQ ID NO: 3619894 - RNA, 14 nt, Salmonella enterica enterica serovar Typhi
ucccagccgggcag

SEQ ID NO: 3619895 - RNA, 21 nt, Salmonella enterica enterica serovar Typhi
ucccagccgggcaggaaaagc

SEQ ID NO: 3619896 - RNA, 19 nt, Salmonella enterica enterica serovar Typhi
ucccagccuuccuggucug

SEQ ID NO: 3619897 - RNA, 22 nt, Salmonella enterica enterica serovar Typhi
ucccagccuuccuggucugcca

SEQ ID NO: 3619898 - RNA, 20 nt, Salmonella enterica enterica serovar Typhi
ucccagcgcgcgcgcaaagc

SEQ ID NO: 3619899 - RNA, 14 nt, Salmonella enterica enterica serovar Typhi
ucccagcugagcua

SEQ ID NO: 3619900 - RNA, 19 nt, Salmonella enterica enterica serovar Typhi
ucccaggccgccaccgccu

SEQ ID NO: 3619901 - RNA, 18 nt, Salmonella enterica enterica serovar Typhi
ucccaggccggcauaaug

SEQ ID NO: 3619902 - RNA, 16 nt, Salmonella enterica enterica serovar Typhi
ucccaggcgcgcagcu

SEQ ID NO: 3619903 - RNA, 19 nt, Salmonella enterica enterica serovar Typhi
ucccagguuucaaugccgc

SEQ ID NO: 3619904 - RNA, 23 nt, Salmonella enterica enterica serovar Typhi
ucccaguaguuaccguaaucauc

SEQ ID NO: 3619905 - RNA, 14 nt, Salmonella enterica enterica serovar Typhi
ucccaguggcgucg

SEQ ID NO: 3619906 - RNA, 13 nt, Salmonella enterica enterica serovar Typhi
ucccagugucaac

SEQ ID NO: 3619907 - RNA, 17 nt, Salmonella enterica enterica serovar Typhi
ucccaguuggcagggcu

SEQ ID NO: 3619908 - RNA, 18 nt, Salmonella enterica enterica serovar Typhi
ucccauauuuuuucugcc

SEQ ID NO: 3619909 - RNA, 19 nt, Salmonella enterica enterica serovar Typhi
ucccaucaauaagcgaauu

SEQ ID NO: 3619910 - RNA, 19 nt, Salmonella enterica enterica serovar Typhi
ucccauccgugcgaugaga

SEQ ID NO: 3619911 - RNA, 13 nt, Salmonella enterica enterica serovar Typhi
ucccaucgcgcca

SEQ ID NO: 3619912 - RNA, 22 nt, Salmonella enterica enterica serovar Typhi
ucccaucgcuuugcagaaaauc

SEQ ID NO: 3619913 - RNA, 18 nt, Salmonella enterica enterica serovar Typhi
ucccaugaaacucgacac

SEQ ID NO: 3619914 - RNA, 19 nt, Salmonella enterica enterica serovar Typhi
ucccauucacguagcggcg

SEQ ID NO: 3619915 - RNA, 18 nt, Salmonella enterica enterica serovar Typhi
ucccauuccugcaagaag

SEQ ID NO: 3619916 - RNA, 21 nt, Salmonella enterica enterica serovar Typhi
ucccauuccugcaagaagcgu

SEQ ID NO: 3619917 - RNA, 14 nt, Salmonella enterica enterica serovar Typhi
uccccaccaccgcc

SEQ ID NO: 3619918 - RNA, 15 nt, Salmonella enterica enterica serovar Typhi
uccccaccaccgcca

SEQ ID NO: 3619919 - RNA, 17 nt, Salmonella enterica enterica serovar Typhi
uccccaccaccgccacu

SEQ ID NO: 3619920 - RNA, 14 nt, Salmonella enterica enterica serovar Typhi
uccccaccaggaau

SEQ ID NO: 3619921 - RNA, 15 nt, Salmonella enterica enterica serovar Typhi
uccccaccgcugaug

SEQ ID NO: 3619922 - RNA, 22 nt, Salmonella enterica enterica serovar Typhi
uccccacgccgaccaccagcuu

SEQ ID NO: 3619923 - RNA, 21 nt, Salmonella enterica enterica serovar Typhi
uccccagaaugauaaugccgc

SEQ ID NO: 3619924 - RNA, 16 nt, Salmonella enterica enterica serovar Typhi
uccccagcaucauguc

SEQ ID NO: 3619925 - RNA, 21 nt, Salmonella enterica enterica serovar Typhi
uccccauaaucgaccguaucc

SEQ ID NO: 3619926 - RNA, 23 nt, Salmonella enterica enterica serovar Typhi
uccccauacugacggcgcucuuu

SEQ ID NO: 3619927 - RNA, 15 nt, Salmonella enterica enterica serovar Typhi
uccccauaucccgaa

SEQ ID NO: 3619928 - RNA, 19 nt, Salmonella enterica enterica serovar Typhi
uccccauaucccgaaaagc

SEQ ID NO: 3619929 - RNA, 16 nt, Salmonella enterica enterica serovar Typhi
uccccaucccaaucag

SEQ ID NO: 3619930 - RNA, 12 nt, Salmonella enterica enterica serovar Typhi
uccccauguuga

SEQ ID NO: 3619931 - RNA, 16 nt, Salmonella enterica enterica serovar Typhi
uccccauuuuuuucag

SEQ ID NO: 3619932 - RNA, 12 nt, Salmonella enterica enterica serovar Typhi
ucccccacuucu

SEQ ID NO: 3619933 - RNA, 17 nt, Salmonella enterica enterica serovar Typhi
uccccccucugauuggc

SEQ ID NO: 3619934 - RNA, 19 nt, Salmonella enterica enterica serovar Typhi
ucccccucuugccccacau

SEQ ID NO: 3619935 - RNA, 12 nt, Salmonella enterica enterica serovar Typhi
ucccccuggccc

SEQ ID NO: 3619936 - RNA, 22 nt, Salmonella enterica enterica serovar Typhi
ucccccuggccugcucaucagg

SEQ ID NO: 3619937 - RNA, 19 nt, Salmonella enterica enterica serovar Typhi
uccccgacggccucuucac

SEQ ID NO: 3619938 - RNA, 19 nt, Salmonella enterica enterica serovar Typhi
uccccgauucgcaugaauu

SEQ ID NO: 3619939 - RNA, 12 nt, Salmonella enterica enterica serovar Typhi
uccccgccgcca

SEQ ID NO: 3619940 - RNA, 17 nt, Salmonella enterica enterica serovar Typhi
uccccgccgccaucacc

SEQ ID NO: 3619941 - RNA, 14 nt, Salmonella enterica enterica serovar Typhi
uccccgccgcggcg

SEQ ID NO: 3619942 - RNA, 22 nt, Salmonella enterica enterica serovar Typhi
uccccgccgcugaggauggcgc

SEQ ID NO: 3619943 - RNA, 17 nt, Salmonella enterica enterica serovar Typhi
uccccgcgcaauugcgg

SEQ ID NO: 3619944 - RNA, 22 nt, Salmonella enterica enterica serovar Typhi
uccccgcugucgggagccucuu

SEQ ID NO: 3619945 - RNA, 13 nt, Salmonella enterica enterica serovar Typhi
uccccggcagccu

SEQ ID NO: 3619946 - RNA, 14 nt, Salmonella enterica enterica serovar Typhi
uccccggcaggcuc

SEQ ID NO: 3619947 - RNA, 14 nt, Salmonella enterica enterica serovar Typhi
uccccggcuucaca

SEQ ID NO: 3619948 - RNA, 13 nt, Salmonella enterica enterica serovar Typhi
uccccggcuucca

SEQ ID NO: 3619949 - RNA, 21 nt, Salmonella enterica enterica serovar Typhi
uccccggguaucgcuuucggc

SEQ ID NO: 3619950 - RNA, 21 nt, Salmonella enterica enterica serovar Typhi
uccccggucagucccagcguu

SEQ ID NO: 3619951 - RNA, 21 nt, Salmonella enterica enterica serovar Typhi
uccccucaugacuuuuuucaa

SEQ ID NO: 3619952 - RNA, 15 nt, Salmonella enterica enterica serovar Typhi
uccccucuuccauca

SEQ ID NO: 3619953 - RNA, 21 nt, Salmonella enterica enterica serovar Typhi
uccccucuuccaucagccagg

SEQ ID NO: 3619954 - RNA, 14 nt, Salmonella enterica enterica serovar Typhi
uccccuucaggaau

SEQ ID NO: 3619955 - RNA, 15 nt, Salmonella enterica enterica serovar Typhi
uccccuucugguagc

SEQ ID NO: 3619956 - RNA, 19 nt, Salmonella enterica enterica serovar Typhi
uccccuucuguaagcaauu

SEQ ID NO: 3619957 - RNA, 13 nt, Salmonella enterica enterica serovar Typhi
ucccgaacaugcc

SEQ ID NO: 3619958 - RNA, 12 nt, Salmonella enterica enterica serovar Typhi
ucccgaacgaua

SEQ ID NO: 3619959 - RNA, 12 nt, Salmonella enterica enterica serovar Typhi
ucccgaauacgc

SEQ ID NO: 3619960 - RNA, 15 nt, Salmonella enterica enterica serovar Typhi
ucccgauacgguugc

SEQ ID NO: 3619961 - RNA, 17 nt, Salmonella enterica enterica serovar Typhi
ucccgauacgguugcgc

SEQ ID NO: 3619962 - RNA, 19 nt, Salmonella enterica enterica serovar Typhi
ucccgaucuucaucguuac

SEQ ID NO: 3619963 - RNA, 21 nt, Salmonella enterica enterica serovar Typhi
ucccgaugguauuuauucuau

SEQ ID NO: 3619964 - RNA, 14 nt, Salmonella enterica enterica serovar Typhi
ucccgcacgcuggc

SEQ ID NO: 3619965 - RNA, 22 nt, Salmonella enterica enterica serovar Typhi
ucccgcacgcuggcaucaauau

SEQ ID NO: 3619966 - RNA, 13 nt, Salmonella enterica enterica serovar Typhi
ucccgcagccagc

SEQ ID NO: 3619967 - RNA, 17 nt, Salmonella enterica enterica serovar Typhi
ucccgccucggucagua

SEQ ID NO: 3619968 - RNA, 12 nt, Salmonella enterica enterica serovar Typhi
ucccgccugcug

SEQ ID NO: 3619969 - RNA, 14 nt, Salmonella enterica enterica serovar Typhi
ucccgccugcugca

SEQ ID NO: 3619970 - RNA, 22 nt, Salmonella enterica enterica serovar Typhi
ucccgcgacgucaauaaagccg

SEQ ID NO: 3619971 - RNA, 16 nt, Salmonella enterica enterica serovar Typhi
ucccgcgcuucauccg

SEQ ID NO: 3619972 - RNA, 18 nt, Salmonella enterica enterica serovar Typhi
ucccgcggcggacagcgg

SEQ ID NO: 3619973 - RNA, 22 nt, Salmonella enterica enterica serovar Typhi
ucccgcguucgcgcaguucauc

SEQ ID NO: 3619974 - RNA, 14 nt, Salmonella enterica enterica serovar Typhi
ucccgcugcggcgu

SEQ ID NO: 3619975 - RNA, 15 nt, Salmonella enterica enterica serovar Typhi
ucccgcugcggcgug

SEQ ID NO: 3619976 - RNA, 18 nt, Salmonella enterica enterica serovar Typhi
ucccgcugugauccaugu

SEQ ID NO: 3619977 - RNA, 22 nt, Salmonella enterica enterica serovar Typhi
ucccgcugugauccauguugcc

SEQ ID NO: 3619978 - RNA, 21 nt, Salmonella enterica enterica serovar Typhi
ucccggaacagcggagcgaag

SEQ ID NO: 3619979 - RNA, 14 nt, Salmonella enterica enterica serovar Typhi
ucccggcauuauaa

SEQ ID NO: 3619980 - RNA, 14 nt, Salmonella enterica enterica serovar Typhi
ucccguaaaagaag

SEQ ID NO: 3619981 - RNA, 15 nt, Salmonella enterica enterica serovar Typhi
ucccguaaaagaaga

SEQ ID NO: 3619982 - RNA, 17 nt, Salmonella enterica enterica serovar Typhi
ucccguaaaagaagaaa

SEQ ID NO: 3619983 - RNA, 18 nt, Salmonella enterica enterica serovar Typhi
ucccguuuucgucccagc

SEQ ID NO: 3619984 - RNA, 19 nt, Salmonella enterica enterica serovar Typhi
ucccuacucucgcaugggg

SEQ ID NO: 3619985 - RNA, 23 nt, Salmonella enterica enterica serovar Typhi
ucccuacugcuuagcucaucagc

SEQ ID NO: 3619986 - RNA, 12 nt, Salmonella enterica enterica serovar Typhi
ucccuauacguu

SEQ ID NO: 3619987 - RNA, 23 nt, Salmonella enterica enterica serovar Typhi
ucccuauguaaagaaugaaaaaa

SEQ ID NO: 3619988 - RNA, 14 nt, Salmonella enterica enterica serovar Typhi
ucccucaccucccc

SEQ ID NO: 3619989 - RNA, 17 nt, Salmonella enterica enterica serovar Typhi
ucccucauauuuguauc

SEQ ID NO: 3619990 - RNA, 17 nt, Salmonella enterica enterica serovar Typhi
ucccucgacaauuucac

SEQ ID NO: 3619991 - RNA, 12 nt, Salmonella enterica enterica serovar Typhi
ucccucgccccg

SEQ ID NO: 3619992 - RNA, 14 nt, Salmonella enterica enterica serovar Typhi
ucccucuccagggc

SEQ ID NO: 3619993 - RNA, 16 nt, Salmonella enterica enterica serovar Typhi
ucccucuccagggcaa

SEQ ID NO: 3619994 - RNA, 16 nt, Salmonella enterica enterica serovar Typhi
ucccucugaaacgcuu

SEQ ID NO: 3619995 - RNA, 18 nt, Salmonella enterica enterica serovar Typhi
ucccugaccuuccaucca

SEQ ID NO: 3619996 - RNA, 13 nt, Salmonella enterica enterica serovar Typhi
ucccugacgcgca

SEQ ID NO: 3619997 - RNA, 15 nt, Salmonella enterica enterica serovar Typhi
ucccugacuggcuga

SEQ ID NO: 3619998 - RNA, 22 nt, Salmonella enterica enterica serovar Typhi
ucccugagacaggccagaauuc

SEQ ID NO: 3619999 - RNA, 16 nt, Salmonella enterica enterica serovar Typhi
ucccugagucuugccu

SEQ ID NO: 3620000 - RNA, 17 nt, Salmonella enterica enterica serovar Typhi
ucccuggauaaaauauc

SEQ ID NO: 3620001 - RNA, 10 nt, Salmonella enterica enterica serovar Typhi
ucccuggccg

SEQ ID NO: 3620002 - RNA, 17 nt, Salmonella enterica enterica serovar Typhi
ucccuggcgugucauca

SEQ ID NO: 3620003 - RNA, 17 nt, Salmonella enterica enterica serovar Typhi
ucccuuccgccaccagg

SEQ ID NO: 3620004 - RNA, 18 nt, Salmonella enterica enterica serovar Typhi
ucccuuccgccaccaggu

SEQ ID NO: 3620005 - RNA, 21 nt, Salmonella enterica enterica serovar Typhi
ucccuuccgccaccagguuca

SEQ ID NO: 3620006 - RNA, 16 nt, Salmonella enterica enterica serovar Typhi
ucccuuucaaaaaaga

SEQ ID NO: 3620007 - RNA, 20 nt, Salmonella enterica enterica serovar Typhi
uccgaaacaaucaccugaug

SEQ ID NO: 3620008 - RNA, 11 nt, Salmonella enterica enterica serovar Typhi
uccgaauaauc

SEQ ID NO: 3620009 - RNA, 21 nt, Salmonella enterica enterica serovar Typhi
uccgaauacggacauuuauuu

SEQ ID NO: 3620010 - RNA, 14 nt, Salmonella enterica enterica serovar Typhi
uccgacaaccggcu

SEQ ID NO: 3620011 - RNA, 16 nt, Salmonella enterica enterica serovar Typhi
uccgacacgcacaucc

SEQ ID NO: 3620012 - RNA, 14 nt, Salmonella enterica enterica serovar Typhi
uccgacauuguucu

SEQ ID NO: 3620013 - RNA, 23 nt, Salmonella enterica enterica serovar Typhi
uccgaggaacgugaguccuucaa

SEQ ID NO: 3620014 - RNA, 11 nt, Salmonella enterica enterica serovar Typhi
uccgauagcga

SEQ ID NO: 3620015 - RNA, 20 nt, Salmonella enterica enterica serovar Typhi
uccgaucuacgcuauuucca

SEQ ID NO: 3620016 - RNA, 22 nt, Salmonella enterica enterica serovar Typhi
uccgaugcgcuuuacugucgcu

SEQ ID NO: 3620017 - RNA, 19 nt, Salmonella enterica enterica serovar Typhi
uccgcaaagcccaucagcg

SEQ ID NO: 3620018 - RNA, 23 nt, Salmonella enterica enterica serovar Typhi
uccgcaaagcccaucagcgccag

SEQ ID NO: 3620019 - RNA, 12 nt, Salmonella enterica enterica serovar Typhi
uccgcaaagugg

SEQ ID NO: 3620020 - RNA, 22 nt, Salmonella enterica enterica serovar Typhi
uccgcaagacacgcuuccagau

SEQ ID NO: 3620021 - RNA, 11 nt, Salmonella enterica enterica serovar Typhi
uccgcaauaag

SEQ ID NO: 3620022 - RNA, 13 nt, Salmonella enterica enterica serovar Typhi
uccgcaauaagug

SEQ ID NO: 3620023 - RNA, 16 nt, Salmonella enterica enterica serovar Typhi
uccgcaauaagugcau

SEQ ID NO: 3620024 - RNA, 22 nt, Salmonella enterica enterica serovar Typhi
uccgcaaucacauacagcacuu

SEQ ID NO: 3620025 - RNA, 14 nt, Salmonella enterica enterica serovar Typhi
uccgcacgcgcgcc

SEQ ID NO: 3620026 - RNA, 16 nt, Salmonella enterica enterica serovar Typhi
uccgcacgcgcgcccu

SEQ ID NO: 3620027 - RNA, 20 nt, Salmonella enterica enterica serovar Typhi
uccgcagccagaaucagccg

SEQ ID NO: 3620028 - RNA, 12 nt, Salmonella enterica enterica serovar Typhi
uccgcaggcaac

SEQ ID NO: 3620029 - RNA, 18 nt, Salmonella enterica enterica serovar Typhi
uccggcgcuggcgcuggc

SEQ ID NO: 3620030 - RNA, 21 nt, Salmonella enterica enterica serovar Typhi
uccggcggcaaggucugcgcc

SEQ ID NO: 3620031 - RNA, 15 nt, Salmonella enterica enterica serovar Typhi
uccggcggugaagca

SEQ ID NO: 3620032 - RNA, 23 nt, Salmonella enterica enterica serovar Typhi
uccggcgucuggguuugcagcag

SEQ ID NO: 3620033 - RNA, 14 nt, Salmonella enterica enterica serovar Typhi
uccggcgugacuca

SEQ ID NO: 3620034 - RNA, 12 nt, Salmonella enterica enterica serovar Typhi
uccggcguuucg

SEQ ID NO: 3620035 - RNA, 24 nt, Salmonella enterica enterica serovar Typhi
uccggcguuucguuuagcgccugc

SEQ ID NO: 3620036 - RNA, 17 nt, Salmonella enterica enterica serovar Typhi
uccggcguuuuagcgcc

SEQ ID NO: 3620037 - RNA, 18 nt, Salmonella enterica enterica serovar Typhi
uccggcuacgguuuuaau

SEQ ID NO: 3620038 - RNA, 14 nt, Salmonella enterica enterica serovar Typhi
uccggcuaugccgg

SEQ ID NO: 3620039 - RNA, 19 nt, Salmonella enterica enterica serovar Typhi
uccggcuuauccggccugc

SEQ ID NO: 3620040 - RNA, 16 nt, Salmonella enterica enterica serovar Typhi
uccgggauagcacuac

SEQ ID NO: 3620041 - RNA, 19 nt, Salmonella enterica enterica serovar Typhi
uccggggucucuacgcggc

SEQ ID NO: 3620042 - RNA, 16 nt, Salmonella enterica enterica serovar Typhi
uccgggguucgaaucc

SEQ ID NO: 3620043 - RNA, 15 nt, Salmonella enterica enterica serovar Typhi
uccgguaaucgacgg

SEQ ID NO: 3620044 - RNA, 16 nt, Salmonella enterica enterica serovar Typhi
uccgguagagaacgaa

SEQ ID NO: 3620045 - RNA, 18 nt, Salmonella enterica enterica serovar Typhi
uccgguaucaugcugaug

SEQ ID NO: 3620046 - RNA, 21 nt, Salmonella enterica enterica serovar Typhi
uccgguaucaugcugaugacu

SEQ ID NO: 3620047 - RNA, 15 nt, Salmonella enterica enterica serovar Typhi
uccggucuacaagug

SEQ ID NO: 3620048 - RNA, 14 nt, Salmonella enterica enterica serovar Typhi
uccggucugcgcgc

SEQ ID NO: 3620049 - RNA, 17 nt, Salmonella enterica enterica serovar Typhi
uccggugaagguaauuu

SEQ ID NO: 3620050 - RNA, 18 nt, Salmonella enterica enterica serovar Typhi
uccggugaagguaauuuu

SEQ ID NO: 3620051 - RNA, 14 nt, Salmonella enterica enterica serovar Typhi
uccgguuaauacgc

SEQ ID NO: 3620052 - RNA, 16 nt, Salmonella enterica enterica serovar Typhi
uccgguugaccgcaua

SEQ ID NO: 3620053 - RNA, 12 nt, Salmonella enterica enterica serovar Typhi
uccgguuucaac

SEQ ID NO: 3620054 - RNA, 22 nt, Salmonella enterica enterica serovar Typhi
uccgguuuuacuauugccgaua

SEQ ID NO: 3620055 - RNA, 20 nt, Salmonella enterica enterica serovar Typhi
uccguaagcggcggaccagc

SEQ ID NO: 3620056 - RNA, 20 nt, Salmonella enterica enterica serovar Typhi
uccguacauaacagcagcag

SEQ ID NO: 3620057 - RNA, 12 nt, Salmonella enterica enterica serovar Typhi
uccguagccaac

SEQ ID NO: 3620058 - RNA, 16 nt, Salmonella enterica enterica serovar Typhi
uccguagcgauaauga

SEQ ID NO: 3620059 - RNA, 18 nt, Salmonella enterica enterica serovar Typhi
uccguagcgauaaugacg

SEQ ID NO: 3620060 - RNA, 19 nt, Salmonella enterica enterica serovar Typhi
uccguauuauccacccccg

SEQ ID NO: 3620061 - RNA, 15 nt, Salmonella enterica enterica serovar Typhi
uccgucaaagaaaac

SEQ ID NO: 3620062 - RNA, 19 nt, Salmonella enterica enterica serovar Typhi
uccgucagcgaaucgaucu

SEQ ID NO: 3620063 - RNA, 23 nt, Salmonella enterica enterica serovar Typhi
uccgucagcgucacguuauacca

SEQ ID NO: 3620064 - RNA, 13 nt, Salmonella enterica enterica serovar Typhi
uccgucaggaugg

SEQ ID NO: 3620065 - RNA, 13 nt, Salmonella enterica enterica serovar Typhi
uccguccagaccg

SEQ ID NO: 3620066 - RNA, 19 nt, Salmonella enterica enterica serovar Typhi
uccgucggcuggaagccuu

SEQ ID NO: 3620067 - RNA, 18 nt, Salmonella enterica enterica serovar Typhi
uccgucgugccuuucagg

SEQ ID NO: 3620068 - RNA, 15 nt, Salmonella enterica enterica serovar Typhi
uccgucguguagccu

SEQ ID NO: 3620069 - RNA, 16 nt, Salmonella enterica enterica serovar Typhi
uccgucuccggacguu

SEQ ID NO: 3620070 - RNA, 13 nt, Salmonella enterica enterica serovar Typhi
uccgugaccugcu

SEQ ID NO: 3620071 - RNA, 14 nt, Salmonella enterica enterica serovar Typhi
uccguuaagcccug

SEQ ID NO: 3620072 - RNA, 17 nt, Salmonella enterica enterica serovar Typhi
uccguuagcucuuucau

SEQ ID NO: 3620073 - RNA, 16 nt, Salmonella enterica enterica serovar Typhi
uccuaauuuuuaaaga

SEQ ID NO: 3620074 - RNA, 23 nt, Salmonella enterica enterica serovar Typhi
uccuaccacgccgcuacugccgc

SEQ ID NO: 3620075 - RNA, 15 nt, Salmonella enterica enterica serovar Typhi
uccucaauguuaacu

SEQ ID NO: 3620076 - RNA, 19 nt, Salmonella enterica enterica serovar Typhi
uccucacaaacggcaucga

SEQ ID NO: 3620077 - RNA, 12 nt, Salmonella enterica enterica serovar Typhi
uccucacgcccu

SEQ ID NO: 3620078 - RNA, 17 nt, Salmonella enterica enterica serovar Typhi
uccucagaauccgucag

SEQ ID NO: 3620079 - RNA, 16 nt, Salmonella enterica enterica serovar Typhi
uccucauacagcccgc

SEQ ID NO: 3620080 - RNA, 16 nt, Salmonella enterica enterica serovar Typhi
uccucauucagcggcu

SEQ ID NO: 3620081 - RNA, 23 nt, Salmonella enterica enterica serovar Typhi
uccuccggcauagccggagguuu

SEQ ID NO: 3620082 - RNA, 22 nt, Salmonella enterica enterica serovar Typhi
uccuccggcgacugaaugccuu

SEQ ID NO: 3620083 - RNA, 20 nt, Salmonella enterica enterica serovar Typhi
uccuccggcgagcgaugcug

SEQ ID NO: 3620084 - RNA, 19 nt, Salmonella enterica enterica serovar Typhi
uccuccggcguaaaggcuu

SEQ ID NO: 3620085 - RNA, 23 nt, Salmonella enterica enterica serovar Typhi
uccuccggcguaaaggcuuguuu

SEQ ID NO: 3620086 - RNA, 16 nt, Salmonella enterica enterica serovar Typhi
uccuccgguuucaacu

SEQ ID NO: 3620087 - RNA, 15 nt, Salmonella enterica enterica serovar Typhi
uccuccucauucagc

SEQ ID NO: 3620088 - RNA, 19 nt, Salmonella enterica enterica serovar Typhi
uccucgcaguuaugcgcau

SEQ ID NO: 3620089 - RNA, 19 nt, Salmonella enterica enterica serovar Typhi
uccucgucgcgcgccgccu

SEQ ID NO: 3620090 - RNA, 22 nt, Salmonella enterica enterica serovar Typhi
uccucguugacuucaaucacuu

SEQ ID NO: 3620091 - RNA, 19 nt, Salmonella enterica enterica serovar Typhi
uccucuuccgacaaaccuu

SEQ ID NO: 3620092 - RNA, 13 nt, Salmonella enterica enterica serovar Typhi
uccucuucucuga

SEQ ID NO: 3620093 - RNA, 15 nt, Salmonella enterica enterica serovar Typhi
uccucuuucccuuuu

SEQ ID NO: 3620094 - RNA, 18 nt, Salmonella enterica enterica serovar Typhi
uccucuuucccuuuuuaa

SEQ ID NO: 3620095 - RNA, 17 nt, Salmonella enterica enterica serovar Typhi
uccucuuuucgaacgcc

SEQ ID NO: 3620096 - RNA, 19 nt, Salmonella enterica enterica serovar Typhi
uccucuuuucgaacgccga

SEQ ID NO: 3620097 - RNA, 21 nt, Salmonella enterica enterica serovar Typhi
uccucuuuucgaacgccgaca

SEQ ID NO: 3620098 - RNA, 16 nt, Salmonella enterica enterica serovar Typhi
uccugaaaaaauuccc

SEQ ID NO: 3620099 - RNA, 21 nt, Salmonella enterica enterica serovar Typhi
uccugaaacccauaauaauga

SEQ ID NO: 3620100 - RNA, 14 nt, Salmonella enterica enterica serovar Typhi
uccugaaccagcgg

SEQ ID NO: 3620101 - RNA, 21 nt, Salmonella enterica enterica serovar Typhi
uccugaaccagcggcaccagc

SEQ ID NO: 3620102 - RNA, 22 nt, Salmonella enterica enterica serovar Typhi
uccugaagaugggucagugcau

SEQ ID NO: 3620103 - RNA, 19 nt, Salmonella enterica enterica serovar Typhi
uccugaaggacaagcugcg

SEQ ID NO: 3620104 - RNA, 12 nt, Salmonella enterica enterica serovar Typhi
uccugacgcuga

SEQ ID NO: 3620105 - RNA, 12 nt, Salmonella enterica enterica serovar Typhi
uccugauaaccu

SEQ ID NO: 3620106 - RNA, 13 nt, Salmonella enterica enterica serovar Typhi
uccugauccggcu

SEQ ID NO: 3620107 - RNA, 17 nt, Salmonella enterica enterica serovar Typhi
uccugaucuucaaccuc

SEQ ID NO: 3620108 - RNA, 17 nt, Salmonella enterica enterica serovar Typhi
uccugaugauggaaaac

SEQ ID NO: 3620109 - RNA, 20 nt, Salmonella enterica enterica serovar Typhi
uccugauuaaguuuuuuuaa

SEQ ID NO: 3620110 - RNA, 14 nt, Salmonella enterica enterica serovar Typhi
uccugauuuuacug

SEQ ID NO: 3620111 - RNA, 17 nt, Salmonella enterica enterica serovar Typhi
uccugcaacagcaccag

SEQ ID NO: 3620112 - RNA, 19 nt, Salmonella enterica enterica serovar Typhi
uccugcaacagcaccagca

SEQ ID NO: 3620113 - RNA, 13 nt, Salmonella enterica enterica serovar Typhi
uccugcagcgcca

SEQ ID NO: 3620114 - RNA, 20 nt, Salmonella enterica enterica serovar Typhi
uccugcaggcgagugcuacc

SEQ ID NO: 3620115 - RNA, 14 nt, Salmonella enterica enterica serovar Typhi
ucgaaugagaacga

SEQ ID NO: 3620116 - RNA, 21 nt, Salmonella enterica enterica serovar Typhi
ucgaaugaggacggcccgcug

SEQ ID NO: 3620117 - RNA, 15 nt, Salmonella enterica enterica serovar Typhi
ucgacaaagccgacg

SEQ ID NO: 3620118 - RNA, 23 nt, Salmonella enterica enterica serovar Typhi
ucgacaacgcguuuauuauaaac

SEQ ID NO: 3620119 - RNA, 22 nt, Salmonella enterica enterica serovar Typhi
ucgacaagcuaauccccagcgc

SEQ ID NO: 3620120 - RNA, 13 nt, Salmonella enterica enterica serovar Typhi
ucgacaauuucac

SEQ ID NO: 3620121 - RNA, 18 nt, Salmonella enterica enterica serovar Typhi
ucgacagauuggucagca

SEQ ID NO: 3620122 - RNA, 17 nt, Salmonella enterica enterica serovar Typhi
ucgacaguucccggcaa

SEQ ID NO: 3620123 - RNA, 22 nt, Salmonella enterica enterica serovar Typhi
ucgacaguucccggcaacagua

SEQ ID NO: 3620124 - RNA, 19 nt, Salmonella enterica enterica serovar Typhi
ucgacaucuuggcgcugcc

SEQ ID NO: 3620125 - RNA, 17 nt, Salmonella enterica enterica serovar Typhi
ucgacaugcagaucgcg

SEQ ID NO: 3620126 - RNA, 18 nt, Salmonella enterica enterica serovar Typhi
ucgacaugguuggccacc

SEQ ID NO: 3620127 - RNA, 14 nt, Salmonella enterica enterica serovar Typhi
ucgacauuacccau

SEQ ID NO: 3620128 - RNA, 17 nt, Salmonella enterica enterica serovar Typhi
ucgaccgucagcagcac

SEQ ID NO: 3620129 - RNA, 17 nt, Salmonella enterica enterica serovar Typhi
ucgaccuucaucucuuu

SEQ ID NO: 3620130 - RNA, 13 nt, Salmonella enterica enterica serovar Typhi
ucgacgaaauggu

SEQ ID NO: 3620131 - RNA, 19 nt, Salmonella enterica enterica serovar Typhi
ucgacgauaaaaaaaguau

SEQ ID NO: 3620132 - RNA, 20 nt, Salmonella enterica enterica serovar Typhi
ucgacgccgguuaguaguag

SEQ ID NO: 3620133 - RNA, 14 nt, Salmonella enterica enterica serovar Typhi
ucgacgcgcaucac

SEQ ID NO: 3620134 - RNA, 16 nt, Salmonella enterica enterica serovar Typhi
ucgacggccagcgcgc

SEQ ID NO: 3620135 - RNA, 20 nt, Salmonella enterica enterica serovar Typhi
ucgacgggacgaauuuccag

SEQ ID NO: 3620136 - RNA, 21 nt, Salmonella enterica enterica serovar Typhi
ucgacgggacgaauuuccagc

SEQ ID NO: 3620137 - RNA, 22 nt, Salmonella enterica enterica serovar Typhi
ucgacgucaacgguaaaauggc

SEQ ID NO: 3620138 - RNA, 23 nt, Salmonella enterica enterica serovar Typhi
ucgacguucagcauauccagcgc

SEQ ID NO: 3620139 - RNA, 17 nt, Salmonella enterica enterica serovar Typhi
ucgacguuuuccaucac

SEQ ID NO: 3620140 - RNA, 12 nt, Salmonella enterica enterica serovar Typhi
ucgacuuucauu

SEQ ID NO: 3620141 - RNA, 15 nt, Salmonella enterica enterica serovar Typhi
ucgagaagccaucaa

SEQ ID NO: 3620142 - RNA, 19 nt, Salmonella enterica enterica serovar Typhi
ucgagcaucuccagcgcau

SEQ ID NO: 3620143 - RNA, 15 nt, Salmonella enterica enterica serovar Typhi
ucgaggccauauuua

SEQ ID NO: 3620144 - RNA, 22 nt, Salmonella enterica enterica serovar Typhi
ucgagggugggcgcacaggccu

SEQ ID NO: 3620145 - RNA, 20 nt, Salmonella enterica enterica serovar Typhi
ucgaguucuucacgcugaug

SEQ ID NO: 3620146 - RNA, 20 nt, Salmonella enterica enterica serovar Typhi
ucgauaaccuguaaauaaua

SEQ ID NO: 3620147 - RNA, 18 nt, Salmonella enterica enterica serovar Typhi
ucgauaauugcucaccca

SEQ ID NO: 3620148 - RNA, 14 nt, Salmonella enterica enterica serovar Typhi
ucgauagcauuuuu

SEQ ID NO: 3620149 - RNA, 19 nt, Salmonella enterica enterica serovar Typhi
ucgauagcgccgcaucgau

SEQ ID NO: 3620150 - RNA, 19 nt, Salmonella enterica enterica serovar Typhi
ucgauagcguuuuccagcu

SEQ ID NO: 3620151 - RNA, 13 nt, Salmonella enterica enterica serovar Typhi
ucgauauaucgcg

SEQ ID NO: 3620152 - RNA, 15 nt, Salmonella enterica enterica serovar Typhi
ucgauaucugccugc

SEQ ID NO: 3620153 - RNA, 22 nt, Salmonella enterica enterica serovar Typhi
ucgauaucugccugcagaccca

SEQ ID NO: 3620154 - RNA, 11 nt, Salmonella enterica enterica serovar Typhi
ucgaucaccca

SEQ ID NO: 3620155 - RNA, 19 nt, Salmonella enterica enterica serovar Typhi
ucgaucacccacaucagcg

SEQ ID NO: 3620156 - RNA, 15 nt, Salmonella enterica enterica serovar Typhi
ucgaucagcuggcuu

SEQ ID NO: 3620157 - RNA, 17 nt, Salmonella enterica enterica serovar Typhi
ucgauccacuucccauu

SEQ ID NO: 3620158 - RNA, 15 nt, Salmonella enterica enterica serovar Typhi
ucgauccccaacgac

SEQ ID NO: 3620159 - RNA, 20 nt, Salmonella enterica enterica serovar Typhi
ucgauccgcaucagcaacgc

SEQ ID NO: 3620160 - RNA, 14 nt, Salmonella enterica enterica serovar Typhi
ucgaugaaaaagag

SEQ ID NO: 3620161 - RNA, 21 nt, Salmonella enterica enterica serovar Typhi
ucgaugagcucguuauaagcu

SEQ ID NO: 3620162 - RNA, 17 nt, Salmonella enterica enterica serovar Typhi
ucgaugauauccagcac

SEQ ID NO: 3620163 - RNA, 12 nt, Salmonella enterica enterica serovar Typhi
ucgaugauggcg

SEQ ID NO: 3620164 - RNA, 19 nt, Salmonella enterica enterica serovar Typhi
ucgaugccacagcgcauuc

SEQ ID NO: 3620165 - RNA, 18 nt, Salmonella enterica enterica serovar Typhi
ucgaugcccguugucaca

SEQ ID NO: 3620166 - RNA, 21 nt, Salmonella enterica enterica serovar Typhi
ucgaugcccguugucacaggc

SEQ ID NO: 3620167 - RNA, 23 nt, Salmonella enterica enterica serovar Typhi
ucgauuagaccguaaauccuaac

SEQ ID NO: 3620168 - RNA, 13 nt, Salmonella enterica enterica serovar Typhi
ucgauuuuuucga

SEQ ID NO: 3620169 - RNA, 20 nt, Salmonella enterica enterica serovar Typhi
ucgcaaacccacccgguaau

SEQ ID NO: 3620170 - RNA, 18 nt, Salmonella enterica enterica serovar Typhi
ucgcaaacggaauaaacg

SEQ ID NO: 3620171 - RNA, 12 nt, Salmonella enterica enterica serovar Typhi
ucgcaacgccgc

SEQ ID NO: 3620172 - RNA, 21 nt, Salmonella enterica enterica serovar Typhi
ucgcaacgccgccgacaugac

SEQ ID NO: 3620173 - RNA, 20 nt, Salmonella enterica enterica serovar Typhi
ucgcaacgccggugccugcc

SEQ ID NO: 3620174 - RNA, 20 nt, Salmonella enterica enterica serovar Typhi
ucgcaagacgaaaaaugaau

SEQ ID NO: 3620175 - RNA, 20 nt, Salmonella enterica enterica serovar Typhi
ucgcaaggcgcgauccgccc

SEQ ID NO: 3620176 - RNA, 18 nt, Salmonella enterica enterica serovar Typhi
ucgcaagguuagacggcg

SEQ ID NO: 3620177 - RNA, 21 nt, Salmonella enterica enterica serovar Typhi
ucgcaauauaaauaucauucg

SEQ ID NO: 3620178 - RNA, 15 nt, Salmonella enterica enterica serovar Typhi
ucgcaauauucaugc

SEQ ID NO: 3620179 - RNA, 15 nt, Salmonella enterica enterica serovar Typhi
ucgcaaucuccgccg

SEQ ID NO: 3620180 - RNA, 13 nt, Salmonella enterica enterica serovar Typhi
ucgcaaugccacc

SEQ ID NO: 3620181 - RNA, 14 nt, Salmonella enterica enterica serovar Typhi
ucgcaaugccacca

SEQ ID NO: 3620182 - RNA, 17 nt, Salmonella enterica enterica serovar Typhi
ucgcaccauagcagcca

SEQ ID NO: 3620183 - RNA, 18 nt, Salmonella enterica enterica serovar Typhi
ucgcacgccucuggcgua

SEQ ID NO: 3620184 - RNA, 15 nt, Salmonella enterica enterica serovar Typhi
ucgcagaccauccau

SEQ ID NO: 3620185 - RNA, 15 nt, Salmonella enterica enterica serovar Typhi
ucgcagaucgccugg

SEQ ID NO: 3620186 - RNA, 16 nt, Salmonella enterica enterica serovar Typhi
ucgcagccuuuggcaa

SEQ ID NO: 3620187 - RNA, 16 nt, Salmonella enterica enterica serovar Typhi
ucgcagcggcugcgcc

SEQ ID NO: 3620188 - RNA, 19 nt, Salmonella enterica enterica serovar Typhi
ucgcaggaugcgcugcgcg

SEQ ID NO: 3620189 - RNA, 21 nt, Salmonella enterica enterica serovar Typhi
ucgcaggccaaacagcggcuc

SEQ ID NO: 3620190 - RNA, 21 nt, Salmonella enterica enterica serovar Typhi
ucgcaguuaugcgcaucaccg

SEQ ID NO: 3620191 - RNA, 23 nt, Salmonella enterica enterica serovar Typhi
ucgcaguuaugcgcaucaccguu

SEQ ID NO: 3620192 - RNA, 17 nt, Salmonella enterica enterica serovar Typhi
ucgcauaaaauuauaaa

SEQ ID NO: 3620193 - RNA, 13 nt, Salmonella enterica enterica serovar Typhi
ucgcauaacuucg

SEQ ID NO: 3620194 - RNA, 13 nt, Salmonella enterica enterica serovar Typhi
ucgcauagacgcc

SEQ ID NO: 3620195 - RNA, 15 nt, Salmonella enterica enterica serovar Typhi
ucgcauccuccaucc

SEQ ID NO: 3620196 - RNA, 20 nt, Salmonella enterica enterica serovar Typhi
ucgcauguugacugcgcucc

SEQ ID NO: 3620197 - RNA, 21 nt, Salmonella enterica enterica serovar Typhi
ucgcauucauaucgccugcgg

SEQ ID NO: 3620198 - RNA, 18 nt, Salmonella enterica enterica serovar Typhi
ucgcauugguaucggcag

SEQ ID NO: 3620199 - RNA, 21 nt, Salmonella enterica enterica serovar Typhi
ucgcauuuuuaagcuggcgaa

SEQ ID NO: 3620200 - RNA, 16 nt, Salmonella enterica enterica serovar Typhi
ucgccuauuuucucuu

SEQ ID NO: 3620201 - RNA, 18 nt, Salmonella enterica enterica serovar Typhi
ucgccucccugccuaaag

SEQ ID NO: 3620202 - RNA, 14 nt, Salmonella enterica enterica serovar Typhi
ucgccucuacgggc

SEQ ID NO: 3620203 - RNA, 20 nt, Salmonella enterica enterica serovar Typhi
ucgccugaaugcacugcuga

SEQ ID NO: 3620204 - RNA, 14 nt, Salmonella enterica enterica serovar Typhi
ucgccugacaggag

SEQ ID NO: 3620205 - RNA, 16 nt, Salmonella enterica enterica serovar Typhi
ucgccugaugaccgcc

SEQ ID NO: 3620206 - RNA, 13 nt, Salmonella enterica enterica serovar Typhi
ucgccugcaacgc

SEQ ID NO: 3620207 - RNA, 23 nt, Salmonella enterica enterica serovar Typhi
ucgccugcgcucauauacccugc

SEQ ID NO: 3620208 - RNA, 18 nt, Salmonella enterica enterica serovar Typhi
ucgccugcgucgccccaa

SEQ ID NO: 3620209 - RNA, 22 nt, Salmonella enterica enterica serovar Typhi
ucgccuggauaauggcuaugcc

SEQ ID NO: 3620210 - RNA, 14 nt, Salmonella enterica enterica serovar Typhi
ucgccuguacgcgc

SEQ ID NO: 3620211 - RNA, 15 nt, Salmonella enterica enterica serovar Typhi
ucgccuguuucugcg

SEQ ID NO: 3620212 - RNA, 16 nt, Salmonella enterica enterica serovar Typhi
ucgccuuauccggccu

SEQ ID NO: 3620213 - RNA, 15 nt, Salmonella enterica enterica serovar Typhi
ucgccuuccagcgac

SEQ ID NO: 3620214 - RNA, 15 nt, Salmonella enterica enterica serovar Typhi
ucgcgaauaauuauu

SEQ ID NO: 3620215 - RNA, 13 nt, Salmonella enterica enterica serovar Typhi
ucgcgaauuucaa

SEQ ID NO: 3620216 - RNA, 21 nt, Salmonella enterica enterica serovar Typhi
ucgcgacggaccggcagcguc

SEQ ID NO: 3620217 - RNA, 16 nt, Salmonella enterica enterica serovar Typhi
ucgcgacugauaccca

SEQ ID NO: 3620218 - RNA, 18 nt, Salmonella enterica enterica serovar Typhi
ucgcgagcacuuuuuccu

SEQ ID NO: 3620219 - RNA, 22 nt, Salmonella enterica enterica serovar Typhi
ucgcgagcacuuuuuccuccug

SEQ ID NO: 3620220 - RNA, 19 nt, Salmonella enterica enterica serovar Typhi
ucgcgauacugccgcccau

SEQ ID NO: 3620221 - RNA, 14 nt, Salmonella enterica enterica serovar Typhi
ucgcgauccagccc

SEQ ID NO: 3620222 - RNA, 12 nt, Salmonella enterica enterica serovar Typhi
ucgcgaugaugu

SEQ ID NO: 3620223 - RNA, 15 nt, Salmonella enterica enterica serovar Typhi
ucgcgauuuuuuucc

SEQ ID NO: 3620224 - RNA, 15 nt, Salmonella enterica enterica serovar Typhi
ucgcgcaccauaaua

SEQ ID NO: 3620225 - RNA, 22 nt, Salmonella enterica enterica serovar Typhi
ucgcgcacgcgccgaaugcguu

SEQ ID NO: 3620226 - RNA, 22 nt, Salmonella enterica enterica serovar Typhi
ucgcgcagacaguggccaucuu

SEQ ID NO: 3620227 - RNA, 20 nt, Salmonella enterica enterica serovar Typhi
ucgcgcagauagagcgccug

SEQ ID NO: 3620228 - RNA, 13 nt, Salmonella enterica enterica serovar Typhi
ucgcgcaguucca

SEQ ID NO: 3620229 - RNA, 17 nt, Salmonella enterica enterica serovar Typhi
ucgcgcaguuccagcgg

SEQ ID NO: 3620230 - RNA, 20 nt, Salmonella enterica enterica serovar Typhi
ucgcgccaaaagaggcagca

SEQ ID NO: 3620231 - RNA, 13 nt, Salmonella enterica enterica serovar Typhi
ucgcgccagcgac

SEQ ID NO: 3620232 - RNA, 21 nt, Salmonella enterica enterica serovar Typhi
ucgcgccagcgacaucccaga

SEQ ID NO: 3620233 - RNA, 15 nt, Salmonella enterica enterica serovar Typhi
ucgcgccauuuagcg

SEQ ID NO: 3620234 - RNA, 12 nt, Salmonella enterica enterica serovar Typhi
ucgcgccgccaa

SEQ ID NO: 3620235 - RNA, 19 nt, Salmonella enterica enterica serovar Typhi
ucgcgccggucgccagcau

SEQ ID NO: 3620236 - RNA, 15 nt, Salmonella enterica enterica serovar Typhi
ucgcgccuccccugc

SEQ ID NO: 3620237 - RNA, 16 nt, Salmonella enterica enterica serovar Typhi
ucgcgccuccccugcc

SEQ ID NO: 3620238 - RNA, 20 nt, Salmonella enterica enterica serovar Typhi
ucgcgcggcgguucauccug

SEQ ID NO: 3620239 - RNA, 17 nt, Salmonella enterica enterica serovar Typhi
ucgcgcgggaaaucguc

SEQ ID NO: 3620240 - RNA, 14 nt, Salmonella enterica enterica serovar Typhi
ucgcgcuauaucag

SEQ ID NO: 3620241 - RNA, 20 nt, Salmonella enterica enterica serovar Typhi
ucgcgcugauauuuuuacug

SEQ ID NO: 3620242 - RNA, 13 nt, Salmonella enterica enterica serovar Typhi
ucgcgcugcgcag

SEQ ID NO: 3620243 - RNA, 19 nt, Salmonella enterica enterica serovar Typhi
ucgcgcuguauaaucccgc

SEQ ID NO: 3620244 - RNA, 21 nt, Salmonella enterica enterica serovar Typhi
ucgcgcuuacacagacugcuu

SEQ ID NO: 3620245 - RNA, 21 nt, Salmonella enterica enterica serovar Typhi
ucgcgcuuucaaucgucagac

SEQ ID NO: 3620246 - RNA, 17 nt, Salmonella enterica enterica serovar Typhi
ucgcggaauuucaggaa

SEQ ID NO: 3620247 - RNA, 18 nt, Salmonella enterica enterica serovar Typhi
ucgcggaauuucaggaag

SEQ ID NO: 3620248 - RNA, 19 nt, Salmonella enterica enterica serovar Typhi
ucgcggauaugcagcagcc

SEQ ID NO: 3620249 - RNA, 22 nt, Salmonella enterica enterica serovar Typhi
ucgcggcaaugaacagcacguu

SEQ ID NO: 3620250 - RNA, 18 nt, Salmonella enterica enterica serovar Typhi
ucgcggcauuaaaugcgc

SEQ ID NO: 3620251 - RNA, 20 nt, Salmonella enterica enterica serovar Typhi
ucgcggguaaacucacccag

SEQ ID NO: 3620252 - RNA, 14 nt, Salmonella enterica enterica serovar Typhi
ucgcgguaaaaagc

SEQ ID NO: 3620253 - RNA, 13 nt, Salmonella enterica enterica serovar Typhi
ucgcgguuagaaa

SEQ ID NO: 3620254 - RNA, 18 nt, Salmonella enterica enterica serovar Typhi
ucgcgguugccgucaaac

SEQ ID NO: 3620255 - RNA, 19 nt, Salmonella enterica enterica serovar Typhi
ucgcgguuuacuucuucag

SEQ ID NO: 3620256 - RNA, 19 nt, Salmonella enterica enterica serovar Typhi
ucgcgguuuuccgggucca

SEQ ID NO: 3620257 - RNA, 21 nt, Salmonella enterica enterica serovar Typhi
ucgcguacagcgccaugaaga

SEQ ID NO: 3620258 - RNA, 16 nt, Salmonella enterica enterica serovar Typhi
ucgcgucgccaucagg

SEQ ID NO: 3620259 - RNA, 19 nt, Salmonella enterica enterica serovar Typhi
ucgcgucgccaucaggcag

SEQ ID NO: 3620260 - RNA, 15 nt, Salmonella enterica enterica serovar Typhi
ucgcguuguaaucgc

SEQ ID NO: 3620261 - RNA, 15 nt, Salmonella enterica enterica serovar Typhi
ucgcuaacccaggcc

SEQ ID NO: 3620262 - RNA, 23 nt, Salmonella enterica enterica serovar Typhi
ucgcuaagagugacgguuuucac

SEQ ID NO: 3620263 - RNA, 22 nt, Salmonella enterica enterica serovar Typhi
ucgcuaagcgucagacacaaua

SEQ ID NO: 3620264 - RNA, 14 nt, Salmonella enterica enterica serovar Typhi
ucgcuaauaaauuc

SEQ ID NO: 3620265 - RNA, 14 nt, Salmonella enterica enterica serovar Typhi
ucgcuaauuuuuaa

SEQ ID NO: 3620266 - RNA, 20 nt, Salmonella enterica enterica serovar Typhi
ucgcuacaaccagcgcggcc

SEQ ID NO: 3620267 - RNA, 17 nt, Salmonella enterica enterica serovar Typhi
ucgcuaccuuuuuucag

SEQ ID NO: 3620268 - RNA, 15 nt, Salmonella enterica enterica serovar Typhi
ucgcuacugcaucug

SEQ ID NO: 3620269 - RNA, 13 nt, Salmonella enterica enterica serovar Typhi
ucgcuauccagca

SEQ ID NO: 3620270 - RNA, 22 nt, Salmonella enterica enterica serovar Typhi
ucgcuauccgcauauguuuagu

SEQ ID NO: 3620271 - RNA, 17 nt, Salmonella enterica enterica serovar Typhi
ucgcuaugaaaacgcag

SEQ ID NO: 3620272 - RNA, 16 nt, Salmonella enterica enterica serovar Typhi
ucgcucaacuccugca

SEQ ID NO: 3620273 - RNA, 18 nt, Salmonella enterica enterica serovar Typhi
ucgcucaggagcgccuga

SEQ ID NO: 3620274 - RNA, 16 nt, Salmonella enterica enterica serovar Typhi
ucgcucaucucaagcc

SEQ ID NO: 3620275 - RNA, 21 nt, Salmonella enterica enterica serovar Typhi
ucgcuccucagcgcuuaccac

SEQ ID NO: 3620276 - RNA, 11 nt, Salmonella enterica enterica serovar Typhi
ucgcuccuccc

SEQ ID NO: 3620277 - RNA, 21 nt, Salmonella enterica enterica serovar Typhi
ucgcucgacauagguucugcg

SEQ ID NO: 3620278 - RNA, 17 nt, Salmonella enterica enterica serovar Typhi
ucgcucuauauccugcc

SEQ ID NO: 3620279 - RNA, 15 nt, Salmonella enterica enterica serovar Typhi
ucgcucuaucgccug

SEQ ID NO: 3620280 - RNA, 22 nt, Salmonella enterica enterica serovar Typhi
ucgcucuaucgccuggagcuga

SEQ ID NO: 3620281 - RNA, 17 nt, Salmonella enterica enterica serovar Typhi
ucgcucucuuucaccag

SEQ ID NO: 3620282 - RNA, 19 nt, Salmonella enterica enterica serovar Typhi
ucgcucuuuuuuuugcuua

SEQ ID NO: 3620283 - RNA, 17 nt, Salmonella enterica enterica serovar Typhi
ucgcugaauaaugccuu

SEQ ID NO: 3620284 - RNA, 18 nt, Salmonella enterica enterica serovar Typhi
ucgcugaauuucucguga

SEQ ID NO: 3620285 - RNA, 17 nt, Salmonella enterica enterica serovar Typhi
ucgcugacauugcuacg

SEQ ID NO: 3620286 - RNA, 23 nt, Salmonella enterica enterica serovar Typhi
ucgggugagacgcagccucucuu

SEQ ID NO: 3620287 - RNA, 21 nt, Salmonella enterica enterica serovar Typhi
ucggguucacuuuaccaggca

SEQ ID NO: 3620288 - RNA, 17 nt, Salmonella enterica enterica serovar Typhi
ucggguucggcggugcc

SEQ ID NO: 3620289 - RNA, 12 nt, Salmonella enterica enterica serovar Typhi
ucgguaagcgca

SEQ ID NO: 3620290 - RNA, 15 nt, Salmonella enterica enterica serovar Typhi
ucgguacuccccuuu

SEQ ID NO: 3620291 - RNA, 23 nt, Salmonella enterica enterica serovar Typhi
ucgguacuucacaauaagaaauu

SEQ ID NO: 3620292 - RNA, 18 nt, Salmonella enterica enterica serovar Typhi
ucgguagaaugaauguag

SEQ ID NO: 3620293 - RNA, 22 nt, Salmonella enterica enterica serovar Typhi
ucgguagcuguaccagaucgcc

SEQ ID NO: 3620294 - RNA, 19 nt, Salmonella enterica enterica serovar Typhi
ucgguaguguuaucgccga

SEQ ID NO: 3620295 - RNA, 16 nt, Salmonella enterica enterica serovar Typhi
ucgguaugccuuccag

SEQ ID NO: 3620296 - RNA, 16 nt, Salmonella enterica enterica serovar Typhi
ucggucaacauuccgu

SEQ ID NO: 3620297 - RNA, 15 nt, Salmonella enterica enterica serovar Typhi
ucggucagauucaga

SEQ ID NO: 3620298 - RNA, 14 nt, Salmonella enterica enterica serovar Typhi
ucggucaggcugcg

SEQ ID NO: 3620299 - RNA, 19 nt, Salmonella enterica enterica serovar Typhi
ucggugacggaaaccagca

SEQ ID NO: 3620300 - RNA, 14 nt, Salmonella enterica enterica serovar Typhi
ucggugauccagca

SEQ ID NO: 3620301 - RNA, 13 nt, Salmonella enterica enterica serovar Typhi
ucggugcccggcu

SEQ ID NO: 3620302 - RNA, 14 nt, Salmonella enterica enterica serovar Typhi
ucggugcccggcug

SEQ ID NO: 3620303 - RNA, 17 nt, Salmonella enterica enterica serovar Typhi
ucgguggaaaccgcaga

SEQ ID NO: 3620304 - RNA, 22 nt, Salmonella enterica enterica serovar Typhi
ucggugguuuuaacccccagca

SEQ ID NO: 3620305 - RNA, 21 nt, Salmonella enterica enterica serovar Typhi
ucgguuauucggucagauaaa

SEQ ID NO: 3620306 - RNA, 23 nt, Salmonella enterica enterica serovar Typhi
ucgguugauguaugaacugcauc

SEQ ID NO: 3620307 - RNA, 12 nt, Salmonella enterica enterica serovar Typhi
ucgguuuauccc

SEQ ID NO: 3620308 - RNA, 16 nt, Salmonella enterica enterica serovar Typhi
ucgguuuauccccgcu

SEQ ID NO: 3620309 - RNA, 21 nt, Salmonella enterica enterica serovar Typhi
ucgguuuauccccgcuggcgc

SEQ ID NO: 3620310 - RNA, 16 nt, Salmonella enterica enterica serovar Typhi
ucgguuuguaagugcc

SEQ ID NO: 3620311 - RNA, 19 nt, Salmonella enterica enterica serovar Typhi
ucguaaagcgcauccagcu

SEQ ID NO: 3620312 - RNA, 17 nt, Salmonella enterica enterica serovar Typhi
ucguaaaucaaaugaga

SEQ ID NO: 3620313 - RNA, 18 nt, Salmonella enterica enterica serovar Typhi
ucguaaugagcacuuucc

SEQ ID NO: 3620314 - RNA, 12 nt, Salmonella enterica enterica serovar Typhi
ucguaauucagc

SEQ ID NO: 3620315 - RNA, 21 nt, Salmonella enterica enterica serovar Typhi
ucguacacgcgcccgccgcca

SEQ ID NO: 3620316 - RNA, 16 nt, Salmonella enterica enterica serovar Typhi
ucguacauguccagau

SEQ ID NO: 3620317 - RNA, 17 nt, Salmonella enterica enterica serovar Typhi
ucguacauguccagauc

SEQ ID NO: 3620318 - RNA, 18 nt, Salmonella enterica enterica serovar Typhi
ucguacuaaagagcgccu

SEQ ID NO: 3620319 - RNA, 18 nt, Salmonella enterica enterica serovar Typhi
ucguaguggaucagcaga

SEQ ID NO: 3620320 - RNA, 13 nt, Salmonella enterica enterica serovar Typhi
ucguauccccagu

SEQ ID NO: 3620321 - RNA, 21 nt, Salmonella enterica enterica serovar Typhi
ucguauccccagucuuccugc

SEQ ID NO: 3620322 - RNA, 15 nt, Salmonella enterica enterica serovar Typhi
ucguauuuauuuucu

SEQ ID NO: 3620323 - RNA, 21 nt, Salmonella enterica enterica serovar Typhi
ucgucaaaaccaaacagcgac

SEQ ID NO: 3620324 - RNA, 21 nt, Salmonella enterica enterica serovar Typhi
ucgucaaacucuuccgggcug

SEQ ID NO: 3620325 - RNA, 19 nt, Salmonella enterica enterica serovar Typhi
ucgucaccugauagcgggu

SEQ ID NO: 3620326 - RNA, 21 nt, Salmonella enterica enterica serovar Typhi
ucgucagaugcguuuucugca

SEQ ID NO: 3620327 - RNA, 15 nt, Salmonella enterica enterica serovar Typhi
ucgucaggcggcugc

SEQ ID NO: 3620328 - RNA, 18 nt, Salmonella enterica enterica serovar Typhi
ucgucaggcggcugcgca

SEQ ID NO: 3620329 - RNA, 12 nt, Salmonella enterica enterica serovar Typhi
ucgucccagcgc

SEQ ID NO: 3620330 - RNA, 12 nt, Salmonella enterica enterica serovar Typhi
ucgucccaggcc

SEQ ID NO: 3620331 - RNA, 23 nt, Salmonella enterica enterica serovar Typhi
ucgucccgcgaguacgcacaaca

SEQ ID NO: 3620332 - RNA, 11 nt, Salmonella enterica enterica serovar Typhi
ucguccggcug

SEQ ID NO: 3620333 - RNA, 18 nt, Salmonella enterica enterica serovar Typhi
ucgucgccaaucagcagc

SEQ ID NO: 3620334 - RNA, 16 nt, Salmonella enterica enterica serovar Typhi
ucgucgccuuccagcg

SEQ ID NO: 3620335 - RNA, 14 nt, Salmonella enterica enterica serovar Typhi
ucgucgcuaagcgu

SEQ ID NO: 3620336 - RNA, 15 nt, Salmonella enterica enterica serovar Typhi
ucgucgggauaagcg

SEQ ID NO: 3620337 - RNA, 16 nt, Salmonella enterica enterica serovar Typhi
ucgucgggauaagcga

SEQ ID NO: 3620338 - RNA, 21 nt, Salmonella enterica enterica serovar Typhi
ucgucuauuuccgcuucgcuu

SEQ ID NO: 3620339 - RNA, 16 nt, Salmonella enterica enterica serovar Typhi
ucgucugacgcuugca

SEQ ID NO: 3620340 - RNA, 21 nt, Salmonella enterica enterica serovar Typhi
ucgucuggaguacgggcagau

SEQ ID NO: 3620341 - RNA, 14 nt, Salmonella enterica enterica serovar Typhi
ucgucuuauuucgu

SEQ ID NO: 3620342 - RNA, 22 nt, Salmonella enterica enterica serovar Typhi
ucgugaaucaucaucauccgcg

SEQ ID NO: 3620343 - RNA, 23 nt, Salmonella enterica enterica serovar Typhi
ucgugaaucaucaucauccgcgc

SEQ ID NO: 3620344 - RNA, 12 nt, Salmonella enterica enterica serovar Typhi
ucgugacccgcc

SEQ ID NO: 3620345 - RNA, 13 nt, Salmonella enterica enterica serovar Typhi
ucgugaggaaaaa

SEQ ID NO: 3620346 - RNA, 12 nt, Salmonella enterica enterica serovar Typhi
ucgugauaaacg

SEQ ID NO: 3620347 - RNA, 18 nt, Salmonella enterica enterica serovar Typhi
ucgugcaaccgccugcac

SEQ ID NO: 3620348 - RNA, 15 nt, Salmonella enterica enterica serovar Typhi
ucgugcagcgccgcc

SEQ ID NO: 3620349 - RNA, 20 nt, Salmonella enterica enterica serovar Typhi
ucgugcaggauucgaaccug

SEQ ID NO: 3620350 - RNA, 23 nt, Salmonella enterica enterica serovar Typhi
ucgugcaucaggaaauccuggau

SEQ ID NO: 3620351 - RNA, 16 nt, Salmonella enterica enterica serovar Typhi
ucguggcgcuguucuu

SEQ ID NO: 3620352 - RNA, 18 nt, Salmonella enterica enterica serovar Typhi
ucgugguuagacaucacg

SEQ ID NO: 3620353 - RNA, 23 nt, Salmonella enterica enterica serovar Typhi
ucguuaaaaucggggucuuccag

SEQ ID NO: 3620354 - RNA, 22 nt, Salmonella enterica enterica serovar Typhi
ucguuaaucucaaacuuggcca

SEQ ID NO: 3620355 - RNA, 19 nt, Salmonella enterica enterica serovar Typhi
ucguuaaugcuguccugca

SEQ ID NO: 3620356 - RNA, 14 nt, Salmonella enterica enterica serovar Typhi
ucguuacccgugcg

SEQ ID NO: 3620357 - RNA, 16 nt, Salmonella enterica enterica serovar Typhi
ucguuacccuccugca

SEQ ID NO: 3620358 - RNA, 12 nt, Salmonella enterica enterica serovar Typhi
ucguuaccgggc

SEQ ID NO: 3620359 - RNA, 21 nt, Salmonella enterica enterica serovar Typhi
ucguuaccggugauauugccg

SEQ ID NO: 3620360 - RNA, 20 nt, Salmonella enterica enterica serovar Typhi
ucguuagcaaauugcugaug

SEQ ID NO: 3620361 - RNA, 13 nt, Salmonella enterica enterica serovar Typhi
ucguuagccagau

SEQ ID NO: 3620362 - RNA, 11 nt, Salmonella enterica enterica serovar Typhi
ucguuaucauu

SEQ ID NO: 3620363 - RNA, 17 nt, Salmonella enterica enterica serovar Typhi
ucguucccguuuauguu

SEQ ID NO: 3620364 - RNA, 22 nt, Salmonella enterica enterica serovar Typhi
ucguucgcccuucaucuuccag

SEQ ID NO: 3620365 - RNA, 17 nt, Salmonella enterica enterica serovar Typhi
ucguucugcgucgcgca

SEQ ID NO: 3620366 - RNA, 17 nt, Salmonella enterica enterica serovar Typhi
ucguugacuucaaucac

SEQ ID NO: 3620367 - RNA, 15 nt, Salmonella enterica enterica serovar Typhi
ucguugccagcggcc

SEQ ID NO: 3620368 - RNA, 14 nt, Salmonella enterica enterica serovar Typhi
ucguugccauuggu

SEQ ID NO: 3620369 - RNA, 12 nt, Salmonella enterica enterica serovar Typhi
ucguugcgccug

SEQ ID NO: 3620370 - RNA, 21 nt, Salmonella enterica enterica serovar Typhi
ucguuggcauggucagcauaa

SEQ ID NO: 3620371 - RNA, 21 nt, Salmonella enterica enterica serovar Typhi
ucguuggcgccaaaaccgcuc

SEQ ID NO: 3620372 - RNA, 19 nt, Salmonella enterica enterica serovar Typhi
ucuccgggaaaaacguguc

SEQ ID NO: 3620373 - RNA, 20 nt, Salmonella enterica enterica serovar Typhi
ucuccgucucucauuuucuu

SEQ ID NO: 3620374 - RNA, 15 nt, Salmonella enterica enterica serovar Typhi
ucuccguuguugcac

SEQ ID NO: 3620375 - RNA, 22 nt, Salmonella enterica enterica serovar Typhi
ucuccucacgcccugaagggcg

SEQ ID NO: 3620376 - RNA, 18 nt, Salmonella enterica enterica serovar Typhi
ucuccuccucauucagcg

SEQ ID NO: 3620377 - RNA, 20 nt, Salmonella enterica enterica serovar Typhi
ucuccugaagccagugcccg

SEQ ID NO: 3620378 - RNA, 19 nt, Salmonella enterica enterica serovar Typhi
ucuccuggcgcagcgcggg

SEQ ID NO: 3620379 - RNA, 15 nt, Salmonella enterica enterica serovar Typhi
ucuccuuucggccac

SEQ ID NO: 3620380 - RNA, 19 nt, Salmonella enterica enterica serovar Typhi
ucucgcaagauuccagaua

SEQ ID NO: 3620381 - RNA, 12 nt, Salmonella enterica enterica serovar Typhi
ucucgcaggcca

SEQ ID NO: 3620382 - RNA, 17 nt, Salmonella enterica enterica serovar Typhi
ucucgccaaaccacacc

SEQ ID NO: 3620383 - RNA, 22 nt, Salmonella enterica enterica serovar Typhi
ucucgccauaauuguucagcua

SEQ ID NO: 3620384 - RNA, 16 nt, Salmonella enterica enterica serovar Typhi
ucucgcgaccagagac

SEQ ID NO: 3620385 - RNA, 14 nt, Salmonella enterica enterica serovar Typhi
ucucgcucgcccgc

SEQ ID NO: 3620386 - RNA, 21 nt, Salmonella enterica enterica serovar Typhi
ucucggccuggcccggcaguu

SEQ ID NO: 3620387 - RNA, 14 nt, Salmonella enterica enterica serovar Typhi
ucucgucgccaggg

SEQ ID NO: 3620388 - RNA, 16 nt, Salmonella enterica enterica serovar Typhi
ucucuacacaacgcga

SEQ ID NO: 3620389 - RNA, 13 nt, Salmonella enterica enterica serovar Typhi
ucucuauuaaccg

SEQ ID NO: 3620390 - RNA, 17 nt, Salmonella enterica enterica serovar Typhi
ucucucccaggcauccu

SEQ ID NO: 3620391 - RNA, 18 nt, Salmonella enterica enterica serovar Typhi
ucucugguuucccugccu

SEQ ID NO: 3620392 - RNA, 15 nt, Salmonella enterica enterica serovar Typhi
ucucugucgccgccc

SEQ ID NO: 3620393 - RNA, 17 nt, Salmonella enterica enterica serovar Typhi
ucucuuaaugccagcgg

SEQ ID NO: 3620394 - RNA, 18 nt, Salmonella enterica enterica serovar Typhi
ucucuuaauguaaaacaa

SEQ ID NO: 3620395 - RNA, 19 nt, Salmonella enterica enterica serovar Typhi
ucucuuaugccgcuuuugc

SEQ ID NO: 3620396 - RNA, 14 nt, Salmonella enterica enterica serovar Typhi
ucucuucccagcgc

SEQ ID NO: 3620397 - RNA, 13 nt, Salmonella enterica enterica serovar Typhi
ucucuuccgccag

SEQ ID NO: 3620398 - RNA, 16 nt, Salmonella enterica enterica serovar Typhi
ucucuuccgccagcgc

SEQ ID NO: 3620399 - RNA, 21 nt, Salmonella enterica enterica serovar Typhi
ucucuucguguaacgcauaca

SEQ ID NO: 3620400 - RNA, 22 nt, Salmonella enterica enterica serovar Typhi
ucucuucguuauuuuccugaaa

SEQ ID NO: 3620401 - RNA, 13 nt, Salmonella enterica enterica serovar Typhi
ucucuucuaucug

SEQ ID NO: 3620402 - RNA, 21 nt, Salmonella enterica enterica serovar Typhi
ucucuugccagcgcauccacc

SEQ ID NO: 3620403 - RNA, 20 nt, Salmonella enterica enterica serovar Typhi
ucucuugugcuuccagcucc

SEQ ID NO: 3620404 - RNA, 14 nt, Salmonella enterica enterica serovar Typhi
ucucuuucaccagc

SEQ ID NO: 3620405 - RNA, 13 nt, Salmonella enterica enterica serovar Typhi
ucucuuucagaau

SEQ ID NO: 3620406 - RNA, 14 nt, Salmonella enterica enterica serovar Typhi
ucucuuuugcuuca

SEQ ID NO: 3620407 - RNA, 14 nt, Salmonella enterica enterica serovar Typhi
ucucuuuuuuaggc

SEQ ID NO: 3620408 - RNA, 23 nt, Salmonella enterica enterica serovar Typhi
ucugaaaaaccgucggcaauaca

SEQ ID NO: 3620409 - RNA, 14 nt, Salmonella enterica enterica serovar Typhi
ucugaaaagaguag

SEQ ID NO: 3620410 - RNA, 19 nt, Salmonella enterica enterica serovar Typhi
ucugaaaaggggauaacaa

SEQ ID NO: 3620411 - RNA, 23 nt, Salmonella enterica enterica serovar Typhi
ucugaaaguaagcuauuccugua

SEQ ID NO: 3620412 - RNA, 12 nt, Salmonella enterica enterica serovar Typhi
ucugaaaguuug

SEQ ID NO: 3620413 - RNA, 16 nt, Salmonella enterica enterica serovar Typhi
ucugaagcguaaaaau

SEQ ID NO: 3620414 - RNA, 15 nt, Salmonella enterica enterica serovar Typhi
ucugaaucagugcau

SEQ ID NO: 3620415 - RNA, 22 nt, Salmonella enterica enterica serovar Typhi
ucugaaucagugcaucuucacu

SEQ ID NO: 3620416 - RNA, 22 nt, Salmonella enterica enterica serovar Typhi
ucugaauuuccugcgcuuuuug

SEQ ID NO: 3620417 - RNA, 13 nt, Salmonella enterica enterica serovar Typhi
ucugacagccaaa

SEQ ID NO: 3620418 - RNA, 16 nt, Salmonella enterica enterica serovar Typhi
ucugacauauacaaac

SEQ ID NO: 3620419 - RNA, 11 nt, Salmonella enterica enterica serovar Typhi
ucugacaucag

SEQ ID NO: 3620420 - RNA, 16 nt, Salmonella enterica enterica serovar Typhi
ucugacauucagcgcu

SEQ ID NO: 3620421 - RNA, 11 nt, Salmonella enterica enterica serovar Typhi
ucugaccaguu

SEQ ID NO: 3620422 - RNA, 13 nt, Salmonella enterica enterica serovar Typhi
ucugacccgcgaa

SEQ ID NO: 3620423 - RNA, 13 nt, Salmonella enterica enterica serovar Typhi
ucugacggccugu

SEQ ID NO: 3620424 - RNA, 20 nt, Salmonella enterica enterica serovar Typhi
ucugacugaucgauccacuu

SEQ ID NO: 3620425 - RNA, 22 nt, Salmonella enterica enterica serovar Typhi
ucugagccaauuuaugccggag

SEQ ID NO: 3620426 - RNA, 24 nt, Salmonella enterica enterica serovar Typhi
ucugagccgcccggcgcgcuggag

SEQ ID NO: 3620427 - RNA, 15 nt, Salmonella enterica enterica serovar Typhi
ucugaggauuuuuac

SEQ ID NO: 3620428 - RNA, 24 nt, Salmonella enterica enterica serovar Typhi
ucugauaacgcaggcgauagcccc

SEQ ID NO: 3620429 - RNA, 12 nt, Salmonella enterica enterica serovar Typhi
ucugauccagcg

SEQ ID NO: 3620430 - RNA, 19 nt, Salmonella enterica enterica serovar Typhi
ucugaugccugaaggcgcu

SEQ ID NO: 3620431 - RNA, 15 nt, Salmonella enterica enterica serovar Typhi
ucugauggcgcugcg

SEQ ID NO: 3620432 - RNA, 16 nt, Salmonella enterica enterica serovar Typhi
ucugauggcuuugcug

SEQ ID NO: 3620433 - RNA, 16 nt, Salmonella enterica enterica serovar Typhi
ucugauucaauagugc

SEQ ID NO: 3620434 - RNA, 23 nt, Salmonella enterica enterica serovar Typhi
ucugauuucgacgauaaaaaaag

SEQ ID NO: 3620435 - RNA, 22 nt, Salmonella enterica enterica serovar Typhi
ucugcaaugguaaaacgcuggc

SEQ ID NO: 3620436 - RNA, 20 nt, Salmonella enterica enterica serovar Typhi
ucugcacaacauuccgcuuc

SEQ ID NO: 3620437 - RNA, 16 nt, Salmonella enterica enterica serovar Typhi
ucugcaccacgguguc

SEQ ID NO: 3620438 - RNA, 16 nt, Salmonella enterica enterica serovar Typhi
ucugcaccagaacucc

SEQ ID NO: 3620439 - RNA, 22 nt, Salmonella enterica enterica serovar Typhi
ucugcagcgagcgcauacgcug

SEQ ID NO: 3620440 - RNA, 21 nt, Salmonella enterica enterica serovar Typhi
ucugcaggcgggugcgcagcc

SEQ ID NO: 3620441 - RNA, 14 nt, Salmonella enterica enterica serovar Typhi
ucugcaggucacga

SEQ ID NO: 3620442 - RNA, 17 nt, Salmonella enterica enterica serovar Typhi
ucugcauguaguaagcc

SEQ ID NO: 3620443 - RNA, 16 nt, Salmonella enterica enterica serovar Typhi
ucugccagcaacggcg

SEQ ID NO: 3620444 - RNA, 18 nt, Salmonella enterica enterica serovar Typhi
ucugccagcuuaaaucgc

SEQ ID NO: 3620445 - RNA, 12 nt, Salmonella enterica enterica serovar Typhi
ucugccagguuc

SEQ ID NO: 3620446 - RNA, 19 nt, Salmonella enterica enterica serovar Typhi
ucugccaguuaucgguaau

SEQ ID NO: 3620447 - RNA, 23 nt, Salmonella enterica enterica serovar Typhi
ucugccgacaagguugaucagga

SEQ ID NO: 3620448 - RNA, 14 nt, Salmonella enterica enterica serovar Typhi
ucugccucaacaag

SEQ ID NO: 3620449 - RNA, 14 nt, Salmonella enterica enterica serovar Typhi
ucugccugcagacc

SEQ ID NO: 3620450 - RNA, 22 nt, Salmonella enterica enterica serovar Typhi
ucugccuuuacugaaucucaga

SEQ ID NO: 3620451 - RNA, 14 nt, Salmonella enterica enterica serovar Typhi
ucugccuuuuuuaa

SEQ ID NO: 3620452 - RNA, 20 nt, Salmonella enterica enterica serovar Typhi
ucugccuuuuuuaauccagg

SEQ ID NO: 3620453 - RNA, 19 nt, Salmonella enterica enterica serovar Typhi
ucugcgcaacgcuuccacc

SEQ ID NO: 3620454 - RNA, 17 nt, Salmonella enterica enterica serovar Typhi
ucugcgcauuaacgcca

SEQ ID NO: 3620455 - RNA, 13 nt, Salmonella enterica enterica serovar Typhi
ucugcgccaccag

SEQ ID NO: 3620456 - RNA, 19 nt, Salmonella enterica enterica serovar Typhi
ucugcgccaccagcgcagu

SEQ ID NO: 3620457 - RNA, 17 nt, Salmonella enterica enterica serovar Typhi
ucugcgccgcaucgcca

SEQ ID NO: 3620458 - RNA, 15 nt, Salmonella enterica enterica serovar Typhi
ucuuaguaucccuuu

SEQ ID NO: 3620459 - RNA, 21 nt, Salmonella enterica enterica serovar Typhi
ucuuauaaaggucaaacaccu

SEQ ID NO: 3620460 - RNA, 12 nt, Salmonella enterica enterica serovar Typhi
ucuuauccgacu

SEQ ID NO: 3620461 - RNA, 21 nt, Salmonella enterica enterica serovar Typhi
ucuuauccgcuuuuaaacggc

SEQ ID NO: 3620462 - RNA, 17 nt, Salmonella enterica enterica serovar Typhi
ucuuauccggccuaccu

SEQ ID NO: 3620463 - RNA, 14 nt, Salmonella enterica enterica serovar Typhi
ucuuauccggccug

SEQ ID NO: 3620464 - RNA, 15 nt, Salmonella enterica enterica serovar Typhi
ucuuauccggccugc

SEQ ID NO: 3620465 - RNA, 16 nt, Salmonella enterica enterica serovar Typhi
ucuuaucgugcgcgua

SEQ ID NO: 3620466 - RNA, 15 nt, Salmonella enterica enterica serovar Typhi
ucuuauuauuauugu

SEQ ID NO: 3620467 - RNA, 13 nt, Salmonella enterica enterica serovar Typhi
ucuucaaacggca

SEQ ID NO: 3620468 - RNA, 19 nt, Salmonella enterica enterica serovar Typhi
ucuucaagguuaugcgcac

SEQ ID NO: 3620469 - RNA, 14 nt, Salmonella enterica enterica serovar Typhi
ucuucaauaacgaa

SEQ ID NO: 3620470 - RNA, 17 nt, Salmonella enterica enterica serovar Typhi
ucuucaaugaacaauaa

SEQ ID NO: 3620471 - RNA, 22 nt, Salmonella enterica enterica serovar Typhi
ucuucaccuuuccagucaacga

SEQ ID NO: 3620472 - RNA, 14 nt, Salmonella enterica enterica serovar Typhi
ucuucacgacgcuc

SEQ ID NO: 3620473 - RNA, 23 nt, Salmonella enterica enterica serovar Typhi
ucuucacgccgugaauuucugcu

SEQ ID NO: 3620474 - RNA, 15 nt, Salmonella enterica enterica serovar Typhi
ucuucaggcguauau

SEQ ID NO: 3620475 - RNA, 20 nt, Salmonella enterica enterica serovar Typhi
ucuucaguuccgccagacuc

SEQ ID NO: 3620476 - RNA, 11 nt, Salmonella enterica enterica serovar Typhi
ucuucaucaaa

SEQ ID NO: 3620477 - RNA, 18 nt, Salmonella enterica enterica serovar Typhi
ucuucaucagccagcauc

SEQ ID NO: 3620478 - RNA, 15 nt, Salmonella enterica enterica serovar Typhi
ucuucaucguuucug

SEQ ID NO: 3620479 - RNA, 22 nt, Salmonella enterica enterica serovar Typhi
ucuucaugguaaaauccuuuuu

SEQ ID NO: 3620480 - RNA, 20 nt, Salmonella enterica enterica serovar Typhi
ucuuccaaccgugucugcug

SEQ ID NO: 3620481 - RNA, 18 nt, Salmonella enterica enterica serovar Typhi
ucuuccacgccgucgaug

SEQ ID NO: 3620482 - RNA, 17 nt, Salmonella enterica enterica serovar Typhi
ucuuccacuucagcagc

SEQ ID NO: 3620483 - RNA, 12 nt, Salmonella enterica enterica serovar Typhi
ucuuccagcauc

SEQ ID NO: 3620484 - RNA, 17 nt, Salmonella enterica enterica serovar Typhi
ucuuccagcgccaaaaa

SEQ ID NO: 3620485 - RNA, 17 nt, Salmonella enterica enterica serovar Typhi
ucuuccagcggcagacc

SEQ ID NO: 3620486 - RNA, 14 nt, Salmonella enterica enterica serovar Typhi
ucuuccagcugcuc

SEQ ID NO: 3620487 - RNA, 14 nt, Salmonella enterica enterica serovar Typhi
ucuuccaucagcca

SEQ ID NO: 3620488 - RNA, 15 nt, Salmonella enterica enterica serovar Typhi
ucuuccaucagccag

SEQ ID NO: 3620489 - RNA, 18 nt, Salmonella enterica enterica serovar Typhi
ucuuccaucagccaggcg

SEQ ID NO: 3620490 - RNA, 16 nt, Salmonella enterica enterica serovar Typhi
ucuuccaugccuucau

SEQ ID NO: 3620491 - RNA, 15 nt, Salmonella enterica enterica serovar Typhi
ucuuccauucccacc

SEQ ID NO: 3620492 - RNA, 21 nt, Salmonella enterica enterica serovar Typhi
ucuucccgaauagcccucggu

SEQ ID NO: 3620493 - RNA, 20 nt, Salmonella enterica enterica serovar Typhi
ucuuccgcaauaugcgucag

SEQ ID NO: 3620494 - RNA, 23 nt, Salmonella enterica enterica serovar Typhi
ucuuccgccauacccggcuccca

SEQ ID NO: 3620495 - RNA, 18 nt, Salmonella enterica enterica serovar Typhi
ucuuccgccugauaaaac

SEQ ID NO: 3620496 - RNA, 18 nt, Salmonella enterica enterica serovar Typhi
ucuuccggcauaaaaagc

SEQ ID NO: 3620497 - RNA, 20 nt, Salmonella enterica enterica serovar Typhi
ucuuccgggcgcgaucuguu

SEQ ID NO: 3620498 - RNA, 21 nt, Salmonella enterica enterica serovar Typhi
ucuuccggugugaccagcgcg

SEQ ID NO: 3620499 - RNA, 14 nt, Salmonella enterica enterica serovar Typhi
ucuuccgucaaaaa

SEQ ID NO: 3620500 - RNA, 18 nt, Salmonella enterica enterica serovar Typhi
ucuuccgucagcgaaucg

SEQ ID NO: 3620501 - RNA, 11 nt, Salmonella enterica enterica serovar Typhi
ucuuccucaca

SEQ ID NO: 3620502 - RNA, 15 nt, Salmonella enterica enterica serovar Typhi
ucuuccucacagccu

SEQ ID NO: 3620503 - RNA, 15 nt, Salmonella enterica enterica serovar Typhi
ucuuccucugugccg

SEQ ID NO: 3620504 - RNA, 14 nt, Salmonella enterica enterica serovar Typhi
ucuuccugcgguaa

SEQ ID NO: 3620505 - RNA, 20 nt, Salmonella enterica enterica serovar Typhi
ucuucgacauauuuacgugc

SEQ ID NO: 3620506 - RNA, 14 nt, Salmonella enterica enterica serovar Typhi
ucuucgauaaaggg

SEQ ID NO: 3620507 - RNA, 21 nt, Salmonella enterica enterica serovar Typhi
ucuucgauuguugacugccag

SEQ ID NO: 3620508 - RNA, 15 nt, Salmonella enterica enterica serovar Typhi
ucuucgcaaucuccg

SEQ ID NO: 3620509 - RNA, 17 nt, Salmonella enterica enterica serovar Typhi
ucuucgcaguagauucu

SEQ ID NO: 3620510 - RNA, 14 nt, Salmonella enterica enterica serovar Typhi
ucuucgccauuaca

SEQ ID NO: 3620511 - RNA, 18 nt, Salmonella enterica enterica serovar Typhi
ucuucgccgucauaaaac

SEQ ID NO: 3620512 - RNA, 22 nt, Salmonella enterica enterica serovar Typhi
ucuucgcuggcggaaagaagca

SEQ ID NO: 3620513 - RNA, 18 nt, Salmonella enterica enterica serovar Typhi
ucuucggcaaaauauuca

SEQ ID NO: 3620514 - RNA, 22 nt, Salmonella enterica enterica serovar Typhi
ucuucggcgggaucuccagaag

SEQ ID NO: 3620515 - RNA, 14 nt, Salmonella enterica enterica serovar Typhi
ucuucgucgucauc

SEQ ID NO: 3620516 - RNA, 20 nt, Salmonella enterica enterica serovar Typhi
ucuucgugacccgccagcau

SEQ ID NO: 3620517 - RNA, 15 nt, Salmonella enterica enterica serovar Typhi
ucuucguguaacgca

SEQ ID NO: 3620518 - RNA, 20 nt, Salmonella enterica enterica serovar Typhi
ucuucguguaacgcauacau

SEQ ID NO: 3620519 - RNA, 17 nt, Salmonella enterica enterica serovar Typhi
ucuucguuagcggcguu

SEQ ID NO: 3620520 - RNA, 15 nt, Salmonella enterica enterica serovar Typhi
ucuucuaaaucauac

SEQ ID NO: 3620521 - RNA, 13 nt, Salmonella enterica enterica serovar Typhi
ucuucuaccaccu

SEQ ID NO: 3620522 - RNA, 23 nt, Salmonella enterica enterica serovar Typhi
ucuucucaggcgagcccugugcg

SEQ ID NO: 3620523 - RNA, 21 nt, Salmonella enterica enterica serovar Typhi
ucuucugauggcuuugcuguc

SEQ ID NO: 3620524 - RNA, 15 nt, Salmonella enterica enterica serovar Typhi
ucuucugccagcaac

SEQ ID NO: 3620525 - RNA, 17 nt, Salmonella enterica enterica serovar Typhi
ucuucuggcguuuuaau

SEQ ID NO: 3620526 - RNA, 19 nt, Salmonella enterica enterica serovar Typhi
ucuucuguaauacgcugua

SEQ ID NO: 3620527 - RNA, 19 nt, Salmonella enterica enterica serovar Typhi
ucuucuuuagauaauuucg

SEQ ID NO: 3620528 - RNA, 23 nt, Salmonella enterica enterica serovar Typhi
ucuucuuugacccacgccagcag

SEQ ID NO: 3620529 - RNA, 23 nt, Salmonella enterica enterica serovar Typhi
ucuugcaacccauauucgucuuc

SEQ ID NO: 3620530 - RNA, 12 nt, Salmonella enterica enterica serovar Typhi
ucuugcacaaua

SEQ ID NO: 3620531 - RNA, 19 nt, Salmonella enterica enterica serovar Typhi
ucuugcacaauacuuuuug

SEQ ID NO: 3620532 - RNA, 13 nt, Salmonella enterica enterica serovar Typhi
ucuugccacuggc

SEQ ID NO: 3620533 - RNA, 14 nt, Salmonella enterica enterica serovar Typhi
ucuugccgccaucu

SEQ ID NO: 3620534 - RNA, 19 nt, Salmonella enterica enterica serovar Typhi
ucuugcgcagcauaucgcc

SEQ ID NO: 3620535 - RNA, 13 nt, Salmonella enterica enterica serovar Typhi
ucuugcguuaugu

SEQ ID NO: 3620536 - RNA, 15 nt, Salmonella enterica enterica serovar Typhi
ucuugcucucaggca

SEQ ID NO: 3620537 - RNA, 15 nt, Salmonella enterica enterica serovar Typhi
ucuugcuuuauuuuu

SEQ ID NO: 3620538 - RNA, 19 nt, Salmonella enterica enterica serovar Typhi
ucuuggagagcaucaucug

SEQ ID NO: 3620539 - RNA, 18 nt, Salmonella enterica enterica serovar Typhi
ucuugguaccaaacagca

SEQ ID NO: 3620540 - RNA, 21 nt, Salmonella enterica enterica serovar Typhi
ucuugucaggcagaaauaacu

SEQ ID NO: 3620541 - RNA, 21 nt, Salmonella enterica enterica serovar Typhi
ucuugugcuuccagcuccauc

SEQ ID NO: 3620542 - RNA, 13 nt, Salmonella enterica enterica serovar Typhi
ucuuguggaacac

SEQ ID NO: 3620543 - RNA, 19 nt, Salmonella enterica enterica serovar Typhi
ucuuguuucaucgucagcu

SEQ ID NO: 3620544 - RNA, 18 nt, Salmonella enterica enterica serovar Typhi
ugaaaugacacccucuuu

SEQ ID NO: 3620545 - RNA, 15 nt, Salmonella enterica enterica serovar Typhi
ugaaauuaaucaggc

SEQ ID NO: 3620546 - RNA, 18 nt, Salmonella enterica enterica serovar Typhi
ugaaauuaaucaggcauc

SEQ ID NO: 3620547 - RNA, 19 nt, Salmonella enterica enterica serovar Typhi
ugaaauuacgccauaaaaa

SEQ ID NO: 3620548 - RNA, 16 nt, Salmonella enterica enterica serovar Typhi
ugaaauucgacgggac

SEQ ID NO: 3620549 - RNA, 18 nt, Salmonella enterica enterica serovar Typhi
ugaaauucuaugccaggc

SEQ ID NO: 3620550 - RNA, 21 nt, Salmonella enterica enterica serovar Typhi
ugaacaaaggcagccaacaaa

SEQ ID NO: 3620551 - RNA, 21 nt, Salmonella enterica enterica serovar Typhi
ugaacaccacugaaaaauaau

SEQ ID NO: 3620552 - RNA, 12 nt, Salmonella enterica enterica serovar Typhi
ugaacaccagca

SEQ ID NO: 3620553 - RNA, 14 nt, Salmonella enterica enterica serovar Typhi
ugaacacccugccc

SEQ ID NO: 3620554 - RNA, 18 nt, Salmonella enterica enterica serovar Typhi
ugaacagccagaagccug

SEQ ID NO: 3620555 - RNA, 22 nt, Salmonella enterica enterica serovar Typhi
ugaacagcgucauccaguguua

SEQ ID NO: 3620556 - RNA, 11 nt, Salmonella enterica enterica serovar Typhi
ugaacaggcag

SEQ ID NO: 3620557 - RNA, 12 nt, Salmonella enterica enterica serovar Typhi
ugaacaggcagc

SEQ ID NO: 3620558 - RNA, 20 nt, Salmonella enterica enterica serovar Typhi
ugaacaggcugugcaacauc

SEQ ID NO: 3620559 - RNA, 18 nt, Salmonella enterica enterica serovar Typhi
ugaacagucccaccagcg

SEQ ID NO: 3620560 - RNA, 15 nt, Salmonella enterica enterica serovar Typhi
ugaacauaaagucag

SEQ ID NO: 3620561 - RNA, 14 nt, Salmonella enterica enterica serovar Typhi
ugaacaucuuccag

SEQ ID NO: 3620562 - RNA, 21 nt, Salmonella enterica enterica serovar Typhi
ugaacaugacgccgaaauaaa

SEQ ID NO: 3620563 - RNA, 22 nt, Salmonella enterica enterica serovar Typhi
ugaacaugacgccgaaauaaau

SEQ ID NO: 3620564 - RNA, 21 nt, Salmonella enterica enterica serovar Typhi
ugaacauggguuucuugccgg

SEQ ID NO: 3620565 - RNA, 13 nt, Salmonella enterica enterica serovar Typhi
ugaacauuuuuuc

SEQ ID NO: 3620566 - RNA, 15 nt, Salmonella enterica enterica serovar Typhi
ugaacauuuuuucag

SEQ ID NO: 3620567 - RNA, 19 nt, Salmonella enterica enterica serovar Typhi
ugaaccagcaucccacgaa

SEQ ID NO: 3620568 - RNA, 20 nt, Salmonella enterica enterica serovar Typhi
ugaaccagcaucccacgaau

SEQ ID NO: 3620569 - RNA, 16 nt, Salmonella enterica enterica serovar Typhi
ugaaccauaucaaaca

SEQ ID NO: 3620570 - RNA, 20 nt, Salmonella enterica enterica serovar Typhi
ugaaccgguaaagcagugca

SEQ ID NO: 3620571 - RNA, 20 nt, Salmonella enterica enterica serovar Typhi
ugaaccgucgccuccagcga

SEQ ID NO: 3620572 - RNA, 20 nt, Salmonella enterica enterica serovar Typhi
ugaacgagucuuaccagguc

SEQ ID NO: 3620573 - RNA, 14 nt, Salmonella enterica enterica serovar Typhi
ugaacgccaaauac

SEQ ID NO: 3620574 - RNA, 19 nt, Salmonella enterica enterica serovar Typhi
ugaacgcugcuguuaaccu

SEQ ID NO: 3620575 - RNA, 18 nt, Salmonella enterica enterica serovar Typhi
ugaacggcucaaaauaau

SEQ ID NO: 3620576 - RNA, 14 nt, Salmonella enterica enterica serovar Typhi
ugaacguaguuagu

SEQ ID NO: 3620577 - RNA, 18 nt, Salmonella enterica enterica serovar Typhi
ugaacguuuucugagcgg

SEQ ID NO: 3620578 - RNA, 22 nt, Salmonella enterica enterica serovar Typhi
ugaacuacggcccuggcucaau

SEQ ID NO: 3620579 - RNA, 21 nt, Salmonella enterica enterica serovar Typhi
ugaacucgccucgcugcuguu

SEQ ID NO: 3620580 - RNA, 14 nt, Salmonella enterica enterica serovar Typhi
ugaacucuuucaga

SEQ ID NO: 3620581 - RNA, 18 nt, Salmonella enterica enterica serovar Typhi
ugaacuuccguaaaaaga

SEQ ID NO: 3620582 - RNA, 19 nt, Salmonella enterica enterica serovar Typhi
ugaagaaaauacugauuaa

SEQ ID NO: 3620583 - RNA, 19 nt, Salmonella enterica enterica serovar Typhi
ugaagacgacgggaaaaag

SEQ ID NO: 3620584 - RNA, 17 nt, Salmonella enterica enterica serovar Typhi
ugaagaguuugaucaug

SEQ ID NO: 3620585 - RNA, 17 nt, Salmonella enterica enterica serovar Typhi
ugaagauuuuuauuccc

SEQ ID NO: 3620586 - RNA, 20 nt, Salmonella enterica enterica serovar Typhi
ugaagauuuuuauucccgcc

SEQ ID NO: 3620587 - RNA, 13 nt, Salmonella enterica enterica serovar Typhi
ugaagcagaagug

SEQ ID NO: 3620588 - RNA, 20 nt, Salmonella enterica enterica serovar Typhi
ugaagccauccucacgcaac

SEQ ID NO: 3620589 - RNA, 11 nt, Salmonella enterica enterica serovar Typhi
ugaagccccaa

SEQ ID NO: 3620590 - RNA, 22 nt, Salmonella enterica enterica serovar Typhi
ugaagccuggucaccugucuuu

SEQ ID NO: 3620591 - RNA, 17 nt, Salmonella enterica enterica serovar Typhi
ugaagccuggugcccaa

SEQ ID NO: 3620592 - RNA, 15 nt, Salmonella enterica enterica serovar Typhi
ugaagcgcaguguua

SEQ ID NO: 3620593 - RNA, 13 nt, Salmonella enterica enterica serovar Typhi
ugaagcugcaggg

SEQ ID NO: 3620594 - RNA, 14 nt, Salmonella enterica enterica serovar Typhi
ugaagcugccguag

SEQ ID NO: 3620595 - RNA, 18 nt, Salmonella enterica enterica serovar Typhi
ugaagcugccgucccagc

SEQ ID NO: 3620596 - RNA, 13 nt, Salmonella enterica enterica serovar Typhi
ugaagcuguuuug

SEQ ID NO: 3620597 - RNA, 23 nt, Salmonella enterica enterica serovar Typhi
ugaaggagcaaugagauccacug

SEQ ID NO: 3620598 - RNA, 16 nt, Salmonella enterica enterica serovar Typhi
ugaaggcgccgcgcag

SEQ ID NO: 3620599 - RNA, 18 nt, Salmonella enterica enterica serovar Typhi
ugaaggcgcuccccugcu

SEQ ID NO: 3620600 - RNA, 17 nt, Salmonella enterica enterica serovar Typhi
ugaaggcguaugaauga

SEQ ID NO: 3620601 - RNA, 22 nt, Salmonella enterica enterica serovar Typhi
ugaagggcauauuaugcugcuc

SEQ ID NO: 3620602 - RNA, 19 nt, Salmonella enterica enterica serovar Typhi
ugaaguaauucuucgaaug

SEQ ID NO: 3620603 - RNA, 14 nt, Salmonella enterica enterica serovar Typhi
ugaaguguuccuga

SEQ ID NO: 3620604 - RNA, 15 nt, Salmonella enterica enterica serovar Typhi
ugaaguuauccagcg

SEQ ID NO: 3620605 - RNA, 15 nt, Salmonella enterica enterica serovar Typhi
ugaauaaaaccggca

SEQ ID NO: 3620606 - RNA, 11 nt, Salmonella enterica enterica serovar Typhi
ugaauaaaaua

SEQ ID NO: 3620607 - RNA, 14 nt, Salmonella enterica enterica serovar Typhi
ugaauaaaggguuu

SEQ ID NO: 3620608 - RNA, 16 nt, Salmonella enterica enterica serovar Typhi
ugaauaaccauacuga

SEQ ID NO: 3620609 - RNA, 15 nt, Salmonella enterica enterica serovar Typhi
ugaauaauaauacac

SEQ ID NO: 3620610 - RNA, 14 nt, Salmonella enterica enterica serovar Typhi
ugaauaaugaccag

SEQ ID NO: 3620611 - RNA, 17 nt, Salmonella enterica enterica serovar Typhi
ugaauaaugguaaauuu

SEQ ID NO: 3620612 - RNA, 12 nt, Salmonella enterica enterica serovar Typhi
ugaauacacaaa

SEQ ID NO: 3620613 - RNA, 15 nt, Salmonella enterica enterica serovar Typhi
ugaauaccaaagccc

SEQ ID NO: 3620614 - RNA, 16 nt, Salmonella enterica enterica serovar Typhi
ugaauaccaaagcccg

SEQ ID NO: 3620615 - RNA, 17 nt, Salmonella enterica enterica serovar Typhi
ugaauaccacaaauuuu

SEQ ID NO: 3620616 - RNA, 19 nt, Salmonella enterica enterica serovar Typhi
ugaauaccagcggcaaaca

SEQ ID NO: 3620617 - RNA, 15 nt, Salmonella enterica enterica serovar Typhi
ugaauagccagcccc

SEQ ID NO: 3620618 - RNA, 15 nt, Salmonella enterica enterica serovar Typhi
ugaaucaagcuuugc

SEQ ID NO: 3620619 - RNA, 16 nt, Salmonella enterica enterica serovar Typhi
ugaaucaagcuuugcg

SEQ ID NO: 3620620 - RNA, 24 nt, Salmonella enterica enterica serovar Typhi
ugaaucaucagaaucguccagauu

SEQ ID NO: 3620621 - RNA, 20 nt, Salmonella enterica enterica serovar Typhi
ugaaucaucaucauccgcgc

SEQ ID NO: 3620622 - RNA, 22 nt, Salmonella enterica enterica serovar Typhi
ugaaucaucgguaaaugcuuau

SEQ ID NO: 3620623 - RNA, 22 nt, Salmonella enterica enterica serovar Typhi
ugaauccauacgguuguugauu

SEQ ID NO: 3620624 - RNA, 21 nt, Salmonella enterica enterica serovar Typhi
ugaauccccagaauuucuuug

SEQ ID NO: 3620625 - RNA, 17 nt, Salmonella enterica enterica serovar Typhi
ugaaucccccugccaca

SEQ ID NO: 3620626 - RNA, 15 nt, Salmonella enterica enterica serovar Typhi
ugaaucccgccaucg

SEQ ID NO: 3620627 - RNA, 21 nt, Salmonella enterica enterica serovar Typhi
ugaaucccgccaucguccagc

SEQ ID NO: 3620628 - RNA, 15 nt, Salmonella enterica enterica serovar Typhi
ugaaucccuguucaa

SEQ ID NO: 3620629 - RNA, 21 nt, Salmonella enterica enterica serovar Typhi
ugaaucgccgucagugagccc

SEQ ID NO: 3620630 - RNA, 17 nt, Salmonella enterica enterica serovar Typhi
ugaccuuaauccagcag

SEQ ID NO: 3620631 - RNA, 20 nt, Salmonella enterica enterica serovar Typhi
ugacgaaaaccguccacauc

SEQ ID NO: 3620632 - RNA, 20 nt, Salmonella enterica enterica serovar Typhi
ugacgaauaccgugcacgcu

SEQ ID NO: 3620633 - RNA, 18 nt, Salmonella enterica enterica serovar Typhi
ugacgaauaccugaaaga

SEQ ID NO: 3620634 - RNA, 16 nt, Salmonella enterica enterica serovar Typhi
ugacgaauagcgcgcu

SEQ ID NO: 3620635 - RNA, 14 nt, Salmonella enterica enterica serovar Typhi
ugacgaccacagcc

SEQ ID NO: 3620636 - RNA, 23 nt, Salmonella enterica enterica serovar Typhi
ugacgagcagguuacucuuccac

SEQ ID NO: 3620637 - RNA, 16 nt, Salmonella enterica enterica serovar Typhi
ugacgagggaagggga

SEQ ID NO: 3620638 - RNA, 16 nt, Salmonella enterica enterica serovar Typhi
ugacgagucggaucau

SEQ ID NO: 3620639 - RNA, 14 nt, Salmonella enterica enterica serovar Typhi
ugacgaucaugccg

SEQ ID NO: 3620640 - RNA, 21 nt, Salmonella enterica enterica serovar Typhi
ugacgaucaugccgcccaggc

SEQ ID NO: 3620641 - RNA, 18 nt, Salmonella enterica enterica serovar Typhi
ugacgauguucgucccug

SEQ ID NO: 3620642 - RNA, 18 nt, Salmonella enterica enterica serovar Typhi
ugacgcaaacugccaggc

SEQ ID NO: 3620643 - RNA, 16 nt, Salmonella enterica enterica serovar Typhi
ugacgcacaggcgcgg

SEQ ID NO: 3620644 - RNA, 14 nt, Salmonella enterica enterica serovar Typhi
ugacgcacaguguu

SEQ ID NO: 3620645 - RNA, 13 nt, Salmonella enterica enterica serovar Typhi
ugacgcagcaguu

SEQ ID NO: 3620646 - RNA, 16 nt, Salmonella enterica enterica serovar Typhi
ugacgcagcaucucaa

SEQ ID NO: 3620647 - RNA, 19 nt, Salmonella enterica enterica serovar Typhi
ugacgcaugauauaaaaug

SEQ ID NO: 3620648 - RNA, 12 nt, Salmonella enterica enterica serovar Typhi
ugacgccaggca

SEQ ID NO: 3620649 - RNA, 14 nt, Salmonella enterica enterica serovar Typhi
ugacgccaggcaga

SEQ ID NO: 3620650 - RNA, 16 nt, Salmonella enterica enterica serovar Typhi
ugacgccaugcaaaaa

SEQ ID NO: 3620651 - RNA, 20 nt, Salmonella enterica enterica serovar Typhi
ugacgccgaccaccgcccug

SEQ ID NO: 3620652 - RNA, 19 nt, Salmonella enterica enterica serovar Typhi
ugacgccgcuguuuucacu

SEQ ID NO: 3620653 - RNA, 20 nt, Salmonella enterica enterica serovar Typhi
ugacgcgauauuacuccagc

SEQ ID NO: 3620654 - RNA, 18 nt, Salmonella enterica enterica serovar Typhi
ugacgcgcauacucauua

SEQ ID NO: 3620655 - RNA, 22 nt, Salmonella enterica enterica serovar Typhi
ugacgcgccagcggauugccau

SEQ ID NO: 3620656 - RNA, 20 nt, Salmonella enterica enterica serovar Typhi
ugacgcgucauaaugcccag

SEQ ID NO: 3620657 - RNA, 22 nt, Salmonella enterica enterica serovar Typhi
ugacgcguuaauauccuucagc

SEQ ID NO: 3620658 - RNA, 19 nt, Salmonella enterica enterica serovar Typhi
ugacgcuaacgcuuauccg

SEQ ID NO: 3620659 - RNA, 16 nt, Salmonella enterica enterica serovar Typhi
ugacgcugaugaaaac

SEQ ID NO: 3620660 - RNA, 18 nt, Salmonella enterica enterica serovar Typhi
ugacgcuggaaguaugcc

SEQ ID NO: 3620661 - RNA, 19 nt, Salmonella enterica enterica serovar Typhi
ugacgcuugcaugaccauc

SEQ ID NO: 3620662 - RNA, 14 nt, Salmonella enterica enterica serovar Typhi
ugacgcuuugcauu

SEQ ID NO: 3620663 - RNA, 19 nt, Salmonella enterica enterica serovar Typhi
ugacggauucuuccucucg

SEQ ID NO: 3620664 - RNA, 21 nt, Salmonella enterica enterica serovar Typhi
ugacggcaaagcccacgcccu

SEQ ID NO: 3620665 - RNA, 23 nt, Salmonella enterica enterica serovar Typhi
ugacggcaacugaaaacaggccu

SEQ ID NO: 3620666 - RNA, 19 nt, Salmonella enterica enterica serovar Typhi
ugacggccugucuccucag

SEQ ID NO: 3620667 - RNA, 16 nt, Salmonella enterica enterica serovar Typhi
ugacggcgcugucacu

SEQ ID NO: 3620668 - RNA, 22 nt, Salmonella enterica enterica serovar Typhi
ugacgggaaaucucccuggcag

SEQ ID NO: 3620669 - RNA, 17 nt, Salmonella enterica enterica serovar Typhi
ugacgggcgaucgacua

SEQ ID NO: 3620670 - RNA, 19 nt, Salmonella enterica enterica serovar Typhi
ugacggggggaauguuugg

SEQ ID NO: 3620671 - RNA, 20 nt, Salmonella enterica enterica serovar Typhi
ugacggggggaauguuuggc

SEQ ID NO: 3620672 - RNA, 16 nt, Salmonella enterica enterica serovar Typhi
ugacggugauguuggc

SEQ ID NO: 3620673 - RNA, 15 nt, Salmonella enterica enterica serovar Typhi
ugacgguuuauaugc

SEQ ID NO: 3620674 - RNA, 13 nt, Salmonella enterica enterica serovar Typhi
ugacguacaaaca

SEQ ID NO: 3620675 - RNA, 22 nt, Salmonella enterica enterica serovar Typhi
ugacguacaaacaguuuuuccu

SEQ ID NO: 3620676 - RNA, 16 nt, Salmonella enterica enterica serovar Typhi
ugacguagauucugau

SEQ ID NO: 3620677 - RNA, 18 nt, Salmonella enterica enterica serovar Typhi
ugacguagauucugauug

SEQ ID NO: 3620678 - RNA, 21 nt, Salmonella enterica enterica serovar Typhi
ugacgucgcaagacgaaaaau

SEQ ID NO: 3620679 - RNA, 20 nt, Salmonella enterica enterica serovar Typhi
ugacgucgcagccugauggc

SEQ ID NO: 3620680 - RNA, 14 nt, Salmonella enterica enterica serovar Typhi
ugacgugagagaaa

SEQ ID NO: 3620681 - RNA, 18 nt, Salmonella enterica enterica serovar Typhi
ugacguugguuucggcgu

SEQ ID NO: 3620682 - RNA, 15 nt, Salmonella enterica enterica serovar Typhi
ugacuaaaagacgcc

SEQ ID NO: 3620683 - RNA, 15 nt, Salmonella enterica enterica serovar Typhi
ugacuacgucagaug

SEQ ID NO: 3620684 - RNA, 16 nt, Salmonella enterica enterica serovar Typhi
ugacucuguggccgcg

SEQ ID NO: 3620685 - RNA, 16 nt, Salmonella enterica enterica serovar Typhi
ugacugaauuaucagg

SEQ ID NO: 3620686 - RNA, 16 nt, Salmonella enterica enterica serovar Typhi
ugacugccagguaauc

SEQ ID NO: 3620687 - RNA, 21 nt, Salmonella enterica enterica serovar Typhi
ugacugccguauaauccagcu

SEQ ID NO: 3620688 - RNA, 20 nt, Salmonella enterica enterica serovar Typhi
ugacuucugcucgguaaaaa

SEQ ID NO: 3620689 - RNA, 22 nt, Salmonella enterica enterica serovar Typhi
ugacuucugcucgguaaaaagu

SEQ ID NO: 3620690 - RNA, 21 nt, Salmonella enterica enterica serovar Typhi
ugacuuuaccgguuucaaucc

SEQ ID NO: 3620691 - RNA, 17 nt, Salmonella enterica enterica serovar Typhi
ugacuuuccugguaauc

SEQ ID NO: 3620692 - RNA, 16 nt, Salmonella enterica enterica serovar Typhi
ugacuuugcucuccuu

SEQ ID NO: 3620693 - RNA, 21 nt, Salmonella enterica enterica serovar Typhi
ugacuuuuuucaaccucacug

SEQ ID NO: 3620694 - RNA, 13 nt, Salmonella enterica enterica serovar Typhi
ugagaaaaauacg

SEQ ID NO: 3620695 - RNA, 14 nt, Salmonella enterica enterica serovar Typhi
ugagaaaaauuuaa

SEQ ID NO: 3620696 - RNA, 14 nt, Salmonella enterica enterica serovar Typhi
ugagaaaagcagag

SEQ ID NO: 3620697 - RNA, 18 nt, Salmonella enterica enterica serovar Typhi
ugagaaaagcgaaaauaa

SEQ ID NO: 3620698 - RNA, 20 nt, Salmonella enterica enterica serovar Typhi
ugagaaaaggaagaauaaau

SEQ ID NO: 3620699 - RNA, 23 nt, Salmonella enterica enterica serovar Typhi
ugagaaaaggaagaauaaauaac

SEQ ID NO: 3620700 - RNA, 18 nt, Salmonella enterica enterica serovar Typhi
ugagaaauuauuuuaaau

SEQ ID NO: 3620701 - RNA, 12 nt, Salmonella enterica enterica serovar Typhi
ugagaagaaaaa

SEQ ID NO: 3620702 - RNA, 14 nt, Salmonella enterica enterica serovar Typhi
ugagaauggcggga

SEQ ID NO: 3620703 - RNA, 13 nt, Salmonella enterica enterica serovar Typhi
ugagaccauccug

SEQ ID NO: 3620704 - RNA, 18 nt, Salmonella enterica enterica serovar Typhi
ugagacgcagccucucuu

SEQ ID NO: 3620705 - RNA, 21 nt, Salmonella enterica enterica serovar Typhi
ugagacgugugauuguggcgu

SEQ ID NO: 3620706 - RNA, 12 nt, Salmonella enterica enterica serovar Typhi
ugagacucagca

SEQ ID NO: 3620707 - RNA, 17 nt, Salmonella enterica enterica serovar Typhi
ugagacuguuugucuca

SEQ ID NO: 3620708 - RNA, 22 nt, Salmonella enterica enterica serovar Typhi
ugagagaacguugccgcaggca

SEQ ID NO: 3620709 - RNA, 19 nt, Salmonella enterica enterica serovar Typhi
ugagagcacguaggccuga

SEQ ID NO: 3620710 - RNA, 21 nt, Salmonella enterica enterica serovar Typhi
ugagauccgggcuggcaaaca

SEQ ID NO: 3620711 - RNA, 18 nt, Salmonella enterica enterica serovar Typhi
ugagaucgguaauuucca

SEQ ID NO: 3620712 - RNA, 12 nt, Salmonella enterica enterica serovar Typhi
ugagaucguuau

SEQ ID NO: 3620713 - RNA, 21 nt, Salmonella enterica enterica serovar Typhi
ugagaugaccauaugcggcau

SEQ ID NO: 3620714 - RNA, 13 nt, Salmonella enterica enterica serovar Typhi
ugagcacgcggaa

SEQ ID NO: 3620715 - RNA, 23 nt, Salmonella enterica enterica serovar Typhi
ugauagguucaauaugccaggca

SEQ ID NO: 3620716 - RNA, 19 nt, Salmonella enterica enterica serovar Typhi
ugauauaaaauggcgcaca

SEQ ID NO: 3620717 - RNA, 18 nt, Salmonella enterica enterica serovar Typhi
ugauauaaucgaaucgcc

SEQ ID NO: 3620718 - RNA, 19 nt, Salmonella enterica enterica serovar Typhi
ugauauaaucgaaucgccu

SEQ ID NO: 3620719 - RNA, 14 nt, Salmonella enterica enterica serovar Typhi
ugauauagcgccau

SEQ ID NO: 3620720 - RNA, 16 nt, Salmonella enterica enterica serovar Typhi
ugauaucgccccagaa

SEQ ID NO: 3620721 - RNA, 23 nt, Salmonella enterica enterica serovar Typhi
ugauaucgcugugguuuauccgc

SEQ ID NO: 3620722 - RNA, 21 nt, Salmonella enterica enterica serovar Typhi
ugauaucggccggaugccagu

SEQ ID NO: 3620723 - RNA, 16 nt, Salmonella enterica enterica serovar Typhi
ugauaucgguaagcgc

SEQ ID NO: 3620724 - RNA, 15 nt, Salmonella enterica enterica serovar Typhi
ugauaugcaguucau

SEQ ID NO: 3620725 - RNA, 21 nt, Salmonella enterica enterica serovar Typhi
ugauauuagaaagcugcacca

SEQ ID NO: 3620726 - RNA, 21 nt, Salmonella enterica enterica serovar Typhi
ugauauugaccaucucuuccg

SEQ ID NO: 3620727 - RNA, 22 nt, Salmonella enterica enterica serovar Typhi
ugauauugcguaagcagcugcu

SEQ ID NO: 3620728 - RNA, 16 nt, Salmonella enterica enterica serovar Typhi
ugauauugugcauacu

SEQ ID NO: 3620729 - RNA, 20 nt, Salmonella enterica enterica serovar Typhi
ugauauuucuuagcacccac

SEQ ID NO: 3620730 - RNA, 18 nt, Salmonella enterica enterica serovar Typhi
ugaucaaucaacucuuua

SEQ ID NO: 3620731 - RNA, 23 nt, Salmonella enterica enterica serovar Typhi
ugaucaauuugccuuuauucauu

SEQ ID NO: 3620732 - RNA, 17 nt, Salmonella enterica enterica serovar Typhi
ugaucaccgcccuggcg

SEQ ID NO: 3620733 - RNA, 18 nt, Salmonella enterica enterica serovar Typhi
ugaucaggaaaucuucca

SEQ ID NO: 3620734 - RNA, 15 nt, Salmonella enterica enterica serovar Typhi
ugaucauacugccgc

SEQ ID NO: 3620735 - RNA, 20 nt, Salmonella enterica enterica serovar Typhi
ugaucaucggcgcgucgcug

SEQ ID NO: 3620736 - RNA, 15 nt, Salmonella enterica enterica serovar Typhi
ugaucauggcucaga

SEQ ID NO: 3620737 - RNA, 18 nt, Salmonella enterica enterica serovar Typhi
ugauccaccaccagcauc

SEQ ID NO: 3620738 - RNA, 22 nt, Salmonella enterica enterica serovar Typhi
ugauccaccaccaguacauggc

SEQ ID NO: 3620739 - RNA, 11 nt, Salmonella enterica enterica serovar Typhi
ugauccagcga

SEQ ID NO: 3620740 - RNA, 13 nt, Salmonella enterica enterica serovar Typhi
ugaucccccagaa

SEQ ID NO: 3620741 - RNA, 19 nt, Salmonella enterica enterica serovar Typhi
ugauccgcccccuccagua

SEQ ID NO: 3620742 - RNA, 17 nt, Salmonella enterica enterica serovar Typhi
ugauccguuucagaaag

SEQ ID NO: 3620743 - RNA, 19 nt, Salmonella enterica enterica serovar Typhi
ugauccuguaacgcauaag

SEQ ID NO: 3620744 - RNA, 21 nt, Salmonella enterica enterica serovar Typhi
ugaucgaaaaugcgcaugaug

SEQ ID NO: 3620745 - RNA, 12 nt, Salmonella enterica enterica serovar Typhi
ugaucgaauuca

SEQ ID NO: 3620746 - RNA, 17 nt, Salmonella enterica enterica serovar Typhi
ugaucgccaaagcguaa

SEQ ID NO: 3620747 - RNA, 21 nt, Salmonella enterica enterica serovar Typhi
ugaucgccacgccuaaacuga

SEQ ID NO: 3620748 - RNA, 24 nt, Salmonella enterica enterica serovar Typhi
ugaucgccggagaauccuuccagu

SEQ ID NO: 3620749 - RNA, 14 nt, Salmonella enterica enterica serovar Typhi
ugaucgccucuucg

SEQ ID NO: 3620750 - RNA, 22 nt, Salmonella enterica enterica serovar Typhi
ugaucggccagauaguggcuga

SEQ ID NO: 3620751 - RNA, 14 nt, Salmonella enterica enterica serovar Typhi
ugaucggguuuucc

SEQ ID NO: 3620752 - RNA, 18 nt, Salmonella enterica enterica serovar Typhi
ugaucgugauaggccaga

SEQ ID NO: 3620753 - RNA, 13 nt, Salmonella enterica enterica serovar Typhi
ugaucgugcccac

SEQ ID NO: 3620754 - RNA, 12 nt, Salmonella enterica enterica serovar Typhi
ugaucugcacaa

SEQ ID NO: 3620755 - RNA, 13 nt, Salmonella enterica enterica serovar Typhi
ugaucugcgcaac

SEQ ID NO: 3620756 - RNA, 14 nt, Salmonella enterica enterica serovar Typhi
ugaucugcgccggc

SEQ ID NO: 3620757 - RNA, 22 nt, Salmonella enterica enterica serovar Typhi
ugaucugcgccggcugcgcugc

SEQ ID NO: 3620758 - RNA, 21 nt, Salmonella enterica enterica serovar Typhi
ugaugacgcgaauuauagaac

SEQ ID NO: 3620759 - RNA, 13 nt, Salmonella enterica enterica serovar Typhi
ugaugacgcgcag

SEQ ID NO: 3620760 - RNA, 20 nt, Salmonella enterica enterica serovar Typhi
ugaugacgcgcaggccguca

SEQ ID NO: 3620761 - RNA, 21 nt, Salmonella enterica enterica serovar Typhi
ugaugacucauuaaaaaaaca

SEQ ID NO: 3620762 - RNA, 13 nt, Salmonella enterica enterica serovar Typhi
ugaugagaggcga

SEQ ID NO: 3620763 - RNA, 18 nt, Salmonella enterica enterica serovar Typhi
ugaugagaugcaggccaa

SEQ ID NO: 3620764 - RNA, 20 nt, Salmonella enterica enterica serovar Typhi
ugaugauacccccagagauu

SEQ ID NO: 3620765 - RNA, 15 nt, Salmonella enterica enterica serovar Typhi
ugaugauagcgccau

SEQ ID NO: 3620766 - RNA, 15 nt, Salmonella enterica enterica serovar Typhi
ugaugaucgcgguaa

SEQ ID NO: 3620767 - RNA, 18 nt, Salmonella enterica enterica serovar Typhi
ugaugaucuucagcccgu

SEQ ID NO: 3620768 - RNA, 17 nt, Salmonella enterica enterica serovar Typhi
ugaugaugaagcugcag

SEQ ID NO: 3620769 - RNA, 21 nt, Salmonella enterica enterica serovar Typhi
ugaugaugcguuuguuggaga

SEQ ID NO: 3620770 - RNA, 16 nt, Salmonella enterica enterica serovar Typhi
ugaugauggaacagac

SEQ ID NO: 3620771 - RNA, 16 nt, Salmonella enterica enterica serovar Typhi
ugaugauuuaugaaua

SEQ ID NO: 3620772 - RNA, 16 nt, Salmonella enterica enterica serovar Typhi
ugaugcaucagaacaa

SEQ ID NO: 3620773 - RNA, 20 nt, Salmonella enterica enterica serovar Typhi
ugaugcaucagaacaaacuu

SEQ ID NO: 3620774 - RNA, 18 nt, Salmonella enterica enterica serovar Typhi
ugaugcgccccgcuuccc

SEQ ID NO: 3620775 - RNA, 19 nt, Salmonella enterica enterica serovar Typhi
ugaugcgccugucuccagc

SEQ ID NO: 3620776 - RNA, 18 nt, Salmonella enterica enterica serovar Typhi
ugaugcguauccagcgcg

SEQ ID NO: 3620777 - RNA, 23 nt, Salmonella enterica enterica serovar Typhi
ugaugcguuguaccguuuuccag

SEQ ID NO: 3620778 - RNA, 15 nt, Salmonella enterica enterica serovar Typhi
ugaugcugcgcaucc

SEQ ID NO: 3620779 - RNA, 20 nt, Salmonella enterica enterica serovar Typhi
ugauggcagaccguggccgu

SEQ ID NO: 3620780 - RNA, 17 nt, Salmonella enterica enterica serovar Typhi
ugauggccuuugugauc

SEQ ID NO: 3620781 - RNA, 16 nt, Salmonella enterica enterica serovar Typhi
ugauggcgcuacgcca

SEQ ID NO: 3620782 - RNA, 13 nt, Salmonella enterica enterica serovar Typhi
ugauggcgcugcg

SEQ ID NO: 3620783 - RNA, 20 nt, Salmonella enterica enterica serovar Typhi
ugauggcgcugcgcuuauca

SEQ ID NO: 3620784 - RNA, 19 nt, Salmonella enterica enterica serovar Typhi
ugauggcguagcgccauca

SEQ ID NO: 3620785 - RNA, 10 nt, Salmonella enterica enterica serovar Typhi
ugauggcuuu

SEQ ID NO: 3620786 - RNA, 18 nt, Salmonella enterica enterica serovar Typhi
ugaugggcgcacagcgcc

SEQ ID NO: 3620787 - RNA, 13 nt, Salmonella enterica enterica serovar Typhi
ugauggucuccag

SEQ ID NO: 3620788 - RNA, 15 nt, Salmonella enterica enterica serovar Typhi
ugaugguuauuuuca

SEQ ID NO: 3620789 - RNA, 21 nt, Salmonella enterica enterica serovar Typhi
ugaugguuucggcaugccacu

SEQ ID NO: 3620790 - RNA, 15 nt, Salmonella enterica enterica serovar Typhi
ugauguacaggugaa

SEQ ID NO: 3620791 - RNA, 20 nt, Salmonella enterica enterica serovar Typhi
ugaugugauuuuugacccgc

SEQ ID NO: 3620792 - RNA, 17 nt, Salmonella enterica enterica serovar Typhi
ugaugugucuauuuauu

SEQ ID NO: 3620793 - RNA, 18 nt, Salmonella enterica enterica serovar Typhi
ugauguguuucagcagcc

SEQ ID NO: 3620794 - RNA, 13 nt, Salmonella enterica enterica serovar Typhi
ugauuaaagccac

SEQ ID NO: 3620795 - RNA, 16 nt, Salmonella enterica enterica serovar Typhi
ugauuaacagcgccau

SEQ ID NO: 3620796 - RNA, 18 nt, Salmonella enterica enterica serovar Typhi
ugauuaaugauuugcuuu

SEQ ID NO: 3620797 - RNA, 12 nt, Salmonella enterica enterica serovar Typhi
ugauuacaaaau

SEQ ID NO: 3620798 - RNA, 15 nt, Salmonella enterica enterica serovar Typhi
ugauuacaaaaugug

SEQ ID NO: 3620799 - RNA, 14 nt, Salmonella enterica enterica serovar Typhi
ugauuacggaacaa

SEQ ID NO: 3620800 - RNA, 15 nt, Salmonella enterica enterica serovar Typhi
ugauuauuacaauaa

SEQ ID NO: 3620801 - RNA, 20 nt, Salmonella enterica enterica serovar Typhi
ugcaccaggugaaugaggug

SEQ ID NO: 3620802 - RNA, 17 nt, Salmonella enterica enterica serovar Typhi
ugcaccgcuaaaaaaca

SEQ ID NO: 3620803 - RNA, 18 nt, Salmonella enterica enterica serovar Typhi
ugcaccucagaccguuag

SEQ ID NO: 3620804 - RNA, 12 nt, Salmonella enterica enterica serovar Typhi
ugcaccucuuua

SEQ ID NO: 3620805 - RNA, 22 nt, Salmonella enterica enterica serovar Typhi
ugcaccuuaaccgucugcucag

SEQ ID NO: 3620806 - RNA, 17 nt, Salmonella enterica enterica serovar Typhi
ugcacgaaauguagagc

SEQ ID NO: 3620807 - RNA, 20 nt, Salmonella enterica enterica serovar Typhi
ugcacgccugcuucacguau

SEQ ID NO: 3620808 - RNA, 17 nt, Salmonella enterica enterica serovar Typhi
ugcacgguugaagcgac

SEQ ID NO: 3620809 - RNA, 17 nt, Salmonella enterica enterica serovar Typhi
ugcacguaccugcucca

SEQ ID NO: 3620810 - RNA, 22 nt, Salmonella enterica enterica serovar Typhi
ugcacgucgagacgguguuuag

SEQ ID NO: 3620811 - RNA, 23 nt, Salmonella enterica enterica serovar Typhi
ugcacgucgcgcucgcucaucac

SEQ ID NO: 3620812 - RNA, 17 nt, Salmonella enterica enterica serovar Typhi
ugcacugacuuacaggc

SEQ ID NO: 3620813 - RNA, 12 nt, Salmonella enterica enterica serovar Typhi
ugcacugcaccu

SEQ ID NO: 3620814 - RNA, 21 nt, Salmonella enterica enterica serovar Typhi
ugcacugcgcccauuauugau

SEQ ID NO: 3620815 - RNA, 12 nt, Salmonella enterica enterica serovar Typhi
ugcacuuccugc

SEQ ID NO: 3620816 - RNA, 13 nt, Salmonella enterica enterica serovar Typhi
ugcacuuccugcg

SEQ ID NO: 3620817 - RNA, 14 nt, Salmonella enterica enterica serovar Typhi
ugcagaaucauuaa

SEQ ID NO: 3620818 - RNA, 20 nt, Salmonella enterica enterica serovar Typhi
ugcagaauugauaccacauc

SEQ ID NO: 3620819 - RNA, 14 nt, Salmonella enterica enterica serovar Typhi
ugcagaccucugca

SEQ ID NO: 3620820 - RNA, 16 nt, Salmonella enterica enterica serovar Typhi
ugcagaccucugcaaa

SEQ ID NO: 3620821 - RNA, 20 nt, Salmonella enterica enterica serovar Typhi
ugcagaucgcgggcaaucaa

SEQ ID NO: 3620822 - RNA, 18 nt, Salmonella enterica enterica serovar Typhi
ugcagaucggccuguuuu

SEQ ID NO: 3620823 - RNA, 15 nt, Salmonella enterica enterica serovar Typhi
ugcagauuaugccgu

SEQ ID NO: 3620824 - RNA, 13 nt, Salmonella enterica enterica serovar Typhi
ugcagauuuugcu

SEQ ID NO: 3620825 - RNA, 24 nt, Salmonella enterica enterica serovar Typhi
ugcagcaagcggcugucaucaaug

SEQ ID NO: 3620826 - RNA, 12 nt, Salmonella enterica enterica serovar Typhi
ugcagcagccag

SEQ ID NO: 3620827 - RNA, 18 nt, Salmonella enterica enterica serovar Typhi
ugcagcaggacgcgcacu

SEQ ID NO: 3620828 - RNA, 14 nt, Salmonella enterica enterica serovar Typhi
ugcagccaggccau

SEQ ID NO: 3620829 - RNA, 15 nt, Salmonella enterica enterica serovar Typhi
ugcagcgaccuggga

SEQ ID NO: 3620830 - RNA, 15 nt, Salmonella enterica enterica serovar Typhi
ugcagcgccagagau

SEQ ID NO: 3620831 - RNA, 18 nt, Salmonella enterica enterica serovar Typhi
ugcagcgcggcggcaacu

SEQ ID NO: 3620832 - RNA, 18 nt, Salmonella enterica enterica serovar Typhi
ugcagcggaauucccaca

SEQ ID NO: 3620833 - RNA, 23 nt, Salmonella enterica enterica serovar Typhi
ugcagcggaugcucuuuacggac

SEQ ID NO: 3620834 - RNA, 21 nt, Salmonella enterica enterica serovar Typhi
ugcagcggcaguuccggcguu

SEQ ID NO: 3620835 - RNA, 18 nt, Salmonella enterica enterica serovar Typhi
ugcagcgugaaaagcuua

SEQ ID NO: 3620836 - RNA, 15 nt, Salmonella enterica enterica serovar Typhi
ugcagcguuuccagc

SEQ ID NO: 3620837 - RNA, 16 nt, Salmonella enterica enterica serovar Typhi
ugcagcucaagcgccg

SEQ ID NO: 3620838 - RNA, 16 nt, Salmonella enterica enterica serovar Typhi
ugcaggaaguuuucug

SEQ ID NO: 3620839 - RNA, 13 nt, Salmonella enterica enterica serovar Typhi
ugcaggaggcgcg

SEQ ID NO: 3620840 - RNA, 18 nt, Salmonella enterica enterica serovar Typhi
ugcaggcaggucuccagc

SEQ ID NO: 3620841 - RNA, 18 nt, Salmonella enterica enterica serovar Typhi
ugcaggcauaaaaaagag

SEQ ID NO: 3620842 - RNA, 21 nt, Salmonella enterica enterica serovar Typhi
ugcaggccaaauagaacgcuc

SEQ ID NO: 3620843 - RNA, 13 nt, Salmonella enterica enterica serovar Typhi
ugcaggccggaua

SEQ ID NO: 3620844 - RNA, 18 nt, Salmonella enterica enterica serovar Typhi
ugcaggccggauaagccg

SEQ ID NO: 3620845 - RNA, 15 nt, Salmonella enterica enterica serovar Typhi
ugcaggcgccugggu

SEQ ID NO: 3620846 - RNA, 19 nt, Salmonella enterica enterica serovar Typhi
ugcaggcgggugcgcagcc

SEQ ID NO: 3620847 - RNA, 22 nt, Salmonella enterica enterica serovar Typhi
ugcaggcugagcguagaccgcc

SEQ ID NO: 3620848 - RNA, 15 nt, Salmonella enterica enterica serovar Typhi
ugcagggugcagcaa

SEQ ID NO: 3620849 - RNA, 14 nt, Salmonella enterica enterica serovar Typhi
ugcagguucccgcc

SEQ ID NO: 3620850 - RNA, 19 nt, Salmonella enterica enterica serovar Typhi
ugcaguauugcaccaggaa

SEQ ID NO: 3620851 - RNA, 18 nt, Salmonella enterica enterica serovar Typhi
ugcagucugguaacgcaa

SEQ ID NO: 3620852 - RNA, 17 nt, Salmonella enterica enterica serovar Typhi
ugcagugacagaggaau

SEQ ID NO: 3620853 - RNA, 15 nt, Salmonella enterica enterica serovar Typhi
ugcaguucaaaaggu

SEQ ID NO: 3620854 - RNA, 22 nt, Salmonella enterica enterica serovar Typhi
ugcaguucaucauccugcaggg

SEQ ID NO: 3620855 - RNA, 23 nt, Salmonella enterica enterica serovar Typhi
ugcaguuccgcaauccuggcuuc

SEQ ID NO: 3620856 - RNA, 19 nt, Salmonella enterica enterica serovar Typhi
ugcaguuccguugcaauau

SEQ ID NO: 3620857 - RNA, 21 nt, Salmonella enterica enterica serovar Typhi
ugcaguucuguaggccggaua

SEQ ID NO: 3620858 - RNA, 23 nt, Salmonella enterica enterica serovar Typhi
ugcaguuuuaccguaaaaugcug

SEQ ID NO: 3620859 - RNA, 13 nt, Salmonella enterica enterica serovar Typhi
ugcauaaaaaaac

SEQ ID NO: 3620860 - RNA, 20 nt, Salmonella enterica enterica serovar Typhi
ugcauaaaacgguuuucaaa

SEQ ID NO: 3620861 - RNA, 20 nt, Salmonella enterica enterica serovar Typhi
ugcauaaagauuggcaucug

SEQ ID NO: 3620862 - RNA, 18 nt, Salmonella enterica enterica serovar Typhi
ugcauaaaggaguaacag

SEQ ID NO: 3620863 - RNA, 12 nt, Salmonella enterica enterica serovar Typhi
ugcauaagaggu

SEQ ID NO: 3620864 - RNA, 17 nt, Salmonella enterica enterica serovar Typhi
ugcauaauauccaggag

SEQ ID NO: 3620865 - RNA, 16 nt, Salmonella enterica enterica serovar Typhi
ugcauaaugccggauc

SEQ ID NO: 3620866 - RNA, 13 nt, Salmonella enterica enterica serovar Typhi
ugcauacauaaau

SEQ ID NO: 3620867 - RNA, 19 nt, Salmonella enterica enterica serovar Typhi
ugcauacguuucaccagca

SEQ ID NO: 3620868 - RNA, 20 nt, Salmonella enterica enterica serovar Typhi
ugcauacguuucaccagcac

SEQ ID NO: 3620869 - RNA, 19 nt, Salmonella enterica enterica serovar Typhi
ugcauacucacauucauaa

SEQ ID NO: 3620870 - RNA, 22 nt, Salmonella enterica enterica serovar Typhi
ugcauacucacauucauaaaag

SEQ ID NO: 3620871 - RNA, 16 nt, Salmonella enterica enterica serovar Typhi
ugcauauaacuuucaa

SEQ ID NO: 3620872 - RNA, 22 nt, Salmonella enterica enterica serovar Typhi
ugcauauacguugcggcgcguu

SEQ ID NO: 3620873 - RNA, 19 nt, Salmonella enterica enterica serovar Typhi
ugcauaucgcuaaaccaaa

SEQ ID NO: 3620874 - RNA, 15 nt, Salmonella enterica enterica serovar Typhi
ugcauauuauucaug

SEQ ID NO: 3620875 - RNA, 14 nt, Salmonella enterica enterica serovar Typhi
ugcaucaaacuucg

SEQ ID NO: 3620876 - RNA, 21 nt, Salmonella enterica enterica serovar Typhi
ugcaucaaacuucguuacuua

SEQ ID NO: 3620877 - RNA, 23 nt, Salmonella enterica enterica serovar Typhi
ugcaucagaacaaacuuauccca

SEQ ID NO: 3620878 - RNA, 18 nt, Salmonella enterica enterica serovar Typhi
ugcauccgcgcuuucugg

SEQ ID NO: 3620879 - RNA, 21 nt, Salmonella enterica enterica serovar Typhi
ugcauccgggguucgaauccc

SEQ ID NO: 3620880 - RNA, 20 nt, Salmonella enterica enterica serovar Typhi
ugcauccuguaccaccacgc

SEQ ID NO: 3620881 - RNA, 17 nt, Salmonella enterica enterica serovar Typhi
ugcaucgcggucagcgg

SEQ ID NO: 3620882 - RNA, 18 nt, Salmonella enterica enterica serovar Typhi
ugcaucgugagcgcguca

SEQ ID NO: 3620883 - RNA, 18 nt, Salmonella enterica enterica serovar Typhi
ugcaucuggucaggugau

SEQ ID NO: 3620884 - RNA, 20 nt, Salmonella enterica enterica serovar Typhi
ugcaucuugaaugauuuugu

SEQ ID NO: 3620885 - RNA, 14 nt, Salmonella enterica enterica serovar Typhi
ugcaugaauaucaa

SEQ ID NO: 3620886 - RNA, 18 nt, Salmonella enterica enterica serovar Typhi
ugccauucccagccgagc

SEQ ID NO: 3620887 - RNA, 17 nt, Salmonella enterica enterica serovar Typhi
ugccauuguucgcgcgu

SEQ ID NO: 3620888 - RNA, 21 nt, Salmonella enterica enterica serovar Typhi
ugccauuuuaucgacgcuauu

SEQ ID NO: 3620889 - RNA, 15 nt, Salmonella enterica enterica serovar Typhi
ugcccaaccugcgca

SEQ ID NO: 3620890 - RNA, 16 nt, Salmonella enterica enterica serovar Typhi
ugcccaaccugcgcag

SEQ ID NO: 3620891 - RNA, 17 nt, Salmonella enterica enterica serovar Typhi
ugcccaauagcgcugag

SEQ ID NO: 3620892 - RNA, 15 nt, Salmonella enterica enterica serovar Typhi
ugcccacccgggccg

SEQ ID NO: 3620893 - RNA, 14 nt, Salmonella enterica enterica serovar Typhi
ugcccagccuucuc

SEQ ID NO: 3620894 - RNA, 15 nt, Salmonella enterica enterica serovar Typhi
ugcccagcgccguca

SEQ ID NO: 3620895 - RNA, 22 nt, Salmonella enterica enterica serovar Typhi
ugcccagcgcgaccugcauccc

SEQ ID NO: 3620896 - RNA, 16 nt, Salmonella enterica enterica serovar Typhi
ugcccagcucagcuuu

SEQ ID NO: 3620897 - RNA, 13 nt, Salmonella enterica enterica serovar Typhi
ugcccaguuuacc

SEQ ID NO: 3620898 - RNA, 18 nt, Salmonella enterica enterica serovar Typhi
ugcccaucgcaacgccgg

SEQ ID NO: 3620899 - RNA, 19 nt, Salmonella enterica enterica serovar Typhi
ugcccaucgcgccaugauu

SEQ ID NO: 3620900 - RNA, 22 nt, Salmonella enterica enterica serovar Typhi
ugcccaucuaaccgggccugau

SEQ ID NO: 3620901 - RNA, 22 nt, Salmonella enterica enterica serovar Typhi
ugcccaucugacgugcgauagc

SEQ ID NO: 3620902 - RNA, 14 nt, Salmonella enterica enterica serovar Typhi
ugcccaugaagcga

SEQ ID NO: 3620903 - RNA, 13 nt, Salmonella enterica enterica serovar Typhi
ugcccauuccgcc

SEQ ID NO: 3620904 - RNA, 19 nt, Salmonella enterica enterica serovar Typhi
ugcccauuuccugcauuaa

SEQ ID NO: 3620905 - RNA, 21 nt, Salmonella enterica enterica serovar Typhi
ugccccacgauacgccccugc

SEQ ID NO: 3620906 - RNA, 18 nt, Salmonella enterica enterica serovar Typhi
ugccccaucucuuucaga

SEQ ID NO: 3620907 - RNA, 15 nt, Salmonella enterica enterica serovar Typhi
ugccccauuguucuu

SEQ ID NO: 3620908 - RNA, 15 nt, Salmonella enterica enterica serovar Typhi
ugcccccgagccaga

SEQ ID NO: 3620909 - RNA, 19 nt, Salmonella enterica enterica serovar Typhi
ugcccccgaucacggcgaa

SEQ ID NO: 3620910 - RNA, 12 nt, Salmonella enterica enterica serovar Typhi
ugccccucuucc

SEQ ID NO: 3620911 - RNA, 14 nt, Salmonella enterica enterica serovar Typhi
ugccccugaccgaa

SEQ ID NO: 3620912 - RNA, 20 nt, Salmonella enterica enterica serovar Typhi
ugcccgaaagcaauacugua

SEQ ID NO: 3620913 - RNA, 17 nt, Salmonella enterica enterica serovar Typhi
ugcccgagugacugaca

SEQ ID NO: 3620914 - RNA, 21 nt, Salmonella enterica enterica serovar Typhi
ugcccgaugagcuugcacuau

SEQ ID NO: 3620915 - RNA, 15 nt, Salmonella enterica enterica serovar Typhi
ugcccgauggcgcua

SEQ ID NO: 3620916 - RNA, 15 nt, Salmonella enterica enterica serovar Typhi
ugcccgauggcgcug

SEQ ID NO: 3620917 - RNA, 20 nt, Salmonella enterica enterica serovar Typhi
ugcccgcaaucucuggccag

SEQ ID NO: 3620918 - RNA, 13 nt, Salmonella enterica enterica serovar Typhi
ugcccgccagcgg

SEQ ID NO: 3620919 - RNA, 14 nt, Salmonella enterica enterica serovar Typhi
ugcccgccagcggg

SEQ ID NO: 3620920 - RNA, 17 nt, Salmonella enterica enterica serovar Typhi
ugcccgccagcgggccg

SEQ ID NO: 3620921 - RNA, 15 nt, Salmonella enterica enterica serovar Typhi
ugcccgccgccggcc

SEQ ID NO: 3620922 - RNA, 18 nt, Salmonella enterica enterica serovar Typhi
ugcccgccguuaaaucau

SEQ ID NO: 3620923 - RNA, 21 nt, Salmonella enterica enterica serovar Typhi
ugcccgcucgcuuacgcggcg

SEQ ID NO: 3620924 - RNA, 23 nt, Salmonella enterica enterica serovar Typhi
ugcccggcgcguuuuggcagaca

SEQ ID NO: 3620925 - RNA, 15 nt, Salmonella enterica enterica serovar Typhi
ugcccgguggcgcug

SEQ ID NO: 3620926 - RNA, 16 nt, Salmonella enterica enterica serovar Typhi
ugcccgguggcgcugc

SEQ ID NO: 3620927 - RNA, 19 nt, Salmonella enterica enterica serovar Typhi
ugcccgguggcgcugcgcu

SEQ ID NO: 3620928 - RNA, 21 nt, Salmonella enterica enterica serovar Typhi
ugcccgguuaaggggcaggcg

SEQ ID NO: 3620929 - RNA, 16 nt, Salmonella enterica enterica serovar Typhi
ugcccgguuuuuuaau

SEQ ID NO: 3620930 - RNA, 17 nt, Salmonella enterica enterica serovar Typhi
ugcccgucggacucauc

SEQ ID NO: 3620931 - RNA, 16 nt, Salmonella enterica enterica serovar Typhi
ugcccguugucacagg

SEQ ID NO: 3620932 - RNA, 20 nt, Salmonella enterica enterica serovar Typhi
ugcccguugucacaggcuug

SEQ ID NO: 3620933 - RNA, 16 nt, Salmonella enterica enterica serovar Typhi
ugcccucuuccagcgc

SEQ ID NO: 3620934 - RNA, 19 nt, Salmonella enterica enterica serovar Typhi
ugcccugcuggcgcaugau

SEQ ID NO: 3620935 - RNA, 23 nt, Salmonella enterica enterica serovar Typhi
ugcccugcuugucgaucaucaga

SEQ ID NO: 3620936 - RNA, 13 nt, Salmonella enterica enterica serovar Typhi
ugcccuggaagaa

SEQ ID NO: 3620937 - RNA, 21 nt, Salmonella enterica enterica serovar Typhi
ugcccuuaucuggaugaggac

SEQ ID NO: 3620938 - RNA, 17 nt, Salmonella enterica enterica serovar Typhi
ugcccuuccagcagcca

SEQ ID NO: 3620939 - RNA, 14 nt, Salmonella enterica enterica serovar Typhi
ugcccuuucuuaug

SEQ ID NO: 3620940 - RNA, 14 nt, Salmonella enterica enterica serovar Typhi
ugcccuuuuccaga

SEQ ID NO: 3620941 - RNA, 20 nt, Salmonella enterica enterica serovar Typhi
ugccgacaaagagcucccca

SEQ ID NO: 3620942 - RNA, 16 nt, Salmonella enterica enterica serovar Typhi
ugccgaccaaugacgc

SEQ ID NO: 3620943 - RNA, 15 nt, Salmonella enterica enterica serovar Typhi
ugccgaccuggcuug

SEQ ID NO: 3620944 - RNA, 13 nt, Salmonella enterica enterica serovar Typhi
ugccgacggcgcu

SEQ ID NO: 3620945 - RNA, 15 nt, Salmonella enterica enterica serovar Typhi
ugccgacuggcguga

SEQ ID NO: 3620946 - RNA, 14 nt, Salmonella enterica enterica serovar Typhi
ugccgagcaacaga

SEQ ID NO: 3620947 - RNA, 17 nt, Salmonella enterica enterica serovar Typhi
ugccgauaauaaacgcg

SEQ ID NO: 3620948 - RNA, 21 nt, Salmonella enterica enterica serovar Typhi
ugccgauaauaaacgcgccaa

SEQ ID NO: 3620949 - RNA, 19 nt, Salmonella enterica enterica serovar Typhi
ugccgauacguccccaucc

SEQ ID NO: 3620950 - RNA, 21 nt, Salmonella enterica enterica serovar Typhi
ugccgaucaccagcgcaucuc

SEQ ID NO: 3620951 - RNA, 16 nt, Salmonella enterica enterica serovar Typhi
ugccgaugacucccag

SEQ ID NO: 3620952 - RNA, 16 nt, Salmonella enterica enterica serovar Typhi
ugccgaugccgccgca

SEQ ID NO: 3620953 - RNA, 17 nt, Salmonella enterica enterica serovar Typhi
ugccgaugccugcgaga

SEQ ID NO: 3620954 - RNA, 21 nt, Salmonella enterica enterica serovar Typhi
ugccgauggcgcuccugaauc

SEQ ID NO: 3620955 - RNA, 12 nt, Salmonella enterica enterica serovar Typhi
ugccgauggcua

SEQ ID NO: 3620956 - RNA, 18 nt, Salmonella enterica enterica serovar Typhi
ugccgauggcuaaagcgc

SEQ ID NO: 3620957 - RNA, 20 nt, Salmonella enterica enterica serovar Typhi
ugccgauuccaugcccaguu

SEQ ID NO: 3620958 - RNA, 22 nt, Salmonella enterica enterica serovar Typhi
ugccgauuccaugcccaguuca

SEQ ID NO: 3620959 - RNA, 13 nt, Salmonella enterica enterica serovar Typhi
ugccgcaaaaaug

SEQ ID NO: 3620960 - RNA, 20 nt, Salmonella enterica enterica serovar Typhi
ugccgcaaacgccugcuccg

SEQ ID NO: 3620961 - RNA, 19 nt, Salmonella enterica enterica serovar Typhi
ugccgcaaaugaccagauc

SEQ ID NO: 3620962 - RNA, 21 nt, Salmonella enterica enterica serovar Typhi
ugccgcacauguuaaauacgc

SEQ ID NO: 3620963 - RNA, 21 nt, Salmonella enterica enterica serovar Typhi
ugccgcagccgcucaggguaa

SEQ ID NO: 3620964 - RNA, 14 nt, Salmonella enterica enterica serovar Typhi
ugccgcagcgcagu

SEQ ID NO: 3620965 - RNA, 18 nt, Salmonella enterica enterica serovar Typhi
ugccgccacgccgcucca

SEQ ID NO: 3620966 - RNA, 22 nt, Salmonella enterica enterica serovar Typhi
ugccgccacgccgcuccacagc

SEQ ID NO: 3620967 - RNA, 21 nt, Salmonella enterica enterica serovar Typhi
ugccgccauaacgccggcgcu

SEQ ID NO: 3620968 - RNA, 23 nt, Salmonella enterica enterica serovar Typhi
ugccgccaucagcgucagcagag

SEQ ID NO: 3620969 - RNA, 12 nt, Salmonella enterica enterica serovar Typhi
ugccgccauccg

SEQ ID NO: 3620970 - RNA, 20 nt, Salmonella enterica enterica serovar Typhi
ugccgccaucucacgcaugg

SEQ ID NO: 3620971 - RNA, 20 nt, Salmonella enterica enterica serovar Typhi
ugccgcccagggaaagauca

SEQ ID NO: 3620972 - RNA, 23 nt, Salmonella enterica enterica serovar Typhi
ugccuuccgggcggcugucccag

SEQ ID NO: 3620973 - RNA, 14 nt, Salmonella enterica enterica serovar Typhi
ugccuucgccgccg

SEQ ID NO: 3620974 - RNA, 17 nt, Salmonella enterica enterica serovar Typhi
ugccuucggcgcuggga

SEQ ID NO: 3620975 - RNA, 18 nt, Salmonella enterica enterica serovar Typhi
ugccuucucugucgagca

SEQ ID NO: 3620976 - RNA, 21 nt, Salmonella enterica enterica serovar Typhi
ugccuucuguuuuuugccaca

SEQ ID NO: 3620977 - RNA, 22 nt, Salmonella enterica enterica serovar Typhi
ugccuucuuuggugcgacgcca

SEQ ID NO: 3620978 - RNA, 16 nt, Salmonella enterica enterica serovar Typhi
ugccuugcgaauggag

SEQ ID NO: 3620979 - RNA, 18 nt, Salmonella enterica enterica serovar Typhi
ugccuuguaagccggaua

SEQ ID NO: 3620980 - RNA, 17 nt, Salmonella enterica enterica serovar Typhi
ugccuuguaggccugau

SEQ ID NO: 3620981 - RNA, 22 nt, Salmonella enterica enterica serovar Typhi
ugccuugugucacauuuucuug

SEQ ID NO: 3620982 - RNA, 19 nt, Salmonella enterica enterica serovar Typhi
ugccuuuaacaaauuaaau

SEQ ID NO: 3620983 - RNA, 23 nt, Salmonella enterica enterica serovar Typhi
ugccuuuaacaaauuaaauccug

SEQ ID NO: 3620984 - RNA, 12 nt, Salmonella enterica enterica serovar Typhi
ugccuuucagau

SEQ ID NO: 3620985 - RNA, 14 nt, Salmonella enterica enterica serovar Typhi
ugccuuucgccagc

SEQ ID NO: 3620986 - RNA, 19 nt, Salmonella enterica enterica serovar Typhi
ugccuuuuucccacugcgc

SEQ ID NO: 3620987 - RNA, 18 nt, Salmonella enterica enterica serovar Typhi
ugccuuuuugcagcgcgg

SEQ ID NO: 3620988 - RNA, 13 nt, Salmonella enterica enterica serovar Typhi
ugcgaaaagccgg

SEQ ID NO: 3620989 - RNA, 18 nt, Salmonella enterica enterica serovar Typhi
ugcgaaaauacucccggc

SEQ ID NO: 3620990 - RNA, 12 nt, Salmonella enterica enterica serovar Typhi
ugcgaaacgucc

SEQ ID NO: 3620991 - RNA, 19 nt, Salmonella enterica enterica serovar Typhi
ugcgaaagccucuuccgcc

SEQ ID NO: 3620992 - RNA, 21 nt, Salmonella enterica enterica serovar Typhi
ugcgaacgauaccauccccuu

SEQ ID NO: 3620993 - RNA, 23 nt, Salmonella enterica enterica serovar Typhi
ugcgaagcgcccggaaagugggc

SEQ ID NO: 3620994 - RNA, 18 nt, Salmonella enterica enterica serovar Typhi
ugcgacaacaaugaaacg

SEQ ID NO: 3620995 - RNA, 19 nt, Salmonella enterica enterica serovar Typhi
ugcgacacgcugcauauaa

SEQ ID NO: 3620996 - RNA, 15 nt, Salmonella enterica enterica serovar Typhi
ugcgaccacuccggc

SEQ ID NO: 3620997 - RNA, 18 nt, Salmonella enterica enterica serovar Typhi
ugcgaccgcgccacggcc

SEQ ID NO: 3620998 - RNA, 22 nt, Salmonella enterica enterica serovar Typhi
ugcgacgcgcucaccuccgcca

SEQ ID NO: 3620999 - RNA, 21 nt, Salmonella enterica enterica serovar Typhi
ugcgacucggugccgcugcug

SEQ ID NO: 3621000 - RNA, 18 nt, Salmonella enterica enterica serovar Typhi
ugcgacugaaaaucaaaa

SEQ ID NO: 3621001 - RNA, 12 nt, Salmonella enterica enterica serovar Typhi
ugcgagaaaaag

SEQ ID NO: 3621002 - RNA, 12 nt, Salmonella enterica enterica serovar Typhi
ugcgagaccauc

SEQ ID NO: 3621003 - RNA, 11 nt, Salmonella enterica enterica serovar Typhi
ugcgaggcgcg

SEQ ID NO: 3621004 - RNA, 15 nt, Salmonella enterica enterica serovar Typhi
ugcgaggucugguca

SEQ ID NO: 3621005 - RNA, 16 nt, Salmonella enterica enterica serovar Typhi
ugcgaggugauagccc

SEQ ID NO: 3621006 - RNA, 17 nt, Salmonella enterica enterica serovar Typhi
ugcgaguagcaaauccc

SEQ ID NO: 3621007 - RNA, 22 nt, Salmonella enterica enterica serovar Typhi
ugcgauaaugaagcauaaaaag

SEQ ID NO: 3621008 - RNA, 23 nt, Salmonella enterica enterica serovar Typhi
ugcgauaaugguugaacaggcug

SEQ ID NO: 3621009 - RNA, 18 nt, Salmonella enterica enterica serovar Typhi
ugcgauagcccggcaugu

SEQ ID NO: 3621010 - RNA, 19 nt, Salmonella enterica enterica serovar Typhi
ugcgaugagauccgggcug

SEQ ID NO: 3621011 - RNA, 21 nt, Salmonella enterica enterica serovar Typhi
ugcgcaacaugccugauggcg

SEQ ID NO: 3621012 - RNA, 18 nt, Salmonella enterica enterica serovar Typhi
ugcgcaacguuucuuuca

SEQ ID NO: 3621013 - RNA, 20 nt, Salmonella enterica enterica serovar Typhi
ugcgcaacguuucuuucauc

SEQ ID NO: 3621014 - RNA, 16 nt, Salmonella enterica enterica serovar Typhi
ugcgcacucagaaaau

SEQ ID NO: 3621015 - RNA, 18 nt, Salmonella enterica enterica serovar Typhi
ugcgcagccccagcgcca

SEQ ID NO: 3621016 - RNA, 20 nt, Salmonella enterica enterica serovar Typhi
ugcgcagccccagcgccagc

SEQ ID NO: 3621017 - RNA, 17 nt, Salmonella enterica enterica serovar Typhi
ugcgcagcguuuccaga

SEQ ID NO: 3621018 - RNA, 17 nt, Salmonella enterica enterica serovar Typhi
ugcgcaggaggcuuccg

SEQ ID NO: 3621019 - RNA, 18 nt, Salmonella enterica enterica serovar Typhi
ugcgcauccucuuuccgu

SEQ ID NO: 3621020 - RNA, 13 nt, Salmonella enterica enterica serovar Typhi
ugcgccaacguca

SEQ ID NO: 3621021 - RNA, 14 nt, Salmonella enterica enterica serovar Typhi
ugcgccacaucauu

SEQ ID NO: 3621022 - RNA, 17 nt, Salmonella enterica enterica serovar Typhi
ugcgccaccagcgcagu

SEQ ID NO: 3621023 - RNA, 20 nt, Salmonella enterica enterica serovar Typhi
ugcgccacguucggcgugua

SEQ ID NO: 3621024 - RNA, 12 nt, Salmonella enterica enterica serovar Typhi
ugcgccagcaug

SEQ ID NO: 3621025 - RNA, 15 nt, Salmonella enterica enterica serovar Typhi
ugcgccagccagcuc

SEQ ID NO: 3621026 - RNA, 20 nt, Salmonella enterica enterica serovar Typhi
ugcgccagccagcucaccag

SEQ ID NO: 3621027 - RNA, 22 nt, Salmonella enterica enterica serovar Typhi
ugcgccagccggauacugcgcu

SEQ ID NO: 3621028 - RNA, 15 nt, Salmonella enterica enterica serovar Typhi
ugcgccagccugcug

SEQ ID NO: 3621029 - RNA, 18 nt, Salmonella enterica enterica serovar Typhi
ugcgccagccugcugguc

SEQ ID NO: 3621030 - RNA, 13 nt, Salmonella enterica enterica serovar Typhi
ugcgccagcgccg

SEQ ID NO: 3621031 - RNA, 13 nt, Salmonella enterica enterica serovar Typhi
ugcgccagcguaa

SEQ ID NO: 3621032 - RNA, 18 nt, Salmonella enterica enterica serovar Typhi
ugcgccagcgugcuaagc

SEQ ID NO: 3621033 - RNA, 17 nt, Salmonella enterica enterica serovar Typhi
ugcgccaggcagcaccu

SEQ ID NO: 3621034 - RNA, 15 nt, Salmonella enterica enterica serovar Typhi
ugcgccaucgggccg

SEQ ID NO: 3621035 - RNA, 23 nt, Salmonella enterica enterica serovar Typhi
ugcgccauugccguaucagcaag

SEQ ID NO: 3621036 - RNA, 19 nt, Salmonella enterica enterica serovar Typhi
ugcgccauuucaauaauau

SEQ ID NO: 3621037 - RNA, 14 nt, Salmonella enterica enterica serovar Typhi
ugcgcccacaauga

SEQ ID NO: 3621038 - RNA, 21 nt, Salmonella enterica enterica serovar Typhi
ugcgcccagcccggaaauaaa

SEQ ID NO: 3621039 - RNA, 18 nt, Salmonella enterica enterica serovar Typhi
ugcgcccaugacaugaaa

SEQ ID NO: 3621040 - RNA, 14 nt, Salmonella enterica enterica serovar Typhi
ugcgccccagcaug

SEQ ID NO: 3621041 - RNA, 21 nt, Salmonella enterica enterica serovar Typhi
ugcgccccagcaugagccagc

SEQ ID NO: 3621042 - RNA, 22 nt, Salmonella enterica enterica serovar Typhi
ugcgccccgcaacgccgauaag

SEQ ID NO: 3621043 - RNA, 14 nt, Salmonella enterica enterica serovar Typhi
ugcgcccguacacc

SEQ ID NO: 3621044 - RNA, 20 nt, Salmonella enterica enterica serovar Typhi
ugcgccgcaucuuuugccgc

SEQ ID NO: 3621045 - RNA, 22 nt, Salmonella enterica enterica serovar Typhi
ugcgccggcugcgcugccagcu

SEQ ID NO: 3621046 - RNA, 15 nt, Salmonella enterica enterica serovar Typhi
ugcgccgucaggcuu

SEQ ID NO: 3621047 - RNA, 19 nt, Salmonella enterica enterica serovar Typhi
ugcgccgucaggcuugccg

SEQ ID NO: 3621048 - RNA, 21 nt, Salmonella enterica enterica serovar Typhi
ugcgccgucaggcuugccgcg

SEQ ID NO: 3621049 - RNA, 19 nt, Salmonella enterica enterica serovar Typhi
ugcgccguccugcaaggca

SEQ ID NO: 3621050 - RNA, 14 nt, Salmonella enterica enterica serovar Typhi
ugcgccgugccugg

SEQ ID NO: 3621051 - RNA, 15 nt, Salmonella enterica enterica serovar Typhi
ugcgccgugccuggc

SEQ ID NO: 3621052 - RNA, 19 nt, Salmonella enterica enterica serovar Typhi
ugcgccgugccuggcgcug

SEQ ID NO: 3621053 - RNA, 12 nt, Salmonella enterica enterica serovar Typhi
ugcgccugcuca

SEQ ID NO: 3621054 - RNA, 14 nt, Salmonella enterica enterica serovar Typhi
ugcgccuggcggua

SEQ ID NO: 3621055 - RNA, 23 nt, Salmonella enterica enterica serovar Typhi
ugcgccugggugggcggaaaacu

SEQ ID NO: 3621056 - RNA, 14 nt, Salmonella enterica enterica serovar Typhi
ugcgccugucucca

SEQ ID NO: 3621057 - RNA, 18 nt, Salmonella enterica enterica serovar Typhi
ugcgguggcaacgcuggc

SEQ ID NO: 3621058 - RNA, 17 nt, Salmonella enterica enterica serovar Typhi
ugcgguuaaaccaggcg

SEQ ID NO: 3621059 - RNA, 18 nt, Salmonella enterica enterica serovar Typhi
ugcgguuacguccggcau

SEQ ID NO: 3621060 - RNA, 19 nt, Salmonella enterica enterica serovar Typhi
ugcgguuauaauaauaauu

SEQ ID NO: 3621061 - RNA, 15 nt, Salmonella enterica enterica serovar Typhi
ugcgguucucccggc

SEQ ID NO: 3621062 - RNA, 19 nt, Salmonella enterica enterica serovar Typhi
ugcguaaaauauacagccu

SEQ ID NO: 3621063 - RNA, 17 nt, Salmonella enterica enterica serovar Typhi
ugcguaaaaucagcauc

SEQ ID NO: 3621064 - RNA, 21 nt, Salmonella enterica enterica serovar Typhi
ugcguaauacggagcaaaaaa

SEQ ID NO: 3621065 - RNA, 15 nt, Salmonella enterica enterica serovar Typhi
ugcguaaucuuuuca

SEQ ID NO: 3621066 - RNA, 21 nt, Salmonella enterica enterica serovar Typhi
ugcguaaucuuuucauauuau

SEQ ID NO: 3621067 - RNA, 22 nt, Salmonella enterica enterica serovar Typhi
ugcguaccgcuaucgccaaacu

SEQ ID NO: 3621068 - RNA, 14 nt, Salmonella enterica enterica serovar Typhi
ugcguacucagcag

SEQ ID NO: 3621069 - RNA, 19 nt, Salmonella enterica enterica serovar Typhi
ugcguagacgaugcaggcc

SEQ ID NO: 3621070 - RNA, 16 nt, Salmonella enterica enterica serovar Typhi
ugcguaucgcccaccg

SEQ ID NO: 3621071 - RNA, 14 nt, Salmonella enterica enterica serovar Typhi
ugcguauugagcgc

SEQ ID NO: 3621072 - RNA, 13 nt, Salmonella enterica enterica serovar Typhi
ugcguauuuccac

SEQ ID NO: 3621073 - RNA, 12 nt, Salmonella enterica enterica serovar Typhi
ugcgucagcgcu

SEQ ID NO: 3621074 - RNA, 23 nt, Salmonella enterica enterica serovar Typhi
ugcgucaugauuaacgucacgau

SEQ ID NO: 3621075 - RNA, 18 nt, Salmonella enterica enterica serovar Typhi
ugcgucaugcuuuuuuuc

SEQ ID NO: 3621076 - RNA, 17 nt, Salmonella enterica enterica serovar Typhi
ugcgucgccccaaucgc

SEQ ID NO: 3621077 - RNA, 18 nt, Salmonella enterica enterica serovar Typhi
ugcgucggcaccauuccc

SEQ ID NO: 3621078 - RNA, 15 nt, Salmonella enterica enterica serovar Typhi
ugcgucuuaauggug

SEQ ID NO: 3621079 - RNA, 21 nt, Salmonella enterica enterica serovar Typhi
ugcgugcgccgugaaauaucc

SEQ ID NO: 3621080 - RNA, 16 nt, Salmonella enterica enterica serovar Typhi
ugcgugcuggcggccg

SEQ ID NO: 3621081 - RNA, 23 nt, Salmonella enterica enterica serovar Typhi
ugcguuaacccgcuuacaauuua

SEQ ID NO: 3621082 - RNA, 23 nt, Salmonella enterica enterica serovar Typhi
ugcguuaacggcuucguuucaga

SEQ ID NO: 3621083 - RNA, 21 nt, Salmonella enterica enterica serovar Typhi
ugcguuaccccaucauugacu

SEQ ID NO: 3621084 - RNA, 20 nt, Salmonella enterica enterica serovar Typhi
ugcguucacagcaccauguu

SEQ ID NO: 3621085 - RNA, 16 nt, Salmonella enterica enterica serovar Typhi
ugcguucauggcgcga

SEQ ID NO: 3621086 - RNA, 22 nt, Salmonella enterica enterica serovar Typhi
ugcguucuauugucaccgggcg

SEQ ID NO: 3621087 - RNA, 15 nt, Salmonella enterica enterica serovar Typhi
ugcguugcuauggca

SEQ ID NO: 3621088 - RNA, 16 nt, Salmonella enterica enterica serovar Typhi
ugcguugucgcugauu

SEQ ID NO: 3621089 - RNA, 13 nt, Salmonella enterica enterica serovar Typhi
ugcguuguggacg

SEQ ID NO: 3621090 - RNA, 21 nt, Salmonella enterica enterica serovar Typhi
ugcguuuaaagagaugacugg

SEQ ID NO: 3621091 - RNA, 18 nt, Salmonella enterica enterica serovar Typhi
ugcguuuugugcggccua

SEQ ID NO: 3621092 - RNA, 13 nt, Salmonella enterica enterica serovar Typhi
ugcuaaaagaagc

SEQ ID NO: 3621093 - RNA, 14 nt, Salmonella enterica enterica serovar Typhi
ugcuaauaccggga

SEQ ID NO: 3621094 - RNA, 22 nt, Salmonella enterica enterica serovar Typhi
ugcuaccguuuucgccuuugcg

SEQ ID NO: 3621095 - RNA, 14 nt, Salmonella enterica enterica serovar Typhi
ugcuacgcgccagu

SEQ ID NO: 3621096 - RNA, 22 nt, Salmonella enterica enterica serovar Typhi
ugcuagaacauuucccgaaaaa

SEQ ID NO: 3621097 - RNA, 19 nt, Salmonella enterica enterica serovar Typhi
ugcuauaugcaggcauaaa

SEQ ID NO: 3621098 - RNA, 14 nt, Salmonella enterica enterica serovar Typhi
ugcuaucaaacuga

SEQ ID NO: 3621099 - RNA, 19 nt, Salmonella enterica enterica serovar Typhi
ugcuaucaaacugaaaauc

SEQ ID NO: 3621100 - RNA, 12 nt, Salmonella enterica enterica serovar Typhi
ugcuaucaggau

SEQ ID NO: 3621101 - RNA, 16 nt, Salmonella enterica enterica serovar Typhi
ugcuauccgccgccag

SEQ ID NO: 3621102 - RNA, 14 nt, Salmonella enterica enterica serovar Typhi
ugcuauucagcagu

SEQ ID NO: 3621103 - RNA, 16 nt, Salmonella enterica enterica serovar Typhi
ugcucaaaggcgcuga

SEQ ID NO: 3621104 - RNA, 21 nt, Salmonella enterica enterica serovar Typhi
ugcucaaccaguaccgggccu

SEQ ID NO: 3621105 - RNA, 17 nt, Salmonella enterica enterica serovar Typhi
ugcucaacuuccagagc

SEQ ID NO: 3621106 - RNA, 12 nt, Salmonella enterica enterica serovar Typhi
ugcucaauaagc

SEQ ID NO: 3621107 - RNA, 21 nt, Salmonella enterica enterica serovar Typhi
ugcucaauacuuuccgggccg

SEQ ID NO: 3621108 - RNA, 16 nt, Salmonella enterica enterica serovar Typhi
ugcucaaucgcaugac

SEQ ID NO: 3621109 - RNA, 22 nt, Salmonella enterica enterica serovar Typhi
ugcucacccauuuuauccucuu

SEQ ID NO: 3621110 - RNA, 13 nt, Salmonella enterica enterica serovar Typhi
ugcucaggcaaca

SEQ ID NO: 3621111 - RNA, 20 nt, Salmonella enterica enterica serovar Typhi
ugcucauaacggcuacgcag

SEQ ID NO: 3621112 - RNA, 21 nt, Salmonella enterica enterica serovar Typhi
ugcucaugacaucgcccuggg

SEQ ID NO: 3621113 - RNA, 21 nt, Salmonella enterica enterica serovar Typhi
ugcucaugcgagguauacgcc

SEQ ID NO: 3621114 - RNA, 23 nt, Salmonella enterica enterica serovar Typhi
ugcucaugcgagguauacgccac

SEQ ID NO: 3621115 - RNA, 21 nt, Salmonella enterica enterica serovar Typhi
ugcuccagaagaucuaaagcc

SEQ ID NO: 3621116 - RNA, 11 nt, Salmonella enterica enterica serovar Typhi
ugcuccagcgu

SEQ ID NO: 3621117 - RNA, 20 nt, Salmonella enterica enterica serovar Typhi
ugcuccaguuguuccagcag

SEQ ID NO: 3621118 - RNA, 13 nt, Salmonella enterica enterica serovar Typhi
ugcuccggcuuaa

SEQ ID NO: 3621119 - RNA, 22 nt, Salmonella enterica enterica serovar Typhi
ugcuccggcuuaaugcccggcc

SEQ ID NO: 3621120 - RNA, 14 nt, Salmonella enterica enterica serovar Typhi
ugcuccugccagau

SEQ ID NO: 3621121 - RNA, 19 nt, Salmonella enterica enterica serovar Typhi
ugcucgaaauccucacggu

SEQ ID NO: 3621122 - RNA, 18 nt, Salmonella enterica enterica serovar Typhi
ugcucgauauauuuuccg

SEQ ID NO: 3621123 - RNA, 20 nt, Salmonella enterica enterica serovar Typhi
ugcucggcggucagccacau

SEQ ID NO: 3621124 - RNA, 20 nt, Salmonella enterica enterica serovar Typhi
ugcucguaaagcaucagacu

SEQ ID NO: 3621125 - RNA, 19 nt, Salmonella enterica enterica serovar Typhi
ugcucguagcguuuaaaga

SEQ ID NO: 3621126 - RNA, 23 nt, Salmonella enterica enterica serovar Typhi
ugcucgucggcaauuugacuaca

SEQ ID NO: 3621127 - RNA, 17 nt, Salmonella enterica enterica serovar Typhi
ugcucuaccaacugagc

SEQ ID NO: 3621128 - RNA, 19 nt, Salmonella enterica enterica serovar Typhi
ugcucuaccaacugagcua

SEQ ID NO: 3621129 - RNA, 16 nt, Salmonella enterica enterica serovar Typhi
ugcucuccacgccgca

SEQ ID NO: 3621130 - RNA, 20 nt, Salmonella enterica enterica serovar Typhi
ugcucuccacgccgcaagga

SEQ ID NO: 3621131 - RNA, 21 nt, Salmonella enterica enterica serovar Typhi
ugcugaaaaucgucucucauc

SEQ ID NO: 3621132 - RNA, 21 nt, Salmonella enterica enterica serovar Typhi
ugcugaacacaaugaauccuc

SEQ ID NO: 3621133 - RNA, 20 nt, Salmonella enterica enterica serovar Typhi
ugcugaagcagauacugcgc

SEQ ID NO: 3621134 - RNA, 19 nt, Salmonella enterica enterica serovar Typhi
ugcugaauauuaucggcgu

SEQ ID NO: 3621135 - RNA, 21 nt, Salmonella enterica enterica serovar Typhi
ugcugacaaaauaaagugaaa

SEQ ID NO: 3621136 - RNA, 16 nt, Salmonella enterica enterica serovar Typhi
ugcugacaaucugcug

SEQ ID NO: 3621137 - RNA, 19 nt, Salmonella enterica enterica serovar Typhi
ugcugacacccucugcgcc

SEQ ID NO: 3621138 - RNA, 23 nt, Salmonella enterica enterica serovar Typhi
ugcugacaucucuuuuaauuuuc

SEQ ID NO: 3621139 - RNA, 13 nt, Salmonella enterica enterica serovar Typhi
ugcugaugcugua

SEQ ID NO: 3621140 - RNA, 21 nt, Salmonella enterica enterica serovar Typhi
ugcugauguccgcagccgcau

SEQ ID NO: 3621141 - RNA, 15 nt, Salmonella enterica enterica serovar Typhi
ugcugauuuuggcuu

SEQ ID NO: 3621142 - RNA, 17 nt, Salmonella enterica enterica serovar Typhi
ugcuuuuuuucucuguc

SEQ ID NO: 3621143 - RNA, 12 nt, Salmonella enterica enterica serovar Typhi
uggaaaaaaaga

SEQ ID NO: 3621144 - RNA, 13 nt, Salmonella enterica enterica serovar Typhi
uggaaaaaaagaa

SEQ ID NO: 3621145 - RNA, 15 nt, Salmonella enterica enterica serovar Typhi
uggaaaaaagcgccc

SEQ ID NO: 3621146 - RNA, 23 nt, Salmonella enterica enterica serovar Typhi
uggaaaacaagugcagaagcaau

SEQ ID NO: 3621147 - RNA, 13 nt, Salmonella enterica enterica serovar Typhi
uggaaaacagcgc

SEQ ID NO: 3621148 - RNA, 22 nt, Salmonella enterica enterica serovar Typhi
uggaaaaccccaucccggcaac

SEQ ID NO: 3621149 - RNA, 15 nt, Salmonella enterica enterica serovar Typhi
uggaaaauaauaauc

SEQ ID NO: 3621150 - RNA, 16 nt, Salmonella enterica enterica serovar Typhi
uggaaaauaauaaucg

SEQ ID NO: 3621151 - RNA, 18 nt, Salmonella enterica enterica serovar Typhi
uggaaaauaauaaucguu

SEQ ID NO: 3621152 - RNA, 15 nt, Salmonella enterica enterica serovar Typhi
uggaaaaucacgcug

SEQ ID NO: 3621153 - RNA, 14 nt, Salmonella enterica enterica serovar Typhi
uggaaaauuucagu

SEQ ID NO: 3621154 - RNA, 18 nt, Salmonella enterica enterica serovar Typhi
uggaaaccgcagaagguc

SEQ ID NO: 3621155 - RNA, 19 nt, Salmonella enterica enterica serovar Typhi
uggaaaccgcagaagguca

SEQ ID NO: 3621156 - RNA, 17 nt, Salmonella enterica enterica serovar Typhi
uggaaacuccagcggca

SEQ ID NO: 3621157 - RNA, 24 nt, Salmonella enterica enterica serovar Typhi
uggaaacugugcgacaaccugcgc

SEQ ID NO: 3621158 - RNA, 16 nt, Salmonella enterica enterica serovar Typhi
uggaaauaaagguuca

SEQ ID NO: 3621159 - RNA, 21 nt, Salmonella enterica enterica serovar Typhi
uggaaauaccgguaaucaagc

SEQ ID NO: 3621160 - RNA, 18 nt, Salmonella enterica enterica serovar Typhi
uggaaauauucucagcca

SEQ ID NO: 3621161 - RNA, 19 nt, Salmonella enterica enterica serovar Typhi
uggaaaugcguggcauuaa

SEQ ID NO: 3621162 - RNA, 19 nt, Salmonella enterica enterica serovar Typhi
uggaacaggccaaacccug

SEQ ID NO: 3621163 - RNA, 19 nt, Salmonella enterica enterica serovar Typhi
uggaacauccucuccugaa

SEQ ID NO: 3621164 - RNA, 18 nt, Salmonella enterica enterica serovar Typhi
uggaaccaaacaccagau

SEQ ID NO: 3621165 - RNA, 14 nt, Salmonella enterica enterica serovar Typhi
uggaaccaggcgcg

SEQ ID NO: 3621166 - RNA, 15 nt, Salmonella enterica enterica serovar Typhi
uggaaccgccggaga

SEQ ID NO: 3621167 - RNA, 21 nt, Salmonella enterica enterica serovar Typhi
uggaacuuuaucgcgcggcga

SEQ ID NO: 3621168 - RNA, 19 nt, Salmonella enterica enterica serovar Typhi
uggaaggaagggcgcugcc

SEQ ID NO: 3621169 - RNA, 14 nt, Salmonella enterica enterica serovar Typhi
uggaaguacuggau

SEQ ID NO: 3621170 - RNA, 23 nt, Salmonella enterica enterica serovar Typhi
uggaaguagucgcgaaugcgcaa

SEQ ID NO: 3621171 - RNA, 22 nt, Salmonella enterica enterica serovar Typhi
uggaaguaugccucgcgcacca

SEQ ID NO: 3621172 - RNA, 19 nt, Salmonella enterica enterica serovar Typhi
uggaagugcguuaacccgc

SEQ ID NO: 3621173 - RNA, 14 nt, Salmonella enterica enterica serovar Typhi
uggaauaaauauaa

SEQ ID NO: 3621174 - RNA, 13 nt, Salmonella enterica enterica serovar Typhi
uggaauucuucau

SEQ ID NO: 3621175 - RNA, 22 nt, Salmonella enterica enterica serovar Typhi
uggaauuugucgucaugcgcca

SEQ ID NO: 3621176 - RNA, 24 nt, Salmonella enterica enterica serovar Typhi
uggaauuugucgucaugcgccagg

SEQ ID NO: 3621177 - RNA, 12 nt, Salmonella enterica enterica serovar Typhi
uggaauuuugca

SEQ ID NO: 3621178 - RNA, 14 nt, Salmonella enterica enterica serovar Typhi
uggaauuuuuccag

SEQ ID NO: 3621179 - RNA, 22 nt, Salmonella enterica enterica serovar Typhi
uggacaaaaaaggaaaaugacg

SEQ ID NO: 3621180 - RNA, 19 nt, Salmonella enterica enterica serovar Typhi
uggacaaaauuuuuuauca

SEQ ID NO: 3621181 - RNA, 13 nt, Salmonella enterica enterica serovar Typhi
uggacaaggcacc

SEQ ID NO: 3621182 - RNA, 19 nt, Salmonella enterica enterica serovar Typhi
uggacagguaaaccgguca

SEQ ID NO: 3621183 - RNA, 24 nt, Salmonella enterica enterica serovar Typhi
uggacauguccgacgacaagcaga

SEQ ID NO: 3621184 - RNA, 19 nt, Salmonella enterica enterica serovar Typhi
uggacgcgaaugucauccg

SEQ ID NO: 3621185 - RNA, 13 nt, Salmonella enterica enterica serovar Typhi
uggacggcaucag

SEQ ID NO: 3621186 - RNA, 16 nt, Salmonella enterica enterica serovar Typhi
uggacggcaucaggaa

SEQ ID NO: 3621187 - RNA, 13 nt, Salmonella enterica enterica serovar Typhi
uggacgucaugcc

SEQ ID NO: 3621188 - RNA, 14 nt, Salmonella enterica enterica serovar Typhi
uggacgucaugccg

SEQ ID NO: 3621189 - RNA, 21 nt, Salmonella enterica enterica serovar Typhi
uggacguggguuucaauauag

SEQ ID NO: 3621190 - RNA, 19 nt, Salmonella enterica enterica serovar Typhi
uggacuauggucugaaaga

SEQ ID NO: 3621191 - RNA, 19 nt, Salmonella enterica enterica serovar Typhi
uggagagcagcgccagcga

SEQ ID NO: 3621192 - RNA, 14 nt, Salmonella enterica enterica serovar Typhi
uggagcgagcuggu

SEQ ID NO: 3621193 - RNA, 16 nt, Salmonella enterica enterica serovar Typhi
uggaggguaagaaagu

SEQ ID NO: 3621194 - RNA, 19 nt, Salmonella enterica enterica serovar Typhi
uggagguuauccugaaagg

SEQ ID NO: 3621195 - RNA, 13 nt, Salmonella enterica enterica serovar Typhi
uggagguuguuuu

SEQ ID NO: 3621196 - RNA, 15 nt, Salmonella enterica enterica serovar Typhi
uggagguuucuucau

SEQ ID NO: 3621197 - RNA, 22 nt, Salmonella enterica enterica serovar Typhi
uggaguacgggcagauggucgc

SEQ ID NO: 3621198 - RNA, 18 nt, Salmonella enterica enterica serovar Typhi
uggaguagauguagcuga

SEQ ID NO: 3621199 - RNA, 14 nt, Salmonella enterica enterica serovar Typhi
uggagucugaaaau

SEQ ID NO: 3621200 - RNA, 18 nt, Salmonella enterica enterica serovar Typhi
uggauaaagccaauggug

SEQ ID NO: 3621201 - RNA, 15 nt, Salmonella enterica enterica serovar Typhi
uggauaaauaggcug

SEQ ID NO: 3621202 - RNA, 17 nt, Salmonella enterica enterica serovar Typhi
uggauaacgaaaagggu

SEQ ID NO: 3621203 - RNA, 19 nt, Salmonella enterica enterica serovar Typhi
uggauaacgaaaaggguca

SEQ ID NO: 3621204 - RNA, 23 nt, Salmonella enterica enterica serovar Typhi
uggauaagacgacgguuaaaaag

SEQ ID NO: 3621205 - RNA, 14 nt, Salmonella enterica enterica serovar Typhi
uggauaccgcacug

SEQ ID NO: 3621206 - RNA, 16 nt, Salmonella enterica enterica serovar Typhi
uggauacguuccagca

SEQ ID NO: 3621207 - RNA, 16 nt, Salmonella enterica enterica serovar Typhi
uggauagcaauuucag

SEQ ID NO: 3621208 - RNA, 20 nt, Salmonella enterica enterica serovar Typhi
uggauagcaccauaaacggc

SEQ ID NO: 3621209 - RNA, 15 nt, Salmonella enterica enterica serovar Typhi
uggauagucuucaag

SEQ ID NO: 3621210 - RNA, 15 nt, Salmonella enterica enterica serovar Typhi
uggauauccagcaua

SEQ ID NO: 3621211 - RNA, 15 nt, Salmonella enterica enterica serovar Typhi
uggaucagaagcuuc

SEQ ID NO: 3621212 - RNA, 18 nt, Salmonella enterica enterica serovar Typhi
uggaucagacgccgcgcu

SEQ ID NO: 3621213 - RNA, 16 nt, Salmonella enterica enterica serovar Typhi
uggaucaucggcucag

SEQ ID NO: 3621214 - RNA, 16 nt, Salmonella enterica enterica serovar Typhi
uggaucccccuggccc

SEQ ID NO: 3621215 - RNA, 14 nt, Salmonella enterica enterica serovar Typhi
uggaucgcuccauu

SEQ ID NO: 3621216 - RNA, 16 nt, Salmonella enterica enterica serovar Typhi
uggaucggaaaucaaa

SEQ ID NO: 3621217 - RNA, 15 nt, Salmonella enterica enterica serovar Typhi
uggaucucgucgccg

SEQ ID NO: 3621218 - RNA, 17 nt, Salmonella enterica enterica serovar Typhi
uggaugcgcugaauagc

SEQ ID NO: 3621219 - RNA, 15 nt, Salmonella enterica enterica serovar Typhi
uggauggacuguuuc

SEQ ID NO: 3621220 - RNA, 22 nt, Salmonella enterica enterica serovar Typhi
uggaugguuucuucgcuggcgg

SEQ ID NO: 3621221 - RNA, 22 nt, Salmonella enterica enterica serovar Typhi
uggauuaucgaaauagcgguga

SEQ ID NO: 3621222 - RNA, 19 nt, Salmonella enterica enterica serovar Typhi
uggauuccuccaauucagg

SEQ ID NO: 3621223 - RNA, 15 nt, Salmonella enterica enterica serovar Typhi
uggauucucgcgccg

SEQ ID NO: 3621224 - RNA, 22 nt, Salmonella enterica enterica serovar Typhi
uggauuuauggcacaucaggca

SEQ ID NO: 3621225 - RNA, 15 nt, Salmonella enterica enterica serovar Typhi
uggauuuauggcguc

SEQ ID NO: 3621226 - RNA, 21 nt, Salmonella enterica enterica serovar Typhi
uggauuuuccguuaagcugga

SEQ ID NO: 3621227 - RNA, 21 nt, Salmonella enterica enterica serovar Typhi
uggcaaaaaaggccagacuca

SEQ ID NO: 3621228 - RNA, 16 nt, Salmonella enterica enterica serovar Typhi
uggcgauauccgugcc

SEQ ID NO: 3621229 - RNA, 16 nt, Salmonella enterica enterica serovar Typhi
uggcgaucacaauuac

SEQ ID NO: 3621230 - RNA, 16 nt, Salmonella enterica enterica serovar Typhi
uggcgaucagcgccac

SEQ ID NO: 3621231 - RNA, 16 nt, Salmonella enterica enterica serovar Typhi
uggcgauuuccagcga

SEQ ID NO: 3621232 - RNA, 20 nt, Salmonella enterica enterica serovar Typhi
uggcgauuuccagcgaauaa

SEQ ID NO: 3621233 - RNA, 19 nt, Salmonella enterica enterica serovar Typhi
uggcgauuuucauagcugg

SEQ ID NO: 3621234 - RNA, 13 nt, Salmonella enterica enterica serovar Typhi
uggcgcagcgcgg

SEQ ID NO: 3621235 - RNA, 12 nt, Salmonella enterica enterica serovar Typhi
uggcgcagcgcu

SEQ ID NO: 3621236 - RNA, 21 nt, Salmonella enterica enterica serovar Typhi
uggcgcaguuuacgcagcgcc

SEQ ID NO: 3621237 - RNA, 15 nt, Salmonella enterica enterica serovar Typhi
uggcgccacgccacc

SEQ ID NO: 3621238 - RNA, 15 nt, Salmonella enterica enterica serovar Typhi
uggcgccagccuguc

SEQ ID NO: 3621239 - RNA, 20 nt, Salmonella enterica enterica serovar Typhi
uggcgccauuggcucggcgu

SEQ ID NO: 3621240 - RNA, 21 nt, Salmonella enterica enterica serovar Typhi
uggcgccuuuuggcagcagcg

SEQ ID NO: 3621241 - RNA, 21 nt, Salmonella enterica enterica serovar Typhi
uggcgcgaucaguucuugcag

SEQ ID NO: 3621242 - RNA, 17 nt, Salmonella enterica enterica serovar Typhi
uggcgcgaugacucgua

SEQ ID NO: 3621243 - RNA, 15 nt, Salmonella enterica enterica serovar Typhi
uggcgcgcuugcauu

SEQ ID NO: 3621244 - RNA, 23 nt, Salmonella enterica enterica serovar Typhi
uggcgcggacgcuuaccgggccu

SEQ ID NO: 3621245 - RNA, 18 nt, Salmonella enterica enterica serovar Typhi
uggcgcuaaaauccacuc

SEQ ID NO: 3621246 - RNA, 16 nt, Salmonella enterica enterica serovar Typhi
uggcgcuaagacguga

SEQ ID NO: 3621247 - RNA, 14 nt, Salmonella enterica enterica serovar Typhi
uggcgcuccugaau

SEQ ID NO: 3621248 - RNA, 16 nt, Salmonella enterica enterica serovar Typhi
uggcgcuccugaaucg

SEQ ID NO: 3621249 - RNA, 17 nt, Salmonella enterica enterica serovar Typhi
uggcgcucggaugugca

SEQ ID NO: 3621250 - RNA, 16 nt, Salmonella enterica enterica serovar Typhi
uggcgcugccggaaag

SEQ ID NO: 3621251 - RNA, 12 nt, Salmonella enterica enterica serovar Typhi
uggcgcugcgcu

SEQ ID NO: 3621252 - RNA, 21 nt, Salmonella enterica enterica serovar Typhi
uggcgcuggccgaauagcuga

SEQ ID NO: 3621253 - RNA, 21 nt, Salmonella enterica enterica serovar Typhi
uggcgcuguucuugcugcugc

SEQ ID NO: 3621254 - RNA, 17 nt, Salmonella enterica enterica serovar Typhi
uggcgcuuaauacgcga

SEQ ID NO: 3621255 - RNA, 14 nt, Salmonella enterica enterica serovar Typhi
uggcggaaagaagc

SEQ ID NO: 3621256 - RNA, 15 nt, Salmonella enterica enterica serovar Typhi
uggcggaauaucgcg

SEQ ID NO: 3621257 - RNA, 17 nt, Salmonella enterica enterica serovar Typhi
uggcggagggauuuuaa

SEQ ID NO: 3621258 - RNA, 17 nt, Salmonella enterica enterica serovar Typhi
uggcggcacuaaagcgu

SEQ ID NO: 3621259 - RNA, 23 nt, Salmonella enterica enterica serovar Typhi
uggcggcauaaaugccuuauccg

SEQ ID NO: 3621260 - RNA, 15 nt, Salmonella enterica enterica serovar Typhi
uggcggcauaauaug

SEQ ID NO: 3621261 - RNA, 21 nt, Salmonella enterica enterica serovar Typhi
uggcggcggacaugguaauaa

SEQ ID NO: 3621262 - RNA, 14 nt, Salmonella enterica enterica serovar Typhi
uggcggcggucgua

SEQ ID NO: 3621263 - RNA, 23 nt, Salmonella enterica enterica serovar Typhi
uggcggcguccggcacgcgcagc

SEQ ID NO: 3621264 - RNA, 15 nt, Salmonella enterica enterica serovar Typhi
uggcgggcuuauccc

SEQ ID NO: 3621265 - RNA, 18 nt, Salmonella enterica enterica serovar Typhi
uggcgguaaauacgcggc

SEQ ID NO: 3621266 - RNA, 14 nt, Salmonella enterica enterica serovar Typhi
uggcguaaacgcca

SEQ ID NO: 3621267 - RNA, 13 nt, Salmonella enterica enterica serovar Typhi
uggcguaaauauu

SEQ ID NO: 3621268 - RNA, 20 nt, Salmonella enterica enterica serovar Typhi
uggcguacgguuggaucggc

SEQ ID NO: 3621269 - RNA, 17 nt, Salmonella enterica enterica serovar Typhi
uggcguagaagcuuacc

SEQ ID NO: 3621270 - RNA, 17 nt, Salmonella enterica enterica serovar Typhi
uggcguagauauucccc

SEQ ID NO: 3621271 - RNA, 15 nt, Salmonella enterica enterica serovar Typhi
uggcgucaaucaacu

SEQ ID NO: 3621272 - RNA, 16 nt, Salmonella enterica enterica serovar Typhi
uggcgucagaccggca

SEQ ID NO: 3621273 - RNA, 18 nt, Salmonella enterica enterica serovar Typhi
uggcgucagaccggcaau

SEQ ID NO: 3621274 - RNA, 15 nt, Salmonella enterica enterica serovar Typhi
uggcguccagcccgu

SEQ ID NO: 3621275 - RNA, 15 nt, Salmonella enterica enterica serovar Typhi
uggcgucccuuuccc

SEQ ID NO: 3621276 - RNA, 16 nt, Salmonella enterica enterica serovar Typhi
uggcguccggccacua

SEQ ID NO: 3621277 - RNA, 17 nt, Salmonella enterica enterica serovar Typhi
uggcgucgccaaagcag

SEQ ID NO: 3621278 - RNA, 21 nt, Salmonella enterica enterica serovar Typhi
uggcgucgccaaagcagcugc

SEQ ID NO: 3621279 - RNA, 15 nt, Salmonella enterica enterica serovar Typhi
uggcguuaacggcgc

SEQ ID NO: 3621280 - RNA, 18 nt, Salmonella enterica enterica serovar Typhi
uggcuaacccgcugcgcc

SEQ ID NO: 3621281 - RNA, 15 nt, Salmonella enterica enterica serovar Typhi
uggcuaauuucaauu

SEQ ID NO: 3621282 - RNA, 17 nt, Salmonella enterica enterica serovar Typhi
uggcuaucuuuauguca

SEQ ID NO: 3621283 - RNA, 19 nt, Salmonella enterica enterica serovar Typhi
uggcuauuuuuugcuggcg

SEQ ID NO: 3621284 - RNA, 17 nt, Salmonella enterica enterica serovar Typhi
uggcucaaggauauugc

SEQ ID NO: 3621285 - RNA, 18 nt, Salmonella enterica enterica serovar Typhi
uggcucagauugaacgcu

SEQ ID NO: 3621286 - RNA, 19 nt, Salmonella enterica enterica serovar Typhi
uggcucccgcagccacucc

SEQ ID NO: 3621287 - RNA, 19 nt, Salmonella enterica enterica serovar Typhi
uggcuccuguugguuauac

SEQ ID NO: 3621288 - RNA, 14 nt, Salmonella enterica enterica serovar Typhi
uggcucggccuguc

SEQ ID NO: 3621289 - RNA, 22 nt, Salmonella enterica enterica serovar Typhi
uggcucggccugucgcgaccau

SEQ ID NO: 3621290 - RNA, 18 nt, Salmonella enterica enterica serovar Typhi
uggcucggcgucaucccg

SEQ ID NO: 3621291 - RNA, 13 nt, Salmonella enterica enterica serovar Typhi
uggcucugggcca

SEQ ID NO: 3621292 - RNA, 23 nt, Salmonella enterica enterica serovar Typhi
uggcucuuagcagcauaaacauc

SEQ ID NO: 3621293 - RNA, 15 nt, Salmonella enterica enterica serovar Typhi
uggcucuugguuuua

SEQ ID NO: 3621294 - RNA, 13 nt, Salmonella enterica enterica serovar Typhi
uggcugagaaaaa

SEQ ID NO: 3621295 - RNA, 19 nt, Salmonella enterica enterica serovar Typhi
uggcugagaaucaccuggc

SEQ ID NO: 3621296 - RNA, 20 nt, Salmonella enterica enterica serovar Typhi
uggcugaggccgcucgccau

SEQ ID NO: 3621297 - RNA, 21 nt, Salmonella enterica enterica serovar Typhi
uggcugcgcgucccucuccag

SEQ ID NO: 3621298 - RNA, 15 nt, Salmonella enterica enterica serovar Typhi
uggcuggcauauugc

SEQ ID NO: 3621299 - RNA, 13 nt, Salmonella enterica enterica serovar Typhi
uggcuggcgcuga

SEQ ID NO: 3621300 - RNA, 16 nt, Salmonella enterica enterica serovar Typhi
uggcuggggcguuauc

SEQ ID NO: 3621301 - RNA, 23 nt, Salmonella enterica enterica serovar Typhi
uggcuguagauacugaccaagcg

SEQ ID NO: 3621302 - RNA, 22 nt, Salmonella enterica enterica serovar Typhi
uggcuguccuugcgccaucggc

SEQ ID NO: 3621303 - RNA, 17 nt, Salmonella enterica enterica serovar Typhi
uggcugucggcagaacc

SEQ ID NO: 3621304 - RNA, 13 nt, Salmonella enterica enterica serovar Typhi
uggcugucuuccg

SEQ ID NO: 3621305 - RNA, 15 nt, Salmonella enterica enterica serovar Typhi
uggcugugccaauaa

SEQ ID NO: 3621306 - RNA, 16 nt, Salmonella enterica enterica serovar Typhi
uggcugugcgugaccc

SEQ ID NO: 3621307 - RNA, 17 nt, Salmonella enterica enterica serovar Typhi
uggcuuaccuucggccu

SEQ ID NO: 3621308 - RNA, 18 nt, Salmonella enterica enterica serovar Typhi
uggcuuccguccccagcc

SEQ ID NO: 3621309 - RNA, 22 nt, Salmonella enterica enterica serovar Typhi
uggcuucuuuaacuaauggcaa

SEQ ID NO: 3621310 - RNA, 18 nt, Salmonella enterica enterica serovar Typhi
uggcuugaucaacgccgc

SEQ ID NO: 3621311 - RNA, 17 nt, Salmonella enterica enterica serovar Typhi
uggcuuuauauaaaaaa

SEQ ID NO: 3621312 - RNA, 14 nt, Salmonella enterica enterica serovar Typhi
uggcuuucauccaa

SEQ ID NO: 3621313 - RNA, 18 nt, Salmonella enterica enterica serovar Typhi
uggcuuuuaagguuaauu

SEQ ID NO: 3621314 - RNA, 12 nt, Salmonella enterica enterica serovar Typhi
uggugcauuuuu

SEQ ID NO: 3621315 - RNA, 16 nt, Salmonella enterica enterica serovar Typhi
uggugccaaucuccag

SEQ ID NO: 3621316 - RNA, 16 nt, Salmonella enterica enterica serovar Typhi
ugguggauauccagca

SEQ ID NO: 3621317 - RNA, 18 nt, Salmonella enterica enterica serovar Typhi
ugguggauauccagcaua

SEQ ID NO: 3621318 - RNA, 23 nt, Salmonella enterica enterica serovar Typhi
ugguggcagaguccagcggcagc

SEQ ID NO: 3621319 - RNA, 16 nt, Salmonella enterica enterica serovar Typhi
ugguggcgaauacugu

SEQ ID NO: 3621320 - RNA, 17 nt, Salmonella enterica enterica serovar Typhi
ugguggcuauagcucag

SEQ ID NO: 3621321 - RNA, 19 nt, Salmonella enterica enterica serovar Typhi
ugguggucauccgcccggc

SEQ ID NO: 3621322 - RNA, 15 nt, Salmonella enterica enterica serovar Typhi
uggugguugcaucau

SEQ ID NO: 3621323 - RNA, 15 nt, Salmonella enterica enterica serovar Typhi
ugguguaggcguagc

SEQ ID NO: 3621324 - RNA, 16 nt, Salmonella enterica enterica serovar Typhi
ugguguuaguuucuau

SEQ ID NO: 3621325 - RNA, 15 nt, Salmonella enterica enterica serovar Typhi
ugguguugguacaca

SEQ ID NO: 3621326 - RNA, 13 nt, Salmonella enterica enterica serovar Typhi
ugguguuuuccag

SEQ ID NO: 3621327 - RNA, 20 nt, Salmonella enterica enterica serovar Typhi
ugguuaaauuaaauaacaaa

SEQ ID NO: 3621328 - RNA, 21 nt, Salmonella enterica enterica serovar Typhi
ugguuaacaauauugcgcuua

SEQ ID NO: 3621329 - RNA, 16 nt, Salmonella enterica enterica serovar Typhi
ugguuaacucaagcga

SEQ ID NO: 3621330 - RNA, 16 nt, Salmonella enterica enterica serovar Typhi
ugguuacuauuuuuca

SEQ ID NO: 3621331 - RNA, 13 nt, Salmonella enterica enterica serovar Typhi
ugguuagcgcucu

SEQ ID NO: 3621332 - RNA, 19 nt, Salmonella enterica enterica serovar Typhi
ugguuauacgguaauaacu

SEQ ID NO: 3621333 - RNA, 19 nt, Salmonella enterica enterica serovar Typhi
ugguuaucaauaaugcgcu

SEQ ID NO: 3621334 - RNA, 17 nt, Salmonella enterica enterica serovar Typhi
ugguuauccagcaggua

SEQ ID NO: 3621335 - RNA, 18 nt, Salmonella enterica enterica serovar Typhi
ugguuaucgaauccagca

SEQ ID NO: 3621336 - RNA, 14 nt, Salmonella enterica enterica serovar Typhi
ugguuauuuucaga

SEQ ID NO: 3621337 - RNA, 22 nt, Salmonella enterica enterica serovar Typhi
ugguucauagaguguuggucuu

SEQ ID NO: 3621338 - RNA, 13 nt, Salmonella enterica enterica serovar Typhi
ugguuccauucca

SEQ ID NO: 3621339 - RNA, 23 nt, Salmonella enterica enterica serovar Typhi
ugguucccugaccuuccauccac

SEQ ID NO: 3621340 - RNA, 14 nt, Salmonella enterica enterica serovar Typhi
ugguucugccagaa

SEQ ID NO: 3621341 - RNA, 13 nt, Salmonella enterica enterica serovar Typhi
ugguugccgcaua

SEQ ID NO: 3621342 - RNA, 15 nt, Salmonella enterica enterica serovar Typhi
ugguuguagcacagc

SEQ ID NO: 3621343 - RNA, 16 nt, Salmonella enterica enterica serovar Typhi
ugguuguagcacagcc

SEQ ID NO: 3621344 - RNA, 23 nt, Salmonella enterica enterica serovar Typhi
ugguugugccaguaaucccgguc

SEQ ID NO: 3621345 - RNA, 23 nt, Salmonella enterica enterica serovar Typhi
ugguuuaauaccgcguaaaaagu

SEQ ID NO: 3621346 - RNA, 20 nt, Salmonella enterica enterica serovar Typhi
ugguuuauguaauuugcaaa

SEQ ID NO: 3621347 - RNA, 19 nt, Salmonella enterica enterica serovar Typhi
ugguuucccugaccaguug

SEQ ID NO: 3621348 - RNA, 13 nt, Salmonella enterica enterica serovar Typhi
ugguuucccugcc

SEQ ID NO: 3621349 - RNA, 17 nt, Salmonella enterica enterica serovar Typhi
ugguuucccugccucaa

SEQ ID NO: 3621350 - RNA, 19 nt, Salmonella enterica enterica serovar Typhi
ugguuucuagucgccggua

SEQ ID NO: 3621351 - RNA, 23 nt, Salmonella enterica enterica serovar Typhi
ugguuuuagcuuaucccauugcg

SEQ ID NO: 3621352 - RNA, 16 nt, Salmonella enterica enterica serovar Typhi
uguaaaaaaauaaaaa

SEQ ID NO: 3621353 - RNA, 21 nt, Salmonella enterica enterica serovar Typhi
uguaaaacgguaugaaacaua

SEQ ID NO: 3621354 - RNA, 20 nt, Salmonella enterica enterica serovar Typhi
uguaaaauccggcaggcagc

SEQ ID NO: 3621355 - RNA, 21 nt, Salmonella enterica enterica serovar Typhi
uguaaacccgauucugccagu

SEQ ID NO: 3621356 - RNA, 12 nt, Salmonella enterica enterica serovar Typhi
uguaaaccggcc

SEQ ID NO: 3621357 - RNA, 20 nt, Salmonella enterica enterica serovar Typhi
uguaaagaaauuuaaagaua

SEQ ID NO: 3621358 - RNA, 15 nt, Salmonella enterica enterica serovar Typhi
uguaaagaaugaaaa

SEQ ID NO: 3621359 - RNA, 16 nt, Salmonella enterica enterica serovar Typhi
uguaacauauuuuuau

SEQ ID NO: 3621360 - RNA, 16 nt, Salmonella enterica enterica serovar Typhi
uguaaccaaagcacca

SEQ ID NO: 3621361 - RNA, 13 nt, Salmonella enterica enterica serovar Typhi
uguaaccaacaaa

SEQ ID NO: 3621362 - RNA, 22 nt, Salmonella enterica enterica serovar Typhi
uguaacgaguugcggcaacgug

SEQ ID NO: 3621363 - RNA, 19 nt, Salmonella enterica enterica serovar Typhi
uguaacuucggccagcgag

SEQ ID NO: 3621364 - RNA, 20 nt, Salmonella enterica enterica serovar Typhi
uguaacuucggccagcgagu

SEQ ID NO: 3621365 - RNA, 15 nt, Salmonella enterica enterica serovar Typhi
uguaauaaccguggc

SEQ ID NO: 3621366 - RNA, 23 nt, Salmonella enterica enterica serovar Typhi
uguaauaccacugcccgccgcca

SEQ ID NO: 3621367 - RNA, 20 nt, Salmonella enterica enterica serovar Typhi
uguaauggcgcucuuuucca

SEQ ID NO: 3621368 - RNA, 22 nt, Salmonella enterica enterica serovar Typhi
uguaauggugggacacugccgg

SEQ ID NO: 3621369 - RNA, 18 nt, Salmonella enterica enterica serovar Typhi
uguaauucaccaaauccu

SEQ ID NO: 3621370 - RNA, 15 nt, Salmonella enterica enterica serovar Typhi
uguaauugcgccagg

SEQ ID NO: 3621371 - RNA, 22 nt, Salmonella enterica enterica serovar Typhi
uguacaaccaucacugaaccca

SEQ ID NO: 3621372 - RNA, 15 nt, Salmonella enterica enterica serovar Typhi
uguacaucacauugc

SEQ ID NO: 3621373 - RNA, 22 nt, Salmonella enterica enterica serovar Typhi
uguacaucacauugccccagcc

SEQ ID NO: 3621374 - RNA, 16 nt, Salmonella enterica enterica serovar Typhi
uguacaucuacuucag

SEQ ID NO: 3621375 - RNA, 19 nt, Salmonella enterica enterica serovar Typhi
uguacccucgcgccaguga

SEQ ID NO: 3621376 - RNA, 21 nt, Salmonella enterica enterica serovar Typhi
uguaccucuacauaacgaaug

SEQ ID NO: 3621377 - RNA, 20 nt, Salmonella enterica enterica serovar Typhi
uguaccugauccagcucuuc

SEQ ID NO: 3621378 - RNA, 13 nt, Salmonella enterica enterica serovar Typhi
uguacgcccagcc

SEQ ID NO: 3621379 - RNA, 22 nt, Salmonella enterica enterica serovar Typhi
uguacggcgucagccacgguuc

SEQ ID NO: 3621380 - RNA, 18 nt, Salmonella enterica enterica serovar Typhi
uguacguaaaaccagcuc

SEQ ID NO: 3621381 - RNA, 15 nt, Salmonella enterica enterica serovar Typhi
uguacguauuuacaa

SEQ ID NO: 3621382 - RNA, 16 nt, Salmonella enterica enterica serovar Typhi
uguacgugaagggaau

SEQ ID NO: 3621383 - RNA, 15 nt, Salmonella enterica enterica serovar Typhi
uguacuccugauagg

SEQ ID NO: 3621384 - RNA, 16 nt, Salmonella enterica enterica serovar Typhi
uguacuugcgccgcca

SEQ ID NO: 3621385 - RNA, 18 nt, Salmonella enterica enterica serovar Typhi
uguacuuuugcuuccagu

SEQ ID NO: 3621386 - RNA, 20 nt, Salmonella enterica enterica serovar Typhi
uguagaaaagaaggggcugg

SEQ ID NO: 3621387 - RNA, 21 nt, Salmonella enterica enterica serovar Typhi
uguagagauucugcaggccaa

SEQ ID NO: 3621388 - RNA, 23 nt, Salmonella enterica enterica serovar Typhi
uguagcaacccuggcgcuuuaaa

SEQ ID NO: 3621389 - RNA, 23 nt, Salmonella enterica enterica serovar Typhi
uguagcaaccucggcuugcuuca

SEQ ID NO: 3621390 - RNA, 16 nt, Salmonella enterica enterica serovar Typhi
uguagcagauagauaa

SEQ ID NO: 3621391 - RNA, 15 nt, Salmonella enterica enterica serovar Typhi
uguagcagcgccagc

SEQ ID NO: 3621392 - RNA, 17 nt, Salmonella enterica enterica serovar Typhi
uguagcagcgccagcgu

SEQ ID NO: 3621393 - RNA, 17 nt, Salmonella enterica enterica serovar Typhi
uguagcgccaaccggcu

SEQ ID NO: 3621394 - RNA, 18 nt, Salmonella enterica enterica serovar Typhi
uguagcggcaacagcacc

SEQ ID NO: 3621395 - RNA, 18 nt, Salmonella enterica enterica serovar Typhi
uguagcucauaacucgcu

SEQ ID NO: 3621396 - RNA, 23 nt, Salmonella enterica enterica serovar Typhi
uguagcugucccagugucaacug

SEQ ID NO: 3621397 - RNA, 16 nt, Salmonella enterica enterica serovar Typhi
uguaggcacuuuccag

SEQ ID NO: 3621398 - RNA, 20 nt, Salmonella enterica enterica serovar Typhi
uguaggcccgguaagcgcag

SEQ ID NO: 3621399 - RNA, 21 nt, Salmonella enterica enterica serovar Typhi
ugucuauuuauugaagaugua

SEQ ID NO: 3621400 - RNA, 19 nt, Salmonella enterica enterica serovar Typhi
ugucucacccguuuucucc

SEQ ID NO: 3621401 - RNA, 13 nt, Salmonella enterica enterica serovar Typhi
ugucuccucagca

SEQ ID NO: 3621402 - RNA, 14 nt, Salmonella enterica enterica serovar Typhi
ugucuccucaugcc

SEQ ID NO: 3621403 - RNA, 17 nt, Salmonella enterica enterica serovar Typhi
ugucucgucgccagggc

SEQ ID NO: 3621404 - RNA, 13 nt, Salmonella enterica enterica serovar Typhi
ugucucuccagua

SEQ ID NO: 3621405 - RNA, 14 nt, Salmonella enterica enterica serovar Typhi
ugucugaaugaguc

SEQ ID NO: 3621406 - RNA, 18 nt, Salmonella enterica enterica serovar Typhi
ugucugcuuugguauccu

SEQ ID NO: 3621407 - RNA, 15 nt, Salmonella enterica enterica serovar Typhi
ugucuuaaagaaaaa

SEQ ID NO: 3621408 - RNA, 19 nt, Salmonella enterica enterica serovar Typhi
ugucuuaccuaacggauaa

SEQ ID NO: 3621409 - RNA, 13 nt, Salmonella enterica enterica serovar Typhi
ugucuucaucuau

SEQ ID NO: 3621410 - RNA, 14 nt, Salmonella enterica enterica serovar Typhi
ugucuucugccagc

SEQ ID NO: 3621411 - RNA, 15 nt, Salmonella enterica enterica serovar Typhi
ugucuugcuaucaaa

SEQ ID NO: 3621412 - RNA, 13 nt, Salmonella enterica enterica serovar Typhi
ugucuuuauuacg

SEQ ID NO: 3621413 - RNA, 14 nt, Salmonella enterica enterica serovar Typhi
ugugaaguccguau

SEQ ID NO: 3621414 - RNA, 13 nt, Salmonella enterica enterica serovar Typhi
ugugaauaaagga

SEQ ID NO: 3621415 - RNA, 17 nt, Salmonella enterica enterica serovar Typhi
ugugaccagcaguuccg

SEQ ID NO: 3621416 - RNA, 21 nt, Salmonella enterica enterica serovar Typhi
ugugaccagcaguuccggcgu

SEQ ID NO: 3621417 - RNA, 23 nt, Salmonella enterica enterica serovar Typhi
ugugaccagcaguuccggcguaa

SEQ ID NO: 3621418 - RNA, 14 nt, Salmonella enterica enterica serovar Typhi
ugugaccccggccu

SEQ ID NO: 3621419 - RNA, 14 nt, Salmonella enterica enterica serovar Typhi
ugugacggcauguc

SEQ ID NO: 3621420 - RNA, 23 nt, Salmonella enterica enterica serovar Typhi
ugugagaaaagcgaaaauaaacg

SEQ ID NO: 3621421 - RNA, 20 nt, Salmonella enterica enterica serovar Typhi
ugugagauaaaaaagcugcg

SEQ ID NO: 3621422 - RNA, 23 nt, Salmonella enterica enterica serovar Typhi
ugugagccauaacaacuauuuuu

SEQ ID NO: 3621423 - RNA, 11 nt, Salmonella enterica enterica serovar Typhi
ugugauaaaug

SEQ ID NO: 3621424 - RNA, 21 nt, Salmonella enterica enterica serovar Typhi
ugugauaaggcuaaucgcauu

SEQ ID NO: 3621425 - RNA, 16 nt, Salmonella enterica enterica serovar Typhi
ugugauacgcuuuagg

SEQ ID NO: 3621426 - RNA, 15 nt, Salmonella enterica enterica serovar Typhi
ugugaucaccgcccu

SEQ ID NO: 3621427 - RNA, 21 nt, Salmonella enterica enterica serovar Typhi
ugugauccgcccccuccagua

SEQ ID NO: 3621428 - RNA, 22 nt, Salmonella enterica enterica serovar Typhi
ugugaucgccgcgaggaaaauc

SEQ ID NO: 3621429 - RNA, 17 nt, Salmonella enterica enterica serovar Typhi
ugugaucugguuuggua

SEQ ID NO: 3621430 - RNA, 14 nt, Salmonella enterica enterica serovar Typhi
ugugauuaauccaa

SEQ ID NO: 3621431 - RNA, 22 nt, Salmonella enterica enterica serovar Typhi
ugugauugcagauaauuuugca

SEQ ID NO: 3621432 - RNA, 16 nt, Salmonella enterica enterica serovar Typhi
ugugauuuugcuggug

SEQ ID NO: 3621433 - RNA, 15 nt, Salmonella enterica enterica serovar Typhi
ugugcacagguaaac

SEQ ID NO: 3621434 - RNA, 19 nt, Salmonella enterica enterica serovar Typhi
ugugcagcaggacgcgcac

SEQ ID NO: 3621435 - RNA, 12 nt, Salmonella enterica enterica serovar Typhi
ugugcaggagca

SEQ ID NO: 3621436 - RNA, 15 nt, Salmonella enterica enterica serovar Typhi
ugugccauacuguuu

SEQ ID NO: 3621437 - RNA, 17 nt, Salmonella enterica enterica serovar Typhi
ugugccggaaaucgcgg

SEQ ID NO: 3621438 - RNA, 16 nt, Salmonella enterica enterica serovar Typhi
ugugccgguaagaaga

SEQ ID NO: 3621439 - RNA, 15 nt, Salmonella enterica enterica serovar Typhi
ugugccgucauccag

SEQ ID NO: 3621440 - RNA, 18 nt, Salmonella enterica enterica serovar Typhi
ugugcgccagccuuaucc

SEQ ID NO: 3621441 - RNA, 19 nt, Salmonella enterica enterica serovar Typhi
ugugcguauugagcgcagu

SEQ ID NO: 3621442 - RNA, 20 nt, Salmonella enterica enterica serovar Typhi
ugugcgucgcguucgcauau

SEQ ID NO: 3621443 - RNA, 21 nt, Salmonella enterica enterica serovar Typhi
ugugcgugacccacaguuuca

SEQ ID NO: 3621444 - RNA, 16 nt, Salmonella enterica enterica serovar Typhi
ugugcugauugucagc

SEQ ID NO: 3621445 - RNA, 22 nt, Salmonella enterica enterica serovar Typhi
ugugcuuaucacguagccagag

SEQ ID NO: 3621446 - RNA, 12 nt, Salmonella enterica enterica serovar Typhi
ugugcuuccagc

SEQ ID NO: 3621447 - RNA, 15 nt, Salmonella enterica enterica serovar Typhi
ugugcuuccagcucc

SEQ ID NO: 3621448 - RNA, 17 nt, Salmonella enterica enterica serovar Typhi
ugugcuuccagcuccau

SEQ ID NO: 3621449 - RNA, 18 nt, Salmonella enterica enterica serovar Typhi
ugugcuuccagcuccauc

SEQ ID NO: 3621450 - RNA, 11 nt, Salmonella enterica enterica serovar Typhi
ugugcuuuagc

SEQ ID NO: 3621451 - RNA, 21 nt, Salmonella enterica enterica serovar Typhi
uguggaaaacagcgccggcag

SEQ ID NO: 3621452 - RNA, 15 nt, Salmonella enterica enterica serovar Typhi
uguggagguuucuuc

SEQ ID NO: 3621453 - RNA, 14 nt, Salmonella enterica enterica serovar Typhi
uguggccaggcacg

SEQ ID NO: 3621454 - RNA, 16 nt, Salmonella enterica enterica serovar Typhi
uguggcgcggccugga

SEQ ID NO: 3621455 - RNA, 15 nt, Salmonella enterica enterica serovar Typhi
uguggcugucgaccg

SEQ ID NO: 3621456 - RNA, 19 nt, Salmonella enterica enterica serovar Typhi
uguggcuguguucauccca

SEQ ID NO: 3621457 - RNA, 13 nt, Salmonella enterica enterica serovar Typhi
uguggugcggcuu

SEQ ID NO: 3621458 - RNA, 19 nt, Salmonella enterica enterica serovar Typhi
ugugguguuccauugcugc

SEQ ID NO: 3621459 - RNA, 18 nt, Salmonella enterica enterica serovar Typhi
ugugguugugguaaucaa

SEQ ID NO: 3621460 - RNA, 13 nt, Salmonella enterica enterica serovar Typhi
ugugguuuaaaac

SEQ ID NO: 3621461 - RNA, 13 nt, Salmonella enterica enterica serovar Typhi
uguguacaaccau

SEQ ID NO: 3621462 - RNA, 21 nt, Salmonella enterica enterica serovar Typhi
uguguacauccagaaggcaaa

SEQ ID NO: 3621463 - RNA, 18 nt, Salmonella enterica enterica serovar Typhi
uguguaccagcagcgcca

SEQ ID NO: 3621464 - RNA, 22 nt, Salmonella enterica enterica serovar Typhi
uguguaccagcagcgccagcga

SEQ ID NO: 3621465 - RNA, 22 nt, Salmonella enterica enterica serovar Typhi
uguguagagauucugcaggcca

SEQ ID NO: 3621466 - RNA, 14 nt, Salmonella enterica enterica serovar Typhi
uguguauauauugc

SEQ ID NO: 3621467 - RNA, 21 nt, Salmonella enterica enterica serovar Typhi
uguguauauauugcauuuuau

SEQ ID NO: 3621468 - RNA, 21 nt, Salmonella enterica enterica serovar Typhi
uguguaucgcccugccagcuc

SEQ ID NO: 3621469 - RNA, 14 nt, Salmonella enterica enterica serovar Typhi
ugugucaaaaaguu

SEQ ID NO: 3621470 - RNA, 14 nt, Salmonella enterica enterica serovar Typhi
ugugucaccacggg

SEQ ID NO: 3621471 - RNA, 15 nt, Salmonella enterica enterica serovar Typhi
ugugucggccggaua

SEQ ID NO: 3621472 - RNA, 15 nt, Salmonella enterica enterica serovar Typhi
ugugucguccaggcc

SEQ ID NO: 3621473 - RNA, 18 nt, Salmonella enterica enterica serovar Typhi
uguguuuggccgccggaa

SEQ ID NO: 3621474 - RNA, 14 nt, Salmonella enterica enterica serovar Typhi
uguguuuuuuaaua

SEQ ID NO: 3621475 - RNA, 19 nt, Salmonella enterica enterica serovar Typhi
uguuaaaaagaccaugaac

SEQ ID NO: 3621476 - RNA, 14 nt, Salmonella enterica enterica serovar Typhi
uguuaaaaccggcu

SEQ ID NO: 3621477 - RNA, 22 nt, Salmonella enterica enterica serovar Typhi
uguuaaccagauaagccugugc

SEQ ID NO: 3621478 - RNA, 20 nt, Salmonella enterica enterica serovar Typhi
uguuaaucauuuucuuugca

SEQ ID NO: 3621479 - RNA, 16 nt, Salmonella enterica enterica serovar Typhi
uguuaaugguaccaau

SEQ ID NO: 3621480 - RNA, 14 nt, Salmonella enterica enterica serovar Typhi
uguuaauugucagc

SEQ ID NO: 3621481 - RNA, 22 nt, Salmonella enterica enterica serovar Typhi
uguuagacauuccauuggccag

SEQ ID NO: 3621482 - RNA, 16 nt, Salmonella enterica enterica serovar Typhi
uguuagcaaaaaugcc

SEQ ID NO: 3621483 - RNA, 14 nt, Salmonella enterica enterica serovar Typhi
uguuaguuucuauu

SEQ ID NO: 3621484 - RNA, 15 nt, Salmonella enterica enterica serovar Typhi
uguuaguuucuauua

SEQ ID NO: 3621485 - RNA, 16 nt, Salmonella enterica enterica serovar Typhi
uguuuuuuaauauauu

SEQ ID NO: 3621486 - RNA, 23 nt, Salmonella enterica enterica serovar Typhi
uguuuuuucaucuccgauaaaua

SEQ ID NO: 3621487 - RNA, 16 nt, Salmonella enterica enterica serovar Typhi
uguuuuuuguaggccg

SEQ ID NO: 3621488 - RNA, 11 nt, Salmonella enterica enterica serovar Typhi
uuaaaaaaacg

SEQ ID NO: 3621489 - RNA, 23 nt, Salmonella enterica enterica serovar Typhi
uuaaaaaaggcagaagaaucugc

SEQ ID NO: 3621490 - RNA, 15 nt, Salmonella enterica enterica serovar Typhi
uuaaaaaauccugca

SEQ ID NO: 3621491 - RNA, 13 nt, Salmonella enterica enterica serovar Typhi
uuaaaaacagcca

SEQ ID NO: 3621492 - RNA, 22 nt, Salmonella enterica enterica serovar Typhi
uuaaaaacagguugcguaacgc

SEQ ID NO: 3621493 - RNA, 12 nt, Salmonella enterica enterica serovar Typhi
uuaaaaacauca

SEQ ID NO: 3621494 - RNA, 18 nt, Salmonella enterica enterica serovar Typhi
uuaaaaaccaggcaaaaa

SEQ ID NO: 3621495 - RNA, 14 nt, Salmonella enterica enterica serovar Typhi
uuaaaaagcugcau

SEQ ID NO: 3621496 - RNA, 17 nt, Salmonella enterica enterica serovar Typhi
uuaaaaagcugcauaau

SEQ ID NO: 3621497 - RNA, 22 nt, Salmonella enterica enterica serovar Typhi
uuaaaaauauccuguaacucau

SEQ ID NO: 3621498 - RNA, 17 nt, Salmonella enterica enterica serovar Typhi
uuaaaagggaguauuua

SEQ ID NO: 3621499 - RNA, 23 nt, Salmonella enterica enterica serovar Typhi
uuaaaauaaaugaggcuguuuuu

SEQ ID NO: 3621500 - RNA, 16 nt, Salmonella enterica enterica serovar Typhi
uuaaaauccggcugcc

SEQ ID NO: 3621501 - RNA, 18 nt, Salmonella enterica enterica serovar Typhi
uuaaaaucugguggccgg

SEQ ID NO: 3621502 - RNA, 11 nt, Salmonella enterica enterica serovar Typhi
uuaaaaugacc

SEQ ID NO: 3621503 - RNA, 21 nt, Salmonella enterica enterica serovar Typhi
uuaaaaugcggggacuggaug

SEQ ID NO: 3621504 - RNA, 18 nt, Salmonella enterica enterica serovar Typhi
uuaaacagcgaucacgcc

SEQ ID NO: 3621505 - RNA, 22 nt, Salmonella enterica enterica serovar Typhi
uuaaacgauccugacgcaaugg

SEQ ID NO: 3621506 - RNA, 23 nt, Salmonella enterica enterica serovar Typhi
uuaaagcacaagaacuuaaauua

SEQ ID NO: 3621507 - RNA, 23 nt, Salmonella enterica enterica serovar Typhi
uuaaagccgaccaucgcgccgcu

SEQ ID NO: 3621508 - RNA, 13 nt, Salmonella enterica enterica serovar Typhi
uuaaagccuucau

SEQ ID NO: 3621509 - RNA, 19 nt, Salmonella enterica enterica serovar Typhi
uuaaaguacuucacaauca

SEQ ID NO: 3621510 - RNA, 21 nt, Salmonella enterica enterica serovar Typhi
uuaaaguuaguaccgaacagc

SEQ ID NO: 3621511 - RNA, 23 nt, Salmonella enterica enterica serovar Typhi
uuaaauacugcaacggcgaggug

SEQ ID NO: 3621512 - RNA, 17 nt, Salmonella enterica enterica serovar Typhi
uuaaauaugaaagagaa

SEQ ID NO: 3621513 - RNA, 14 nt, Salmonella enterica enterica serovar Typhi
uuaaaucagauaac

SEQ ID NO: 3621514 - RNA, 16 nt, Salmonella enterica enterica serovar Typhi
uuaaaucagauaacaa

SEQ ID NO: 3621515 - RNA, 16 nt, Salmonella enterica enterica serovar Typhi
uuaaaucaucauaauc

SEQ ID NO: 3621516 - RNA, 17 nt, Salmonella enterica enterica serovar Typhi
uuaaaucgcgcaaauau

SEQ ID NO: 3621517 - RNA, 18 nt, Salmonella enterica enterica serovar Typhi
uuaaaucgcgcaaauauu

SEQ ID NO: 3621518 - RNA, 20 nt, Salmonella enterica enterica serovar Typhi
uuaaaugccuguuuauauuc

SEQ ID NO: 3621519 - RNA, 13 nt, Salmonella enterica enterica serovar Typhi
uuaaaugcgccca

SEQ ID NO: 3621520 - RNA, 16 nt, Salmonella enterica enterica serovar Typhi
uuaaaugcuugcuuua

SEQ ID NO: 3621521 - RNA, 14 nt, Salmonella enterica enterica serovar Typhi
uuaaaugucugaau

SEQ ID NO: 3621522 - RNA, 20 nt, Salmonella enterica enterica serovar Typhi
uuaaauuaaugauuaaaaua

SEQ ID NO: 3621523 - RNA, 21 nt, Salmonella enterica enterica serovar Typhi
uuaaauuaaugauuaaaauaa

SEQ ID NO: 3621524 - RNA, 15 nt, Salmonella enterica enterica serovar Typhi
uuaaauuuuuaauaa

SEQ ID NO: 3621525 - RNA, 12 nt, Salmonella enterica enterica serovar Typhi
uuaacaaaucau

SEQ ID NO: 3621526 - RNA, 20 nt, Salmonella enterica enterica serovar Typhi
uuaacaauccccgucacagc

SEQ ID NO: 3621527 - RNA, 16 nt, Salmonella enterica enterica serovar Typhi
uuaacacauauaagua

SEQ ID NO: 3621528 - RNA, 15 nt, Salmonella enterica enterica serovar Typhi
uuaacacccggauau

SEQ ID NO: 3621529 - RNA, 18 nt, Salmonella enterica enterica serovar Typhi
uuaacagaauugcgccac

SEQ ID NO: 3621530 - RNA, 16 nt, Salmonella enterica enterica serovar Typhi
uuaacaucaccuuuca

SEQ ID NO: 3621531 - RNA, 13 nt, Salmonella enterica enterica serovar Typhi
uuaacaucagaaa

SEQ ID NO: 3621532 - RNA, 16 nt, Salmonella enterica enterica serovar Typhi
uuaacaucagaaaaaa

SEQ ID NO: 3621533 - RNA, 17 nt, Salmonella enterica enterica serovar Typhi
uuaacaucaucaggccu

SEQ ID NO: 3621534 - RNA, 18 nt, Salmonella enterica enterica serovar Typhi
uuaacauuuaagaaacaa

SEQ ID NO: 3621535 - RNA, 15 nt, Salmonella enterica enterica serovar Typhi
uuaaccagcaguccu

SEQ ID NO: 3621536 - RNA, 21 nt, Salmonella enterica enterica serovar Typhi
uuaacccagauaucagucugc

SEQ ID NO: 3621537 - RNA, 13 nt, Salmonella enterica enterica serovar Typhi
uuaacccugccgu

SEQ ID NO: 3621538 - RNA, 16 nt, Salmonella enterica enterica serovar Typhi
uuaacgaagguaaacg

SEQ ID NO: 3621539 - RNA, 15 nt, Salmonella enterica enterica serovar Typhi
uuaacgacaaaaaua

SEQ ID NO: 3621540 - RNA, 18 nt, Salmonella enterica enterica serovar Typhi
uuaacgccgccaucagua

SEQ ID NO: 3621541 - RNA, 21 nt, Salmonella enterica enterica serovar Typhi
uuaacgcguaaucuuccaccc

SEQ ID NO: 3621542 - RNA, 16 nt, Salmonella enterica enterica serovar Typhi
uuaacggcaaaaacgu

SEQ ID NO: 3621543 - RNA, 19 nt, Salmonella enterica enterica serovar Typhi
uuaacuaauggcaauaaua

SEQ ID NO: 3621544 - RNA, 18 nt, Salmonella enterica enterica serovar Typhi
uuaacucuuugagcgccc

SEQ ID NO: 3621545 - RNA, 21 nt, Salmonella enterica enterica serovar Typhi
uuaagaacgguuggaauaauu

SEQ ID NO: 3621546 - RNA, 23 nt, Salmonella enterica enterica serovar Typhi
uuaagacgcuucauaucgcccag

SEQ ID NO: 3621547 - RNA, 16 nt, Salmonella enterica enterica serovar Typhi
uuaagauuuaaaacaa

SEQ ID NO: 3621548 - RNA, 19 nt, Salmonella enterica enterica serovar Typhi
uuaagcaacguuuccgcua

SEQ ID NO: 3621549 - RNA, 16 nt, Salmonella enterica enterica serovar Typhi
uuaagcaccgcuuugg

SEQ ID NO: 3621550 - RNA, 19 nt, Salmonella enterica enterica serovar Typhi
uuaagccgggucagccccc

SEQ ID NO: 3621551 - RNA, 22 nt, Salmonella enterica enterica serovar Typhi
uuaagcggauuuuuucgcuuuu

SEQ ID NO: 3621552 - RNA, 18 nt, Salmonella enterica enterica serovar Typhi
uuaagcgggucccagaag

SEQ ID NO: 3621553 - RNA, 18 nt, Salmonella enterica enterica serovar Typhi
uuaagcuuaaugauaauu

SEQ ID NO: 3621554 - RNA, 21 nt, Salmonella enterica enterica serovar Typhi
uuaagcuuugcaccacuuugu

SEQ ID NO: 3621555 - RNA, 15 nt, Salmonella enterica enterica serovar Typhi
uuaaggcaucaauac

SEQ ID NO: 3621556 - RNA, 19 nt, Salmonella enterica enterica serovar Typhi
uuaaggccgcaaacagcac

SEQ ID NO: 3621557 - RNA, 14 nt, Salmonella enterica enterica serovar Typhi
uuaagucaucuguu

SEQ ID NO: 3621558 - RNA, 21 nt, Salmonella enterica enterica serovar Typhi
uuaaguuuuacugaugccagc

SEQ ID NO: 3621559 - RNA, 13 nt, Salmonella enterica enterica serovar Typhi
uuaauaaaaucua

SEQ ID NO: 3621560 - RNA, 18 nt, Salmonella enterica enterica serovar Typhi
uuaauaaugaacaugacg

SEQ ID NO: 3621561 - RNA, 11 nt, Salmonella enterica enterica serovar Typhi
uuaauacacga

SEQ ID NO: 3621562 - RNA, 17 nt, Salmonella enterica enterica serovar Typhi
uuaauacacgauaaacc

SEQ ID NO: 3621563 - RNA, 15 nt, Salmonella enterica enterica serovar Typhi
uuaauacaucagaaa

SEQ ID NO: 3621564 - RNA, 18 nt, Salmonella enterica enterica serovar Typhi
uuaauacaucagaaaaca

SEQ ID NO: 3621565 - RNA, 21 nt, Salmonella enterica enterica serovar Typhi
uuaauacaucaugcuugcuuu

SEQ ID NO: 3621566 - RNA, 21 nt, Salmonella enterica enterica serovar Typhi
uuaauaccagcgccaaucacu

SEQ ID NO: 3621567 - RNA, 22 nt, Salmonella enterica enterica serovar Typhi
uuaauaccaucuccaucgggcu

SEQ ID NO: 3621568 - RNA, 14 nt, Salmonella enterica enterica serovar Typhi
uuaauacccauagu

SEQ ID NO: 3621569 - RNA, 24 nt, Salmonella enterica enterica serovar Typhi
uuaauaccgugcaggacagacaga

SEQ ID NO: 3621570 - RNA, 17 nt, Salmonella enterica enterica serovar Typhi
uuaccguuugucuucug

SEQ ID NO: 3621571 - RNA, 19 nt, Salmonella enterica enterica serovar Typhi
uuaccuacgcgauaaaaaa

SEQ ID NO: 3621572 - RNA, 21 nt, Salmonella enterica enterica serovar Typhi
uuaccuacuguggugugccug

SEQ ID NO: 3621573 - RNA, 22 nt, Salmonella enterica enterica serovar Typhi
uuaccugcgcaaucaugacaga

SEQ ID NO: 3621574 - RNA, 23 nt, Salmonella enterica enterica serovar Typhi
uuaccuucauuguccucggcaac

SEQ ID NO: 3621575 - RNA, 15 nt, Salmonella enterica enterica serovar Typhi
uuaccuucugccgcg

SEQ ID NO: 3621576 - RNA, 17 nt, Salmonella enterica enterica serovar Typhi
uuaccuuguucuuccau

SEQ ID NO: 3621577 - RNA, 13 nt, Salmonella enterica enterica serovar Typhi
uuacgaaaagguc

SEQ ID NO: 3621578 - RNA, 22 nt, Salmonella enterica enterica serovar Typhi
uuacgaccgcagaaacagauag

SEQ ID NO: 3621579 - RNA, 21 nt, Salmonella enterica enterica serovar Typhi
uuacgacgauaaggccaauau

SEQ ID NO: 3621580 - RNA, 22 nt, Salmonella enterica enterica serovar Typhi
uuacgacgggucagauucagca

SEQ ID NO: 3621581 - RNA, 20 nt, Salmonella enterica enterica serovar Typhi
uuacgagugcguucuuccac

SEQ ID NO: 3621582 - RNA, 21 nt, Salmonella enterica enterica serovar Typhi
uuacgauacguuuaaaaugaa

SEQ ID NO: 3621583 - RNA, 19 nt, Salmonella enterica enterica serovar Typhi
uuacgcaagagagcaacau

SEQ ID NO: 3621584 - RNA, 17 nt, Salmonella enterica enterica serovar Typhi
uuacgcacgccagauaa

SEQ ID NO: 3621585 - RNA, 13 nt, Salmonella enterica enterica serovar Typhi
uuacgcacuuuua

SEQ ID NO: 3621586 - RNA, 22 nt, Salmonella enterica enterica serovar Typhi
uuacgcagcaagaacagagcaa

SEQ ID NO: 3621587 - RNA, 20 nt, Salmonella enterica enterica serovar Typhi
uuacgccauaaaaagcguac

SEQ ID NO: 3621588 - RNA, 12 nt, Salmonella enterica enterica serovar Typhi
uuacgccgccau

SEQ ID NO: 3621589 - RNA, 17 nt, Salmonella enterica enterica serovar Typhi
uuacgcuauagcuauca

SEQ ID NO: 3621590 - RNA, 23 nt, Salmonella enterica enterica serovar Typhi
uuacgcuuaauggcgucaaucaa

SEQ ID NO: 3621591 - RNA, 20 nt, Salmonella enterica enterica serovar Typhi
uuacgcuuacccggccuaca

SEQ ID NO: 3621592 - RNA, 18 nt, Salmonella enterica enterica serovar Typhi
uuacgcuuccugccguga

SEQ ID NO: 3621593 - RNA, 15 nt, Salmonella enterica enterica serovar Typhi
uuacggaaaaaauac

SEQ ID NO: 3621594 - RNA, 22 nt, Salmonella enterica enterica serovar Typhi
uuacggacugcggccugcaaag

SEQ ID NO: 3621595 - RNA, 16 nt, Salmonella enterica enterica serovar Typhi
uuacggauaaaaaccc

SEQ ID NO: 3621596 - RNA, 21 nt, Salmonella enterica enterica serovar Typhi
uuacggcacauaggcaaacac

SEQ ID NO: 3621597 - RNA, 15 nt, Salmonella enterica enterica serovar Typhi
uuacgggaacagaau

SEQ ID NO: 3621598 - RNA, 12 nt, Salmonella enterica enterica serovar Typhi
uuacguaacugc

SEQ ID NO: 3621599 - RNA, 23 nt, Salmonella enterica enterica serovar Typhi
uuacguguaguuauaaauuuauu

SEQ ID NO: 3621600 - RNA, 19 nt, Salmonella enterica enterica serovar Typhi
uuacguuaaguucaaggau

SEQ ID NO: 3621601 - RNA, 15 nt, Salmonella enterica enterica serovar Typhi
uuacguugauuauca

SEQ ID NO: 3621602 - RNA, 23 nt, Salmonella enterica enterica serovar Typhi
uuacguugguauucaacgccauc

SEQ ID NO: 3621603 - RNA, 15 nt, Salmonella enterica enterica serovar Typhi
uuacuaauaaauauu

SEQ ID NO: 3621604 - RNA, 17 nt, Salmonella enterica enterica serovar Typhi
uuacuaauaaauauuca

SEQ ID NO: 3621605 - RNA, 13 nt, Salmonella enterica enterica serovar Typhi
uuacuaucuucaa

SEQ ID NO: 3621606 - RNA, 14 nt, Salmonella enterica enterica serovar Typhi
uuacuauuuuucac

SEQ ID NO: 3621607 - RNA, 14 nt, Salmonella enterica enterica serovar Typhi
uuacucacugccgc

SEQ ID NO: 3621608 - RNA, 15 nt, Salmonella enterica enterica serovar Typhi
uuacucaguuugccg

SEQ ID NO: 3621609 - RNA, 22 nt, Salmonella enterica enterica serovar Typhi
uuacucccgucgccuguuucug

SEQ ID NO: 3621610 - RNA, 21 nt, Salmonella enterica enterica serovar Typhi
uuacucccuggugacgcgcau

SEQ ID NO: 3621611 - RNA, 15 nt, Salmonella enterica enterica serovar Typhi
uuacucucauguuca

SEQ ID NO: 3621612 - RNA, 12 nt, Salmonella enterica enterica serovar Typhi
uuacucuuccac

SEQ ID NO: 3621613 - RNA, 14 nt, Salmonella enterica enterica serovar Typhi
uuacucuuccacca

SEQ ID NO: 3621614 - RNA, 15 nt, Salmonella enterica enterica serovar Typhi
uuacucuuccugcug

SEQ ID NO: 3621615 - RNA, 14 nt, Salmonella enterica enterica serovar Typhi
uuacugacaauaag

SEQ ID NO: 3621616 - RNA, 15 nt, Salmonella enterica enterica serovar Typhi
uuacugacaauaagu

SEQ ID NO: 3621617 - RNA, 16 nt, Salmonella enterica enterica serovar Typhi
uuacugcaagcgaugu

SEQ ID NO: 3621618 - RNA, 13 nt, Salmonella enterica enterica serovar Typhi
uuacugcgaaggc

SEQ ID NO: 3621619 - RNA, 20 nt, Salmonella enterica enterica serovar Typhi
uuacugcgccagccugcugg

SEQ ID NO: 3621620 - RNA, 23 nt, Salmonella enterica enterica serovar Typhi
uuacugcuuugaucacccacacc

SEQ ID NO: 3621621 - RNA, 14 nt, Salmonella enterica enterica serovar Typhi
uuacugugccgccg

SEQ ID NO: 3621622 - RNA, 17 nt, Salmonella enterica enterica serovar Typhi
uuacugugccgccggug

SEQ ID NO: 3621623 - RNA, 12 nt, Salmonella enterica enterica serovar Typhi
uuacuucaggcu

SEQ ID NO: 3621624 - RNA, 15 nt, Salmonella enterica enterica serovar Typhi
uuacuuucauuccuu

SEQ ID NO: 3621625 - RNA, 20 nt, Salmonella enterica enterica serovar Typhi
uuagaaaaaauuaaaaauac

SEQ ID NO: 3621626 - RNA, 16 nt, Salmonella enterica enterica serovar Typhi
uuagaaaauacugcua

SEQ ID NO: 3621627 - RNA, 15 nt, Salmonella enterica enterica serovar Typhi
uuagaagugaagaau

SEQ ID NO: 3621628 - RNA, 22 nt, Salmonella enterica enterica serovar Typhi
uuagaauagaaucaauuucucu

SEQ ID NO: 3621629 - RNA, 13 nt, Salmonella enterica enterica serovar Typhi
uuagaaucucuga

SEQ ID NO: 3621630 - RNA, 13 nt, Salmonella enterica enterica serovar Typhi
uuagacaagcagu

SEQ ID NO: 3621631 - RNA, 19 nt, Salmonella enterica enterica serovar Typhi
uuagagaguaaaaccggca

SEQ ID NO: 3621632 - RNA, 13 nt, Salmonella enterica enterica serovar Typhi
uuagagccuaucc

SEQ ID NO: 3621633 - RNA, 21 nt, Salmonella enterica enterica serovar Typhi
uuagcaacacagacuuugcac

SEQ ID NO: 3621634 - RNA, 22 nt, Salmonella enterica enterica serovar Typhi
uuagcaaccagcuaaccuguuc

SEQ ID NO: 3621635 - RNA, 20 nt, Salmonella enterica enterica serovar Typhi
uuagcaauugccauaaaaac

SEQ ID NO: 3621636 - RNA, 17 nt, Salmonella enterica enterica serovar Typhi
uuagcacagcucuaauu

SEQ ID NO: 3621637 - RNA, 22 nt, Salmonella enterica enterica serovar Typhi
uuagcacccaccaucacuucca

SEQ ID NO: 3621638 - RNA, 15 nt, Salmonella enterica enterica serovar Typhi
uuagcaugacaauaa

SEQ ID NO: 3621639 - RNA, 16 nt, Salmonella enterica enterica serovar Typhi
uuagccaaagcgguaa

SEQ ID NO: 3621640 - RNA, 14 nt, Salmonella enterica enterica serovar Typhi
uuagccacgccguc

SEQ ID NO: 3621641 - RNA, 17 nt, Salmonella enterica enterica serovar Typhi
uuagcccaaaaggcuca

SEQ ID NO: 3621642 - RNA, 20 nt, Salmonella enterica enterica serovar Typhi
uuagccggacgagcugcgcg

SEQ ID NO: 3621643 - RNA, 19 nt, Salmonella enterica enterica serovar Typhi
uuagcgaacguccagcggc

SEQ ID NO: 3621644 - RNA, 14 nt, Salmonella enterica enterica serovar Typhi
uuagcgcacaaaaa

SEQ ID NO: 3621645 - RNA, 19 nt, Salmonella enterica enterica serovar Typhi
uuagcgcauuuuuaucagg

SEQ ID NO: 3621646 - RNA, 17 nt, Salmonella enterica enterica serovar Typhi
uuagcgguacucuuuuu

SEQ ID NO: 3621647 - RNA, 22 nt, Salmonella enterica enterica serovar Typhi
uuagcucuuucauuucugccug

SEQ ID NO: 3621648 - RNA, 12 nt, Salmonella enterica enterica serovar Typhi
uuagcuuccagc

SEQ ID NO: 3621649 - RNA, 17 nt, Salmonella enterica enterica serovar Typhi
uuaggcacuaccaccuc

SEQ ID NO: 3621650 - RNA, 23 nt, Salmonella enterica enterica serovar Typhi
uuaggcggcuucacgccauccag

SEQ ID NO: 3621651 - RNA, 11 nt, Salmonella enterica enterica serovar Typhi
uuaggcguggu

SEQ ID NO: 3621652 - RNA, 18 nt, Salmonella enterica enterica serovar Typhi
uuaggguagaaaaaggua

SEQ ID NO: 3621653 - RNA, 11 nt, Salmonella enterica enterica serovar Typhi
uuaguaacccc

SEQ ID NO: 3621654 - RNA, 13 nt, Salmonella enterica enterica serovar Typhi
uuaguaacuuaca

SEQ ID NO: 3621655 - RNA, 19 nt, Salmonella enterica enterica serovar Typhi
uuaguaccgaacagccagg

SEQ ID NO: 3621656 - RNA, 14 nt, Salmonella enterica enterica serovar Typhi
uuauuacagacagu

SEQ ID NO: 3621657 - RNA, 20 nt, Salmonella enterica enterica serovar Typhi
uuauuacgcaagaucacaua

SEQ ID NO: 3621658 - RNA, 22 nt, Salmonella enterica enterica serovar Typhi
uuauuacgcgcucucauaagcc

SEQ ID NO: 3621659 - RNA, 20 nt, Salmonella enterica enterica serovar Typhi
uuauucacgcuauguuugcu

SEQ ID NO: 3621660 - RNA, 17 nt, Salmonella enterica enterica serovar Typhi
uuauucccauuccugca

SEQ ID NO: 3621661 - RNA, 15 nt, Salmonella enterica enterica serovar Typhi
uuauuccgaauacgg

SEQ ID NO: 3621662 - RNA, 21 nt, Salmonella enterica enterica serovar Typhi
uuauuccuuuuuaggcuauaa

SEQ ID NO: 3621663 - RNA, 22 nt, Salmonella enterica enterica serovar Typhi
uuauucgcauguugacugcgcu

SEQ ID NO: 3621664 - RNA, 19 nt, Salmonella enterica enterica serovar Typhi
uuauucggaaugaugugcu

SEQ ID NO: 3621665 - RNA, 17 nt, Salmonella enterica enterica serovar Typhi
uuauucggucagauaaa

SEQ ID NO: 3621666 - RNA, 20 nt, Salmonella enterica enterica serovar Typhi
uuauucggucagauaaauaa

SEQ ID NO: 3621667 - RNA, 21 nt, Salmonella enterica enterica serovar Typhi
uuauugaccaucgccagccau

SEQ ID NO: 3621668 - RNA, 15 nt, Salmonella enterica enterica serovar Typhi
uuauugcguugcuuu

SEQ ID NO: 3621669 - RNA, 20 nt, Salmonella enterica enterica serovar Typhi
uuauuggugaaaaaucauua

SEQ ID NO: 3621670 - RNA, 11 nt, Salmonella enterica enterica serovar Typhi
uuauugugcac

SEQ ID NO: 3621671 - RNA, 13 nt, Salmonella enterica enterica serovar Typhi
uuauuuaauucuu

SEQ ID NO: 3621672 - RNA, 15 nt, Salmonella enterica enterica serovar Typhi
uuauuuaauugcuau

SEQ ID NO: 3621673 - RNA, 16 nt, Salmonella enterica enterica serovar Typhi
uuauuucaagcaauac

SEQ ID NO: 3621674 - RNA, 10 nt, Salmonella enterica enterica serovar Typhi
uuauuucuau

SEQ ID NO: 3621675 - RNA, 11 nt, Salmonella enterica enterica serovar Typhi
uuauuucuauc

SEQ ID NO: 3621676 - RNA, 11 nt, Salmonella enterica enterica serovar Typhi
uuauuuuaaau

SEQ ID NO: 3621677 - RNA, 21 nt, Salmonella enterica enterica serovar Typhi
uuauuuuagugaaaaaauauc

SEQ ID NO: 3621678 - RNA, 15 nt, Salmonella enterica enterica serovar Typhi
uuauuuucacgccau

SEQ ID NO: 3621679 - RNA, 13 nt, Salmonella enterica enterica serovar Typhi
uuauuuucauacu

SEQ ID NO: 3621680 - RNA, 20 nt, Salmonella enterica enterica serovar Typhi
uuauuuuccugaaaaaauuc

SEQ ID NO: 3621681 - RNA, 21 nt, Salmonella enterica enterica serovar Typhi
uuauuuuccugaaaaaauucc

SEQ ID NO: 3621682 - RNA, 14 nt, Salmonella enterica enterica serovar Typhi
uuauuuugucaugu

SEQ ID NO: 3621683 - RNA, 13 nt, Salmonella enterica enterica serovar Typhi
uuauuuuuaauug

SEQ ID NO: 3621684 - RNA, 17 nt, Salmonella enterica enterica serovar Typhi
uuauuuuucuggcuucu

SEQ ID NO: 3621685 - RNA, 12 nt, Salmonella enterica enterica serovar Typhi
uuauuuuuucau

SEQ ID NO: 3621686 - RNA, 17 nt, Salmonella enterica enterica serovar Typhi
uucaaaaaugauguguu

SEQ ID NO: 3621687 - RNA, 23 nt, Salmonella enterica enterica serovar Typhi
uucaaaagccuguuuaccaagca

SEQ ID NO: 3621688 - RNA, 13 nt, Salmonella enterica enterica serovar Typhi
uucaaaaucaaac

SEQ ID NO: 3621689 - RNA, 16 nt, Salmonella enterica enterica serovar Typhi
uucaaacaucagcgca

SEQ ID NO: 3621690 - RNA, 23 nt, Salmonella enterica enterica serovar Typhi
uucaaagccgccauccggccugu

SEQ ID NO: 3621691 - RNA, 17 nt, Salmonella enterica enterica serovar Typhi
uucaaauauauugaaaa

SEQ ID NO: 3621692 - RNA, 19 nt, Salmonella enterica enterica serovar Typhi
uucaaauguuguuugaaaa

SEQ ID NO: 3621693 - RNA, 19 nt, Salmonella enterica enterica serovar Typhi
uucaaauuucugaugugau

SEQ ID NO: 3621694 - RNA, 14 nt, Salmonella enterica enterica serovar Typhi
uucaacaaacucag

SEQ ID NO: 3621695 - RNA, 18 nt, Salmonella enterica enterica serovar Typhi
uucaaccucacuguugau

SEQ ID NO: 3621696 - RNA, 15 nt, Salmonella enterica enterica serovar Typhi
uucaaccuccugcaa

SEQ ID NO: 3621697 - RNA, 20 nt, Salmonella enterica enterica serovar Typhi
uucaacgaaugccugcauau

SEQ ID NO: 3621698 - RNA, 17 nt, Salmonella enterica enterica serovar Typhi
uucaacgcguugccuga

SEQ ID NO: 3621699 - RNA, 14 nt, Salmonella enterica enterica serovar Typhi
uucaacggcaucaa

SEQ ID NO: 3621700 - RNA, 12 nt, Salmonella enterica enterica serovar Typhi
uucaagcaauaa

SEQ ID NO: 3621701 - RNA, 23 nt, Salmonella enterica enterica serovar Typhi
uucaaggcucaauacgcauaaug

SEQ ID NO: 3621702 - RNA, 17 nt, Salmonella enterica enterica serovar Typhi
uucaaguuuagaaaaaa

SEQ ID NO: 3621703 - RNA, 18 nt, Salmonella enterica enterica serovar Typhi
uucaaguuuagaaaaaau

SEQ ID NO: 3621704 - RNA, 22 nt, Salmonella enterica enterica serovar Typhi
uucaauaaauugaaauucuaug

SEQ ID NO: 3621705 - RNA, 17 nt, Salmonella enterica enterica serovar Typhi
uucaauaaguuagcuuu

SEQ ID NO: 3621706 - RNA, 20 nt, Salmonella enterica enterica serovar Typhi
uucaauaaguuagcuuuuuu

SEQ ID NO: 3621707 - RNA, 14 nt, Salmonella enterica enterica serovar Typhi
uucaauaauaaaac

SEQ ID NO: 3621708 - RNA, 23 nt, Salmonella enterica enterica serovar Typhi
uucaauacccuuuucuuuaaaca

SEQ ID NO: 3621709 - RNA, 17 nt, Salmonella enterica enterica serovar Typhi
uucaauacgaaaaccga

SEQ ID NO: 3621710 - RNA, 16 nt, Salmonella enterica enterica serovar Typhi
uucaauagguugaaag

SEQ ID NO: 3621711 - RNA, 17 nt, Salmonella enterica enterica serovar Typhi
uucaauaugccaggcau

SEQ ID NO: 3621712 - RNA, 22 nt, Salmonella enterica enterica serovar Typhi
uucaauauuccuggcgccaccc

SEQ ID NO: 3621713 - RNA, 17 nt, Salmonella enterica enterica serovar Typhi
uucaaucgccaguuuuu

SEQ ID NO: 3621714 - RNA, 18 nt, Salmonella enterica enterica serovar Typhi
uucaaucgcgcccgccau

SEQ ID NO: 3621715 - RNA, 18 nt, Salmonella enterica enterica serovar Typhi
uucaaugcauacugccgg

SEQ ID NO: 3621716 - RNA, 15 nt, Salmonella enterica enterica serovar Typhi
uucaauuuucgcuuu

SEQ ID NO: 3621717 - RNA, 22 nt, Salmonella enterica enterica serovar Typhi
uucacaaacaauuucccccacu

SEQ ID NO: 3621718 - RNA, 16 nt, Salmonella enterica enterica serovar Typhi
uucacaaccuccacgc

SEQ ID NO: 3621719 - RNA, 17 nt, Salmonella enterica enterica serovar Typhi
uucacaaccuccacgcc

SEQ ID NO: 3621720 - RNA, 14 nt, Salmonella enterica enterica serovar Typhi
uucacaaccugaaa

SEQ ID NO: 3621721 - RNA, 15 nt, Salmonella enterica enterica serovar Typhi
uucacaaucagcgca

SEQ ID NO: 3621722 - RNA, 14 nt, Salmonella enterica enterica serovar Typhi
uucacacaauuuuc

SEQ ID NO: 3621723 - RNA, 22 nt, Salmonella enterica enterica serovar Typhi
uucacaccaaugucauauuugu

SEQ ID NO: 3621724 - RNA, 20 nt, Salmonella enterica enterica serovar Typhi
uucacaccgccgccagccau

SEQ ID NO: 3621725 - RNA, 21 nt, Salmonella enterica enterica serovar Typhi
uucacaccguuauccggcaaa

SEQ ID NO: 3621726 - RNA, 14 nt, Salmonella enterica enterica serovar Typhi
uucacagaaggcua

SEQ ID NO: 3621727 - RNA, 14 nt, Salmonella enterica enterica serovar Typhi
uucacaucgccagu

SEQ ID NO: 3621728 - RNA, 24 nt, Salmonella enterica enterica serovar Typhi
uucaccaaaaggcagacagagaaa

SEQ ID NO: 3621729 - RNA, 16 nt, Salmonella enterica enterica serovar Typhi
uucaccaaauccucac

SEQ ID NO: 3621730 - RNA, 21 nt, Salmonella enterica enterica serovar Typhi
uucaccaccacccgaucgccc

SEQ ID NO: 3621731 - RNA, 16 nt, Salmonella enterica enterica serovar Typhi
uucaccagacgcuggc

SEQ ID NO: 3621732 - RNA, 12 nt, Salmonella enterica enterica serovar Typhi
uucaccagcgcg

SEQ ID NO: 3621733 - RNA, 15 nt, Salmonella enterica enterica serovar Typhi
uucacccauugaacc

SEQ ID NO: 3621734 - RNA, 16 nt, Salmonella enterica enterica serovar Typhi
uucaccccagcgguaa

SEQ ID NO: 3621735 - RNA, 19 nt, Salmonella enterica enterica serovar Typhi
uucaccccagcgguaaaau

SEQ ID NO: 3621736 - RNA, 16 nt, Salmonella enterica enterica serovar Typhi
uucacccccaucgccc

SEQ ID NO: 3621737 - RNA, 13 nt, Salmonella enterica enterica serovar Typhi
uucaccgaggguu

SEQ ID NO: 3621738 - RNA, 16 nt, Salmonella enterica enterica serovar Typhi
uucaccgcgccaaacg

SEQ ID NO: 3621739 - RNA, 23 nt, Salmonella enterica enterica serovar Typhi
uucaccgcgucguuacgcucguc

SEQ ID NO: 3621740 - RNA, 21 nt, Salmonella enterica enterica serovar Typhi
uucaccggauacccagccaca

SEQ ID NO: 3621741 - RNA, 20 nt, Salmonella enterica enterica serovar Typhi
uucaccgguaucgaucacgc

SEQ ID NO: 3621742 - RNA, 23 nt, Salmonella enterica enterica serovar Typhi
uucaucccugcgacggcuaccug

SEQ ID NO: 3621743 - RNA, 14 nt, Salmonella enterica enterica serovar Typhi
uucauccucaacca

SEQ ID NO: 3621744 - RNA, 16 nt, Salmonella enterica enterica serovar Typhi
uucaucgccgauuccu

SEQ ID NO: 3621745 - RNA, 20 nt, Salmonella enterica enterica serovar Typhi
uucaucgccgauuccugcug

SEQ ID NO: 3621746 - RNA, 21 nt, Salmonella enterica enterica serovar Typhi
uucaucgcuuuuaccaggaau

SEQ ID NO: 3621747 - RNA, 15 nt, Salmonella enterica enterica serovar Typhi
uucaucgguaauauu

SEQ ID NO: 3621748 - RNA, 17 nt, Salmonella enterica enterica serovar Typhi
uucaucguucauugcuu

SEQ ID NO: 3621749 - RNA, 21 nt, Salmonella enterica enterica serovar Typhi
uucaucuccucuucaguaagc

SEQ ID NO: 3621750 - RNA, 20 nt, Salmonella enterica enterica serovar Typhi
uucaucuguggcaauuuuca

SEQ ID NO: 3621751 - RNA, 15 nt, Salmonella enterica enterica serovar Typhi
uucaucuuccgggac

SEQ ID NO: 3621752 - RNA, 14 nt, Salmonella enterica enterica serovar Typhi
uucaugaaucauca

SEQ ID NO: 3621753 - RNA, 16 nt, Salmonella enterica enterica serovar Typhi
uucaugauacccagcg

SEQ ID NO: 3621754 - RNA, 21 nt, Salmonella enterica enterica serovar Typhi
uucaugcaauuccgcuuucuu

SEQ ID NO: 3621755 - RNA, 16 nt, Salmonella enterica enterica serovar Typhi
uucaugcacaaaaccc

SEQ ID NO: 3621756 - RNA, 14 nt, Salmonella enterica enterica serovar Typhi
uucaugcagccaua

SEQ ID NO: 3621757 - RNA, 17 nt, Salmonella enterica enterica serovar Typhi
uucaugcagcccgcacu

SEQ ID NO: 3621758 - RNA, 21 nt, Salmonella enterica enterica serovar Typhi
uucaugccagaagcaaauuca

SEQ ID NO: 3621759 - RNA, 19 nt, Salmonella enterica enterica serovar Typhi
uucaugccauacuccugcc

SEQ ID NO: 3621760 - RNA, 16 nt, Salmonella enterica enterica serovar Typhi
uucaugcuguauaaac

SEQ ID NO: 3621761 - RNA, 15 nt, Salmonella enterica enterica serovar Typhi
uucaugcuucucaaa

SEQ ID NO: 3621762 - RNA, 20 nt, Salmonella enterica enterica serovar Typhi
uucauggcgcgacauggcga

SEQ ID NO: 3621763 - RNA, 19 nt, Salmonella enterica enterica serovar Typhi
uucaugguaaaauccuuuu

SEQ ID NO: 3621764 - RNA, 19 nt, Salmonella enterica enterica serovar Typhi
uucaugguacucaacauca

SEQ ID NO: 3621765 - RNA, 21 nt, Salmonella enterica enterica serovar Typhi
uucaugguacucaacaucauu

SEQ ID NO: 3621766 - RNA, 13 nt, Salmonella enterica enterica serovar Typhi
uucauggucaucg

SEQ ID NO: 3621767 - RNA, 21 nt, Salmonella enterica enterica serovar Typhi
uucauggucaucgcaaauucu

SEQ ID NO: 3621768 - RNA, 22 nt, Salmonella enterica enterica serovar Typhi
uucauguuucgacaguuucuuc

SEQ ID NO: 3621769 - RNA, 13 nt, Salmonella enterica enterica serovar Typhi
uucauuacaggug

SEQ ID NO: 3621770 - RNA, 15 nt, Salmonella enterica enterica serovar Typhi
uucauuacgccuguc

SEQ ID NO: 3621771 - RNA, 18 nt, Salmonella enterica enterica serovar Typhi
uucauuauuuuuaaauaa

SEQ ID NO: 3621772 - RNA, 12 nt, Salmonella enterica enterica serovar Typhi
uucauucagacc

SEQ ID NO: 3621773 - RNA, 13 nt, Salmonella enterica enterica serovar Typhi
uucauucugucag

SEQ ID NO: 3621774 - RNA, 15 nt, Salmonella enterica enterica serovar Typhi
uucauuucaauguaa

SEQ ID NO: 3621775 - RNA, 16 nt, Salmonella enterica enterica serovar Typhi
uucauuucacuuguuc

SEQ ID NO: 3621776 - RNA, 15 nt, Salmonella enterica enterica serovar Typhi
uucauuucaggcaaa

SEQ ID NO: 3621777 - RNA, 17 nt, Salmonella enterica enterica serovar Typhi
uucauuucuuccagcac

SEQ ID NO: 3621778 - RNA, 22 nt, Salmonella enterica enterica serovar Typhi
uucauuuguuccucgaaacgcu

SEQ ID NO: 3621779 - RNA, 19 nt, Salmonella enterica enterica serovar Typhi
uuccacacggcauucacgu

SEQ ID NO: 3621780 - RNA, 13 nt, Salmonella enterica enterica serovar Typhi
uuccacagaccca

SEQ ID NO: 3621781 - RNA, 12 nt, Salmonella enterica enterica serovar Typhi
uuccaccaccuc

SEQ ID NO: 3621782 - RNA, 16 nt, Salmonella enterica enterica serovar Typhi
uuccaccgcaugguua

SEQ ID NO: 3621783 - RNA, 11 nt, Salmonella enterica enterica serovar Typhi
uuccaccgcca

SEQ ID NO: 3621784 - RNA, 18 nt, Salmonella enterica enterica serovar Typhi
uuccaccucuucugcagu

SEQ ID NO: 3621785 - RNA, 21 nt, Salmonella enterica enterica serovar Typhi
uuccacgccgucgaugauggc

SEQ ID NO: 3621786 - RNA, 14 nt, Salmonella enterica enterica serovar Typhi
uuccacgguaaaac

SEQ ID NO: 3621787 - RNA, 21 nt, Salmonella enterica enterica serovar Typhi
uuccacugagcuucaccgcca

SEQ ID NO: 3621788 - RNA, 22 nt, Salmonella enterica enterica serovar Typhi
uuccacugagcuucaccgccag

SEQ ID NO: 3621789 - RNA, 20 nt, Salmonella enterica enterica serovar Typhi
uuccacugcggcauuacgcg

SEQ ID NO: 3621790 - RNA, 18 nt, Salmonella enterica enterica serovar Typhi
uuccagaaauaaaauacg

SEQ ID NO: 3621791 - RNA, 18 nt, Salmonella enterica enterica serovar Typhi
uuccagagugcucaauaa

SEQ ID NO: 3621792 - RNA, 20 nt, Salmonella enterica enterica serovar Typhi
uuccagauaauccagcgucg

SEQ ID NO: 3621793 - RNA, 19 nt, Salmonella enterica enterica serovar Typhi
uuccagauagcgcugcgcc

SEQ ID NO: 3621794 - RNA, 15 nt, Salmonella enterica enterica serovar Typhi
uuccagauucucaac

SEQ ID NO: 3621795 - RNA, 13 nt, Salmonella enterica enterica serovar Typhi
uuccagcacgccc

SEQ ID NO: 3621796 - RNA, 16 nt, Salmonella enterica enterica serovar Typhi
uuccagcagccagccg

SEQ ID NO: 3621797 - RNA, 20 nt, Salmonella enterica enterica serovar Typhi
uuccagcagcucaucaauaa

SEQ ID NO: 3621798 - RNA, 22 nt, Salmonella enterica enterica serovar Typhi
uuccagcauccugacauuaccc

SEQ ID NO: 3621799 - RNA, 16 nt, Salmonella enterica enterica serovar Typhi
uuccagcauuucuuca

SEQ ID NO: 3621800 - RNA, 21 nt, Salmonella enterica enterica serovar Typhi
uuccagccagugugcgguggc

SEQ ID NO: 3621801 - RNA, 21 nt, Salmonella enterica enterica serovar Typhi
uuccagcgcgccgucaucgcu

SEQ ID NO: 3621802 - RNA, 12 nt, Salmonella enterica enterica serovar Typhi
uuccagcggcag

SEQ ID NO: 3621803 - RNA, 17 nt, Salmonella enterica enterica serovar Typhi
uuccagcggcggaaugc

SEQ ID NO: 3621804 - RNA, 22 nt, Salmonella enterica enterica serovar Typhi
uuccagcucacggauauuaccc

SEQ ID NO: 3621805 - RNA, 20 nt, Salmonella enterica enterica serovar Typhi
uuccagcuguaccaucaccu

SEQ ID NO: 3621806 - RNA, 14 nt, Salmonella enterica enterica serovar Typhi
uuccaggccgccag

SEQ ID NO: 3621807 - RNA, 13 nt, Salmonella enterica enterica serovar Typhi
uuccaggcgaacc

SEQ ID NO: 3621808 - RNA, 18 nt, Salmonella enterica enterica serovar Typhi
uuccagggcuuccagaau

SEQ ID NO: 3621809 - RNA, 20 nt, Salmonella enterica enterica serovar Typhi
uuccaggguggcgcuaagac

SEQ ID NO: 3621810 - RNA, 18 nt, Salmonella enterica enterica serovar Typhi
uuccaguagucgcgccau

SEQ ID NO: 3621811 - RNA, 17 nt, Salmonella enterica enterica serovar Typhi
uuccaguugcggcauca

SEQ ID NO: 3621812 - RNA, 15 nt, Salmonella enterica enterica serovar Typhi
uuccaguuucucaaa

SEQ ID NO: 3621813 - RNA, 17 nt, Salmonella enterica enterica serovar Typhi
uuccaguuucucaaaca

SEQ ID NO: 3621814 - RNA, 11 nt, Salmonella enterica enterica serovar Typhi
uuccauacauu

SEQ ID NO: 3621815 - RNA, 16 nt, Salmonella enterica enterica serovar Typhi
uuccaucagccaggcg

SEQ ID NO: 3621816 - RNA, 19 nt, Salmonella enterica enterica serovar Typhi
uuccauggcaaaauucgua

SEQ ID NO: 3621817 - RNA, 17 nt, Salmonella enterica enterica serovar Typhi
uuccauuagcuguuguu

SEQ ID NO: 3621818 - RNA, 16 nt, Salmonella enterica enterica serovar Typhi
uuccauuaugaugagu

SEQ ID NO: 3621819 - RNA, 14 nt, Salmonella enterica enterica serovar Typhi
uuccauucacacaa

SEQ ID NO: 3621820 - RNA, 19 nt, Salmonella enterica enterica serovar Typhi
uuccauucaucgauuuccu

SEQ ID NO: 3621821 - RNA, 19 nt, Salmonella enterica enterica serovar Typhi
uuccauucggcgaaagaag

SEQ ID NO: 3621822 - RNA, 13 nt, Salmonella enterica enterica serovar Typhi
uuccauuuuucag

SEQ ID NO: 3621823 - RNA, 19 nt, Salmonella enterica enterica serovar Typhi
uucccaacaaugccacgcc

SEQ ID NO: 3621824 - RNA, 15 nt, Salmonella enterica enterica serovar Typhi
uucccaacuguauuu

SEQ ID NO: 3621825 - RNA, 21 nt, Salmonella enterica enterica serovar Typhi
uucccacagcuucaggcucau

SEQ ID NO: 3621826 - RNA, 23 nt, Salmonella enterica enterica serovar Typhi
uucccacaguuaacgccaacgcc

SEQ ID NO: 3621827 - RNA, 13 nt, Salmonella enterica enterica serovar Typhi
uucccacaucgcg

SEQ ID NO: 3621828 - RNA, 11 nt, Salmonella enterica enterica serovar Typhi
uucgaauccuc

SEQ ID NO: 3621829 - RNA, 20 nt, Salmonella enterica enterica serovar Typhi
uucgacaaacagcuauccau

SEQ ID NO: 3621830 - RNA, 22 nt, Salmonella enterica enterica serovar Typhi
uucgacaagaagauuucuuaau

SEQ ID NO: 3621831 - RNA, 15 nt, Salmonella enterica enterica serovar Typhi
uucgacaguuucuuc

SEQ ID NO: 3621832 - RNA, 23 nt, Salmonella enterica enterica serovar Typhi
uucgaccgacgcguuuuccagca

SEQ ID NO: 3621833 - RNA, 18 nt, Salmonella enterica enterica serovar Typhi
uucgacgagguuuccggc

SEQ ID NO: 3621834 - RNA, 16 nt, Salmonella enterica enterica serovar Typhi
uucgacgauaaaaaaa

SEQ ID NO: 3621835 - RNA, 13 nt, Salmonella enterica enterica serovar Typhi
uucgacgcgcgca

SEQ ID NO: 3621836 - RNA, 20 nt, Salmonella enterica enterica serovar Typhi
uucgagauuuuucugcgcca

SEQ ID NO: 3621837 - RNA, 23 nt, Salmonella enterica enterica serovar Typhi
uucgaguguaucuccugaaaccc

SEQ ID NO: 3621838 - RNA, 23 nt, Salmonella enterica enterica serovar Typhi
uucgauaaacucaaucaggcuau

SEQ ID NO: 3621839 - RNA, 17 nt, Salmonella enterica enterica serovar Typhi
uucgauaugaccaguac

SEQ ID NO: 3621840 - RNA, 15 nt, Salmonella enterica enterica serovar Typhi
uucgaugaaaaagag

SEQ ID NO: 3621841 - RNA, 19 nt, Salmonella enterica enterica serovar Typhi
uucgaugcggccauggaga

SEQ ID NO: 3621842 - RNA, 20 nt, Salmonella enterica enterica serovar Typhi
uucgauuguugacugccagc

SEQ ID NO: 3621843 - RNA, 21 nt, Salmonella enterica enterica serovar Typhi
uucgcaaccuaaccaaacaga

SEQ ID NO: 3621844 - RNA, 23 nt, Salmonella enterica enterica serovar Typhi
uucgcacgccucuggcguacgca

SEQ ID NO: 3621845 - RNA, 12 nt, Salmonella enterica enterica serovar Typhi
uucgcagcgcag

SEQ ID NO: 3621846 - RNA, 16 nt, Salmonella enterica enterica serovar Typhi
uucgcauauucugcga

SEQ ID NO: 3621847 - RNA, 22 nt, Salmonella enterica enterica serovar Typhi
uucgcaugaauucaacgucccc

SEQ ID NO: 3621848 - RNA, 19 nt, Salmonella enterica enterica serovar Typhi
uucgcauguugacugcgcu

SEQ ID NO: 3621849 - RNA, 22 nt, Salmonella enterica enterica serovar Typhi
uucgccaaagcagugaaucccc

SEQ ID NO: 3621850 - RNA, 17 nt, Salmonella enterica enterica serovar Typhi
uucgccacgcucacuuu

SEQ ID NO: 3621851 - RNA, 23 nt, Salmonella enterica enterica serovar Typhi
uucgccagcccgaucaucuccug

SEQ ID NO: 3621852 - RNA, 15 nt, Salmonella enterica enterica serovar Typhi
uucgccagugacaaa

SEQ ID NO: 3621853 - RNA, 22 nt, Salmonella enterica enterica serovar Typhi
uucgccauucccgcgacgucaa

SEQ ID NO: 3621854 - RNA, 13 nt, Salmonella enterica enterica serovar Typhi
uucgcccacgccc

SEQ ID NO: 3621855 - RNA, 17 nt, Salmonella enterica enterica serovar Typhi
uucgccccacuggcccc

SEQ ID NO: 3621856 - RNA, 14 nt, Salmonella enterica enterica serovar Typhi
uucgcccggcagga

SEQ ID NO: 3621857 - RNA, 18 nt, Salmonella enterica enterica serovar Typhi
uucgcccggcgccagcuc

SEQ ID NO: 3621858 - RNA, 18 nt, Salmonella enterica enterica serovar Typhi
uucgccgagaauccacuc

SEQ ID NO: 3621859 - RNA, 16 nt, Salmonella enterica enterica serovar Typhi
uucgccgucaccugaa

SEQ ID NO: 3621860 - RNA, 14 nt, Salmonella enterica enterica serovar Typhi
uucgccugaacagg

SEQ ID NO: 3621861 - RNA, 23 nt, Salmonella enterica enterica serovar Typhi
uucgcgaacugcacucggaugua

SEQ ID NO: 3621862 - RNA, 17 nt, Salmonella enterica enterica serovar Typhi
uucgcgaugcucaacca

SEQ ID NO: 3621863 - RNA, 13 nt, Salmonella enterica enterica serovar Typhi
uucgcgcaguuca

SEQ ID NO: 3621864 - RNA, 20 nt, Salmonella enterica enterica serovar Typhi
uucgcgcaguucauccacgc

SEQ ID NO: 3621865 - RNA, 22 nt, Salmonella enterica enterica serovar Typhi
uucgcgcuaaaugacaaauaga

SEQ ID NO: 3621866 - RNA, 18 nt, Salmonella enterica enterica serovar Typhi
uucgcggauaacguucuu

SEQ ID NO: 3621867 - RNA, 16 nt, Salmonella enterica enterica serovar Typhi
uucgcgucacaaucgc

SEQ ID NO: 3621868 - RNA, 19 nt, Salmonella enterica enterica serovar Typhi
uucgcgucacaaucgcgcc

SEQ ID NO: 3621869 - RNA, 13 nt, Salmonella enterica enterica serovar Typhi
uucgcuaaaucag

SEQ ID NO: 3621870 - RNA, 17 nt, Salmonella enterica enterica serovar Typhi
uucgcuacguucaaauu

SEQ ID NO: 3621871 - RNA, 19 nt, Salmonella enterica enterica serovar Typhi
uucgcuaucauagcgguac

SEQ ID NO: 3621872 - RNA, 18 nt, Salmonella enterica enterica serovar Typhi
uucgcugaguggucugga

SEQ ID NO: 3621873 - RNA, 13 nt, Salmonella enterica enterica serovar Typhi
uucgcugauaccg

SEQ ID NO: 3621874 - RNA, 18 nt, Salmonella enterica enterica serovar Typhi
uucgcugauuugcgucaa

SEQ ID NO: 3621875 - RNA, 13 nt, Salmonella enterica enterica serovar Typhi
uucgcugcaacuu

SEQ ID NO: 3621876 - RNA, 20 nt, Salmonella enterica enterica serovar Typhi
uucgcuucuucuaccaccuu

SEQ ID NO: 3621877 - RNA, 14 nt, Salmonella enterica enterica serovar Typhi
uucgcuuuuaaaac

SEQ ID NO: 3621878 - RNA, 19 nt, Salmonella enterica enterica serovar Typhi
uucggauuauuggucagua

SEQ ID NO: 3621879 - RNA, 15 nt, Salmonella enterica enterica serovar Typhi
uucggauucaauauu

SEQ ID NO: 3621880 - RNA, 14 nt, Salmonella enterica enterica serovar Typhi
uucggcagaaaaag

SEQ ID NO: 3621881 - RNA, 10 nt, Salmonella enterica enterica serovar Typhi
uucggcgauc

SEQ ID NO: 3621882 - RNA, 13 nt, Salmonella enterica enterica serovar Typhi
uucggcucgacag

SEQ ID NO: 3621883 - RNA, 17 nt, Salmonella enterica enterica serovar Typhi
uucgggcacuccggcuc

SEQ ID NO: 3621884 - RNA, 17 nt, Salmonella enterica enterica serovar Typhi
uucgguaguuccagaau

SEQ ID NO: 3621885 - RNA, 13 nt, Salmonella enterica enterica serovar Typhi
uucggucaggaua

SEQ ID NO: 3621886 - RNA, 17 nt, Salmonella enterica enterica serovar Typhi
uucgguguaauuucucg

SEQ ID NO: 3621887 - RNA, 19 nt, Salmonella enterica enterica serovar Typhi
uucguacccgcaggccugg

SEQ ID NO: 3621888 - RNA, 16 nt, Salmonella enterica enterica serovar Typhi
uucguacguuuuucca

SEQ ID NO: 3621889 - RNA, 13 nt, Salmonella enterica enterica serovar Typhi
uucguagacucag

SEQ ID NO: 3621890 - RNA, 16 nt, Salmonella enterica enterica serovar Typhi
uucguagacucaggcg

SEQ ID NO: 3621891 - RNA, 18 nt, Salmonella enterica enterica serovar Typhi
uucguagcgcaaauaucc

SEQ ID NO: 3621892 - RNA, 20 nt, Salmonella enterica enterica serovar Typhi
uucgucaaugcugcuuugau

SEQ ID NO: 3621893 - RNA, 19 nt, Salmonella enterica enterica serovar Typhi
uucgucaggcggcugcgca

SEQ ID NO: 3621894 - RNA, 12 nt, Salmonella enterica enterica serovar Typhi
uucgucggcaaa

SEQ ID NO: 3621895 - RNA, 21 nt, Salmonella enterica enterica serovar Typhi
uucgucggggauucgccagcg

SEQ ID NO: 3621896 - RNA, 13 nt, Salmonella enterica enterica serovar Typhi
uucgucuucaucu

SEQ ID NO: 3621897 - RNA, 15 nt, Salmonella enterica enterica serovar Typhi
uucgucuucaucuuc

SEQ ID NO: 3621898 - RNA, 15 nt, Salmonella enterica enterica serovar Typhi
uucgugaauaugacg

SEQ ID NO: 3621899 - RNA, 20 nt, Salmonella enterica enterica serovar Typhi
uucguggcgcuguucuugcu

SEQ ID NO: 3621900 - RNA, 15 nt, Salmonella enterica enterica serovar Typhi
uucguuaccggugau

SEQ ID NO: 3621901 - RNA, 15 nt, Salmonella enterica enterica serovar Typhi
uucguuaugaauggc

SEQ ID NO: 3621902 - RNA, 18 nt, Salmonella enterica enterica serovar Typhi
uucguuccgcgauuuccu

SEQ ID NO: 3621903 - RNA, 14 nt, Salmonella enterica enterica serovar Typhi
uucguucucugaau

SEQ ID NO: 3621904 - RNA, 11 nt, Salmonella enterica enterica serovar Typhi
uucguuuuccg

SEQ ID NO: 3621905 - RNA, 21 nt, Salmonella enterica enterica serovar Typhi
uucuaaaaguaagcuauguuu

SEQ ID NO: 3621906 - RNA, 20 nt, Salmonella enterica enterica serovar Typhi
uucuaaacguucaucuuccc

SEQ ID NO: 3621907 - RNA, 16 nt, Salmonella enterica enterica serovar Typhi
uucuacaaguucagua

SEQ ID NO: 3621908 - RNA, 14 nt, Salmonella enterica enterica serovar Typhi
uucuacaaugcggu

SEQ ID NO: 3621909 - RNA, 20 nt, Salmonella enterica enterica serovar Typhi
uucuaccacgcugccgccgc

SEQ ID NO: 3621910 - RNA, 14 nt, Salmonella enterica enterica serovar Typhi
uucuacuacagaaa

SEQ ID NO: 3621911 - RNA, 19 nt, Salmonella enterica enterica serovar Typhi
uucuacuacagaaagccau

SEQ ID NO: 3621912 - RNA, 18 nt, Salmonella enterica enterica serovar Typhi
uucuacucgggccagcuc

SEQ ID NO: 3621913 - RNA, 19 nt, Salmonella enterica enterica serovar Typhi
uucuacucuucacccuucu

SEQ ID NO: 3621914 - RNA, 23 nt, Salmonella enterica enterica serovar Typhi
uugaacggcggcucguuguuuaa

SEQ ID NO: 3621915 - RNA, 11 nt, Salmonella enterica enterica serovar Typhi
uugaagacagc

SEQ ID NO: 3621916 - RNA, 15 nt, Salmonella enterica enterica serovar Typhi
uugaagcgaccagcg

SEQ ID NO: 3621917 - RNA, 23 nt, Salmonella enterica enterica serovar Typhi
uugaagugguggcgaacaggcuc

SEQ ID NO: 3621918 - RNA, 16 nt, Salmonella enterica enterica serovar Typhi
uugaaguuauccagcg

SEQ ID NO: 3621919 - RNA, 18 nt, Salmonella enterica enterica serovar Typhi
uugaauaaccauacugac

SEQ ID NO: 3621920 - RNA, 17 nt, Salmonella enterica enterica serovar Typhi
uugaauaacguguuaug

SEQ ID NO: 3621921 - RNA, 16 nt, Salmonella enterica enterica serovar Typhi
uugaauaaugcccguu

SEQ ID NO: 3621922 - RNA, 21 nt, Salmonella enterica enterica serovar Typhi
uugaauaaugcccguugacga

SEQ ID NO: 3621923 - RNA, 13 nt, Salmonella enterica enterica serovar Typhi
uugaauggcugcu

SEQ ID NO: 3621924 - RNA, 14 nt, Salmonella enterica enterica serovar Typhi
uugaauuauaauaa

SEQ ID NO: 3621925 - RNA, 14 nt, Salmonella enterica enterica serovar Typhi
uugacaugaaaaau

SEQ ID NO: 3621926 - RNA, 15 nt, Salmonella enterica enterica serovar Typhi
uugaccaacaaucgc

SEQ ID NO: 3621927 - RNA, 19 nt, Salmonella enterica enterica serovar Typhi
uugaccaggucgccagcgg

SEQ ID NO: 3621928 - RNA, 12 nt, Salmonella enterica enterica serovar Typhi
uugaccauuacc

SEQ ID NO: 3621929 - RNA, 20 nt, Salmonella enterica enterica serovar Typhi
uugaccgcauaaucugugau

SEQ ID NO: 3621930 - RNA, 16 nt, Salmonella enterica enterica serovar Typhi
uugaccggaaaaaaau

SEQ ID NO: 3621931 - RNA, 17 nt, Salmonella enterica enterica serovar Typhi
uugaccguccccagcca

SEQ ID NO: 3621932 - RNA, 21 nt, Salmonella enterica enterica serovar Typhi
uugaccucauccaucagcgcg

SEQ ID NO: 3621933 - RNA, 13 nt, Salmonella enterica enterica serovar Typhi
uugacgcaaacug

SEQ ID NO: 3621934 - RNA, 16 nt, Salmonella enterica enterica serovar Typhi
uugacgucgguaauca

SEQ ID NO: 3621935 - RNA, 16 nt, Salmonella enterica enterica serovar Typhi
uugacguuuaccugaa

SEQ ID NO: 3621936 - RNA, 13 nt, Salmonella enterica enterica serovar Typhi
uugacucugaagc

SEQ ID NO: 3621937 - RNA, 16 nt, Salmonella enterica enterica serovar Typhi
uugacucuguuauaua

SEQ ID NO: 3621938 - RNA, 12 nt, Salmonella enterica enterica serovar Typhi
uugacugccaga

SEQ ID NO: 3621939 - RNA, 20 nt, Salmonella enterica enterica serovar Typhi
uugacugcgggggcaaaugc

SEQ ID NO: 3621940 - RNA, 16 nt, Salmonella enterica enterica serovar Typhi
uugacuuacaaaaaau

SEQ ID NO: 3621941 - RNA, 17 nt, Salmonella enterica enterica serovar Typhi
uugacuuuuacgccacg

SEQ ID NO: 3621942 - RNA, 14 nt, Salmonella enterica enterica serovar Typhi
uugagaaaaccaua

SEQ ID NO: 3621943 - RNA, 14 nt, Salmonella enterica enterica serovar Typhi
uugagcagaucagc

SEQ ID NO: 3621944 - RNA, 16 nt, Salmonella enterica enterica serovar Typhi
uugagcuggauaagcu

SEQ ID NO: 3621945 - RNA, 16 nt, Salmonella enterica enterica serovar Typhi
uugaggaaauucugac

SEQ ID NO: 3621946 - RNA, 18 nt, Salmonella enterica enterica serovar Typhi
uugaguuugcaauccaga

SEQ ID NO: 3621947 - RNA, 14 nt, Salmonella enterica enterica serovar Typhi
uugauaagagaaaa

SEQ ID NO: 3621948 - RNA, 21 nt, Salmonella enterica enterica serovar Typhi
uugauaagcggguugcacauu

SEQ ID NO: 3621949 - RNA, 21 nt, Salmonella enterica enterica serovar Typhi
uugauaauguuggauuauaca

SEQ ID NO: 3621950 - RNA, 17 nt, Salmonella enterica enterica serovar Typhi
uugauaccaucaauguu

SEQ ID NO: 3621951 - RNA, 18 nt, Salmonella enterica enterica serovar Typhi
uugauaccuauuuaauaa

SEQ ID NO: 3621952 - RNA, 23 nt, Salmonella enterica enterica serovar Typhi
uugauagcgacgcccauuagcau

SEQ ID NO: 3621953 - RNA, 18 nt, Salmonella enterica enterica serovar Typhi
uugauagggugaaugcgu

SEQ ID NO: 3621954 - RNA, 23 nt, Salmonella enterica enterica serovar Typhi
uugauaucgcugugguuuauccg

SEQ ID NO: 3621955 - RNA, 19 nt, Salmonella enterica enterica serovar Typhi
uugaucaacgccgcgccau

SEQ ID NO: 3621956 - RNA, 13 nt, Salmonella enterica enterica serovar Typhi
uugaucacaaaau

SEQ ID NO: 3621957 - RNA, 23 nt, Salmonella enterica enterica serovar Typhi
uugaucacgguacgcaucaccag

SEQ ID NO: 3621958 - RNA, 23 nt, Salmonella enterica enterica serovar Typhi
uugaucacuuuugggccgcguag

SEQ ID NO: 3621959 - RNA, 14 nt, Salmonella enterica enterica serovar Typhi
uugaucgcgcagca

SEQ ID NO: 3621960 - RNA, 18 nt, Salmonella enterica enterica serovar Typhi
uugaucgcgcagcaaauc

SEQ ID NO: 3621961 - RNA, 22 nt, Salmonella enterica enterica serovar Typhi
uugaucgcgcagcaaaucagcu

SEQ ID NO: 3621962 - RNA, 17 nt, Salmonella enterica enterica serovar Typhi
uugaucggguuuuccug

SEQ ID NO: 3621963 - RNA, 17 nt, Salmonella enterica enterica serovar Typhi
uugaucguaaaaugaaa

SEQ ID NO: 3621964 - RNA, 13 nt, Salmonella enterica enterica serovar Typhi
uugaucguccauc

SEQ ID NO: 3621965 - RNA, 11 nt, Salmonella enterica enterica serovar Typhi
uugaugcccaa

SEQ ID NO: 3621966 - RNA, 20 nt, Salmonella enterica enterica serovar Typhi
uugaugccuggcaguucccu

SEQ ID NO: 3621967 - RNA, 17 nt, Salmonella enterica enterica serovar Typhi
uugaugcuaaccucuau

SEQ ID NO: 3621968 - RNA, 17 nt, Salmonella enterica enterica serovar Typhi
uugauuucauugcugca

SEQ ID NO: 3621969 - RNA, 15 nt, Salmonella enterica enterica serovar Typhi
uugauuuguuuuuua

SEQ ID NO: 3621970 - RNA, 12 nt, Salmonella enterica enterica serovar Typhi
uugauuuuauga

SEQ ID NO: 3621971 - RNA, 12 nt, Salmonella enterica enterica serovar Typhi
uugcaacuauua

SEQ ID NO: 3621972 - RNA, 15 nt, Salmonella enterica enterica serovar Typhi
uugcacguucugcug

SEQ ID NO: 3621973 - RNA, 17 nt, Salmonella enterica enterica serovar Typhi
uugcacuuuugccaggc

SEQ ID NO: 3621974 - RNA, 14 nt, Salmonella enterica enterica serovar Typhi
uugcagauccgcga

SEQ ID NO: 3621975 - RNA, 20 nt, Salmonella enterica enterica serovar Typhi
uugcagcagcgagauggcuu

SEQ ID NO: 3621976 - RNA, 14 nt, Salmonella enterica enterica serovar Typhi
uugcagccagaacu

SEQ ID NO: 3621977 - RNA, 12 nt, Salmonella enterica enterica serovar Typhi
uugcagcgccau

SEQ ID NO: 3621978 - RNA, 15 nt, Salmonella enterica enterica serovar Typhi
uugcagcgguaaaca

SEQ ID NO: 3621979 - RNA, 16 nt, Salmonella enterica enterica serovar Typhi
uugcagcgugaaaagc

SEQ ID NO: 3621980 - RNA, 19 nt, Salmonella enterica enterica serovar Typhi
uugcaggaaaaacuguccc

SEQ ID NO: 3621981 - RNA, 17 nt, Salmonella enterica enterica serovar Typhi
uugcaggaagggcagca

SEQ ID NO: 3621982 - RNA, 13 nt, Salmonella enterica enterica serovar Typhi
uugcaggaggcgc

SEQ ID NO: 3621983 - RNA, 20 nt, Salmonella enterica enterica serovar Typhi
uugcagggugcagcaaauaa

SEQ ID NO: 3621984 - RNA, 21 nt, Salmonella enterica enterica serovar Typhi
uugcagguaacgacuacuucc

SEQ ID NO: 3621985 - RNA, 14 nt, Salmonella enterica enterica serovar Typhi
uugcauaagagguc

SEQ ID NO: 3621986 - RNA, 13 nt, Salmonella enterica enterica serovar Typhi
uugcauacauaaa

SEQ ID NO: 3621987 - RNA, 17 nt, Salmonella enterica enterica serovar Typhi
uugcauccguagcuuca

SEQ ID NO: 3621988 - RNA, 18 nt, Salmonella enterica enterica serovar Typhi
uugcauggcaauuaaauu

SEQ ID NO: 3621989 - RNA, 13 nt, Salmonella enterica enterica serovar Typhi
uugcauuauauuu

SEQ ID NO: 3621990 - RNA, 21 nt, Salmonella enterica enterica serovar Typhi
uugccacaauaucaucgucau

SEQ ID NO: 3621991 - RNA, 14 nt, Salmonella enterica enterica serovar Typhi
uugccacagccuca

SEQ ID NO: 3621992 - RNA, 14 nt, Salmonella enterica enterica serovar Typhi
uugccacuacgcag

SEQ ID NO: 3621993 - RNA, 20 nt, Salmonella enterica enterica serovar Typhi
uugccacuacgcagcuccag

SEQ ID NO: 3621994 - RNA, 13 nt, Salmonella enterica enterica serovar Typhi
uugccacuggccu

SEQ ID NO: 3621995 - RNA, 20 nt, Salmonella enterica enterica serovar Typhi
uugccacuggcuuuccugau

SEQ ID NO: 3621996 - RNA, 23 nt, Salmonella enterica enterica serovar Typhi
uugccacuggcuuuccugaucaa

SEQ ID NO: 3621997 - RNA, 17 nt, Salmonella enterica enterica serovar Typhi
uugccagcgcauccacc

SEQ ID NO: 3621998 - RNA, 15 nt, Salmonella enterica enterica serovar Typhi
uugccagugaaaaaa

SEQ ID NO: 3621999 - RNA, 19 nt, Salmonella enterica enterica serovar Typhi
uugccauacgcccacgcgg

SEQ ID NO: 3622000 - RNA, 18 nt, Salmonella enterica enterica serovar Typhi
uuggaaacuaugcaaaac

SEQ ID NO: 3622001 - RNA, 18 nt, Salmonella enterica enterica serovar Typhi
uuggaaccaaacaccaga

SEQ ID NO: 3622002 - RNA, 13 nt, Salmonella enterica enterica serovar Typhi
uuggacggcauca

SEQ ID NO: 3622003 - RNA, 16 nt, Salmonella enterica enterica serovar Typhi
uuggacggcgucacca

SEQ ID NO: 3622004 - RNA, 21 nt, Salmonella enterica enterica serovar Typhi
uuggaggucauuauucaggcc

SEQ ID NO: 3622005 - RNA, 14 nt, Salmonella enterica enterica serovar Typhi
uuggauuauacauu

SEQ ID NO: 3622006 - RNA, 15 nt, Salmonella enterica enterica serovar Typhi
uuggcaaaaaaggcc

SEQ ID NO: 3622007 - RNA, 16 nt, Salmonella enterica enterica serovar Typhi
uuggcaaaccccugcu

SEQ ID NO: 3622008 - RNA, 23 nt, Salmonella enterica enterica serovar Typhi
uuggcaaacugucgguaaagaaa

SEQ ID NO: 3622009 - RNA, 22 nt, Salmonella enterica enterica serovar Typhi
uuggcaacccguaccuccagcg

SEQ ID NO: 3622010 - RNA, 19 nt, Salmonella enterica enterica serovar Typhi
uuggcaacggcagccagcg

SEQ ID NO: 3622011 - RNA, 15 nt, Salmonella enterica enterica serovar Typhi
uuggcaaucagcggc

SEQ ID NO: 3622012 - RNA, 13 nt, Salmonella enterica enterica serovar Typhi
uuggcaccaccag

SEQ ID NO: 3622013 - RNA, 21 nt, Salmonella enterica enterica serovar Typhi
uuggcaggaggggcagauaaa

SEQ ID NO: 3622014 - RNA, 14 nt, Salmonella enterica enterica serovar Typhi
uuggcaucugcaau

SEQ ID NO: 3622015 - RNA, 11 nt, Salmonella enterica enterica serovar Typhi
uuggccagcgu

SEQ ID NO: 3622016 - RNA, 22 nt, Salmonella enterica enterica serovar Typhi
uuggccagcguggaugaacuca

SEQ ID NO: 3622017 - RNA, 13 nt, Salmonella enterica enterica serovar Typhi
uuggcccgacaug

SEQ ID NO: 3622018 - RNA, 18 nt, Salmonella enterica enterica serovar Typhi
uuggccgauggucgcgcc

SEQ ID NO: 3622019 - RNA, 23 nt, Salmonella enterica enterica serovar Typhi
uuggcgagcaggaaccacaucgc

SEQ ID NO: 3622020 - RNA, 14 nt, Salmonella enterica enterica serovar Typhi
uuggcgauuuccag

SEQ ID NO: 3622021 - RNA, 18 nt, Salmonella enterica enterica serovar Typhi
uuggcgauuuucagcacc

SEQ ID NO: 3622022 - RNA, 16 nt, Salmonella enterica enterica serovar Typhi
uuggcgcgaaccguaa

SEQ ID NO: 3622023 - RNA, 14 nt, Salmonella enterica enterica serovar Typhi
uuggcgcuggguac

SEQ ID NO: 3622024 - RNA, 17 nt, Salmonella enterica enterica serovar Typhi
uuggcguaaaucaggcc

SEQ ID NO: 3622025 - RNA, 18 nt, Salmonella enterica enterica serovar Typhi
uuggcguaaaucaggcca

SEQ ID NO: 3622026 - RNA, 19 nt, Salmonella enterica enterica serovar Typhi
uuggcguaaaucaggccaa

SEQ ID NO: 3622027 - RNA, 13 nt, Salmonella enterica enterica serovar Typhi
uuggcguauuaug

SEQ ID NO: 3622028 - RNA, 19 nt, Salmonella enterica enterica serovar Typhi
uuggcuauacgcggcguac

SEQ ID NO: 3622029 - RNA, 21 nt, Salmonella enterica enterica serovar Typhi
uuggcucgauuccugacgcac

SEQ ID NO: 3622030 - RNA, 18 nt, Salmonella enterica enterica serovar Typhi
uugggaauuagcgaauca

SEQ ID NO: 3622031 - RNA, 18 nt, Salmonella enterica enterica serovar Typhi
uugggauuacuuccgguu

SEQ ID NO: 3622032 - RNA, 18 nt, Salmonella enterica enterica serovar Typhi
uugggcagugcucgccaa

SEQ ID NO: 3622033 - RNA, 23 nt, Salmonella enterica enterica serovar Typhi
uugggcgcgaaacugcugccgca

SEQ ID NO: 3622034 - RNA, 20 nt, Salmonella enterica enterica serovar Typhi
uuggggaaccuggcagaaag

SEQ ID NO: 3622035 - RNA, 19 nt, Salmonella enterica enterica serovar Typhi
uugguauucaacgccaucu

SEQ ID NO: 3622036 - RNA, 22 nt, Salmonella enterica enterica serovar Typhi
uuggucacaaaggccagcagca

SEQ ID NO: 3622037 - RNA, 19 nt, Salmonella enterica enterica serovar Typhi
uuggucaggcuaaauggca

SEQ ID NO: 3622038 - RNA, 12 nt, Salmonella enterica enterica serovar Typhi
uuggugaguggc

SEQ ID NO: 3622039 - RNA, 20 nt, Salmonella enterica enterica serovar Typhi
uuggugauuaacagcgccau

SEQ ID NO: 3622040 - RNA, 11 nt, Salmonella enterica enterica serovar Typhi
uugguuuugcc

SEQ ID NO: 3622041 - RNA, 15 nt, Salmonella enterica enterica serovar Typhi
uugguuuugccauuc

SEQ ID NO: 3622042 - RNA, 16 nt, Salmonella enterica enterica serovar Typhi
uuguaaagaaauuuaa

SEQ ID NO: 3622043 - RNA, 12 nt, Salmonella enterica enterica serovar Typhi
uuguaacagcag

SEQ ID NO: 3622044 - RNA, 19 nt, Salmonella enterica enterica serovar Typhi
uuguacaaaaaaugugagc

SEQ ID NO: 3622045 - RNA, 16 nt, Salmonella enterica enterica serovar Typhi
uuguacagcaauaaaa

SEQ ID NO: 3622046 - RNA, 23 nt, Salmonella enterica enterica serovar Typhi
uuguacggaugggguaucgccaa

SEQ ID NO: 3622047 - RNA, 23 nt, Salmonella enterica enterica serovar Typhi
uuguacggcggcauuaaagccgc

SEQ ID NO: 3622048 - RNA, 13 nt, Salmonella enterica enterica serovar Typhi
uuguagcugcgcc

SEQ ID NO: 3622049 - RNA, 18 nt, Salmonella enterica enterica serovar Typhi
uuguagcugcgccagcgu

SEQ ID NO: 3622050 - RNA, 18 nt, Salmonella enterica enterica serovar Typhi
uuguagcugcgccugaaa

SEQ ID NO: 3622051 - RNA, 15 nt, Salmonella enterica enterica serovar Typhi
uuguaggcaggaauu

SEQ ID NO: 3622052 - RNA, 20 nt, Salmonella enterica enterica serovar Typhi
uuguaggccggauaaggcgu

SEQ ID NO: 3622053 - RNA, 19 nt, Salmonella enterica enterica serovar Typhi
uuguaggccugauaagcgc

SEQ ID NO: 3622054 - RNA, 18 nt, Salmonella enterica enterica serovar Typhi
uuguaggccugauagcac

SEQ ID NO: 3622055 - RNA, 13 nt, Salmonella enterica enterica serovar Typhi
uugucaaaaauag

SEQ ID NO: 3622056 - RNA, 15 nt, Salmonella enterica enterica serovar Typhi
uugucaaaaauagca

SEQ ID NO: 3622057 - RNA, 15 nt, Salmonella enterica enterica serovar Typhi
uugucagacaugaua

SEQ ID NO: 3622058 - RNA, 23 nt, Salmonella enterica enterica serovar Typhi
uugucagcugaacagucccacca

SEQ ID NO: 3622059 - RNA, 16 nt, Salmonella enterica enterica serovar Typhi
uugucaggcagaaaua

SEQ ID NO: 3622060 - RNA, 17 nt, Salmonella enterica enterica serovar Typhi
uugucagucugguacuc

SEQ ID NO: 3622061 - RNA, 17 nt, Salmonella enterica enterica serovar Typhi
uugucauccugcucauc

SEQ ID NO: 3622062 - RNA, 22 nt, Salmonella enterica enterica serovar Typhi
uugucaugcuaaaacagauaac

SEQ ID NO: 3622063 - RNA, 18 nt, Salmonella enterica enterica serovar Typhi
uuguccggaucucgccag

SEQ ID NO: 3622064 - RNA, 13 nt, Salmonella enterica enterica serovar Typhi
uuguccugguaca

SEQ ID NO: 3622065 - RNA, 18 nt, Salmonella enterica enterica serovar Typhi
uuguccuuuaucugcccu

SEQ ID NO: 3622066 - RNA, 14 nt, Salmonella enterica enterica serovar Typhi
uugucgccaauaau

SEQ ID NO: 3622067 - RNA, 15 nt, Salmonella enterica enterica serovar Typhi
uugucgcccugcaau

SEQ ID NO: 3622068 - RNA, 13 nt, Salmonella enterica enterica serovar Typhi
uugucgggcagaa

SEQ ID NO: 3622069 - RNA, 19 nt, Salmonella enterica enterica serovar Typhi
uugucguucacguaaucgc

SEQ ID NO: 3622070 - RNA, 14 nt, Salmonella enterica enterica serovar Typhi
uugucuaacuuacc

SEQ ID NO: 3622071 - RNA, 17 nt, Salmonella enterica enterica serovar Typhi
uugucucaaaaaauauc

SEQ ID NO: 3622072 - RNA, 14 nt, Salmonella enterica enterica serovar Typhi
uugucuucuuagua

SEQ ID NO: 3622073 - RNA, 22 nt, Salmonella enterica enterica serovar Typhi
uugugagcuauacgguaaauca

SEQ ID NO: 3622074 - RNA, 14 nt, Salmonella enterica enterica serovar Typhi
uugugaguaauaau

SEQ ID NO: 3622075 - RNA, 18 nt, Salmonella enterica enterica serovar Typhi
uugugaguaauaaucaca

SEQ ID NO: 3622076 - RNA, 13 nt, Salmonella enterica enterica serovar Typhi
uugugauuccagu

SEQ ID NO: 3622077 - RNA, 15 nt, Salmonella enterica enterica serovar Typhi
uugugcagaaucauu

SEQ ID NO: 3622078 - RNA, 23 nt, Salmonella enterica enterica serovar Typhi
uugugcauuccaggugucacuca

SEQ ID NO: 3622079 - RNA, 22 nt, Salmonella enterica enterica serovar Typhi
uugugccugcugcggauaacgu

SEQ ID NO: 3622080 - RNA, 15 nt, Salmonella enterica enterica serovar Typhi
uuguggcgaccagca

SEQ ID NO: 3622081 - RNA, 14 nt, Salmonella enterica enterica serovar Typhi
uugugguugguagc

SEQ ID NO: 3622082 - RNA, 23 nt, Salmonella enterica enterica serovar Typhi
uuguucaauagagcgcagcaaaa

SEQ ID NO: 3622083 - RNA, 21 nt, Salmonella enterica enterica serovar Typhi
uuguucaaucggauaauccgc

SEQ ID NO: 3622084 - RNA, 21 nt, Salmonella enterica enterica serovar Typhi
uuguucaguuucaaagaacga

SEQ ID NO: 3622085 - RNA, 19 nt, Salmonella enterica enterica serovar Typhi
uuguuccugcuggcaaaac

SEQ ID NO: 3622086 - RNA, 15 nt, Salmonella enterica enterica serovar Typhi
uuuaugcguuauaga

SEQ ID NO: 3622087 - RNA, 18 nt, Salmonella enterica enterica serovar Typhi
uuuauggcggggcgcuau

SEQ ID NO: 3622088 - RNA, 16 nt, Salmonella enterica enterica serovar Typhi
uuuaugggaaaauucc

SEQ ID NO: 3622089 - RNA, 11 nt, Salmonella enterica enterica serovar Typhi
uuuaugguucc

SEQ ID NO: 3622090 - RNA, 18 nt, Salmonella enterica enterica serovar Typhi
uuuauuaggccuacaaga

SEQ ID NO: 3622091 - RNA, 15 nt, Salmonella enterica enterica serovar Typhi
uuuauucgcuuguuu

SEQ ID NO: 3622092 - RNA, 22 nt, Salmonella enterica enterica serovar Typhi
uuuauugccuaagauggcgccu

SEQ ID NO: 3622093 - RNA, 23 nt, Salmonella enterica enterica serovar Typhi
uuuauugggcguaagaaaaguuu

SEQ ID NO: 3622094 - RNA, 18 nt, Salmonella enterica enterica serovar Typhi
uuuauuuaggauuugucu

SEQ ID NO: 3622095 - RNA, 23 nt, Salmonella enterica enterica serovar Typhi
uuuauuuggcucugaagcguaaa

SEQ ID NO: 3622096 - RNA, 16 nt, Salmonella enterica enterica serovar Typhi
uuucaaaaaagagaag

SEQ ID NO: 3622097 - RNA, 22 nt, Salmonella enterica enterica serovar Typhi
uuucaaaaccgaccccgcucag

SEQ ID NO: 3622098 - RNA, 19 nt, Salmonella enterica enterica serovar Typhi
uuucaaauuucugauguga

SEQ ID NO: 3622099 - RNA, 20 nt, Salmonella enterica enterica serovar Typhi
uuucaacauauuuuucacac

SEQ ID NO: 3622100 - RNA, 21 nt, Salmonella enterica enterica serovar Typhi
uuucaaccgcgccaaagauaa

SEQ ID NO: 3622101 - RNA, 12 nt, Salmonella enterica enterica serovar Typhi
uuucaacggauu

SEQ ID NO: 3622102 - RNA, 22 nt, Salmonella enterica enterica serovar Typhi
uuucaacggauugugaaauucg

SEQ ID NO: 3622103 - RNA, 12 nt, Salmonella enterica enterica serovar Typhi
uuucaacuggcu

SEQ ID NO: 3622104 - RNA, 13 nt, Salmonella enterica enterica serovar Typhi
uuucaacuuccac

SEQ ID NO: 3622105 - RNA, 19 nt, Salmonella enterica enterica serovar Typhi
uuucaacuuccgcguuagg

SEQ ID NO: 3622106 - RNA, 21 nt, Salmonella enterica enterica serovar Typhi
uuucaagcaauaccggguuaa

SEQ ID NO: 3622107 - RNA, 11 nt, Salmonella enterica enterica serovar Typhi
uuucaauaaua

SEQ ID NO: 3622108 - RNA, 13 nt, Salmonella enterica enterica serovar Typhi
uuucaaucaucau

SEQ ID NO: 3622109 - RNA, 18 nt, Salmonella enterica enterica serovar Typhi
uuucaauccuucuucuga

SEQ ID NO: 3622110 - RNA, 20 nt, Salmonella enterica enterica serovar Typhi
uuucaauccuucuucugaaa

SEQ ID NO: 3622111 - RNA, 16 nt, Salmonella enterica enterica serovar Typhi
uuucaaucgccaccac

SEQ ID NO: 3622112 - RNA, 17 nt, Salmonella enterica enterica serovar Typhi
uuucaauuccacaggcg

SEQ ID NO: 3622113 - RNA, 23 nt, Salmonella enterica enterica serovar Typhi
uuucaauuccgcaggagagccag

SEQ ID NO: 3622114 - RNA, 20 nt, Salmonella enterica enterica serovar Typhi
uuucaccucacuccagaccu

SEQ ID NO: 3622115 - RNA, 23 nt, Salmonella enterica enterica serovar Typhi
uuucacgccauugccaggacuga

SEQ ID NO: 3622116 - RNA, 21 nt, Salmonella enterica enterica serovar Typhi
uuucacgccuuuugacgcuuc

SEQ ID NO: 3622117 - RNA, 19 nt, Salmonella enterica enterica serovar Typhi
uuucacucgcauucuucag

SEQ ID NO: 3622118 - RNA, 15 nt, Salmonella enterica enterica serovar Typhi
uuucacuuaucccug

SEQ ID NO: 3622119 - RNA, 15 nt, Salmonella enterica enterica serovar Typhi
uuucagaauaauguu

SEQ ID NO: 3622120 - RNA, 22 nt, Salmonella enterica enterica serovar Typhi
uuucagaggucaggauuuucgc

SEQ ID NO: 3622121 - RNA, 23 nt, Salmonella enterica enterica serovar Typhi
uuucagaucgccgccgguaacga

SEQ ID NO: 3622122 - RNA, 12 nt, Salmonella enterica enterica serovar Typhi
uuucagccccuu

SEQ ID NO: 3622123 - RNA, 18 nt, Salmonella enterica enterica serovar Typhi
uuucagccgcgcauagcu

SEQ ID NO: 3622124 - RNA, 19 nt, Salmonella enterica enterica serovar Typhi
uuucagccgcgcauagcug

SEQ ID NO: 3622125 - RNA, 23 nt, Salmonella enterica enterica serovar Typhi
uuucagcgcagaauuuauuucug

SEQ ID NO: 3622126 - RNA, 12 nt, Salmonella enterica enterica serovar Typhi
uuucagcgccag

SEQ ID NO: 3622127 - RNA, 16 nt, Salmonella enterica enterica serovar Typhi
uuucagcggcagcucu

SEQ ID NO: 3622128 - RNA, 20 nt, Salmonella enterica enterica serovar Typhi
uuucagcggcagcucugccu

SEQ ID NO: 3622129 - RNA, 22 nt, Salmonella enterica enterica serovar Typhi
uuucagcggcagcucugccugu

SEQ ID NO: 3622130 - RNA, 18 nt, Salmonella enterica enterica serovar Typhi
uuucagcucgcaggccau

SEQ ID NO: 3622131 - RNA, 20 nt, Salmonella enterica enterica serovar Typhi
uuucaggcaaaaaaaaaccg

SEQ ID NO: 3622132 - RNA, 16 nt, Salmonella enterica enterica serovar Typhi
uuucagggaaaagaag

SEQ ID NO: 3622133 - RNA, 12 nt, Salmonella enterica enterica serovar Typhi
uuucagggcuua

SEQ ID NO: 3622134 - RNA, 11 nt, Salmonella enterica enterica serovar Typhi
uuucaggucau

SEQ ID NO: 3622135 - RNA, 18 nt, Salmonella enterica enterica serovar Typhi
uuucaguaauaauauaaa

SEQ ID NO: 3622136 - RNA, 21 nt, Salmonella enterica enterica serovar Typhi
uuucagugacgcguuaauauc

SEQ ID NO: 3622137 - RNA, 14 nt, Salmonella enterica enterica serovar Typhi
uuucagugauaaag

SEQ ID NO: 3622138 - RNA, 15 nt, Salmonella enterica enterica serovar Typhi
uuucaguugcccauu

SEQ ID NO: 3622139 - RNA, 22 nt, Salmonella enterica enterica serovar Typhi
uuucaguuucggccccccccau

SEQ ID NO: 3622140 - RNA, 16 nt, Salmonella enterica enterica serovar Typhi
uuucauaaugugugua

SEQ ID NO: 3622141 - RNA, 12 nt, Salmonella enterica enterica serovar Typhi
uuucauaauguu

SEQ ID NO: 3622142 - RNA, 20 nt, Salmonella enterica enterica serovar Typhi
uuucauaugcgggguuugca

SEQ ID NO: 3622143 - RNA, 14 nt, Salmonella enterica enterica serovar Typhi
uuucauauuuuccu

SEQ ID NO: 3622144 - RNA, 18 nt, Salmonella enterica enterica serovar Typhi
uuucaucaaacggauaag

SEQ ID NO: 3622145 - RNA, 12 nt, Salmonella enterica enterica serovar Typhi
uuucauccucuu

SEQ ID NO: 3622146 - RNA, 19 nt, Salmonella enterica enterica serovar Typhi
uuucaucuccgauaaauaa

SEQ ID NO: 3622147 - RNA, 15 nt, Salmonella enterica enterica serovar Typhi
uuucaucuucaguaa

SEQ ID NO: 3622148 - RNA, 14 nt, Salmonella enterica enterica serovar Typhi
uuucaugccauacu

SEQ ID NO: 3622149 - RNA, 21 nt, Salmonella enterica enterica serovar Typhi
uuucauggucaucgcaaauuc

SEQ ID NO: 3622150 - RNA, 22 nt, Salmonella enterica enterica serovar Typhi
uuucauggucaucgcaaauucu

SEQ ID NO: 3622151 - RNA, 16 nt, Salmonella enterica enterica serovar Typhi
uuucauguaaaugacg

SEQ ID NO: 3622152 - RNA, 14 nt, Salmonella enterica enterica serovar Typhi
uuucauuagccgcc

SEQ ID NO: 3622153 - RNA, 20 nt, Salmonella enterica enterica serovar Typhi
uuucauucagggaaucagcg

SEQ ID NO: 3622154 - RNA, 17 nt, Salmonella enterica enterica serovar Typhi
uuucauuggucaguaag

SEQ ID NO: 3622155 - RNA, 13 nt, Salmonella enterica enterica serovar Typhi
uuucauuucugcc

SEQ ID NO: 3622156 - RNA, 13 nt, Salmonella enterica enterica serovar Typhi
uuuccaaaaucca

SEQ ID NO: 3622157 - RNA, 21 nt, Salmonella enterica enterica serovar Typhi
uuuccaaagcgaagcugcugu

SEQ ID NO: 3622158 - RNA, 17 nt, Salmonella enterica enterica serovar Typhi
uuuccacaaucccggca

SEQ ID NO: 3622159 - RNA, 22 nt, Salmonella enterica enterica serovar Typhi
uuuccacaaucccggcaacugc

SEQ ID NO: 3622160 - RNA, 21 nt, Salmonella enterica enterica serovar Typhi
uuuccacacaggaguucauca

SEQ ID NO: 3622161 - RNA, 20 nt, Salmonella enterica enterica serovar Typhi
uuuccagaguacauucucuu

SEQ ID NO: 3622162 - RNA, 15 nt, Salmonella enterica enterica serovar Typhi
uuuccagcacgccca

SEQ ID NO: 3622163 - RNA, 22 nt, Salmonella enterica enterica serovar Typhi
uuuccagcacgcccauauccag

SEQ ID NO: 3622164 - RNA, 14 nt, Salmonella enterica enterica serovar Typhi
uuuccagcagccag

SEQ ID NO: 3622165 - RNA, 21 nt, Salmonella enterica enterica serovar Typhi
uuuccagccguaccacccggg

SEQ ID NO: 3622166 - RNA, 16 nt, Salmonella enterica enterica serovar Typhi
uuuccaggugcugcca

SEQ ID NO: 3622167 - RNA, 17 nt, Salmonella enterica enterica serovar Typhi
uuuccaggugcugccac

SEQ ID NO: 3622168 - RNA, 21 nt, Salmonella enterica enterica serovar Typhi
uuuccagucccugaagaaaag

SEQ ID NO: 3622169 - RNA, 13 nt, Salmonella enterica enterica serovar Typhi
uuuccagugccag

SEQ ID NO: 3622170 - RNA, 20 nt, Salmonella enterica enterica serovar Typhi
uuuccaguguuguucucuga

SEQ ID NO: 3622171 - RNA, 21 nt, Salmonella enterica enterica serovar Typhi
uuugauguccggcgcguucau

SEQ ID NO: 3622172 - RNA, 18 nt, Salmonella enterica enterica serovar Typhi
uuugauuuauuuugaauu

SEQ ID NO: 3622173 - RNA, 22 nt, Salmonella enterica enterica serovar Typhi
uuugauuuguuuuuuauauuuu

SEQ ID NO: 3622174 - RNA, 21 nt, Salmonella enterica enterica serovar Typhi
uuugcaccaucaacgccggug

SEQ ID NO: 3622175 - RNA, 17 nt, Salmonella enterica enterica serovar Typhi
uuugcaccgcuaaaaaa

SEQ ID NO: 3622176 - RNA, 19 nt, Salmonella enterica enterica serovar Typhi
uuugcaccgcuaaaaaaca

SEQ ID NO: 3622177 - RNA, 22 nt, Salmonella enterica enterica serovar Typhi
uuugcacggcaucuuuguucug

SEQ ID NO: 3622178 - RNA, 12 nt, Salmonella enterica enterica serovar Typhi
uuugcagaaaau

SEQ ID NO: 3622179 - RNA, 13 nt, Salmonella enterica enterica serovar Typhi
uuugcauaaauaa

SEQ ID NO: 3622180 - RNA, 17 nt, Salmonella enterica enterica serovar Typhi
uuugcauaccaaguuug

SEQ ID NO: 3622181 - RNA, 21 nt, Salmonella enterica enterica serovar Typhi
uuugcaucgugauagacggcu

SEQ ID NO: 3622182 - RNA, 13 nt, Salmonella enterica enterica serovar Typhi
uuugcauucgcuc

SEQ ID NO: 3622183 - RNA, 15 nt, Salmonella enterica enterica serovar Typhi
uuugcauucgcuccu

SEQ ID NO: 3622184 - RNA, 14 nt, Salmonella enterica enterica serovar Typhi
uuugcauugccacu

SEQ ID NO: 3622185 - RNA, 16 nt, Salmonella enterica enterica serovar Typhi
uuugccaaacugcugg

SEQ ID NO: 3622186 - RNA, 20 nt, Salmonella enterica enterica serovar Typhi
uuugccaaauauucucccua

SEQ ID NO: 3622187 - RNA, 18 nt, Salmonella enterica enterica serovar Typhi
uuugccagacgggccagg

SEQ ID NO: 3622188 - RNA, 14 nt, Salmonella enterica enterica serovar Typhi
uuugccauccggcg

SEQ ID NO: 3622189 - RNA, 22 nt, Salmonella enterica enterica serovar Typhi
uuugccccagauacgcacggug

SEQ ID NO: 3622190 - RNA, 21 nt, Salmonella enterica enterica serovar Typhi
uuugccccauuguucuuucau

SEQ ID NO: 3622191 - RNA, 15 nt, Salmonella enterica enterica serovar Typhi
uuugccucuggccag

SEQ ID NO: 3622192 - RNA, 21 nt, Salmonella enterica enterica serovar Typhi
uuugccucuggccaguuucaa

SEQ ID NO: 3622193 - RNA, 19 nt, Salmonella enterica enterica serovar Typhi
uuugccuuuugacagcaca

SEQ ID NO: 3622194 - RNA, 15 nt, Salmonella enterica enterica serovar Typhi
uuugcgacacgcugc

SEQ ID NO: 3622195 - RNA, 13 nt, Salmonella enterica enterica serovar Typhi
uuugcgacaucag

SEQ ID NO: 3622196 - RNA, 23 nt, Salmonella enterica enterica serovar Typhi
uuugcgcagcaacgucucgacau

SEQ ID NO: 3622197 - RNA, 20 nt, Salmonella enterica enterica serovar Typhi
uuugcgcaguuuaaaucaca

SEQ ID NO: 3622198 - RNA, 23 nt, Salmonella enterica enterica serovar Typhi
uuugcgccggcaguccuugcagc

SEQ ID NO: 3622199 - RNA, 15 nt, Salmonella enterica enterica serovar Typhi
uuugcgccuuccagu

SEQ ID NO: 3622200 - RNA, 21 nt, Salmonella enterica enterica serovar Typhi
uuugcgcgaagucgagcucag

SEQ ID NO: 3622201 - RNA, 15 nt, Salmonella enterica enterica serovar Typhi
uuugcgcuacgcugc

SEQ ID NO: 3622202 - RNA, 19 nt, Salmonella enterica enterica serovar Typhi
uuugcggcgucgccuggug

SEQ ID NO: 3622203 - RNA, 16 nt, Salmonella enterica enterica serovar Typhi
uuugcgguuuuaauuu

SEQ ID NO: 3622204 - RNA, 18 nt, Salmonella enterica enterica serovar Typhi
uuugcgguuuuaauuucc

SEQ ID NO: 3622205 - RNA, 15 nt, Salmonella enterica enterica serovar Typhi
uuugcguaaaaaaca

SEQ ID NO: 3622206 - RNA, 17 nt, Salmonella enterica enterica serovar Typhi
uuugcguacucagcaga

SEQ ID NO: 3622207 - RNA, 18 nt, Salmonella enterica enterica serovar Typhi
uuugcgucguuccgucag

SEQ ID NO: 3622208 - RNA, 19 nt, Salmonella enterica enterica serovar Typhi
uuugcuacaccccuucugg

SEQ ID NO: 3622209 - RNA, 12 nt, Salmonella enterica enterica serovar Typhi
uuugcuccagaa

SEQ ID NO: 3622210 - RNA, 15 nt, Salmonella enterica enterica serovar Typhi
uuugcugacaaucug

SEQ ID NO: 3622211 - RNA, 19 nt, Salmonella enterica enterica serovar Typhi
uuugcugacaaucugcugg

SEQ ID NO: 3622212 - RNA, 15 nt, Salmonella enterica enterica serovar Typhi
uuugcugcauuucuu

SEQ ID NO: 3622213 - RNA, 11 nt, Salmonella enterica enterica serovar Typhi
uuugcugcugc

SEQ ID NO: 3622214 - RNA, 19 nt, Salmonella enterica enterica serovar Typhi
uuugcuguuuuauuuccuc

SEQ ID NO: 3622215 - RNA, 21 nt, Salmonella enterica enterica serovar Typhi
uuugcuucaauaaguuagcuu

SEQ ID NO: 3622216 - RNA, 12 nt, Salmonella enterica enterica serovar Typhi
uuugcuuccagu

SEQ ID NO: 3622217 - RNA, 22 nt, Salmonella enterica enterica serovar Typhi
uuugcuucgccaucuccaucau

SEQ ID NO: 3622218 - RNA, 18 nt, Salmonella enterica enterica serovar Typhi
uuugcuuuaauauucauu

SEQ ID NO: 3622219 - RNA, 17 nt, Salmonella enterica enterica serovar Typhi
uuugcuuucucgggccu

SEQ ID NO: 3622220 - RNA, 20 nt, Salmonella enterica enterica serovar Typhi
uuuggcagacagccauauuu

SEQ ID NO: 3622221 - RNA, 24 nt, Salmonella enterica enterica serovar Typhi
uuuggcaggccucuaucuucucag

SEQ ID NO: 3622222 - RNA, 13 nt, Salmonella enterica enterica serovar Typhi
uuuggccugcugc

SEQ ID NO: 3622223 - RNA, 18 nt, Salmonella enterica enterica serovar Typhi
uuuggcgaauaaucaacc

SEQ ID NO: 3622224 - RNA, 22 nt, Salmonella enterica enterica serovar Typhi
uuuggcguaaucgauaagcuca

SEQ ID NO: 3622225 - RNA, 21 nt, Salmonella enterica enterica serovar Typhi
uuuggucggcguaacccagug

SEQ ID NO: 3622226 - RNA, 21 nt, Salmonella enterica enterica serovar Typhi
uuuggugcccgcguggaaaac

SEQ ID NO: 3622227 - RNA, 19 nt, Salmonella enterica enterica serovar Typhi
uuugguuagggaucaucuu

SEQ ID NO: 3622228 - RNA, 17 nt, Salmonella enterica enterica serovar Typhi
uuuguaaaauacauucu

SEQ ID NO: 3622229 - RNA, 19 nt, Salmonella enterica enterica serovar Typhi
uuuguaaaauacauucucu

SEQ ID NO: 3622230 - RNA, 14 nt, Salmonella enterica enterica serovar Typhi
uuuguaacauauuu

SEQ ID NO: 3622231 - RNA, 17 nt, Salmonella enterica enterica serovar Typhi
uuuguaacauauuuuua

SEQ ID NO: 3622232 - RNA, 18 nt, Salmonella enterica enterica serovar Typhi
uuuguaacauauuuuuau

SEQ ID NO: 3622233 - RNA, 18 nt, Salmonella enterica enterica serovar Typhi
uuuguacguauuuacaaa

SEQ ID NO: 3622234 - RNA, 22 nt, Salmonella enterica enterica serovar Typhi
uuuguauuaacggcgcugcgcu

SEQ ID NO: 3622235 - RNA, 22 nt, Salmonella enterica enterica serovar Typhi
uuuguauugcgcgucacaagcu

SEQ ID NO: 3622236 - RNA, 22 nt, Salmonella enterica enterica serovar Typhi
uuugucaucagaucaugaggau

SEQ ID NO: 3622237 - RNA, 14 nt, Salmonella enterica enterica serovar Typhi
uuuguccgcugcug

SEQ ID NO: 3622238 - RNA, 18 nt, Salmonella enterica enterica serovar Typhi
uuugucgcuguuaaucuc

SEQ ID NO: 3622239 - RNA, 17 nt, Salmonella enterica enterica serovar Typhi
uuugucuccucaugccu

SEQ ID NO: 3622240 - RNA, 16 nt, Salmonella enterica enterica serovar Typhi
uuugucuccucgccag

SEQ ID NO: 3622241 - RNA, 18 nt, Salmonella enterica enterica serovar Typhi
uuugucugucggacucag

SEQ ID NO: 3622242 - RNA, 23 nt, Salmonella enterica enterica serovar Typhi
uuuguggccugcuuaaacaguau

SEQ ID NO: 3622243 - RNA, 13 nt, Salmonella enterica enterica serovar Typhi
uuugugugcagga

SEQ ID NO: 3622244 - RNA, 18 nt, Salmonella enterica enterica serovar Typhi
uuuguuaucuacagugua

SEQ ID NO: 3622245 - RNA, 15 nt, Salmonella enterica enterica serovar Typhi
uuuguugccuucgau

SEQ ID NO: 3622246 - RNA, 18 nt, Salmonella enterica enterica serovar Typhi
uuuguuuuccagauucuc

SEQ ID NO: 3622247 - RNA, 14 nt, Salmonella enterica enterica serovar Typhi
uuuguuuuuuauau

SEQ ID NO: 3622248 - RNA, 12 nt, Salmonella enterica enterica serovar Typhi
uuuuaaaaauaa

SEQ ID NO: 3622249 - RNA, 14 nt, Salmonella enterica enterica serovar Typhi
uuuuaaaaaucagu

SEQ ID NO: 3622250 - RNA, 12 nt, Salmonella enterica enterica serovar Typhi
uuuuaaaagaag

SEQ ID NO: 3622251 - RNA, 12 nt, Salmonella enterica enterica serovar Typhi
uuuuaaaaguua

SEQ ID NO: 3622252 - RNA, 13 nt, Salmonella enterica enterica serovar Typhi
uuuuaaaaguuag

SEQ ID NO: 3622253 - RNA, 21 nt, Salmonella enterica enterica serovar Typhi
uuuuaaaauguuuuuguuguu

SEQ ID NO: 3622254 - RNA, 19 nt, Salmonella enterica enterica serovar Typhi
uuuuaaauaacuuuuaauu

SEQ ID NO: 3622255 - RNA, 12 nt, Salmonella enterica enterica serovar Typhi
uuuuaaauuccu

SEQ ID NO: 3622256 - RNA, 13 nt, Salmonella enterica enterica serovar Typhi
uuuuaaauugaag

SEQ ID NO: 3622257 - RNA, 19 nt, Salmonella enterica enterica serovar Typhi
uuuuguuguuaauuugauu

SEQ ID NO: 3622258 - RNA, 19 nt, Salmonella enterica enterica serovar Typhi
uuuuuaaauaacuuuuaau

SEQ ID NO: 3622259 - RNA, 19 nt, Salmonella enterica enterica serovar Typhi
uuuuuaaauguuuuuucau

SEQ ID NO: 3622260 - RNA, 13 nt, Salmonella enterica enterica serovar Typhi
uuuuuaauauaag

SEQ ID NO: 3622261 - RNA, 16 nt, Salmonella enterica enterica serovar Typhi
uuuuuaauauaagccu

SEQ ID NO: 3622262 - RNA, 15 nt, Salmonella enterica enterica serovar Typhi
uuuuuaauccaggaa

SEQ ID NO: 3622263 - RNA, 15 nt, Salmonella enterica enterica serovar Typhi
uuuuuacaaauuuaa

SEQ ID NO: 3622264 - RNA, 12 nt, Salmonella enterica enterica serovar Typhi
uuuuuaccaauu

SEQ ID NO: 3622265 - RNA, 17 nt, Salmonella enterica enterica serovar Typhi
uuuuuaccgacguuaaa

SEQ ID NO: 3622266 - RNA, 22 nt, Salmonella enterica enterica serovar Typhi
uuuuuaccgcauuauaaauauc

SEQ ID NO: 3622267 - RNA, 23 nt, Salmonella enterica enterica serovar Typhi
uuuuuaccgcauuauaaauauca

SEQ ID NO: 3622268 - RNA, 17 nt, Salmonella enterica enterica serovar Typhi
uuuuuaggccaaacuua

SEQ ID NO: 3622269 - RNA, 12 nt, Salmonella enterica enterica serovar Typhi
uuuuuauaacau

SEQ ID NO: 3622270 - RNA, 13 nt, Salmonella enterica enterica serovar Typhi
uuuuuauauaagc

SEQ ID NO: 3622271 - RNA, 21 nt, Salmonella enterica enterica serovar Typhi
uuuuuauauuccgcaggcaag

SEQ ID NO: 3622272 - RNA, 16 nt, Salmonella enterica enterica serovar Typhi
uuuuuauauucgcuca

SEQ ID NO: 3622273 - RNA, 19 nt, Salmonella enterica enterica serovar Typhi
uuuuuaugugacaaucacu

SEQ ID NO: 3622274 - RNA, 12 nt, Salmonella enterica enterica serovar Typhi
uuuuucagaucg

SEQ ID NO: 3622275 - RNA, 13 nt, Salmonella enterica enterica serovar Typhi
uuuuucagcaaau

SEQ ID NO: 3622276 - RNA, 14 nt, Salmonella enterica enterica serovar Typhi
uuuuucagccgcgc

SEQ ID NO: 3622277 - RNA, 21 nt, Salmonella enterica enterica serovar Typhi
uuuuuccagcacggcauaagc

SEQ ID NO: 3622278 - RNA, 12 nt, Salmonella enterica enterica serovar Typhi
uuuuuccagcuc

SEQ ID NO: 3622279 - RNA, 14 nt, Salmonella enterica enterica serovar Typhi
uuuuuccagcucag

SEQ ID NO: 3622280 - RNA, 21 nt, Salmonella enterica enterica serovar Typhi
uuuuuccagcucagaaauaaa

SEQ ID NO: 3622281 - RNA, 22 nt, Salmonella enterica enterica serovar Typhi
uuuuuccccguugcucauguua

SEQ ID NO: 3622282 - RNA, 23 nt, Salmonella enterica enterica serovar Typhi
uuuuuccgccaccuguuucgcca

SEQ ID NO: 3622283 - RNA, 16 nt, Salmonella enterica enterica serovar Typhi
uuuuucgcgugccauu

SEQ ID NO: 3622284 - RNA, 21 nt, Salmonella enterica enterica serovar Typhi
uuuuucucgauaucuuccccg

SEQ ID NO: 3622285 - RNA, 22 nt, Salmonella enterica enterica serovar Typhi
uuuuucucuguccggaauaacu

SEQ ID NO: 3622286 - RNA, 12 nt, Salmonella enterica enterica serovar Typhi
uuuuucuucagu

SEQ ID NO: 3622287 - RNA, 16 nt, Salmonella enterica enterica serovar Typhi
uuuuugacuaaaguuu

SEQ ID NO: 3622288 - RNA, 18 nt, Salmonella enterica enterica serovar Typhi
uuuuugccacauuucccg

SEQ ID NO: 3622289 - RNA, 18 nt, Salmonella enterica enterica serovar Typhi
uuuuugcuuuaauauuca

SEQ ID NO: 3622290 - RNA, 13 nt, Salmonella enterica enterica serovar Typhi
uuuuuguauuccu

SEQ ID NO: 3622291 - RNA, 19 nt, Salmonella enterica enterica serovar Typhi
uuuuuuacuuucaaaauac

SEQ ID NO: 3622292 - RNA, 24 nt, Salmonella enterica enterica serovar Typhi
uuuuuuaugaccguauuacaagua

SEQ ID NO: 3622293 - RNA, 12 nt, Salmonella enterica enterica serovar Typhi
uuuuuucagccu

SEQ ID NO: 3622294 - RNA, 11 nt, Salmonella enterica enterica serovar Typhi
uuuuuuggcag

SEQ ID NO: 3622295 - RNA, 15 nt, Salmonella enterica enterica serovar Typhi
gaccuucauggcguu

SEQ ID NO: 3622296 - RNA, 15 nt, Salmonella enterica enterica serovar Typhi
gacgaaagucaucca

SEQ ID NO: 3622297 - RNA, 18 nt, Salmonella enterica enterica serovar Typhi
gacgaaccggcgccguuu

SEQ ID NO: 3622298 - RNA, 12 nt, Salmonella enterica enterica serovar Typhi
gacgaacgcuau

SEQ ID NO: 3622299 - RNA, 19 nt, Salmonella enterica enterica serovar Typhi
gacgaaguccuucacaaac

SEQ ID NO: 3622300 - RNA, 17 nt, Salmonella enterica enterica serovar Typhi
gacgaauaccugaaaga

SEQ ID NO: 3622301 - RNA, 19 nt, Salmonella enterica enterica serovar Typhi
gacgaaucagcgauugcgc

SEQ ID NO: 3622302 - RNA, 16 nt, Salmonella enterica enterica serovar Typhi
gacgaaucuggauagu

SEQ ID NO: 3622303 - RNA, 14 nt, Salmonella enterica enterica serovar Typhi
gacgaauuuccagc

SEQ ID NO: 3622304 - RNA, 14 nt, Salmonella enterica enterica serovar Typhi
gacgacaagcagaa

SEQ ID NO: 3622305 - RNA, 16 nt, Salmonella enterica enterica serovar Typhi
gacgacccuguguagu

SEQ ID NO: 3622306 - RNA, 23 nt, Salmonella enterica enterica serovar Typhi
gacgaccguaauagcaauacuuu

SEQ ID NO: 3622307 - RNA, 17 nt, Salmonella enterica enterica serovar Typhi
gacgacgccagccagcc

SEQ ID NO: 3622308 - RNA, 21 nt, Salmonella enterica enterica serovar Typhi
gacgacguucgauacuauaac

SEQ ID NO: 3622309 - RNA, 20 nt, Salmonella enterica enterica serovar Typhi
gacgacuucacccgcgggcg

SEQ ID NO: 3622310 - RNA, 23 nt, Salmonella enterica enterica serovar Typhi
gacgacuucacccgcgggcggcg

SEQ ID NO: 3622311 - RNA, 22 nt, Salmonella enterica enterica serovar Typhi
gacgaggauuagacuucuucca

SEQ ID NO: 3622312 - RNA, 18 nt, Salmonella enterica enterica serovar Typhi
gacgagguuuccggcggg

SEQ ID NO: 3622313 - RNA, 13 nt, Salmonella enterica enterica serovar Typhi
gacgauaaaaaaa

SEQ ID NO: 3622314 - RNA, 16 nt, Salmonella enterica enterica serovar Typhi
gacgauaaccaugcuc

SEQ ID NO: 3622315 - RNA, 22 nt, Salmonella enterica enterica serovar Typhi
gacgauaaccggacgauuuaag

SEQ ID NO: 3622316 - RNA, 17 nt, Salmonella enterica enterica serovar Typhi
gacgauacgucauauca

SEQ ID NO: 3622317 - RNA, 21 nt, Salmonella enterica enterica serovar Typhi
gacgauacucagccccaggcc

SEQ ID NO: 3622318 - RNA, 14 nt, Salmonella enterica enterica serovar Typhi
gacgaucagcgcca

SEQ ID NO: 3622319 - RNA, 13 nt, Salmonella enterica enterica serovar Typhi
gacgaugauaaua

SEQ ID NO: 3622320 - RNA, 18 nt, Salmonella enterica enterica serovar Typhi
gacgaugaugagauacgu

SEQ ID NO: 3622321 - RNA, 23 nt, Salmonella enterica enterica serovar Typhi
gacgauuugcgcucgcgccagau

SEQ ID NO: 3622322 - RNA, 16 nt, Salmonella enterica enterica serovar Typhi
gacgcaacucacgcca

SEQ ID NO: 3622323 - RNA, 20 nt, Salmonella enterica enterica serovar Typhi
gacgcaauagaguaaugaca

SEQ ID NO: 3622324 - RNA, 15 nt, Salmonella enterica enterica serovar Typhi
gacgcacaaucgccg

SEQ ID NO: 3622325 - RNA, 20 nt, Salmonella enterica enterica serovar Typhi
gcagccccauuugccgugcc

SEQ ID NO: 3622326 - RNA, 21 nt, Salmonella enterica enterica serovar Typhi
gcagccccggcauccaguucc

SEQ ID NO: 3622327 - RNA, 20 nt, Salmonella enterica enterica serovar Typhi
gcagcccugcgucgcguacc

SEQ ID NO: 3622328 - RNA, 23 nt, Salmonella enterica enterica serovar Typhi
gcagcccuuacgcuuuauucugu

SEQ ID NO: 3622329 - RNA, 21 nt, Salmonella enterica enterica serovar Typhi
gcagcccuuugagaaaacugc

SEQ ID NO: 3622330 - RNA, 13 nt, Salmonella enterica enterica serovar Typhi
gcagccgacagcg

SEQ ID NO: 3622331 - RNA, 15 nt, Salmonella enterica enterica serovar Typhi
gcagccgcacaugaa

SEQ ID NO: 3622332 - RNA, 12 nt, Salmonella enterica enterica serovar Typhi
gcagccgccacc

SEQ ID NO: 3622333 - RNA, 14 nt, Salmonella enterica enterica serovar Typhi
gcagccgccaccac

SEQ ID NO: 3622334 - RNA, 17 nt, Salmonella enterica enterica serovar Typhi
gcagccgcucaggguaa

SEQ ID NO: 3622335 - RNA, 13 nt, Salmonella enterica enterica serovar Typhi
gcagccgcugaua

SEQ ID NO: 3622336 - RNA, 16 nt, Salmonella enterica enterica serovar Typhi
gcagccgguauccagc

SEQ ID NO: 3622337 - RNA, 16 nt, Salmonella enterica enterica serovar Typhi
gcagcgaaaauccagu

SEQ ID NO: 3622338 - RNA, 18 nt, Salmonella enterica enterica serovar Typhi
gcagcgaaagcugccuuu

SEQ ID NO: 3622339 - RNA, 17 nt, Salmonella enterica enterica serovar Typhi
gcagcgaauagcggcaa

SEQ ID NO: 3622340 - RNA, 20 nt, Salmonella enterica enterica serovar Typhi
gcagcgaggugauaaucagc

SEQ ID NO: 3622341 - RNA, 16 nt, Salmonella enterica enterica serovar Typhi
gcagcgaugacagcag

SEQ ID NO: 3622342 - RNA, 16 nt, Salmonella enterica enterica serovar Typhi
gcagcgcaccugcccc

SEQ ID NO: 3622343 - RNA, 13 nt, Salmonella enterica enterica serovar Typhi
gcagcgcauaggc

SEQ ID NO: 3622344 - RNA, 14 nt, Salmonella enterica enterica serovar Typhi
gcagcgcaucaucc

SEQ ID NO: 3622345 - RNA, 15 nt, Salmonella enterica enterica serovar Typhi
gcagcgcaucauggu

SEQ ID NO: 3622346 - RNA, 21 nt, Salmonella enterica enterica serovar Typhi
gcagcgccaccgggcaacaca

SEQ ID NO: 3622347 - RNA, 13 nt, Salmonella enterica enterica serovar Typhi
gcagcgccagcgu

SEQ ID NO: 3622348 - RNA, 14 nt, Salmonella enterica enterica serovar Typhi
gcagcgccaucagg

SEQ ID NO: 3622349 - RNA, 15 nt, Salmonella enterica enterica serovar Typhi
gcagcgccaucaggc

SEQ ID NO: 3622350 - RNA, 20 nt, Salmonella enterica enterica serovar Typhi
gcagcgccaucaggcacggc

SEQ ID NO: 3622351 - RNA, 18 nt, Salmonella enterica enterica serovar Typhi
gcagcgccaucaggcccc

SEQ ID NO: 3622352 - RNA, 15 nt, Salmonella enterica enterica serovar Typhi
gcagcgccauccggc

SEQ ID NO: 3622353 - RNA, 13 nt, Salmonella enterica enterica serovar Typhi
gcagcgcccagca

SEQ ID NO: 3622354 - RNA, 17 nt, Salmonella enterica enterica serovar Typhi
gcagcgccccgccgcgc

SEQ ID NO: 3622355 - RNA, 15 nt, Salmonella enterica enterica serovar Typhi
gcagcgccuucgcuu

SEQ ID NO: 3622356 - RNA, 17 nt, Salmonella enterica enterica serovar Typhi
gcagcgcgacauagagc

SEQ ID NO: 3622357 - RNA, 14 nt, Salmonella enterica enterica serovar Typhi
gcagcgcgauacgc

SEQ ID NO: 3622358 - RNA, 15 nt, Salmonella enterica enterica serovar Typhi
gcagcgcggcacaca

SEQ ID NO: 3622359 - RNA, 18 nt, Salmonella enterica enterica serovar Typhi
gcagcgcggccagcgccu

SEQ ID NO: 3622360 - RNA, 16 nt, Salmonella enterica enterica serovar Typhi
gcagcgcggccugcgu

SEQ ID NO: 3622361 - RNA, 20 nt, Salmonella enterica enterica serovar Typhi
gcagcggcgguuauccgcca

SEQ ID NO: 3622362 - RNA, 18 nt, Salmonella enterica enterica serovar Typhi
gcagcguaauagucugcu

SEQ ID NO: 3622363 - RNA, 15 nt, Salmonella enterica enterica serovar Typhi
gcagcguauacgccg

SEQ ID NO: 3622364 - RNA, 15 nt, Salmonella enterica enterica serovar Typhi
gcagcgucaucaggc

SEQ ID NO: 3622365 - RNA, 15 nt, Salmonella enterica enterica serovar Typhi
gcagcgucggcuuca

SEQ ID NO: 3622366 - RNA, 14 nt, Salmonella enterica enterica serovar Typhi
gcagcgucuuccca

SEQ ID NO: 3622367 - RNA, 15 nt, Salmonella enterica enterica serovar Typhi
gcagcucaagcgccg

SEQ ID NO: 3622368 - RNA, 14 nt, Salmonella enterica enterica serovar Typhi
gcagcucaucaaua

SEQ ID NO: 3622369 - RNA, 21 nt, Salmonella enterica enterica serovar Typhi
gcagcuccuuuuaauaaagaa

SEQ ID NO: 3622370 - RNA, 13 nt, Salmonella enterica enterica serovar Typhi
gcagcucugccug

SEQ ID NO: 3622371 - RNA, 12 nt, Salmonella enterica enterica serovar Typhi
gcagcugggccu

SEQ ID NO: 3622372 - RNA, 13 nt, Salmonella enterica enterica serovar Typhi
gcagcugggccug

SEQ ID NO: 3622373 - RNA, 15 nt, Salmonella enterica enterica serovar Typhi
gcagcuuaaagccaa

SEQ ID NO: 3622374 - RNA, 21 nt, Salmonella enterica enterica serovar Typhi
gcagcuuagcaaucugacgca

SEQ ID NO: 3622375 - RNA, 13 nt, Salmonella enterica enterica serovar Typhi
gcagcuucagcca

SEQ ID NO: 3622376 - RNA, 12 nt, Salmonella enterica enterica serovar Typhi
gcagcuuccagc

SEQ ID NO: 3622377 - RNA, 15 nt, Salmonella enterica enterica serovar Typhi
gcagcuucgccgcgu

SEQ ID NO: 3622378 - RNA, 22 nt, Salmonella enterica enterica serovar Typhi
gcagcuucgccgcguaaucuuc

SEQ ID NO: 3622379 - RNA, 15 nt, Salmonella enterica enterica serovar Typhi
gcagcuucugauacu

SEQ ID NO: 3622380 - RNA, 18 nt, Salmonella enterica enterica serovar Typhi
gcagcuuggcggcuuccu

SEQ ID NO: 3622381 - RNA, 19 nt, Salmonella enterica enterica serovar Typhi
gcaggaaauccagcagaau

SEQ ID NO: 3622382 - RNA, 14 nt, Salmonella enterica enterica serovar Typhi
gcaggaacagauac

SEQ ID NO: 3622383 - RNA, 15 nt, Salmonella enterica enterica serovar Typhi
gcaggaacggcagga

SEQ ID NO: 3622384 - RNA, 16 nt, Salmonella enterica enterica serovar Typhi
gcaggaaggaauuaug

SEQ ID NO: 3622385 - RNA, 15 nt, Salmonella enterica enterica serovar Typhi
gcaggaaguuuucug

SEQ ID NO: 3622386 - RNA, 14 nt, Salmonella enterica enterica serovar Typhi
gcaggacagcgaca

SEQ ID NO: 3622387 - RNA, 15 nt, Salmonella enterica enterica serovar Typhi
gcaggacagcgacau

SEQ ID NO: 3622388 - RNA, 12 nt, Salmonella enterica enterica serovar Typhi
gcaggacccgag

SEQ ID NO: 3622389 - RNA, 18 nt, Salmonella enterica enterica serovar Typhi
gcaggagcgcgacgacgg

SEQ ID NO: 3622390 - RNA, 19 nt, Salmonella enterica enterica serovar Typhi
gcaggagggagguucgccu

SEQ ID NO: 3622391 - RNA, 23 nt, Salmonella enterica enterica serovar Typhi
gcaggaucuccagaucgccacga

SEQ ID NO: 3622392 - RNA, 16 nt, Salmonella enterica enterica serovar Typhi
gcaggaugcgcugcgc

SEQ ID NO: 3622393 - RNA, 23 nt, Salmonella enterica enterica serovar Typhi
gcaggaugucgauaauacagccu

SEQ ID NO: 3622394 - RNA, 21 nt, Salmonella enterica enterica serovar Typhi
gcaggauuuguaucacaauca

SEQ ID NO: 3622395 - RNA, 22 nt, Salmonella enterica enterica serovar Typhi
gcaggcaaaucaacauuauuaa

SEQ ID NO: 3622396 - RNA, 17 nt, Salmonella enterica enterica serovar Typhi
gcaggcaggucuccagc

SEQ ID NO: 3622397 - RNA, 19 nt, Salmonella enterica enterica serovar Typhi
gcaggcaguuuauucagaa

SEQ ID NO: 3622398 - RNA, 17 nt, Salmonella enterica enterica serovar Typhi
gcaggcauuaaaaaaac

SEQ ID NO: 3622399 - RNA, 18 nt, Salmonella enterica enterica serovar Typhi
gcaggcauuaaaaaaacg

SEQ ID NO: 3622400 - RNA, 17 nt, Salmonella enterica enterica serovar Typhi
gcaggccaaacagcggc

SEQ ID NO: 3622401 - RNA, 18 nt, Salmonella enterica enterica serovar Typhi
gcaggccauaaaacgggc

SEQ ID NO: 3622402 - RNA, 18 nt, Salmonella enterica enterica serovar Typhi
gcaggccuuucggcagcg

SEQ ID NO: 3622403 - RNA, 22 nt, Salmonella enterica enterica serovar Typhi
gcaggcgaaaccggccgccauc

SEQ ID NO: 3622404 - RNA, 22 nt, Salmonella enterica enterica serovar Typhi
gcaggcgauagccccaguaaau

SEQ ID NO: 3622405 - RNA, 18 nt, Salmonella enterica enterica serovar Typhi
gcaggcgggugcgcagcc

SEQ ID NO: 3622406 - RNA, 18 nt, Salmonella enterica enterica serovar Typhi
gcaggcgucaaaacaggu

SEQ ID NO: 3622407 - RNA, 22 nt, Salmonella enterica enterica serovar Typhi
gcaggcgucaaaacaggucugu

SEQ ID NO: 3622408 - RNA, 19 nt, Salmonella enterica enterica serovar Typhi
gcaggcgucauagccgcgc

SEQ ID NO: 3622409 - RNA, 20 nt, Salmonella enterica enterica serovar Typhi
gcaggcuaacgcgccccagg

SEQ ID NO: 3622410 - RNA, 14 nt, Salmonella enterica enterica serovar Typhi
gcaggcucaccagc

SEQ ID NO: 3622411 - RNA, 23 nt, Salmonella enterica enterica serovar Typhi
gcauaccggccacgagcugucac

SEQ ID NO: 3622412 - RNA, 20 nt, Salmonella enterica enterica serovar Typhi
gcauaccgugugcagugaca

SEQ ID NO: 3622413 - RNA, 13 nt, Salmonella enterica enterica serovar Typhi
gcauaccuucaca

SEQ ID NO: 3622414 - RNA, 23 nt, Salmonella enterica enterica serovar Typhi
gcauacgccccgguggcgguacc

SEQ ID NO: 3622415 - RNA, 14 nt, Salmonella enterica enterica serovar Typhi
gcauacguuucacc

SEQ ID NO: 3622416 - RNA, 16 nt, Salmonella enterica enterica serovar Typhi
gcauacguuucaccag

SEQ ID NO: 3622417 - RNA, 15 nt, Salmonella enterica enterica serovar Typhi
gcauacuaccgcugc

SEQ ID NO: 3622418 - RNA, 19 nt, Salmonella enterica enterica serovar Typhi
gcauacucacgaauaagaa

SEQ ID NO: 3622419 - RNA, 21 nt, Salmonella enterica enterica serovar Typhi
gcauacucauuaccggcugcc

SEQ ID NO: 3622420 - RNA, 22 nt, Salmonella enterica enterica serovar Typhi
gcauacucuccuccauaccuuu

SEQ ID NO: 3622421 - RNA, 18 nt, Salmonella enterica enterica serovar Typhi
gcauacucuuggagagca

SEQ ID NO: 3622422 - RNA, 14 nt, Salmonella enterica enterica serovar Typhi
gcauagaaaaagaa

SEQ ID NO: 3622423 - RNA, 17 nt, Salmonella enterica enterica serovar Typhi
gcauagaauuucagggu

SEQ ID NO: 3622424 - RNA, 16 nt, Salmonella enterica enterica serovar Typhi
gcauagacgugcggca

SEQ ID NO: 3622425 - RNA, 18 nt, Salmonella enterica enterica serovar Typhi
gcauagcgccuucaggca

SEQ ID NO: 3622426 - RNA, 20 nt, Salmonella enterica enterica serovar Typhi
gcauagcgcgaaugauuuua

SEQ ID NO: 3622427 - RNA, 19 nt, Salmonella enterica enterica serovar Typhi
gcauagcgucaucaacaua

SEQ ID NO: 3622428 - RNA, 19 nt, Salmonella enterica enterica serovar Typhi
gcauagcuggcguagccag

SEQ ID NO: 3622429 - RNA, 18 nt, Salmonella enterica enterica serovar Typhi
gcauagcuguuccgcaac

SEQ ID NO: 3622430 - RNA, 17 nt, Salmonella enterica enterica serovar Typhi
gcauauacucacugaau

SEQ ID NO: 3622431 - RNA, 17 nt, Salmonella enterica enterica serovar Typhi
gcauaucgauagcaucg

SEQ ID NO: 3622432 - RNA, 14 nt, Salmonella enterica enterica serovar Typhi
gcauaucgccauac

SEQ ID NO: 3622433 - RNA, 12 nt, Salmonella enterica enterica serovar Typhi
gcauaucgccgu

SEQ ID NO: 3622434 - RNA, 18 nt, Salmonella enterica enterica serovar Typhi
gcauaugcacacgcagcu

SEQ ID NO: 3622435 - RNA, 16 nt, Salmonella enterica enterica serovar Typhi
gcauaugcacagcgcu

SEQ ID NO: 3622436 - RNA, 22 nt, Salmonella enterica enterica serovar Typhi
gcauauucauaucgaagcccag

SEQ ID NO: 3622437 - RNA, 14 nt, Salmonella enterica enterica serovar Typhi
gcauauuuagccca

SEQ ID NO: 3622438 - RNA, 18 nt, Salmonella enterica enterica serovar Typhi
gcaucaaacuucguuacu

SEQ ID NO: 3622439 - RNA, 13 nt, Salmonella enterica enterica serovar Typhi
gcaucaaacuuuu

SEQ ID NO: 3622440 - RNA, 16 nt, Salmonella enterica enterica serovar Typhi
gcaucaaacuuuuaaa

SEQ ID NO: 3622441 - RNA, 21 nt, Salmonella enterica enterica serovar Typhi
gcaucaaacuuuuaaauugaa

SEQ ID NO: 3622442 - RNA, 13 nt, Salmonella enterica enterica serovar Typhi
gcaucaaagccac

SEQ ID NO: 3622443 - RNA, 16 nt, Salmonella enterica enterica serovar Typhi
gcaucaaauaccuuuu

SEQ ID NO: 3622444 - RNA, 13 nt, Salmonella enterica enterica serovar Typhi
gcaucaacgccag

SEQ ID NO: 3622445 - RNA, 15 nt, Salmonella enterica enterica serovar Typhi
gcaucaacguaaaua

SEQ ID NO: 3622446 - RNA, 14 nt, Salmonella enterica enterica serovar Typhi
gcaucaagcccaug

SEQ ID NO: 3622447 - RNA, 18 nt, Salmonella enterica enterica serovar Typhi
gcaucacaucaaagcccc

SEQ ID NO: 3622448 - RNA, 15 nt, Salmonella enterica enterica serovar Typhi
gcaucaccaggcaau

SEQ ID NO: 3622449 - RNA, 12 nt, Salmonella enterica enterica serovar Typhi
gcaucaccggau

SEQ ID NO: 3622450 - RNA, 13 nt, Salmonella enterica enterica serovar Typhi
gcaucagaaaaac

SEQ ID NO: 3622451 - RNA, 14 nt, Salmonella enterica enterica serovar Typhi
gcaucagaaaaacc

SEQ ID NO: 3622452 - RNA, 22 nt, Salmonella enterica enterica serovar Typhi
gcaucagaaaaaccuccggcua

SEQ ID NO: 3622453 - RNA, 19 nt, Salmonella enterica enterica serovar Typhi
gcaucagaacaaacuuauc

SEQ ID NO: 3622454 - RNA, 12 nt, Salmonella enterica enterica serovar Typhi
gcaucagacggu

SEQ ID NO: 3622455 - RNA, 15 nt, Salmonella enterica enterica serovar Typhi
gcaucagacgguggc

SEQ ID NO: 3622456 - RNA, 17 nt, Salmonella enterica enterica serovar Typhi
gcaucagacuacuuuua

SEQ ID NO: 3622457 - RNA, 18 nt, Salmonella enterica enterica serovar Typhi
gcaucaggaaauccugga

SEQ ID NO: 3622458 - RNA, 13 nt, Salmonella enterica enterica serovar Typhi
gcaucauaaaagg

SEQ ID NO: 3622459 - RNA, 15 nt, Salmonella enterica enterica serovar Typhi
gcaucauauucgcag

SEQ ID NO: 3622460 - RNA, 14 nt, Salmonella enterica enterica serovar Typhi
gcaucauccccacc

SEQ ID NO: 3622461 - RNA, 21 nt, Salmonella enterica enterica serovar Typhi
gcaucaucgguguucacaauu

SEQ ID NO: 3622462 - RNA, 17 nt, Salmonella enterica enterica serovar Typhi
gcaucaucucccaggcc

SEQ ID NO: 3622463 - RNA, 21 nt, Salmonella enterica enterica serovar Typhi
gcaucaucucccaggccgcca

SEQ ID NO: 3622464 - RNA, 15 nt, Salmonella enterica enterica serovar Typhi
gcaucauucaucucg

SEQ ID NO: 3622465 - RNA, 15 nt, Salmonella enterica enterica serovar Typhi
gcaucauucugcagg

SEQ ID NO: 3622466 - RNA, 16 nt, Salmonella enterica enterica serovar Typhi
gcauccaccgcggagu

SEQ ID NO: 3622467 - RNA, 13 nt, Salmonella enterica enterica serovar Typhi
gcauccagaccca

SEQ ID NO: 3622468 - RNA, 21 nt, Salmonella enterica enterica serovar Typhi
gcauccagacccacagccggu

SEQ ID NO: 3622469 - RNA, 21 nt, Salmonella enterica enterica serovar Typhi
gcauccagcacgagcgccagc

SEQ ID NO: 3622470 - RNA, 13 nt, Salmonella enterica enterica serovar Typhi
gcauccagcucau

SEQ ID NO: 3622471 - RNA, 14 nt, Salmonella enterica enterica serovar Typhi
cuccgguaaucacc

SEQ ID NO: 3622472 - RNA, 21 nt, Salmonella enterica enterica serovar Typhi
cuccgguaucgccggcagacg

SEQ ID NO: 3622473 - RNA, 14 nt, Salmonella enterica enterica serovar Typhi
cuccgguugcugau

SEQ ID NO: 3622474 - RNA, 17 nt, Salmonella enterica enterica serovar Typhi
cuccgguugcugauaac

SEQ ID NO: 3622475 - RNA, 12 nt, Salmonella enterica enterica serovar Typhi
cuccgucaaaga

SEQ ID NO: 3622476 - RNA, 15 nt, Salmonella enterica enterica serovar Typhi
cuccuaagagaaaac

SEQ ID NO: 3622477 - RNA, 16 nt, Salmonella enterica enterica serovar Typhi
cuccuaagagaaaacc

SEQ ID NO: 3622478 - RNA, 12 nt, Salmonella enterica enterica serovar Typhi
cuccucagcagg

SEQ ID NO: 3622479 - RNA, 18 nt, Salmonella enterica enterica serovar Typhi
cuccucagcgcuuaccac

SEQ ID NO: 3622480 - RNA, 22 nt, Salmonella enterica enterica serovar Typhi
cuccugaauagcuuucaccggu

SEQ ID NO: 3622481 - RNA, 21 nt, Salmonella enterica enterica serovar Typhi
cuccugauaaccuauuuugca

SEQ ID NO: 3622482 - RNA, 21 nt, Salmonella enterica enterica serovar Typhi
cuccugcaaucguucuugcac

SEQ ID NO: 3622483 - RNA, 12 nt, Salmonella enterica enterica serovar Typhi
cuccugcauuug

SEQ ID NO: 3622484 - RNA, 23 nt, Salmonella enterica enterica serovar Typhi
cuccugccugacaaugacgcuuc

SEQ ID NO: 3622485 - RNA, 18 nt, Salmonella enterica enterica serovar Typhi
cuccugcgauagcugcug

SEQ ID NO: 3622486 - RNA, 15 nt, Salmonella enterica enterica serovar Typhi
cuccugcggccuugc

SEQ ID NO: 3622487 - RNA, 21 nt, Salmonella enterica enterica serovar Typhi
cuccugcggccuugccgccag

SEQ ID NO: 3622488 - RNA, 22 nt, Salmonella enterica enterica serovar Typhi
cuccugcggccuugccgccagc

SEQ ID NO: 3622489 - RNA, 13 nt, Salmonella enterica enterica serovar Typhi
cuccugcucccag

SEQ ID NO: 3622490 - RNA, 17 nt, Salmonella enterica enterica serovar Typhi
cuccuggaugcgcugaa

SEQ ID NO: 3622491 - RNA, 15 nt, Salmonella enterica enterica serovar Typhi
cuccuggauuuuacc

SEQ ID NO: 3622492 - RNA, 15 nt, Salmonella enterica enterica serovar Typhi
cuccuggcauggcuc

SEQ ID NO: 3622493 - RNA, 22 nt, Salmonella enterica enterica serovar Typhi
cuccuggcauggcucgccgcug

SEQ ID NO: 3622494 - RNA, 18 nt, Salmonella enterica enterica serovar Typhi
cuccuggcuuaccugcuc

SEQ ID NO: 3622495 - RNA, 14 nt, Salmonella enterica enterica serovar Typhi
cuccugucaggcga

SEQ ID NO: 3622496 - RNA, 19 nt, Salmonella enterica enterica serovar Typhi
cuccuguugaagauuagcc

SEQ ID NO: 3622497 - RNA, 14 nt, Salmonella enterica enterica serovar Typhi
cuccuucauccaga

SEQ ID NO: 3622498 - RNA, 23 nt, Salmonella enterica enterica serovar Typhi
cuccuucuucgccgucauaaaac

SEQ ID NO: 3622499 - RNA, 23 nt, Salmonella enterica enterica serovar Typhi
cuccuugcggugagaaacgcgcc

SEQ ID NO: 3622500 - RNA, 16 nt, Salmonella enterica enterica serovar Typhi
cuccuuguaagggagg

SEQ ID NO: 3622501 - RNA, 21 nt, Salmonella enterica enterica serovar Typhi
cuccuuguaagggaggugcuc

SEQ ID NO: 3622502 - RNA, 23 nt, Salmonella enterica enterica serovar Typhi
cuccuuguaagggaggugcucuc

SEQ ID NO: 3622503 - RNA, 16 nt, Salmonella enterica enterica serovar Typhi
cucgaaacgcugcgcu

SEQ ID NO: 3622504 - RNA, 17 nt, Salmonella enterica enterica serovar Typhi
cucgaauuguuaaaagc

SEQ ID NO: 3622505 - RNA, 19 nt, Salmonella enterica enterica serovar Typhi
cucgacauagguucugcga

SEQ ID NO: 3622506 - RNA, 15 nt, Salmonella enterica enterica serovar Typhi
cucgacgcacuccag

SEQ ID NO: 3622507 - RNA, 11 nt, Salmonella enterica enterica serovar Typhi
cucgacggugc

SEQ ID NO: 3622508 - RNA, 20 nt, Salmonella enterica enterica serovar Typhi
cucgaggaacuguucagcca

SEQ ID NO: 3622509 - RNA, 21 nt, Salmonella enterica enterica serovar Typhi
cucgaggaacuguucagccag

SEQ ID NO: 3622510 - RNA, 22 nt, Salmonella enterica enterica serovar Typhi
cucgauaauauccgacgccugu

SEQ ID NO: 3622511 - RNA, 13 nt, Salmonella enterica enterica serovar Typhi
cucgauccggcag

SEQ ID NO: 3622512 - RNA, 13 nt, Salmonella enterica enterica serovar Typhi
cucgaucgccugg

SEQ ID NO: 3622513 - RNA, 22 nt, Salmonella enterica enterica serovar Typhi
cucgauuccugacgcacagugu

SEQ ID NO: 3622514 - RNA, 19 nt, Salmonella enterica enterica serovar Typhi
cucgauuugcccuuccagc

SEQ ID NO: 3622515 - RNA, 15 nt, Salmonella enterica enterica serovar Typhi
cucgcaagauuccag

SEQ ID NO: 3622516 - RNA, 14 nt, Salmonella enterica enterica serovar Typhi
cucgcaauauucau

SEQ ID NO: 3622517 - RNA, 20 nt, Salmonella enterica enterica serovar Typhi
cucgcaauauucaugccaga

SEQ ID NO: 3622518 - RNA, 17 nt, Salmonella enterica enterica serovar Typhi
cucgcagguacgacacc

SEQ ID NO: 3622519 - RNA, 21 nt, Salmonella enterica enterica serovar Typhi
cucgcagguacgacacccgau

SEQ ID NO: 3622520 - RNA, 20 nt, Salmonella enterica enterica serovar Typhi
cucgcaugcauagccgcugc

SEQ ID NO: 3622521 - RNA, 20 nt, Salmonella enterica enterica serovar Typhi
cucgccaaagcgcugcugcu

SEQ ID NO: 3622522 - RNA, 20 nt, Salmonella enterica enterica serovar Typhi
cucgccacgguuggcccagc

SEQ ID NO: 3622523 - RNA, 12 nt, Salmonella enterica enterica serovar Typhi
cucgccagucag

SEQ ID NO: 3622524 - RNA, 13 nt, Salmonella enterica enterica serovar Typhi
cucgccauaaaga

SEQ ID NO: 3622525 - RNA, 22 nt, Salmonella enterica enterica serovar Typhi
cucgccauaaaucccggcgauu

SEQ ID NO: 3622526 - RNA, 12 nt, Salmonella enterica enterica serovar Typhi
cucgcccagcac

SEQ ID NO: 3622527 - RNA, 13 nt, Salmonella enterica enterica serovar Typhi
cucgcccgccaga

SEQ ID NO: 3622528 - RNA, 14 nt, Salmonella enterica enterica serovar Typhi
cucgcccgccagau

SEQ ID NO: 3622529 - RNA, 19 nt, Salmonella enterica enterica serovar Typhi
cucgccgacaugcuccugc

SEQ ID NO: 3622530 - RNA, 18 nt, Salmonella enterica enterica serovar Typhi
cucgccgauuggcaaaau

SEQ ID NO: 3622531 - RNA, 13 nt, Salmonella enterica enterica serovar Typhi
cucgccgccuccc

SEQ ID NO: 3622532 - RNA, 14 nt, Salmonella enterica enterica serovar Typhi
cucgccgcgcucca

SEQ ID NO: 3622533 - RNA, 23 nt, Salmonella enterica enterica serovar Typhi
cucgccggauggcgacgcguagc

SEQ ID NO: 3622534 - RNA, 21 nt, Salmonella enterica enterica serovar Typhi
cucgccgguuuuuuuacucug

SEQ ID NO: 3622535 - RNA, 15 nt, Salmonella enterica enterica serovar Typhi
cucgccuuucuccau

SEQ ID NO: 3622536 - RNA, 20 nt, Salmonella enterica enterica serovar Typhi
cucgcgacauggcgguaauc

SEQ ID NO: 3622537 - RNA, 16 nt, Salmonella enterica enterica serovar Typhi
cucgcgauaggccucg

SEQ ID NO: 3622538 - RNA, 16 nt, Salmonella enterica enterica serovar Typhi
cucgcgauccgccagc

SEQ ID NO: 3622539 - RNA, 16 nt, Salmonella enterica enterica serovar Typhi
cucgcgcagauagagc

SEQ ID NO: 3622540 - RNA, 14 nt, Salmonella enterica enterica serovar Typhi
cucgcgcaguucca

SEQ ID NO: 3622541 - RNA, 12 nt, Salmonella enterica enterica serovar Typhi
cucgcgcaugac

SEQ ID NO: 3622542 - RNA, 13 nt, Salmonella enterica enterica serovar Typhi
cucgcgccgccug

SEQ ID NO: 3622543 - RNA, 18 nt, Salmonella enterica enterica serovar Typhi
cucgcgggcauacucucc

SEQ ID NO: 3622544 - RNA, 16 nt, Salmonella enterica enterica serovar Typhi
cucgcuacgcucgccc

SEQ ID NO: 3622545 - RNA, 23 nt, Salmonella enterica enterica serovar Typhi
cucgcuaugaaaacgcagcccca

SEQ ID NO: 3622546 - RNA, 22 nt, Salmonella enterica enterica serovar Typhi
cucgcucauuugcgagaaaaag

SEQ ID NO: 3622547 - RNA, 14 nt, Salmonella enterica enterica serovar Typhi
cucgcucccuuccc

SEQ ID NO: 3622548 - RNA, 20 nt, Salmonella enterica enterica serovar Typhi
cucgcugauacgcaccagcu

SEQ ID NO: 3622549 - RNA, 23 nt, Salmonella enterica enterica serovar Typhi
cucgcuuaaaccaccauacccag

SEQ ID NO: 3622550 - RNA, 16 nt, Salmonella enterica enterica serovar Typhi
cucgcuuacgcggcgc

SEQ ID NO: 3622551 - RNA, 17 nt, Salmonella enterica enterica serovar Typhi
cucgcuuugccgccauc

SEQ ID NO: 3622552 - RNA, 21 nt, Salmonella enterica enterica serovar Typhi
cucggcauacaccgccagcgu

SEQ ID NO: 3622553 - RNA, 13 nt, Salmonella enterica enterica serovar Typhi
cucggcgagcagu

SEQ ID NO: 3622554 - RNA, 20 nt, Salmonella enterica enterica serovar Typhi
cucggcgagcaguacgccug

SEQ ID NO: 3622555 - RNA, 17 nt, Salmonella enterica enterica serovar Typhi
cucggcggucagccaca

SEQ ID NO: 3622556 - RNA, 22 nt, Salmonella enterica enterica serovar Typhi
cucgggaauaaaaauaaauaaa

SEQ ID NO: 3622557 - RNA, 17 nt, Salmonella enterica enterica serovar Typhi
cuccagacgaugauaau

SEQ ID NO: 3622558 - RNA, 22 nt, Salmonella enterica enterica serovar Typhi
cuccagacgaugauaauacauu

SEQ ID NO: 3622559 - RNA, 16 nt, Salmonella enterica enterica serovar Typhi
cuccagcacauccuca

SEQ ID NO: 3622560 - RNA, 20 nt, Salmonella enterica enterica serovar Typhi
cuccagcacgcgcugcgccg

SEQ ID NO: 3622561 - RNA, 14 nt, Salmonella enterica enterica serovar Typhi
cuccagcaucacau

SEQ ID NO: 3622562 - RNA, 14 nt, Salmonella enterica enterica serovar Typhi
cuccagccauaaug

SEQ ID NO: 3622563 - RNA, 17 nt, Salmonella enterica enterica serovar Typhi
cuccagcccaucagucc

SEQ ID NO: 3622564 - RNA, 15 nt, Salmonella enterica enterica serovar Typhi
cuccagccgcugccu

SEQ ID NO: 3622565 - RNA, 15 nt, Salmonella enterica enterica serovar Typhi
cuccagcgauaaacg

SEQ ID NO: 3622566 - RNA, 13 nt, Salmonella enterica enterica serovar Typhi
cuccagcgccagc

SEQ ID NO: 3622567 - RNA, 17 nt, Salmonella enterica enterica serovar Typhi
cuccagcgccagcucca

SEQ ID NO: 3622568 - RNA, 18 nt, Salmonella enterica enterica serovar Typhi
cuccagcgccagcuccau

SEQ ID NO: 3622569 - RNA, 14 nt, Salmonella enterica enterica serovar Typhi
cuccagcguggcag

SEQ ID NO: 3622570 - RNA, 16 nt, Salmonella enterica enterica serovar Typhi
cuccaggcgaaucccc

SEQ ID NO: 3622571 - RNA, 17 nt, Salmonella enterica enterica serovar Typhi
cuccaguaauucccggc

SEQ ID NO: 3622572 - RNA, 12 nt, Salmonella enterica enterica serovar Typhi
cuccaguugaua

SEQ ID NO: 3622573 - RNA, 22 nt, Salmonella enterica enterica serovar Typhi
cuccaguuguuccagcagcuca

SEQ ID NO: 3622574 - RNA, 19 nt, Salmonella enterica enterica serovar Typhi
cuccauaaauaacauuuca

SEQ ID NO: 3622575 - RNA, 23 nt, Salmonella enterica enterica serovar Typhi
cuccauaauuugaaucgccuggc

SEQ ID NO: 3622576 - RNA, 19 nt, Salmonella enterica enterica serovar Typhi
cuccauagaaaucagcagg

SEQ ID NO: 3622577 - RNA, 12 nt, Salmonella enterica enterica serovar Typhi
cuccaucacggu

SEQ ID NO: 3622578 - RNA, 18 nt, Salmonella enterica enterica serovar Typhi
cuccaucacgguaaaccu

SEQ ID NO: 3622579 - RNA, 16 nt, Salmonella enterica enterica serovar Typhi
cuccaucauuuccggc

SEQ ID NO: 3622580 - RNA, 16 nt, Salmonella enterica enterica serovar Typhi
cuccaucuccggcagc

SEQ ID NO: 3622581 - RNA, 13 nt, Salmonella enterica enterica serovar Typhi
cuccaugcccaca

SEQ ID NO: 3622582 - RNA, 15 nt, Salmonella enterica enterica serovar Typhi
cuccauuaaauuacu

SEQ ID NO: 3622583 - RNA, 13 nt, Salmonella enterica enterica serovar Typhi
cuccauucccagc

SEQ ID NO: 3622584 - RNA, 19 nt, Salmonella enterica enterica serovar Typhi
cucccaaauuuuuuuagca

SEQ ID NO: 3622585 - RNA, 11 nt, Salmonella enterica enterica serovar Typhi
cucccaacaga

SEQ ID NO: 3622586 - RNA, 23 nt, Salmonella enterica enterica serovar Typhi
cucccaacagacgaucuacggua

SEQ ID NO: 3622587 - RNA, 13 nt, Salmonella enterica enterica serovar Typhi
cucccagcugagc

SEQ ID NO: 3622588 - RNA, 17 nt, Salmonella enterica enterica serovar Typhi
cucccaggccgccaccg

SEQ ID NO: 3622589 - RNA, 18 nt, Salmonella enterica enterica serovar Typhi
cucccaggccgccaccgc

SEQ ID NO: 3622590 - RNA, 22 nt, Salmonella enterica enterica serovar Typhi
cucccaggcgcgcagcugccac

SEQ ID NO: 3622591 - RNA, 15 nt, Salmonella enterica enterica serovar Typhi
cucccauacccaggu

SEQ ID NO: 3622592 - RNA, 18 nt, Salmonella enterica enterica serovar Typhi
cuccccacgaaagucugu

SEQ ID NO: 3622593 - RNA, 21 nt, Salmonella enterica enterica serovar Typhi
cuccccaggcgcuauucccag

SEQ ID NO: 3622594 - RNA, 22 nt, Salmonella enterica enterica serovar Typhi
cuccccaggcgcuauucccagg

SEQ ID NO: 3622595 - RNA, 23 nt, Salmonella enterica enterica serovar Typhi
cuccccaggcgcuauucccaggc

SEQ ID NO: 3622596 - RNA, 14 nt, Salmonella enterica enterica serovar Typhi
cucccccggcacca

SEQ ID NO: 3622597 - RNA, 18 nt, Salmonella enterica enterica serovar Typhi
cucccccggcaccacgca

SEQ ID NO: 3622598 - RNA, 22 nt, Salmonella enterica enterica serovar Typhi
cuccccgccccagcagcagccg

SEQ ID NO: 3622599 - RNA, 19 nt, Salmonella enterica enterica serovar Typhi
cuccccguuccaccgccaa

SEQ ID NO: 3622600 - RNA, 22 nt, Salmonella enterica enterica serovar Typhi
cuccccugucguuaaugggauc

SEQ ID NO: 3622601 - RNA, 15 nt, Salmonella enterica enterica serovar Typhi
cuccccuuuuuuacu

SEQ ID NO: 3622602 - RNA, 22 nt, Salmonella enterica enterica serovar Typhi
cucccgccagaugcagcggcag

SEQ ID NO: 3622603 - RNA, 22 nt, Salmonella enterica enterica serovar Typhi
cucccgcgucacgaccggcgaa

SEQ ID NO: 3622604 - RNA, 21 nt, Salmonella enterica enterica serovar Typhi
cucccgcugcggcguggagca

SEQ ID NO: 3622605 - RNA, 17 nt, Salmonella enterica enterica serovar Typhi
cucccggcgcccauccg

SEQ ID NO: 3622606 - RNA, 16 nt, Salmonella enterica enterica serovar Typhi
cucccgguucgccgcu

SEQ ID NO: 3622607 - RNA, 20 nt, Salmonella enterica enterica serovar Typhi
cucccguuucgacgggaggu

SEQ ID NO: 3622608 - RNA, 16 nt, Salmonella enterica enterica serovar Typhi
cucccucacccuucac

SEQ ID NO: 3622609 - RNA, 18 nt, Salmonella enterica enterica serovar Typhi
cucccugagucuugccug

SEQ ID NO: 3622610 - RNA, 20 nt, Salmonella enterica enterica serovar Typhi
cucccugagucuugccuguc

SEQ ID NO: 3622611 - RNA, 17 nt, Salmonella enterica enterica serovar Typhi
cucccugccuaaagaaa

SEQ ID NO: 3622612 - RNA, 21 nt, Salmonella enterica enterica serovar Typhi
cuccgaaacaaucaccugaug

SEQ ID NO: 3622613 - RNA, 18 nt, Salmonella enterica enterica serovar Typhi
cuccgacaaacuucaucg

SEQ ID NO: 3622614 - RNA, 15 nt, Salmonella enterica enterica serovar Typhi
cuccgaccaucgccg

SEQ ID NO: 3622615 - RNA, 18 nt, Salmonella enterica enterica serovar Typhi
cuccgagacucaaagaaa

SEQ ID NO: 3622616 - RNA, 16 nt, Salmonella enterica enterica serovar Typhi
cuccgaggaacgugag

SEQ ID NO: 3622617 - RNA, 17 nt, Salmonella enterica enterica serovar Typhi
cuccgcaaagcccauca

SEQ ID NO: 3622618 - RNA, 23 nt, Salmonella enterica enterica serovar Typhi
cuccgcaaagcccaucagcgcca

SEQ ID NO: 3622619 - RNA, 16 nt, Salmonella enterica enterica serovar Typhi
cuccgcagccgccgga

SEQ ID NO: 3622620 - RNA, 18 nt, Salmonella enterica enterica serovar Typhi
cuccgcaguaaucaccgu

SEQ ID NO: 3622621 - RNA, 21 nt, Salmonella enterica enterica serovar Typhi
cuccgccagcaaugccgccgc

SEQ ID NO: 3622622 - RNA, 14 nt, Salmonella enterica enterica serovar Typhi
cuccgccugcgguu

SEQ ID NO: 3622623 - RNA, 14 nt, Salmonella enterica enterica serovar Typhi
cuccgcgcauguaa

SEQ ID NO: 3622624 - RNA, 19 nt, Salmonella enterica enterica serovar Typhi
cuccgcgcauguaaccaaa

SEQ ID NO: 3622625 - RNA, 21 nt, Salmonella enterica enterica serovar Typhi
cuccgcgcauguaaccaaagc

SEQ ID NO: 3622626 - RNA, 13 nt, Salmonella enterica enterica serovar Typhi
cuccgcgcuggca

SEQ ID NO: 3622627 - RNA, 15 nt, Salmonella enterica enterica serovar Typhi
cuccgcgcuggcaau

SEQ ID NO: 3622628 - RNA, 16 nt, Salmonella enterica enterica serovar Typhi
cuccgcggggaucggu

SEQ ID NO: 3622629 - RNA, 13 nt, Salmonella enterica enterica serovar Typhi
cuccggaagcaua

SEQ ID NO: 3622630 - RNA, 14 nt, Salmonella enterica enterica serovar Typhi
cuccggacguaccc

SEQ ID NO: 3622631 - RNA, 16 nt, Salmonella enterica enterica serovar Typhi
cuccggcacauucacc

SEQ ID NO: 3622632 - RNA, 18 nt, Salmonella enterica enterica serovar Typhi
cuccggcacauucaccac

SEQ ID NO: 3622633 - RNA, 12 nt, Salmonella enterica enterica serovar Typhi
cuccggcagcau

SEQ ID NO: 3622634 - RNA, 15 nt, Salmonella enterica enterica serovar Typhi
cuccggcagcguauu

SEQ ID NO: 3622635 - RNA, 13 nt, Salmonella enterica enterica serovar Typhi
cuccggcaggcaa

SEQ ID NO: 3622636 - RNA, 18 nt, Salmonella enterica enterica serovar Typhi
cuccggcaggcaaaucug

SEQ ID NO: 3622637 - RNA, 14 nt, Salmonella enterica enterica serovar Typhi
cuccggcaguccau

SEQ ID NO: 3622638 - RNA, 23 nt, Salmonella enterica enterica serovar Typhi
cuccggcaucuuaaagcgggcuu

SEQ ID NO: 3622639 - RNA, 15 nt, Salmonella enterica enterica serovar Typhi
cuccggccagcgcca

SEQ ID NO: 3622640 - RNA, 16 nt, Salmonella enterica enterica serovar Typhi
cuccggcuaugccgga

SEQ ID NO: 3622641 - RNA, 17 nt, Salmonella enterica enterica serovar Typhi
cuccggcuaugccggag

SEQ ID NO: 3622642 - RNA, 19 nt, Salmonella enterica enterica serovar Typhi
cuccgggauagcaaucucg

SEQ ID NO: 3622643 - RNA, 13 nt, Salmonella enterica enterica serovar Typhi
cuacccgcugacg

SEQ ID NO: 3622644 - RNA, 19 nt, Salmonella enterica enterica serovar Typhi
cuacccgguguaaaaaaug

SEQ ID NO: 3622645 - RNA, 20 nt, Salmonella enterica enterica serovar Typhi
cuaccgcucaggcgcgcgcu

SEQ ID NO: 3622646 - RNA, 16 nt, Salmonella enterica enterica serovar Typhi
cuaccggaaucgccug

SEQ ID NO: 3622647 - RNA, 19 nt, Salmonella enterica enterica serovar Typhi
cuaccgucgacgucuuucu

SEQ ID NO: 3622648 - RNA, 22 nt, Salmonella enterica enterica serovar Typhi
cuaccgucgacgucuuucuuaa

SEQ ID NO: 3622649 - RNA, 16 nt, Salmonella enterica enterica serovar Typhi
cuaccgucgccgacaa

SEQ ID NO: 3622650 - RNA, 16 nt, Salmonella enterica enterica serovar Typhi
cuaccugcgagcugua

SEQ ID NO: 3622651 - RNA, 17 nt, Salmonella enterica enterica serovar Typhi
cuaccuucacccccauc

SEQ ID NO: 3622652 - RNA, 16 nt, Salmonella enterica enterica serovar Typhi
cuaccuucuucccaua

SEQ ID NO: 3622653 - RNA, 13 nt, Salmonella enterica enterica serovar Typhi
cuacgccauggca

SEQ ID NO: 3622654 - RNA, 19 nt, Salmonella enterica enterica serovar Typhi
cuacgccuuauccggccua

SEQ ID NO: 3622655 - RNA, 23 nt, Salmonella enterica enterica serovar Typhi
cuacgcgucgccauccggcgaga

SEQ ID NO: 3622656 - RNA, 22 nt, Salmonella enterica enterica serovar Typhi
cuacgcuauuuccagaaaucag

SEQ ID NO: 3622657 - RNA, 16 nt, Salmonella enterica enterica serovar Typhi
cuacgcugcgcguucu

SEQ ID NO: 3622658 - RNA, 15 nt, Salmonella enterica enterica serovar Typhi
cuacgcuuaucaggc

SEQ ID NO: 3622659 - RNA, 18 nt, Salmonella enterica enterica serovar Typhi
cuacgcuuaucaggccua

SEQ ID NO: 3622660 - RNA, 23 nt, Salmonella enterica enterica serovar Typhi
cuacgcuuaucaggccuacaacg

SEQ ID NO: 3622661 - RNA, 13 nt, Salmonella enterica enterica serovar Typhi
cuacggcaaacac

SEQ ID NO: 3622662 - RNA, 16 nt, Salmonella enterica enterica serovar Typhi
cuacggcccuggcuca

SEQ ID NO: 3622663 - RNA, 13 nt, Salmonella enterica enterica serovar Typhi
cuacguaauucau

SEQ ID NO: 3622664 - RNA, 15 nt, Salmonella enterica enterica serovar Typhi
cuacguucaucaggc

SEQ ID NO: 3622665 - RNA, 14 nt, Salmonella enterica enterica serovar Typhi
cuacguuccaugcg

SEQ ID NO: 3622666 - RNA, 19 nt, Salmonella enterica enterica serovar Typhi
cuacguugaccucaucacc

SEQ ID NO: 3622667 - RNA, 14 nt, Salmonella enterica enterica serovar Typhi
cuacguuuaucugg

SEQ ID NO: 3622668 - RNA, 18 nt, Salmonella enterica enterica serovar Typhi
cuacguuugaacagcagu

SEQ ID NO: 3622669 - RNA, 16 nt, Salmonella enterica enterica serovar Typhi
cuacuacacacuuacc

SEQ ID NO: 3622670 - RNA, 13 nt, Salmonella enterica enterica serovar Typhi
cuacuacauaucu

SEQ ID NO: 3622671 - RNA, 13 nt, Salmonella enterica enterica serovar Typhi
cuacucaggagau

SEQ ID NO: 3622672 - RNA, 23 nt, Salmonella enterica enterica serovar Typhi
cuacucguaaucuaaaauuauuu

SEQ ID NO: 3622673 - RNA, 12 nt, Salmonella enterica enterica serovar Typhi
cuacugccgcca

SEQ ID NO: 3622674 - RNA, 17 nt, Salmonella enterica enterica serovar Typhi
cuacuguggugugccug

SEQ ID NO: 3622675 - RNA, 20 nt, Salmonella enterica enterica serovar Typhi
cuacuuuaaauucggcguua

SEQ ID NO: 3622676 - RNA, 11 nt, Salmonella enterica enterica serovar Typhi
cuacuuuaucg

SEQ ID NO: 3622677 - RNA, 21 nt, Salmonella enterica enterica serovar Typhi
cuacuuuaucgaaugccggaa

SEQ ID NO: 3622678 - RNA, 13 nt, Salmonella enterica enterica serovar Typhi
cuagaacauuucc

SEQ ID NO: 3622679 - RNA, 20 nt, Salmonella enterica enterica serovar Typhi
cuagaugaugauuuaugaau

SEQ ID NO: 3622680 - RNA, 23 nt, Salmonella enterica enterica serovar Typhi
cuagaugaugauuuaugaauagc

SEQ ID NO: 3622681 - RNA, 18 nt, Salmonella enterica enterica serovar Typhi
cuagauuuuagaaaauaa

SEQ ID NO: 3622682 - RNA, 20 nt, Salmonella enterica enterica serovar Typhi
cuagauuuuagaaaauaauu

SEQ ID NO: 3622683 - RNA, 21 nt, Salmonella enterica enterica serovar Typhi
cuagccaauaaucgaaauaaa

SEQ ID NO: 3622684 - RNA, 22 nt, Salmonella enterica enterica serovar Typhi
cuagccgccguguugugugccg

SEQ ID NO: 3622685 - RNA, 14 nt, Salmonella enterica enterica serovar Typhi
cuagcgcaguuugu

SEQ ID NO: 3622686 - RNA, 16 nt, Salmonella enterica enterica serovar Typhi
cuagcgucccggcaau

SEQ ID NO: 3622687 - RNA, 14 nt, Salmonella enterica enterica serovar Typhi
cuagcugcagcgcu

SEQ ID NO: 3622688 - RNA, 21 nt, Salmonella enterica enterica serovar Typhi
cuagcuuaucgccaaagauau

SEQ ID NO: 3622689 - RNA, 15 nt, Salmonella enterica enterica serovar Typhi
cuagcuuaucgggcc

SEQ ID NO: 3622690 - RNA, 19 nt, Salmonella enterica enterica serovar Typhi
cuaggccagugccaagcaa

SEQ ID NO: 3622691 - RNA, 21 nt, Salmonella enterica enterica serovar Typhi
cuaggccagugccaagcaaca

SEQ ID NO: 3622692 - RNA, 23 nt, Salmonella enterica enterica serovar Typhi
cuaggcgcugcuggcagcgcuga

SEQ ID NO: 3622693 - RNA, 13 nt, Salmonella enterica enterica serovar Typhi
cuagggcaucaga

SEQ ID NO: 3622694 - RNA, 16 nt, Salmonella enterica enterica serovar Typhi
cuaggggcucuuuuuu

SEQ ID NO: 3622695 - RNA, 11 nt, Salmonella enterica enterica serovar Typhi
cuauaaaaauc

SEQ ID NO: 3622696 - RNA, 18 nt, Salmonella enterica enterica serovar Typhi
cuauaaaguucccaugcu

SEQ ID NO: 3622697 - RNA, 22 nt, Salmonella enterica enterica serovar Typhi
cuauaaguacgcggucgccugc

SEQ ID NO: 3622698 - RNA, 12 nt, Salmonella enterica enterica serovar Typhi
cuauaauaacaa

SEQ ID NO: 3622699 - RNA, 16 nt, Salmonella enterica enterica serovar Typhi
cuauaauugcuuuuuu

SEQ ID NO: 3622700 - RNA, 23 nt, Salmonella enterica enterica serovar Typhi
cuauaauugcuuuuuuccacaga

SEQ ID NO: 3622701 - RNA, 12 nt, Salmonella enterica enterica serovar Typhi
cuauacaguaaa

SEQ ID NO: 3622702 - RNA, 18 nt, Salmonella enterica enterica serovar Typhi
cuauacgguaaaucauuu

SEQ ID NO: 3622703 - RNA, 23 nt, Salmonella enterica enterica serovar Typhi
cuauagaaugcaagcagcauaau

SEQ ID NO: 3622704 - RNA, 17 nt, Salmonella enterica enterica serovar Typhi
cuauagagagauggaac

SEQ ID NO: 3622705 - RNA, 19 nt, Salmonella enterica enterica serovar Typhi
cuauagauuucgcgucagg

SEQ ID NO: 3622706 - RNA, 16 nt, Salmonella enterica enterica serovar Typhi
cuauagcuuuucauau

SEQ ID NO: 3622707 - RNA, 18 nt, Salmonella enterica enterica serovar Typhi
cuauaguggcauuuaccu

SEQ ID NO: 3622708 - RNA, 16 nt, Salmonella enterica enterica serovar Typhi
cuauauuccagccagg

SEQ ID NO: 3622709 - RNA, 17 nt, Salmonella enterica enterica serovar Typhi
cuaucaagauaaaaaga

SEQ ID NO: 3622710 - RNA, 22 nt, Salmonella enterica enterica serovar Typhi
cuaucacacauaucgccagcca

SEQ ID NO: 3622711 - RNA, 22 nt, Salmonella enterica enterica serovar Typhi
cuaucaccgcgaugaccaucaa

SEQ ID NO: 3622712 - RNA, 23 nt, Salmonella enterica enterica serovar Typhi
cuaucagaauauccgguacacca

SEQ ID NO: 3622713 - RNA, 14 nt, Salmonella enterica enterica serovar Typhi
cuaucagccgcgac

SEQ ID NO: 3622714 - RNA, 23 nt, Salmonella enterica enterica serovar Typhi
cuaucagguaacauaucgacaua

SEQ ID NO: 3622715 - RNA, 19 nt, Salmonella enterica enterica serovar Typhi
cuaucaguagcuuuuccgc

SEQ ID NO: 3622716 - RNA, 22 nt, Salmonella enterica enterica serovar Typhi
cuaucauacacaucauuaccau

SEQ ID NO: 3622717 - RNA, 15 nt, Salmonella enterica enterica serovar Typhi
cuauccacagcgaau

SEQ ID NO: 3622718 - RNA, 18 nt, Salmonella enterica enterica serovar Typhi
cuauccacgcagacgccg

SEQ ID NO: 3622719 - RNA, 23 nt, Salmonella enterica enterica serovar Typhi
cuauccauaccggacuccaggca

SEQ ID NO: 3622720 - RNA, 20 nt, Salmonella enterica enterica serovar Typhi
cuauccgccagguauucuaa

SEQ ID NO: 3622721 - RNA, 21 nt, Salmonella enterica enterica serovar Typhi
cuauccgccgccagccauaaa

SEQ ID NO: 3622722 - RNA, 14 nt, Salmonella enterica enterica serovar Typhi
cuauccgcgccggg

SEQ ID NO: 3622723 - RNA, 22 nt, Salmonella enterica enterica serovar Typhi
cuauccguccucuuucccuuuu

SEQ ID NO: 3622724 - RNA, 17 nt, Salmonella enterica enterica serovar Typhi
cuauccguuuugacgac

SEQ ID NO: 3622725 - RNA, 17 nt, Salmonella enterica enterica serovar Typhi
cuaucgaccagcaccug

SEQ ID NO: 3622726 - RNA, 16 nt, Salmonella enterica enterica serovar Typhi
cuaucgccaaacuggu

SEQ ID NO: 3622727 - RNA, 16 nt, Salmonella enterica enterica serovar Typhi
cuaucgccagcgcguu

SEQ ID NO: 3622728 - RNA, 22 nt, Salmonella enterica enterica serovar Typhi
cuaucgcccaaauaguccagca

SEQ ID NO: 3622729 - RNA, 12 nt, Salmonella enterica enterica serovar Typhi
cuaucgccgccc

SEQ ID NO: 3622730 - RNA, 15 nt, Salmonella enterica enterica serovar Typhi
cuaucgccuggagcu

SEQ ID NO: 3622731 - RNA, 20 nt, Salmonella enterica enterica serovar Typhi
cuaucgcgacggaccggcag

SEQ ID NO: 3622732 - RNA, 12 nt, Salmonella enterica enterica serovar Typhi
cuaucgcuaucg

SEQ ID NO: 3622733 - RNA, 17 nt, Salmonella enterica enterica serovar Typhi
cuaucgcuccucccuga

SEQ ID NO: 3622734 - RNA, 22 nt, Salmonella enterica enterica serovar Typhi
cuaucugacagccaaacugcug

SEQ ID NO: 3622735 - RNA, 23 nt, Salmonella enterica enterica serovar Typhi
cuaucugcuucuggcuugcgcua

SEQ ID NO: 3622736 - RNA, 19 nt, Salmonella enterica enterica serovar Typhi
cuaucuggauacgauaagc

SEQ ID NO: 3622737 - RNA, 23 nt, Salmonella enterica enterica serovar Typhi
cuaucuguauaucuuucuuaucc

SEQ ID NO: 3622738 - RNA, 14 nt, Salmonella enterica enterica serovar Typhi
cuaucuucgauaaa

SEQ ID NO: 3622739 - RNA, 17 nt, Salmonella enterica enterica serovar Typhi
cuaucuuuucaaucagg

SEQ ID NO: 3622740 - RNA, 20 nt, Salmonella enterica enterica serovar Typhi
cuaugaagagaaacauacug

SEQ ID NO: 3622741 - RNA, 13 nt, Salmonella enterica enterica serovar Typhi
cuaugcaaaacgu

SEQ ID NO: 3622742 - RNA, 14 nt, Salmonella enterica enterica serovar Typhi
cuaugcaaaagaaa

SEQ ID NO: 3622743 - RNA, 16 nt, Salmonella enterica enterica serovar Typhi
cuaugcaaaagaaaaa

SEQ ID NO: 3622744 - RNA, 22 nt, Salmonella enterica enterica serovar Typhi
cuaugcuccaguuguuccagca

SEQ ID NO: 3622745 - RNA, 21 nt, Salmonella enterica enterica serovar Typhi
cuaugcuuauccggccugcac

SEQ ID NO: 3622746 - RNA, 23 nt, Salmonella enterica enterica serovar Typhi
cuauggcggagggauuuuaaacc

SEQ ID NO: 3622747 - RNA, 17 nt, Salmonella enterica enterica serovar Typhi
cuaugggauaacgcaga

SEQ ID NO: 3622748 - RNA, 22 nt, Salmonella enterica enterica serovar Typhi
cuaugguacggcguguuuaacu

SEQ ID NO: 3622749 - RNA, 20 nt, Salmonella enterica enterica serovar Typhi
cuauguaaagaaugaaaaaa

SEQ ID NO: 3622750 - RNA, 16 nt, Salmonella enterica enterica serovar Typhi
cuauguuugcugagaa

SEQ ID NO: 3622751 - RNA, 17 nt, Salmonella enterica enterica serovar Typhi
cuauuaaagcacaagaa

SEQ ID NO: 3622752 - RNA, 13 nt, Salmonella enterica enterica serovar Typhi
cuauuaaucaccu

SEQ ID NO: 3622753 - RNA, 13 nt, Salmonella enterica enterica serovar Typhi
cuauuacaaaaau

SEQ ID NO: 3622754 - RNA, 22 nt, Salmonella enterica enterica serovar Typhi
cuauuagcgcgggauaucgcug

SEQ ID NO: 3622755 - RNA, 19 nt, Salmonella enterica enterica serovar Typhi
cuauuaggcacuaccaccu

SEQ ID NO: 3622756 - RNA, 20 nt, Salmonella enterica enterica serovar Typhi
cuauuaguucugaggcuauu

SEQ ID NO: 3622757 - RNA, 13 nt, Salmonella enterica enterica serovar Typhi
cuauuaucagaau

SEQ ID NO: 3622758 - RNA, 21 nt, Salmonella enterica enterica serovar Typhi
cuauucaccagacuaaaacgu

SEQ ID NO: 3622759 - RNA, 20 nt, Salmonella enterica enterica serovar Typhi
cuauucauuauuuuuaaaua

SEQ ID NO: 3622760 - RNA, 14 nt, Salmonella enterica enterica serovar Typhi
cuauucccaggcaa

SEQ ID NO: 3622761 - RNA, 17 nt, Salmonella enterica enterica serovar Typhi
cuauuccucgaucgccu

SEQ ID NO: 3622762 - RNA, 15 nt, Salmonella enterica enterica serovar Typhi
cuauucguucucuga

SEQ ID NO: 3622763 - RNA, 13 nt, Salmonella enterica enterica serovar Typhi
cuauucuucaucg

SEQ ID NO: 3622764 - RNA, 19 nt, Salmonella enterica enterica serovar Typhi
cuauugaaaaagccgcgcc

SEQ ID NO: 3622765 - RNA, 17 nt, Salmonella enterica enterica serovar Typhi
cuauugccuaaauaacu

SEQ ID NO: 3622766 - RNA, 19 nt, Salmonella enterica enterica serovar Typhi
cuauuuaaaaaccgccccc

SEQ ID NO: 3622767 - RNA, 19 nt, Salmonella enterica enterica serovar Typhi
cuauuuuaaauucccagcg

SEQ ID NO: 3622768 - RNA, 18 nt, Salmonella enterica enterica serovar Typhi
cuauuuuacuugccauuu

SEQ ID NO: 3622769 - RNA, 23 nt, Salmonella enterica enterica serovar Typhi
cuauuuucuacucgggccagcuc

SEQ ID NO: 3622770 - RNA, 13 nt, Salmonella enterica enterica serovar Typhi
cuauuuucucuuc

SEQ ID NO: 3622771 - RNA, 11 nt, Salmonella enterica enterica serovar Typhi
cuauuuuucac

SEQ ID NO: 3622772 - RNA, 16 nt, Salmonella enterica enterica serovar Typhi
cuauuuuuugcuggcg

SEQ ID NO: 3622773 - RNA, 18 nt, Salmonella enterica enterica serovar Typhi
cucaaagcguuauuugca

SEQ ID NO: 3622774 - RNA, 21 nt, Salmonella enterica enterica serovar Typhi
cucaacacauaacgcccgaca

SEQ ID NO: 3622775 - RNA, 17 nt, Salmonella enterica enterica serovar Typhi
cucaacauacgccgcca

SEQ ID NO: 3622776 - RNA, 23 nt, Salmonella enterica enterica serovar Typhi
cucaacauacgccgccagccacu

SEQ ID NO: 3622777 - RNA, 22 nt, Salmonella enterica enterica serovar Typhi
cucaacauugccggcaucauuc

SEQ ID NO: 3622778 - RNA, 21 nt, Salmonella enterica enterica serovar Typhi
cucaaccaccaccgauaaacg

SEQ ID NO: 3622779 - RNA, 14 nt, Salmonella enterica enterica serovar Typhi
cucaaccagcaaug

SEQ ID NO: 3622780 - RNA, 21 nt, Salmonella enterica enterica serovar Typhi
cucaaccaucaaaaaaaauag

SEQ ID NO: 3622781 - RNA, 16 nt, Salmonella enterica enterica serovar Typhi
cucaaccgguuuguca

SEQ ID NO: 3622782 - RNA, 21 nt, Salmonella enterica enterica serovar Typhi
cucaacgcccucaaguaaaau

SEQ ID NO: 3622783 - RNA, 13 nt, Salmonella enterica enterica serovar Typhi
cucaacgcccugc

SEQ ID NO: 3622784 - RNA, 23 nt, Salmonella enterica enterica serovar Typhi
cucaacgcgcccagauuggugau

SEQ ID NO: 3622785 - RNA, 13 nt, Salmonella enterica enterica serovar Typhi
cucaacugagcgg

SEQ ID NO: 3622786 - RNA, 19 nt, Salmonella enterica enterica serovar Typhi
cucaagacgguuauuuuuc

SEQ ID NO: 3622787 - RNA, 14 nt, Salmonella enterica enterica serovar Typhi
cucaagcgcagcac

SEQ ID NO: 3622788 - RNA, 16 nt, Salmonella enterica enterica serovar Typhi
cucaagcggcaccaca

SEQ ID NO: 3622789 - RNA, 16 nt, Salmonella enterica enterica serovar Typhi
cucaagcuguagcguu

SEQ ID NO: 3622790 - RNA, 22 nt, Salmonella enterica enterica serovar Typhi
cucaaggcaauagaccagcggc

SEQ ID NO: 3622791 - RNA, 18 nt, Salmonella enterica enterica serovar Typhi
cucaaggcuauuagccaa

SEQ ID NO: 3622792 - RNA, 21 nt, Salmonella enterica enterica serovar Typhi
cucaaggcuauuagccaaagc

SEQ ID NO: 3622793 - RNA, 22 nt, Salmonella enterica enterica serovar Typhi
cucaagguagcgugucuaccaa

SEQ ID NO: 3622794 - RNA, 19 nt, Salmonella enterica enterica serovar Typhi
cucaauaaaaugucuguuu

SEQ ID NO: 3622795 - RNA, 18 nt, Salmonella enterica enterica serovar Typhi
cucaauauacuuaucggc

SEQ ID NO: 3622796 - RNA, 22 nt, Salmonella enterica enterica serovar Typhi
cucaaucacuuaucaaaccagc

SEQ ID NO: 3622797 - RNA, 21 nt, Salmonella enterica enterica serovar Typhi
cucaaucacuuuugcgaccca

SEQ ID NO: 3622798 - RNA, 14 nt, Salmonella enterica enterica serovar Typhi
cucaaucggcgaua

SEQ ID NO: 3622799 - RNA, 15 nt, Salmonella enterica enterica serovar Typhi
cucaaugauuuccgc

SEQ ID NO: 3622800 - RNA, 15 nt, Salmonella enterica enterica serovar Typhi
cucaauuuuacagcc

SEQ ID NO: 3622801 - RNA, 18 nt, Salmonella enterica enterica serovar Typhi
cucacaauaauuuuacca

SEQ ID NO: 3622802 - RNA, 22 nt, Salmonella enterica enterica serovar Typhi
cucacacauuggcgcggcagga

SEQ ID NO: 3622803 - RNA, 20 nt, Salmonella enterica enterica serovar Typhi
cucacagaaucaucaggcua

SEQ ID NO: 3622804 - RNA, 13 nt, Salmonella enterica enterica serovar Typhi
cucaccaccgccg

SEQ ID NO: 3622805 - RNA, 17 nt, Salmonella enterica enterica serovar Typhi
cucaccaccgccgcgag

SEQ ID NO: 3622806 - RNA, 21 nt, Salmonella enterica enterica serovar Typhi
cucaccagcugacgcagcagu

SEQ ID NO: 3622807 - RNA, 23 nt, Salmonella enterica enterica serovar Typhi
cucaccaguccggcagaaagcag

SEQ ID NO: 3622808 - RNA, 14 nt, Salmonella enterica enterica serovar Typhi
cucacccaggcgau

SEQ ID NO: 3622809 - RNA, 19 nt, Salmonella enterica enterica serovar Typhi
cucacccaguuuuuuucug

SEQ ID NO: 3622810 - RNA, 21 nt, Salmonella enterica enterica serovar Typhi
cucacccauuuuauccucuuc

SEQ ID NO: 3622811 - RNA, 11 nt, Salmonella enterica enterica serovar Typhi
cucacccugaa

SEQ ID NO: 3622812 - RNA, 15 nt, Salmonella enterica enterica serovar Typhi
cucaccgaccugccu

SEQ ID NO: 3622813 - RNA, 16 nt, Salmonella enterica enterica serovar Typhi
cucaccgaccugccuu

SEQ ID NO: 3622814 - RNA, 20 nt, Salmonella enterica enterica serovar Typhi
cucaccgagacugcccggca

SEQ ID NO: 3622815 - RNA, 16 nt, Salmonella enterica enterica serovar Typhi
cucaccgccuaggcca

SEQ ID NO: 3622816 - RNA, 13 nt, Salmonella enterica enterica serovar Typhi
cucaccucccccg

SEQ ID NO: 3622817 - RNA, 17 nt, Salmonella enterica enterica serovar Typhi
cucaccugguaagcgcc

SEQ ID NO: 3622818 - RNA, 18 nt, Salmonella enterica enterica serovar Typhi
cucacgaauaagaaucag

SEQ ID NO: 3622819 - RNA, 24 nt, Salmonella enterica enterica serovar Typhi
cucacgaauaagaaucagaugcuc

SEQ ID NO: 3622820 - RNA, 19 nt, Salmonella enterica enterica serovar Typhi
cucacgauaacgcagcgcg

SEQ ID NO: 3622821 - RNA, 14 nt, Salmonella enterica enterica serovar Typhi
cucacgcagggugu

SEQ ID NO: 3622822 - RNA, 14 nt, Salmonella enterica enterica serovar Typhi
cucacgcuggugcu

SEQ ID NO: 3622823 - RNA, 19 nt, Salmonella enterica enterica serovar Typhi
cucacgcuuauccggccua

SEQ ID NO: 3622824 - RNA, 16 nt, Salmonella enterica enterica serovar Typhi
cucacggauauuaccc

SEQ ID NO: 3622825 - RNA, 19 nt, Salmonella enterica enterica serovar Typhi
cucacggcacgcccuucgu

SEQ ID NO: 3622826 - RNA, 22 nt, Salmonella enterica enterica serovar Typhi
cucacgggcguagucagcgacg

SEQ ID NO: 3622827 - RNA, 14 nt, Salmonella enterica enterica serovar Typhi
cucacggucuccug

SEQ ID NO: 3622828 - RNA, 13 nt, Salmonella enterica enterica serovar Typhi
cucacgucccguu

SEQ ID NO: 3622829 - RNA, 16 nt, Salmonella enterica enterica serovar Typhi
cucacguuccccagca

SEQ ID NO: 3622830 - RNA, 21 nt, Salmonella enterica enterica serovar Typhi
cucacuacccggaggcaauau

SEQ ID NO: 3622831 - RNA, 17 nt, Salmonella enterica enterica serovar Typhi
cucacuuuucuuuccug

SEQ ID NO: 3622832 - RNA, 19 nt, Salmonella enterica enterica serovar Typhi
cucagaccauauucacgca

SEQ ID NO: 3622833 - RNA, 22 nt, Salmonella enterica enterica serovar Typhi
cucagaccgaucucaugcaacu

SEQ ID NO: 3622834 - RNA, 16 nt, Salmonella enterica enterica serovar Typhi
cucagaucggcagaca

SEQ ID NO: 3622835 - RNA, 24 nt, Salmonella enterica enterica serovar Typhi
cucagcaaaaucacgcacacgucu

SEQ ID NO: 3622836 - RNA, 23 nt, Salmonella enterica enterica serovar Typhi
cucagcauagcgcugaaacggga

SEQ ID NO: 3622837 - RNA, 18 nt, Salmonella enterica enterica serovar Typhi
cucagcaucgcauuaacg

SEQ ID NO: 3622838 - RNA, 13 nt, Salmonella enterica enterica serovar Typhi
cucagccacccac

SEQ ID NO: 3622839 - RNA, 14 nt, Salmonella enterica enterica serovar Typhi
cucagccccaggcc

SEQ ID NO: 3622840 - RNA, 23 nt, Salmonella enterica enterica serovar Typhi
cucagcgccacgcccaacauaaa

SEQ ID NO: 3622841 - RNA, 15 nt, Salmonella enterica enterica serovar Typhi
cucagcgcggcagcc

SEQ ID NO: 3622842 - RNA, 13 nt, Salmonella enterica enterica serovar Typhi
cucagcggcggcg

SEQ ID NO: 3622843 - RNA, 21 nt, Salmonella enterica enterica serovar Typhi
cucagcgucggugaagaaaau

SEQ ID NO: 3622844 - RNA, 19 nt, Salmonella enterica enterica serovar Typhi
cucagcuaaaaacagcgca

SEQ ID NO: 3622845 - RNA, 14 nt, Salmonella enterica enterica serovar Typhi
cucagcuugcgcug

SEQ ID NO: 3622846 - RNA, 13 nt, Salmonella enterica enterica serovar Typhi
cucaggaaaacaa

SEQ ID NO: 3622847 - RNA, 11 nt, Salmonella enterica enterica serovar Typhi
cucaggacgcc

SEQ ID NO: 3622848 - RNA, 22 nt, Salmonella enterica enterica serovar Typhi
cucaggcaacacgacaaaagca

SEQ ID NO: 3622849 - RNA, 18 nt, Salmonella enterica enterica serovar Typhi
cucaggcaagacacagcg

SEQ ID NO: 3622850 - RNA, 18 nt, Salmonella enterica enterica serovar Typhi
cucaggccggauaaggcg

SEQ ID NO: 3622851 - RNA, 13 nt, Salmonella enterica enterica serovar Typhi
cucaggcgagccc

SEQ ID NO: 3622852 - RNA, 22 nt, Salmonella enterica enterica serovar Typhi
cucaggcggggaguggugaucg

SEQ ID NO: 3622853 - RNA, 17 nt, Salmonella enterica enterica serovar Typhi
cucagggagaacucauc

SEQ ID NO: 3622854 - RNA, 18 nt, Salmonella enterica enterica serovar Typhi
cucagggcaaaaaugauc

SEQ ID NO: 3622855 - RNA, 17 nt, Salmonella enterica enterica serovar Typhi
cucagggucagaauaca

SEQ ID NO: 3622856 - RNA, 20 nt, Salmonella enterica enterica serovar Typhi
cucaguccagccgccgcgcg

SEQ ID NO: 3622857 - RNA, 19 nt, Salmonella enterica enterica serovar Typhi
cucaguugguuagagcaca

SEQ ID NO: 3622858 - RNA, 22 nt, Salmonella enterica enterica serovar Typhi
cucauaaaacauuccugacauu

SEQ ID NO: 3622859 - RNA, 18 nt, Salmonella enterica enterica serovar Typhi
cucauaacggcuacgcag

SEQ ID NO: 3622860 - RNA, 15 nt, Salmonella enterica enterica serovar Typhi
cucauacccuuccag

SEQ ID NO: 3622861 - RNA, 14 nt, Salmonella enterica enterica serovar Typhi
cucauagccgcuuu

SEQ ID NO: 3622862 - RNA, 16 nt, Salmonella enterica enterica serovar Typhi
cucauauuccagccac

SEQ ID NO: 3622863 - RNA, 16 nt, Salmonella enterica enterica serovar Typhi
cucaucaaacagcggc

SEQ ID NO: 3622864 - RNA, 21 nt, Salmonella enterica enterica serovar Typhi
cucaucaauggauuuauggca

SEQ ID NO: 3622865 - RNA, 13 nt, Salmonella enterica enterica serovar Typhi
cucaucacagcca

SEQ ID NO: 3622866 - RNA, 17 nt, Salmonella enterica enterica serovar Typhi
cucaucacagccacacu

SEQ ID NO: 3622867 - RNA, 15 nt, Salmonella enterica enterica serovar Typhi
cucaucagaccguga

SEQ ID NO: 3622868 - RNA, 24 nt, Salmonella enterica enterica serovar Typhi
cucauccaacugcgccugaagaua

SEQ ID NO: 3622869 - RNA, 14 nt, Salmonella enterica enterica serovar Typhi
cucauccaccuuau

SEQ ID NO: 3622870 - RNA, 17 nt, Salmonella enterica enterica serovar Typhi
cucauccagcaaaauaa

SEQ ID NO: 3622871 - RNA, 13 nt, Salmonella enterica enterica serovar Typhi
cucauccagcaac

SEQ ID NO: 3622872 - RNA, 11 nt, Salmonella enterica enterica serovar Typhi
cucauccagcg

SEQ ID NO: 3622873 - RNA, 22 nt, Salmonella enterica enterica serovar Typhi
cucaucuucggcgggaucucca

SEQ ID NO: 3622874 - RNA, 19 nt, Salmonella enterica enterica serovar Typhi
cucaucuucuuuuuccgga

SEQ ID NO: 3622875 - RNA, 14 nt, Salmonella enterica enterica serovar Typhi
cucaucuugcagga

SEQ ID NO: 3622876 - RNA, 19 nt, Salmonella enterica enterica serovar Typhi
cucaugauagggcagcagu

SEQ ID NO: 3622877 - RNA, 22 nt, Salmonella enterica enterica serovar Typhi
cucaugcaagacaucuaacucu

SEQ ID NO: 3622878 - RNA, 14 nt, Salmonella enterica enterica serovar Typhi
cucaugcguaaauc

SEQ ID NO: 3622879 - RNA, 15 nt, Salmonella enterica enterica serovar Typhi
cucauggacaaaaaa

SEQ ID NO: 3622880 - RNA, 21 nt, Salmonella enterica enterica serovar Typhi
cucaugugcagcauccagcuc

SEQ ID NO: 3622881 - RNA, 15 nt, Salmonella enterica enterica serovar Typhi
cucauguucaagcug

SEQ ID NO: 3622882 - RNA, 17 nt, Salmonella enterica enterica serovar Typhi
cucauguucaagcuggu

SEQ ID NO: 3622883 - RNA, 14 nt, Salmonella enterica enterica serovar Typhi
cucauuaaaaaaac

SEQ ID NO: 3622884 - RNA, 18 nt, Salmonella enterica enterica serovar Typhi
cucauuaugccucccguu

SEQ ID NO: 3622885 - RNA, 23 nt, Salmonella enterica enterica serovar Typhi
cucauuauuaaauuaacacccaa

SEQ ID NO: 3622886 - RNA, 16 nt, Salmonella enterica enterica serovar Typhi
cucauucagcaacugc

SEQ ID NO: 3622887 - RNA, 15 nt, Salmonella enterica enterica serovar Typhi
cucauucagcggcug

SEQ ID NO: 3622888 - RNA, 21 nt, Salmonella enterica enterica serovar Typhi
cucauucgggcacuccggcuc

SEQ ID NO: 3622889 - RNA, 22 nt, Salmonella enterica enterica serovar Typhi
cucauuuugccguugcuguucc

SEQ ID NO: 3622890 - RNA, 13 nt, Salmonella enterica enterica serovar Typhi
cuccaauaaauau

SEQ ID NO: 3622891 - RNA, 19 nt, Salmonella enterica enterica serovar Typhi
cuccaccaaaucccccaac

SEQ ID NO: 3622892 - RNA, 16 nt, Salmonella enterica enterica serovar Typhi
cuccaccauaucgcag

SEQ ID NO: 3622893 - RNA, 21 nt, Salmonella enterica enterica serovar Typhi
cuccaccauaucgcagaccau

SEQ ID NO: 3622894 - RNA, 18 nt, Salmonella enterica enterica serovar Typhi
cuccaccgugucauagcc

SEQ ID NO: 3622895 - RNA, 22 nt, Salmonella enterica enterica serovar Typhi
cuccagaagaucuaaagccagu

SEQ ID NO: 3622896 - RNA, 19 nt, Salmonella enterica enterica serovar Typhi
cuccagaagcacuucucca

SEQ ID NO: 3622897 - RNA, 13 nt, Salmonella enterica enterica serovar Typhi
cuccagacaggac

SEQ ID NO: 3622898 - RNA, 14 nt, Salmonella enterica enterica serovar Typhi
cuccagaccgcugc

SEQ ID NO: 3622899 - RNA, 18 nt, Salmonella enterica enterica serovar Typhi
cuccagaccgcugcggaa

SEQ ID NO: 3622900 - RNA, 17 nt, Salmonella enterica enterica serovar Typhi
cuaaaaaggaaagggac

SEQ ID NO: 3622901 - RNA, 16 nt, Salmonella enterica enterica serovar Typhi
cuaaaauacccgaccc

SEQ ID NO: 3622902 - RNA, 19 nt, Salmonella enterica enterica serovar Typhi
cuaaaauuauuuuuacuua

SEQ ID NO: 3622903 - RNA, 23 nt, Salmonella enterica enterica serovar Typhi
cuaaacaauuugcccagcgcugg

SEQ ID NO: 3622904 - RNA, 16 nt, Salmonella enterica enterica serovar Typhi
cuaaacagcaaaucgg

SEQ ID NO: 3622905 - RNA, 21 nt, Salmonella enterica enterica serovar Typhi
cuaaaccacaugaccagcgcc

SEQ ID NO: 3622906 - RNA, 13 nt, Salmonella enterica enterica serovar Typhi
cuaaaccacggaa

SEQ ID NO: 3622907 - RNA, 20 nt, Salmonella enterica enterica serovar Typhi
cuaaaccagauguacagaau

SEQ ID NO: 3622908 - RNA, 18 nt, Salmonella enterica enterica serovar Typhi
cuaaaccggcggaauagc

SEQ ID NO: 3622909 - RNA, 23 nt, Salmonella enterica enterica serovar Typhi
cuaaaccgucauuuaccagugcu

SEQ ID NO: 3622910 - RNA, 21 nt, Salmonella enterica enterica serovar Typhi
cuaaacguucaucuucccgaa

SEQ ID NO: 3622911 - RNA, 15 nt, Salmonella enterica enterica serovar Typhi
cuaaacucaucuuua

SEQ ID NO: 3622912 - RNA, 11 nt, Salmonella enterica enterica serovar Typhi
cuaaagaaaaa

SEQ ID NO: 3622913 - RNA, 21 nt, Salmonella enterica enterica serovar Typhi
cuaaagccaguuucucuucuu

SEQ ID NO: 3622914 - RNA, 15 nt, Salmonella enterica enterica serovar Typhi
cuaaagcgcuggcgg

SEQ ID NO: 3622915 - RNA, 17 nt, Salmonella enterica enterica serovar Typhi
cuaaaguaaaggaauaa

SEQ ID NO: 3622916 - RNA, 15 nt, Salmonella enterica enterica serovar Typhi
cuaaaucauaccagc

SEQ ID NO: 3622917 - RNA, 20 nt, Salmonella enterica enterica serovar Typhi
cuaaauccguuaagcccuga

SEQ ID NO: 3622918 - RNA, 16 nt, Salmonella enterica enterica serovar Typhi
cuaaaugaacuuacac

SEQ ID NO: 3622919 - RNA, 19 nt, Salmonella enterica enterica serovar Typhi
cuaaaugaccgccuuuuuu

SEQ ID NO: 3622920 - RNA, 17 nt, Salmonella enterica enterica serovar Typhi
cuaaaugcauagcccca

SEQ ID NO: 3622921 - RNA, 21 nt, Salmonella enterica enterica serovar Typhi
cuaaauggcauagccugauau

SEQ ID NO: 3622922 - RNA, 19 nt, Salmonella enterica enterica serovar Typhi
cuaacacaugcaagucgaa

SEQ ID NO: 3622923 - RNA, 12 nt, Salmonella enterica enterica serovar Typhi
cuaacagcagca

SEQ ID NO: 3622924 - RNA, 22 nt, Salmonella enterica enterica serovar Typhi
cuaacagcagcagcaaaccgau

SEQ ID NO: 3622925 - RNA, 23 nt, Salmonella enterica enterica serovar Typhi
cuaacagucgcgccgugcccagc

SEQ ID NO: 3622926 - RNA, 13 nt, Salmonella enterica enterica serovar Typhi
cuaacagugaaau

SEQ ID NO: 3622927 - RNA, 18 nt, Salmonella enterica enterica serovar Typhi
cuaacccgcugcgccguu

SEQ ID NO: 3622928 - RNA, 17 nt, Salmonella enterica enterica serovar Typhi
cuaaccuguaucugcug

SEQ ID NO: 3622929 - RNA, 17 nt, Salmonella enterica enterica serovar Typhi
cuaacgaaaccggcggc

SEQ ID NO: 3622930 - RNA, 22 nt, Salmonella enterica enterica serovar Typhi
cuaacgauguaaaaccuggcac

SEQ ID NO: 3622931 - RNA, 17 nt, Salmonella enterica enterica serovar Typhi
cuaacgccgugucgacc

SEQ ID NO: 3622932 - RNA, 18 nt, Salmonella enterica enterica serovar Typhi
cuaacgcggcaucaagca

SEQ ID NO: 3622933 - RNA, 20 nt, Salmonella enterica enterica serovar Typhi
cuaacgucuuauccggccua

SEQ ID NO: 3622934 - RNA, 22 nt, Salmonella enterica enterica serovar Typhi
cuaacuccggagcuaaaccguc

SEQ ID NO: 3622935 - RNA, 20 nt, Salmonella enterica enterica serovar Typhi
cuaacugcggcuuacccuga

SEQ ID NO: 3622936 - RNA, 20 nt, Salmonella enterica enterica serovar Typhi
cuaacugguacguccauccg

SEQ ID NO: 3622937 - RNA, 14 nt, Salmonella enterica enterica serovar Typhi
cuaagaccagcauc

SEQ ID NO: 3622938 - RNA, 21 nt, Salmonella enterica enterica serovar Typhi
cuaagagugacgguuuucacu

SEQ ID NO: 3622939 - RNA, 21 nt, Salmonella enterica enterica serovar Typhi
cuaagcagaacggcgauacuc

SEQ ID NO: 3622940 - RNA, 17 nt, Salmonella enterica enterica serovar Typhi
cuaagccaguucucaau

SEQ ID NO: 3622941 - RNA, 18 nt, Salmonella enterica enterica serovar Typhi
cuaagcgcccguagcuca

SEQ ID NO: 3622942 - RNA, 20 nt, Salmonella enterica enterica serovar Typhi
cuaagggguugaugccgacc

SEQ ID NO: 3622943 - RNA, 19 nt, Salmonella enterica enterica serovar Typhi
cuaaggucacuacgcggcu

SEQ ID NO: 3622944 - RNA, 20 nt, Salmonella enterica enterica serovar Typhi
cuaagguugaaaggccuaaa

SEQ ID NO: 3622945 - RNA, 14 nt, Salmonella enterica enterica serovar Typhi
cuaaguaaggagga

SEQ ID NO: 3622946 - RNA, 18 nt, Salmonella enterica enterica serovar Typhi
cuaaguauucacgugugu

SEQ ID NO: 3622947 - RNA, 18 nt, Salmonella enterica enterica serovar Typhi
cuaauaaaauaacuauaa

SEQ ID NO: 3622948 - RNA, 16 nt, Salmonella enterica enterica serovar Typhi
cuaauaaaauucacuu

SEQ ID NO: 3622949 - RNA, 22 nt, Salmonella enterica enterica serovar Typhi
cuaauaaauauucaucaaaaug

SEQ ID NO: 3622950 - RNA, 16 nt, Salmonella enterica enterica serovar Typhi
cuaauaccgagaaugc

SEQ ID NO: 3622951 - RNA, 21 nt, Salmonella enterica enterica serovar Typhi
cuaaucaauaaguuuuuucuu

SEQ ID NO: 3622952 - RNA, 16 nt, Salmonella enterica enterica serovar Typhi
cuaauccccagcgcuc

SEQ ID NO: 3622953 - RNA, 22 nt, Salmonella enterica enterica serovar Typhi
cuaauccccauuuuuuucagcc

SEQ ID NO: 3622954 - RNA, 21 nt, Salmonella enterica enterica serovar Typhi
cuaaucccuggcgaauaaaau

SEQ ID NO: 3622955 - RNA, 17 nt, Salmonella enterica enterica serovar Typhi
cuaaugacauagugcaa

SEQ ID NO: 3622956 - RNA, 15 nt, Salmonella enterica enterica serovar Typhi
cuaaugagccagaug

SEQ ID NO: 3622957 - RNA, 21 nt, Salmonella enterica enterica serovar Typhi
cuaaugauuaucuuuuuuagu

SEQ ID NO: 3622958 - RNA, 19 nt, Salmonella enterica enterica serovar Typhi
cuaaugcuuauccggccua

SEQ ID NO: 3622959 - RNA, 14 nt, Salmonella enterica enterica serovar Typhi
cuaauggcaauaau

SEQ ID NO: 3622960 - RNA, 15 nt, Salmonella enterica enterica serovar Typhi
cuaauuauuuuucaa

SEQ ID NO: 3622961 - RNA, 13 nt, Salmonella enterica enterica serovar Typhi
cuaauuguuugua

SEQ ID NO: 3622962 - RNA, 14 nt, Salmonella enterica enterica serovar Typhi
cuaauuucaauuuu

SEQ ID NO: 3622963 - RNA, 18 nt, Salmonella enterica enterica serovar Typhi
cuaauuuuacuuucauuc

SEQ ID NO: 3622964 - RNA, 20 nt, Salmonella enterica enterica serovar Typhi
cuacaaucgugugaugcacc

SEQ ID NO: 3622965 - RNA, 19 nt, Salmonella enterica enterica serovar Typhi
cuacaccccuucuggagaa

SEQ ID NO: 3622966 - RNA, 18 nt, Salmonella enterica enterica serovar Typhi
cuacaccguauccggccu

SEQ ID NO: 3622967 - RNA, 19 nt, Salmonella enterica enterica serovar Typhi
cuacaccguauccggccug

SEQ ID NO: 3622968 - RNA, 22 nt, Salmonella enterica enterica serovar Typhi
cuacaccguauccggccugcag

SEQ ID NO: 3622969 - RNA, 14 nt, Salmonella enterica enterica serovar Typhi
cuacaccugggcuu

SEQ ID NO: 3622970 - RNA, 22 nt, Salmonella enterica enterica serovar Typhi
cuacaccugggcuugcuuuucu

SEQ ID NO: 3622971 - RNA, 16 nt, Salmonella enterica enterica serovar Typhi
cuacacgucuccucag

SEQ ID NO: 3622972 - RNA, 15 nt, Salmonella enterica enterica serovar Typhi
cuacaucaagagaaa

SEQ ID NO: 3622973 - RNA, 23 nt, Salmonella enterica enterica serovar Typhi
cuaccacagaaaucgccgggcua

SEQ ID NO: 3622974 - RNA, 13 nt, Salmonella enterica enterica serovar Typhi
cuaccacccagcc

SEQ ID NO: 3622975 - RNA, 20 nt, Salmonella enterica enterica serovar Typhi
cuaccacccagccagacgcc

SEQ ID NO: 3622976 - RNA, 20 nt, Salmonella enterica enterica serovar Typhi
cuaccacgccgcuacugccg

SEQ ID NO: 3622977 - RNA, 17 nt, Salmonella enterica enterica serovar Typhi
cuaccagcgcggcgcca

SEQ ID NO: 3622978 - RNA, 19 nt, Salmonella enterica enterica serovar Typhi
cuaccagcgcuauccaggc

SEQ ID NO: 3622979 - RNA, 21 nt, Salmonella enterica enterica serovar Typhi
cuaccagcgcuauccaggccg

SEQ ID NO: 3622980 - RNA, 14 nt, Salmonella enterica enterica serovar Typhi
cuaccaggcaaagc

SEQ ID NO: 3622981 - RNA, 13 nt, Salmonella enterica enterica serovar Typhi
cuaccauaaugau

SEQ ID NO: 3622982 - RNA, 16 nt, Salmonella enterica enterica serovar Typhi
cuaccaucggcgcuac

SEQ ID NO: 3622983 - RNA, 16 nt, Salmonella enterica enterica serovar Typhi
cuaccauuacccgaac

SEQ ID NO: 3622984 - RNA, 23 nt, Salmonella enterica enterica serovar Typhi
cuacccagacaagcacauaacug

SEQ ID NO: 3622985 - RNA, 19 nt, Salmonella enterica enterica serovar Typhi
cguugagaaaaccauauaa

SEQ ID NO: 3622986 - RNA, 14 nt, Salmonella enterica enterica serovar Typhi
cguugauggcguaa

SEQ ID NO: 3622987 - RNA, 21 nt, Salmonella enterica enterica serovar Typhi
cguugauguuuuuaaaagaag

SEQ ID NO: 3622988 - RNA, 18 nt, Salmonella enterica enterica serovar Typhi
cguugauuaucacccaca

SEQ ID NO: 3622989 - RNA, 17 nt, Salmonella enterica enterica serovar Typhi
cguugcaggcgauugcc

SEQ ID NO: 3622990 - RNA, 13 nt, Salmonella enterica enterica serovar Typhi
cguugccagcggc

SEQ ID NO: 3622991 - RNA, 17 nt, Salmonella enterica enterica serovar Typhi
cguugcccaucgcaacg

SEQ ID NO: 3622992 - RNA, 16 nt, Salmonella enterica enterica serovar Typhi
cguugccgcaggcaac

SEQ ID NO: 3622993 - RNA, 17 nt, Salmonella enterica enterica serovar Typhi
cguugccgcaggcaacg

SEQ ID NO: 3622994 - RNA, 19 nt, Salmonella enterica enterica serovar Typhi
cguugccgccgucgccgaa

SEQ ID NO: 3622995 - RNA, 14 nt, Salmonella enterica enterica serovar Typhi
cguugcggcguauc

SEQ ID NO: 3622996 - RNA, 22 nt, Salmonella enterica enterica serovar Typhi
cguugcuggacauauuccagaa

SEQ ID NO: 3622997 - RNA, 21 nt, Salmonella enterica enterica serovar Typhi
cguugcuguaaccggaauaga

SEQ ID NO: 3622998 - RNA, 12 nt, Salmonella enterica enterica serovar Typhi
cguugcuuuaua

SEQ ID NO: 3622999 - RNA, 20 nt, Salmonella enterica enterica serovar Typhi
cguuggaauaaaucacaacg

SEQ ID NO: 3623000 - RNA, 19 nt, Salmonella enterica enterica serovar Typhi
cguuggcuugaucaacgcc

SEQ ID NO: 3623001 - RNA, 14 nt, Salmonella enterica enterica serovar Typhi
cguuggggaaaaua

SEQ ID NO: 3623002 - RNA, 18 nt, Salmonella enterica enterica serovar Typhi
cguugguagacccggcau

SEQ ID NO: 3623003 - RNA, 23 nt, Salmonella enterica enterica serovar Typhi
cguugguuucggcguaagaucgc

SEQ ID NO: 3623004 - RNA, 13 nt, Salmonella enterica enterica serovar Typhi
cguuguauaaaca

SEQ ID NO: 3623005 - RNA, 18 nt, Salmonella enterica enterica serovar Typhi
cguugucuucaucuaucc

SEQ ID NO: 3623006 - RNA, 15 nt, Salmonella enterica enterica serovar Typhi
cguugugcugcggca

SEQ ID NO: 3623007 - RNA, 18 nt, Salmonella enterica enterica serovar Typhi
cguuguggcgaccagcag

SEQ ID NO: 3623008 - RNA, 21 nt, Salmonella enterica enterica serovar Typhi
cguuguuucucuuccgccagc

SEQ ID NO: 3623009 - RNA, 19 nt, Salmonella enterica enterica serovar Typhi
cguuguuucugccuuuaac

SEQ ID NO: 3623010 - RNA, 15 nt, Salmonella enterica enterica serovar Typhi
cguuguuuggguaac

SEQ ID NO: 3623011 - RNA, 16 nt, Salmonella enterica enterica serovar Typhi
cguuuaaaaagcugca

SEQ ID NO: 3623012 - RNA, 13 nt, Salmonella enterica enterica serovar Typhi
cguuuaaaaugaa

SEQ ID NO: 3623013 - RNA, 12 nt, Salmonella enterica enterica serovar Typhi
cguuuaaacggg

SEQ ID NO: 3623014 - RNA, 16 nt, Salmonella enterica enterica serovar Typhi
cguuuaaacucccggc

SEQ ID NO: 3623015 - RNA, 16 nt, Salmonella enterica enterica serovar Typhi
cguuuaagcaugguga

SEQ ID NO: 3623016 - RNA, 22 nt, Salmonella enterica enterica serovar Typhi
cguuuaagucccuggcgcgcca

SEQ ID NO: 3623017 - RNA, 14 nt, Salmonella enterica enterica serovar Typhi
cguuuacaccuauu

SEQ ID NO: 3623018 - RNA, 17 nt, Salmonella enterica enterica serovar Typhi
cguuuaccuucgauaac

SEQ ID NO: 3623019 - RNA, 14 nt, Salmonella enterica enterica serovar Typhi
cguuuagcgccagc

SEQ ID NO: 3623020 - RNA, 20 nt, Salmonella enterica enterica serovar Typhi
cguuuauauaaaaauagcug

SEQ ID NO: 3623021 - RNA, 14 nt, Salmonella enterica enterica serovar Typhi
cguuuaugcaggaa

SEQ ID NO: 3623022 - RNA, 13 nt, Salmonella enterica enterica serovar Typhi
cguuuauuauuug

SEQ ID NO: 3623023 - RNA, 13 nt, Salmonella enterica enterica serovar Typhi
cguuuauucuuuu

SEQ ID NO: 3623024 - RNA, 20 nt, Salmonella enterica enterica serovar Typhi
cguuucaacaaacucagcca

SEQ ID NO: 3623025 - RNA, 14 nt, Salmonella enterica enterica serovar Typhi
cguuucaaccgcgc

SEQ ID NO: 3623026 - RNA, 19 nt, Salmonella enterica enterica serovar Typhi
cguuucacaaccuccacgc

SEQ ID NO: 3623027 - RNA, 23 nt, Salmonella enterica enterica serovar Typhi
cguuucacgcgcgccugccgcca

SEQ ID NO: 3623028 - RNA, 16 nt, Salmonella enterica enterica serovar Typhi
cguuucagucaccagc

SEQ ID NO: 3623029 - RNA, 12 nt, Salmonella enterica enterica serovar Typhi
cguuuccagacu

SEQ ID NO: 3623030 - RNA, 22 nt, Salmonella enterica enterica serovar Typhi
cguuucgauaaccaccagcgga

SEQ ID NO: 3623031 - RNA, 16 nt, Salmonella enterica enterica serovar Typhi
cguuucgccaguuuac

SEQ ID NO: 3623032 - RNA, 18 nt, Salmonella enterica enterica serovar Typhi
cguuucguuuagcgccug

SEQ ID NO: 3623033 - RNA, 20 nt, Salmonella enterica enterica serovar Typhi
cguuucuauuauugaucggc

SEQ ID NO: 3623034 - RNA, 16 nt, Salmonella enterica enterica serovar Typhi
cguuucucgcgaccag

SEQ ID NO: 3623035 - RNA, 23 nt, Salmonella enterica enterica serovar Typhi
cguuugaaauaccaggcggcuuu

SEQ ID NO: 3623036 - RNA, 14 nt, Salmonella enterica enterica serovar Typhi
cguuugaacagcag

SEQ ID NO: 3623037 - RNA, 18 nt, Salmonella enterica enterica serovar Typhi
cguuugacggauuuuuuu

SEQ ID NO: 3623038 - RNA, 14 nt, Salmonella enterica enterica serovar Typhi
cguuugcagccaga

SEQ ID NO: 3623039 - RNA, 14 nt, Salmonella enterica enterica serovar Typhi
cguuugcgccgcca

SEQ ID NO: 3623040 - RNA, 15 nt, Salmonella enterica enterica serovar Typhi
cguuugcgccgccau

SEQ ID NO: 3623041 - RNA, 15 nt, Salmonella enterica enterica serovar Typhi
cguuugcgcgcgcca

SEQ ID NO: 3623042 - RNA, 16 nt, Salmonella enterica enterica serovar Typhi
cguuugcgcuacgcug

SEQ ID NO: 3623043 - RNA, 20 nt, Salmonella enterica enterica serovar Typhi
cguuugcgucaaucaggaaa

SEQ ID NO: 3623044 - RNA, 15 nt, Salmonella enterica enterica serovar Typhi
cguuuggcgauguuu

SEQ ID NO: 3623045 - RNA, 16 nt, Salmonella enterica enterica serovar Typhi
cguuuggucaacucuu

SEQ ID NO: 3623046 - RNA, 13 nt, Salmonella enterica enterica serovar Typhi
cguuuguaacagc

SEQ ID NO: 3623047 - RNA, 20 nt, Salmonella enterica enterica serovar Typhi
cguuuguuugucgauuuccg

SEQ ID NO: 3623048 - RNA, 20 nt, Salmonella enterica enterica serovar Typhi
cguuuuaacgucauuaccag

SEQ ID NO: 3623049 - RNA, 16 nt, Salmonella enterica enterica serovar Typhi
cguuuuaccuucugcc

SEQ ID NO: 3623050 - RNA, 14 nt, Salmonella enterica enterica serovar Typhi
cguuuuacgcugcc

SEQ ID NO: 3623051 - RNA, 13 nt, Salmonella enterica enterica serovar Typhi
cguuuucaauaau

SEQ ID NO: 3623052 - RNA, 15 nt, Salmonella enterica enterica serovar Typhi
cguuuucaugcacga

SEQ ID NO: 3623053 - RNA, 19 nt, Salmonella enterica enterica serovar Typhi
cguuuucauuagccgccag

SEQ ID NO: 3623054 - RNA, 14 nt, Salmonella enterica enterica serovar Typhi
cguuuuccagcauc

SEQ ID NO: 3623055 - RNA, 20 nt, Salmonella enterica enterica serovar Typhi
cguuuucccggcaauuaccg

SEQ ID NO: 3623056 - RNA, 15 nt, Salmonella enterica enterica serovar Typhi
cguuuucgccggaug

SEQ ID NO: 3623057 - RNA, 16 nt, Salmonella enterica enterica serovar Typhi
cguuuucgucaacaua

SEQ ID NO: 3623058 - RNA, 20 nt, Salmonella enterica enterica serovar Typhi
cguuuugauguccagaugcu

SEQ ID NO: 3623059 - RNA, 13 nt, Salmonella enterica enterica serovar Typhi
cguuuugcagcgc

SEQ ID NO: 3623060 - RNA, 16 nt, Salmonella enterica enterica serovar Typhi
cguuuugcagcgccau

SEQ ID NO: 3623061 - RNA, 17 nt, Salmonella enterica enterica serovar Typhi
cguuuugcgacuucaga

SEQ ID NO: 3623062 - RNA, 13 nt, Salmonella enterica enterica serovar Typhi
cguuuugcucuuc

SEQ ID NO: 3623063 - RNA, 17 nt, Salmonella enterica enterica serovar Typhi
cguuuugcugccacguc

SEQ ID NO: 3623064 - RNA, 12 nt, Salmonella enterica enterica serovar Typhi
cguuuugcuguc

SEQ ID NO: 3623065 - RNA, 21 nt, Salmonella enterica enterica serovar Typhi
cguuuuggcagacagccauau

SEQ ID NO: 3623066 - RNA, 18 nt, Salmonella enterica enterica serovar Typhi
cguuuuucccgcuggcug

SEQ ID NO: 3623067 - RNA, 15 nt, Salmonella enterica enterica serovar Typhi
cguuuuucucaucaa

SEQ ID NO: 3623068 - RNA, 16 nt, Salmonella enterica enterica serovar Typhi
cguuuuucucaucaag

SEQ ID NO: 3623069 - RNA, 15 nt, Salmonella enterica enterica serovar Typhi
cguuuuuguuuaaaa

SEQ ID NO: 3623070 - RNA, 16 nt, Salmonella enterica enterica serovar Typhi
cuaaaaacagcgcaau

SEQ ID NO: 3623071 - RNA, 21 nt, Salmonella enterica enterica serovar Typhi
cuaaaaaccagaauuuccaga

SEQ ID NO: 3623072 - RNA, 18 nt, Salmonella enterica enterica serovar Typhi
gcccgccgccugaugcug

SEQ ID NO: 3623073 - RNA, 19 nt, Salmonella enterica enterica serovar Typhi
gcccgccgcgaccagcagc

SEQ ID NO: 3623074 - RNA, 12 nt, Salmonella enterica enterica serovar Typhi
gcccgccgggcg

SEQ ID NO: 3623075 - RNA, 14 nt, Salmonella enterica enterica serovar Typhi
gcccgccuccguca

SEQ ID NO: 3623076 - RNA, 16 nt, Salmonella enterica enterica serovar Typhi
gcccgccucgcugaua

SEQ ID NO: 3623077 - RNA, 17 nt, Salmonella enterica enterica serovar Typhi
gcccgccugagcgcgca

SEQ ID NO: 3623078 - RNA, 22 nt, Salmonella enterica enterica serovar Typhi
gcccgccugagcgcgcaguggg

SEQ ID NO: 3623079 - RNA, 22 nt, Salmonella enterica enterica serovar Typhi
gcccgccugcuguaaccccugc

SEQ ID NO: 3623080 - RNA, 13 nt, Salmonella enterica enterica serovar Typhi
gcccgcgcguuca

SEQ ID NO: 3623081 - RNA, 15 nt, Salmonella enterica enterica serovar Typhi
gcccgcgcuaagcac

SEQ ID NO: 3623082 - RNA, 11 nt, Salmonella enterica enterica serovar Typhi
gcccgcggcga

SEQ ID NO: 3623083 - RNA, 17 nt, Salmonella enterica enterica serovar Typhi
gcccgcuaacggcacca

SEQ ID NO: 3623084 - RNA, 15 nt, Salmonella enterica enterica serovar Typhi
gcccgcucugcgcca

SEQ ID NO: 3623085 - RNA, 22 nt, Salmonella enterica enterica serovar Typhi
gcccgcuucauuggcgucugcu

SEQ ID NO: 3623086 - RNA, 22 nt, Salmonella enterica enterica serovar Typhi
gcccggaaauggguaucuucau

SEQ ID NO: 3623087 - RNA, 18 nt, Salmonella enterica enterica serovar Typhi
gcccggacgaaccuggcg

SEQ ID NO: 3623088 - RNA, 20 nt, Salmonella enterica enterica serovar Typhi
gcccggacgaaccuggcggu

SEQ ID NO: 3623089 - RNA, 19 nt, Salmonella enterica enterica serovar Typhi
gcccggacgccguccaggc

SEQ ID NO: 3623090 - RNA, 21 nt, Salmonella enterica enterica serovar Typhi
gcccggagggguuuucgccag

SEQ ID NO: 3623091 - RNA, 22 nt, Salmonella enterica enterica serovar Typhi
gcccggauaaccgcccgcggcg

SEQ ID NO: 3623092 - RNA, 14 nt, Salmonella enterica enterica serovar Typhi
gcccggcaaacggg

SEQ ID NO: 3623093 - RNA, 15 nt, Salmonella enterica enterica serovar Typhi
gcccggcaguugcug

SEQ ID NO: 3623094 - RNA, 13 nt, Salmonella enterica enterica serovar Typhi
gcccugcaaagca

SEQ ID NO: 3623095 - RNA, 21 nt, Salmonella enterica enterica serovar Typhi
gcccugcaucaugcgcagaaa

SEQ ID NO: 3623096 - RNA, 14 nt, Salmonella enterica enterica serovar Typhi
gcccugcccgccag

SEQ ID NO: 3623097 - RNA, 15 nt, Salmonella enterica enterica serovar Typhi
gcccugcccgccagg

SEQ ID NO: 3623098 - RNA, 18 nt, Salmonella enterica enterica serovar Typhi
gcccugccggaaaaugcg

SEQ ID NO: 3623099 - RNA, 19 nt, Salmonella enterica enterica serovar Typhi
gcccugcggaaccgcccau

SEQ ID NO: 3623100 - RNA, 17 nt, Salmonella enterica enterica serovar Typhi
gcccugcggacaggcga

SEQ ID NO: 3623101 - RNA, 16 nt, Salmonella enterica enterica serovar Typhi
gcccugcucccacagc

SEQ ID NO: 3623102 - RNA, 14 nt, Salmonella enterica enterica serovar Typhi
gcccugcuggcgca

SEQ ID NO: 3623103 - RNA, 16 nt, Salmonella enterica enterica serovar Typhi
gcccugcuguuccagu

SEQ ID NO: 3623104 - RNA, 23 nt, Salmonella enterica enterica serovar Typhi
gcccuggaggaacagcgccguca

SEQ ID NO: 3623105 - RNA, 19 nt, Salmonella enterica enterica serovar Typhi
gcccuggcucaauccaggu

SEQ ID NO: 3623106 - RNA, 13 nt, Salmonella enterica enterica serovar Typhi
gcccuggguugcc

SEQ ID NO: 3623107 - RNA, 20 nt, Salmonella enterica enterica serovar Typhi
gcccuggguugcccaaaugc

SEQ ID NO: 3623108 - RNA, 18 nt, Salmonella enterica enterica serovar Typhi
gcccuggugagcuccagc

SEQ ID NO: 3623109 - RNA, 17 nt, Salmonella enterica enterica serovar Typhi
gcccuguccuccauggc

SEQ ID NO: 3623110 - RNA, 18 nt, Salmonella enterica enterica serovar Typhi
gcccugugccgcuggugc

SEQ ID NO: 3623111 - RNA, 15 nt, Salmonella enterica enterica serovar Typhi
gcccuguuucgcagg

SEQ ID NO: 3623112 - RNA, 20 nt, Salmonella enterica enterica serovar Typhi
gcccuguuuuuucgccgcgc

SEQ ID NO: 3623113 - RNA, 14 nt, Salmonella enterica enterica serovar Typhi
gcccuucaucuucc

SEQ ID NO: 3623114 - RNA, 13 nt, Salmonella enterica enterica serovar Typhi
gccgcaaaagccg

SEQ ID NO: 3623115 - RNA, 21 nt, Salmonella enterica enterica serovar Typhi
gccgcaaacgccgaagccagc

SEQ ID NO: 3623116 - RNA, 23 nt, Salmonella enterica enterica serovar Typhi
gccgcaaaggaucaucggccaga

SEQ ID NO: 3623117 - RNA, 23 nt, Salmonella enterica enterica serovar Typhi
gccgcaaaugaccagaucaacau

SEQ ID NO: 3623118 - RNA, 14 nt, Salmonella enterica enterica serovar Typhi
gccgcaaccgccaa

SEQ ID NO: 3623119 - RNA, 18 nt, Salmonella enterica enterica serovar Typhi
gccgcaaccgccaauaau

SEQ ID NO: 3623120 - RNA, 14 nt, Salmonella enterica enterica serovar Typhi
gccgcaacggucgg

SEQ ID NO: 3623121 - RNA, 20 nt, Salmonella enterica enterica serovar Typhi
gccgcaaucacuucauacga

SEQ ID NO: 3623122 - RNA, 17 nt, Salmonella enterica enterica serovar Typhi
gccgcaccagucggcaa

SEQ ID NO: 3623123 - RNA, 21 nt, Salmonella enterica enterica serovar Typhi
gccgcaccagucggcaaagac

SEQ ID NO: 3623124 - RNA, 15 nt, Salmonella enterica enterica serovar Typhi
gccgcacuccccaga

SEQ ID NO: 3623125 - RNA, 19 nt, Salmonella enterica enterica serovar Typhi
gccgcagaaaauggucugc

SEQ ID NO: 3623126 - RNA, 14 nt, Salmonella enterica enterica serovar Typhi
gccgcagacggaga

SEQ ID NO: 3623127 - RNA, 20 nt, Salmonella enterica enterica serovar Typhi
gccgcaggaaagugccuggg

SEQ ID NO: 3623128 - RNA, 22 nt, Salmonella enterica enterica serovar Typhi
gccgcaggaaagugccugggga

SEQ ID NO: 3623129 - RNA, 12 nt, Salmonella enterica enterica serovar Typhi
gccgcaggccau

SEQ ID NO: 3623130 - RNA, 20 nt, Salmonella enterica enterica serovar Typhi
gccgcagugaagaauggcgc

SEQ ID NO: 3623131 - RNA, 18 nt, Salmonella enterica enterica serovar Typhi
gccgcauaauucaucuuc

SEQ ID NO: 3623132 - RNA, 14 nt, Salmonella enterica enterica serovar Typhi
gccgcauccccaua

SEQ ID NO: 3623133 - RNA, 21 nt, Salmonella enterica enterica serovar Typhi
gccgcauccccauagacagua

SEQ ID NO: 3623134 - RNA, 13 nt, Salmonella enterica enterica serovar Typhi
gccgcauccggca

SEQ ID NO: 3623135 - RNA, 14 nt, Salmonella enterica enterica serovar Typhi
gccgcaucgccaua

SEQ ID NO: 3623136 - RNA, 16 nt, Salmonella enterica enterica serovar Typhi
gccgcaucggcccugu

SEQ ID NO: 3623137 - RNA, 22 nt, Salmonella enterica enterica serovar Typhi
gccgcauggagcaucagcgccg

SEQ ID NO: 3623138 - RNA, 19 nt, Salmonella enterica enterica serovar Typhi
gccgccaaaaauaucgccg

SEQ ID NO: 3623139 - RNA, 20 nt, Salmonella enterica enterica serovar Typhi
gccgccaaaaauaucgccgu

SEQ ID NO: 3623140 - RNA, 23 nt, Salmonella enterica enterica serovar Typhi
gccgccaaacugcgcgccgcccu

SEQ ID NO: 3623141 - RNA, 17 nt, Salmonella enterica enterica serovar Typhi
gccgccaaagcgcccga

SEQ ID NO: 3623142 - RNA, 15 nt, Salmonella enterica enterica serovar Typhi
gccgccaacgccagc

SEQ ID NO: 3623143 - RNA, 17 nt, Salmonella enterica enterica serovar Typhi
gccgccaacgccagcag

SEQ ID NO: 3623144 - RNA, 18 nt, Salmonella enterica enterica serovar Typhi
gccgccaacgccagcagc

SEQ ID NO: 3623145 - RNA, 19 nt, Salmonella enterica enterica serovar Typhi
gccgccacauugcgcgccg

SEQ ID NO: 3623146 - RNA, 17 nt, Salmonella enterica enterica serovar Typhi
gccgccaccacaaagcg

SEQ ID NO: 3623147 - RNA, 12 nt, Salmonella enterica enterica serovar Typhi
gccgccagaauc

SEQ ID NO: 3623148 - RNA, 13 nt, Salmonella enterica enterica serovar Typhi
gccgccagaauca

SEQ ID NO: 3623149 - RNA, 24 nt, Salmonella enterica enterica serovar Typhi
gccgccagaaucaccucuuucucc

SEQ ID NO: 3623150 - RNA, 20 nt, Salmonella enterica enterica serovar Typhi
gccgccagauuauccagucc

SEQ ID NO: 3623151 - RNA, 14 nt, Salmonella enterica enterica serovar Typhi
gccgccagcaaacu

SEQ ID NO: 3623152 - RNA, 13 nt, Salmonella enterica enterica serovar Typhi
gccgccagcaaua

SEQ ID NO: 3623153 - RNA, 17 nt, Salmonella enterica enterica serovar Typhi
gccgccagcaccgccgc

SEQ ID NO: 3623154 - RNA, 13 nt, Salmonella enterica enterica serovar Typhi
gccgccagccauc

SEQ ID NO: 3623155 - RNA, 19 nt, Salmonella enterica enterica serovar Typhi
gccgccagccauccccaua

SEQ ID NO: 3623156 - RNA, 21 nt, Salmonella enterica enterica serovar Typhi
gccgccaggcauguuaugaau

SEQ ID NO: 3623157 - RNA, 22 nt, Salmonella enterica enterica serovar Typhi
gccgccaguaauuuuucuccca

SEQ ID NO: 3623158 - RNA, 20 nt, Salmonella enterica enterica serovar Typhi
gccgccauaacgccggcgcu

SEQ ID NO: 3623159 - RNA, 23 nt, Salmonella enterica enterica serovar Typhi
gccgccaucaacgaccaugguuc

SEQ ID NO: 3623160 - RNA, 16 nt, Salmonella enterica enterica serovar Typhi
gccgccauccggcaaa

SEQ ID NO: 3623161 - RNA, 16 nt, Salmonella enterica enterica serovar Typhi
gccgccauccggcaac

SEQ ID NO: 3623162 - RNA, 20 nt, Salmonella enterica enterica serovar Typhi
gccgccauccggcacaguau

SEQ ID NO: 3623163 - RNA, 16 nt, Salmonella enterica enterica serovar Typhi
gccgccauccggccug

SEQ ID NO: 3623164 - RNA, 17 nt, Salmonella enterica enterica serovar Typhi
gccgccaucgcugacga

SEQ ID NO: 3623165 - RNA, 22 nt, Salmonella enterica enterica serovar Typhi
gccgccaucuccggcagcgaau

SEQ ID NO: 3623166 - RNA, 23 nt, Salmonella enterica enterica serovar Typhi
gccgccaucuuuacccugagccu

SEQ ID NO: 3623167 - RNA, 12 nt, Salmonella enterica enterica serovar Typhi
gccgccauggcg

SEQ ID NO: 3623168 - RNA, 14 nt, Salmonella enterica enterica serovar Typhi
gccgccauuaauac

SEQ ID NO: 3623169 - RNA, 16 nt, Salmonella enterica enterica serovar Typhi
gccgccauuaauacca

SEQ ID NO: 3623170 - RNA, 15 nt, Salmonella enterica enterica serovar Typhi
gccgccauuugcgcg

SEQ ID NO: 3623171 - RNA, 23 nt, Salmonella enterica enterica serovar Typhi
gccgccauuuuauccaggccagc

SEQ ID NO: 3623172 - RNA, 16 nt, Salmonella enterica enterica serovar Typhi
gccgcccauaaucacc

SEQ ID NO: 3623173 - RNA, 21 nt, Salmonella enterica enterica serovar Typhi
gccgcccaucccuaauaaggu

SEQ ID NO: 3623174 - RNA, 18 nt, Salmonella enterica enterica serovar Typhi
gccgcccaucgccacagc

SEQ ID NO: 3623175 - RNA, 23 nt, Salmonella enterica enterica serovar Typhi
gccgcccauuaauaucagcccca

SEQ ID NO: 3623176 - RNA, 18 nt, Salmonella enterica enterica serovar Typhi
gccgcccccaugccgccu

SEQ ID NO: 3623177 - RNA, 23 nt, Salmonella enterica enterica serovar Typhi
gccgcccgcaugguaaacgcauc

SEQ ID NO: 3623178 - RNA, 16 nt, Salmonella enterica enterica serovar Typhi
gccgcccuccggcaca

SEQ ID NO: 3623179 - RNA, 11 nt, Salmonella enterica enterica serovar Typhi
gccgcccugcg

SEQ ID NO: 3623180 - RNA, 12 nt, Salmonella enterica enterica serovar Typhi
gccgccgagcgc

SEQ ID NO: 3623181 - RNA, 14 nt, Salmonella enterica enterica serovar Typhi
gccgccgagcgccg

SEQ ID NO: 3623182 - RNA, 18 nt, Salmonella enterica enterica serovar Typhi
gccgccgaggcuaagcca

SEQ ID NO: 3623183 - RNA, 12 nt, Salmonella enterica enterica serovar Typhi
gccgccgcagca

SEQ ID NO: 3623184 - RNA, 15 nt, Salmonella enterica enterica serovar Typhi
gccgccgcagcagau

SEQ ID NO: 3623185 - RNA, 16 nt, Salmonella enterica enterica serovar Typhi
gccgccgcaggacagc

SEQ ID NO: 3623186 - RNA, 12 nt, Salmonella enterica enterica serovar Typhi
gccgccgccagg

SEQ ID NO: 3623187 - RNA, 13 nt, Salmonella enterica enterica serovar Typhi
gccgccggaaauu

SEQ ID NO: 3623188 - RNA, 11 nt, Salmonella enterica enterica serovar Typhi
gccgccgggca

SEQ ID NO: 3623189 - RNA, 21 nt, Salmonella enterica enterica serovar Typhi
gccgccgggcgauuauaaggu

SEQ ID NO: 3623190 - RNA, 17 nt, Salmonella enterica enterica serovar Typhi
gccgccgucaucugcgc

SEQ ID NO: 3623191 - RNA, 20 nt, Salmonella enterica enterica serovar Typhi
gccgccgugauaaauacgcu

SEQ ID NO: 3623192 - RNA, 14 nt, Salmonella enterica enterica serovar Typhi
gccgccucccccuc

SEQ ID NO: 3623193 - RNA, 16 nt, Salmonella enterica enterica serovar Typhi
gccgccucccccucaa

SEQ ID NO: 3623194 - RNA, 13 nt, Salmonella enterica enterica serovar Typhi
gccgccugaugcu

SEQ ID NO: 3623195 - RNA, 14 nt, Salmonella enterica enterica serovar Typhi
gccgccugaugcug

SEQ ID NO: 3623196 - RNA, 22 nt, Salmonella enterica enterica serovar Typhi
gccgccugcacggcgucauuca

SEQ ID NO: 3623197 - RNA, 13 nt, Salmonella enterica enterica serovar Typhi
gccgccugcgcca

SEQ ID NO: 3623198 - RNA, 19 nt, Salmonella enterica enterica serovar Typhi
gccgccugcgccagcgccg

SEQ ID NO: 3623199 - RNA, 13 nt, Salmonella enterica enterica serovar Typhi
gccgccuggccug

SEQ ID NO: 3623200 - RNA, 14 nt, Salmonella enterica enterica serovar Typhi
gccggauaaggcau

SEQ ID NO: 3623201 - RNA, 17 nt, Salmonella enterica enterica serovar Typhi
gccggauaaggcgcagc

SEQ ID NO: 3623202 - RNA, 22 nt, Salmonella enterica enterica serovar Typhi
gccggauaaggcggagccgcca

SEQ ID NO: 3623203 - RNA, 16 nt, Salmonella enterica enterica serovar Typhi
gccggauaaggcguaa

SEQ ID NO: 3623204 - RNA, 16 nt, Salmonella enterica enterica serovar Typhi
gccggauaagguguuu

SEQ ID NO: 3623205 - RNA, 20 nt, Salmonella enterica enterica serovar Typhi
gccggauagacaugaccgga

SEQ ID NO: 3623206 - RNA, 19 nt, Salmonella enterica enterica serovar Typhi
gccggauagcguagcgcca

SEQ ID NO: 3623207 - RNA, 20 nt, Salmonella enterica enterica serovar Typhi
gccggauagcguagcgccau

SEQ ID NO: 3623208 - RNA, 15 nt, Salmonella enterica enterica serovar Typhi
gccggauaucgcuau

SEQ ID NO: 3623209 - RNA, 17 nt, Salmonella enterica enterica serovar Typhi
gccggaucgggcuucca

SEQ ID NO: 3623210 - RNA, 17 nt, Salmonella enterica enterica serovar Typhi
gccggauggcaacgcca

SEQ ID NO: 3623211 - RNA, 19 nt, Salmonella enterica enterica serovar Typhi
gccggauggcaacgccaga

SEQ ID NO: 3623212 - RNA, 13 nt, Salmonella enterica enterica serovar Typhi
gccggauggcggc

SEQ ID NO: 3623213 - RNA, 16 nt, Salmonella enterica enterica serovar Typhi
gccggauggcggcgca

SEQ ID NO: 3623214 - RNA, 15 nt, Salmonella enterica enterica serovar Typhi
gccggauggcggcug

SEQ ID NO: 3623215 - RNA, 23 nt, Salmonella enterica enterica serovar Typhi
gccggauggggcauuagccgcca

SEQ ID NO: 3623216 - RNA, 13 nt, Salmonella enterica enterica serovar Typhi
gccggaugguggu

SEQ ID NO: 3623217 - RNA, 14 nt, Salmonella enterica enterica serovar Typhi
gccggauguaggcc

SEQ ID NO: 3623218 - RNA, 17 nt, Salmonella enterica enterica serovar Typhi
gccggaugugagcgcau

SEQ ID NO: 3623219 - RNA, 22 nt, Salmonella enterica enterica serovar Typhi
gccggaugugagcgcauccggc

SEQ ID NO: 3623220 - RNA, 21 nt, Salmonella enterica enterica serovar Typhi
gccggauuagcgacagcgcua

SEQ ID NO: 3623221 - RNA, 13 nt, Salmonella enterica enterica serovar Typhi
gccggcaaagcca

SEQ ID NO: 3623222 - RNA, 14 nt, Salmonella enterica enterica serovar Typhi
gccggcagcagcuu

SEQ ID NO: 3623223 - RNA, 15 nt, Salmonella enterica enterica serovar Typhi
gccggcaucauucug

SEQ ID NO: 3623224 - RNA, 19 nt, Salmonella enterica enterica serovar Typhi
gccggcaucauucugcagg

SEQ ID NO: 3623225 - RNA, 16 nt, Salmonella enterica enterica serovar Typhi
gccggcgaccaugcca

SEQ ID NO: 3623226 - RNA, 17 nt, Salmonella enterica enterica serovar Typhi
gccggcgaccaugccag

SEQ ID NO: 3623227 - RNA, 14 nt, Salmonella enterica enterica serovar Typhi
gccggcggcggaau

SEQ ID NO: 3623228 - RNA, 18 nt, Salmonella enterica enterica serovar Typhi
gccgggcagacaucgccg

SEQ ID NO: 3623229 - RNA, 12 nt, Salmonella enterica enterica serovar Typhi
gccgggcauaug

SEQ ID NO: 3623230 - RNA, 20 nt, Salmonella enterica enterica serovar Typhi
gccgggcauugugccgggua

SEQ ID NO: 3623231 - RNA, 17 nt, Salmonella enterica enterica serovar Typhi
gccgggccugagcgcgc

SEQ ID NO: 3623232 - RNA, 14 nt, Salmonella enterica enterica serovar Typhi
gccgggccugcgcc

SEQ ID NO: 3623233 - RNA, 20 nt, Salmonella enterica enterica serovar Typhi
gccgggcggcuguguccgcc

SEQ ID NO: 3623234 - RNA, 23 nt, Salmonella enterica enterica serovar Typhi
gccgggcggcuguguccgccaug

SEQ ID NO: 3623235 - RNA, 20 nt, Salmonella enterica enterica serovar Typhi
gccgggcgucacccgccggc

SEQ ID NO: 3623236 - RNA, 18 nt, Salmonella enterica enterica serovar Typhi
gccgggcuauccggcugu

SEQ ID NO: 3623237 - RNA, 15 nt, Salmonella enterica enterica serovar Typhi
gccgggcugaccgcu

SEQ ID NO: 3623238 - RNA, 22 nt, Salmonella enterica enterica serovar Typhi
gccggggcucccacucuuccag

SEQ ID NO: 3623239 - RNA, 16 nt, Salmonella enterica enterica serovar Typhi
gccggguggcgcugug

SEQ ID NO: 3623240 - RNA, 14 nt, Salmonella enterica enterica serovar Typhi
gccggguuuaaugc

SEQ ID NO: 3623241 - RNA, 17 nt, Salmonella enterica enterica serovar Typhi
gccggguuugccgugcg

SEQ ID NO: 3623242 - RNA, 18 nt, Salmonella enterica enterica serovar Typhi
gccgguaaagggcgggau

SEQ ID NO: 3623243 - RNA, 13 nt, Salmonella enterica enterica serovar Typhi
gccgguaagaaga

SEQ ID NO: 3623244 - RNA, 21 nt, Salmonella enterica enterica serovar Typhi
gccgguaagaagaaccagcgc

SEQ ID NO: 3623245 - RNA, 21 nt, Salmonella enterica enterica serovar Typhi
gccgguaaucacugccgccac

SEQ ID NO: 3623246 - RNA, 14 nt, Salmonella enterica enterica serovar Typhi
gccgguaaucgcgc

SEQ ID NO: 3623247 - RNA, 20 nt, Salmonella enterica enterica serovar Typhi
gccgguacgcagcaggcaga

SEQ ID NO: 3623248 - RNA, 21 nt, Salmonella enterica enterica serovar Typhi
gccgguacgcagcaggcagac

SEQ ID NO: 3623249 - RNA, 14 nt, Salmonella enterica enterica serovar Typhi
gccgguagcgagaa

SEQ ID NO: 3623250 - RNA, 18 nt, Salmonella enterica enterica serovar Typhi
gccgguagcuucagcggc

SEQ ID NO: 3623251 - RNA, 17 nt, Salmonella enterica enterica serovar Typhi
gccgguauccagcgcgu

SEQ ID NO: 3623252 - RNA, 16 nt, Salmonella enterica enterica serovar Typhi
gccggucggcgcguca

SEQ ID NO: 3623253 - RNA, 19 nt, Salmonella enterica enterica serovar Typhi
gccggucguaaugagcacu

SEQ ID NO: 3623254 - RNA, 18 nt, Salmonella enterica enterica serovar Typhi
gccggugaucccaccagc

SEQ ID NO: 3623255 - RNA, 21 nt, Salmonella enterica enterica serovar Typhi
gccggugccgcaaucgguuuc

SEQ ID NO: 3623256 - RNA, 20 nt, Salmonella enterica enterica serovar Typhi
gccggugccugccgccucca

SEQ ID NO: 3623257 - RNA, 14 nt, Salmonella enterica enterica serovar Typhi
gccggugcgagaaa

SEQ ID NO: 3623258 - RNA, 16 nt, Salmonella enterica enterica serovar Typhi
gccgguguuaaccaga

SEQ ID NO: 3623259 - RNA, 22 nt, Salmonella enterica enterica serovar Typhi
gccgguuagccacaaugacaug

SEQ ID NO: 3623260 - RNA, 19 nt, Salmonella enterica enterica serovar Typhi
gccgguucggcaucgcccg

SEQ ID NO: 3623261 - RNA, 22 nt, Salmonella enterica enterica serovar Typhi
gccgguugccagggaaugccau

SEQ ID NO: 3623262 - RNA, 16 nt, Salmonella enterica enterica serovar Typhi
gccgguugcgcugguu

SEQ ID NO: 3623263 - RNA, 21 nt, Salmonella enterica enterica serovar Typhi
gccgguuuauccccgcuggcg

SEQ ID NO: 3623264 - RNA, 23 nt, Salmonella enterica enterica serovar Typhi
gccgguuuauccccgcuggcgcg

SEQ ID NO: 3623265 - RNA, 16 nt, Salmonella enterica enterica serovar Typhi
gccgguuucauaacac

SEQ ID NO: 3623266 - RNA, 21 nt, Salmonella enterica enterica serovar Typhi
gccgguuuuagcguauccggc

SEQ ID NO: 3623267 - RNA, 21 nt, Salmonella enterica enterica serovar Typhi
gcauccauauaagcgguauuc

SEQ ID NO: 3623268 - RNA, 13 nt, Salmonella enterica enterica serovar Typhi
gcauccaugccag

SEQ ID NO: 3623269 - RNA, 16 nt, Salmonella enterica enterica serovar Typhi
gcauccaugccagcgc

SEQ ID NO: 3623270 - RNA, 21 nt, Salmonella enterica enterica serovar Typhi
gcaucccggugucaaagcgcc

SEQ ID NO: 3623271 - RNA, 23 nt, Salmonella enterica enterica serovar Typhi
gcaucccggugucaaagcgccag

SEQ ID NO: 3623272 - RNA, 18 nt, Salmonella enterica enterica serovar Typhi
gcauccgcaagacacgcu

SEQ ID NO: 3623273 - RNA, 14 nt, Salmonella enterica enterica serovar Typhi
gcauccggcaucaa

SEQ ID NO: 3623274 - RNA, 16 nt, Salmonella enterica enterica serovar Typhi
gcauccggccagcgac

SEQ ID NO: 3623275 - RNA, 17 nt, Salmonella enterica enterica serovar Typhi
gcauccggccagcgacu

SEQ ID NO: 3623276 - RNA, 17 nt, Salmonella enterica enterica serovar Typhi
gcauccggcccgugcca

SEQ ID NO: 3623277 - RNA, 15 nt, Salmonella enterica enterica serovar Typhi
gcauccgugaccugc

SEQ ID NO: 3623278 - RNA, 18 nt, Salmonella enterica enterica serovar Typhi
gcauccgugaccugcuga

SEQ ID NO: 3623279 - RNA, 18 nt, Salmonella enterica enterica serovar Typhi
gcauccuccauccaggua

SEQ ID NO: 3623280 - RNA, 23 nt, Salmonella enterica enterica serovar Typhi
gcauccugcggguucaucgccac

SEQ ID NO: 3623281 - RNA, 13 nt, Salmonella enterica enterica serovar Typhi
gcaucgacgccag

SEQ ID NO: 3623282 - RNA, 16 nt, Salmonella enterica enterica serovar Typhi
gcaucgacgccagcgg

SEQ ID NO: 3623283 - RNA, 17 nt, Salmonella enterica enterica serovar Typhi
gcaucgacguucagcau

SEQ ID NO: 3623284 - RNA, 20 nt, Salmonella enterica enterica serovar Typhi
gcaucgauuccccaccagga

SEQ ID NO: 3623285 - RNA, 23 nt, Salmonella enterica enterica serovar Typhi
gcaucgauuuuucaucuucagua

SEQ ID NO: 3623286 - RNA, 20 nt, Salmonella enterica enterica serovar Typhi
gcaucgcccguaucacugau

SEQ ID NO: 3623287 - RNA, 22 nt, Salmonella enterica enterica serovar Typhi
gcaucgccgguagcuucagcgg

SEQ ID NO: 3623288 - RNA, 23 nt, Salmonella enterica enterica serovar Typhi
gcaucgcguuauugaccaucgcc

SEQ ID NO: 3623289 - RNA, 15 nt, Salmonella enterica enterica serovar Typhi
gcaucgcuccccaac

SEQ ID NO: 3623290 - RNA, 21 nt, Salmonella enterica enterica serovar Typhi
gcaucgcugcgcuuacacacc

SEQ ID NO: 3623291 - RNA, 19 nt, Salmonella enterica enterica serovar Typhi
gccagcguggaugaacuca

SEQ ID NO: 3623292 - RNA, 16 nt, Salmonella enterica enterica serovar Typhi
gccagcuaauuuuacu

SEQ ID NO: 3623293 - RNA, 21 nt, Salmonella enterica enterica serovar Typhi
gccagcuaccgcucaggcgcg

SEQ ID NO: 3623294 - RNA, 17 nt, Salmonella enterica enterica serovar Typhi
gccagcuacgacaagcu

SEQ ID NO: 3623295 - RNA, 14 nt, Salmonella enterica enterica serovar Typhi
gccagcucaaauga

SEQ ID NO: 3623296 - RNA, 15 nt, Salmonella enterica enterica serovar Typhi
gccagcucaaaugac

SEQ ID NO: 3623297 - RNA, 23 nt, Salmonella enterica enterica serovar Typhi
gccagcucaugcaagacaucuaa

SEQ ID NO: 3623298 - RNA, 16 nt, Salmonella enterica enterica serovar Typhi
gccagcuuaaaucgcg

SEQ ID NO: 3623299 - RNA, 20 nt, Salmonella enterica enterica serovar Typhi
gccagcuuaaaucgcggcgc

SEQ ID NO: 3623300 - RNA, 16 nt, Salmonella enterica enterica serovar Typhi
gccagcuucgcugcgc

SEQ ID NO: 3623301 - RNA, 18 nt, Salmonella enterica enterica serovar Typhi
gccagcuuucggcgagcu

SEQ ID NO: 3623302 - RNA, 20 nt, Salmonella enterica enterica serovar Typhi
gccaggaaccgcggucggca

SEQ ID NO: 3623303 - RNA, 15 nt, Salmonella enterica enterica serovar Typhi
gccaggaacgagcug

SEQ ID NO: 3623304 - RNA, 19 nt, Salmonella enterica enterica serovar Typhi
gccaggaagucagcuuccu

SEQ ID NO: 3623305 - RNA, 17 nt, Salmonella enterica enterica serovar Typhi
gccaggaauggcuacug

SEQ ID NO: 3623306 - RNA, 17 nt, Salmonella enterica enterica serovar Typhi
gccaggaucgccgccgc

SEQ ID NO: 3623307 - RNA, 19 nt, Salmonella enterica enterica serovar Typhi
gccaggcaaagccccaguc

SEQ ID NO: 3623308 - RNA, 18 nt, Salmonella enterica enterica serovar Typhi
gccaggcaaucagcagcc

SEQ ID NO: 3623309 - RNA, 18 nt, Salmonella enterica enterica serovar Typhi
gccaggcacguuaaacac

SEQ ID NO: 3623310 - RNA, 21 nt, Salmonella enterica enterica serovar Typhi
gccaggcauugauaaagcgcu

SEQ ID NO: 3623311 - RNA, 16 nt, Salmonella enterica enterica serovar Typhi
gccaggccauugcuga

SEQ ID NO: 3623312 - RNA, 13 nt, Salmonella enterica enterica serovar Typhi
gccaggcccagcc

SEQ ID NO: 3623313 - RNA, 22 nt, Salmonella enterica enterica serovar Typhi
gccaggcccgguggcgccacgc

SEQ ID NO: 3623314 - RNA, 14 nt, Salmonella enterica enterica serovar Typhi
gccaggccgccagc

SEQ ID NO: 3623315 - RNA, 16 nt, Salmonella enterica enterica serovar Typhi
gccaggccgcggcugu

SEQ ID NO: 3623316 - RNA, 22 nt, Salmonella enterica enterica serovar Typhi
gccaggccguugugucccugga

SEQ ID NO: 3623317 - RNA, 13 nt, Salmonella enterica enterica serovar Typhi
gccaggcgccacg

SEQ ID NO: 3623318 - RNA, 19 nt, Salmonella enterica enterica serovar Typhi
gccaggcgcuaucuucaau

SEQ ID NO: 3623319 - RNA, 19 nt, Salmonella enterica enterica serovar Typhi
gccaggcggcaaagucuuc

SEQ ID NO: 3623320 - RNA, 22 nt, Salmonella enterica enterica serovar Typhi
gccagggcggcaaaaucuuuuu

SEQ ID NO: 3623321 - RNA, 21 nt, Salmonella enterica enterica serovar Typhi
gccagggcgggauccccugcu

SEQ ID NO: 3623322 - RNA, 17 nt, Salmonella enterica enterica serovar Typhi
gccaggggaugauuuuc

SEQ ID NO: 3623323 - RNA, 19 nt, Salmonella enterica enterica serovar Typhi
gccaggggaugauuuucag

SEQ ID NO: 3623324 - RNA, 18 nt, Salmonella enterica enterica serovar Typhi
gccaggucucauagcgcc

SEQ ID NO: 3623325 - RNA, 20 nt, Salmonella enterica enterica serovar Typhi
gccaggucucauagcgcccc

SEQ ID NO: 3623326 - RNA, 15 nt, Salmonella enterica enterica serovar Typhi
gccaggucugcacca

SEQ ID NO: 3623327 - RNA, 18 nt, Salmonella enterica enterica serovar Typhi
gccaggugacuuugcccu

SEQ ID NO: 3623328 - RNA, 23 nt, Salmonella enterica enterica serovar Typhi
gccagguuauuucgcgcaguuag

SEQ ID NO: 3623329 - RNA, 14 nt, Salmonella enterica enterica serovar Typhi
gccagguugccaga

SEQ ID NO: 3623330 - RNA, 18 nt, Salmonella enterica enterica serovar Typhi
gccaguaacucaucgcca

SEQ ID NO: 3623331 - RNA, 22 nt, Salmonella enterica enterica serovar Typhi
gccaguaaucccggucgcgcca

SEQ ID NO: 3623332 - RNA, 15 nt, Salmonella enterica enterica serovar Typhi
gccaguaaucggcgc

SEQ ID NO: 3623333 - RNA, 18 nt, Salmonella enterica enterica serovar Typhi
gccaguacagcacgccgg

SEQ ID NO: 3623334 - RNA, 18 nt, Salmonella enterica enterica serovar Typhi
gccaguacagcagcgacg

SEQ ID NO: 3623335 - RNA, 15 nt, Salmonella enterica enterica serovar Typhi
gccaguaccgccgcc

SEQ ID NO: 3623336 - RNA, 18 nt, Salmonella enterica enterica serovar Typhi
gccaguaucgcgccgcca

SEQ ID NO: 3623337 - RNA, 21 nt, Salmonella enterica enterica serovar Typhi
gccaguaucgcgccgccaaua

SEQ ID NO: 3623338 - RNA, 23 nt, Salmonella enterica enterica serovar Typhi
gccagucauuaauucccgcagcc

SEQ ID NO: 3623339 - RNA, 14 nt, Salmonella enterica enterica serovar Typhi
gccaguccgcccgc

SEQ ID NO: 3623340 - RNA, 23 nt, Salmonella enterica enterica serovar Typhi
gccaguccgguggcgaaaacgcu

SEQ ID NO: 3623341 - RNA, 16 nt, Salmonella enterica enterica serovar Typhi
gccaguccugccacca

SEQ ID NO: 3623342 - RNA, 18 nt, Salmonella enterica enterica serovar Typhi
gccaguccugccaccagc

SEQ ID NO: 3623343 - RNA, 17 nt, Salmonella enterica enterica serovar Typhi
gccagucgcagcaaacg

SEQ ID NO: 3623344 - RNA, 16 nt, Salmonella enterica enterica serovar Typhi
gccagucgccaggcaa

SEQ ID NO: 3623345 - RNA, 18 nt, Salmonella enterica enterica serovar Typhi
gccagucuuauuguccug

SEQ ID NO: 3623346 - RNA, 18 nt, Salmonella enterica enterica serovar Typhi
gccagucuuugcaggagg

SEQ ID NO: 3623347 - RNA, 22 nt, Salmonella enterica enterica serovar Typhi
gccagucuuugcaggaggcgcg

SEQ ID NO: 3623348 - RNA, 21 nt, Salmonella enterica enterica serovar Typhi
gccagugacgacgccagauaa

SEQ ID NO: 3623349 - RNA, 12 nt, Salmonella enterica enterica serovar Typhi
gccaguggcgaa

SEQ ID NO: 3623350 - RNA, 21 nt, Salmonella enterica enterica serovar Typhi
gccagugggcgucaaaauccc

SEQ ID NO: 3623351 - RNA, 21 nt, Salmonella enterica enterica serovar Typhi
gccaguuaagcaacugauuaa

SEQ ID NO: 3623352 - RNA, 20 nt, Salmonella enterica enterica serovar Typhi
gccaguuaaugccgacccac

SEQ ID NO: 3623353 - RNA, 15 nt, Salmonella enterica enterica serovar Typhi
gccaguucacgccgc

SEQ ID NO: 3623354 - RNA, 17 nt, Salmonella enterica enterica serovar Typhi
gccaguucacgccgccg

SEQ ID NO: 3623355 - RNA, 19 nt, Salmonella enterica enterica serovar Typhi
gccaguucauucgccacca

SEQ ID NO: 3623356 - RNA, 14 nt, Salmonella enterica enterica serovar Typhi
gccaguucgccggc

SEQ ID NO: 3623357 - RNA, 15 nt, Salmonella enterica enterica serovar Typhi
gccaguuggccggau

SEQ ID NO: 3623358 - RNA, 12 nt, Salmonella enterica enterica serovar Typhi
gccaguuuacgc

SEQ ID NO: 3623359 - RNA, 15 nt, Salmonella enterica enterica serovar Typhi
gccaguuuccugacc

SEQ ID NO: 3623360 - RNA, 12 nt, Salmonella enterica enterica serovar Typhi
gccaguuucucu

SEQ ID NO: 3623361 - RNA, 15 nt, Salmonella enterica enterica serovar Typhi
gccaguuuuccgccu

SEQ ID NO: 3623362 - RNA, 16 nt, Salmonella enterica enterica serovar Typhi
gccaguuuuccgccug

SEQ ID NO: 3623363 - RNA, 21 nt, Salmonella enterica enterica serovar Typhi
gccaguuuuccgccugaaucg

SEQ ID NO: 3623364 - RNA, 20 nt, Salmonella enterica enterica serovar Typhi
gccaguuuucgacauauuug

SEQ ID NO: 3623365 - RNA, 18 nt, Salmonella enterica enterica serovar Typhi
gccauaacaacuauuuuu

SEQ ID NO: 3623366 - RNA, 21 nt, Salmonella enterica enterica serovar Typhi
gccauaacggcuguccauccg

SEQ ID NO: 3623367 - RNA, 14 nt, Salmonella enterica enterica serovar Typhi
gccauaauacuuaa

SEQ ID NO: 3623368 - RNA, 17 nt, Salmonella enterica enterica serovar Typhi
gccauaaucgcuuuuuc

SEQ ID NO: 3623369 - RNA, 13 nt, Salmonella enterica enterica serovar Typhi
gccauaauuguuc

SEQ ID NO: 3623370 - RNA, 22 nt, Salmonella enterica enterica serovar Typhi
gccauacagguuuuaaucguuu

SEQ ID NO: 3623371 - RNA, 16 nt, Salmonella enterica enterica serovar Typhi
gccauacuuacugcug

SEQ ID NO: 3623372 - RNA, 13 nt, Salmonella enterica enterica serovar Typhi
gccauagaaagau

SEQ ID NO: 3623373 - RNA, 18 nt, Salmonella enterica enterica serovar Typhi
gccauagacuuuggcgca

SEQ ID NO: 3623374 - RNA, 14 nt, Salmonella enterica enterica serovar Typhi
gccauagcgcuaug

SEQ ID NO: 3623375 - RNA, 18 nt, Salmonella enterica enterica serovar Typhi
gccauaguagaagugaag

SEQ ID NO: 3623376 - RNA, 16 nt, Salmonella enterica enterica serovar Typhi
gccauucacgcugggu

SEQ ID NO: 3623377 - RNA, 14 nt, Salmonella enterica enterica serovar Typhi
gccauucauuaaaa

SEQ ID NO: 3623378 - RNA, 13 nt, Salmonella enterica enterica serovar Typhi
gccauuccaagaa

SEQ ID NO: 3623379 - RNA, 14 nt, Salmonella enterica enterica serovar Typhi
gccauuccagccgg

SEQ ID NO: 3623380 - RNA, 18 nt, Salmonella enterica enterica serovar Typhi
gccauucccagccgagcg

SEQ ID NO: 3623381 - RNA, 17 nt, Salmonella enterica enterica serovar Typhi
gccauuccgcagaagcc

SEQ ID NO: 3623382 - RNA, 18 nt, Salmonella enterica enterica serovar Typhi
gccauucgcuuccgccgg

SEQ ID NO: 3623383 - RNA, 13 nt, Salmonella enterica enterica serovar Typhi
gccauugcgacga

SEQ ID NO: 3623384 - RNA, 21 nt, Salmonella enterica enterica serovar Typhi
gccauugcuaggaacagugac

SEQ ID NO: 3623385 - RNA, 20 nt, Salmonella enterica enterica serovar Typhi
gccauuucaauaauauguuc

SEQ ID NO: 3623386 - RNA, 12 nt, Salmonella enterica enterica serovar Typhi
gccauuuccagc

SEQ ID NO: 3623387 - RNA, 13 nt, Salmonella enterica enterica serovar Typhi
gccauuuccagcc

SEQ ID NO: 3623388 - RNA, 20 nt, Salmonella enterica enterica serovar Typhi
gccauuucgccuauuuucuc

SEQ ID NO: 3623389 - RNA, 14 nt, Salmonella enterica enterica serovar Typhi
gccauuucugcuca

SEQ ID NO: 3623390 - RNA, 22 nt, Salmonella enterica enterica serovar Typhi
gccauuugcauccguagcuuca

SEQ ID NO: 3623391 - RNA, 19 nt, Salmonella enterica enterica serovar Typhi
gccauuuuauccaggccag

SEQ ID NO: 3623392 - RNA, 19 nt, Salmonella enterica enterica serovar Typhi
gcccaacagcaauguuuca

SEQ ID NO: 3623393 - RNA, 19 nt, Salmonella enterica enterica serovar Typhi
gcccaacaucaguucagaa

SEQ ID NO: 3623394 - RNA, 19 nt, Salmonella enterica enterica serovar Typhi
gcccaacggaugcgccauc

SEQ ID NO: 3623395 - RNA, 15 nt, Salmonella enterica enterica serovar Typhi
gcccaagcugacgga

SEQ ID NO: 3623396 - RNA, 13 nt, Salmonella enterica enterica serovar Typhi
gcccaauagcgcu

SEQ ID NO: 3623397 - RNA, 15 nt, Salmonella enterica enterica serovar Typhi
gcccaauagcgcuga

SEQ ID NO: 3623398 - RNA, 23 nt, Salmonella enterica enterica serovar Typhi
gcccaccggagcggcguccgcca

SEQ ID NO: 3623399 - RNA, 19 nt, Salmonella enterica enterica serovar Typhi
gcccaccggcgagcgcgau

SEQ ID NO: 3623400 - RNA, 18 nt, Salmonella enterica enterica serovar Typhi
gcccaccugaaaaagggu

SEQ ID NO: 3623401 - RNA, 20 nt, Salmonella enterica enterica serovar Typhi
gcccacgcaaaauggccugc

SEQ ID NO: 3623402 - RNA, 13 nt, Salmonella enterica enterica serovar Typhi
gcccacgcccaga

SEQ ID NO: 3623403 - RNA, 15 nt, Salmonella enterica enterica serovar Typhi
gcccacgcccagagc

SEQ ID NO: 3623404 - RNA, 19 nt, Salmonella enterica enterica serovar Typhi
gcccacggaugaucuucau

SEQ ID NO: 3623405 - RNA, 20 nt, Salmonella enterica enterica serovar Typhi
gcccacuauuuuucauggca

SEQ ID NO: 3623406 - RNA, 16 nt, Salmonella enterica enterica serovar Typhi
gcccacucauccagca

SEQ ID NO: 3623407 - RNA, 18 nt, Salmonella enterica enterica serovar Typhi
gcccagaaagaucagcag

SEQ ID NO: 3623408 - RNA, 20 nt, Salmonella enterica enterica serovar Typhi
gcccagaaagaucagcagaa

SEQ ID NO: 3623409 - RNA, 16 nt, Salmonella enterica enterica serovar Typhi
gcccagagcgacaaug

SEQ ID NO: 3623410 - RNA, 23 nt, Salmonella enterica enterica serovar Typhi
gcccagagcgacaaugaaccagc

SEQ ID NO: 3623411 - RNA, 14 nt, Salmonella enterica enterica serovar Typhi
gcccagaucaggcc

SEQ ID NO: 3623412 - RNA, 19 nt, Salmonella enterica enterica serovar Typhi
gcccagcaacacagccagc

SEQ ID NO: 3623413 - RNA, 21 nt, Salmonella enterica enterica serovar Typhi
gcccagcacggcaagcgcggc

SEQ ID NO: 3623414 - RNA, 10 nt, Salmonella enterica enterica serovar Typhi
gcccagcagc

SEQ ID NO: 3623415 - RNA, 15 nt, Salmonella enterica enterica serovar Typhi
gcccagcagcugcug

SEQ ID NO: 3623416 - RNA, 21 nt, Salmonella enterica enterica serovar Typhi
gcccagcauauuaacagugag

SEQ ID NO: 3623417 - RNA, 16 nt, Salmonella enterica enterica serovar Typhi
gcccagccaaagcgcc

SEQ ID NO: 3623418 - RNA, 14 nt, Salmonella enterica enterica serovar Typhi
gcccagcccggaaa

SEQ ID NO: 3623419 - RNA, 16 nt, Salmonella enterica enterica serovar Typhi
gcccagcccggaaaua

SEQ ID NO: 3623420 - RNA, 13 nt, Salmonella enterica enterica serovar Typhi
gcccagccugccu

SEQ ID NO: 3623421 - RNA, 11 nt, Salmonella enterica enterica serovar Typhi
gcccagcgccg

SEQ ID NO: 3623422 - RNA, 23 nt, Salmonella enterica enterica serovar Typhi
gcccagcgccgugucaucauuac

SEQ ID NO: 3623423 - RNA, 19 nt, Salmonella enterica enterica serovar Typhi
gcccagcgcgaccugcauc

SEQ ID NO: 3623424 - RNA, 15 nt, Salmonella enterica enterica serovar Typhi
gcccagcgcggccca

SEQ ID NO: 3623425 - RNA, 15 nt, Salmonella enterica enterica serovar Typhi
gcccagcuauuuuuc

SEQ ID NO: 3623426 - RNA, 23 nt, Salmonella enterica enterica serovar Typhi
gcccagcucaugauagggcagca

SEQ ID NO: 3623427 - RNA, 12 nt, Salmonella enterica enterica serovar Typhi
gcccagcuuagu

SEQ ID NO: 3623428 - RNA, 23 nt, Salmonella enterica enterica serovar Typhi
gcccaggccaaaaccacagugac

SEQ ID NO: 3623429 - RNA, 11 nt, Salmonella enterica enterica serovar Typhi
gcccaggccug

SEQ ID NO: 3623430 - RNA, 13 nt, Salmonella enterica enterica serovar Typhi
gcccaggccugau

SEQ ID NO: 3623431 - RNA, 22 nt, Salmonella enterica enterica serovar Typhi
gcccaggcggguagucccagga

SEQ ID NO: 3623432 - RNA, 20 nt, Salmonella enterica enterica serovar Typhi
gcccagguagaaucccacca

SEQ ID NO: 3623433 - RNA, 15 nt, Salmonella enterica enterica serovar Typhi
gcccaguaccagcac

SEQ ID NO: 3623434 - RNA, 13 nt, Salmonella enterica enterica serovar Typhi
gcccagucacggc

SEQ ID NO: 3623435 - RNA, 21 nt, Salmonella enterica enterica serovar Typhi
gcccaguuucaucaucgccga

SEQ ID NO: 3623436 - RNA, 13 nt, Salmonella enterica enterica serovar Typhi
gcccauaaagaaa

SEQ ID NO: 3623437 - RNA, 19 nt, Salmonella enterica enterica serovar Typhi
gcccauaccccacgccaua

SEQ ID NO: 3623438 - RNA, 11 nt, Salmonella enterica enterica serovar Typhi
gcccauacugg

SEQ ID NO: 3623439 - RNA, 11 nt, Salmonella enterica enterica serovar Typhi
gcccauaucca

SEQ ID NO: 3623440 - RNA, 15 nt, Salmonella enterica enterica serovar Typhi
gcccauauccagcuc

SEQ ID NO: 3623441 - RNA, 16 nt, Salmonella enterica enterica serovar Typhi
gcccauauucuuugcg

SEQ ID NO: 3623442 - RNA, 20 nt, Salmonella enterica enterica serovar Typhi
gcccaucagcaucccaccgg

SEQ ID NO: 3623443 - RNA, 19 nt, Salmonella enterica enterica serovar Typhi
gcccaucagcgccagcccu

SEQ ID NO: 3623444 - RNA, 20 nt, Salmonella enterica enterica serovar Typhi
gcccaucagcgccagcccug

SEQ ID NO: 3623445 - RNA, 18 nt, Salmonella enterica enterica serovar Typhi
gcccaucaucaucggcac

SEQ ID NO: 3623446 - RNA, 19 nt, Salmonella enterica enterica serovar Typhi
gcccaucaucaucggcaca

SEQ ID NO: 3623447 - RNA, 14 nt, Salmonella enterica enterica serovar Typhi
gcccauccagagca

SEQ ID NO: 3623448 - RNA, 16 nt, Salmonella enterica enterica serovar Typhi
gcccauccagagcagu

SEQ ID NO: 3623449 - RNA, 15 nt, Salmonella enterica enterica serovar Typhi
gcccauccgucagga

SEQ ID NO: 3623450 - RNA, 14 nt, Salmonella enterica enterica serovar Typhi
gcccaucgccacag

SEQ ID NO: 3623451 - RNA, 15 nt, Salmonella enterica enterica serovar Typhi
gcccaucgccacagc

SEQ ID NO: 3623452 - RNA, 16 nt, Salmonella enterica enterica serovar Typhi
gcccaucgccagggcu

SEQ ID NO: 3623453 - RNA, 21 nt, Salmonella enterica enterica serovar Typhi
gcccaucgcgccaugauucau

SEQ ID NO: 3623454 - RNA, 14 nt, Salmonella enterica enterica serovar Typhi
gcccaucuccagcc

SEQ ID NO: 3623455 - RNA, 15 nt, Salmonella enterica enterica serovar Typhi
gcccaucugacgugc

SEQ ID NO: 3623456 - RNA, 20 nt, Salmonella enterica enterica serovar Typhi
gcccaugcaaccagugcgug

SEQ ID NO: 3623457 - RNA, 15 nt, Salmonella enterica enterica serovar Typhi
gcccaugccgcccag

SEQ ID NO: 3623458 - RNA, 17 nt, Salmonella enterica enterica serovar Typhi
gcccauggaugcgccgc

SEQ ID NO: 3623459 - RNA, 17 nt, Salmonella enterica enterica serovar Typhi
gcccauggcaggcagca

SEQ ID NO: 3623460 - RNA, 20 nt, Salmonella enterica enterica serovar Typhi
gcccauggcaggcagcacaa

SEQ ID NO: 3623461 - RNA, 15 nt, Salmonella enterica enterica serovar Typhi
gcccauucaacgggc

SEQ ID NO: 3623462 - RNA, 18 nt, Salmonella enterica enterica serovar Typhi
gccugcgaaugcaggccg

SEQ ID NO: 3623463 - RNA, 15 nt, Salmonella enterica enterica serovar Typhi
gccugcgccagcgcc

SEQ ID NO: 3623464 - RNA, 14 nt, Salmonella enterica enterica serovar Typhi
gccugcgccgcagg

SEQ ID NO: 3623465 - RNA, 19 nt, Salmonella enterica enterica serovar Typhi
gccugcgccuauuguucca

SEQ ID NO: 3623466 - RNA, 23 nt, Salmonella enterica enterica serovar Typhi
gccugcgccuauuguuccaaugu

SEQ ID NO: 3623467 - RNA, 17 nt, Salmonella enterica enterica serovar Typhi
gccugcgcgauggaugc

SEQ ID NO: 3623468 - RNA, 12 nt, Salmonella enterica enterica serovar Typhi
gccugcgcggca

SEQ ID NO: 3623469 - RNA, 21 nt, Salmonella enterica enterica serovar Typhi
gccugcgcggcaauuuccgcu

SEQ ID NO: 3623470 - RNA, 19 nt, Salmonella enterica enterica serovar Typhi
gccugcgcucauauacccu

SEQ ID NO: 3623471 - RNA, 21 nt, Salmonella enterica enterica serovar Typhi
gccugcgcucauauacccugc

SEQ ID NO: 3623472 - RNA, 21 nt, Salmonella enterica enterica serovar Typhi
gccugcgcuggaaucauccac

SEQ ID NO: 3623473 - RNA, 21 nt, Salmonella enterica enterica serovar Typhi
gccugcggauucaggacgaga

SEQ ID NO: 3623474 - RNA, 22 nt, Salmonella enterica enterica serovar Typhi
gccugcgguauauucccccugc

SEQ ID NO: 3623475 - RNA, 15 nt, Salmonella enterica enterica serovar Typhi
gccugcgucgcccca

SEQ ID NO: 3623476 - RNA, 14 nt, Salmonella enterica enterica serovar Typhi
gccugcgugcgccg

SEQ ID NO: 3623477 - RNA, 19 nt, Salmonella enterica enterica serovar Typhi
gccugcucaauacuuuccg

SEQ ID NO: 3623478 - RNA, 20 nt, Salmonella enterica enterica serovar Typhi
gccugcucaauacuuuccgg

SEQ ID NO: 3623479 - RNA, 15 nt, Salmonella enterica enterica serovar Typhi
gccugcucaucaggu

SEQ ID NO: 3623480 - RNA, 21 nt, Salmonella enterica enterica serovar Typhi
gccugcugcggauaacguucg

SEQ ID NO: 3623481 - RNA, 20 nt, Salmonella enterica enterica serovar Typhi
gccugcugcgguaaggcagc

SEQ ID NO: 3623482 - RNA, 15 nt, Salmonella enterica enterica serovar Typhi
gccugcuggucugaa

SEQ ID NO: 3623483 - RNA, 15 nt, Salmonella enterica enterica serovar Typhi
gccugcuucagacaa

SEQ ID NO: 3623484 - RNA, 21 nt, Salmonella enterica enterica serovar Typhi
gccuggaaagggaaugcgccg

SEQ ID NO: 3623485 - RNA, 22 nt, Salmonella enterica enterica serovar Typhi
gccuggauaauaagacgccagu

SEQ ID NO: 3623486 - RNA, 18 nt, Salmonella enterica enterica serovar Typhi
gccuggcauggugcagcc

SEQ ID NO: 3623487 - RNA, 19 nt, Salmonella enterica enterica serovar Typhi
gccuggcauggugcagccg

SEQ ID NO: 3623488 - RNA, 13 nt, Salmonella enterica enterica serovar Typhi
gccuggcccguuc

SEQ ID NO: 3623489 - RNA, 12 nt, Salmonella enterica enterica serovar Typhi
gccuggccuccg

SEQ ID NO: 3623490 - RNA, 15 nt, Salmonella enterica enterica serovar Typhi
gccuggcgcagcgcu

SEQ ID NO: 3623491 - RNA, 13 nt, Salmonella enterica enterica serovar Typhi
gccuggcgcuggg

SEQ ID NO: 3623492 - RNA, 16 nt, Salmonella enterica enterica serovar Typhi
gccugggauaagcaga

SEQ ID NO: 3623493 - RNA, 16 nt, Salmonella enterica enterica serovar Typhi
gccugguaagcguagc

SEQ ID NO: 3623494 - RNA, 18 nt, Salmonella enterica enterica serovar Typhi
gccugguaagcguagcgc

SEQ ID NO: 3623495 - RNA, 22 nt, Salmonella enterica enterica serovar Typhi
gccuggugcccaaccugcgcag

SEQ ID NO: 3623496 - RNA, 19 nt, Salmonella enterica enterica serovar Typhi
gccuguaaaacaacccccg

SEQ ID NO: 3623497 - RNA, 14 nt, Salmonella enterica enterica serovar Typhi
gccuguaaaccgcc

SEQ ID NO: 3623498 - RNA, 18 nt, Salmonella enterica enterica serovar Typhi
gccuguaaacguuccugc

SEQ ID NO: 3623499 - RNA, 19 nt, Salmonella enterica enterica serovar Typhi
gccuguaaacguuccugcc

SEQ ID NO: 3623500 - RNA, 21 nt, Salmonella enterica enterica serovar Typhi
gccuguaaggucucagcgacc

SEQ ID NO: 3623501 - RNA, 19 nt, Salmonella enterica enterica serovar Typhi
gccuguaccgggcagacau

SEQ ID NO: 3623502 - RNA, 17 nt, Salmonella enterica enterica serovar Typhi
gccuguacuugcgccgc

SEQ ID NO: 3623503 - RNA, 20 nt, Salmonella enterica enterica serovar Typhi
gccuguacuugcgccgccau

SEQ ID NO: 3623504 - RNA, 21 nt, Salmonella enterica enterica serovar Typhi
gccuguacuugcgccgccauc

SEQ ID NO: 3623505 - RNA, 22 nt, Salmonella enterica enterica serovar Typhi
gccuguagcagcgccagcgugc

SEQ ID NO: 3623506 - RNA, 19 nt, Salmonella enterica enterica serovar Typhi
gccugucacguaaaauuag

SEQ ID NO: 3623507 - RNA, 13 nt, Salmonella enterica enterica serovar Typhi
gccuguccggccu

SEQ ID NO: 3623508 - RNA, 13 nt, Salmonella enterica enterica serovar Typhi
gccugucggucuu

SEQ ID NO: 3623509 - RNA, 15 nt, Salmonella enterica enterica serovar Typhi
gccugucuauuguuu

SEQ ID NO: 3623510 - RNA, 16 nt, Salmonella enterica enterica serovar Typhi
gccugucuccagcgcc

SEQ ID NO: 3623511 - RNA, 15 nt, Salmonella enterica enterica serovar Typhi
gccugucuccucagc

SEQ ID NO: 3623512 - RNA, 21 nt, Salmonella enterica enterica serovar Typhi
gccugugacguuaacgcagca

SEQ ID NO: 3623513 - RNA, 19 nt, Salmonella enterica enterica serovar Typhi
gccugugaucggagaaaua

SEQ ID NO: 3623514 - RNA, 15 nt, Salmonella enterica enterica serovar Typhi
gccugugcaaccagc

SEQ ID NO: 3623515 - RNA, 18 nt, Salmonella enterica enterica serovar Typhi
gccuguuagggcgcggcu

SEQ ID NO: 3623516 - RNA, 19 nt, Salmonella enterica enterica serovar Typhi
gccuguuagggcgcggcug

SEQ ID NO: 3623517 - RNA, 13 nt, Salmonella enterica enterica serovar Typhi
gccuguuauucaa

SEQ ID NO: 3623518 - RNA, 16 nt, Salmonella enterica enterica serovar Typhi
gccuguuauucaauuc

SEQ ID NO: 3623519 - RNA, 18 nt, Salmonella enterica enterica serovar Typhi
gccuguucuucaguaauu

SEQ ID NO: 3623520 - RNA, 16 nt, Salmonella enterica enterica serovar Typhi
gccuguugacgcgcau

SEQ ID NO: 3623521 - RNA, 14 nt, Salmonella enterica enterica serovar Typhi
gccuguugauuacg

SEQ ID NO: 3623522 - RNA, 16 nt, Salmonella enterica enterica serovar Typhi
gccuguuuaagcuuuu

SEQ ID NO: 3623523 - RNA, 15 nt, Salmonella enterica enterica serovar Typhi
gccuguuuauauucu

SEQ ID NO: 3623524 - RNA, 12 nt, Salmonella enterica enterica serovar Typhi
gccuuacaggcg

SEQ ID NO: 3623525 - RNA, 15 nt, Salmonella enterica enterica serovar Typhi
gccuuacaggcgcau

SEQ ID NO: 3623526 - RNA, 18 nt, Salmonella enterica enterica serovar Typhi
gccuuacaggcgcaucag

SEQ ID NO: 3623527 - RNA, 17 nt, Salmonella enterica enterica serovar Typhi
gccuuaccgggccuacg

SEQ ID NO: 3623528 - RNA, 22 nt, Salmonella enterica enterica serovar Typhi
gccuuauaagaaccaucuacca

SEQ ID NO: 3623529 - RNA, 19 nt, Salmonella enterica enterica serovar Typhi
gccuuaucaagccuacacc

SEQ ID NO: 3623530 - RNA, 15 nt, Salmonella enterica enterica serovar Typhi
gccuuaucaggccug

SEQ ID NO: 3623531 - RNA, 19 nt, Salmonella enterica enterica serovar Typhi
gccuuaucaggccuguggu

SEQ ID NO: 3623532 - RNA, 19 nt, Salmonella enterica enterica serovar Typhi
gccuuauccggccuacacg

SEQ ID NO: 3623533 - RNA, 18 nt, Salmonella enterica enterica serovar Typhi
gccuuauccggccuacag

SEQ ID NO: 3623534 - RNA, 18 nt, Salmonella enterica enterica serovar Typhi
gccuuauccggccuacuc

SEQ ID NO: 3623535 - RNA, 13 nt, Salmonella enterica enterica serovar Typhi
gccuuauccggcg

SEQ ID NO: 3623536 - RNA, 23 nt, Salmonella enterica enterica serovar Typhi
gccuuaucgagugucaauaagcc

SEQ ID NO: 3623537 - RNA, 23 nt, Salmonella enterica enterica serovar Typhi
gccuuauggccagggacaggaga

SEQ ID NO: 3623538 - RNA, 18 nt, Salmonella enterica enterica serovar Typhi
gccuucaaauauauugaa

SEQ ID NO: 3623539 - RNA, 16 nt, Salmonella enterica enterica serovar Typhi
gccuucaacgcucagu

SEQ ID NO: 3623540 - RNA, 18 nt, Salmonella enterica enterica serovar Typhi
gccuucaauuugaccuga

SEQ ID NO: 3623541 - RNA, 21 nt, Salmonella enterica enterica serovar Typhi
gccuucaauuugaccugaccu

SEQ ID NO: 3623542 - RNA, 15 nt, Salmonella enterica enterica serovar Typhi
gccuucagcgcgccc

SEQ ID NO: 3623543 - RNA, 20 nt, Salmonella enterica enterica serovar Typhi
gccuucagguuuuuaagcug

SEQ ID NO: 3623544 - RNA, 13 nt, Salmonella enterica enterica serovar Typhi
gccuucauaauga

SEQ ID NO: 3623545 - RNA, 14 nt, Salmonella enterica enterica serovar Typhi
gccuucauuaauuu

SEQ ID NO: 3623546 - RNA, 13 nt, Salmonella enterica enterica serovar Typhi
gccuuccagaaau

SEQ ID NO: 3623547 - RNA, 12 nt, Salmonella enterica enterica serovar Typhi
gccuuccagcaa

SEQ ID NO: 3623548 - RNA, 19 nt, Salmonella enterica enterica serovar Typhi
gcgaaucacauccgccagc

SEQ ID NO: 3623549 - RNA, 22 nt, Salmonella enterica enterica serovar Typhi
gcgaaucacauccgccagcgcc

SEQ ID NO: 3623550 - RNA, 18 nt, Salmonella enterica enterica serovar Typhi
gcgaaucauguuuuucuc

SEQ ID NO: 3623551 - RNA, 13 nt, Salmonella enterica enterica serovar Typhi
gcgaauccagauc

SEQ ID NO: 3623552 - RNA, 17 nt, Salmonella enterica enterica serovar Typhi
gcgaauccagaucgccc

SEQ ID NO: 3623553 - RNA, 15 nt, Salmonella enterica enterica serovar Typhi
gcgaauccagcgccg

SEQ ID NO: 3623554 - RNA, 15 nt, Salmonella enterica enterica serovar Typhi
gcgaauccgccauag

SEQ ID NO: 3623555 - RNA, 15 nt, Salmonella enterica enterica serovar Typhi
gcgaauccggcggcu

SEQ ID NO: 3623556 - RNA, 20 nt, Salmonella enterica enterica serovar Typhi
gcgaaucgccaaucgccgcc

SEQ ID NO: 3623557 - RNA, 20 nt, Salmonella enterica enterica serovar Typhi
gcgaaucucgugaucgccaa

SEQ ID NO: 3623558 - RNA, 14 nt, Salmonella enterica enterica serovar Typhi
gcgaaugcgcaauc

SEQ ID NO: 3623559 - RNA, 12 nt, Salmonella enterica enterica serovar Typhi
gcgaaugcgcgc

SEQ ID NO: 3623560 - RNA, 16 nt, Salmonella enterica enterica serovar Typhi
gcgaaugcgcgccaua

SEQ ID NO: 3623561 - RNA, 18 nt, Salmonella enterica enterica serovar Typhi
gcgaauggagaagcgcgc

SEQ ID NO: 3623562 - RNA, 23 nt, Salmonella enterica enterica serovar Typhi
gcgaauggccuccagcagcacuu

SEQ ID NO: 3623563 - RNA, 18 nt, Salmonella enterica enterica serovar Typhi
gcgaauugcgaguaaccu

SEQ ID NO: 3623564 - RNA, 23 nt, Salmonella enterica enterica serovar Typhi
gcgaauuuauaagccugagcgcg

SEQ ID NO: 3623565 - RNA, 16 nt, Salmonella enterica enterica serovar Typhi
gcgaauuuccugccag

SEQ ID NO: 3623566 - RNA, 20 nt, Salmonella enterica enterica serovar Typhi
gcgaauuuccugccagaccu

SEQ ID NO: 3623567 - RNA, 17 nt, Salmonella enterica enterica serovar Typhi
gcgaauuugccccagau

SEQ ID NO: 3623568 - RNA, 15 nt, Salmonella enterica enterica serovar Typhi
gcgacaaacagcgcc

SEQ ID NO: 3623569 - RNA, 16 nt, Salmonella enterica enterica serovar Typhi
gcgacaaacagcgccc

SEQ ID NO: 3623570 - RNA, 17 nt, Salmonella enterica enterica serovar Typhi
gcgacaaccuguaggcc

SEQ ID NO: 3623571 - RNA, 10 nt, Salmonella enterica enterica serovar Typhi
gcgacaagaa

SEQ ID NO: 3623572 - RNA, 19 nt, Salmonella enterica enterica serovar Typhi
gcgacaaugaaccagccca

SEQ ID NO: 3623573 - RNA, 18 nt, Salmonella enterica enterica serovar Typhi
gcgacacaacggcacaac

SEQ ID NO: 3623574 - RNA, 19 nt, Salmonella enterica enterica serovar Typhi
gcgacacgcgcgcugcgcc

SEQ ID NO: 3623575 - RNA, 20 nt, Salmonella enterica enterica serovar Typhi
gcgacacgcgcgcugcgccu

SEQ ID NO: 3623576 - RNA, 15 nt, Salmonella enterica enterica serovar Typhi
gcgacagcccggcgu

SEQ ID NO: 3623577 - RNA, 18 nt, Salmonella enterica enterica serovar Typhi
gcgacagcgcuauccggc

SEQ ID NO: 3623578 - RNA, 21 nt, Salmonella enterica enterica serovar Typhi
gcgacaggcgcuuaucgccgu

SEQ ID NO: 3623579 - RNA, 15 nt, Salmonella enterica enterica serovar Typhi
gcgacaguaguauca

SEQ ID NO: 3623580 - RNA, 21 nt, Salmonella enterica enterica serovar Typhi
gcgacagucgcagagcccagc

SEQ ID NO: 3623581 - RNA, 14 nt, Salmonella enterica enterica serovar Typhi
gcgacaucagccag

SEQ ID NO: 3623582 - RNA, 14 nt, Salmonella enterica enterica serovar Typhi
gcgacaucccagac

SEQ ID NO: 3623583 - RNA, 20 nt, Salmonella enterica enterica serovar Typhi
gcgacaucguuuccagcgaa

SEQ ID NO: 3623584 - RNA, 21 nt, Salmonella enterica enterica serovar Typhi
gcgacauuuuuguuaauauuc

SEQ ID NO: 3623585 - RNA, 14 nt, Salmonella enterica enterica serovar Typhi
gcgaccacccgcga

SEQ ID NO: 3623586 - RNA, 15 nt, Salmonella enterica enterica serovar Typhi
gcgaccacgcauacc

SEQ ID NO: 3623587 - RNA, 14 nt, Salmonella enterica enterica serovar Typhi
gcgaccacgccacc

SEQ ID NO: 3623588 - RNA, 18 nt, Salmonella enterica enterica serovar Typhi
gcgaccagcagaugcagu

SEQ ID NO: 3623589 - RNA, 21 nt, Salmonella enterica enterica serovar Typhi
gcgaccagcagcgcggcguac

SEQ ID NO: 3623590 - RNA, 13 nt, Salmonella enterica enterica serovar Typhi
gcgaccagcgcgc

SEQ ID NO: 3623591 - RNA, 13 nt, Salmonella enterica enterica serovar Typhi
gcgacccagcgca

SEQ ID NO: 3623592 - RNA, 20 nt, Salmonella enterica enterica serovar Typhi
gcgaccgaucaucauuccga

SEQ ID NO: 3623593 - RNA, 22 nt, Salmonella enterica enterica serovar Typhi
gcgaccgccaccauccggcgcu

SEQ ID NO: 3623594 - RNA, 17 nt, Salmonella enterica enterica serovar Typhi
gcgaccgcuucgcuggc

SEQ ID NO: 3623595 - RNA, 11 nt, Salmonella enterica enterica serovar Typhi
gcgaccggcac

SEQ ID NO: 3623596 - RNA, 23 nt, Salmonella enterica enterica serovar Typhi
gcgaccggcucgcuguucgccag

SEQ ID NO: 3623597 - RNA, 19 nt, Salmonella enterica enterica serovar Typhi
gcgaccuucacgccgccaa

SEQ ID NO: 3623598 - RNA, 19 nt, Salmonella enterica enterica serovar Typhi
gcgacgacgcuguuuaugc

SEQ ID NO: 3623599 - RNA, 19 nt, Salmonella enterica enterica serovar Typhi
gcgacgacuucacccgcgg

SEQ ID NO: 3623600 - RNA, 20 nt, Salmonella enterica enterica serovar Typhi
gcgacgauaaaucgguucau

SEQ ID NO: 3623601 - RNA, 22 nt, Salmonella enterica enterica serovar Typhi
gcgacgauaggcauacacaucu

SEQ ID NO: 3623602 - RNA, 14 nt, Salmonella enterica enterica serovar Typhi
gcgacgaucagcgc

SEQ ID NO: 3623603 - RNA, 17 nt, Salmonella enterica enterica serovar Typhi
gcgacgccaaaccugcc

SEQ ID NO: 3623604 - RNA, 22 nt, Salmonella enterica enterica serovar Typhi
gcgacgccagauuaucggccag

SEQ ID NO: 3623605 - RNA, 14 nt, Salmonella enterica enterica serovar Typhi
gcgacgccgccauc

SEQ ID NO: 3623606 - RNA, 15 nt, Salmonella enterica enterica serovar Typhi
gcgacgcgccagcca

SEQ ID NO: 3623607 - RNA, 20 nt, Salmonella enterica enterica serovar Typhi
gcgacgcgccagccagcgcc

SEQ ID NO: 3623608 - RNA, 15 nt, Salmonella enterica enterica serovar Typhi
gcgacggaccggcag

SEQ ID NO: 3623609 - RNA, 16 nt, Salmonella enterica enterica serovar Typhi
gcgacggacucgcgca

SEQ ID NO: 3623610 - RNA, 16 nt, Salmonella enterica enterica serovar Typhi
gcgacggcgcgccggc

SEQ ID NO: 3623611 - RNA, 20 nt, Salmonella enterica enterica serovar Typhi
gcgacggcguaagcgcuaug

SEQ ID NO: 3623612 - RNA, 15 nt, Salmonella enterica enterica serovar Typhi
gcgacggggcgcaga

SEQ ID NO: 3623613 - RNA, 14 nt, Salmonella enterica enterica serovar Typhi
gcgacgguccuggc

SEQ ID NO: 3623614 - RNA, 20 nt, Salmonella enterica enterica serovar Typhi
gcgacgguccuggccaggcu

SEQ ID NO: 3623615 - RNA, 18 nt, Salmonella enterica enterica serovar Typhi
gcgacguccgccaacagc

SEQ ID NO: 3623616 - RNA, 18 nt, Salmonella enterica enterica serovar Typhi
gcgacgugacggugaccu

SEQ ID NO: 3623617 - RNA, 17 nt, Salmonella enterica enterica serovar Typhi
gcgacguuaucucgcca

SEQ ID NO: 3623618 - RNA, 18 nt, Salmonella enterica enterica serovar Typhi
gcgacguuaucucgccag

SEQ ID NO: 3623619 - RNA, 18 nt, Salmonella enterica enterica serovar Typhi
gcgacguugucuucaucu

SEQ ID NO: 3623620 - RNA, 17 nt, Salmonella enterica enterica serovar Typhi
gcgacuaaccagcgcaa

SEQ ID NO: 3623621 - RNA, 23 nt, Salmonella enterica enterica serovar Typhi
gcgacuacgguaaaccaggccag

SEQ ID NO: 3623622 - RNA, 21 nt, Salmonella enterica enterica serovar Typhi
gcgacuaugccggcugcagca

SEQ ID NO: 3623623 - RNA, 13 nt, Salmonella enterica enterica serovar Typhi
gcgacucauccac

SEQ ID NO: 3623624 - RNA, 16 nt, Salmonella enterica enterica serovar Typhi
gcgacucauucagcaa

SEQ ID NO: 3623625 - RNA, 23 nt, Salmonella enterica enterica serovar Typhi
gcgacucgccguuuuaucgcccg

SEQ ID NO: 3623626 - RNA, 16 nt, Salmonella enterica enterica serovar Typhi
gcgacucggugccgcu

SEQ ID NO: 3623627 - RNA, 16 nt, Salmonella enterica enterica serovar Typhi
gcgacugaaaaucaaa

SEQ ID NO: 3623628 - RNA, 14 nt, Salmonella enterica enterica serovar Typhi
gcgacugccgcaga

SEQ ID NO: 3623629 - RNA, 14 nt, Salmonella enterica enterica serovar Typhi
gcgacuuauccggc

SEQ ID NO: 3623630 - RNA, 14 nt, Salmonella enterica enterica serovar Typhi
gcgacuucauucag

SEQ ID NO: 3623631 - RNA, 16 nt, Salmonella enterica enterica serovar Typhi
gcgacuucgcuuccug

SEQ ID NO: 3623632 - RNA, 16 nt, Salmonella enterica enterica serovar Typhi
gcgacuuggaaaguug

SEQ ID NO: 3623633 - RNA, 22 nt, Salmonella enterica enterica serovar Typhi
gcgacuuuaaacuuauccgcca

SEQ ID NO: 3623634 - RNA, 20 nt, Salmonella enterica enterica serovar Typhi
gcgauguucuugccgccauc

SEQ ID NO: 3623635 - RNA, 22 nt, Salmonella enterica enterica serovar Typhi
gcgauguucuugccgccaucuc

SEQ ID NO: 3623636 - RNA, 16 nt, Salmonella enterica enterica serovar Typhi
gcgauguuggguuucg

SEQ ID NO: 3623637 - RNA, 16 nt, Salmonella enterica enterica serovar Typhi
gcgauguuuauugaaa

SEQ ID NO: 3623638 - RNA, 13 nt, Salmonella enterica enterica serovar Typhi
gcgauuacgccag

SEQ ID NO: 3623639 - RNA, 17 nt, Salmonella enterica enterica serovar Typhi
gcgauucagcgcaggca

SEQ ID NO: 3623640 - RNA, 17 nt, Salmonella enterica enterica serovar Typhi
gcgauucauaugcgcca

SEQ ID NO: 3623641 - RNA, 16 nt, Salmonella enterica enterica serovar Typhi
gcgauucgcccacgga

SEQ ID NO: 3623642 - RNA, 18 nt, Salmonella enterica enterica serovar Typhi
gcgauugauucaccgaca

SEQ ID NO: 3623643 - RNA, 21 nt, Salmonella enterica enterica serovar Typhi
gcgauuguuauccccccgccg

SEQ ID NO: 3623644 - RNA, 21 nt, Salmonella enterica enterica serovar Typhi
gcgauuuagcguuggcgucau

SEQ ID NO: 3623645 - RNA, 17 nt, Salmonella enterica enterica serovar Typhi
gcgauuugccgcgccuu

SEQ ID NO: 3623646 - RNA, 18 nt, Salmonella enterica enterica serovar Typhi
gcgauuuguccgcugcug

SEQ ID NO: 3623647 - RNA, 18 nt, Salmonella enterica enterica serovar Typhi
gcgauuuucaccggcguu

SEQ ID NO: 3623648 - RNA, 16 nt, Salmonella enterica enterica serovar Typhi
gcgauuuucaucaagc

SEQ ID NO: 3623649 - RNA, 15 nt, Salmonella enterica enterica serovar Typhi
gcgauuuuuacgcca

SEQ ID NO: 3623650 - RNA, 14 nt, Salmonella enterica enterica serovar Typhi
gcgauuuuuaggcc

SEQ ID NO: 3623651 - RNA, 13 nt, Salmonella enterica enterica serovar Typhi
gcgcaaaagcgcg

SEQ ID NO: 3623652 - RNA, 18 nt, Salmonella enterica enterica serovar Typhi
gcgcaaacgcgugcuggu

SEQ ID NO: 3623653 - RNA, 18 nt, Salmonella enterica enterica serovar Typhi
gcgcaaacggaucuucca

SEQ ID NO: 3623654 - RNA, 18 nt, Salmonella enterica enterica serovar Typhi
gcgcaaacuaccgggccu

SEQ ID NO: 3623655 - RNA, 21 nt, Salmonella enterica enterica serovar Typhi
gcgcaaagcaauguaaaacug

SEQ ID NO: 3623656 - RNA, 13 nt, Salmonella enterica enterica serovar Typhi
gcgcaaauacuga

SEQ ID NO: 3623657 - RNA, 12 nt, Salmonella enterica enterica serovar Typhi
gcgcaaauauua

SEQ ID NO: 3623658 - RNA, 14 nt, Salmonella enterica enterica serovar Typhi
gcgcaaaucgccau

SEQ ID NO: 3623659 - RNA, 15 nt, Salmonella enterica enterica serovar Typhi
gcgcaaaucgccauc

SEQ ID NO: 3623660 - RNA, 18 nt, Salmonella enterica enterica serovar Typhi
gcgcaaaucgccaucagc

SEQ ID NO: 3623661 - RNA, 18 nt, Salmonella enterica enterica serovar Typhi
gcgcaaccgacgggcgcu

SEQ ID NO: 3623662 - RNA, 18 nt, Salmonella enterica enterica serovar Typhi
gcgcaacgccuucguccg

SEQ ID NO: 3623663 - RNA, 19 nt, Salmonella enterica enterica serovar Typhi
gcgcaacgcuuaaucccuu

SEQ ID NO: 3623664 - RNA, 18 nt, Salmonella enterica enterica serovar Typhi
gcgcaacgcuuccaccuc

SEQ ID NO: 3623665 - RNA, 22 nt, Salmonella enterica enterica serovar Typhi
gcgcaauaugcagaucgacggu

SEQ ID NO: 3623666 - RNA, 15 nt, Salmonella enterica enterica serovar Typhi
gcgcaauaugcggcg

SEQ ID NO: 3623667 - RNA, 20 nt, Salmonella enterica enterica serovar Typhi
gcgcaauaugcggcgccauc

SEQ ID NO: 3623668 - RNA, 16 nt, Salmonella enterica enterica serovar Typhi
gcgcaauccgcgccgc

SEQ ID NO: 3623669 - RNA, 20 nt, Salmonella enterica enterica serovar Typhi
gcgcacaauaccgagaaugu

SEQ ID NO: 3623670 - RNA, 19 nt, Salmonella enterica enterica serovar Typhi
gcgcacauuuacgccagcc

SEQ ID NO: 3623671 - RNA, 22 nt, Salmonella enterica enterica serovar Typhi
gcgcaccuucaacagcucgcca

SEQ ID NO: 3623672 - RNA, 22 nt, Salmonella enterica enterica serovar Typhi
gcgcacgagugaucccgacaua

SEQ ID NO: 3623673 - RNA, 14 nt, Salmonella enterica enterica serovar Typhi
gcgcacgcgcgcgc

SEQ ID NO: 3623674 - RNA, 15 nt, Salmonella enterica enterica serovar Typhi
gcgcacggcgcgucc

SEQ ID NO: 3623675 - RNA, 23 nt, Salmonella enterica enterica serovar Typhi
gcgcacuuccucucccacugcga

SEQ ID NO: 3623676 - RNA, 20 nt, Salmonella enterica enterica serovar Typhi
gcgcagaaucacuucauccg

SEQ ID NO: 3623677 - RNA, 15 nt, Salmonella enterica enterica serovar Typhi
gcgcagacacugcca

SEQ ID NO: 3623678 - RNA, 12 nt, Salmonella enterica enterica serovar Typhi
gcgcagagugac

SEQ ID NO: 3623679 - RNA, 19 nt, Salmonella enterica enterica serovar Typhi
gcgcagagugaccagcggu

SEQ ID NO: 3623680 - RNA, 23 nt, Salmonella enterica enterica serovar Typhi
gcgcagauuuugcagauccgcga

SEQ ID NO: 3623681 - RNA, 11 nt, Salmonella enterica enterica serovar Typhi
gcgcagcgacu

SEQ ID NO: 3623682 - RNA, 19 nt, Salmonella enterica enterica serovar Typhi
gcgcagcgacuucaggcgu

SEQ ID NO: 3623683 - RNA, 17 nt, Salmonella enterica enterica serovar Typhi
gcgcagcgccaucaggc

SEQ ID NO: 3623684 - RNA, 20 nt, Salmonella enterica enterica serovar Typhi
gcgcagcgccaucaggcaau

SEQ ID NO: 3623685 - RNA, 20 nt, Salmonella enterica enterica serovar Typhi
gcgcagcgccaucaggcacg

SEQ ID NO: 3623686 - RNA, 19 nt, Salmonella enterica enterica serovar Typhi
gcgcagcgccaucaggcau

SEQ ID NO: 3623687 - RNA, 20 nt, Salmonella enterica enterica serovar Typhi
gcgcagcgccaucaggcaug

SEQ ID NO: 3623688 - RNA, 18 nt, Salmonella enterica enterica serovar Typhi
gcgcagcgccaucaggcc

SEQ ID NO: 3623689 - RNA, 21 nt, Salmonella enterica enterica serovar Typhi
gcgcagcgcgcgacccagcgc

SEQ ID NO: 3623690 - RNA, 19 nt, Salmonella enterica enterica serovar Typhi
gcgcagcgcgucggcgggc

SEQ ID NO: 3623691 - RNA, 22 nt, Salmonella enterica enterica serovar Typhi
gcgcagcgcuuuugccgcgccc

SEQ ID NO: 3623692 - RNA, 15 nt, Salmonella enterica enterica serovar Typhi
gcgcagcgucaucag

SEQ ID NO: 3623693 - RNA, 16 nt, Salmonella enterica enterica serovar Typhi
gcgcagcugggccugc

SEQ ID NO: 3623694 - RNA, 20 nt, Salmonella enterica enterica serovar Typhi
gcgcagcugggccugcuccg

SEQ ID NO: 3623695 - RNA, 21 nt, Salmonella enterica enterica serovar Typhi
gcgcagcugggccugcuccgu

SEQ ID NO: 3623696 - RNA, 15 nt, Salmonella enterica enterica serovar Typhi
gcgcaggcgggggcg

SEQ ID NO: 3623697 - RNA, 14 nt, Salmonella enterica enterica serovar Typhi
gcgcaggggcauuu

SEQ ID NO: 3623698 - RNA, 14 nt, Salmonella enterica enterica serovar Typhi
gcgcaggggcuauu

SEQ ID NO: 3623699 - RNA, 23 nt, Salmonella enterica enterica serovar Typhi
gcgcagguaguugucggcggucg

SEQ ID NO: 3623700 - RNA, 20 nt, Salmonella enterica enterica serovar Typhi
gcgcaguaaacuccucuucc

SEQ ID NO: 3623701 - RNA, 14 nt, Salmonella enterica enterica serovar Typhi
gcgcagucacagau

SEQ ID NO: 3623702 - RNA, 16 nt, Salmonella enterica enterica serovar Typhi
gcgcaguuccagcggc

SEQ ID NO: 3623703 - RNA, 21 nt, Salmonella enterica enterica serovar Typhi
gcgcaguugccaguacagcag

SEQ ID NO: 3623704 - RNA, 21 nt, Salmonella enterica enterica serovar Typhi
gcgcaguuuacgcagcgccuu

SEQ ID NO: 3623705 - RNA, 21 nt, Salmonella enterica enterica serovar Typhi
gcgcauaagccacuucaacca

SEQ ID NO: 3623706 - RNA, 23 nt, Salmonella enterica enterica serovar Typhi
gcgcauacgcuguccagucaaaa

SEQ ID NO: 3623707 - RNA, 17 nt, Salmonella enterica enterica serovar Typhi
gcgcauacgucaugccu

SEQ ID NO: 3623708 - RNA, 13 nt, Salmonella enterica enterica serovar Typhi
gcgcauacucuuc

SEQ ID NO: 3623709 - RNA, 17 nt, Salmonella enterica enterica serovar Typhi
gcgcauaggcuuugcug

SEQ ID NO: 3623710 - RNA, 16 nt, Salmonella enterica enterica serovar Typhi
gcgcauauuccggcga

SEQ ID NO: 3623711 - RNA, 17 nt, Salmonella enterica enterica serovar Typhi
gcgcauauuccggcgac

SEQ ID NO: 3623712 - RNA, 14 nt, Salmonella enterica enterica serovar Typhi
gcgcaucagaaaaa

SEQ ID NO: 3623713 - RNA, 15 nt, Salmonella enterica enterica serovar Typhi
gcgcaucagaaaaac

SEQ ID NO: 3623714 - RNA, 16 nt, Salmonella enterica enterica serovar Typhi
gcgcauccaccagacc

SEQ ID NO: 3623715 - RNA, 18 nt, Salmonella enterica enterica serovar Typhi
gcgcauccaccagacccg

SEQ ID NO: 3623716 - RNA, 23 nt, Salmonella enterica enterica serovar Typhi
gcgcaucucccugccagugaaag

SEQ ID NO: 3623717 - RNA, 18 nt, Salmonella enterica enterica serovar Typhi
gcgcaucuggucauggcu

SEQ ID NO: 3623718 - RNA, 22 nt, Salmonella enterica enterica serovar Typhi
gcgcauggaagaaaauauaauc

SEQ ID NO: 3623719 - RNA, 21 nt, Salmonella enterica enterica serovar Typhi
gcgccccucuugcagcaagaa

SEQ ID NO: 3623720 - RNA, 20 nt, Salmonella enterica enterica serovar Typhi
gcgcccgacgcgccacuucc

SEQ ID NO: 3623721 - RNA, 19 nt, Salmonella enterica enterica serovar Typhi
gcgcccgaucguccgccuc

SEQ ID NO: 3623722 - RNA, 15 nt, Salmonella enterica enterica serovar Typhi
gcgcccgccaccagc

SEQ ID NO: 3623723 - RNA, 21 nt, Salmonella enterica enterica serovar Typhi
gcgcccgccaccagcacagcc

SEQ ID NO: 3623724 - RNA, 12 nt, Salmonella enterica enterica serovar Typhi
gcgcccgccauc

SEQ ID NO: 3623725 - RNA, 17 nt, Salmonella enterica enterica serovar Typhi
gcgcccgccaucgcccg

SEQ ID NO: 3623726 - RNA, 14 nt, Salmonella enterica enterica serovar Typhi
gcgcccgccgccaa

SEQ ID NO: 3623727 - RNA, 23 nt, Salmonella enterica enterica serovar Typhi
gcgcccgccugcuguaaccccug

SEQ ID NO: 3623728 - RNA, 16 nt, Salmonella enterica enterica serovar Typhi
gcgcccguccaugagu

SEQ ID NO: 3623729 - RNA, 13 nt, Salmonella enterica enterica serovar Typhi
gcgcccuccucca

SEQ ID NO: 3623730 - RNA, 18 nt, Salmonella enterica enterica serovar Typhi
gcgccgaagcaggcggag

SEQ ID NO: 3623731 - RNA, 21 nt, Salmonella enterica enterica serovar Typhi
gcgccgaaugcguuuuuucac

SEQ ID NO: 3623732 - RNA, 21 nt, Salmonella enterica enterica serovar Typhi
gcgccgagaaaaucagugaac

SEQ ID NO: 3623733 - RNA, 20 nt, Salmonella enterica enterica serovar Typhi
gcgccgauaacacggcuggc

SEQ ID NO: 3623734 - RNA, 18 nt, Salmonella enterica enterica serovar Typhi
gcgccgcaaugccgccug

SEQ ID NO: 3623735 - RNA, 17 nt, Salmonella enterica enterica serovar Typhi
gcgccgcaggccggaua

SEQ ID NO: 3623736 - RNA, 20 nt, Salmonella enterica enterica serovar Typhi
gcgccgcaggccggauaaga

SEQ ID NO: 3623737 - RNA, 19 nt, Salmonella enterica enterica serovar Typhi
gcgccgccaacgauacagc

SEQ ID NO: 3623738 - RNA, 17 nt, Salmonella enterica enterica serovar Typhi
gcgccgccaacgccaac

SEQ ID NO: 3623739 - RNA, 15 nt, Salmonella enterica enterica serovar Typhi
gcgccgccagcgaca

SEQ ID NO: 3623740 - RNA, 14 nt, Salmonella enterica enterica serovar Typhi
gcgccgccauccgg

SEQ ID NO: 3623741 - RNA, 16 nt, Salmonella enterica enterica serovar Typhi
gcgccgccauccggca

SEQ ID NO: 3623742 - RNA, 15 nt, Salmonella enterica enterica serovar Typhi
gcgccgccgaacaga

SEQ ID NO: 3623743 - RNA, 23 nt, Salmonella enterica enterica serovar Typhi
gcgccgccgaacagacggcggcu

SEQ ID NO: 3623744 - RNA, 18 nt, Salmonella enterica enterica serovar Typhi
gcgccgccugcacggcgu

SEQ ID NO: 3623745 - RNA, 19 nt, Salmonella enterica enterica serovar Typhi
gcgccgcgacaacgccauc

SEQ ID NO: 3623746 - RNA, 19 nt, Salmonella enterica enterica serovar Typhi
gcgccgcgcagcaucugau

SEQ ID NO: 3623747 - RNA, 13 nt, Salmonella enterica enterica serovar Typhi
gcgccgcgccacc

SEQ ID NO: 3623748 - RNA, 16 nt, Salmonella enterica enterica serovar Typhi
gcgccgcgccgccgua

SEQ ID NO: 3623749 - RNA, 13 nt, Salmonella enterica enterica serovar Typhi
gcgccgcggccuc

SEQ ID NO: 3623750 - RNA, 22 nt, Salmonella enterica enterica serovar Typhi
gcgccgcuacguaccgcuuccg

SEQ ID NO: 3623751 - RNA, 15 nt, Salmonella enterica enterica serovar Typhi
gcgccgcucaucacc

SEQ ID NO: 3623752 - RNA, 23 nt, Salmonella enterica enterica serovar Typhi
gcgccgcuggcgaccagccugcc

SEQ ID NO: 3623753 - RNA, 15 nt, Salmonella enterica enterica serovar Typhi
gcgccggacagcagc

SEQ ID NO: 3623754 - RNA, 16 nt, Salmonella enterica enterica serovar Typhi
gcgccggacgccacgc

SEQ ID NO: 3623755 - RNA, 18 nt, Salmonella enterica enterica serovar Typhi
gcgccggaucgggcuucc

SEQ ID NO: 3623756 - RNA, 19 nt, Salmonella enterica enterica serovar Typhi
gcgccggaucgggcuucca

SEQ ID NO: 3623757 - RNA, 17 nt, Salmonella enterica enterica serovar Typhi
gcgccggaugacggcag

SEQ ID NO: 3623758 - RNA, 16 nt, Salmonella enterica enterica serovar Typhi
gcgccggauuuaccag

SEQ ID NO: 3623759 - RNA, 13 nt, Salmonella enterica enterica serovar Typhi
gcgccggggcagc

SEQ ID NO: 3623760 - RNA, 16 nt, Salmonella enterica enterica serovar Typhi
gcgccgguuucuccag

SEQ ID NO: 3623761 - RNA, 13 nt, Salmonella enterica enterica serovar Typhi
gcgccguaaacaa

SEQ ID NO: 3623762 - RNA, 13 nt, Salmonella enterica enterica serovar Typhi
gcgccgucauccg

SEQ ID NO: 3623763 - RNA, 14 nt, Salmonella enterica enterica serovar Typhi
gcgccgucauccgc

SEQ ID NO: 3623764 - RNA, 15 nt, Salmonella enterica enterica serovar Typhi
gcgccguccauaaug

SEQ ID NO: 3623765 - RNA, 14 nt, Salmonella enterica enterica serovar Typhi
gcgccguccugcaa

SEQ ID NO: 3623766 - RNA, 17 nt, Salmonella enterica enterica serovar Typhi
gcgccgucggcaucggg

SEQ ID NO: 3623767 - RNA, 17 nt, Salmonella enterica enterica serovar Typhi
gcgccgugcccagcauc

SEQ ID NO: 3623768 - RNA, 21 nt, Salmonella enterica enterica serovar Typhi
gcgccgugcccagcaucccgc

SEQ ID NO: 3623769 - RNA, 15 nt, Salmonella enterica enterica serovar Typhi
gcgccguggccgaua

SEQ ID NO: 3623770 - RNA, 17 nt, Salmonella enterica enterica serovar Typhi
gcgccguugaaaucggu

SEQ ID NO: 3623771 - RNA, 13 nt, Salmonella enterica enterica serovar Typhi
gcgccuaccgcca

SEQ ID NO: 3623772 - RNA, 15 nt, Salmonella enterica enterica serovar Typhi
gcgccuaccgccaua

SEQ ID NO: 3623773 - RNA, 15 nt, Salmonella enterica enterica serovar Typhi
gcgccuagcgcgcgc

SEQ ID NO: 3623774 - RNA, 21 nt, Salmonella enterica enterica serovar Typhi
gcgccuccgcguagcccagcg

SEQ ID NO: 3623775 - RNA, 23 nt, Salmonella enterica enterica serovar Typhi
gcgccuccgcguagcccagcgcc

SEQ ID NO: 3623776 - RNA, 19 nt, Salmonella enterica enterica serovar Typhi
gcgccugaagauacgccag

SEQ ID NO: 3623777 - RNA, 16 nt, Salmonella enterica enterica serovar Typhi
gcgccugacgcggacg

SEQ ID NO: 3623778 - RNA, 21 nt, Salmonella enterica enterica serovar Typhi
gcgccugacgcggacgccacc

SEQ ID NO: 3623779 - RNA, 17 nt, Salmonella enterica enterica serovar Typhi
gcgccugaugccgccgu

SEQ ID NO: 3623780 - RNA, 17 nt, Salmonella enterica enterica serovar Typhi
gcgccugcauacucaca

SEQ ID NO: 3623781 - RNA, 18 nt, Salmonella enterica enterica serovar Typhi
gcgccugcauacucacau

SEQ ID NO: 3623782 - RNA, 13 nt, Salmonella enterica enterica serovar Typhi
gcgccugcgcggc

SEQ ID NO: 3623783 - RNA, 14 nt, Salmonella enterica enterica serovar Typhi
gcgccugcugccug

SEQ ID NO: 3623784 - RNA, 21 nt, Salmonella enterica enterica serovar Typhi
gcgccuggaugaagcagacau

SEQ ID NO: 3623785 - RNA, 17 nt, Salmonella enterica enterica serovar Typhi
gcgccugggauaagcag

SEQ ID NO: 3623786 - RNA, 22 nt, Salmonella enterica enterica serovar Typhi
gcgccuguaaggcucucuuacc

SEQ ID NO: 3623787 - RNA, 17 nt, Salmonella enterica enterica serovar Typhi
gcgccuguagcguaauu

SEQ ID NO: 3623788 - RNA, 20 nt, Salmonella enterica enterica serovar Typhi
gcgccugucgggccuacaga

SEQ ID NO: 3623789 - RNA, 20 nt, Salmonella enterica enterica serovar Typhi
gcgccugucuccagcgccgc

SEQ ID NO: 3623790 - RNA, 23 nt, Salmonella enterica enterica serovar Typhi
gcgccuuaaaccgucgggcgucg

SEQ ID NO: 3623791 - RNA, 14 nt, Salmonella enterica enterica serovar Typhi
gcgccuucaggcau

SEQ ID NO: 3623792 - RNA, 15 nt, Salmonella enterica enterica serovar Typhi
gcgccuuccagcaau

SEQ ID NO: 3623793 - RNA, 13 nt, Salmonella enterica enterica serovar Typhi
gcgccuuccggga

SEQ ID NO: 3623794 - RNA, 21 nt, Salmonella enterica enterica serovar Typhi
gcgccuucuucgcaaucuccg

SEQ ID NO: 3623795 - RNA, 20 nt, Salmonella enterica enterica serovar Typhi
gcgccuugucugaccgggcg

SEQ ID NO: 3623796 - RNA, 23 nt, Salmonella enterica enterica serovar Typhi
gcgccuuuaauuccgccgggcaa

SEQ ID NO: 3623797 - RNA, 15 nt, Salmonella enterica enterica serovar Typhi
gcgccuuuccggccu

SEQ ID NO: 3623798 - RNA, 20 nt, Salmonella enterica enterica serovar Typhi
gcgccuuucgauaacccgcu

SEQ ID NO: 3623799 - RNA, 18 nt, Salmonella enterica enterica serovar Typhi
gcgccuuuuggcagcagc

SEQ ID NO: 3623800 - RNA, 16 nt, Salmonella enterica enterica serovar Typhi
gcgcgaaaagaaacug

SEQ ID NO: 3623801 - RNA, 19 nt, Salmonella enterica enterica serovar Typhi
gcgcgaaacgcacccgcgc

SEQ ID NO: 3623802 - RNA, 22 nt, Salmonella enterica enterica serovar Typhi
gcgcgaacgccuuauccggccu

SEQ ID NO: 3623803 - RNA, 21 nt, Salmonella enterica enterica serovar Typhi
gcgcgaagaggaugaaaagua

SEQ ID NO: 3623804 - RNA, 14 nt, Salmonella enterica enterica serovar Typhi
gcgcgucagcgccu

SEQ ID NO: 3623805 - RNA, 15 nt, Salmonella enterica enterica serovar Typhi
gcgcgucagcgccuc

SEQ ID NO: 3623806 - RNA, 13 nt, Salmonella enterica enterica serovar Typhi
gcgcguccacggc

SEQ ID NO: 3623807 - RNA, 23 nt, Salmonella enterica enterica serovar Typhi
gcgcguccacggcgggacgcugc

SEQ ID NO: 3623808 - RNA, 19 nt, Salmonella enterica enterica serovar Typhi
gcgcguccagccagcguuu

SEQ ID NO: 3623809 - RNA, 20 nt, Salmonella enterica enterica serovar Typhi
gcgcguccgccuuugacgcc

SEQ ID NO: 3623810 - RNA, 16 nt, Salmonella enterica enterica serovar Typhi
gcgcguccuuauaaug

SEQ ID NO: 3623811 - RNA, 18 nt, Salmonella enterica enterica serovar Typhi
gcgcgucgcauccggcaa

SEQ ID NO: 3623812 - RNA, 22 nt, Salmonella enterica enterica serovar Typhi
gcgcgucgcuguucgccggaug

SEQ ID NO: 3623813 - RNA, 18 nt, Salmonella enterica enterica serovar Typhi
gcgcgucuucccggcgcu

SEQ ID NO: 3623814 - RNA, 22 nt, Salmonella enterica enterica serovar Typhi
gcgcgugaccccaggcauagaa

SEQ ID NO: 3623815 - RNA, 13 nt, Salmonella enterica enterica serovar Typhi
gcgcguggcaaau

SEQ ID NO: 3623816 - RNA, 14 nt, Salmonella enterica enterica serovar Typhi
gcgcgugucgggaa

SEQ ID NO: 3623817 - RNA, 18 nt, Salmonella enterica enterica serovar Typhi
gcgcguguuacugacgac

SEQ ID NO: 3623818 - RNA, 14 nt, Salmonella enterica enterica serovar Typhi
gcgcguucauccac

SEQ ID NO: 3623819 - RNA, 17 nt, Salmonella enterica enterica serovar Typhi
gcgcguuccccaacagc

SEQ ID NO: 3623820 - RNA, 17 nt, Salmonella enterica enterica serovar Typhi
gcgcguuuaaucgagcc

SEQ ID NO: 3623821 - RNA, 19 nt, Salmonella enterica enterica serovar Typhi
gcgcguuuagcgccagcag

SEQ ID NO: 3623822 - RNA, 17 nt, Salmonella enterica enterica serovar Typhi
gcgcuaaaugcauagcc

SEQ ID NO: 3623823 - RNA, 15 nt, Salmonella enterica enterica serovar Typhi
gcgcuaacggcggua

SEQ ID NO: 3623824 - RNA, 14 nt, Salmonella enterica enterica serovar Typhi
gcgcuaagccagcc

SEQ ID NO: 3623825 - RNA, 22 nt, Salmonella enterica enterica serovar Typhi
gcgcuaagcgcccguagcucag

SEQ ID NO: 3623826 - RNA, 22 nt, Salmonella enterica enterica serovar Typhi
gcgcuaagcguuacggaaaaaa

SEQ ID NO: 3623827 - RNA, 20 nt, Salmonella enterica enterica serovar Typhi
gcgcuaaugcuuauccggcc

SEQ ID NO: 3623828 - RNA, 13 nt, Salmonella enterica enterica serovar Typhi
gcgcuacauccgc

SEQ ID NO: 3623829 - RNA, 15 nt, Salmonella enterica enterica serovar Typhi
gcgcuacauccgcca

SEQ ID NO: 3623830 - RNA, 16 nt, Salmonella enterica enterica serovar Typhi
gcgcuacauccgccag

SEQ ID NO: 3623831 - RNA, 20 nt, Salmonella enterica enterica serovar Typhi
gcgcuacauccgccagccgc

SEQ ID NO: 3623832 - RNA, 14 nt, Salmonella enterica enterica serovar Typhi
gcgcuaccagcgcg

SEQ ID NO: 3623833 - RNA, 19 nt, Salmonella enterica enterica serovar Typhi
gcgcuagccgcauccggca

SEQ ID NO: 3623834 - RNA, 18 nt, Salmonella enterica enterica serovar Typhi
gcgcuagcgccacccgac

SEQ ID NO: 3623835 - RNA, 22 nt, Salmonella enterica enterica serovar Typhi
gcgcuagcuuaucgggccuacc

SEQ ID NO: 3623836 - RNA, 18 nt, Salmonella enterica enterica serovar Typhi
gcgcuagugccgccaggc

SEQ ID NO: 3623837 - RNA, 15 nt, Salmonella enterica enterica serovar Typhi
gcgcuaucaggcacu

SEQ ID NO: 3623838 - RNA, 14 nt, Salmonella enterica enterica serovar Typhi
gcgcuauccggcau

SEQ ID NO: 3623839 - RNA, 17 nt, Salmonella enterica enterica serovar Typhi
gcgcuaucgguaucaug

SEQ ID NO: 3623840 - RNA, 13 nt, Salmonella enterica enterica serovar Typhi
gcgcuaucuucaa

SEQ ID NO: 3623841 - RNA, 14 nt, Salmonella enterica enterica serovar Typhi
gcgcucaaaugguc

SEQ ID NO: 3623842 - RNA, 18 nt, Salmonella enterica enterica serovar Typhi
gcgcucaacacauaacgc

SEQ ID NO: 3623843 - RNA, 13 nt, Salmonella enterica enterica serovar Typhi
gcgcucaagcgaa

SEQ ID NO: 3623844 - RNA, 16 nt, Salmonella enterica enterica serovar Typhi
gcgcucaggaucgccg

SEQ ID NO: 3623845 - RNA, 22 nt, Salmonella enterica enterica serovar Typhi
gcgcucagggucagaauacaga

SEQ ID NO: 3623846 - RNA, 16 nt, Salmonella enterica enterica serovar Typhi
gcgcucauaaccgcga

SEQ ID NO: 3623847 - RNA, 12 nt, Salmonella enterica enterica serovar Typhi
gcgcucaucagg

SEQ ID NO: 3623848 - RNA, 15 nt, Salmonella enterica enterica serovar Typhi
gcgcucaucaggccu

SEQ ID NO: 3623849 - RNA, 19 nt, Salmonella enterica enterica serovar Typhi
gcgcuccaccaaccaggca

SEQ ID NO: 3623850 - RNA, 22 nt, Salmonella enterica enterica serovar Typhi
gcgcuccaccaaccaggcaaac

SEQ ID NO: 3623851 - RNA, 19 nt, Salmonella enterica enterica serovar Typhi
gcgcuccagaccaccagcg

SEQ ID NO: 3623852 - RNA, 12 nt, Salmonella enterica enterica serovar Typhi
gcgcuccaggau

SEQ ID NO: 3623853 - RNA, 18 nt, Salmonella enterica enterica serovar Typhi
gcgcuccgacaaacuuca

SEQ ID NO: 3623854 - RNA, 14 nt, Salmonella enterica enterica serovar Typhi
gcgcuccgacugaa

SEQ ID NO: 3623855 - RNA, 16 nt, Salmonella enterica enterica serovar Typhi
gcgcuccugucaggcg

SEQ ID NO: 3623856 - RNA, 18 nt, Salmonella enterica enterica serovar Typhi
gcgcuccugucaggcgag

SEQ ID NO: 3623857 - RNA, 23 nt, Salmonella enterica enterica serovar Typhi
gcgcucgcuuuuacucuuccugc

SEQ ID NO: 3623858 - RNA, 22 nt, Salmonella enterica enterica serovar Typhi
gcgcucuaucaccgcccgccgg

SEQ ID NO: 3623859 - RNA, 17 nt, Salmonella enterica enterica serovar Typhi
gcgcucuaucgccgccc

SEQ ID NO: 3623860 - RNA, 13 nt, Salmonella enterica enterica serovar Typhi
gcgcucuccggca

SEQ ID NO: 3623861 - RNA, 16 nt, Salmonella enterica enterica serovar Typhi
gcgcucugccaguagc

SEQ ID NO: 3623862 - RNA, 14 nt, Salmonella enterica enterica serovar Typhi
gcgcucuuuuuuaa

SEQ ID NO: 3623863 - RNA, 14 nt, Salmonella enterica enterica serovar Typhi
gcgcugaaguccgc

SEQ ID NO: 3623864 - RNA, 17 nt, Salmonella enterica enterica serovar Typhi
gcgcugaggcgcuggcu

SEQ ID NO: 3623865 - RNA, 15 nt, Salmonella enterica enterica serovar Typhi
gcgcugagucauccu

SEQ ID NO: 3623866 - RNA, 17 nt, Salmonella enterica enterica serovar Typhi
gcgcugaguuucucccg

SEQ ID NO: 3623867 - RNA, 13 nt, Salmonella enterica enterica serovar Typhi
gcgcugaugaaaa

SEQ ID NO: 3623868 - RNA, 17 nt, Salmonella enterica enterica serovar Typhi
gcgcugaugugcggccu

SEQ ID NO: 3623869 - RNA, 18 nt, Salmonella enterica enterica serovar Typhi
gcgcugcacaaucgccag

SEQ ID NO: 3623870 - RNA, 18 nt, Salmonella enterica enterica serovar Typhi
gcgcugcauuugcugccg

SEQ ID NO: 3623871 - RNA, 18 nt, Salmonella enterica enterica serovar Typhi
gcgcugccagcugcguca

SEQ ID NO: 3623872 - RNA, 21 nt, Salmonella enterica enterica serovar Typhi
gcgcugccgcuuauccggccu

SEQ ID NO: 3623873 - RNA, 22 nt, Salmonella enterica enterica serovar Typhi
gcgcugccgucaaugccuggca

SEQ ID NO: 3623874 - RNA, 23 nt, Salmonella enterica enterica serovar Typhi
gcgcugccgucaaugccuggcag

SEQ ID NO: 3623875 - RNA, 18 nt, Salmonella enterica enterica serovar Typhi
gcgcugcgcgcgaugcug

SEQ ID NO: 3623876 - RNA, 18 nt, Salmonella enterica enterica serovar Typhi
gcgcugcgcggcgugcag

SEQ ID NO: 3623877 - RNA, 16 nt, Salmonella enterica enterica serovar Typhi
gcgcugcggcuacacg

SEQ ID NO: 3623878 - RNA, 20 nt, Salmonella enterica enterica serovar Typhi
gcgcugcguuuauuaggccu

SEQ ID NO: 3623879 - RNA, 23 nt, Salmonella enterica enterica serovar Typhi
gcgcuggcgcacgcgucaucggc

SEQ ID NO: 3623880 - RNA, 14 nt, Salmonella enterica enterica serovar Typhi
gcgcuggcggcgac

SEQ ID NO: 3623881 - RNA, 15 nt, Salmonella enterica enterica serovar Typhi
gcgcuggcggcgacg

SEQ ID NO: 3623882 - RNA, 19 nt, Salmonella enterica enterica serovar Typhi
gcgcuggcugaaucccugu

SEQ ID NO: 3623883 - RNA, 12 nt, Salmonella enterica enterica serovar Typhi
gcgcuggcuggc

SEQ ID NO: 3623884 - RNA, 17 nt, Salmonella enterica enterica serovar Typhi
gcgcuggcuugaccgcu

SEQ ID NO: 3623885 - RNA, 17 nt, Salmonella enterica enterica serovar Typhi
gcgcugggccgggccug

SEQ ID NO: 3623886 - RNA, 17 nt, Salmonella enterica enterica serovar Typhi
gcgcuggguacguucgg

SEQ ID NO: 3623887 - RNA, 18 nt, Salmonella enterica enterica serovar Typhi
gcgcuggugacaucgccg

SEQ ID NO: 3623888 - RNA, 19 nt, Salmonella enterica enterica serovar Typhi
gcgcugguggccgggggcg

SEQ ID NO: 3623889 - RNA, 23 nt, Salmonella enterica enterica serovar Typhi
gcgcuguacgccucuuucagccg

SEQ ID NO: 3623890 - RNA, 19 nt, Salmonella enterica enterica serovar Typhi
gcggauuccaguagcgcgc

SEQ ID NO: 3623891 - RNA, 14 nt, Salmonella enterica enterica serovar Typhi
gcggauucuccagg

SEQ ID NO: 3623892 - RNA, 19 nt, Salmonella enterica enterica serovar Typhi
gcggauugccauacacgcg

SEQ ID NO: 3623893 - RNA, 13 nt, Salmonella enterica enterica serovar Typhi
gcggauugccgcg

SEQ ID NO: 3623894 - RNA, 19 nt, Salmonella enterica enterica serovar Typhi
gcggcaaaaaacgacgcgc

SEQ ID NO: 3623895 - RNA, 20 nt, Salmonella enterica enterica serovar Typhi
gcggcaaaaaauauagccau

SEQ ID NO: 3623896 - RNA, 13 nt, Salmonella enterica enterica serovar Typhi
gcggcaaaagagg

SEQ ID NO: 3623897 - RNA, 19 nt, Salmonella enterica enterica serovar Typhi
gcggcaaaaucuuuuucgc

SEQ ID NO: 3623898 - RNA, 20 nt, Salmonella enterica enterica serovar Typhi
gcggcaaagauaaucugaau

SEQ ID NO: 3623899 - RNA, 23 nt, Salmonella enterica enterica serovar Typhi
gcggcaacccuuuggccaccagc

SEQ ID NO: 3623900 - RNA, 16 nt, Salmonella enterica enterica serovar Typhi
gcggcaacucgugcag

SEQ ID NO: 3623901 - RNA, 16 nt, Salmonella enterica enterica serovar Typhi
gcggcaaucgccucau

SEQ ID NO: 3623902 - RNA, 16 nt, Salmonella enterica enterica serovar Typhi
gcggcaaugccgccgu

SEQ ID NO: 3623903 - RNA, 14 nt, Salmonella enterica enterica serovar Typhi
gcggcaauggccgc

SEQ ID NO: 3623904 - RNA, 17 nt, Salmonella enterica enterica serovar Typhi
gcggcaauggccgcagc

SEQ ID NO: 3623905 - RNA, 22 nt, Salmonella enterica enterica serovar Typhi
gcggcaauggccgcagcgccau

SEQ ID NO: 3623906 - RNA, 23 nt, Salmonella enterica enterica serovar Typhi
gcggcaauggccgcagcgccaua

SEQ ID NO: 3623907 - RNA, 21 nt, Salmonella enterica enterica serovar Typhi
gcggcacacaacacggcggcu

SEQ ID NO: 3623908 - RNA, 20 nt, Salmonella enterica enterica serovar Typhi
gcggcacagauacgaggugg

SEQ ID NO: 3623909 - RNA, 18 nt, Salmonella enterica enterica serovar Typhi
gcggcacguuuuccaggu

SEQ ID NO: 3623910 - RNA, 19 nt, Salmonella enterica enterica serovar Typhi
gcggcacuggcguagucuc

SEQ ID NO: 3623911 - RNA, 19 nt, Salmonella enterica enterica serovar Typhi
gcggcagaauuaacucauc

SEQ ID NO: 3623912 - RNA, 24 nt, Salmonella enterica enterica serovar Typhi
gcggcagaauuaacucaucacagc

SEQ ID NO: 3623913 - RNA, 14 nt, Salmonella enterica enterica serovar Typhi
gcggcagccaugcu

SEQ ID NO: 3623914 - RNA, 23 nt, Salmonella enterica enterica serovar Typhi
gcggcagccaugcuauucagcag

SEQ ID NO: 3623915 - RNA, 12 nt, Salmonella enterica enterica serovar Typhi
gcggcagcuuca

SEQ ID NO: 3623916 - RNA, 22 nt, Salmonella enterica enterica serovar Typhi
gcggcaggauccccaucccaau

SEQ ID NO: 3623917 - RNA, 12 nt, Salmonella enterica enterica serovar Typhi
gcggcagggcag

SEQ ID NO: 3623918 - RNA, 17 nt, Salmonella enterica enterica serovar Typhi
gcggcagggcagcgagc

SEQ ID NO: 3623919 - RNA, 20 nt, Salmonella enterica enterica serovar Typhi
gcggcagggcggucugguac

SEQ ID NO: 3623920 - RNA, 19 nt, Salmonella enterica enterica serovar Typhi
gcggcaggugagggcgucg

SEQ ID NO: 3623921 - RNA, 22 nt, Salmonella enterica enterica serovar Typhi
gcggcaguacgagcauccagau

SEQ ID NO: 3623922 - RNA, 18 nt, Salmonella enterica enterica serovar Typhi
gcggcagugggcuaugcu

SEQ ID NO: 3623923 - RNA, 16 nt, Salmonella enterica enterica serovar Typhi
gcggcaguuccggcgu

SEQ ID NO: 3623924 - RNA, 18 nt, Salmonella enterica enterica serovar Typhi
gcggcauacuuucgcgcg

SEQ ID NO: 3623925 - RNA, 13 nt, Salmonella enterica enterica serovar Typhi
gcggcaucaggca

SEQ ID NO: 3623926 - RNA, 16 nt, Salmonella enterica enterica serovar Typhi
gcggcaugauccacca

SEQ ID NO: 3623927 - RNA, 19 nt, Salmonella enterica enterica serovar Typhi
gcggcauuggcguuaccgg

SEQ ID NO: 3623928 - RNA, 22 nt, Salmonella enterica enterica serovar Typhi
gcggcauuggcguuaccggcag

SEQ ID NO: 3623929 - RNA, 18 nt, Salmonella enterica enterica serovar Typhi
gcggccaaagggagcaga

SEQ ID NO: 3623930 - RNA, 18 nt, Salmonella enterica enterica serovar Typhi
gcggccaccgccaguucg

SEQ ID NO: 3623931 - RNA, 13 nt, Salmonella enterica enterica serovar Typhi
gcggccagauaag

SEQ ID NO: 3623932 - RNA, 13 nt, Salmonella enterica enterica serovar Typhi
gcggccagccaua

SEQ ID NO: 3623933 - RNA, 13 nt, Salmonella enterica enterica serovar Typhi
gcggccagcgccu

SEQ ID NO: 3623934 - RNA, 16 nt, Salmonella enterica enterica serovar Typhi
gcggccaugaucgccg

SEQ ID NO: 3623935 - RNA, 20 nt, Salmonella enterica enterica serovar Typhi
gcggccaugaucgccgccau

SEQ ID NO: 3623936 - RNA, 20 nt, Salmonella enterica enterica serovar Typhi
gcggcccauucaacgggcga

SEQ ID NO: 3623937 - RNA, 19 nt, Salmonella enterica enterica serovar Typhi
gcggccuaaaucgcugcug

SEQ ID NO: 3623938 - RNA, 21 nt, Salmonella enterica enterica serovar Typhi
gcggccuaugacuauaucagc

SEQ ID NO: 3623939 - RNA, 13 nt, Salmonella enterica enterica serovar Typhi
gcggccuccggau

SEQ ID NO: 3623940 - RNA, 19 nt, Salmonella enterica enterica serovar Typhi
gcggccuccuggcuuaccu

SEQ ID NO: 3623941 - RNA, 17 nt, Salmonella enterica enterica serovar Typhi
gcggccugcgugcgccg

SEQ ID NO: 3623942 - RNA, 11 nt, Salmonella enterica enterica serovar Typhi
gcggccuugcc

SEQ ID NO: 3623943 - RNA, 16 nt, Salmonella enterica enterica serovar Typhi
gcggccuuuauccagc

SEQ ID NO: 3623944 - RNA, 21 nt, Salmonella enterica enterica serovar Typhi
gcggcgaaauaggccgcgaua

SEQ ID NO: 3623945 - RNA, 20 nt, Salmonella enterica enterica serovar Typhi
gcggcgaaauauuaucgcca

SEQ ID NO: 3623946 - RNA, 18 nt, Salmonella enterica enterica serovar Typhi
gcggcgaagcaucuuucc

SEQ ID NO: 3623947 - RNA, 19 nt, Salmonella enterica enterica serovar Typhi
gcggcgaagcaucuuuccg

SEQ ID NO: 3623948 - RNA, 20 nt, Salmonella enterica enterica serovar Typhi
gcggcgaagcaucuuuccgg

SEQ ID NO: 3623949 - RNA, 22 nt, Salmonella enterica enterica serovar Typhi
gcggcgaauauagcuaaugcaa

SEQ ID NO: 3623950 - RNA, 15 nt, Salmonella enterica enterica serovar Typhi
gcggcgacaccagcg

SEQ ID NO: 3623951 - RNA, 17 nt, Salmonella enterica enterica serovar Typhi
gcggcgacaccagcguc

SEQ ID NO: 3623952 - RNA, 20 nt, Salmonella enterica enterica serovar Typhi
gcggcgacagagaaugcgcc

SEQ ID NO: 3623953 - RNA, 15 nt, Salmonella enterica enterica serovar Typhi
gcggcgacaucgcca

SEQ ID NO: 3623954 - RNA, 20 nt, Salmonella enterica enterica serovar Typhi
gcggcgaguuguuucaacau

SEQ ID NO: 3623955 - RNA, 21 nt, Salmonella enterica enterica serovar Typhi
gcggcgaucagacgcugguug

SEQ ID NO: 3623956 - RNA, 22 nt, Salmonella enterica enterica serovar Typhi
gcggcgcacugccugauggcgc

SEQ ID NO: 3623957 - RNA, 20 nt, Salmonella enterica enterica serovar Typhi
gcggcgcauucucugucgcc

SEQ ID NO: 3623958 - RNA, 18 nt, Salmonella enterica enterica serovar Typhi
gcggcgccgaagcaggcg

SEQ ID NO: 3623959 - RNA, 19 nt, Salmonella enterica enterica serovar Typhi
gcggcgccuuguccggcgu

SEQ ID NO: 3623960 - RNA, 13 nt, Salmonella enterica enterica serovar Typhi
gcggcgcgcccgg

SEQ ID NO: 3623961 - RNA, 15 nt, Salmonella enterica enterica serovar Typhi
gcggcgcuauccggc

SEQ ID NO: 3623962 - RNA, 18 nt, Salmonella enterica enterica serovar Typhi
gcggcgcucgccagcccg

SEQ ID NO: 3623963 - RNA, 21 nt, Salmonella enterica enterica serovar Typhi
gcggcgcuuccagacuacgga

SEQ ID NO: 3623964 - RNA, 19 nt, Salmonella enterica enterica serovar Typhi
gcggcgcuuugcuucucgc

SEQ ID NO: 3623965 - RNA, 13 nt, Salmonella enterica enterica serovar Typhi
gcggcggaaugcu

SEQ ID NO: 3623966 - RNA, 22 nt, Salmonella enterica enterica serovar Typhi
gcggcggacaacgcuccagcag

SEQ ID NO: 3623967 - RNA, 14 nt, Salmonella enterica enterica serovar Typhi
gcggcggaccgcaa

SEQ ID NO: 3623968 - RNA, 11 nt, Salmonella enterica enterica serovar Typhi
gcggcggcaag

SEQ ID NO: 3623969 - RNA, 21 nt, Salmonella enterica enterica serovar Typhi
gcggcggggauaaucagcagc

SEQ ID NO: 3623970 - RNA, 17 nt, Salmonella enterica enterica serovar Typhi
gcggcggucugcgccug

SEQ ID NO: 3623971 - RNA, 19 nt, Salmonella enterica enterica serovar Typhi
gcggcgguuauccgccagc

SEQ ID NO: 3623972 - RNA, 21 nt, Salmonella enterica enterica serovar Typhi
gcggcgguuauccgccagcgc

SEQ ID NO: 3623973 - RNA, 22 nt, Salmonella enterica enterica serovar Typhi
gcggcgguuauccuccgggucg

SEQ ID NO: 3623974 - RNA, 16 nt, Salmonella enterica enterica serovar Typhi
gcggcgguucauccug

SEQ ID NO: 3623975 - RNA, 19 nt, Salmonella enterica enterica serovar Typhi
gcggucggcagcaccggaa

SEQ ID NO: 3623976 - RNA, 16 nt, Salmonella enterica enterica serovar Typhi
gcggucggcaggcggu

SEQ ID NO: 3623977 - RNA, 18 nt, Salmonella enterica enterica serovar Typhi
gcggucggcaggcgguca

SEQ ID NO: 3623978 - RNA, 19 nt, Salmonella enterica enterica serovar Typhi
gcggucgguuuucuucgac

SEQ ID NO: 3623979 - RNA, 22 nt, Salmonella enterica enterica serovar Typhi
gcggucguauuuaccgcuggcg

SEQ ID NO: 3623980 - RNA, 12 nt, Salmonella enterica enterica serovar Typhi
gcggucuucacu

SEQ ID NO: 3623981 - RNA, 13 nt, Salmonella enterica enterica serovar Typhi
gcggugaaagaga

SEQ ID NO: 3623982 - RNA, 22 nt, Salmonella enterica enterica serovar Typhi
gcggugaaaugcccgauggcgc

SEQ ID NO: 3623983 - RNA, 20 nt, Salmonella enterica enterica serovar Typhi
gcggugaucccaggccggca

SEQ ID NO: 3623984 - RNA, 22 nt, Salmonella enterica enterica serovar Typhi
gcggugcagguugccugauggc

SEQ ID NO: 3623985 - RNA, 18 nt, Salmonella enterica enterica serovar Typhi
gcgguggguagcggcaau

SEQ ID NO: 3623986 - RNA, 23 nt, Salmonella enterica enterica serovar Typhi
gcggugucgauacgauugcgcgu

SEQ ID NO: 3623987 - RNA, 13 nt, Salmonella enterica enterica serovar Typhi
gcgguuauccgcc

SEQ ID NO: 3623988 - RNA, 19 nt, Salmonella enterica enterica serovar Typhi
gcgguuauccgccagcgca

SEQ ID NO: 3623989 - RNA, 18 nt, Salmonella enterica enterica serovar Typhi
gcgguucaaucacgcgua

SEQ ID NO: 3623990 - RNA, 14 nt, Salmonella enterica enterica serovar Typhi
gcgguucucccggc

SEQ ID NO: 3623991 - RNA, 16 nt, Salmonella enterica enterica serovar Typhi
gcgguucucccggcau

SEQ ID NO: 3623992 - RNA, 14 nt, Salmonella enterica enterica serovar Typhi
gcgguucuuuugcu

SEQ ID NO: 3623993 - RNA, 20 nt, Salmonella enterica enterica serovar Typhi
gcgguugacgcugcuuuuuu

SEQ ID NO: 3623994 - RNA, 15 nt, Salmonella enterica enterica serovar Typhi
gcgguugcagcaaaa

SEQ ID NO: 3623995 - RNA, 20 nt, Salmonella enterica enterica serovar Typhi
gcgguuucuaccacccagcc

SEQ ID NO: 3623996 - RNA, 18 nt, Salmonella enterica enterica serovar Typhi
gcgguuuuccugaugaua

SEQ ID NO: 3623997 - RNA, 15 nt, Salmonella enterica enterica serovar Typhi
gcguaaaaaggcgca

SEQ ID NO: 3623998 - RNA, 14 nt, Salmonella enterica enterica serovar Typhi
gcguaaaaauuuuc

SEQ ID NO: 3623999 - RNA, 15 nt, Salmonella enterica enterica serovar Typhi
gcguaaaaccgcgcu

SEQ ID NO: 3624000 - RNA, 17 nt, Salmonella enterica enterica serovar Typhi
gcguaaaauauacagcc

SEQ ID NO: 3624001 - RNA, 16 nt, Salmonella enterica enterica serovar Typhi
gcguaaacaggcgcgg

SEQ ID NO: 3624002 - RNA, 12 nt, Salmonella enterica enterica serovar Typhi
gcguaaacuucc

SEQ ID NO: 3624003 - RNA, 12 nt, Salmonella enterica enterica serovar Typhi
gcguaaagcugu

SEQ ID NO: 3624004 - RNA, 22 nt, Salmonella enterica enterica serovar Typhi
gcguaacagcgcuaucaggaag

SEQ ID NO: 3624005 - RNA, 17 nt, Salmonella enterica enterica serovar Typhi
gcguaacagcgguauac

SEQ ID NO: 3624006 - RNA, 18 nt, Salmonella enterica enterica serovar Typhi
gcguaacgccacauauaa

SEQ ID NO: 3624007 - RNA, 15 nt, Salmonella enterica enterica serovar Typhi
gcguaacgccuccac

SEQ ID NO: 3624008 - RNA, 18 nt, Salmonella enterica enterica serovar Typhi
gcguaacgccuccaccgu

SEQ ID NO: 3624009 - RNA, 14 nt, Salmonella enterica enterica serovar Typhi
gcguaacugccaga

SEQ ID NO: 3624010 - RNA, 21 nt, Salmonella enterica enterica serovar Typhi
gcguaagguauuuagccguuc

SEQ ID NO: 3624011 - RNA, 15 nt, Salmonella enterica enterica serovar Typhi
gcguaauauacgcca

SEQ ID NO: 3624012 - RNA, 22 nt, Salmonella enterica enterica serovar Typhi
gcguaauaugaauauccgccgc

SEQ ID NO: 3624013 - RNA, 16 nt, Salmonella enterica enterica serovar Typhi
gcguaaucagcuuuuc

SEQ ID NO: 3624014 - RNA, 21 nt, Salmonella enterica enterica serovar Typhi
gcguaauccggccuggcgcag

SEQ ID NO: 3624015 - RNA, 14 nt, Salmonella enterica enterica serovar Typhi
gcguaaucuuccac

SEQ ID NO: 3624016 - RNA, 20 nt, Salmonella enterica enterica serovar Typhi
gcguaaucuucgcggcugcc

SEQ ID NO: 3624017 - RNA, 21 nt, Salmonella enterica enterica serovar Typhi
gcguaaugcgccaggcagcac

SEQ ID NO: 3624018 - RNA, 21 nt, Salmonella enterica enterica serovar Typhi
gcguaaugguggcaaccugac

SEQ ID NO: 3624019 - RNA, 23 nt, Salmonella enterica enterica serovar Typhi
gcguacaaucgcguuuuccagca

SEQ ID NO: 3624020 - RNA, 14 nt, Salmonella enterica enterica serovar Typhi
gcguacagcgccau

SEQ ID NO: 3624021 - RNA, 23 nt, Salmonella enterica enterica serovar Typhi
gcguacaggauguccaggcgaca

SEQ ID NO: 3624022 - RNA, 22 nt, Salmonella enterica enterica serovar Typhi
gcguacaggcggaaaucaacaa

SEQ ID NO: 3624023 - RNA, 16 nt, Salmonella enterica enterica serovar Typhi
gcguacaggcggauga

SEQ ID NO: 3624024 - RNA, 19 nt, Salmonella enterica enterica serovar Typhi
gcguacauugccggauggc

SEQ ID NO: 3624025 - RNA, 13 nt, Salmonella enterica enterica serovar Typhi
gcguaccagcgcc

SEQ ID NO: 3624026 - RNA, 14 nt, Salmonella enterica enterica serovar Typhi
gcguaccagcguca

SEQ ID NO: 3624027 - RNA, 12 nt, Salmonella enterica enterica serovar Typhi
gcguacccgcgg

SEQ ID NO: 3624028 - RNA, 12 nt, Salmonella enterica enterica serovar Typhi
gcguaccgcaau

SEQ ID NO: 3624029 - RNA, 18 nt, Salmonella enterica enterica serovar Typhi
gcguaccgcuaucgccaa

SEQ ID NO: 3624030 - RNA, 21 nt, Salmonella enterica enterica serovar Typhi
gcguaccgcuaucgccaaacu

SEQ ID NO: 3624031 - RNA, 22 nt, Salmonella enterica enterica serovar Typhi
gcguaccggccacaauugccag

SEQ ID NO: 3624032 - RNA, 19 nt, Salmonella enterica enterica serovar Typhi
gcguacuaaauaggcggca

SEQ ID NO: 3624033 - RNA, 15 nt, Salmonella enterica enterica serovar Typhi
gcguacucagcagac

SEQ ID NO: 3624034 - RNA, 21 nt, Salmonella enterica enterica serovar Typhi
gcguacugcccguggcggagg

SEQ ID NO: 3624035 - RNA, 19 nt, Salmonella enterica enterica serovar Typhi
gcguacuuucgccaguuca

SEQ ID NO: 3624036 - RNA, 17 nt, Salmonella enterica enterica serovar Typhi
gcguagaagcuuaccac

SEQ ID NO: 3624037 - RNA, 13 nt, Salmonella enterica enterica serovar Typhi
gcguagagagcgg

SEQ ID NO: 3624038 - RNA, 18 nt, Salmonella enterica enterica serovar Typhi
gcguagagaggcauccgc

SEQ ID NO: 3624039 - RNA, 20 nt, Salmonella enterica enterica serovar Typhi
gcguagcccagcgccgcauc

SEQ ID NO: 3624040 - RNA, 22 nt, Salmonella enterica enterica serovar Typhi
gcguagcgcccuggucagcauc

SEQ ID NO: 3624041 - RNA, 15 nt, Salmonella enterica enterica serovar Typhi
gcguagcgcgcggau

SEQ ID NO: 3624042 - RNA, 19 nt, Salmonella enterica enterica serovar Typhi
gcguagcguguauuccagu

SEQ ID NO: 3624043 - RNA, 17 nt, Salmonella enterica enterica serovar Typhi
gcguagcucgcccagca

SEQ ID NO: 3624044 - RNA, 21 nt, Salmonella enterica enterica serovar Typhi
gcguagcuggccuucuccacu

SEQ ID NO: 3624045 - RNA, 24 nt, Salmonella enterica enterica serovar Typhi
gcguaggguagaucacgccagcgc

SEQ ID NO: 3624046 - RNA, 15 nt, Salmonella enterica enterica serovar Typhi
gcguagucagcgacg

SEQ ID NO: 3624047 - RNA, 13 nt, Salmonella enterica enterica serovar Typhi
gcuucagagcagg

SEQ ID NO: 3624048 - RNA, 14 nt, Salmonella enterica enterica serovar Typhi
gcuucagagcaggu

SEQ ID NO: 3624049 - RNA, 16 nt, Salmonella enterica enterica serovar Typhi
gcuucagccacuggcu

SEQ ID NO: 3624050 - RNA, 19 nt, Salmonella enterica enterica serovar Typhi
gcuucagccugugcaacca

SEQ ID NO: 3624051 - RNA, 16 nt, Salmonella enterica enterica serovar Typhi
gcuucagcggcgcguu

SEQ ID NO: 3624052 - RNA, 21 nt, Salmonella enterica enterica serovar Typhi
gcuucaggcucaucagcgcca

SEQ ID NO: 3624053 - RNA, 21 nt, Salmonella enterica enterica serovar Typhi
gcuucagucauaauccuuccu

SEQ ID NO: 3624054 - RNA, 20 nt, Salmonella enterica enterica serovar Typhi
gcuucauaucgcccagcagc

SEQ ID NO: 3624055 - RNA, 17 nt, Salmonella enterica enterica serovar Typhi
gcuuccaccucuucugc

SEQ ID NO: 3624056 - RNA, 15 nt, Salmonella enterica enterica serovar Typhi
gcuuccacucguaac

SEQ ID NO: 3624057 - RNA, 21 nt, Salmonella enterica enterica serovar Typhi
gcuuccagaauucguacguuu

SEQ ID NO: 3624058 - RNA, 20 nt, Salmonella enterica enterica serovar Typhi
gcuuccagaugaagcgcauc

SEQ ID NO: 3624059 - RNA, 21 nt, Salmonella enterica enterica serovar Typhi
gcuuccagcgcgucggccggc

SEQ ID NO: 3624060 - RNA, 22 nt, Salmonella enterica enterica serovar Typhi
ggaaauucugacgcagcuucug

SEQ ID NO: 3624061 - RNA, 21 nt, Salmonella enterica enterica serovar Typhi
ggaacaacggcacacaggccg

SEQ ID NO: 3624062 - RNA, 15 nt, Salmonella enterica enterica serovar Typhi
ggaacaagcaaaccu

SEQ ID NO: 3624063 - RNA, 14 nt, Salmonella enterica enterica serovar Typhi
ggaacaccagcgcc

SEQ ID NO: 3624064 - RNA, 19 nt, Salmonella enterica enterica serovar Typhi
ggaacagcggagcgaagaa

SEQ ID NO: 3624065 - RNA, 15 nt, Salmonella enterica enterica serovar Typhi
ggaacagggccgcau

SEQ ID NO: 3624066 - RNA, 21 nt, Salmonella enterica enterica serovar Typhi
ggaacaguuuaguugccguuu

SEQ ID NO: 3624067 - RNA, 14 nt, Salmonella enterica enterica serovar Typhi
ggaacaucagccag

SEQ ID NO: 3624068 - RNA, 20 nt, Salmonella enterica enterica serovar Typhi
ggaacaucagccagcagcuc

SEQ ID NO: 3624069 - RNA, 13 nt, Salmonella enterica enterica serovar Typhi
ggaacaucuuuua

SEQ ID NO: 3624070 - RNA, 18 nt, Salmonella enterica enterica serovar Typhi
ggaaccaaaugcccagcu

SEQ ID NO: 3624071 - RNA, 14 nt, Salmonella enterica enterica serovar Typhi
ggaacccaggcacc

SEQ ID NO: 3624072 - RNA, 16 nt, Salmonella enterica enterica serovar Typhi
ggaaccgcccaucaac

SEQ ID NO: 3624073 - RNA, 12 nt, Salmonella enterica enterica serovar Typhi
ggaaccuggcag

SEQ ID NO: 3624074 - RNA, 17 nt, Salmonella enterica enterica serovar Typhi
ggaacggagagcaacau

SEQ ID NO: 3624075 - RNA, 13 nt, Salmonella enterica enterica serovar Typhi
ggaacgucaucau

SEQ ID NO: 3624076 - RNA, 21 nt, Salmonella enterica enterica serovar Typhi
ggaacguccaguugucaucgu

SEQ ID NO: 3624077 - RNA, 21 nt, Salmonella enterica enterica serovar Typhi
ggaacucugcgacgccaggcg

SEQ ID NO: 3624078 - RNA, 21 nt, Salmonella enterica enterica serovar Typhi
ggaacugacuccagcugguau

SEQ ID NO: 3624079 - RNA, 16 nt, Salmonella enterica enterica serovar Typhi
ggaacugggugccgug

SEQ ID NO: 3624080 - RNA, 16 nt, Salmonella enterica enterica serovar Typhi
ggaacuggugaaacag

SEQ ID NO: 3624081 - RNA, 18 nt, Salmonella enterica enterica serovar Typhi
ggaacuguucagccagca

SEQ ID NO: 3624082 - RNA, 18 nt, Salmonella enterica enterica serovar Typhi
ggaagaaacgcuuaaagc

SEQ ID NO: 3624083 - RNA, 16 nt, Salmonella enterica enterica serovar Typhi
ggaagaacuggaugac

SEQ ID NO: 3624084 - RNA, 21 nt, Salmonella enterica enterica serovar Typhi
ggaagacauucacauauauuu

SEQ ID NO: 3624085 - RNA, 15 nt, Salmonella enterica enterica serovar Typhi
ggaagaccguuuaaa

SEQ ID NO: 3624086 - RNA, 21 nt, Salmonella enterica enterica serovar Typhi
ggaagacguuuacaccgccau

SEQ ID NO: 3624087 - RNA, 17 nt, Salmonella enterica enterica serovar Typhi
ggaagacugcuccggca

SEQ ID NO: 3624088 - RNA, 14 nt, Salmonella enterica enterica serovar Typhi
ggaagacuggcgca

SEQ ID NO: 3624089 - RNA, 17 nt, Salmonella enterica enterica serovar Typhi
ggaagacuggcgcagca

SEQ ID NO: 3624090 - RNA, 18 nt, Salmonella enterica enterica serovar Typhi
ggaagauguugccguaac

SEQ ID NO: 3624091 - RNA, 18 nt, Salmonella enterica enterica serovar Typhi
ggaagcgaccggcgucau

SEQ ID NO: 3624092 - RNA, 20 nt, Salmonella enterica enterica serovar Typhi
ggaagcgacgacacggcgca

SEQ ID NO: 3624093 - RNA, 15 nt, Salmonella enterica enterica serovar Typhi
ggaagcugcgcagca

SEQ ID NO: 3624094 - RNA, 15 nt, Salmonella enterica enterica serovar Typhi
ggaagcuucagcaaa

SEQ ID NO: 3624095 - RNA, 15 nt, Salmonella enterica enterica serovar Typhi
ggaaggaaauaacgu

SEQ ID NO: 3624096 - RNA, 15 nt, Salmonella enterica enterica serovar Typhi
ggaaggcgugcagcg

SEQ ID NO: 3624097 - RNA, 23 nt, Salmonella enterica enterica serovar Typhi
ggaaggucgcauccgcguuagca

SEQ ID NO: 3624098 - RNA, 18 nt, Salmonella enterica enterica serovar Typhi
ggaaguauacauccacug

SEQ ID NO: 3624099 - RNA, 18 nt, Salmonella enterica enterica serovar Typhi
ggaagucagcuuccugca

SEQ ID NO: 3624100 - RNA, 14 nt, Salmonella enterica enterica serovar Typhi
ggaauaaaaauaaa

SEQ ID NO: 3624101 - RNA, 19 nt, Salmonella enterica enterica serovar Typhi
ggaauaaaaauaaauaaaa

SEQ ID NO: 3624102 - RNA, 18 nt, Salmonella enterica enterica serovar Typhi
ggaauaaaggucacauca

SEQ ID NO: 3624103 - RNA, 15 nt, Salmonella enterica enterica serovar Typhi
ggaauaaauauaaga

SEQ ID NO: 3624104 - RNA, 13 nt, Salmonella enterica enterica serovar Typhi
ggaauaccgucaa

SEQ ID NO: 3624105 - RNA, 19 nt, Salmonella enterica enterica serovar Typhi
ggaauagacagugauuuac

SEQ ID NO: 3624106 - RNA, 14 nt, Salmonella enterica enterica serovar Typhi
ggaauaucaauuca

SEQ ID NO: 3624107 - RNA, 13 nt, Salmonella enterica enterica serovar Typhi
ggaauauccgcgc

SEQ ID NO: 3624108 - RNA, 15 nt, Salmonella enterica enterica serovar Typhi
ggaauaucgcggaaa

SEQ ID NO: 3624109 - RNA, 23 nt, Salmonella enterica enterica serovar Typhi
ggaauauucgcuucuucggcagc

SEQ ID NO: 3624110 - RNA, 12 nt, Salmonella enterica enterica serovar Typhi
ggaauauuggua

SEQ ID NO: 3624111 - RNA, 22 nt, Salmonella enterica enterica serovar Typhi
ggaaucaauuucccuucaauca

SEQ ID NO: 3624112 - RNA, 13 nt, Salmonella enterica enterica serovar Typhi
ggaaucagccagg

SEQ ID NO: 3624113 - RNA, 21 nt, Salmonella enterica enterica serovar Typhi
ggaauccccggcuuccagcgg

SEQ ID NO: 3624114 - RNA, 12 nt, Salmonella enterica enterica serovar Typhi
ggaaucgaugcu

SEQ ID NO: 3624115 - RNA, 24 nt, Salmonella enterica enterica serovar Typhi
ggaaucggacacuugcaacucgca

SEQ ID NO: 3624116 - RNA, 15 nt, Salmonella enterica enterica serovar Typhi
ggaaucgucacagac

SEQ ID NO: 3624117 - RNA, 12 nt, Salmonella enterica enterica serovar Typhi
ggaaugcccagc

SEQ ID NO: 3624118 - RNA, 13 nt, Salmonella enterica enterica serovar Typhi
ggaaugcuuuaca

SEQ ID NO: 3624119 - RNA, 15 nt, Salmonella enterica enterica serovar Typhi
ggaauggcgggcgca

SEQ ID NO: 3624120 - RNA, 17 nt, Salmonella enterica enterica serovar Typhi
ggaauuuaccggugcgg

SEQ ID NO: 3624121 - RNA, 18 nt, Salmonella enterica enterica serovar Typhi
ggaauuuaucaacaaauu

SEQ ID NO: 3624122 - RNA, 13 nt, Salmonella enterica enterica serovar Typhi
ggacaauccgcga

SEQ ID NO: 3624123 - RNA, 16 nt, Salmonella enterica enterica serovar Typhi
ggacacauuucuuuug

SEQ ID NO: 3624124 - RNA, 14 nt, Salmonella enterica enterica serovar Typhi
ggacacccgcagcc

SEQ ID NO: 3624125 - RNA, 18 nt, Salmonella enterica enterica serovar Typhi
ggacacccgcagccagaa

SEQ ID NO: 3624126 - RNA, 20 nt, Salmonella enterica enterica serovar Typhi
ggacacccggcuuuugcuuu

SEQ ID NO: 3624127 - RNA, 20 nt, Salmonella enterica enterica serovar Typhi
ggacagacuucauuuuccac

SEQ ID NO: 3624128 - RNA, 11 nt, Salmonella enterica enterica serovar Typhi
ggacagcgaca

SEQ ID NO: 3624129 - RNA, 17 nt, Salmonella enterica enterica serovar Typhi
ggacauaaacgccucau

SEQ ID NO: 3624130 - RNA, 11 nt, Salmonella enterica enterica serovar Typhi
ggacaucaucc

SEQ ID NO: 3624131 - RNA, 12 nt, Salmonella enterica enterica serovar Typhi
ggaccagcacaa

SEQ ID NO: 3624132 - RNA, 15 nt, Salmonella enterica enterica serovar Typhi
ggaccagcacaaaaa

SEQ ID NO: 3624133 - RNA, 17 nt, Salmonella enterica enterica serovar Typhi
ggaccggcaaucgccug

SEQ ID NO: 3624134 - RNA, 20 nt, Salmonella enterica enterica serovar Typhi
ggacgaauuuccagcgggcg

SEQ ID NO: 3624135 - RNA, 20 nt, Salmonella enterica enterica serovar Typhi
ggacgagcgcgucagcgccu

SEQ ID NO: 3624136 - RNA, 20 nt, Salmonella enterica enterica serovar Typhi
ggacgauaaccaugcucagc

SEQ ID NO: 3624137 - RNA, 18 nt, Salmonella enterica enterica serovar Typhi
ggacgcaccagccaggcg

SEQ ID NO: 3624138 - RNA, 21 nt, Salmonella enterica enterica serovar Typhi
ggacgccagucuuugcaggag

SEQ ID NO: 3624139 - RNA, 18 nt, Salmonella enterica enterica serovar Typhi
ggacgcuccaucacggua

SEQ ID NO: 3624140 - RNA, 15 nt, Salmonella enterica enterica serovar Typhi
ggacggcggccagca

SEQ ID NO: 3624141 - RNA, 19 nt, Salmonella enterica enterica serovar Typhi
ggacgggauacggcgagac

SEQ ID NO: 3624142 - RNA, 17 nt, Salmonella enterica enterica serovar Typhi
ggacgucaugccgccac

SEQ ID NO: 3624143 - RNA, 21 nt, Salmonella enterica enterica serovar Typhi
ggacguggguuucaauauagc

SEQ ID NO: 3624144 - RNA, 12 nt, Salmonella enterica enterica serovar Typhi
ggacguugaaaa

SEQ ID NO: 3624145 - RNA, 23 nt, Salmonella enterica enterica serovar Typhi
ggacguugagcguuacgggaaca

SEQ ID NO: 3624146 - RNA, 13 nt, Salmonella enterica enterica serovar Typhi
ggauauggcaaaa

SEQ ID NO: 3624147 - RNA, 17 nt, Salmonella enterica enterica serovar Typhi
ggauauguuugacaagc

SEQ ID NO: 3624148 - RNA, 17 nt, Salmonella enterica enterica serovar Typhi
ggauauucaucaguuua

SEQ ID NO: 3624149 - RNA, 18 nt, Salmonella enterica enterica serovar Typhi
ggauauugccgaagacca

SEQ ID NO: 3624150 - RNA, 16 nt, Salmonella enterica enterica serovar Typhi
ggauauuggcguuaga

SEQ ID NO: 3624151 - RNA, 17 nt, Salmonella enterica enterica serovar Typhi
ggaucaagcaaugccag

SEQ ID NO: 3624152 - RNA, 17 nt, Salmonella enterica enterica serovar Typhi
ggaucagaaauucgcag

SEQ ID NO: 3624153 - RNA, 15 nt, Salmonella enterica enterica serovar Typhi
ggaucagacggcuga

SEQ ID NO: 3624154 - RNA, 20 nt, Salmonella enterica enterica serovar Typhi
ggaucagcagauccaucgcc

SEQ ID NO: 3624155 - RNA, 21 nt, Salmonella enterica enterica serovar Typhi
ggaucaggcguuagccgccau

SEQ ID NO: 3624156 - RNA, 14 nt, Salmonella enterica enterica serovar Typhi
ggaucaucggccag

SEQ ID NO: 3624157 - RNA, 19 nt, Salmonella enterica enterica serovar Typhi
ggaucaucggcucagcaau

SEQ ID NO: 3624158 - RNA, 17 nt, Salmonella enterica enterica serovar Typhi
ggaucggcacacagcca

SEQ ID NO: 3624159 - RNA, 16 nt, Salmonella enterica enterica serovar Typhi
ggaucggccauaucca

SEQ ID NO: 3624160 - RNA, 20 nt, Salmonella enterica enterica serovar Typhi
ggaucgggcagacuuucuga

SEQ ID NO: 3624161 - RNA, 15 nt, Salmonella enterica enterica serovar Typhi
ggaucgguuuauccc

SEQ ID NO: 3624162 - RNA, 21 nt, Salmonella enterica enterica serovar Typhi
ggaucguacaacggaucgccu

SEQ ID NO: 3624163 - RNA, 23 nt, Salmonella enterica enterica serovar Typhi
ggaucguucugcugauaauacug

SEQ ID NO: 3624164 - RNA, 20 nt, Salmonella enterica enterica serovar Typhi
ggaugaggcgcagccgccau

SEQ ID NO: 3624165 - RNA, 19 nt, Salmonella enterica enterica serovar Typhi
ggaugcaucaugcuaaaag

SEQ ID NO: 3624166 - RNA, 15 nt, Salmonella enterica enterica serovar Typhi
ggaugccaaccaccg

SEQ ID NO: 3624167 - RNA, 19 nt, Salmonella enterica enterica serovar Typhi
ggaugcgccgcccaccgcc

SEQ ID NO: 3624168 - RNA, 17 nt, Salmonella enterica enterica serovar Typhi
ggaugcgcugaauagcg

SEQ ID NO: 3624169 - RNA, 19 nt, Salmonella enterica enterica serovar Typhi
ggauggaauuuugcaccau

SEQ ID NO: 3624170 - RNA, 13 nt, Salmonella enterica enterica serovar Typhi
ggauggcaaaaac

SEQ ID NO: 3624171 - RNA, 17 nt, Salmonella enterica enterica serovar Typhi
ggauggcaguacagggc

SEQ ID NO: 3624172 - RNA, 14 nt, Salmonella enterica enterica serovar Typhi
ggauggccagcacc

SEQ ID NO: 3624173 - RNA, 20 nt, Salmonella enterica enterica serovar Typhi
ggauggccagcaccagcauu

SEQ ID NO: 3624174 - RNA, 23 nt, Salmonella enterica enterica serovar Typhi
ggauggccagcaccagcauuagc

SEQ ID NO: 3624175 - RNA, 12 nt, Salmonella enterica enterica serovar Typhi
ggauggcggcgc

SEQ ID NO: 3624176 - RNA, 22 nt, Salmonella enterica enterica serovar Typhi
ggauggcggcguaaacgccuua

SEQ ID NO: 3624177 - RNA, 11 nt, Salmonella enterica enterica serovar Typhi
ggauggugguc

SEQ ID NO: 3624178 - RNA, 11 nt, Salmonella enterica enterica serovar Typhi
ggauguaggcc

SEQ ID NO: 3624179 - RNA, 12 nt, Salmonella enterica enterica serovar Typhi
ggaugucggcgu

SEQ ID NO: 3624180 - RNA, 18 nt, Salmonella enterica enterica serovar Typhi
ggaugucggcuuacgccu

SEQ ID NO: 3624181 - RNA, 22 nt, Salmonella enterica enterica serovar Typhi
ggaugugaccuuugugcaggau

SEQ ID NO: 3624182 - RNA, 13 nt, Salmonella enterica enterica serovar Typhi
ggaugugcauuga

SEQ ID NO: 3624183 - RNA, 13 nt, Salmonella enterica enterica serovar Typhi
ggauguggugcgg

SEQ ID NO: 3624184 - RNA, 15 nt, Salmonella enterica enterica serovar Typhi
ggauguugccacagg

SEQ ID NO: 3624185 - RNA, 23 nt, Salmonella enterica enterica serovar Typhi
ggauuaaaugacgcccugcgcca

SEQ ID NO: 3624186 - RNA, 15 nt, Salmonella enterica enterica serovar Typhi
ggauuacgacccaca

SEQ ID NO: 3624187 - RNA, 22 nt, Salmonella enterica enterica serovar Typhi
ggauuaucaggaugaauaugaa

SEQ ID NO: 3624188 - RNA, 16 nt, Salmonella enterica enterica serovar Typhi
ggauuaucgaaauagc

SEQ ID NO: 3624189 - RNA, 20 nt, Salmonella enterica enterica serovar Typhi
ggauuccgccgcggccagca

SEQ ID NO: 3624190 - RNA, 19 nt, Salmonella enterica enterica serovar Typhi
ggauucgacggccagcgcg

SEQ ID NO: 3624191 - RNA, 11 nt, Salmonella enterica enterica serovar Typhi
ggauugucuua

SEQ ID NO: 3624192 - RNA, 17 nt, Salmonella enterica enterica serovar Typhi
ggauuuaaaccgccccg

SEQ ID NO: 3624193 - RNA, 23 nt, Salmonella enterica enterica serovar Typhi
ggauuucgucgcuaagcgucaga

SEQ ID NO: 3624194 - RNA, 17 nt, Salmonella enterica enterica serovar Typhi
ggauuuuaaauugguua

SEQ ID NO: 3624195 - RNA, 20 nt, Salmonella enterica enterica serovar Typhi
ggauuuuccguuaagcugga

SEQ ID NO: 3624196 - RNA, 14 nt, Salmonella enterica enterica serovar Typhi
ggcaaaaaacggaa

SEQ ID NO: 3624197 - RNA, 12 nt, Salmonella enterica enterica serovar Typhi
ggcaaaaaucag

SEQ ID NO: 3624198 - RNA, 20 nt, Salmonella enterica enterica serovar Typhi
ggcaaaaaucagccaaagcg

SEQ ID NO: 3624199 - RNA, 20 nt, Salmonella enterica enterica serovar Typhi
ggcaaaaauccuucuuccau

SEQ ID NO: 3624200 - RNA, 14 nt, Salmonella enterica enterica serovar Typhi
ggcaaacauagccu

SEQ ID NO: 3624201 - RNA, 12 nt, Salmonella enterica enterica serovar Typhi
ggcaaaccagca

SEQ ID NO: 3624202 - RNA, 23 nt, Salmonella enterica enterica serovar Typhi
ggcaaaccugcgguuaauacauc

SEQ ID NO: 3624203 - RNA, 16 nt, Salmonella enterica enterica serovar Typhi
ggcaaagcacugcugc

SEQ ID NO: 3624204 - RNA, 17 nt, Salmonella enterica enterica serovar Typhi
ggcaaagccccagucau

SEQ ID NO: 3624205 - RNA, 19 nt, Salmonella enterica enterica serovar Typhi
ggcaaagccccagucauuc

SEQ ID NO: 3624206 - RNA, 15 nt, Salmonella enterica enterica serovar Typhi
ggcaaagucgaacga

SEQ ID NO: 3624207 - RNA, 11 nt, Salmonella enterica enterica serovar Typhi
ggcaaauagcg

SEQ ID NO: 3624208 - RNA, 22 nt, Salmonella enterica enterica serovar Typhi
ggcaaauagcguguguuuuccu

SEQ ID NO: 3624209 - RNA, 14 nt, Salmonella enterica enterica serovar Typhi
ggcaaaucaacauu

SEQ ID NO: 3624210 - RNA, 20 nt, Salmonella enterica enterica serovar Typhi
ggcaaauccuccauaaauaa

SEQ ID NO: 3624211 - RNA, 22 nt, Salmonella enterica enterica serovar Typhi
ggcaaaucuggugauaaagcag

SEQ ID NO: 3624212 - RNA, 19 nt, Salmonella enterica enterica serovar Typhi
ggcaaauuaucccuuccuc

SEQ ID NO: 3624213 - RNA, 14 nt, Salmonella enterica enterica serovar Typhi
ggcaaauucagcga

SEQ ID NO: 3624214 - RNA, 15 nt, Salmonella enterica enterica serovar Typhi
ggcaacacccgccga

SEQ ID NO: 3624215 - RNA, 22 nt, Salmonella enterica enterica serovar Typhi
ggcaacagccauuuuaaaaaua

SEQ ID NO: 3624216 - RNA, 18 nt, Salmonella enterica enterica serovar Typhi
ggcaaccugucaguacgu

SEQ ID NO: 3624217 - RNA, 23 nt, Salmonella enterica enterica serovar Typhi
ggcaacgccguacuccagcccau

SEQ ID NO: 3624218 - RNA, 16 nt, Salmonella enterica enterica serovar Typhi
ggcaacggccagcgca

SEQ ID NO: 3624219 - RNA, 16 nt, Salmonella enterica enterica serovar Typhi
ggcaacggcgacaaga

SEQ ID NO: 3624220 - RNA, 22 nt, Salmonella enterica enterica serovar Typhi
ggcaacgggacggcggccagca

SEQ ID NO: 3624221 - RNA, 23 nt, Salmonella enterica enterica serovar Typhi
ggcaacgggacggcggccagcau

SEQ ID NO: 3624222 - RNA, 19 nt, Salmonella enterica enterica serovar Typhi
ggcaacguaagccaguucu

SEQ ID NO: 3624223 - RNA, 15 nt, Salmonella enterica enterica serovar Typhi
ggcaagaauuaaaua

SEQ ID NO: 3624224 - RNA, 23 nt, Salmonella enterica enterica serovar Typhi
ggcaagagauucaggccgccagc

SEQ ID NO: 3624225 - RNA, 14 nt, Salmonella enterica enterica serovar Typhi
ggcaagcgccagca

SEQ ID NO: 3624226 - RNA, 15 nt, Salmonella enterica enterica serovar Typhi
ggcaagcucagcggc

SEQ ID NO: 3624227 - RNA, 16 nt, Salmonella enterica enterica serovar Typhi
ggcaagcucagcggca

SEQ ID NO: 3624228 - RNA, 20 nt, Salmonella enterica enterica serovar Typhi
ggcaagcuggcgaaucgcau

SEQ ID NO: 3624229 - RNA, 20 nt, Salmonella enterica enterica serovar Typhi
ggcaaggcggcaagaaagug

SEQ ID NO: 3624230 - RNA, 21 nt, Salmonella enterica enterica serovar Typhi
ggcaauauccugugucggcag

SEQ ID NO: 3624231 - RNA, 17 nt, Salmonella enterica enterica serovar Typhi
ggcaauauuaaaugacg

SEQ ID NO: 3624232 - RNA, 18 nt, Salmonella enterica enterica serovar Typhi
ggcaucggaaccggggcg

SEQ ID NO: 3624233 - RNA, 21 nt, Salmonella enterica enterica serovar Typhi
ggcaucgggauuuacaaccgc

SEQ ID NO: 3624234 - RNA, 19 nt, Salmonella enterica enterica serovar Typhi
ggcaucucaucuugcagga

SEQ ID NO: 3624235 - RNA, 13 nt, Salmonella enterica enterica serovar Typhi
ggcaucucgccaa

SEQ ID NO: 3624236 - RNA, 21 nt, Salmonella enterica enterica serovar Typhi
ggcaucugcaauucggcggca

SEQ ID NO: 3624237 - RNA, 15 nt, Salmonella enterica enterica serovar Typhi
ggcaucugcgcaacu

SEQ ID NO: 3624238 - RNA, 19 nt, Salmonella enterica enterica serovar Typhi
ggcaucuuaaagcgggcuu

SEQ ID NO: 3624239 - RNA, 19 nt, Salmonella enterica enterica serovar Typhi
ggcaugacuuuaccgguuu

SEQ ID NO: 3624240 - RNA, 13 nt, Salmonella enterica enterica serovar Typhi
ggcaugaugccac

SEQ ID NO: 3624241 - RNA, 18 nt, Salmonella enterica enterica serovar Typhi
ggcaugccccucgacagg

SEQ ID NO: 3624242 - RNA, 22 nt, Salmonella enterica enterica serovar Typhi
ggcauggggucaggugggacca

SEQ ID NO: 3624243 - RNA, 21 nt, Salmonella enterica enterica serovar Typhi
ggcauguccggcgacuccaga

SEQ ID NO: 3624244 - RNA, 15 nt, Salmonella enterica enterica serovar Typhi
ggcauuaacaaauca

SEQ ID NO: 3624245 - RNA, 22 nt, Salmonella enterica enterica serovar Typhi
ggcauuaguaauaaagcguagc

SEQ ID NO: 3624246 - RNA, 18 nt, Salmonella enterica enterica serovar Typhi
ggcauuaugggcgugcug

SEQ ID NO: 3624247 - RNA, 14 nt, Salmonella enterica enterica serovar Typhi
ggcauuauguuuug

SEQ ID NO: 3624248 - RNA, 17 nt, Salmonella enterica enterica serovar Typhi
ggcauuccgcuggugcg

SEQ ID NO: 3624249 - RNA, 18 nt, Salmonella enterica enterica serovar Typhi
ggcauucgaauccuccug

SEQ ID NO: 3624250 - RNA, 13 nt, Salmonella enterica enterica serovar Typhi
ggcauucgcacac

SEQ ID NO: 3624251 - RNA, 20 nt, Salmonella enterica enterica serovar Typhi
ggcauugccggaaaccaacc

SEQ ID NO: 3624252 - RNA, 18 nt, Salmonella enterica enterica serovar Typhi
ggcauuggcaucugucau

SEQ ID NO: 3624253 - RNA, 18 nt, Salmonella enterica enterica serovar Typhi
ggcauuuaugccgccauc

SEQ ID NO: 3624254 - RNA, 15 nt, Salmonella enterica enterica serovar Typhi
ggcauuucaggcacu

SEQ ID NO: 3624255 - RNA, 17 nt, Salmonella enterica enterica serovar Typhi
ggcauuucugucugacg

SEQ ID NO: 3624256 - RNA, 18 nt, Salmonella enterica enterica serovar Typhi
ggcauuuuauuaccuggu

SEQ ID NO: 3624257 - RNA, 18 nt, Salmonella enterica enterica serovar Typhi
ggcauuuuuauuuaacgc

SEQ ID NO: 3624258 - RNA, 20 nt, Salmonella enterica enterica serovar Typhi
ggcauuuuuauuuaacgcca

SEQ ID NO: 3624259 - RNA, 20 nt, Salmonella enterica enterica serovar Typhi
ggccaaaacccaccagcagg

SEQ ID NO: 3624260 - RNA, 15 nt, Salmonella enterica enterica serovar Typhi
ggccaaacagcggcu

SEQ ID NO: 3624261 - RNA, 15 nt, Salmonella enterica enterica serovar Typhi
ggccaaccgccacaa

SEQ ID NO: 3624262 - RNA, 16 nt, Salmonella enterica enterica serovar Typhi
ggccaaccugccgaug

SEQ ID NO: 3624263 - RNA, 17 nt, Salmonella enterica enterica serovar Typhi
ggccaagcgccuguuca

SEQ ID NO: 3624264 - RNA, 13 nt, Salmonella enterica enterica serovar Typhi
ggccaauccugca

SEQ ID NO: 3624265 - RNA, 20 nt, Salmonella enterica enterica serovar Typhi
ggccaauguacguaaaacca

SEQ ID NO: 3624266 - RNA, 16 nt, Salmonella enterica enterica serovar Typhi
ggccaauuccgccaua

SEQ ID NO: 3624267 - RNA, 22 nt, Salmonella enterica enterica serovar Typhi
ggccacaauuguagcugcgcca

SEQ ID NO: 3624268 - RNA, 13 nt, Salmonella enterica enterica serovar Typhi
ggccacagcgcca

SEQ ID NO: 3624269 - RNA, 23 nt, Salmonella enterica enterica serovar Typhi
ggccacauugaaugccgaauggc

SEQ ID NO: 3624270 - RNA, 12 nt, Salmonella enterica enterica serovar Typhi
ggccaccacaua

SEQ ID NO: 3624271 - RNA, 17 nt, Salmonella enterica enterica serovar Typhi
ggccaccaggccugagc

SEQ ID NO: 3624272 - RNA, 12 nt, Salmonella enterica enterica serovar Typhi
ggccacccacca

SEQ ID NO: 3624273 - RNA, 22 nt, Salmonella enterica enterica serovar Typhi
ggccaccgaagaauuuaucaau

SEQ ID NO: 3624274 - RNA, 22 nt, Salmonella enterica enterica serovar Typhi
ggccaccgauaaaaagcaaaga

SEQ ID NO: 3624275 - RNA, 15 nt, Salmonella enterica enterica serovar Typhi
ggccacgccgccauc

SEQ ID NO: 3624276 - RNA, 23 nt, Salmonella enterica enterica serovar Typhi
ggccacgccgccauccggcauca

SEQ ID NO: 3624277 - RNA, 17 nt, Salmonella enterica enterica serovar Typhi
ggccacggagugcgcgg

SEQ ID NO: 3624278 - RNA, 18 nt, Salmonella enterica enterica serovar Typhi
ggccacggagugcgcggc

SEQ ID NO: 3624279 - RNA, 21 nt, Salmonella enterica enterica serovar Typhi
ggccacgguguggcccagcgc

SEQ ID NO: 3624280 - RNA, 20 nt, Salmonella enterica enterica serovar Typhi
ggccacugcccuggaagaac

SEQ ID NO: 3624281 - RNA, 20 nt, Salmonella enterica enterica serovar Typhi
ggccagaaaccggucgccgu

SEQ ID NO: 3624282 - RNA, 20 nt, Salmonella enterica enterica serovar Typhi
ggccagaaguagcagagaaa

SEQ ID NO: 3624283 - RNA, 20 nt, Salmonella enterica enterica serovar Typhi
ggccagauaaguuugcagau

SEQ ID NO: 3624284 - RNA, 22 nt, Salmonella enterica enterica serovar Typhi
ggccagauauugccgaccauua

SEQ ID NO: 3624285 - RNA, 15 nt, Salmonella enterica enterica serovar Typhi
ggccagaugcggcga

SEQ ID NO: 3624286 - RNA, 19 nt, Salmonella enterica enterica serovar Typhi
ggccagauggcaaacggua

SEQ ID NO: 3624287 - RNA, 11 nt, Salmonella enterica enterica serovar Typhi
ggccagcacaa

SEQ ID NO: 3624288 - RNA, 21 nt, Salmonella enterica enterica serovar Typhi
ggccagccgacgcucuuccuc

SEQ ID NO: 3624289 - RNA, 22 nt, Salmonella enterica enterica serovar Typhi
ggccagccguaacgagugagga

SEQ ID NO: 3624290 - RNA, 21 nt, Salmonella enterica enterica serovar Typhi
ggccagcgaaaaccagcgccg

SEQ ID NO: 3624291 - RNA, 14 nt, Salmonella enterica enterica serovar Typhi
ggccagcgcgcggc

SEQ ID NO: 3624292 - RNA, 17 nt, Salmonella enterica enterica serovar Typhi
ggccagcguaccugcgg

SEQ ID NO: 3624293 - RNA, 19 nt, Salmonella enterica enterica serovar Typhi
ggccagcguggaugaacuc

SEQ ID NO: 3624294 - RNA, 12 nt, Salmonella enterica enterica serovar Typhi
ggccagcuccgc

SEQ ID NO: 3624295 - RNA, 15 nt, Salmonella enterica enterica serovar Typhi
ggccaggcgaccguc

SEQ ID NO: 3624296 - RNA, 16 nt, Salmonella enterica enterica serovar Typhi
ggccagggacaggaga

SEQ ID NO: 3624297 - RNA, 19 nt, Salmonella enterica enterica serovar Typhi
ggccaguagcgggggccgg

SEQ ID NO: 3624298 - RNA, 15 nt, Salmonella enterica enterica serovar Typhi
ggccagucgcagaug

SEQ ID NO: 3624299 - RNA, 14 nt, Salmonella enterica enterica serovar Typhi
ggccagugccaagc

SEQ ID NO: 3624300 - RNA, 16 nt, Salmonella enterica enterica serovar Typhi
ggccagugccaagcaa

SEQ ID NO: 3624301 - RNA, 17 nt, Salmonella enterica enterica serovar Typhi
ggccaguuguucuuuca

SEQ ID NO: 3624302 - RNA, 18 nt, Salmonella enterica enterica serovar Typhi
ggccaguuguucuuucac

SEQ ID NO: 3624303 - RNA, 19 nt, Salmonella enterica enterica serovar Typhi
ggccaguuuccugacccgc

SEQ ID NO: 3624304 - RNA, 16 nt, Salmonella enterica enterica serovar Typhi
ggccaucauaccgcca

SEQ ID NO: 3624305 - RNA, 21 nt, Salmonella enterica enterica serovar Typhi
ggccaucgacgaaauggugug

SEQ ID NO: 3624306 - RNA, 15 nt, Salmonella enterica enterica serovar Typhi
ggccaucuggcguug

SEQ ID NO: 3624307 - RNA, 18 nt, Salmonella enterica enterica serovar Typhi
ggccaucuuccagcauca

SEQ ID NO: 3624308 - RNA, 21 nt, Salmonella enterica enterica serovar Typhi
ggccaucuuccagcaucagca

SEQ ID NO: 3624309 - RNA, 18 nt, Salmonella enterica enterica serovar Typhi
ggccaugaucgccgccau

SEQ ID NO: 3624310 - RNA, 19 nt, Salmonella enterica enterica serovar Typhi
ggccaugaucgccgccauc

SEQ ID NO: 3624311 - RNA, 13 nt, Salmonella enterica enterica serovar Typhi
ggcccaaacgaug

SEQ ID NO: 3624312 - RNA, 17 nt, Salmonella enterica enterica serovar Typhi
ggcccaguguacugcca

SEQ ID NO: 3624313 - RNA, 14 nt, Salmonella enterica enterica serovar Typhi
ggcccccuguucca

SEQ ID NO: 3624314 - RNA, 22 nt, Salmonella enterica enterica serovar Typhi
ggcccgauacgcggaucggcac

SEQ ID NO: 3624315 - RNA, 17 nt, Salmonella enterica enterica serovar Typhi
ggcccgccagcacagca

SEQ ID NO: 3624316 - RNA, 18 nt, Salmonella enterica enterica serovar Typhi
ggcccgccagcacagcaa

SEQ ID NO: 3624317 - RNA, 20 nt, Salmonella enterica enterica serovar Typhi
ggcgaaaaccgagcauccgc

SEQ ID NO: 3624318 - RNA, 12 nt, Salmonella enterica enterica serovar Typhi
ggcgaaaacgcu

SEQ ID NO: 3624319 - RNA, 19 nt, Salmonella enterica enterica serovar Typhi
ggcgaaaaucggcaggccg

SEQ ID NO: 3624320 - RNA, 13 nt, Salmonella enterica enterica serovar Typhi
ggcgaaagaaaau

SEQ ID NO: 3624321 - RNA, 15 nt, Salmonella enterica enterica serovar Typhi
ggcgaacaauaccgu

SEQ ID NO: 3624322 - RNA, 14 nt, Salmonella enterica enterica serovar Typhi
ggcgaacagcccca

SEQ ID NO: 3624323 - RNA, 22 nt, Salmonella enterica enterica serovar Typhi
ggcgaacagccccaccgccaga

SEQ ID NO: 3624324 - RNA, 14 nt, Salmonella enterica enterica serovar Typhi
ggcgaacagcccgc

SEQ ID NO: 3624325 - RNA, 14 nt, Salmonella enterica enterica serovar Typhi
ggcgaacaggcuca

SEQ ID NO: 3624326 - RNA, 16 nt, Salmonella enterica enterica serovar Typhi
ggcgaacgacucacgc

SEQ ID NO: 3624327 - RNA, 17 nt, Salmonella enterica enterica serovar Typhi
ggcgaacguuggcuggg

SEQ ID NO: 3624328 - RNA, 18 nt, Salmonella enterica enterica serovar Typhi
ggcgaacuucauccacgc

SEQ ID NO: 3624329 - RNA, 23 nt, Salmonella enterica enterica serovar Typhi
ggcgaagacugauuuaucaccca

SEQ ID NO: 3624330 - RNA, 15 nt, Salmonella enterica enterica serovar Typhi
ggcgaaggcggcggc

SEQ ID NO: 3624331 - RNA, 15 nt, Salmonella enterica enterica serovar Typhi
ggcgaauaaaauuca

SEQ ID NO: 3624332 - RNA, 16 nt, Salmonella enterica enterica serovar Typhi
ggcgaauccuaaacuc

SEQ ID NO: 3624333 - RNA, 16 nt, Salmonella enterica enterica serovar Typhi
ggcgaauuaaucgucg

SEQ ID NO: 3624334 - RNA, 18 nt, Salmonella enterica enterica serovar Typhi
ggcgaauuuacgggcgcg

SEQ ID NO: 3624335 - RNA, 17 nt, Salmonella enterica enterica serovar Typhi
ggcgacaaacagcgccc

SEQ ID NO: 3624336 - RNA, 14 nt, Salmonella enterica enterica serovar Typhi
ggcgacaaucucac

SEQ ID NO: 3624337 - RNA, 17 nt, Salmonella enterica enterica serovar Typhi
ggcgacacaacggcaca

SEQ ID NO: 3624338 - RNA, 13 nt, Salmonella enterica enterica serovar Typhi
ggcgacagccgcg

SEQ ID NO: 3624339 - RNA, 12 nt, Salmonella enterica enterica serovar Typhi
ggcgacaggcgc

SEQ ID NO: 3624340 - RNA, 21 nt, Salmonella enterica enterica serovar Typhi
ggcgacaggcgcuuaucgccg

SEQ ID NO: 3624341 - RNA, 20 nt, Salmonella enterica enterica serovar Typhi
ggcgacagggauauuccaua

SEQ ID NO: 3624342 - RNA, 13 nt, Salmonella enterica enterica serovar Typhi
ggcgacaucgcca

SEQ ID NO: 3624343 - RNA, 14 nt, Salmonella enterica enterica serovar Typhi
ggcgaccagcagau

SEQ ID NO: 3624344 - RNA, 20 nt, Salmonella enterica enterica serovar Typhi
ggcgaccaggaauuuaccgg

SEQ ID NO: 3624345 - RNA, 17 nt, Salmonella enterica enterica serovar Typhi
ggcgaccaguuauucgg

SEQ ID NO: 3624346 - RNA, 20 nt, Salmonella enterica enterica serovar Typhi
ggcgacgacgcuguuuaugc

SEQ ID NO: 3624347 - RNA, 16 nt, Salmonella enterica enterica serovar Typhi
ggcgacgauacaacuc

SEQ ID NO: 3624348 - RNA, 15 nt, Salmonella enterica enterica serovar Typhi
ggcgacgcuuucacc

SEQ ID NO: 3624349 - RNA, 18 nt, Salmonella enterica enterica serovar Typhi
ggcgacggcggucgccgc

SEQ ID NO: 3624350 - RNA, 22 nt, Salmonella enterica enterica serovar Typhi
ggcgacgguacaaaccccaccc

SEQ ID NO: 3624351 - RNA, 21 nt, Salmonella enterica enterica serovar Typhi
ggcgacuaacgucuuauccgg

SEQ ID NO: 3624352 - RNA, 23 nt, Salmonella enterica enterica serovar Typhi
ggcgacuaacgucuuauccggcc

SEQ ID NO: 3624353 - RNA, 19 nt, Salmonella enterica enterica serovar Typhi
ggcgacuaccucuuauccg

SEQ ID NO: 3624354 - RNA, 18 nt, Salmonella enterica enterica serovar Typhi
ggcgacuagucgcccgcu

SEQ ID NO: 3624355 - RNA, 14 nt, Salmonella enterica enterica serovar Typhi
ggcgacuuucacga

SEQ ID NO: 3624356 - RNA, 22 nt, Salmonella enterica enterica serovar Typhi
ggcgagaacucgucuuauccga

SEQ ID NO: 3624357 - RNA, 22 nt, Salmonella enterica enterica serovar Typhi
ggcgagagaauuaacagcgcga

SEQ ID NO: 3624358 - RNA, 22 nt, Salmonella enterica enterica serovar Typhi
ggcgagagcauugccugauucg

SEQ ID NO: 3624359 - RNA, 15 nt, Salmonella enterica enterica serovar Typhi
ggcgagcacugccca

SEQ ID NO: 3624360 - RNA, 23 nt, Salmonella enterica enterica serovar Typhi
ggcgagcggcaccggacauccca

SEQ ID NO: 3624361 - RNA, 16 nt, Salmonella enterica enterica serovar Typhi
ggcgagcuuuucgccg

SEQ ID NO: 3624362 - RNA, 15 nt, Salmonella enterica enterica serovar Typhi
ggcgaggcguaaaac

SEQ ID NO: 3624363 - RNA, 16 nt, Salmonella enterica enterica serovar Typhi
ggcgaggggcaggcgu

SEQ ID NO: 3624364 - RNA, 18 nt, Salmonella enterica enterica serovar Typhi
ggcgagguuuaccguccg

SEQ ID NO: 3624365 - RNA, 17 nt, Salmonella enterica enterica serovar Typhi
ggcgaguagcgcagcuu

SEQ ID NO: 3624366 - RNA, 22 nt, Salmonella enterica enterica serovar Typhi
ggcgaguuucugcucgaccguc

SEQ ID NO: 3624367 - RNA, 21 nt, Salmonella enterica enterica serovar Typhi
ggcgauaaaccaacagccgcc

SEQ ID NO: 3624368 - RNA, 22 nt, Salmonella enterica enterica serovar Typhi
ggcgauaaaccaacagccgccu

SEQ ID NO: 3624369 - RNA, 17 nt, Salmonella enterica enterica serovar Typhi
ggcgauaaaccagcccc

SEQ ID NO: 3624370 - RNA, 18 nt, Salmonella enterica enterica serovar Typhi
ggcgauaaaccagcccca

SEQ ID NO: 3624371 - RNA, 16 nt, Salmonella enterica enterica serovar Typhi
ggcgauaacccgcgca

SEQ ID NO: 3624372 - RNA, 21 nt, Salmonella enterica enterica serovar Typhi
ggcgauaaggucgcuauccag

SEQ ID NO: 3624373 - RNA, 12 nt, Salmonella enterica enterica serovar Typhi
ggcgauaaucuc

SEQ ID NO: 3624374 - RNA, 13 nt, Salmonella enterica enterica serovar Typhi
ggcgauaccagua

SEQ ID NO: 3624375 - RNA, 22 nt, Salmonella enterica enterica serovar Typhi
ggcgauaccgguacggaacguc

SEQ ID NO: 3624376 - RNA, 17 nt, Salmonella enterica enterica serovar Typhi
ggcgauacucugcccgc

SEQ ID NO: 3624377 - RNA, 21 nt, Salmonella enterica enterica serovar Typhi
ggcgauacugcuccgccggag

SEQ ID NO: 3624378 - RNA, 14 nt, Salmonella enterica enterica serovar Typhi
ggcgauagccccag

SEQ ID NO: 3624379 - RNA, 17 nt, Salmonella enterica enterica serovar Typhi
ggcgauagccccaguaa

SEQ ID NO: 3624380 - RNA, 16 nt, Salmonella enterica enterica serovar Typhi
ggcgauagugucgcca

SEQ ID NO: 3624381 - RNA, 16 nt, Salmonella enterica enterica serovar Typhi
ggcgaucagacgcugg

SEQ ID NO: 3624382 - RNA, 14 nt, Salmonella enterica enterica serovar Typhi
ggcgaucagcgcca

SEQ ID NO: 3624383 - RNA, 19 nt, Salmonella enterica enterica serovar Typhi
ggcgaucgcuaaucaggac

SEQ ID NO: 3624384 - RNA, 19 nt, Salmonella enterica enterica serovar Typhi
ggcgaugccuuauccggcc

SEQ ID NO: 3624385 - RNA, 16 nt, Salmonella enterica enterica serovar Typhi
ggcgauguucuugccg

SEQ ID NO: 3624386 - RNA, 19 nt, Salmonella enterica enterica serovar Typhi
ggcgauguucuugccgcca

SEQ ID NO: 3624387 - RNA, 15 nt, Salmonella enterica enterica serovar Typhi
ggcgauuaauacauc

SEQ ID NO: 3624388 - RNA, 21 nt, Salmonella enterica enterica serovar Typhi
ggcgauuacaacgcgaugguc

SEQ ID NO: 3624389 - RNA, 17 nt, Salmonella enterica enterica serovar Typhi
ggcgauucccgaucuuc

SEQ ID NO: 3624390 - RNA, 15 nt, Salmonella enterica enterica serovar Typhi
ggcgauuuccagcgc

SEQ ID NO: 3624391 - RNA, 17 nt, Salmonella enterica enterica serovar Typhi
ggcgauuuccagcgccg

SEQ ID NO: 3624392 - RNA, 21 nt, Salmonella enterica enterica serovar Typhi
ggcgauuuccagcgccgcgcg

SEQ ID NO: 3624393 - RNA, 15 nt, Salmonella enterica enterica serovar Typhi
ggcgauuugacgaac

SEQ ID NO: 3624394 - RNA, 18 nt, Salmonella enterica enterica serovar Typhi
ggcgauuuucagcaccuu

SEQ ID NO: 3624395 - RNA, 18 nt, Salmonella enterica enterica serovar Typhi
ggcgauuuucauagcugg

SEQ ID NO: 3624396 - RNA, 19 nt, Salmonella enterica enterica serovar Typhi
ggcgcaaacaguacgcccg

SEQ ID NO: 3624397 - RNA, 21 nt, Salmonella enterica enterica serovar Typhi
ggcgcaaagcaauguaaaacu

SEQ ID NO: 3624398 - RNA, 15 nt, Salmonella enterica enterica serovar Typhi
ggcgcaaaucgccau

SEQ ID NO: 3624399 - RNA, 16 nt, Salmonella enterica enterica serovar Typhi
ggcgcaaccgacgggc

SEQ ID NO: 3624400 - RNA, 15 nt, Salmonella enterica enterica serovar Typhi
ggcgcaauaacgaua

SEQ ID NO: 3624401 - RNA, 21 nt, Salmonella enterica enterica serovar Typhi
ggcgcaauccgcgccgcaucu

SEQ ID NO: 3624402 - RNA, 18 nt, Salmonella enterica enterica serovar Typhi
ggcgcacaauaccgagaa

SEQ ID NO: 3624403 - RNA, 23 nt, Salmonella enterica enterica serovar Typhi
ggcggcguaaacaccuuauccgg

SEQ ID NO: 3624404 - RNA, 23 nt, Salmonella enterica enterica serovar Typhi
ggcggcguaaacacguuaucuga

SEQ ID NO: 3624405 - RNA, 23 nt, Salmonella enterica enterica serovar Typhi
ggcggcgugaacgccuuauccgg

SEQ ID NO: 3624406 - RNA, 23 nt, Salmonella enterica enterica serovar Typhi
ggcggcgugaacgucuuauccgg

SEQ ID NO: 3624407 - RNA, 21 nt, Salmonella enterica enterica serovar Typhi
ggcggcuaacgccugauccgg

SEQ ID NO: 3624408 - RNA, 14 nt, Salmonella enterica enterica serovar Typhi
ggcggcuaccgccg

SEQ ID NO: 3624409 - RNA, 19 nt, Salmonella enterica enterica serovar Typhi
ggcggcuacgccuuauccg

SEQ ID NO: 3624410 - RNA, 20 nt, Salmonella enterica enterica serovar Typhi
ggcggcuggcgccuuaccgg

SEQ ID NO: 3624411 - RNA, 19 nt, Salmonella enterica enterica serovar Typhi
ggcggcuucgccuuauccg

SEQ ID NO: 3624412 - RNA, 16 nt, Salmonella enterica enterica serovar Typhi
ggcggcuuucagcgua

SEQ ID NO: 3624413 - RNA, 22 nt, Salmonella enterica enterica serovar Typhi
ggcgggauuuuaagcauccagg

SEQ ID NO: 3624414 - RNA, 14 nt, Salmonella enterica enterica serovar Typhi
ggcgggcagcagca

SEQ ID NO: 3624415 - RNA, 16 nt, Salmonella enterica enterica serovar Typhi
ggcggggcagaaccug

SEQ ID NO: 3624416 - RNA, 17 nt, Salmonella enterica enterica serovar Typhi
ggcgguaaucgcgcugu

SEQ ID NO: 3624417 - RNA, 16 nt, Salmonella enterica enterica serovar Typhi
ggcgguagcugcgcca

SEQ ID NO: 3624418 - RNA, 23 nt, Salmonella enterica enterica serovar Typhi
ggcgguauaacugccuuauccgg

SEQ ID NO: 3624419 - RNA, 14 nt, Salmonella enterica enterica serovar Typhi
ggcgguaugaaagc

SEQ ID NO: 3624420 - RNA, 14 nt, Salmonella enterica enterica serovar Typhi
ggcgguauuauccg

SEQ ID NO: 3624421 - RNA, 14 nt, Salmonella enterica enterica serovar Typhi
ggcggucaucgccc

SEQ ID NO: 3624422 - RNA, 15 nt, Salmonella enterica enterica serovar Typhi
ggcggucgggaacgc

SEQ ID NO: 3624423 - RNA, 20 nt, Salmonella enterica enterica serovar Typhi
ggcgguuaacagacccgcuu

SEQ ID NO: 3624424 - RNA, 20 nt, Salmonella enterica enterica serovar Typhi
ggcgguuauccgccagcgca

SEQ ID NO: 3624425 - RNA, 14 nt, Salmonella enterica enterica serovar Typhi
ggcguaaaucaggc

SEQ ID NO: 3624426 - RNA, 21 nt, Salmonella enterica enterica serovar Typhi
ggcguaaccgccauccggcga

SEQ ID NO: 3624427 - RNA, 16 nt, Salmonella enterica enterica serovar Typhi
ggcguaagaucgcggg

SEQ ID NO: 3624428 - RNA, 14 nt, Salmonella enterica enterica serovar Typhi
ggcguaagcgacau

SEQ ID NO: 3624429 - RNA, 18 nt, Salmonella enterica enterica serovar Typhi
ggcguacauugccggaug

SEQ ID NO: 3624430 - RNA, 12 nt, Salmonella enterica enterica serovar Typhi
ggcguaccgccg

SEQ ID NO: 3624431 - RNA, 17 nt, Salmonella enterica enterica serovar Typhi
ggcguagccgccgagcg

SEQ ID NO: 3624432 - RNA, 16 nt, Salmonella enterica enterica serovar Typhi
ggcguauagccaggca

SEQ ID NO: 3624433 - RNA, 19 nt, Salmonella enterica enterica serovar Typhi
ggcguauagccaggcagau

SEQ ID NO: 3624434 - RNA, 13 nt, Salmonella enterica enterica serovar Typhi
ggcguauagccgc

SEQ ID NO: 3624435 - RNA, 15 nt, Salmonella enterica enterica serovar Typhi
ggcguauucggcaua

SEQ ID NO: 3624436 - RNA, 14 nt, Salmonella enterica enterica serovar Typhi
ggcgucaaaauccc

SEQ ID NO: 3624437 - RNA, 20 nt, Salmonella enterica enterica serovar Typhi
ggcgucaccaccgcaggcag

SEQ ID NO: 3624438 - RNA, 22 nt, Salmonella enterica enterica serovar Typhi
ggcgucaccaccgcaggcagcg

SEQ ID NO: 3624439 - RNA, 19 nt, Salmonella enterica enterica serovar Typhi
ggcgucacguucgucgccg

SEQ ID NO: 3624440 - RNA, 17 nt, Salmonella enterica enterica serovar Typhi
ggcgucagcauggugug

SEQ ID NO: 3624441 - RNA, 22 nt, Salmonella enterica enterica serovar Typhi
ggcgucagcaugguguguuccc

SEQ ID NO: 3624442 - RNA, 22 nt, Salmonella enterica enterica serovar Typhi
ggcgucauagccgcgcgucagc

SEQ ID NO: 3624443 - RNA, 15 nt, Salmonella enterica enterica serovar Typhi
ggcgucauccugcag

SEQ ID NO: 3624444 - RNA, 16 nt, Salmonella enterica enterica serovar Typhi
ggcgucauccugcagg

SEQ ID NO: 3624445 - RNA, 23 nt, Salmonella enterica enterica serovar Typhi
ggcgucccuuucccuuccagcga

SEQ ID NO: 3624446 - RNA, 19 nt, Salmonella enterica enterica serovar Typhi
ggcgucgcggcaauagcga

SEQ ID NO: 3624447 - RNA, 22 nt, Salmonella enterica enterica serovar Typhi
ggcgucuaccuggguagcgcca

SEQ ID NO: 3624448 - RNA, 16 nt, Salmonella enterica enterica serovar Typhi
ggcgucuuaaugcucu

SEQ ID NO: 3624449 - RNA, 15 nt, Salmonella enterica enterica serovar Typhi
ggcgugaaccgguaa

SEQ ID NO: 3624450 - RNA, 22 nt, Salmonella enterica enterica serovar Typhi
ggcgugaccgccuuauccggcc

SEQ ID NO: 3624451 - RNA, 19 nt, Salmonella enterica enterica serovar Typhi
ggcgugauaaaacauucca

SEQ ID NO: 3624452 - RNA, 23 nt, Salmonella enterica enterica serovar Typhi
ggcgugauugagcagaucagcac

SEQ ID NO: 3624453 - RNA, 21 nt, Salmonella enterica enterica serovar Typhi
ggcgugccguccugugcuuug

SEQ ID NO: 3624454 - RNA, 19 nt, Salmonella enterica enterica serovar Typhi
ggcguggaaccgccggaga

SEQ ID NO: 3624455 - RNA, 22 nt, Salmonella enterica enterica serovar Typhi
ggcgugguggauauccagcaua

SEQ ID NO: 3624456 - RNA, 13 nt, Salmonella enterica enterica serovar Typhi
ggcguggugucuc

SEQ ID NO: 3624457 - RNA, 12 nt, Salmonella enterica enterica serovar Typhi
ggcguguaacug

SEQ ID NO: 3624458 - RNA, 21 nt, Salmonella enterica enterica serovar Typhi
ggcgugucaucaaaaucgggc

SEQ ID NO: 3624459 - RNA, 17 nt, Salmonella enterica enterica serovar Typhi
ggcgugucgccggggcg

SEQ ID NO: 3624460 - RNA, 13 nt, Salmonella enterica enterica serovar Typhi
ggcguguggcugu

SEQ ID NO: 3624461 - RNA, 13 nt, Salmonella enterica enterica serovar Typhi
ggcguguuucagc

SEQ ID NO: 3624462 - RNA, 17 nt, Salmonella enterica enterica serovar Typhi
ggcguuacagacgcugc

SEQ ID NO: 3624463 - RNA, 14 nt, Salmonella enterica enterica serovar Typhi
ggcguuacgcgcca

SEQ ID NO: 3624464 - RNA, 23 nt, Salmonella enterica enterica serovar Typhi
ggcguuacuccgcgguagagcgc

SEQ ID NO: 3624465 - RNA, 23 nt, Salmonella enterica enterica serovar Typhi
ggcguuacuggcgaccggcagcc

SEQ ID NO: 3624466 - RNA, 17 nt, Salmonella enterica enterica serovar Typhi
ggcguuaucuugacaug

SEQ ID NO: 3624467 - RNA, 12 nt, Salmonella enterica enterica serovar Typhi
ggcguuccgcac

SEQ ID NO: 3624468 - RNA, 13 nt, Salmonella enterica enterica serovar Typhi
ggcguuccgcaca

SEQ ID NO: 3624469 - RNA, 21 nt, Salmonella enterica enterica serovar Typhi
ggcguuccgcacauaaucacc

SEQ ID NO: 3624470 - RNA, 17 nt, Salmonella enterica enterica serovar Typhi
ggcguuccuuaucagca

SEQ ID NO: 3624471 - RNA, 19 nt, Salmonella enterica enterica serovar Typhi
ggcguucugcgccauuucc

SEQ ID NO: 3624472 - RNA, 21 nt, Salmonella enterica enterica serovar Typhi
ggcguugcgccgccaggcaug

SEQ ID NO: 3624473 - RNA, 20 nt, Salmonella enterica enterica serovar Typhi
ggcguuguaagguuaagccu

SEQ ID NO: 3624474 - RNA, 18 nt, Salmonella enterica enterica serovar Typhi
ggcguuucaacaaacuca

SEQ ID NO: 3624475 - RNA, 13 nt, Salmonella enterica enterica serovar Typhi
ggcuaagccagaa

SEQ ID NO: 3624476 - RNA, 17 nt, Salmonella enterica enterica serovar Typhi
ggcuaagccagaagaua

SEQ ID NO: 3624477 - RNA, 21 nt, Salmonella enterica enterica serovar Typhi
ggcuaauacgccagccgucau

SEQ ID NO: 3624478 - RNA, 17 nt, Salmonella enterica enterica serovar Typhi
ggcuaauaugccaggcu

SEQ ID NO: 3624479 - RNA, 13 nt, Salmonella enterica enterica serovar Typhi
ggcuaaucgccac

SEQ ID NO: 3624480 - RNA, 23 nt, Salmonella enterica enterica serovar Typhi
ggcuacagacaucuuugccaaac

SEQ ID NO: 3624481 - RNA, 13 nt, Salmonella enterica enterica serovar Typhi
ggcuacccagaca

SEQ ID NO: 3624482 - RNA, 20 nt, Salmonella enterica enterica serovar Typhi
ggcuacccagacaagcacau

SEQ ID NO: 3624483 - RNA, 12 nt, Salmonella enterica enterica serovar Typhi
ggcuacccauga

SEQ ID NO: 3624484 - RNA, 21 nt, Salmonella enterica enterica serovar Typhi
ggcuacguacacagucaaaca

SEQ ID NO: 3624485 - RNA, 13 nt, Salmonella enterica enterica serovar Typhi
ggcuauagcucag

SEQ ID NO: 3624486 - RNA, 15 nt, Salmonella enterica enterica serovar Typhi
ggcuaucaauguuua

SEQ ID NO: 3624487 - RNA, 19 nt, Salmonella enterica enterica serovar Typhi
ggcuaugaagagaaacaua

SEQ ID NO: 3624488 - RNA, 24 nt, Salmonella enterica enterica serovar Typhi
gggaagcacauccauguacuccug

SEQ ID NO: 3624489 - RNA, 14 nt, Salmonella enterica enterica serovar Typhi
gggaagcgcgcgca

SEQ ID NO: 3624490 - RNA, 16 nt, Salmonella enterica enterica serovar Typhi
gggaaguaaggcauga

SEQ ID NO: 3624491 - RNA, 22 nt, Salmonella enterica enterica serovar Typhi
gggaaguccuucuccuucgcca

SEQ ID NO: 3624492 - RNA, 23 nt, Salmonella enterica enterica serovar Typhi
gggaaguugcccuuaucuggaug

SEQ ID NO: 3624493 - RNA, 14 nt, Salmonella enterica enterica serovar Typhi
gggaauaagcgccc

SEQ ID NO: 3624494 - RNA, 15 nt, Salmonella enterica enterica serovar Typhi
gggaauaugauuuaa

SEQ ID NO: 3624495 - RNA, 12 nt, Salmonella enterica enterica serovar Typhi
gggacacucaag

SEQ ID NO: 3624496 - RNA, 15 nt, Salmonella enterica enterica serovar Typhi
gggacacugccggcu

SEQ ID NO: 3624497 - RNA, 23 nt, Salmonella enterica enterica serovar Typhi
gggacgaauuuccagcgggcgau

SEQ ID NO: 3624498 - RNA, 23 nt, Salmonella enterica enterica serovar Typhi
gggacguuucgauaaccaccagc

SEQ ID NO: 3624499 - RNA, 23 nt, Salmonella enterica enterica serovar Typhi
gggacuaucgaaagagcaaauac

SEQ ID NO: 3624500 - RNA, 15 nt, Salmonella enterica enterica serovar Typhi
gggacucaccguuac

SEQ ID NO: 3624501 - RNA, 12 nt, Salmonella enterica enterica serovar Typhi
gggacuggauga

SEQ ID NO: 3624502 - RNA, 17 nt, Salmonella enterica enterica serovar Typhi
gggagaaaacgcggccu

SEQ ID NO: 3624503 - RNA, 19 nt, Salmonella enterica enterica serovar Typhi
gggagaaaacgcggccugg

SEQ ID NO: 3624504 - RNA, 13 nt, Salmonella enterica enterica serovar Typhi
gggagaccgggcu

SEQ ID NO: 3624505 - RNA, 13 nt, Salmonella enterica enterica serovar Typhi
gggaggggcuuuc

SEQ ID NO: 3624506 - RNA, 20 nt, Salmonella enterica enterica serovar Typhi
gggaguacauuuacaauaau

SEQ ID NO: 3624507 - RNA, 23 nt, Salmonella enterica enterica serovar Typhi
gggaguaguguaauaccacugcc

SEQ ID NO: 3624508 - RNA, 21 nt, Salmonella enterica enterica serovar Typhi
gggaguaugcggucaaaagcu

SEQ ID NO: 3624509 - RNA, 19 nt, Salmonella enterica enterica serovar Typhi
gggauaacgauucccgccg

SEQ ID NO: 3624510 - RNA, 18 nt, Salmonella enterica enterica serovar Typhi
gggauaaugacauccaga

SEQ ID NO: 3624511 - RNA, 18 nt, Salmonella enterica enterica serovar Typhi
gggauaaugucgacgcgc

SEQ ID NO: 3624512 - RNA, 16 nt, Salmonella enterica enterica serovar Typhi
gggaucuucaaugaac

SEQ ID NO: 3624513 - RNA, 15 nt, Salmonella enterica enterica serovar Typhi
gggauuuccuggcag

SEQ ID NO: 3624514 - RNA, 19 nt, Salmonella enterica enterica serovar Typhi
gggauuuccuggcaguuca

SEQ ID NO: 3624515 - RNA, 21 nt, Salmonella enterica enterica serovar Typhi
gggauuucuucccuugccgcc

SEQ ID NO: 3624516 - RNA, 16 nt, Salmonella enterica enterica serovar Typhi
gggauuugaugcccaa

SEQ ID NO: 3624517 - RNA, 21 nt, Salmonella enterica enterica serovar Typhi
gggcaaaagggccauggcugg

SEQ ID NO: 3624518 - RNA, 23 nt, Salmonella enterica enterica serovar Typhi
gggcaacaaacauaagcaaaucc

SEQ ID NO: 3624519 - RNA, 13 nt, Salmonella enterica enterica serovar Typhi
gggcaacggccag

SEQ ID NO: 3624520 - RNA, 14 nt, Salmonella enterica enterica serovar Typhi
gggcaagccagcau

SEQ ID NO: 3624521 - RNA, 13 nt, Salmonella enterica enterica serovar Typhi
gggcaagcucagc

SEQ ID NO: 3624522 - RNA, 14 nt, Salmonella enterica enterica serovar Typhi
gggcaauccauuaa

SEQ ID NO: 3624523 - RNA, 23 nt, Salmonella enterica enterica serovar Typhi
gggcacgcugaccacgccgccgc

SEQ ID NO: 3624524 - RNA, 19 nt, Salmonella enterica enterica serovar Typhi
gggcacuccggcucgcaca

SEQ ID NO: 3624525 - RNA, 12 nt, Salmonella enterica enterica serovar Typhi
gggcagaaaaau

SEQ ID NO: 3624526 - RNA, 12 nt, Salmonella enterica enterica serovar Typhi
gggcagaaacgu

SEQ ID NO: 3624527 - RNA, 22 nt, Salmonella enterica enterica serovar Typhi
gggcagcaucucgauuacagcg

SEQ ID NO: 3624528 - RNA, 18 nt, Salmonella enterica enterica serovar Typhi
gggcaggcgucaaaacag

SEQ ID NO: 3624529 - RNA, 12 nt, Salmonella enterica enterica serovar Typhi
gggcaggcgugu

SEQ ID NO: 3624530 - RNA, 22 nt, Salmonella enterica enterica serovar Typhi
gggcaguaaauuaaacagcugu

SEQ ID NO: 3624531 - RNA, 15 nt, Salmonella enterica enterica serovar Typhi
gggcagugcucgcca

SEQ ID NO: 3624532 - RNA, 18 nt, Salmonella enterica enterica serovar Typhi
gggcaucccgucccacca

SEQ ID NO: 3624533 - RNA, 12 nt, Salmonella enterica enterica serovar Typhi
gggcauccgccg

SEQ ID NO: 3624534 - RNA, 23 nt, Salmonella enterica enterica serovar Typhi
gggccagaaguagcagagaaaag

SEQ ID NO: 3624535 - RNA, 15 nt, Salmonella enterica enterica serovar Typhi
gggccagauucuuag

SEQ ID NO: 3624536 - RNA, 14 nt, Salmonella enterica enterica serovar Typhi
gggccagcagccag

SEQ ID NO: 3624537 - RNA, 17 nt, Salmonella enterica enterica serovar Typhi
gggcccguggcccaggc

SEQ ID NO: 3624538 - RNA, 14 nt, Salmonella enterica enterica serovar Typhi
gggccgacaggcgg

SEQ ID NO: 3624539 - RNA, 10 nt, Salmonella enterica enterica serovar Typhi
gggccgccgc

SEQ ID NO: 3624540 - RNA, 17 nt, Salmonella enterica enterica serovar Typhi
gggccgcuagcugcagc

SEQ ID NO: 3624541 - RNA, 18 nt, Salmonella enterica enterica serovar Typhi
gggccggaagagcgcaga

SEQ ID NO: 3624542 - RNA, 23 nt, Salmonella enterica enterica serovar Typhi
gggccuacagguacagaugcugu

SEQ ID NO: 3624543 - RNA, 23 nt, Salmonella enterica enterica serovar Typhi
gggccuacgagauaaaaacgggu

SEQ ID NO: 3624544 - RNA, 21 nt, Salmonella enterica enterica serovar Typhi
gggccuacggauucgcugcug

SEQ ID NO: 3624545 - RNA, 14 nt, Salmonella enterica enterica serovar Typhi
gggcgaacuggcgg

SEQ ID NO: 3624546 - RNA, 23 nt, Salmonella enterica enterica serovar Typhi
gggcgagauguuuuaccaguaca

SEQ ID NO: 3624547 - RNA, 15 nt, Salmonella enterica enterica serovar Typhi
gggcgauaaaccagc

SEQ ID NO: 3624548 - RNA, 15 nt, Salmonella enterica enterica serovar Typhi
gggcgcacagcgcca

SEQ ID NO: 3624549 - RNA, 14 nt, Salmonella enterica enterica serovar Typhi
gggcgcagaagcua

SEQ ID NO: 3624550 - RNA, 12 nt, Salmonella enterica enterica serovar Typhi
gggcgcgcgccg

SEQ ID NO: 3624551 - RNA, 13 nt, Salmonella enterica enterica serovar Typhi
gggcgcggcgcaa

SEQ ID NO: 3624552 - RNA, 12 nt, Salmonella enterica enterica serovar Typhi
gggcgcggcugg

SEQ ID NO: 3624553 - RNA, 22 nt, Salmonella enterica enterica serovar Typhi
gggcggacaugcgcaucaauug

SEQ ID NO: 3624554 - RNA, 18 nt, Salmonella enterica enterica serovar Typhi
gggcggacgaugaaccug

SEQ ID NO: 3624555 - RNA, 15 nt, Salmonella enterica enterica serovar Typhi
gggcgggcagcagca

SEQ ID NO: 3624556 - RNA, 16 nt, Salmonella enterica enterica serovar Typhi
gggcguauagccaggc

SEQ ID NO: 3624557 - RNA, 17 nt, Salmonella enterica enterica serovar Typhi
gggcguauagccaggca

SEQ ID NO: 3624558 - RNA, 21 nt, Salmonella enterica enterica serovar Typhi
gggcgucaaaaucccggcugg

SEQ ID NO: 3624559 - RNA, 13 nt, Salmonella enterica enterica serovar Typhi
gggcgugucccug

SEQ ID NO: 3624560 - RNA, 19 nt, Salmonella enterica enterica serovar Typhi
gggcuaaaugcccacggcg

SEQ ID NO: 3624561 - RNA, 21 nt, Salmonella enterica enterica serovar Typhi
gggcuaaucgcaaacugcgcg

SEQ ID NO: 3624562 - RNA, 13 nt, Salmonella enterica enterica serovar Typhi
gggcuaugaagag

SEQ ID NO: 3624563 - RNA, 17 nt, Salmonella enterica enterica serovar Typhi
gggcuaugcuccaguug

SEQ ID NO: 3624564 - RNA, 22 nt, Salmonella enterica enterica serovar Typhi
gggcucauuuuauccaacagcg

SEQ ID NO: 3624565 - RNA, 15 nt, Salmonella enterica enterica serovar Typhi
gggcuuaaugcgcac

SEQ ID NO: 3624566 - RNA, 19 nt, Salmonella enterica enterica serovar Typhi
gggcuuauccccauucugc

SEQ ID NO: 3624567 - RNA, 15 nt, Salmonella enterica enterica serovar Typhi
gggcuuuuagccgcg

SEQ ID NO: 3624568 - RNA, 23 nt, Salmonella enterica enterica serovar Typhi
gggcuuuugagucgcauccagug

SEQ ID NO: 3624569 - RNA, 23 nt, Salmonella enterica enterica serovar Typhi
ggggaacacuaaaacaccgguug

SEQ ID NO: 3624570 - RNA, 22 nt, Salmonella enterica enterica serovar Typhi
ggggaacggcagacagccgcgg

SEQ ID NO: 3624571 - RNA, 16 nt, Salmonella enterica enterica serovar Typhi
ggggauaaccagaaaa

SEQ ID NO: 3624572 - RNA, 15 nt, Salmonella enterica enterica serovar Typhi
ggggauucugccauc

SEQ ID NO: 3624573 - RNA, 13 nt, Salmonella enterica enterica serovar Typhi
ggggcaguaaauu

SEQ ID NO: 3624574 - RNA, 16 nt, Salmonella enterica enterica serovar Typhi
gguacucuuccagcug

SEQ ID NO: 3624575 - RNA, 22 nt, Salmonella enterica enterica serovar Typhi
gguacuuuucauccacagcgcc

SEQ ID NO: 3624576 - RNA, 23 nt, Salmonella enterica enterica serovar Typhi
gguacuuuucauccacagcgcca

SEQ ID NO: 3624577 - RNA, 20 nt, Salmonella enterica enterica serovar Typhi
gguagacccggcauugaaac

SEQ ID NO: 3624578 - RNA, 22 nt, Salmonella enterica enterica serovar Typhi
gguagacgcgcuagcuucaggu

SEQ ID NO: 3624579 - RNA, 14 nt, Salmonella enterica enterica serovar Typhi
gguagcagaccggu

SEQ ID NO: 3624580 - RNA, 13 nt, Salmonella enterica enterica serovar Typhi
gguagccacagau

SEQ ID NO: 3624581 - RNA, 22 nt, Salmonella enterica enterica serovar Typhi
gguagcccggacaaggcgcgcc

SEQ ID NO: 3624582 - RNA, 18 nt, Salmonella enterica enterica serovar Typhi
gguagcccggcaggcugg

SEQ ID NO: 3624583 - RNA, 14 nt, Salmonella enterica enterica serovar Typhi
gguagccgacggcc

SEQ ID NO: 3624584 - RNA, 18 nt, Salmonella enterica enterica serovar Typhi
gguagcgguuucgccuua

SEQ ID NO: 3624585 - RNA, 24 nt, Salmonella enterica enterica serovar Typhi
gguagcuccagacaggacgccagc

SEQ ID NO: 3624586 - RNA, 22 nt, Salmonella enterica enterica serovar Typhi
gguaggguugccagaggcagca

SEQ ID NO: 3624587 - RNA, 19 nt, Salmonella enterica enterica serovar Typhi
gguagucacggagagucgc

SEQ ID NO: 3624588 - RNA, 21 nt, Salmonella enterica enterica serovar Typhi
gguagucacggagagucgcac

SEQ ID NO: 3624589 - RNA, 12 nt, Salmonella enterica enterica serovar Typhi
gguagucaucgc

SEQ ID NO: 3624590 - RNA, 15 nt, Salmonella enterica enterica serovar Typhi
gguaguccaaauaag

SEQ ID NO: 3624591 - RNA, 16 nt, Salmonella enterica enterica serovar Typhi
gguaguguuaucgccg

SEQ ID NO: 3624592 - RNA, 23 nt, Salmonella enterica enterica serovar Typhi
gguauaaauuuccgcagccagaa

SEQ ID NO: 3624593 - RNA, 19 nt, Salmonella enterica enterica serovar Typhi
gguauagaauacuuccugc

SEQ ID NO: 3624594 - RNA, 21 nt, Salmonella enterica enterica serovar Typhi
gguauauaaaucaaaagugca

SEQ ID NO: 3624595 - RNA, 14 nt, Salmonella enterica enterica serovar Typhi
gguaucagcgcguu

SEQ ID NO: 3624596 - RNA, 12 nt, Salmonella enterica enterica serovar Typhi
gguauccagcgc

SEQ ID NO: 3624597 - RNA, 14 nt, Salmonella enterica enterica serovar Typhi
gguaucccgccagc

SEQ ID NO: 3624598 - RNA, 14 nt, Salmonella enterica enterica serovar Typhi
gguauccuccugcc

SEQ ID NO: 3624599 - RNA, 14 nt, Salmonella enterica enterica serovar Typhi
gguauccugaacca

SEQ ID NO: 3624600 - RNA, 18 nt, Salmonella enterica enterica serovar Typhi
gguaucuaacccgcucag

SEQ ID NO: 3624601 - RNA, 22 nt, Salmonella enterica enterica serovar Typhi
gguaucugggcggcaaaauuga

SEQ ID NO: 3624602 - RNA, 19 nt, Salmonella enterica enterica serovar Typhi
gguaugaacgccggcggcg

SEQ ID NO: 3624603 - RNA, 19 nt, Salmonella enterica enterica serovar Typhi
gguaugccuuccagaaaua

SEQ ID NO: 3624604 - RNA, 18 nt, Salmonella enterica enterica serovar Typhi
gguauguuccuggauaga

SEQ ID NO: 3624605 - RNA, 14 nt, Salmonella enterica enterica serovar Typhi
gguauuacaugccg

SEQ ID NO: 3624606 - RNA, 23 nt, Salmonella enterica enterica serovar Typhi
gguauuacaugccguuaauaaug

SEQ ID NO: 3624607 - RNA, 23 nt, Salmonella enterica enterica serovar Typhi
gguauucaacgccaucuuccuca

SEQ ID NO: 3624608 - RNA, 20 nt, Salmonella enterica enterica serovar Typhi
ggucaaaaaagcgacgcugu

SEQ ID NO: 3624609 - RNA, 14 nt, Salmonella enterica enterica serovar Typhi
ggucaaaagcugca

SEQ ID NO: 3624610 - RNA, 15 nt, Salmonella enterica enterica serovar Typhi
ggucaaacaccugaa

SEQ ID NO: 3624611 - RNA, 18 nt, Salmonella enterica enterica serovar Typhi
ggucaaacaccugaacca

SEQ ID NO: 3624612 - RNA, 19 nt, Salmonella enterica enterica serovar Typhi
ggucaauaagauauccugc

SEQ ID NO: 3624613 - RNA, 13 nt, Salmonella enterica enterica serovar Typhi
ggucaaucaucag

SEQ ID NO: 3624614 - RNA, 22 nt, Salmonella enterica enterica serovar Typhi
ggucacaaaggccagcagcagc

SEQ ID NO: 3624615 - RNA, 15 nt, Salmonella enterica enterica serovar Typhi
ggucaccugaaaaug

SEQ ID NO: 3624616 - RNA, 19 nt, Salmonella enterica enterica serovar Typhi
ggucacgcgaucguagcga

SEQ ID NO: 3624617 - RNA, 19 nt, Salmonella enterica enterica serovar Typhi
ggucagcaacgccuccagc

SEQ ID NO: 3624618 - RNA, 17 nt, Salmonella enterica enterica serovar Typhi
ggucagcauuucaucca

SEQ ID NO: 3624619 - RNA, 14 nt, Salmonella enterica enterica serovar Typhi
ggucagcggcgcgc

SEQ ID NO: 3624620 - RNA, 20 nt, Salmonella enterica enterica serovar Typhi
ggucagcucacgcgccagca

SEQ ID NO: 3624621 - RNA, 22 nt, Salmonella enterica enterica serovar Typhi
ggucaggaacugcggccagaca

SEQ ID NO: 3624622 - RNA, 22 nt, Salmonella enterica enterica serovar Typhi
ggucagggugaauaccagcggc

SEQ ID NO: 3624623 - RNA, 21 nt, Salmonella enterica enterica serovar Typhi
ggucagggugaaucccgccau

SEQ ID NO: 3624624 - RNA, 23 nt, Salmonella enterica enterica serovar Typhi
ggucaguacgcgcguauccgccg

SEQ ID NO: 3624625 - RNA, 23 nt, Salmonella enterica enterica serovar Typhi
ggucaguaggcgaacuucaucca

SEQ ID NO: 3624626 - RNA, 20 nt, Salmonella enterica enterica serovar Typhi
ggucauauugccgauaggga

SEQ ID NO: 3624627 - RNA, 19 nt, Salmonella enterica enterica serovar Typhi
ggucauccgcccggcauca

SEQ ID NO: 3624628 - RNA, 21 nt, Salmonella enterica enterica serovar Typhi
ggucaucgaaggcaucuucag

SEQ ID NO: 3624629 - RNA, 13 nt, Salmonella enterica enterica serovar Typhi
ggucaucugguca

SEQ ID NO: 3624630 - RNA, 17 nt, Salmonella enterica enterica serovar Typhi
ggucauuauucaggccu

SEQ ID NO: 3624631 - RNA, 19 nt, Salmonella enterica enterica serovar Typhi
gguccggcgcuaaccagcg

SEQ ID NO: 3624632 - RNA, 21 nt, Salmonella enterica enterica serovar Typhi
gguccggcgcuaaccagcgcu

SEQ ID NO: 3624633 - RNA, 19 nt, Salmonella enterica enterica serovar Typhi
ggucgacagccacacgcca

SEQ ID NO: 3624634 - RNA, 17 nt, Salmonella enterica enterica serovar Typhi
ggucgaccaccugcugu

SEQ ID NO: 3624635 - RNA, 21 nt, Salmonella enterica enterica serovar Typhi
ggucgacguuguccggcgacc

SEQ ID NO: 3624636 - RNA, 21 nt, Salmonella enterica enterica serovar Typhi
ggucgagcuuuugcugcgcca

SEQ ID NO: 3624637 - RNA, 18 nt, Salmonella enterica enterica serovar Typhi
ggucgcgacggccagcau

SEQ ID NO: 3624638 - RNA, 22 nt, Salmonella enterica enterica serovar Typhi
ggucgcgccaaaagaggcagca

SEQ ID NO: 3624639 - RNA, 19 nt, Salmonella enterica enterica serovar Typhi
ggucgcuaacccaggccgg

SEQ ID NO: 3624640 - RNA, 16 nt, Salmonella enterica enterica serovar Typhi
ggucgcuauccagcag

SEQ ID NO: 3624641 - RNA, 23 nt, Salmonella enterica enterica serovar Typhi
ggucgcuuuuugcgccagcgcca

SEQ ID NO: 3624642 - RNA, 18 nt, Salmonella enterica enterica serovar Typhi
ggucggcgcaguucgccg

SEQ ID NO: 3624643 - RNA, 22 nt, Salmonella enterica enterica serovar Typhi
ggucggcguugcgcccaggcca

SEQ ID NO: 3624644 - RNA, 16 nt, Salmonella enterica enterica serovar Typhi
ggucgggcaggcuucc

SEQ ID NO: 3624645 - RNA, 19 nt, Salmonella enterica enterica serovar Typhi
ggucguacuaaagagcgcc

SEQ ID NO: 3624646 - RNA, 20 nt, Salmonella enterica enterica serovar Typhi
ggucguacuaaagagcgccu

SEQ ID NO: 3624647 - RNA, 21 nt, Salmonella enterica enterica serovar Typhi
ggucguacuaaagagcgccug

SEQ ID NO: 3624648 - RNA, 16 nt, Salmonella enterica enterica serovar Typhi
ggucgucugaaagcga

SEQ ID NO: 3624649 - RNA, 22 nt, Salmonella enterica enterica serovar Typhi
ggucgucuggaguacgggcaga

SEQ ID NO: 3624650 - RNA, 15 nt, Salmonella enterica enterica serovar Typhi
ggucgucuucuugcg

SEQ ID NO: 3624651 - RNA, 19 nt, Salmonella enterica enterica serovar Typhi
ggucuaaguugaccacauc

SEQ ID NO: 3624652 - RNA, 19 nt, Salmonella enterica enterica serovar Typhi
ggucucauagcgccccagu

SEQ ID NO: 3624653 - RNA, 17 nt, Salmonella enterica enterica serovar Typhi
ggucuccaucagacguu

SEQ ID NO: 3624654 - RNA, 23 nt, Salmonella enterica enterica serovar Typhi
ggucucucgugcaggccggauaa

SEQ ID NO: 3624655 - RNA, 18 nt, Salmonella enterica enterica serovar Typhi
ggucugccaguagcggaa

SEQ ID NO: 3624656 - RNA, 20 nt, Salmonella enterica enterica serovar Typhi
ggucugcuucagccacuggc

SEQ ID NO: 3624657 - RNA, 20 nt, Salmonella enterica enterica serovar Typhi
ggucuguaugacaacauaaa

SEQ ID NO: 3624658 - RNA, 14 nt, Salmonella enterica enterica serovar Typhi
gguuccauuccaga

SEQ ID NO: 3624659 - RNA, 14 nt, Salmonella enterica enterica serovar Typhi
gguucccaccgcau

SEQ ID NO: 3624660 - RNA, 23 nt, Salmonella enterica enterica serovar Typhi
gguucccgagcggccaaagggag

SEQ ID NO: 3624661 - RNA, 17 nt, Salmonella enterica enterica serovar Typhi
gguucgccucccucacc

SEQ ID NO: 3624662 - RNA, 22 nt, Salmonella enterica enterica serovar Typhi
gguucguacccgcaggccuggc

SEQ ID NO: 3624663 - RNA, 17 nt, Salmonella enterica enterica serovar Typhi
gguucucugccaucauc

SEQ ID NO: 3624664 - RNA, 18 nt, Salmonella enterica enterica serovar Typhi
gguucucugccaucaucc

SEQ ID NO: 3624665 - RNA, 13 nt, Salmonella enterica enterica serovar Typhi
gguucugccagaa

SEQ ID NO: 3624666 - RNA, 20 nt, Salmonella enterica enterica serovar Typhi
gguucugcgaggugauagcc

SEQ ID NO: 3624667 - RNA, 20 nt, Salmonella enterica enterica serovar Typhi
gguugaaggucugacaacua

SEQ ID NO: 3624668 - RNA, 16 nt, Salmonella enterica enterica serovar Typhi
gguugacggcuacccc

SEQ ID NO: 3624669 - RNA, 22 nt, Salmonella enterica enterica serovar Typhi
gguugauaccggaggagugcgc

SEQ ID NO: 3624670 - RNA, 18 nt, Salmonella enterica enterica serovar Typhi
gguugccagaggcagcac

SEQ ID NO: 3624671 - RNA, 22 nt, Salmonella enterica enterica serovar Typhi
gguugcccgguggcgcugcgcu

SEQ ID NO: 3624672 - RNA, 14 nt, Salmonella enterica enterica serovar Typhi
gguugccgcaaaug

SEQ ID NO: 3624673 - RNA, 13 nt, Salmonella enterica enterica serovar Typhi
gguugccgcauaa

SEQ ID NO: 3624674 - RNA, 17 nt, Salmonella enterica enterica serovar Typhi
gguugcgaauaaacaca

SEQ ID NO: 3624675 - RNA, 20 nt, Salmonella enterica enterica serovar Typhi
gguugcgcccuuccgucagc

SEQ ID NO: 3624676 - RNA, 17 nt, Salmonella enterica enterica serovar Typhi
gguugcgcgcuggauca

SEQ ID NO: 3624677 - RNA, 17 nt, Salmonella enterica enterica serovar Typhi
gguugcuucuguccuuu

SEQ ID NO: 3624678 - RNA, 20 nt, Salmonella enterica enterica serovar Typhi
gguuggaauaauuuucgcaa

SEQ ID NO: 3624679 - RNA, 18 nt, Salmonella enterica enterica serovar Typhi
gguuggcuauacgcggcg

SEQ ID NO: 3624680 - RNA, 22 nt, Salmonella enterica enterica serovar Typhi
gguuggucacaaaggccagcag

SEQ ID NO: 3624681 - RNA, 20 nt, Salmonella enterica enterica serovar Typhi
gguuguaucauguuccggca

SEQ ID NO: 3624682 - RNA, 22 nt, Salmonella enterica enterica serovar Typhi
gguugucuuaccuaacggauaa

SEQ ID NO: 3624683 - RNA, 14 nt, Salmonella enterica enterica serovar Typhi
gguugugccaguaa

SEQ ID NO: 3624684 - RNA, 21 nt, Salmonella enterica enterica serovar Typhi
gguuuauccgcagauccagca

SEQ ID NO: 3624685 - RNA, 22 nt, Salmonella enterica enterica serovar Typhi
gguuucaauauagccguggcug

SEQ ID NO: 3624686 - RNA, 22 nt, Salmonella enterica enterica serovar Typhi
gguuucagcaccuccagcgccu

SEQ ID NO: 3624687 - RNA, 19 nt, Salmonella enterica enterica serovar Typhi
gguuucccugccucaacau

SEQ ID NO: 3624688 - RNA, 18 nt, Salmonella enterica enterica serovar Typhi
gguuucgccuaagcccac

SEQ ID NO: 3624689 - RNA, 19 nt, Salmonella enterica enterica serovar Typhi
gguuucguggcgcuguucu

SEQ ID NO: 3624690 - RNA, 14 nt, Salmonella enterica enterica serovar Typhi
gguuucuccagccu

SEQ ID NO: 3624691 - RNA, 14 nt, Salmonella enterica enterica serovar Typhi
gguuucuucgcugg

SEQ ID NO: 3624692 - RNA, 11 nt, Salmonella enterica enterica serovar Typhi
gguuucuuuuu

SEQ ID NO: 3624693 - RNA, 23 nt, Salmonella enterica enterica serovar Typhi
gguuugacccauuuuaaaaguua

SEQ ID NO: 3624694 - RNA, 17 nt, Salmonella enterica enterica serovar Typhi
gguuugagcaccacgcg

SEQ ID NO: 3624695 - RNA, 18 nt, Salmonella enterica enterica serovar Typhi
gguuugcaggccggauaa

SEQ ID NO: 3624696 - RNA, 17 nt, Salmonella enterica enterica serovar Typhi
gguuugcauugccauga

SEQ ID NO: 3624697 - RNA, 17 nt, Salmonella enterica enterica serovar Typhi
gguuugccagcaccagc

SEQ ID NO: 3624698 - RNA, 22 nt, Salmonella enterica enterica serovar Typhi
gguuugccgcauacaucgcaga

SEQ ID NO: 3624699 - RNA, 23 nt, Salmonella enterica enterica serovar Typhi
gguuugucgcuuuucacggucaa

SEQ ID NO: 3624700 - RNA, 20 nt, Salmonella enterica enterica serovar Typhi
gguuugugucguaguggcau

SEQ ID NO: 3624701 - RNA, 18 nt, Salmonella enterica enterica serovar Typhi
gguuuuaugcaucgcggu

SEQ ID NO: 3624702 - RNA, 18 nt, Salmonella enterica enterica serovar Typhi
gguuuucauccacccugg

SEQ ID NO: 3624703 - RNA, 16 nt, Salmonella enterica enterica serovar Typhi
gguuuuuaagcugccc

SEQ ID NO: 3624704 - RNA, 15 nt, Salmonella enterica enterica serovar Typhi
gguuuuuauggaagg

SEQ ID NO: 3624705 - RNA, 22 nt, Salmonella enterica enterica serovar Typhi
gguuuuucgccgaccauccaga

SEQ ID NO: 3624706 - RNA, 12 nt, Salmonella enterica enterica serovar Typhi
gguuuuuuaaug

SEQ ID NO: 3624707 - RNA, 13 nt, Salmonella enterica enterica serovar Typhi
guaaaaaaaccgu

SEQ ID NO: 3624708 - RNA, 22 nt, Salmonella enterica enterica serovar Typhi
guaaaaaaaccguaucacugua

SEQ ID NO: 3624709 - RNA, 13 nt, Salmonella enterica enterica serovar Typhi
guaaaaaaauaaa

SEQ ID NO: 3624710 - RNA, 16 nt, Salmonella enterica enterica serovar Typhi
guaaaaacccuuucau

SEQ ID NO: 3624711 - RNA, 18 nt, Salmonella enterica enterica serovar Typhi
guaaaaauuguuccugua

SEQ ID NO: 3624712 - RNA, 21 nt, Salmonella enterica enterica serovar Typhi
guaaaaauuuuugaucugcuu

SEQ ID NO: 3624713 - RNA, 20 nt, Salmonella enterica enterica serovar Typhi
guaaaacacgccuccauaca

SEQ ID NO: 3624714 - RNA, 22 nt, Salmonella enterica enterica serovar Typhi
guaaaacgccaagaaugaaaca

SEQ ID NO: 3624715 - RNA, 17 nt, Salmonella enterica enterica serovar Typhi
guaaaauccggcaggca

SEQ ID NO: 3624716 - RNA, 17 nt, Salmonella enterica enterica serovar Typhi
guaaaauccuuuuucau

SEQ ID NO: 3624717 - RNA, 15 nt, Salmonella enterica enterica serovar Typhi
guaaaaugcuggugc

SEQ ID NO: 3624718 - RNA, 16 nt, Salmonella enterica enterica serovar Typhi
guaaaauggacuuccg

SEQ ID NO: 3624719 - RNA, 13 nt, Salmonella enterica enterica serovar Typhi
guaaacaccaccg

SEQ ID NO: 3624720 - RNA, 19 nt, Salmonella enterica enterica serovar Typhi
guaaacaccuuauccggcc

SEQ ID NO: 3624721 - RNA, 18 nt, Salmonella enterica enterica serovar Typhi
guaaacacgacgcugcca

SEQ ID NO: 3624722 - RNA, 15 nt, Salmonella enterica enterica serovar Typhi
guaaacaggcaggcc

SEQ ID NO: 3624723 - RNA, 16 nt, Salmonella enterica enterica serovar Typhi
guaaaccauuucuccu

SEQ ID NO: 3624724 - RNA, 17 nt, Salmonella enterica enterica serovar Typhi
guaaaccggucucuuaa

SEQ ID NO: 3624725 - RNA, 23 nt, Salmonella enterica enterica serovar Typhi
guaaaccucaaggcucagcagag

SEQ ID NO: 3624726 - RNA, 22 nt, Salmonella enterica enterica serovar Typhi
guaaacgcaacaccaucccgcu

SEQ ID NO: 3624727 - RNA, 15 nt, Salmonella enterica enterica serovar Typhi
guaaacgcgaccagc

SEQ ID NO: 3624728 - RNA, 16 nt, Salmonella enterica enterica serovar Typhi
guaaacgugccacagu

SEQ ID NO: 3624729 - RNA, 23 nt, Salmonella enterica enterica serovar Typhi
guaaacgugcuggauggcagaca

SEQ ID NO: 3624730 - RNA, 19 nt, Salmonella enterica enterica serovar Typhi
guaaagaaauuuaaagaua

SEQ ID NO: 3624731 - RNA, 13 nt, Salmonella enterica enterica serovar Typhi
guaaagaucuggc

SEQ ID NO: 3624732 - RNA, 23 nt, Salmonella enterica enterica serovar Typhi
guaaagauuaauaauugagcgca

SEQ ID NO: 3624733 - RNA, 18 nt, Salmonella enterica enterica serovar Typhi
guaaagcagugcaguauu

SEQ ID NO: 3624734 - RNA, 11 nt, Salmonella enterica enterica serovar Typhi
guaaagcgcca

SEQ ID NO: 3624735 - RNA, 12 nt, Salmonella enterica enterica serovar Typhi
guaaagcgccau

SEQ ID NO: 3624736 - RNA, 16 nt, Salmonella enterica enterica serovar Typhi
guaaaggucgccgcau

SEQ ID NO: 3624737 - RNA, 16 nt, Salmonella enterica enterica serovar Typhi
guaaaguuauucacgu

SEQ ID NO: 3624738 - RNA, 17 nt, Salmonella enterica enterica serovar Typhi
guaaauaaucgacgaua

SEQ ID NO: 3624739 - RNA, 13 nt, Salmonella enterica enterica serovar Typhi
guaaauacccagg

SEQ ID NO: 3624740 - RNA, 15 nt, Salmonella enterica enterica serovar Typhi
guaaauagaaaauaa

SEQ ID NO: 3624741 - RNA, 17 nt, Salmonella enterica enterica serovar Typhi
guaaauagagaaaucaa

SEQ ID NO: 3624742 - RNA, 18 nt, Salmonella enterica enterica serovar Typhi
guaaauagagaaaucaac

SEQ ID NO: 3624743 - RNA, 16 nt, Salmonella enterica enterica serovar Typhi
gcuauauuccagccag

SEQ ID NO: 3624744 - RNA, 14 nt, Salmonella enterica enterica serovar Typhi
gcuauauugcugcg

SEQ ID NO: 3624745 - RNA, 15 nt, Salmonella enterica enterica serovar Typhi
gcuauauuuauaaaa

SEQ ID NO: 3624746 - RNA, 23 nt, Salmonella enterica enterica serovar Typhi
gcuaucaacgccuccaggcuacc

SEQ ID NO: 3624747 - RNA, 20 nt, Salmonella enterica enterica serovar Typhi
gcuaucaauaccgcuaauac

SEQ ID NO: 3624748 - RNA, 20 nt, Salmonella enterica enterica serovar Typhi
gcuaucacacauaucgccag

SEQ ID NO: 3624749 - RNA, 16 nt, Salmonella enterica enterica serovar Typhi
gcuaucaggcacugaa

SEQ ID NO: 3624750 - RNA, 19 nt, Salmonella enterica enterica serovar Typhi
gcuauccagcaguaaauaa

SEQ ID NO: 3624751 - RNA, 20 nt, Salmonella enterica enterica serovar Typhi
gcuauccaucgccgcgccgu

SEQ ID NO: 3624752 - RNA, 20 nt, Salmonella enterica enterica serovar Typhi
gcuaucccaggcggagaaau

SEQ ID NO: 3624753 - RNA, 12 nt, Salmonella enterica enterica serovar Typhi
gcuauccccauu

SEQ ID NO: 3624754 - RNA, 16 nt, Salmonella enterica enterica serovar Typhi
gcuauccgccgccagc

SEQ ID NO: 3624755 - RNA, 16 nt, Salmonella enterica enterica serovar Typhi
gcuauccggcaucaca

SEQ ID NO: 3624756 - RNA, 16 nt, Salmonella enterica enterica serovar Typhi
gcuauccggcgcgcug

SEQ ID NO: 3624757 - RNA, 19 nt, Salmonella enterica enterica serovar Typhi
gcuauccggcgcgcuggug

SEQ ID NO: 3624758 - RNA, 23 nt, Salmonella enterica enterica serovar Typhi
gcuaucgcccaaauaguccagca

SEQ ID NO: 3624759 - RNA, 21 nt, Salmonella enterica enterica serovar Typhi
gcuaucgcgccggacagcagc

SEQ ID NO: 3624760 - RNA, 14 nt, Salmonella enterica enterica serovar Typhi
gcuaucgcggauaa

SEQ ID NO: 3624761 - RNA, 22 nt, Salmonella enterica enterica serovar Typhi
gcuaucggcgggguuuaacgag

SEQ ID NO: 3624762 - RNA, 19 nt, Salmonella enterica enterica serovar Typhi
gcuaucguugcgcgcaauc

SEQ ID NO: 3624763 - RNA, 22 nt, Salmonella enterica enterica serovar Typhi
gcuaucucuuccagcgucucca

SEQ ID NO: 3624764 - RNA, 18 nt, Salmonella enterica enterica serovar Typhi
gcuaucugcuccgccagc

SEQ ID NO: 3624765 - RNA, 18 nt, Salmonella enterica enterica serovar Typhi
gcuaucuuuaugucagua

SEQ ID NO: 3624766 - RNA, 11 nt, Salmonella enterica enterica serovar Typhi
gcuaugaagac

SEQ ID NO: 3624767 - RNA, 22 nt, Salmonella enterica enterica serovar Typhi
gcuaugaagaccugcuucaggu

SEQ ID NO: 3624768 - RNA, 21 nt, Salmonella enterica enterica serovar Typhi
gcuaugauggccgacuggcac

SEQ ID NO: 3624769 - RNA, 14 nt, Salmonella enterica enterica serovar Typhi
gcuaugccggagga

SEQ ID NO: 3624770 - RNA, 16 nt, Salmonella enterica enterica serovar Typhi
gcuaugcgcuccagga

SEQ ID NO: 3624771 - RNA, 23 nt, Salmonella enterica enterica serovar Typhi
gcuaugcuccaguuguuccagca

SEQ ID NO: 3624772 - RNA, 20 nt, Salmonella enterica enterica serovar Typhi
gcuaugcuuaccaucuggcc

SEQ ID NO: 3624773 - RNA, 14 nt, Salmonella enterica enterica serovar Typhi
gcuauggcaacaaa

SEQ ID NO: 3624774 - RNA, 16 nt, Salmonella enterica enterica serovar Typhi
gcuauggcaacaaagc

SEQ ID NO: 3624775 - RNA, 14 nt, Salmonella enterica enterica serovar Typhi
gcuauuaccaguaa

SEQ ID NO: 3624776 - RNA, 12 nt, Salmonella enterica enterica serovar Typhi
gcuauuagccaa

SEQ ID NO: 3624777 - RNA, 21 nt, Salmonella enterica enterica serovar Typhi
gcuauuagccaaagcgguaau

SEQ ID NO: 3624778 - RNA, 20 nt, Salmonella enterica enterica serovar Typhi
gcuauuccaaaauaauaaaa

SEQ ID NO: 3624779 - RNA, 16 nt, Salmonella enterica enterica serovar Typhi
gcuauucugcuguucc

SEQ ID NO: 3624780 - RNA, 15 nt, Salmonella enterica enterica serovar Typhi
gcuauuucaguggcu

SEQ ID NO: 3624781 - RNA, 15 nt, Salmonella enterica enterica serovar Typhi
gcuauuuccagaaau

SEQ ID NO: 3624782 - RNA, 19 nt, Salmonella enterica enterica serovar Typhi
gcuauuuucucuugcucac

SEQ ID NO: 3624783 - RNA, 15 nt, Salmonella enterica enterica serovar Typhi
gcucaaaaaagagua

SEQ ID NO: 3624784 - RNA, 22 nt, Salmonella enterica enterica serovar Typhi
gcucaaaaaagaguaaaguuau

SEQ ID NO: 3624785 - RNA, 12 nt, Salmonella enterica enterica serovar Typhi
gcucaaauauga

SEQ ID NO: 3624786 - RNA, 23 nt, Salmonella enterica enterica serovar Typhi
gcucaaccaugauaaccagcccc

SEQ ID NO: 3624787 - RNA, 15 nt, Salmonella enterica enterica serovar Typhi
gcucaaccgcgcggc

SEQ ID NO: 3624788 - RNA, 21 nt, Salmonella enterica enterica serovar Typhi
gcucaaccgcgcggcguucug

SEQ ID NO: 3624789 - RNA, 20 nt, Salmonella enterica enterica serovar Typhi
gcucaacgccuuugcaaucg

SEQ ID NO: 3624790 - RNA, 14 nt, Salmonella enterica enterica serovar Typhi
gcucaacuggauga

SEQ ID NO: 3624791 - RNA, 18 nt, Salmonella enterica enterica serovar Typhi
gcucaagaguaggccgga

SEQ ID NO: 3624792 - RNA, 15 nt, Salmonella enterica enterica serovar Typhi
gcucaagcgaaaaaa

SEQ ID NO: 3624793 - RNA, 20 nt, Salmonella enterica enterica serovar Typhi
gcucaauaccuuaguaaaac

SEQ ID NO: 3624794 - RNA, 21 nt, Salmonella enterica enterica serovar Typhi
gcucaauccuucuaccuucac

SEQ ID NO: 3624795 - RNA, 22 nt, Salmonella enterica enterica serovar Typhi
gcucaauguagcgucagccggc

SEQ ID NO: 3624796 - RNA, 19 nt, Salmonella enterica enterica serovar Typhi
gcucaauuauacgcuggug

SEQ ID NO: 3624797 - RNA, 12 nt, Salmonella enterica enterica serovar Typhi
gcucaauuuuuu

SEQ ID NO: 3624798 - RNA, 23 nt, Salmonella enterica enterica serovar Typhi
gcucaccagcugacgcagcaguu

SEQ ID NO: 3624799 - RNA, 23 nt, Salmonella enterica enterica serovar Typhi
gcucacccaguuuuuuucugcca

SEQ ID NO: 3624800 - RNA, 18 nt, Salmonella enterica enterica serovar Typhi
gcucaccgacuccucaac

SEQ ID NO: 3624801 - RNA, 20 nt, Salmonella enterica enterica serovar Typhi
gcucaccgagacugcccggc

SEQ ID NO: 3624802 - RNA, 16 nt, Salmonella enterica enterica serovar Typhi
gcucaccggucccgga

SEQ ID NO: 3624803 - RNA, 20 nt, Salmonella enterica enterica serovar Typhi
gcucacgcuuauccggccua

SEQ ID NO: 3624804 - RNA, 22 nt, Salmonella enterica enterica serovar Typhi
gcucacgcuuuuacaucgcugg

SEQ ID NO: 3624805 - RNA, 23 nt, Salmonella enterica enterica serovar Typhi
gcucacgguuucaacuuccacca

SEQ ID NO: 3624806 - RNA, 13 nt, Salmonella enterica enterica serovar Typhi
gcucagcgcggca

SEQ ID NO: 3624807 - RNA, 15 nt, Salmonella enterica enterica serovar Typhi
gcucagcgcggcagc

SEQ ID NO: 3624808 - RNA, 13 nt, Salmonella enterica enterica serovar Typhi
gcucagcggcggc

SEQ ID NO: 3624809 - RNA, 20 nt, Salmonella enterica enterica serovar Typhi
gcucagcuggauagagcgcu

SEQ ID NO: 3624810 - RNA, 21 nt, Salmonella enterica enterica serovar Typhi
gcucaggaucgccggauuguu

SEQ ID NO: 3624811 - RNA, 19 nt, Salmonella enterica enterica serovar Typhi
gcucaggcgcgaauaaugc

SEQ ID NO: 3624812 - RNA, 14 nt, Salmonella enterica enterica serovar Typhi
gcucaggcgcgcgc

SEQ ID NO: 3624813 - RNA, 16 nt, Salmonella enterica enterica serovar Typhi
gcucagggcauccgcc

SEQ ID NO: 3624814 - RNA, 21 nt, Salmonella enterica enterica serovar Typhi
gcucaggguuuucuaccgcag

SEQ ID NO: 3624815 - RNA, 16 nt, Salmonella enterica enterica serovar Typhi
gcucagguuauacugu

SEQ ID NO: 3624816 - RNA, 18 nt, Salmonella enterica enterica serovar Typhi
gcucaguccagccgccgc

SEQ ID NO: 3624817 - RNA, 22 nt, Salmonella enterica enterica serovar Typhi
gcucagugaaucgcaucauaaa

SEQ ID NO: 3624818 - RNA, 15 nt, Salmonella enterica enterica serovar Typhi
gcucaguugguuaga

SEQ ID NO: 3624819 - RNA, 21 nt, Salmonella enterica enterica serovar Typhi
gcucaguugguuagagcacau

SEQ ID NO: 3624820 - RNA, 21 nt, Salmonella enterica enterica serovar Typhi
gcucauagccgcuuuccgccg

SEQ ID NO: 3624821 - RNA, 21 nt, Salmonella enterica enterica serovar Typhi
gcucauauacccugcggcgaa

SEQ ID NO: 3624822 - RNA, 22 nt, Salmonella enterica enterica serovar Typhi
gcucaucaaacagcggcacuuc

SEQ ID NO: 3624823 - RNA, 17 nt, Salmonella enterica enterica serovar Typhi
gcucaucaggcgugccc

SEQ ID NO: 3624824 - RNA, 18 nt, Salmonella enterica enterica serovar Typhi
gcucauccaacugcgccu

SEQ ID NO: 3624825 - RNA, 13 nt, Salmonella enterica enterica serovar Typhi
gcucauccagcaa

SEQ ID NO: 3624826 - RNA, 16 nt, Salmonella enterica enterica serovar Typhi
gcucauccagcaacag

SEQ ID NO: 3624827 - RNA, 12 nt, Salmonella enterica enterica serovar Typhi
gcucauccagcg

SEQ ID NO: 3624828 - RNA, 18 nt, Salmonella enterica enterica serovar Typhi
gcucggucacuucaaccu

SEQ ID NO: 3624829 - RNA, 18 nt, Salmonella enterica enterica serovar Typhi
gcucguaaagcaucagac

SEQ ID NO: 3624830 - RNA, 21 nt, Salmonella enterica enterica serovar Typhi
gcucguagcguuuaaagacca

SEQ ID NO: 3624831 - RNA, 23 nt, Salmonella enterica enterica serovar Typhi
gcucgucaaacaguucagacacc

SEQ ID NO: 3624832 - RNA, 18 nt, Salmonella enterica enterica serovar Typhi
gcucguuguuuaauacgc

SEQ ID NO: 3624833 - RNA, 23 nt, Salmonella enterica enterica serovar Typhi
gcucguuuuuguuuaaaaaccag

SEQ ID NO: 3624834 - RNA, 18 nt, Salmonella enterica enterica serovar Typhi
gcucuaccaacugagcua

SEQ ID NO: 3624835 - RNA, 20 nt, Salmonella enterica enterica serovar Typhi
gcucuaucgccgcccgcaug

SEQ ID NO: 3624836 - RNA, 22 nt, Salmonella enterica enterica serovar Typhi
gcucuaucgccuggagcugauc

SEQ ID NO: 3624837 - RNA, 15 nt, Salmonella enterica enterica serovar Typhi
gcucuauucggcgcu

SEQ ID NO: 3624838 - RNA, 13 nt, Salmonella enterica enterica serovar Typhi
gcucucccagcug

SEQ ID NO: 3624839 - RNA, 14 nt, Salmonella enterica enterica serovar Typhi
gcucucccagcuga

SEQ ID NO: 3624840 - RNA, 16 nt, Salmonella enterica enterica serovar Typhi
gcucucccagcugagc

SEQ ID NO: 3624841 - RNA, 18 nt, Salmonella enterica enterica serovar Typhi
gcucucccagcugagcua

SEQ ID NO: 3624842 - RNA, 23 nt, Salmonella enterica enterica serovar Typhi
gcucucccgccacugaauuacug

SEQ ID NO: 3624843 - RNA, 18 nt, Salmonella enterica enterica serovar Typhi
gcucuccggcacauucac

SEQ ID NO: 3624844 - RNA, 20 nt, Salmonella enterica enterica serovar Typhi
gcucucucaaacuauuuuua

SEQ ID NO: 3624845 - RNA, 19 nt, Salmonella enterica enterica serovar Typhi
gcucucuuucaccagcgcc

SEQ ID NO: 3624846 - RNA, 20 nt, Salmonella enterica enterica serovar Typhi
gcucucuuucaccagcgcca

SEQ ID NO: 3624847 - RNA, 16 nt, Salmonella enterica enterica serovar Typhi
gcucucuuuucuuacu

SEQ ID NO: 3624848 - RNA, 11 nt, Salmonella enterica enterica serovar Typhi
gcucugcuguu

SEQ ID NO: 3624849 - RNA, 17 nt, Salmonella enterica enterica serovar Typhi
gcucugcuguuccuuca

SEQ ID NO: 3624850 - RNA, 18 nt, Salmonella enterica enterica serovar Typhi
gcucuucaauuuccaucu

SEQ ID NO: 3624851 - RNA, 20 nt, Salmonella enterica enterica serovar Typhi
gcucuucaggcguauauucg

SEQ ID NO: 3624852 - RNA, 18 nt, Salmonella enterica enterica serovar Typhi
gcucuuccgccagcgcca

SEQ ID NO: 3624853 - RNA, 22 nt, Salmonella enterica enterica serovar Typhi
gcucuuuaaugauguccagaau

SEQ ID NO: 3624854 - RNA, 13 nt, Salmonella enterica enterica serovar Typhi
gcucuuucaacug

SEQ ID NO: 3624855 - RNA, 17 nt, Salmonella enterica enterica serovar Typhi
gcucuuucaacuuccgc

SEQ ID NO: 3624856 - RNA, 16 nt, Salmonella enterica enterica serovar Typhi
gcucuuuucaggcgcu

SEQ ID NO: 3624857 - RNA, 18 nt, Salmonella enterica enterica serovar Typhi
gcucuuuuccacggcgcu

SEQ ID NO: 3624858 - RNA, 15 nt, Salmonella enterica enterica serovar Typhi
gcucuuuuuuuugcu

SEQ ID NO: 3624859 - RNA, 23 nt, Salmonella enterica enterica serovar Typhi
gcugaaaacggcaucaagcccau

SEQ ID NO: 3624860 - RNA, 19 nt, Salmonella enterica enterica serovar Typhi
gcugaaaaucaaaucggcg

SEQ ID NO: 3624861 - RNA, 22 nt, Salmonella enterica enterica serovar Typhi
gcugaaagaagacgaaaucguc

SEQ ID NO: 3624862 - RNA, 13 nt, Salmonella enterica enterica serovar Typhi
gcugaaagcgccu

SEQ ID NO: 3624863 - RNA, 15 nt, Salmonella enterica enterica serovar Typhi
gcugaaauagccccg

SEQ ID NO: 3624864 - RNA, 11 nt, Salmonella enterica enterica serovar Typhi
gcugaaccacc

SEQ ID NO: 3624865 - RNA, 22 nt, Salmonella enterica enterica serovar Typhi
gcugaaccacccugaaaaguua

SEQ ID NO: 3624866 - RNA, 17 nt, Salmonella enterica enterica serovar Typhi
gcugaagccccaacaga

SEQ ID NO: 3624867 - RNA, 22 nt, Salmonella enterica enterica serovar Typhi
gcugaagccugcuucaccgcgc

SEQ ID NO: 3624868 - RNA, 18 nt, Salmonella enterica enterica serovar Typhi
gcugaagcuugaaccggg

SEQ ID NO: 3624869 - RNA, 15 nt, Salmonella enterica enterica serovar Typhi
gcugaagugcggaua

SEQ ID NO: 3624870 - RNA, 13 nt, Salmonella enterica enterica serovar Typhi
gcugaauaacccc

SEQ ID NO: 3624871 - RNA, 19 nt, Salmonella enterica enterica serovar Typhi
gcugaauaaugccuuccug

SEQ ID NO: 3624872 - RNA, 15 nt, Salmonella enterica enterica serovar Typhi
gcugacaaucagcac

SEQ ID NO: 3624873 - RNA, 16 nt, Salmonella enterica enterica serovar Typhi
gcugacaaucugcugg

SEQ ID NO: 3624874 - RNA, 18 nt, Salmonella enterica enterica serovar Typhi
gcugacaaucugcuggaa

SEQ ID NO: 3624875 - RNA, 18 nt, Salmonella enterica enterica serovar Typhi
gcugacacccucugcgcc

SEQ ID NO: 3624876 - RNA, 19 nt, Salmonella enterica enterica serovar Typhi
gcugacacccucugcgccu

SEQ ID NO: 3624877 - RNA, 17 nt, Salmonella enterica enterica serovar Typhi
gcugacacucauccaga

SEQ ID NO: 3624878 - RNA, 17 nt, Salmonella enterica enterica serovar Typhi
gcugacauccaucaucu

SEQ ID NO: 3624879 - RNA, 22 nt, Salmonella enterica enterica serovar Typhi
gcugacaucgcgauuguuggug

SEQ ID NO: 3624880 - RNA, 16 nt, Salmonella enterica enterica serovar Typhi
gcugaccgaaccgcug

SEQ ID NO: 3624881 - RNA, 20 nt, Salmonella enterica enterica serovar Typhi
gcugaccgcuuucccggcau

SEQ ID NO: 3624882 - RNA, 21 nt, Salmonella enterica enterica serovar Typhi
gcugaccgcuuucccggcaug

SEQ ID NO: 3624883 - RNA, 18 nt, Salmonella enterica enterica serovar Typhi
gcugaccucaauccgugc

SEQ ID NO: 3624884 - RNA, 17 nt, Salmonella enterica enterica serovar Typhi
gcugaccuuaauccagc

SEQ ID NO: 3624885 - RNA, 15 nt, Salmonella enterica enterica serovar Typhi
gcugacgacauucag

SEQ ID NO: 3624886 - RNA, 21 nt, Salmonella enterica enterica serovar Typhi
gcugacgacauucagcacaug

SEQ ID NO: 3624887 - RNA, 22 nt, Salmonella enterica enterica serovar Typhi
gcugacgauacucagccccagg

SEQ ID NO: 3624888 - RNA, 19 nt, Salmonella enterica enterica serovar Typhi
gcugacgcccaucagcauc

SEQ ID NO: 3624889 - RNA, 21 nt, Salmonella enterica enterica serovar Typhi
gcugacggauacgcugcguca

SEQ ID NO: 3624890 - RNA, 17 nt, Salmonella enterica enterica serovar Typhi
gcugacguagauucuga

SEQ ID NO: 3624891 - RNA, 17 nt, Salmonella enterica enterica serovar Typhi
gcugacugguuuguugc

SEQ ID NO: 3624892 - RNA, 12 nt, Salmonella enterica enterica serovar Typhi
gcugagaaaaau

SEQ ID NO: 3624893 - RNA, 14 nt, Salmonella enterica enterica serovar Typhi
gcugagaaaaauac

SEQ ID NO: 3624894 - RNA, 21 nt, Salmonella enterica enterica serovar Typhi
gcugagcacgcccggucuguc

SEQ ID NO: 3624895 - RNA, 17 nt, Salmonella enterica enterica serovar Typhi
gcugagcgucaggcgca

SEQ ID NO: 3624896 - RNA, 17 nt, Salmonella enterica enterica serovar Typhi
gcugagcuaaucaccca

SEQ ID NO: 3624897 - RNA, 23 nt, Salmonella enterica enterica serovar Typhi
gcugagcucugguugcagcgcca

SEQ ID NO: 3624898 - RNA, 13 nt, Salmonella enterica enterica serovar Typhi
gcugaggcgcugg

SEQ ID NO: 3624899 - RNA, 17 nt, Salmonella enterica enterica serovar Typhi
gcugaggcuuugagcgu

SEQ ID NO: 3624900 - RNA, 21 nt, Salmonella enterica enterica serovar Typhi
gcugagucagaaacggccugg

SEQ ID NO: 3624901 - RNA, 17 nt, Salmonella enterica enterica serovar Typhi
gcugagucauccuuccc

SEQ ID NO: 3624902 - RNA, 20 nt, Salmonella enterica enterica serovar Typhi
gcugagucauccuuccccca

SEQ ID NO: 3624903 - RNA, 20 nt, Salmonella enterica enterica serovar Typhi
gcugagugguucgccaucca

SEQ ID NO: 3624904 - RNA, 16 nt, Salmonella enterica enterica serovar Typhi
gcugaguucaggcacg

SEQ ID NO: 3624905 - RNA, 19 nt, Salmonella enterica enterica serovar Typhi
gcugaguuuagccagcagc

SEQ ID NO: 3624906 - RNA, 22 nt, Salmonella enterica enterica serovar Typhi
gcugaguuucucccgccagaug

SEQ ID NO: 3624907 - RNA, 21 nt, Salmonella enterica enterica serovar Typhi
gcugauaagcuaguaaagaaa

SEQ ID NO: 3624908 - RNA, 22 nt, Salmonella enterica enterica serovar Typhi
gcugauacuuauuacgguauca

SEQ ID NO: 3624909 - RNA, 15 nt, Salmonella enterica enterica serovar Typhi
gcugauaggccugga

SEQ ID NO: 3624910 - RNA, 16 nt, Salmonella enterica enterica serovar Typhi
gcugaucaaugcgcaa

SEQ ID NO: 3624911 - RNA, 17 nt, Salmonella enterica enterica serovar Typhi
gcugaucccgcgcgccu

SEQ ID NO: 3624912 - RNA, 21 nt, Salmonella enterica enterica serovar Typhi
gcugaucgugauaggccagac

SEQ ID NO: 3624913 - RNA, 12 nt, Salmonella enterica enterica serovar Typhi
gcuggcggcaag

SEQ ID NO: 3624914 - RNA, 14 nt, Salmonella enterica enterica serovar Typhi
gcuggcggccccuc

SEQ ID NO: 3624915 - RNA, 20 nt, Salmonella enterica enterica serovar Typhi
gcuggcggucgggaacgcug

SEQ ID NO: 3624916 - RNA, 19 nt, Salmonella enterica enterica serovar Typhi
gcuggcgguuuuugugggu

SEQ ID NO: 3624917 - RNA, 13 nt, Salmonella enterica enterica serovar Typhi
gcuggcguccagc

SEQ ID NO: 3624918 - RNA, 20 nt, Salmonella enterica enterica serovar Typhi
gcuggcgucccgggucagga

SEQ ID NO: 3624919 - RNA, 19 nt, Salmonella enterica enterica serovar Typhi
gcuggcgucgccaaagcag

SEQ ID NO: 3624920 - RNA, 19 nt, Salmonella enterica enterica serovar Typhi
gcuggcguuaucguccguc

SEQ ID NO: 3624921 - RNA, 21 nt, Salmonella enterica enterica serovar Typhi
gcuggcugccguuaaucuggc

SEQ ID NO: 3624922 - RNA, 10 nt, Salmonella enterica enterica serovar Typhi
gcuggcuggc

SEQ ID NO: 3624923 - RNA, 17 nt, Salmonella enterica enterica serovar Typhi
gcuggcuggccagggca

SEQ ID NO: 3624924 - RNA, 14 nt, Salmonella enterica enterica serovar Typhi
gcuggcuggcgguc

SEQ ID NO: 3624925 - RNA, 14 nt, Salmonella enterica enterica serovar Typhi
gcuggcuuaacuca

SEQ ID NO: 3624926 - RNA, 15 nt, Salmonella enterica enterica serovar Typhi
gcuggcuuaacucac

SEQ ID NO: 3624927 - RNA, 15 nt, Salmonella enterica enterica serovar Typhi
gcugggccugcuccg

SEQ ID NO: 3624928 - RNA, 17 nt, Salmonella enterica enterica serovar Typhi
gcugggccugcuccgua

SEQ ID NO: 3624929 - RNA, 22 nt, Salmonella enterica enterica serovar Typhi
gcugggcuuuauccugaccgcu

SEQ ID NO: 3624930 - RNA, 17 nt, Salmonella enterica enterica serovar Typhi
gcugggucauuaugagu

SEQ ID NO: 3624931 - RNA, 17 nt, Salmonella enterica enterica serovar Typhi
gcugggugagcgggcug

SEQ ID NO: 3624932 - RNA, 16 nt, Salmonella enterica enterica serovar Typhi
gcuggguucauccagc

SEQ ID NO: 3624933 - RNA, 20 nt, Salmonella enterica enterica serovar Typhi
gcuggguugauaccggagga

SEQ ID NO: 3624934 - RNA, 18 nt, Salmonella enterica enterica serovar Typhi
gcuggguuucgguauaaa

SEQ ID NO: 3624935 - RNA, 18 nt, Salmonella enterica enterica serovar Typhi
gcugguaaauccggcgcu

SEQ ID NO: 3624936 - RNA, 22 nt, Salmonella enterica enterica serovar Typhi
gcugguaguccucuaucuuuuc

SEQ ID NO: 3624937 - RNA, 22 nt, Salmonella enterica enterica serovar Typhi
gcugguauaggccaggcuauag

SEQ ID NO: 3624938 - RNA, 16 nt, Salmonella enterica enterica serovar Typhi
gcuggucagcgcgcca

SEQ ID NO: 3624939 - RNA, 21 nt, Salmonella enterica enterica serovar Typhi
gcuggucagcguacccgcggu

SEQ ID NO: 3624940 - RNA, 17 nt, Salmonella enterica enterica serovar Typhi
gcuggucgccgcccauc

SEQ ID NO: 3624941 - RNA, 19 nt, Salmonella enterica enterica serovar Typhi
gcuggucgccgcccaucgg

SEQ ID NO: 3624942 - RNA, 21 nt, Salmonella enterica enterica serovar Typhi
gcuggucgccgcccaucgggc

SEQ ID NO: 3624943 - RNA, 18 nt, Salmonella enterica enterica serovar Typhi
gcuggucugaaucugcuc

SEQ ID NO: 3624944 - RNA, 22 nt, Salmonella enterica enterica serovar Typhi
gcuggugaaacguguuuauccc

SEQ ID NO: 3624945 - RNA, 14 nt, Salmonella enterica enterica serovar Typhi
gcuggugaaacguu

SEQ ID NO: 3624946 - RNA, 17 nt, Salmonella enterica enterica serovar Typhi
gcuggugaagacgcugc

SEQ ID NO: 3624947 - RNA, 15 nt, Salmonella enterica enterica serovar Typhi
gcuggugaucuggcc

SEQ ID NO: 3624948 - RNA, 22 nt, Salmonella enterica enterica serovar Typhi
gcuggugccaaucuccagcauc

SEQ ID NO: 3624949 - RNA, 17 nt, Salmonella enterica enterica serovar Typhi
gcuggugcgaauaagcu

SEQ ID NO: 3624950 - RNA, 15 nt, Salmonella enterica enterica serovar Typhi
gcuggugcugugccu

SEQ ID NO: 3624951 - RNA, 12 nt, Salmonella enterica enterica serovar Typhi
gcuggugguaaa

SEQ ID NO: 3624952 - RNA, 14 nt, Salmonella enterica enterica serovar Typhi
gcuggugucgccgu

SEQ ID NO: 3624953 - RNA, 22 nt, Salmonella enterica enterica serovar Typhi
gcugguuaauaauuuuacccgc

SEQ ID NO: 3624954 - RNA, 22 nt, Salmonella enterica enterica serovar Typhi
gcugguuccccgugcccggcau

SEQ ID NO: 3624955 - RNA, 15 nt, Salmonella enterica enterica serovar Typhi
gcuguaaaccggccc

SEQ ID NO: 3624956 - RNA, 15 nt, Salmonella enterica enterica serovar Typhi
gcuguaacccgccgc

SEQ ID NO: 3624957 - RNA, 19 nt, Salmonella enterica enterica serovar Typhi
gcuguaacccgccgccauc

SEQ ID NO: 3624958 - RNA, 18 nt, Salmonella enterica enterica serovar Typhi
gcuguaauagauaugaaa

SEQ ID NO: 3624959 - RNA, 16 nt, Salmonella enterica enterica serovar Typhi
gcuguacauauccagu

SEQ ID NO: 3624960 - RNA, 21 nt, Salmonella enterica enterica serovar Typhi
gcuguacgcuacugagcguca

SEQ ID NO: 3624961 - RNA, 14 nt, Salmonella enterica enterica serovar Typhi
gcuguacuuuugcu

SEQ ID NO: 3624962 - RNA, 17 nt, Salmonella enterica enterica serovar Typhi
gcuguagcugcccggau

SEQ ID NO: 3624963 - RNA, 22 nt, Salmonella enterica enterica serovar Typhi
gcuguaggcacuuuccagacca

SEQ ID NO: 3624964 - RNA, 14 nt, Salmonella enterica enterica serovar Typhi
gcuguaucacgacu

SEQ ID NO: 3624965 - RNA, 20 nt, Salmonella enterica enterica serovar Typhi
gcugucagugaaaaaccgau

SEQ ID NO: 3624966 - RNA, 16 nt, Salmonella enterica enterica serovar Typhi
gcugucaucaaugagc

SEQ ID NO: 3624967 - RNA, 20 nt, Salmonella enterica enterica serovar Typhi
gcugucaucgaaggcgauac

SEQ ID NO: 3624968 - RNA, 14 nt, Salmonella enterica enterica serovar Typhi
gcuguccagccgcc

SEQ ID NO: 3624969 - RNA, 15 nt, Salmonella enterica enterica serovar Typhi
gcugucccaguguca

SEQ ID NO: 3624970 - RNA, 17 nt, Salmonella enterica enterica serovar Typhi
gcuguccuuaaccagcu

SEQ ID NO: 3624971 - RNA, 18 nt, Salmonella enterica enterica serovar Typhi
gcugucgaugauauccag

SEQ ID NO: 3624972 - RNA, 12 nt, Salmonella enterica enterica serovar Typhi
gcugucgccaga

SEQ ID NO: 3624973 - RNA, 20 nt, Salmonella enterica enterica serovar Typhi
gcugucggucggcuuuuguu

SEQ ID NO: 3624974 - RNA, 12 nt, Salmonella enterica enterica serovar Typhi
gcugucguuuca

SEQ ID NO: 3624975 - RNA, 21 nt, Salmonella enterica enterica serovar Typhi
gcugucuuacacugauacccc

SEQ ID NO: 3624976 - RNA, 23 nt, Salmonella enterica enterica serovar Typhi
gcugugacggcaacugaaaacag

SEQ ID NO: 3624977 - RNA, 22 nt, Salmonella enterica enterica serovar Typhi
gcugugagaaggugguggguaa

SEQ ID NO: 3624978 - RNA, 13 nt, Salmonella enterica enterica serovar Typhi
gcugugccaauaa

SEQ ID NO: 3624979 - RNA, 16 nt, Salmonella enterica enterica serovar Typhi
gcugugccaauaacgc

SEQ ID NO: 3624980 - RNA, 20 nt, Salmonella enterica enterica serovar Typhi
gcuguggauuuauggcguca

SEQ ID NO: 3624981 - RNA, 16 nt, Salmonella enterica enterica serovar Typhi
gcugugguuuauccgc

SEQ ID NO: 3624982 - RNA, 16 nt, Salmonella enterica enterica serovar Typhi
gcuguguccaggucau

SEQ ID NO: 3624983 - RNA, 15 nt, Salmonella enterica enterica serovar Typhi
gcuguguccgccaug

SEQ ID NO: 3624984 - RNA, 16 nt, Salmonella enterica enterica serovar Typhi
gcuguguccgccugcu

SEQ ID NO: 3624985 - RNA, 15 nt, Salmonella enterica enterica serovar Typhi
gcuguguucauccca

SEQ ID NO: 3624986 - RNA, 19 nt, Salmonella enterica enterica serovar Typhi
gcuguuaaaaccggcugcc

SEQ ID NO: 3624987 - RNA, 19 nt, Salmonella enterica enterica serovar Typhi
gcuguuaaucucauaaaug

SEQ ID NO: 3624988 - RNA, 21 nt, Salmonella enterica enterica serovar Typhi
gcuguuaauuugcaucaggcc

SEQ ID NO: 3624989 - RNA, 18 nt, Salmonella enterica enterica serovar Typhi
gcuguuacugucggcgau

SEQ ID NO: 3624990 - RNA, 20 nt, Salmonella enterica enterica serovar Typhi
gcuguucaaucacugaugcc

SEQ ID NO: 3624991 - RNA, 15 nt, Salmonella enterica enterica serovar Typhi
gcuguucagcagaau

SEQ ID NO: 3624992 - RNA, 13 nt, Salmonella enterica enterica serovar Typhi
gcuguuccuggug

SEQ ID NO: 3624993 - RNA, 19 nt, Salmonella enterica enterica serovar Typhi
gcuguuccuucagaaaauu

SEQ ID NO: 3624994 - RNA, 22 nt, Salmonella enterica enterica serovar Typhi
gcuguugguuuauugauaggcc

SEQ ID NO: 3624995 - RNA, 15 nt, Salmonella enterica enterica serovar Typhi
gcuguuuauggcgcu

SEQ ID NO: 3624996 - RNA, 20 nt, Salmonella enterica enterica serovar Typhi
gcuguuucuggucauacugu

SEQ ID NO: 3624997 - RNA, 13 nt, Salmonella enterica enterica serovar Typhi
gcuguuuuccgcu

SEQ ID NO: 3624998 - RNA, 23 nt, Salmonella enterica enterica serovar Typhi
gcuguuuuucaucaucauccaga

SEQ ID NO: 3624999 - RNA, 15 nt, Salmonella enterica enterica serovar Typhi
gcgucaacguccagu

SEQ ID NO: 3625000 - RNA, 20 nt, Salmonella enterica enterica serovar Typhi
gcgucaacguuuuucagccg

SEQ ID NO: 3625001 - RNA, 17 nt, Salmonella enterica enterica serovar Typhi
gcgucaacucagcaaua

SEQ ID NO: 3625002 - RNA, 13 nt, Salmonella enterica enterica serovar Typhi
gcgucacaggcuu

SEQ ID NO: 3625003 - RNA, 15 nt, Salmonella enterica enterica serovar Typhi
gcgucacauggcgaa

SEQ ID NO: 3625004 - RNA, 22 nt, Salmonella enterica enterica serovar Typhi
gcgucacccgccggcagcagcu

SEQ ID NO: 3625005 - RNA, 18 nt, Salmonella enterica enterica serovar Typhi
gcgucaccgugccaguua

SEQ ID NO: 3625006 - RNA, 16 nt, Salmonella enterica enterica serovar Typhi
gcgucacgaccggcga

SEQ ID NO: 3625007 - RNA, 18 nt, Salmonella enterica enterica serovar Typhi
gcgucacgcgcaaagcug

SEQ ID NO: 3625008 - RNA, 19 nt, Salmonella enterica enterica serovar Typhi
gcgucacgcgcaaagcugc

SEQ ID NO: 3625009 - RNA, 17 nt, Salmonella enterica enterica serovar Typhi
gcgucagcacgccgccc

SEQ ID NO: 3625010 - RNA, 15 nt, Salmonella enterica enterica serovar Typhi
gcgucagcauggugu

SEQ ID NO: 3625011 - RNA, 17 nt, Salmonella enterica enterica serovar Typhi
gcgucagccagaacgaa

SEQ ID NO: 3625012 - RNA, 14 nt, Salmonella enterica enterica serovar Typhi
gcgucagcccuucu

SEQ ID NO: 3625013 - RNA, 13 nt, Salmonella enterica enterica serovar Typhi
gcgucagccggca

SEQ ID NO: 3625014 - RNA, 20 nt, Salmonella enterica enterica serovar Typhi
gcgucagcgcuugccgcagc

SEQ ID NO: 3625015 - RNA, 15 nt, Salmonella enterica enterica serovar Typhi
gcgucagcgugcggu

SEQ ID NO: 3625016 - RNA, 20 nt, Salmonella enterica enterica serovar Typhi
gcgucagcguguaaucgccg

SEQ ID NO: 3625017 - RNA, 18 nt, Salmonella enterica enterica serovar Typhi
gcgucaggaacgcggcgc

SEQ ID NO: 3625018 - RNA, 22 nt, Salmonella enterica enterica serovar Typhi
gcgucaggccaucgcuucggca

SEQ ID NO: 3625019 - RNA, 19 nt, Salmonella enterica enterica serovar Typhi
gcgucaggcuguuguucuu

SEQ ID NO: 3625020 - RNA, 17 nt, Salmonella enterica enterica serovar Typhi
gcgucauaaccgcaguc

SEQ ID NO: 3625021 - RNA, 18 nt, Salmonella enterica enterica serovar Typhi
gcgucauagccgcgcguc

SEQ ID NO: 3625022 - RNA, 20 nt, Salmonella enterica enterica serovar Typhi
gcgucaucauugcgccaaga

SEQ ID NO: 3625023 - RNA, 15 nt, Salmonella enterica enterica serovar Typhi
gcgucauccaguguu

SEQ ID NO: 3625024 - RNA, 21 nt, Salmonella enterica enterica serovar Typhi
gcgucaucccgguuucccgcg

SEQ ID NO: 3625025 - RNA, 13 nt, Salmonella enterica enterica serovar Typhi
gcgucauccggca

SEQ ID NO: 3625026 - RNA, 15 nt, Salmonella enterica enterica serovar Typhi
gcgucauccugcagg

SEQ ID NO: 3625027 - RNA, 14 nt, Salmonella enterica enterica serovar Typhi
gcgucaucgcucca

SEQ ID NO: 3625028 - RNA, 19 nt, Salmonella enterica enterica serovar Typhi
gcgucaucggcgcgcuggc

SEQ ID NO: 3625029 - RNA, 20 nt, Salmonella enterica enterica serovar Typhi
gcgucaucggcgcgcuggcg

SEQ ID NO: 3625030 - RNA, 19 nt, Salmonella enterica enterica serovar Typhi
gcgucaugucguuagaacc

SEQ ID NO: 3625031 - RNA, 18 nt, Salmonella enterica enterica serovar Typhi
gcguccaacuggcuuuca

SEQ ID NO: 3625032 - RNA, 14 nt, Salmonella enterica enterica serovar Typhi
gcguccagaugcaa

SEQ ID NO: 3625033 - RNA, 20 nt, Salmonella enterica enterica serovar Typhi
gcguccagcccguccagaua

SEQ ID NO: 3625034 - RNA, 22 nt, Salmonella enterica enterica serovar Typhi
gcguccaguacuuucuuuugau

SEQ ID NO: 3625035 - RNA, 18 nt, Salmonella enterica enterica serovar Typhi
gcgucccagcgggcugua

SEQ ID NO: 3625036 - RNA, 17 nt, Salmonella enterica enterica serovar Typhi
gcgucccggcagugcau

SEQ ID NO: 3625037 - RNA, 20 nt, Salmonella enterica enterica serovar Typhi
gcgucccucuccagggcaac

SEQ ID NO: 3625038 - RNA, 11 nt, Salmonella enterica enterica serovar Typhi
gcguccgccgc

SEQ ID NO: 3625039 - RNA, 18 nt, Salmonella enterica enterica serovar Typhi
gcguccguucugauacuc

SEQ ID NO: 3625040 - RNA, 15 nt, Salmonella enterica enterica serovar Typhi
gcguccuucuuccgc

SEQ ID NO: 3625041 - RNA, 16 nt, Salmonella enterica enterica serovar Typhi
gcgucgaaugacgcgc

SEQ ID NO: 3625042 - RNA, 14 nt, Salmonella enterica enterica serovar Typhi
gcgucgcagugcgc

SEQ ID NO: 3625043 - RNA, 14 nt, Salmonella enterica enterica serovar Typhi
gcgucgcauccggc

SEQ ID NO: 3625044 - RNA, 18 nt, Salmonella enterica enterica serovar Typhi
gcgucgcauucgauacgc

SEQ ID NO: 3625045 - RNA, 14 nt, Salmonella enterica enterica serovar Typhi
gcgucgccagcaac

SEQ ID NO: 3625046 - RNA, 22 nt, Salmonella enterica enterica serovar Typhi
gcgucgccuguccggccuguaa

SEQ ID NO: 3625047 - RNA, 22 nt, Salmonella enterica enterica serovar Typhi
gcgucgcgcuuucaaucgucag

SEQ ID NO: 3625048 - RNA, 18 nt, Salmonella enterica enterica serovar Typhi
gcgucgcggcaauagcga

SEQ ID NO: 3625049 - RNA, 15 nt, Salmonella enterica enterica serovar Typhi
gcgucgcugauugcc

SEQ ID NO: 3625050 - RNA, 16 nt, Salmonella enterica enterica serovar Typhi
gcgucgcuucguucug

SEQ ID NO: 3625051 - RNA, 13 nt, Salmonella enterica enterica serovar Typhi
gcgucggcgacuu

SEQ ID NO: 3625052 - RNA, 15 nt, Salmonella enterica enterica serovar Typhi
gcgucggcuucauca

SEQ ID NO: 3625053 - RNA, 23 nt, Salmonella enterica enterica serovar Typhi
gcgucgggggcgacaaacagcgc

SEQ ID NO: 3625054 - RNA, 18 nt, Salmonella enterica enterica serovar Typhi
gcgucgguuauagacgcc

SEQ ID NO: 3625055 - RNA, 15 nt, Salmonella enterica enterica serovar Typhi
gcgucgugcugggcg

SEQ ID NO: 3625056 - RNA, 18 nt, Salmonella enterica enterica serovar Typhi
gcgucguucacgucgcga

SEQ ID NO: 3625057 - RNA, 19 nt, Salmonella enterica enterica serovar Typhi
gcgucuauagaugauaauc

SEQ ID NO: 3625058 - RNA, 22 nt, Salmonella enterica enterica serovar Typhi
gcgucucacuuuucgggugaga

SEQ ID NO: 3625059 - RNA, 21 nt, Salmonella enterica enterica serovar Typhi
gcgucucagauggaaaaaaag

SEQ ID NO: 3625060 - RNA, 14 nt, Salmonella enterica enterica serovar Typhi
gcgucucagcaggc

SEQ ID NO: 3625061 - RNA, 21 nt, Salmonella enterica enterica serovar Typhi
gcgucucucccucaaccaggg

SEQ ID NO: 3625062 - RNA, 16 nt, Salmonella enterica enterica serovar Typhi
gcgucugaaugacgcc

SEQ ID NO: 3625063 - RNA, 18 nt, Salmonella enterica enterica serovar Typhi
gcgucugagcaucccggu

SEQ ID NO: 3625064 - RNA, 23 nt, Salmonella enterica enterica serovar Typhi
gcgucugaguuaaugccaucauc

SEQ ID NO: 3625065 - RNA, 23 nt, Salmonella enterica enterica serovar Typhi
gcgucugcaccgguacacacgcg

SEQ ID NO: 3625066 - RNA, 17 nt, Salmonella enterica enterica serovar Typhi
gcgucugcgcgcuggug

SEQ ID NO: 3625067 - RNA, 14 nt, Salmonella enterica enterica serovar Typhi
gcgucugcggcuga

SEQ ID NO: 3625068 - RNA, 22 nt, Salmonella enterica enterica serovar Typhi
gcgucuggcgacuaaccagcgc

SEQ ID NO: 3625069 - RNA, 13 nt, Salmonella enterica enterica serovar Typhi
gcgucuuauccgg

SEQ ID NO: 3625070 - RNA, 16 nt, Salmonella enterica enterica serovar Typhi
gcgucuuauccggccu

SEQ ID NO: 3625071 - RNA, 21 nt, Salmonella enterica enterica serovar Typhi
gcgucuuauccggccuaccug

SEQ ID NO: 3625072 - RNA, 14 nt, Salmonella enterica enterica serovar Typhi
gcgucuucaucagc

SEQ ID NO: 3625073 - RNA, 15 nt, Salmonella enterica enterica serovar Typhi
gcgucuucaucagcc

SEQ ID NO: 3625074 - RNA, 17 nt, Salmonella enterica enterica serovar Typhi
gcgucuucaucagccag

SEQ ID NO: 3625075 - RNA, 23 nt, Salmonella enterica enterica serovar Typhi
gcgucuuuuagucacuccaggcg

SEQ ID NO: 3625076 - RNA, 15 nt, Salmonella enterica enterica serovar Typhi
gcgugaaccagcauc

SEQ ID NO: 3625077 - RNA, 13 nt, Salmonella enterica enterica serovar Typhi
gcgugacccagac

SEQ ID NO: 3625078 - RNA, 13 nt, Salmonella enterica enterica serovar Typhi
gcgugaccgguaa

SEQ ID NO: 3625079 - RNA, 14 nt, Salmonella enterica enterica serovar Typhi
gcgugaccgguaag

SEQ ID NO: 3625080 - RNA, 17 nt, Salmonella enterica enterica serovar Typhi
gcgugacgaccggcacg

SEQ ID NO: 3625081 - RNA, 17 nt, Salmonella enterica enterica serovar Typhi
gcgugagccacuaucca

SEQ ID NO: 3625082 - RNA, 17 nt, Salmonella enterica enterica serovar Typhi
gcgugauaauuccccca

SEQ ID NO: 3625083 - RNA, 21 nt, Salmonella enterica enterica serovar Typhi
gcgugcagaucaagcgggggc

SEQ ID NO: 3625084 - RNA, 15 nt, Salmonella enterica enterica serovar Typhi
gcgugcccaguaauu

SEQ ID NO: 3625085 - RNA, 12 nt, Salmonella enterica enterica serovar Typhi
gcgugccgagca

SEQ ID NO: 3625086 - RNA, 18 nt, Salmonella enterica enterica serovar Typhi
gcgugccuucaaauauau

SEQ ID NO: 3625087 - RNA, 18 nt, Salmonella enterica enterica serovar Typhi
gcgugcgaauuucggcaa

SEQ ID NO: 3625088 - RNA, 22 nt, Salmonella enterica enterica serovar Typhi
gcgugcgacggcccgucagggc

SEQ ID NO: 3625089 - RNA, 16 nt, Salmonella enterica enterica serovar Typhi
gcgugcgccauccggc

SEQ ID NO: 3625090 - RNA, 17 nt, Salmonella enterica enterica serovar Typhi
gcgugcggacguagggc

SEQ ID NO: 3625091 - RNA, 15 nt, Salmonella enterica enterica serovar Typhi
gcgugcggcugacgu

SEQ ID NO: 3625092 - RNA, 17 nt, Salmonella enterica enterica serovar Typhi
gcgugcugacggagcug

SEQ ID NO: 3625093 - RNA, 13 nt, Salmonella enterica enterica serovar Typhi
gcgugcuggcggc

SEQ ID NO: 3625094 - RNA, 20 nt, Salmonella enterica enterica serovar Typhi
gcguggcaucuuaucaggcc

SEQ ID NO: 3625095 - RNA, 20 nt, Salmonella enterica enterica serovar Typhi
gcguggcugcaggacuuacc

SEQ ID NO: 3625096 - RNA, 22 nt, Salmonella enterica enterica serovar Typhi
gcgugguaucgcgacagcgcug

SEQ ID NO: 3625097 - RNA, 19 nt, Salmonella enterica enterica serovar Typhi
gcgugguggauauccagca

SEQ ID NO: 3625098 - RNA, 24 nt, Salmonella enterica enterica serovar Typhi
gcguggugucucgucgccagggcg

SEQ ID NO: 3625099 - RNA, 19 nt, Salmonella enterica enterica serovar Typhi
gcguguaacugcaaacgcg

SEQ ID NO: 3625100 - RNA, 16 nt, Salmonella enterica enterica serovar Typhi
gcguguauuaaaggau

SEQ ID NO: 3625101 - RNA, 16 nt, Salmonella enterica enterica serovar Typhi
gcgugucgcccggcgg

SEQ ID NO: 3625102 - RNA, 13 nt, Salmonella enterica enterica serovar Typhi
gcguguggugagg

SEQ ID NO: 3625103 - RNA, 22 nt, Salmonella enterica enterica serovar Typhi
gcgugugucccggacaauguaa

SEQ ID NO: 3625104 - RNA, 18 nt, Salmonella enterica enterica serovar Typhi
gcguguugccggaccagc

SEQ ID NO: 3625105 - RNA, 19 nt, Salmonella enterica enterica serovar Typhi
gcguguuguaaaacgcgcc

SEQ ID NO: 3625106 - RNA, 23 nt, Salmonella enterica enterica serovar Typhi
gcguguuguacagcaauaaaagg

SEQ ID NO: 3625107 - RNA, 20 nt, Salmonella enterica enterica serovar Typhi
gcguguuucaucucaucaau

SEQ ID NO: 3625108 - RNA, 17 nt, Salmonella enterica enterica serovar Typhi
gcguguuuguaaaaaua

SEQ ID NO: 3625109 - RNA, 14 nt, Salmonella enterica enterica serovar Typhi
gcguuaaaauaccg

SEQ ID NO: 3625110 - RNA, 22 nt, Salmonella enterica enterica serovar Typhi
gcguuaacccgcuuacaauuua

SEQ ID NO: 3625111 - RNA, 19 nt, Salmonella enterica enterica serovar Typhi
gcguuaacguaaagccauc

SEQ ID NO: 3625112 - RNA, 18 nt, Salmonella enterica enterica serovar Typhi
gcguuaacguuuucccgc

SEQ ID NO: 3625113 - RNA, 23 nt, Salmonella enterica enterica serovar Typhi
gcguuaauauccuucagcguuug

SEQ ID NO: 3625114 - RNA, 22 nt, Salmonella enterica enterica serovar Typhi
gcguuaaugcgcgcuucuucau

SEQ ID NO: 3625115 - RNA, 22 nt, Salmonella enterica enterica serovar Typhi
gcguuaccggcaggcuggcggu

SEQ ID NO: 3625116 - RNA, 12 nt, Salmonella enterica enterica serovar Typhi
gcguuacgcgcc

SEQ ID NO: 3625117 - RNA, 22 nt, Salmonella enterica enterica serovar Typhi
gcguuacugcaacugcgcggca

SEQ ID NO: 3625118 - RNA, 13 nt, Salmonella enterica enterica serovar Typhi
gcguuacuggcga

SEQ ID NO: 3625119 - RNA, 18 nt, Salmonella enterica enterica serovar Typhi
gcguuagaauaacguucg

SEQ ID NO: 3625120 - RNA, 17 nt, Salmonella enterica enterica serovar Typhi
gcguuauccgccugcug

SEQ ID NO: 3625121 - RNA, 22 nt, Salmonella enterica enterica serovar Typhi
gcguuaucguccgucagauccg

SEQ ID NO: 3625122 - RNA, 16 nt, Salmonella enterica enterica serovar Typhi
gcguuaucuguaauug

SEQ ID NO: 3625123 - RNA, 17 nt, Salmonella enterica enterica serovar Typhi
gcguuauuugcauuuuc

SEQ ID NO: 3625124 - RNA, 17 nt, Salmonella enterica enterica serovar Typhi
gcguucacgccgccauc

SEQ ID NO: 3625125 - RNA, 23 nt, Salmonella enterica enterica serovar Typhi
gcguucacgccgccauccggcaa

SEQ ID NO: 3625126 - RNA, 24 nt, Salmonella enterica enterica serovar Typhi
gcguucacgccgccauccggcacu

SEQ ID NO: 3625127 - RNA, 18 nt, Salmonella enterica enterica serovar Typhi
gcguucauccaccgcccg

SEQ ID NO: 3625128 - RNA, 16 nt, Salmonella enterica enterica serovar Typhi
gcguuccaguaauuuc

SEQ ID NO: 3625129 - RNA, 19 nt, Salmonella enterica enterica serovar Typhi
gcguuccccaacagcgacc

SEQ ID NO: 3625130 - RNA, 13 nt, Salmonella enterica enterica serovar Typhi
gcguuccuuauca

SEQ ID NO: 3625131 - RNA, 17 nt, Salmonella enterica enterica serovar Typhi
gcguuccuuaucagcaa

SEQ ID NO: 3625132 - RNA, 22 nt, Salmonella enterica enterica serovar Typhi
gcguucgaccguuuucgccagu

SEQ ID NO: 3625133 - RNA, 17 nt, Salmonella enterica enterica serovar Typhi
gcguucgcccugcgcca

SEQ ID NO: 3625134 - RNA, 23 nt, Salmonella enterica enterica serovar Typhi
gcguucggaagacugcuccggca

SEQ ID NO: 3625135 - RNA, 17 nt, Salmonella enterica enterica serovar Typhi
gcguucggguuuuccug

SEQ ID NO: 3625136 - RNA, 19 nt, Salmonella enterica enterica serovar Typhi
gcguucugcgccauuucca

SEQ ID NO: 3625137 - RNA, 13 nt, Salmonella enterica enterica serovar Typhi
gcguucuggaagu

SEQ ID NO: 3625138 - RNA, 13 nt, Salmonella enterica enterica serovar Typhi
gcguucuuccacu

SEQ ID NO: 3625139 - RNA, 21 nt, Salmonella enterica enterica serovar Typhi
gcguucuuccacuucagcagc

SEQ ID NO: 3625140 - RNA, 24 nt, Salmonella enterica enterica serovar Typhi
gcguugaccagccuaccugccgcc

SEQ ID NO: 3625141 - RNA, 17 nt, Salmonella enterica enterica serovar Typhi
gcguugaccagcgacgg

SEQ ID NO: 3625142 - RNA, 19 nt, Salmonella enterica enterica serovar Typhi
gcguugaccagcgacggcg

SEQ ID NO: 3625143 - RNA, 18 nt, Salmonella enterica enterica serovar Typhi
gcguugccguaggcaacg

SEQ ID NO: 3625144 - RNA, 17 nt, Salmonella enterica enterica serovar Typhi
gcguugcgcccaggcca

SEQ ID NO: 3625145 - RNA, 19 nt, Salmonella enterica enterica serovar Typhi
gcguugcgccgccaggcau

SEQ ID NO: 3625146 - RNA, 18 nt, Salmonella enterica enterica serovar Typhi
gcguugcuuaucaggccu

SEQ ID NO: 3625147 - RNA, 14 nt, Salmonella enterica enterica serovar Typhi
gcguuggcgggcug

SEQ ID NO: 3625148 - RNA, 20 nt, Salmonella enterica enterica serovar Typhi
gcguuggcgucagaccggca

SEQ ID NO: 3625149 - RNA, 19 nt, Salmonella enterica enterica serovar Typhi
gcguugguuaaggcggcug

SEQ ID NO: 3625150 - RNA, 18 nt, Salmonella enterica enterica serovar Typhi
gcguuguaaucgccugaa

SEQ ID NO: 3625151 - RNA, 15 nt, Salmonella enterica enterica serovar Typhi
gcguuguggacgaac

SEQ ID NO: 3625152 - RNA, 21 nt, Salmonella enterica enterica serovar Typhi
gcguuguuuuuucagaauuag

SEQ ID NO: 3625153 - RNA, 22 nt, Salmonella enterica enterica serovar Typhi
gcguuuaacugaacaucgccgu

SEQ ID NO: 3625154 - RNA, 20 nt, Salmonella enterica enterica serovar Typhi
gcguuuaauuccaucggcau

SEQ ID NO: 3625155 - RNA, 14 nt, Salmonella enterica enterica serovar Typhi
gcguuuauuaggcc

SEQ ID NO: 3625156 - RNA, 20 nt, Salmonella enterica enterica serovar Typhi
gcguuuauuaggccuacaag

SEQ ID NO: 3625157 - RNA, 18 nt, Salmonella enterica enterica serovar Typhi
gccgucaggcuugccgcg

SEQ ID NO: 3625158 - RNA, 23 nt, Salmonella enterica enterica serovar Typhi
gccgucaggucaugaucgauccg

SEQ ID NO: 3625159 - RNA, 14 nt, Salmonella enterica enterica serovar Typhi
gccgucauccgcgu

SEQ ID NO: 3625160 - RNA, 12 nt, Salmonella enterica enterica serovar Typhi
gccgucccagcg

SEQ ID NO: 3625161 - RNA, 15 nt, Salmonella enterica enterica serovar Typhi
gccgucgacaaagcc

SEQ ID NO: 3625162 - RNA, 20 nt, Salmonella enterica enterica serovar Typhi
gccgucgacaaagccgacgc

SEQ ID NO: 3625163 - RNA, 16 nt, Salmonella enterica enterica serovar Typhi
gccgucgaugauggcg

SEQ ID NO: 3625164 - RNA, 13 nt, Salmonella enterica enterica serovar Typhi
gccgucgcuauca

SEQ ID NO: 3625165 - RNA, 12 nt, Salmonella enterica enterica serovar Typhi
gccgucggcaga

SEQ ID NO: 3625166 - RNA, 15 nt, Salmonella enterica enterica serovar Typhi
gccgucguacucacc

SEQ ID NO: 3625167 - RNA, 19 nt, Salmonella enterica enterica serovar Typhi
gccgucgucaccgccgcgc

SEQ ID NO: 3625168 - RNA, 18 nt, Salmonella enterica enterica serovar Typhi
gccgucgugccugacguc

SEQ ID NO: 3625169 - RNA, 21 nt, Salmonella enterica enterica serovar Typhi
gccgucguugcugucgcgcaa

SEQ ID NO: 3625170 - RNA, 22 nt, Salmonella enterica enterica serovar Typhi
gccgugaaauauccuccgccga

SEQ ID NO: 3625171 - RNA, 15 nt, Salmonella enterica enterica serovar Typhi
gccgugaacgccaaa

SEQ ID NO: 3625172 - RNA, 21 nt, Salmonella enterica enterica serovar Typhi
gccgugaggcugaagcgcgac

SEQ ID NO: 3625173 - RNA, 21 nt, Salmonella enterica enterica serovar Typhi
gccgugcccagcaucccgcug

SEQ ID NO: 3625174 - RNA, 18 nt, Salmonella enterica enterica serovar Typhi
gccgugccugcuccgcca

SEQ ID NO: 3625175 - RNA, 19 nt, Salmonella enterica enterica serovar Typhi
gccgugcgccgacaucgcc

SEQ ID NO: 3625176 - RNA, 21 nt, Salmonella enterica enterica serovar Typhi
gccgugcguuuugugcggccu

SEQ ID NO: 3625177 - RNA, 13 nt, Salmonella enterica enterica serovar Typhi
gccguggcgcauc

SEQ ID NO: 3625178 - RNA, 21 nt, Salmonella enterica enterica serovar Typhi
gccguggcggugacuuccuga

SEQ ID NO: 3625179 - RNA, 19 nt, Salmonella enterica enterica serovar Typhi
gccgugucaucauuacagg

SEQ ID NO: 3625180 - RNA, 16 nt, Salmonella enterica enterica serovar Typhi
gccguguucuuaccca

SEQ ID NO: 3625181 - RNA, 19 nt, Salmonella enterica enterica serovar Typhi
gccguguugugugccgcgc

SEQ ID NO: 3625182 - RNA, 16 nt, Salmonella enterica enterica serovar Typhi
gccguuaacuggcgca

SEQ ID NO: 3625183 - RNA, 15 nt, Salmonella enterica enterica serovar Typhi
gccguuaauuuucac

SEQ ID NO: 3625184 - RNA, 14 nt, Salmonella enterica enterica serovar Typhi
gccguuaccgccga

SEQ ID NO: 3625185 - RNA, 15 nt, Salmonella enterica enterica serovar Typhi
gccguuaccguggcg

SEQ ID NO: 3625186 - RNA, 13 nt, Salmonella enterica enterica serovar Typhi
gccguuagcgccu

SEQ ID NO: 3625187 - RNA, 15 nt, Salmonella enterica enterica serovar Typhi
gccguuagcgccuuu

SEQ ID NO: 3625188 - RNA, 18 nt, Salmonella enterica enterica serovar Typhi
gccguuauugucaugcua

SEQ ID NO: 3625189 - RNA, 20 nt, Salmonella enterica enterica serovar Typhi
gccguucauucgccccagca

SEQ ID NO: 3625190 - RNA, 22 nt, Salmonella enterica enterica serovar Typhi
gccguucauucgccccagcaua

SEQ ID NO: 3625191 - RNA, 24 nt, Salmonella enterica enterica serovar Typhi
gccguuggcuuuggcucacugcua

SEQ ID NO: 3625192 - RNA, 18 nt, Salmonella enterica enterica serovar Typhi
gccguugucauggcgcca

SEQ ID NO: 3625193 - RNA, 13 nt, Salmonella enterica enterica serovar Typhi
gccguuucaaccc

SEQ ID NO: 3625194 - RNA, 21 nt, Salmonella enterica enterica serovar Typhi
gccguuuuaacgucauuacca

SEQ ID NO: 3625195 - RNA, 16 nt, Salmonella enterica enterica serovar Typhi
gccguuuucaauaauc

SEQ ID NO: 3625196 - RNA, 22 nt, Salmonella enterica enterica serovar Typhi
gccguuuuccggucgcgcaauc

SEQ ID NO: 3625197 - RNA, 20 nt, Salmonella enterica enterica serovar Typhi
gccguuuuuaacgccggcaa

SEQ ID NO: 3625198 - RNA, 19 nt, Salmonella enterica enterica serovar Typhi
gccguuuuuaauuugcucc

SEQ ID NO: 3625199 - RNA, 13 nt, Salmonella enterica enterica serovar Typhi
gccuaaaaaugag

SEQ ID NO: 3625200 - RNA, 13 nt, Salmonella enterica enterica serovar Typhi
gccuaaagaaaaa

SEQ ID NO: 3625201 - RNA, 14 nt, Salmonella enterica enterica serovar Typhi
gccuaaagaaaaac

SEQ ID NO: 3625202 - RNA, 14 nt, Salmonella enterica enterica serovar Typhi
gccuaacagcgccg

SEQ ID NO: 3625203 - RNA, 14 nt, Salmonella enterica enterica serovar Typhi
gccuaagaccagca

SEQ ID NO: 3625204 - RNA, 16 nt, Salmonella enterica enterica serovar Typhi
gccuaagaccagcacc

SEQ ID NO: 3625205 - RNA, 18 nt, Salmonella enterica enterica serovar Typhi
gccuaagcccaccaucag

SEQ ID NO: 3625206 - RNA, 12 nt, Salmonella enterica enterica serovar Typhi
gccuaauccgcc

SEQ ID NO: 3625207 - RNA, 14 nt, Salmonella enterica enterica serovar Typhi
gccuaaugagccag

SEQ ID NO: 3625208 - RNA, 23 nt, Salmonella enterica enterica serovar Typhi
gccuaaugggccagauucuuagu

SEQ ID NO: 3625209 - RNA, 12 nt, Salmonella enterica enterica serovar Typhi
gccuacaaagcc

SEQ ID NO: 3625210 - RNA, 21 nt, Salmonella enterica enterica serovar Typhi
gccuacaacucagcguaauug

SEQ ID NO: 3625211 - RNA, 12 nt, Salmonella enterica enterica serovar Typhi
gccuacaagaau

SEQ ID NO: 3625212 - RNA, 18 nt, Salmonella enterica enterica serovar Typhi
gccuacaaggcauucagg

SEQ ID NO: 3625213 - RNA, 20 nt, Salmonella enterica enterica serovar Typhi
gccuacacucugcgcgcgau

SEQ ID NO: 3625214 - RNA, 22 nt, Salmonella enterica enterica serovar Typhi
gccuacagaacugcacgaaaug

SEQ ID NO: 3625215 - RNA, 14 nt, Salmonella enterica enterica serovar Typhi
gccuacauccggcu

SEQ ID NO: 3625216 - RNA, 19 nt, Salmonella enterica enterica serovar Typhi
gccuaccagcgcuauccag

SEQ ID NO: 3625217 - RNA, 15 nt, Salmonella enterica enterica serovar Typhi
gccuaccagucgacu

SEQ ID NO: 3625218 - RNA, 14 nt, Salmonella enterica enterica serovar Typhi
gccuaccaucgcgc

SEQ ID NO: 3625219 - RNA, 15 nt, Salmonella enterica enterica serovar Typhi
gccuacccgcgugcg

SEQ ID NO: 3625220 - RNA, 13 nt, Salmonella enterica enterica serovar Typhi
gccuaccgccaua

SEQ ID NO: 3625221 - RNA, 15 nt, Salmonella enterica enterica serovar Typhi
gccuaccugccgcca

SEQ ID NO: 3625222 - RNA, 23 nt, Salmonella enterica enterica serovar Typhi
gccuacggucgguuucauaacgc

SEQ ID NO: 3625223 - RNA, 21 nt, Salmonella enterica enterica serovar Typhi
gccuagcugcguuuccagcca

SEQ ID NO: 3625224 - RNA, 23 nt, Salmonella enterica enterica serovar Typhi
gccuauagacaccuuauauuccg

SEQ ID NO: 3625225 - RNA, 20 nt, Salmonella enterica enterica serovar Typhi
gccuaucagcgauccgccgu

SEQ ID NO: 3625226 - RNA, 20 nt, Salmonella enterica enterica serovar Typhi
gccuaucgccauauacgcca

SEQ ID NO: 3625227 - RNA, 19 nt, Salmonella enterica enterica serovar Typhi
gccuaugcugucgcaauuu

SEQ ID NO: 3625228 - RNA, 18 nt, Salmonella enterica enterica serovar Typhi
gccuauuuucucuuccac

SEQ ID NO: 3625229 - RNA, 22 nt, Salmonella enterica enterica serovar Typhi
gccucaauugccgccagcuccu

SEQ ID NO: 3625230 - RNA, 10 nt, Salmonella enterica enterica serovar Typhi
gccucaggcg

SEQ ID NO: 3625231 - RNA, 20 nt, Salmonella enterica enterica serovar Typhi
gccucaucgacagacuucac

SEQ ID NO: 3625232 - RNA, 20 nt, Salmonella enterica enterica serovar Typhi
gccucaucgggacggcgguc

SEQ ID NO: 3625233 - RNA, 16 nt, Salmonella enterica enterica serovar Typhi
gccuccacaaagcgcg

SEQ ID NO: 3625234 - RNA, 23 nt, Salmonella enterica enterica serovar Typhi
gccuccaccguuugcagccagau

SEQ ID NO: 3625235 - RNA, 22 nt, Salmonella enterica enterica serovar Typhi
gccuccagacuggcgaccgcca

SEQ ID NO: 3625236 - RNA, 20 nt, Salmonella enterica enterica serovar Typhi
gccuccauuuuggggaaaau

SEQ ID NO: 3625237 - RNA, 18 nt, Salmonella enterica enterica serovar Typhi
gccucccaguucccccgg

SEQ ID NO: 3625238 - RNA, 13 nt, Salmonella enterica enterica serovar Typhi
gccuccccugccg

SEQ ID NO: 3625239 - RNA, 18 nt, Salmonella enterica enterica serovar Typhi
gccuccgcguagcccagc

SEQ ID NO: 3625240 - RNA, 15 nt, Salmonella enterica enterica serovar Typhi
gccuccgcuuccugc

SEQ ID NO: 3625241 - RNA, 21 nt, Salmonella enterica enterica serovar Typhi
gccuccgcuuccugcgccagu

SEQ ID NO: 3625242 - RNA, 16 nt, Salmonella enterica enterica serovar Typhi
gccuccggaucgacag

SEQ ID NO: 3625243 - RNA, 16 nt, Salmonella enterica enterica serovar Typhi
gccuccggaugacgcc

SEQ ID NO: 3625244 - RNA, 20 nt, Salmonella enterica enterica serovar Typhi
gccuccggaugacgccgcuu

SEQ ID NO: 3625245 - RNA, 14 nt, Salmonella enterica enterica serovar Typhi
gccuccggcgguga

SEQ ID NO: 3625246 - RNA, 18 nt, Salmonella enterica enterica serovar Typhi
gccucgcaaaacauggcu

SEQ ID NO: 3625247 - RNA, 16 nt, Salmonella enterica enterica serovar Typhi
gccucgccaaagcgcu

SEQ ID NO: 3625248 - RNA, 15 nt, Salmonella enterica enterica serovar Typhi
gccucgcgauccgcc

SEQ ID NO: 3625249 - RNA, 18 nt, Salmonella enterica enterica serovar Typhi
gccucgcgcauccgggcc

SEQ ID NO: 3625250 - RNA, 22 nt, Salmonella enterica enterica serovar Typhi
gccucgcgcauccgggccgcua

SEQ ID NO: 3625251 - RNA, 21 nt, Salmonella enterica enterica serovar Typhi
gccucguaucugucccagccu

SEQ ID NO: 3625252 - RNA, 22 nt, Salmonella enterica enterica serovar Typhi
gccucguguaaggcuuccggca

SEQ ID NO: 3625253 - RNA, 20 nt, Salmonella enterica enterica serovar Typhi
gccucguucccagcgggaac

SEQ ID NO: 3625254 - RNA, 17 nt, Salmonella enterica enterica serovar Typhi
gccucguuuugcugcca

SEQ ID NO: 3625255 - RNA, 14 nt, Salmonella enterica enterica serovar Typhi
gccucuaucuucuc

SEQ ID NO: 3625256 - RNA, 16 nt, Salmonella enterica enterica serovar Typhi
gccucuaucuucucag

SEQ ID NO: 3625257 - RNA, 16 nt, Salmonella enterica enterica serovar Typhi
gccucucccagcauga

SEQ ID NO: 3625258 - RNA, 13 nt, Salmonella enterica enterica serovar Typhi
gccucugauuuuu

SEQ ID NO: 3625259 - RNA, 22 nt, Salmonella enterica enterica serovar Typhi
gccucuggccgcgcuuuuuuaa

SEQ ID NO: 3625260 - RNA, 16 nt, Salmonella enterica enterica serovar Typhi
gccucuucaaauuugu

SEQ ID NO: 3625261 - RNA, 19 nt, Salmonella enterica enterica serovar Typhi
gccucuucacauaauggag

SEQ ID NO: 3625262 - RNA, 21 nt, Salmonella enterica enterica serovar Typhi
gccucuucuggcucccgcagc

SEQ ID NO: 3625263 - RNA, 20 nt, Salmonella enterica enterica serovar Typhi
gccucuuggaugauuuucuu

SEQ ID NO: 3625264 - RNA, 21 nt, Salmonella enterica enterica serovar Typhi
gccucuuucagaucgccgccg

SEQ ID NO: 3625265 - RNA, 23 nt, Salmonella enterica enterica serovar Typhi
gccucuuucagaucgccgccggu

SEQ ID NO: 3625266 - RNA, 17 nt, Salmonella enterica enterica serovar Typhi
gccucuuuugcauuaca

SEQ ID NO: 3625267 - RNA, 19 nt, Salmonella enterica enterica serovar Typhi
gccucuuuuuucgccacgc

SEQ ID NO: 3625268 - RNA, 14 nt, Salmonella enterica enterica serovar Typhi
gccugaaccggugg

SEQ ID NO: 3625269 - RNA, 16 nt, Salmonella enterica enterica serovar Typhi
gccugaagauacgcca

SEQ ID NO: 3625270 - RNA, 17 nt, Salmonella enterica enterica serovar Typhi
gccugaagcgcaguguu

SEQ ID NO: 3625271 - RNA, 13 nt, Salmonella enterica enterica serovar Typhi
gccugaaucgccg

SEQ ID NO: 3625272 - RNA, 11 nt, Salmonella enterica enterica serovar Typhi
gccugaaugcu

SEQ ID NO: 3625273 - RNA, 12 nt, Salmonella enterica enterica serovar Typhi
gccugaaugcuc

SEQ ID NO: 3625274 - RNA, 22 nt, Salmonella enterica enterica serovar Typhi
gccugacaggagcgccguggaa

SEQ ID NO: 3625275 - RNA, 21 nt, Salmonella enterica enterica serovar Typhi
gccugacgaaagucauccagu

SEQ ID NO: 3625276 - RNA, 10 nt, Salmonella enterica enterica serovar Typhi
gccugagcgc

SEQ ID NO: 3625277 - RNA, 20 nt, Salmonella enterica enterica serovar Typhi
gccugauaaacguagcguca

SEQ ID NO: 3625278 - RNA, 21 nt, Salmonella enterica enterica serovar Typhi
gccugauaaauaugucggccc

SEQ ID NO: 3625279 - RNA, 16 nt, Salmonella enterica enterica serovar Typhi
gccugauaagcacagg

SEQ ID NO: 3625280 - RNA, 20 nt, Salmonella enterica enterica serovar Typhi
gccugauaagcauagcgcca

SEQ ID NO: 3625281 - RNA, 20 nt, Salmonella enterica enterica serovar Typhi
gccugauaagcgaagcgcca

SEQ ID NO: 3625282 - RNA, 14 nt, Salmonella enterica enterica serovar Typhi
gccugauaagcgca

SEQ ID NO: 3625283 - RNA, 15 nt, Salmonella enterica enterica serovar Typhi
gccugauaagcgcag

SEQ ID NO: 3625284 - RNA, 16 nt, Salmonella enterica enterica serovar Typhi
gccugauaagcgcagc

SEQ ID NO: 3625285 - RNA, 20 nt, Salmonella enterica enterica serovar Typhi
gccugauaagcgcagcgcca

SEQ ID NO: 3625286 - RNA, 12 nt, Salmonella enterica enterica serovar Typhi
gccugauaaggu

SEQ ID NO: 3625287 - RNA, 13 nt, Salmonella enterica enterica serovar Typhi
gccugaucgccac

SEQ ID NO: 3625288 - RNA, 18 nt, Salmonella enterica enterica serovar Typhi
gccugaucgcgcagacag

SEQ ID NO: 3625289 - RNA, 16 nt, Salmonella enterica enterica serovar Typhi
gccugaucuuucuggu

SEQ ID NO: 3625290 - RNA, 20 nt, Salmonella enterica enterica serovar Typhi
gccugaugagcgcagcgacu

SEQ ID NO: 3625291 - RNA, 15 nt, Salmonella enterica enterica serovar Typhi
gccugaugccgccgu

SEQ ID NO: 3625292 - RNA, 13 nt, Salmonella enterica enterica serovar Typhi
gccugaugcgccg

SEQ ID NO: 3625293 - RNA, 15 nt, Salmonella enterica enterica serovar Typhi
gccugaugcgccgcc

SEQ ID NO: 3625294 - RNA, 19 nt, Salmonella enterica enterica serovar Typhi
gccugaugcgccgccuugg

SEQ ID NO: 3625295 - RNA, 20 nt, Salmonella enterica enterica serovar Typhi
gccugaugcgccgccuuggc

SEQ ID NO: 3625296 - RNA, 24 nt, Salmonella enterica enterica serovar Typhi
gccugaugcgcguuuagcgccagc

SEQ ID NO: 3625297 - RNA, 16 nt, Salmonella enterica enterica serovar Typhi
gccugaugcugcgcau

SEQ ID NO: 3625298 - RNA, 11 nt, Salmonella enterica enterica serovar Typhi
gccugauggcg

SEQ ID NO: 3625299 - RNA, 19 nt, Salmonella enterica enterica serovar Typhi
gccugauggcgcuacgcca

SEQ ID NO: 3625300 - RNA, 21 nt, Salmonella enterica enterica serovar Typhi
gccugauggcgcuacgccauc

SEQ ID NO: 3625301 - RNA, 20 nt, Salmonella enterica enterica serovar Typhi
gccugauggcgcuacgcuua

SEQ ID NO: 3625302 - RNA, 23 nt, Salmonella enterica enterica serovar Typhi
gccugauggcgcuacgcuuauca

SEQ ID NO: 3625303 - RNA, 23 nt, Salmonella enterica enterica serovar Typhi
gccugauggcgcuucgcuuauca

SEQ ID NO: 3625304 - RNA, 14 nt, Salmonella enterica enterica serovar Typhi
gccugauggcguag

SEQ ID NO: 3625305 - RNA, 19 nt, Salmonella enterica enterica serovar Typhi
gccugauggcguagcgcca

SEQ ID NO: 3625306 - RNA, 20 nt, Salmonella enterica enterica serovar Typhi
gccugauucaccaacugcug

SEQ ID NO: 3625307 - RNA, 14 nt, Salmonella enterica enterica serovar Typhi
gccugauucauucc

SEQ ID NO: 3625308 - RNA, 17 nt, Salmonella enterica enterica serovar Typhi
gccugauuucccaguug

SEQ ID NO: 3625309 - RNA, 20 nt, Salmonella enterica enterica serovar Typhi
gccugcaaaccucucccccg

SEQ ID NO: 3625310 - RNA, 15 nt, Salmonella enterica enterica serovar Typhi
uuauacacucaacca

SEQ ID NO: 3625311 - RNA, 23 nt, Salmonella enterica enterica serovar Typhi
uuauacauccugugaaguaaaaa

SEQ ID NO: 3625312 - RNA, 17 nt, Salmonella enterica enterica serovar Typhi
uuauacgccuauuuucu

SEQ ID NO: 3625313 - RNA, 15 nt, Salmonella enterica enterica serovar Typhi
uuauacucaaaaaau

SEQ ID NO: 3625314 - RNA, 11 nt, Salmonella enterica enterica serovar Typhi
uuauacugaua

SEQ ID NO: 3625315 - RNA, 15 nt, Salmonella enterica enterica serovar Typhi
uuauacugauaaacu

SEQ ID NO: 3625316 - RNA, 16 nt, Salmonella enterica enterica serovar Typhi
uuauacuugcugcuau

SEQ ID NO: 3625317 - RNA, 20 nt, Salmonella enterica enterica serovar Typhi
uuauacuugcugcuauguaa

SEQ ID NO: 3625318 - RNA, 21 nt, Salmonella enterica enterica serovar Typhi
uuauagacgccggucaugcca

SEQ ID NO: 3625319 - RNA, 20 nt, Salmonella enterica enterica serovar Typhi
uuauagcaaacccucaucgg

SEQ ID NO: 3625320 - RNA, 17 nt, Salmonella enterica enterica serovar Typhi
uuauagcuggcuuuaua

SEQ ID NO: 3625321 - RNA, 20 nt, Salmonella enterica enterica serovar Typhi
uuauagcuggcuuuauauaa

SEQ ID NO: 3625322 - RNA, 14 nt, Salmonella enterica enterica serovar Typhi
uuauaggucagguu

SEQ ID NO: 3625323 - RNA, 13 nt, Salmonella enterica enterica serovar Typhi
uuauaguccacuu

SEQ ID NO: 3625324 - RNA, 12 nt, Salmonella enterica enterica serovar Typhi
uuauauaaaaau

SEQ ID NO: 3625325 - RNA, 17 nt, Salmonella enterica enterica serovar Typhi
uuauauagucuuaauuu

SEQ ID NO: 3625326 - RNA, 21 nt, Salmonella enterica enterica serovar Typhi
uuauaucaggcaaaaaucguc

SEQ ID NO: 3625327 - RNA, 13 nt, Salmonella enterica enterica serovar Typhi
uggauaaccugcc

SEQ ID NO: 3625328 - RNA, 13 nt, Salmonella enterica enterica serovar Typhi
uggauaaggcgug

SEQ ID NO: 3625329 - RNA, 18 nt, Salmonella enterica enterica serovar Typhi
uggauaaggcgugagcca

SEQ ID NO: 3625330 - RNA, 18 nt, Salmonella enterica enterica serovar Typhi
uggauaauugcucugcca

SEQ ID NO: 3625331 - RNA, 19 nt, Salmonella enterica enterica serovar Typhi
uggauaauugcucugccag

SEQ ID NO: 3625332 - RNA, 14 nt, Salmonella enterica enterica serovar Typhi
uggauaccgcgcca

SEQ ID NO: 3625333 - RNA, 23 nt, Salmonella enterica enterica serovar Typhi
uggauagagucgauagaucgcca

SEQ ID NO: 3625334 - RNA, 17 nt, Salmonella enterica enterica serovar Typhi
uggauagcaauuucagc

SEQ ID NO: 3625335 - RNA, 21 nt, Salmonella enterica enterica serovar Typhi
uggauagcaccauaaacggca

SEQ ID NO: 3625336 - RNA, 17 nt, Salmonella enterica enterica serovar Typhi
uggauagucaggcgaug

SEQ ID NO: 3625337 - RNA, 15 nt, Salmonella enterica enterica serovar Typhi
uggauauucaucgcc

SEQ ID NO: 3625338 - RNA, 20 nt, Salmonella enterica enterica serovar Typhi
uggaucacuuuugccgucag

SEQ ID NO: 3625339 - RNA, 13 nt, Salmonella enterica enterica serovar Typhi
uggaugaacucaa

SEQ ID NO: 3625340 - RNA, 14 nt, Salmonella enterica enterica serovar Typhi
uggaugaacucaau

SEQ ID NO: 3625341 - RNA, 23 nt, Salmonella enterica enterica serovar Typhi
uggaugcccaccugaaaaagggu

SEQ ID NO: 3625342 - RNA, 22 nt, Salmonella enterica enterica serovar Typhi
uggaugcgcugaauagcgcugc

SEQ ID NO: 3625343 - RNA, 13 nt, Salmonella enterica enterica serovar Typhi
uggaugcguucaa

SEQ ID NO: 3625344 - RNA, 15 nt, Salmonella enterica enterica serovar Typhi
uggaugguuucuucg

SEQ ID NO: 3625345 - RNA, 21 nt, Salmonella enterica enterica serovar Typhi
uggaugucggcguaaauccag

SEQ ID NO: 3625346 - RNA, 22 nt, Salmonella enterica enterica serovar Typhi
uggauuaaaaaaggcagaagaa

SEQ ID NO: 3625347 - RNA, 17 nt, Salmonella enterica enterica serovar Typhi
uggauuacaaaaauaga

SEQ ID NO: 3625348 - RNA, 20 nt, Salmonella enterica enterica serovar Typhi
uggauucaugaucuuuccuu

SEQ ID NO: 3625349 - RNA, 13 nt, Salmonella enterica enterica serovar Typhi
uggauuuauggcg

SEQ ID NO: 3625350 - RNA, 19 nt, Salmonella enterica enterica serovar Typhi
uggauuucacgaucaucgc

SEQ ID NO: 3625351 - RNA, 18 nt, Salmonella enterica enterica serovar Typhi
uggauuuuugacuaaagu

SEQ ID NO: 3625352 - RNA, 22 nt, Salmonella enterica enterica serovar Typhi
uggcaaaaaaggccagacucau

SEQ ID NO: 3625353 - RNA, 18 nt, Salmonella enterica enterica serovar Typhi
uggcaaaaacaccuaacc

SEQ ID NO: 3625354 - RNA, 16 nt, Salmonella enterica enterica serovar Typhi
uggcaaaacgcaucca

SEQ ID NO: 3625355 - RNA, 20 nt, Salmonella enterica enterica serovar Typhi
uggcaaaaggggcguuucuc

SEQ ID NO: 3625356 - RNA, 13 nt, Salmonella enterica enterica serovar Typhi
uggcaacagccau

SEQ ID NO: 3625357 - RNA, 20 nt, Salmonella enterica enterica serovar Typhi
uggcaacauagcaucguuac

SEQ ID NO: 3625358 - RNA, 13 nt, Salmonella enterica enterica serovar Typhi
uggcaacauuaau

SEQ ID NO: 3625359 - RNA, 13 nt, Salmonella enterica enterica serovar Typhi
uggcaagaaucac

SEQ ID NO: 3625360 - RNA, 21 nt, Salmonella enterica enterica serovar Typhi
uggcaagaccgauagagacug

SEQ ID NO: 3625361 - RNA, 17 nt, Salmonella enterica enterica serovar Typhi
uggcaagcgccagcaug

SEQ ID NO: 3625362 - RNA, 17 nt, Salmonella enterica enterica serovar Typhi
uggcaagcgcuaagcaa

SEQ ID NO: 3625363 - RNA, 21 nt, Salmonella enterica enterica serovar Typhi
uggcaaguaugaaaagcgcgu

SEQ ID NO: 3625364 - RNA, 20 nt, Salmonella enterica enterica serovar Typhi
uggcaaucaaauccagcuca

SEQ ID NO: 3625365 - RNA, 22 nt, Salmonella enterica enterica serovar Typhi
uggcaaucaaauccagcucagu

SEQ ID NO: 3625366 - RNA, 15 nt, Salmonella enterica enterica serovar Typhi
uggcaaucauaccgu

SEQ ID NO: 3625367 - RNA, 16 nt, Salmonella enterica enterica serovar Typhi
uggcaauggcggcgga

SEQ ID NO: 3625368 - RNA, 19 nt, Salmonella enterica enterica serovar Typhi
uggcaauguugagcaucgc

SEQ ID NO: 3625369 - RNA, 17 nt, Salmonella enterica enterica serovar Typhi
uggcaauuaaauuagaa

SEQ ID NO: 3625370 - RNA, 14 nt, Salmonella enterica enterica serovar Typhi
uggcacagcgcagc

SEQ ID NO: 3625371 - RNA, 13 nt, Salmonella enterica enterica serovar Typhi
uggcacuggcagc

SEQ ID NO: 3625372 - RNA, 21 nt, Salmonella enterica enterica serovar Typhi
uggcacuggcagccucguccu

SEQ ID NO: 3625373 - RNA, 15 nt, Salmonella enterica enterica serovar Typhi
uggcacuucgcgcca

SEQ ID NO: 3625374 - RNA, 22 nt, Salmonella enterica enterica serovar Typhi
uggcagaacggcgacggcuuca

SEQ ID NO: 3625375 - RNA, 16 nt, Salmonella enterica enterica serovar Typhi
uggcagaccguggccg

SEQ ID NO: 3625376 - RNA, 16 nt, Salmonella enterica enterica serovar Typhi
uggcagaguccagcgg

SEQ ID NO: 3625377 - RNA, 15 nt, Salmonella enterica enterica serovar Typhi
uggcagaugaacaua

SEQ ID NO: 3625378 - RNA, 17 nt, Salmonella enterica enterica serovar Typhi
uggcagccccugaaaua

SEQ ID NO: 3625379 - RNA, 16 nt, Salmonella enterica enterica serovar Typhi
uggcagccucguccug

SEQ ID NO: 3625380 - RNA, 23 nt, Salmonella enterica enterica serovar Typhi
uggcagccucguccugcaauuug

SEQ ID NO: 3625381 - RNA, 23 nt, Salmonella enterica enterica serovar Typhi
uggcagcgccugacggcgcuguc

SEQ ID NO: 3625382 - RNA, 19 nt, Salmonella enterica enterica serovar Typhi
uggcagcggcaguaaauuu

SEQ ID NO: 3625383 - RNA, 22 nt, Salmonella enterica enterica serovar Typhi
uggcagggcugaaucggcaccu

SEQ ID NO: 3625384 - RNA, 17 nt, Salmonella enterica enterica serovar Typhi
uggcaguacagggcgau

SEQ ID NO: 3625385 - RNA, 15 nt, Salmonella enterica enterica serovar Typhi
uggcagugauggaug

SEQ ID NO: 3625386 - RNA, 15 nt, Salmonella enterica enterica serovar Typhi
uggcauagccaaaga

SEQ ID NO: 3625387 - RNA, 20 nt, Salmonella enterica enterica serovar Typhi
uggcauagccugauauccac

SEQ ID NO: 3625388 - RNA, 20 nt, Salmonella enterica enterica serovar Typhi
uggcauauugcgaucuguac

SEQ ID NO: 3625389 - RNA, 20 nt, Salmonella enterica enterica serovar Typhi
uggcauauuugccccuuccg

SEQ ID NO: 3625390 - RNA, 22 nt, Salmonella enterica enterica serovar Typhi
uggcauauuugccccuuccgcc

SEQ ID NO: 3625391 - RNA, 15 nt, Salmonella enterica enterica serovar Typhi
uggcaucaucaaacg

SEQ ID NO: 3625392 - RNA, 17 nt, Salmonella enterica enterica serovar Typhi
uggcaucugaucuacaa

SEQ ID NO: 3625393 - RNA, 18 nt, Salmonella enterica enterica serovar Typhi
uggcauuacgcuggcccc

SEQ ID NO: 3625394 - RNA, 20 nt, Salmonella enterica enterica serovar Typhi
uggcauugccggaaaccaac

SEQ ID NO: 3625395 - RNA, 13 nt, Salmonella enterica enterica serovar Typhi
uggcauuggcauc

SEQ ID NO: 3625396 - RNA, 15 nt, Salmonella enterica enterica serovar Typhi
uuaaucgcuucaauc

SEQ ID NO: 3625397 - RNA, 14 nt, Salmonella enterica enterica serovar Typhi
uuaaucgucauccc

SEQ ID NO: 3625398 - RNA, 15 nt, Salmonella enterica enterica serovar Typhi
uuaaucgucaucccg

SEQ ID NO: 3625399 - RNA, 14 nt, Salmonella enterica enterica serovar Typhi
uuaaucuauuuaau

SEQ ID NO: 3625400 - RNA, 13 nt, Salmonella enterica enterica serovar Typhi
uuaaucuuaucca

SEQ ID NO: 3625401 - RNA, 23 nt, Salmonella enterica enterica serovar Typhi
uuaaugaguagaacguauuauua

SEQ ID NO: 3625402 - RNA, 13 nt, Salmonella enterica enterica serovar Typhi
uuaaugauuugcu

SEQ ID NO: 3625403 - RNA, 23 nt, Salmonella enterica enterica serovar Typhi
uuaaugcauggcagauaaaccac

SEQ ID NO: 3625404 - RNA, 18 nt, Salmonella enterica enterica serovar Typhi
uuaaugcgcacgccagcg

SEQ ID NO: 3625405 - RNA, 21 nt, Salmonella enterica enterica serovar Typhi
uuaaugcgccccugcaggcga

SEQ ID NO: 3625406 - RNA, 23 nt, Salmonella enterica enterica serovar Typhi
uuaaugcgccccugcaggcgauc

SEQ ID NO: 3625407 - RNA, 17 nt, Salmonella enterica enterica serovar Typhi
uuaaugcuaucccaggc

SEQ ID NO: 3625408 - RNA, 16 nt, Salmonella enterica enterica serovar Typhi
uuaaugcucuccagca

SEQ ID NO: 3625409 - RNA, 15 nt, Salmonella enterica enterica serovar Typhi
uuaaugcucugcugu

SEQ ID NO: 3625410 - RNA, 22 nt, Salmonella enterica enterica serovar Typhi
uuaaugcuguccugcaaaauac

SEQ ID NO: 3625411 - RNA, 18 nt, Salmonella enterica enterica serovar Typhi
uuaauggcagaauaaaac

SEQ ID NO: 3625412 - RNA, 20 nt, Salmonella enterica enterica serovar Typhi
ugcgcuuuaugcccuucgac

SEQ ID NO: 3625413 - RNA, 21 nt, Salmonella enterica enterica serovar Typhi
ugcgcuuuccgccaugaaaaa

SEQ ID NO: 3625414 - RNA, 18 nt, Salmonella enterica enterica serovar Typhi
ugcgcuuuuagccaguug

SEQ ID NO: 3625415 - RNA, 21 nt, Salmonella enterica enterica serovar Typhi
ugcggaaccgcccaucaacac

SEQ ID NO: 3625416 - RNA, 22 nt, Salmonella enterica enterica serovar Typhi
ugcggaacuaacccgcagccgg

SEQ ID NO: 3625417 - RNA, 18 nt, Salmonella enterica enterica serovar Typhi
ugcggacaggcgaaauaa

SEQ ID NO: 3625418 - RNA, 13 nt, Salmonella enterica enterica serovar Typhi
ugcggacauuaac

SEQ ID NO: 3625419 - RNA, 21 nt, Salmonella enterica enterica serovar Typhi
ugcggacggcgucuggugaaa

SEQ ID NO: 3625420 - RNA, 19 nt, Salmonella enterica enterica serovar Typhi
ugcggagaagacgccgccg

SEQ ID NO: 3625421 - RNA, 15 nt, Salmonella enterica enterica serovar Typhi
ugcggaugcgccauc

SEQ ID NO: 3625422 - RNA, 17 nt, Salmonella enterica enterica serovar Typhi
ugcggauuacgaauacc

SEQ ID NO: 3625423 - RNA, 13 nt, Salmonella enterica enterica serovar Typhi
ugcggauucagga

SEQ ID NO: 3625424 - RNA, 18 nt, Salmonella enterica enterica serovar Typhi
ugcggcaaaaauccuucu

SEQ ID NO: 3625425 - RNA, 21 nt, Salmonella enterica enterica serovar Typhi
ugcggcaauggccgcagcgcc

SEQ ID NO: 3625426 - RNA, 14 nt, Salmonella enterica enterica serovar Typhi
uuauggcccgccag

SEQ ID NO: 3625427 - RNA, 16 nt, Salmonella enterica enterica serovar Typhi
uuaugggaggauacug

SEQ ID NO: 3625428 - RNA, 16 nt, Salmonella enterica enterica serovar Typhi
uuauggguuuuuuauu

SEQ ID NO: 3625429 - RNA, 17 nt, Salmonella enterica enterica serovar Typhi
uuauguaccgucaucgc

SEQ ID NO: 3625430 - RNA, 23 nt, Salmonella enterica enterica serovar Typhi
uuauguagccagccauggcccuu

SEQ ID NO: 3625431 - RNA, 18 nt, Salmonella enterica enterica serovar Typhi
uuauguaggccugauaag

SEQ ID NO: 3625432 - RNA, 17 nt, Salmonella enterica enterica serovar Typhi
uuauguccuuccagcuc

SEQ ID NO: 3625433 - RNA, 13 nt, Salmonella enterica enterica serovar Typhi
uuauguuugccca

SEQ ID NO: 3625434 - RNA, 17 nt, Salmonella enterica enterica serovar Typhi
uuauguuugcugauaag

SEQ ID NO: 3625435 - RNA, 15 nt, Salmonella enterica enterica serovar Typhi
uuauuaacccuuccu

SEQ ID NO: 3625436 - RNA, 12 nt, Salmonella enterica enterica serovar Typhi
uuauuaccaaug

SEQ ID NO: 3625437 - RNA, 19 nt, Salmonella enterica enterica serovar Typhi
uuauuagaggucagaauaa

SEQ ID NO: 3625438 - RNA, 23 nt, Salmonella enterica enterica serovar Typhi
uuauuagaggucagaauaacuca

SEQ ID NO: 3625439 - RNA, 22 nt, Salmonella enterica enterica serovar Typhi
uuauuauagcuauggucacuuu

SEQ ID NO: 3625440 - RNA, 18 nt, Salmonella enterica enterica serovar Typhi
uuauucacuggcaacgau

SEQ ID NO: 3625441 - RNA, 15 nt, Salmonella enterica enterica serovar Typhi
uuauucaucuccucu

SEQ ID NO: 3625442 - RNA, 19 nt, Salmonella enterica enterica serovar Typhi
uuauuccauucaucgauuu

SEQ ID NO: 3625443 - RNA, 19 nt, Salmonella enterica enterica serovar Typhi
uuauuccuuaucacauuuu

SEQ ID NO: 3625444 - RNA, 23 nt, Salmonella enterica enterica serovar Typhi
uuauucgccuuucacgcguucaa

SEQ ID NO: 3625445 - RNA, 23 nt, Salmonella enterica enterica serovar Typhi
uuauucuuugucugucggacuca

SEQ ID NO: 3625446 - RNA, 19 nt, Salmonella enterica enterica serovar Typhi
uuauugaaaagcagccaga

SEQ ID NO: 3625447 - RNA, 23 nt, Salmonella enterica enterica serovar Typhi
uuauugaccaucgccagccauuc

SEQ ID NO: 3625448 - RNA, 15 nt, Salmonella enterica enterica serovar Typhi
uuauugagauaauuu

SEQ ID NO: 3625449 - RNA, 23 nt, Salmonella enterica enterica serovar Typhi
uuauugauccacggaucgacauu

SEQ ID NO: 3625450 - RNA, 18 nt, Salmonella enterica enterica serovar Typhi
uuauugccacgccauacg

SEQ ID NO: 3625451 - RNA, 22 nt, Salmonella enterica enterica serovar Typhi
uuauugcuguaggcacuuucca

SEQ ID NO: 3625452 - RNA, 16 nt, Salmonella enterica enterica serovar Typhi
uuauuguuaaaaagac

SEQ ID NO: 3625453 - RNA, 22 nt, Salmonella enterica enterica serovar Typhi
uuauuuaaaaaggaaagauuac

SEQ ID NO: 3625454 - RNA, 15 nt, Salmonella enterica enterica serovar Typhi
uuauuuaacgccagu

SEQ ID NO: 3625455 - RNA, 21 nt, Salmonella enterica enterica serovar Typhi
uuauuucaggaauacauuaac

SEQ ID NO: 3625456 - RNA, 12 nt, Salmonella enterica enterica serovar Typhi
uuauuugaauag

SEQ ID NO: 3625457 - RNA, 21 nt, Salmonella enterica enterica serovar Typhi
uuauuugaauagucaaccguu

SEQ ID NO: 3625458 - RNA, 13 nt, Salmonella enterica enterica serovar Typhi
uuauuugauggga

SEQ ID NO: 3625459 - RNA, 20 nt, Salmonella enterica enterica serovar Typhi
uuauuuuucgccagaucgau

SEQ ID NO: 3625460 - RNA, 12 nt, Salmonella enterica enterica serovar Typhi
uucaaaaaagag

SEQ ID NO: 3625461 - RNA, 14 nt, Salmonella enterica enterica serovar Typhi
uucaaaaucaaaca

SEQ ID NO: 3625462 - RNA, 17 nt, Salmonella enterica enterica serovar Typhi
uucaaaccuucaagaau

SEQ ID NO: 3625463 - RNA, 13 nt, Salmonella enterica enterica serovar Typhi
uucaaagacgguu

SEQ ID NO: 3625464 - RNA, 16 nt, Salmonella enterica enterica serovar Typhi
uucaacagcucgccau

SEQ ID NO: 3625465 - RNA, 19 nt, Salmonella enterica enterica serovar Typhi
uucaacagcucgccaugca

SEQ ID NO: 3625466 - RNA, 18 nt, Salmonella enterica enterica serovar Typhi
uucaacauauuuuucaca

SEQ ID NO: 3625467 - RNA, 15 nt, Salmonella enterica enterica serovar Typhi
uucaacaucagcgcu

SEQ ID NO: 3625468 - RNA, 17 nt, Salmonella enterica enterica serovar Typhi
uucaaccacggauaagc

SEQ ID NO: 3625469 - RNA, 23 nt, Salmonella enterica enterica serovar Typhi
uucaaccagccgaucagcgccau

SEQ ID NO: 3625470 - RNA, 17 nt, Salmonella enterica enterica serovar Typhi
uucaaccggcaguuuuu

SEQ ID NO: 3625471 - RNA, 15 nt, Salmonella enterica enterica serovar Typhi
uucaaccguuucuuu

SEQ ID NO: 3625472 - RNA, 12 nt, Salmonella enterica enterica serovar Typhi
uucaaccucacu

SEQ ID NO: 3625473 - RNA, 16 nt, Salmonella enterica enterica serovar Typhi
uucaaccuccugcaau

SEQ ID NO: 3625474 - RNA, 15 nt, Salmonella enterica enterica serovar Typhi
uucaacgcauccagc

SEQ ID NO: 3625475 - RNA, 14 nt, Salmonella enterica enterica serovar Typhi
uucaacgcgaccgg

SEQ ID NO: 3625476 - RNA, 19 nt, Salmonella enterica enterica serovar Typhi
uucaacgcguugccugaaa

SEQ ID NO: 3625477 - RNA, 18 nt, Salmonella enterica enterica serovar Typhi
uucaacgugcaucuccuc

SEQ ID NO: 3625478 - RNA, 18 nt, Salmonella enterica enterica serovar Typhi
uucaacuuccaccaccuc

SEQ ID NO: 3625479 - RNA, 12 nt, Salmonella enterica enterica serovar Typhi
uucaagcaauac

SEQ ID NO: 3625480 - RNA, 14 nt, Salmonella enterica enterica serovar Typhi
uucaagcaguucca

SEQ ID NO: 3625481 - RNA, 17 nt, Salmonella enterica enterica serovar Typhi
uucaagcaguuccagca

SEQ ID NO: 3625482 - RNA, 18 nt, Salmonella enterica enterica serovar Typhi
uucaagcccgugcuuagc

SEQ ID NO: 3625483 - RNA, 23 nt, Salmonella enterica enterica serovar Typhi
uucaagccguuuuggcagcgccc

SEQ ID NO: 3625484 - RNA, 16 nt, Salmonella enterica enterica serovar Typhi
uucaagcuggugcuuu

SEQ ID NO: 3625485 - RNA, 21 nt, Salmonella enterica enterica serovar Typhi
uucaaguuuagaaaaaauuaa

SEQ ID NO: 3625486 - RNA, 22 nt, Salmonella enterica enterica serovar Typhi
uucaaguuuagaaaaaauuaaa

SEQ ID NO: 3625487 - RNA, 21 nt, Salmonella enterica enterica serovar Typhi
uucaauaaauugaaauucuau

SEQ ID NO: 3625488 - RNA, 20 nt, Salmonella enterica enterica serovar Typhi
uucaauaagcgguaauaauu

SEQ ID NO: 3625489 - RNA, 21 nt, Salmonella enterica enterica serovar Typhi
uucaauaaguuagcuuuuuua

SEQ ID NO: 3625490 - RNA, 17 nt, Salmonella enterica enterica serovar Typhi
uucaauaauauuaucau

SEQ ID NO: 3625491 - RNA, 18 nt, Salmonella enterica enterica serovar Typhi
uucaauaauauuaucaua

SEQ ID NO: 3625492 - RNA, 20 nt, Salmonella enterica enterica serovar Typhi
uucaauaauauuaucauaau

SEQ ID NO: 3625493 - RNA, 21 nt, Salmonella enterica enterica serovar Typhi
uucaauaauggcgcgaaaaca

SEQ ID NO: 3625494 - RNA, 15 nt, Salmonella enterica enterica serovar Typhi
uucaauacgaaaacc

SEQ ID NO: 3625495 - RNA, 15 nt, Salmonella enterica enterica serovar Typhi
uucaauaugccaggc

SEQ ID NO: 3625496 - RNA, 20 nt, Salmonella enterica enterica serovar Typhi
uucaauauugaacauuuuuu

SEQ ID NO: 3625497 - RNA, 22 nt, Salmonella enterica enterica serovar Typhi
uucaaucacugaugccacaccc

SEQ ID NO: 3625498 - RNA, 18 nt, Salmonella enterica enterica serovar Typhi
uucaaucagcacgcgguc

SEQ ID NO: 3625499 - RNA, 13 nt, Salmonella enterica enterica serovar Typhi
uucaaucaucaua

SEQ ID NO: 3625500 - RNA, 17 nt, Salmonella enterica enterica serovar Typhi
uucaaucaucauauccc

SEQ ID NO: 3625501 - RNA, 19 nt, Salmonella enterica enterica serovar Typhi
uucaaucuggugacgauga

SEQ ID NO: 3625502 - RNA, 15 nt, Salmonella enterica enterica serovar Typhi
uucaaugaacaauaa

SEQ ID NO: 3625503 - RNA, 14 nt, Salmonella enterica enterica serovar Typhi
uucaaugcacgcca

SEQ ID NO: 3625504 - RNA, 16 nt, Salmonella enterica enterica serovar Typhi
uucaaugccaugcugg

SEQ ID NO: 3625505 - RNA, 14 nt, Salmonella enterica enterica serovar Typhi
uucaaugcccaggc

SEQ ID NO: 3625506 - RNA, 17 nt, Salmonella enterica enterica serovar Typhi
uucaauggguuaugggu

SEQ ID NO: 3625507 - RNA, 19 nt, Salmonella enterica enterica serovar Typhi
uucaauuaaugaguagaac

SEQ ID NO: 3625508 - RNA, 19 nt, Salmonella enterica enterica serovar Typhi
uucaauuagcgccuccccu

SEQ ID NO: 3625509 - RNA, 21 nt, Salmonella enterica enterica serovar Typhi
uucaauuugugagauaaaaaa

SEQ ID NO: 3625510 - RNA, 13 nt, Salmonella enterica enterica serovar Typhi
uucacaaacuucu

SEQ ID NO: 3625511 - RNA, 17 nt, Salmonella enterica enterica serovar Typhi
uucacacaauuuucuua

SEQ ID NO: 3625512 - RNA, 19 nt, Salmonella enterica enterica serovar Typhi
uucacaccguuauccggca

SEQ ID NO: 3625513 - RNA, 20 nt, Salmonella enterica enterica serovar Typhi
uucacaccguuauccggcaa

SEQ ID NO: 3625514 - RNA, 21 nt, Salmonella enterica enterica serovar Typhi
uucacaccuuuauauuuuucc

SEQ ID NO: 3625515 - RNA, 13 nt, Salmonella enterica enterica serovar Typhi
uucacauauauuu

SEQ ID NO: 3625516 - RNA, 19 nt, Salmonella enterica enterica serovar Typhi
uucaccaccgguauaaaac

SEQ ID NO: 3625517 - RNA, 18 nt, Salmonella enterica enterica serovar Typhi
uucaccauuaagcaaucc

SEQ ID NO: 3625518 - RNA, 22 nt, Salmonella enterica enterica serovar Typhi
uucaccauuaauacccauagua

SEQ ID NO: 3625519 - RNA, 16 nt, Salmonella enterica enterica serovar Typhi
uucacccacugcacau

SEQ ID NO: 3625520 - RNA, 20 nt, Salmonella enterica enterica serovar Typhi
uucacccagacugugauggc

SEQ ID NO: 3625521 - RNA, 13 nt, Salmonella enterica enterica serovar Typhi
uucacccccaucg

SEQ ID NO: 3625522 - RNA, 16 nt, Salmonella enterica enterica serovar Typhi
uucacccguuauucau

SEQ ID NO: 3625523 - RNA, 17 nt, Salmonella enterica enterica serovar Typhi
uucacccuauaagcugc

SEQ ID NO: 3625524 - RNA, 12 nt, Salmonella enterica enterica serovar Typhi
uucaccggauac

SEQ ID NO: 3625525 - RNA, 12 nt, Salmonella enterica enterica serovar Typhi
uucaccggcguu

SEQ ID NO: 3625526 - RNA, 13 nt, Salmonella enterica enterica serovar Typhi
uucaccggcuggu

SEQ ID NO: 3625527 - RNA, 15 nt, Salmonella enterica enterica serovar Typhi
uucaccguaucgccc

SEQ ID NO: 3625528 - RNA, 10 nt, Salmonella enterica enterica serovar Typhi
uucaccgugu

SEQ ID NO: 3625529 - RNA, 20 nt, Salmonella enterica enterica serovar Typhi
uucaccucccugcaacagca

SEQ ID NO: 3625530 - RNA, 23 nt, Salmonella enterica enterica serovar Typhi
uucaccuucugugaaaguuucag

SEQ ID NO: 3625531 - RNA, 16 nt, Salmonella enterica enterica serovar Typhi
uucacgaucaucgcau

SEQ ID NO: 3625532 - RNA, 21 nt, Salmonella enterica enterica serovar Typhi
uucacgcagucguuccagacg

SEQ ID NO: 3625533 - RNA, 11 nt, Salmonella enterica enterica serovar Typhi
uucacgccacc

SEQ ID NO: 3625534 - RNA, 18 nt, Salmonella enterica enterica serovar Typhi
uucacgccauugccagga

SEQ ID NO: 3625535 - RNA, 19 nt, Salmonella enterica enterica serovar Typhi
uucacgccauugccaggac

SEQ ID NO: 3625536 - RNA, 20 nt, Salmonella enterica enterica serovar Typhi
uucacgccgccauccggcaa

SEQ ID NO: 3625537 - RNA, 20 nt, Salmonella enterica enterica serovar Typhi
uucacgccgugaauuucugc

SEQ ID NO: 3625538 - RNA, 20 nt, Salmonella enterica enterica serovar Typhi
uucacgcuauguuugcugag

SEQ ID NO: 3625539 - RNA, 22 nt, Salmonella enterica enterica serovar Typhi
uucacgcuauguuugcugagaa

SEQ ID NO: 3625540 - RNA, 19 nt, Salmonella enterica enterica serovar Typhi
uucacgcucacgcagauau

SEQ ID NO: 3625541 - RNA, 20 nt, Salmonella enterica enterica serovar Typhi
uucacgcucacgcagauauu

SEQ ID NO: 3625542 - RNA, 24 nt, Salmonella enterica enterica serovar Typhi
uucacguacccaaauaucaaauac

SEQ ID NO: 3625543 - RNA, 17 nt, Salmonella enterica enterica serovar Typhi
uucacucuuugccgaug

SEQ ID NO: 3625544 - RNA, 15 nt, Salmonella enterica enterica serovar Typhi
uucacuuauaaauaa

SEQ ID NO: 3625545 - RNA, 16 nt, Salmonella enterica enterica serovar Typhi
uucacuuuaaagccca

SEQ ID NO: 3625546 - RNA, 14 nt, Salmonella enterica enterica serovar Typhi
uucacuuuuucucu

SEQ ID NO: 3625547 - RNA, 21 nt, Salmonella enterica enterica serovar Typhi
uucagaaaguuacuuuccaua

SEQ ID NO: 3625548 - RNA, 19 nt, Salmonella enterica enterica serovar Typhi
uucagaaauguauucuccc

SEQ ID NO: 3625549 - RNA, 21 nt, Salmonella enterica enterica serovar Typhi
uucagaauaauguugguauau

SEQ ID NO: 3625550 - RNA, 19 nt, Salmonella enterica enterica serovar Typhi
uucagaauacgaccucaaa

SEQ ID NO: 3625551 - RNA, 17 nt, Salmonella enterica enterica serovar Typhi
uucagaauaugccaggg

SEQ ID NO: 3625552 - RNA, 17 nt, Salmonella enterica enterica serovar Typhi
uucagaccacuauaguu

SEQ ID NO: 3625553 - RNA, 16 nt, Salmonella enterica enterica serovar Typhi
uucagaccauagucca

SEQ ID NO: 3625554 - RNA, 19 nt, Salmonella enterica enterica serovar Typhi
uucagaccuuuuacuucac

SEQ ID NO: 3625555 - RNA, 12 nt, Salmonella enterica enterica serovar Typhi
uucagacgucau

SEQ ID NO: 3625556 - RNA, 22 nt, Salmonella enterica enterica serovar Typhi
uucagagcguccacgccaucau

SEQ ID NO: 3625557 - RNA, 14 nt, Salmonella enterica enterica serovar Typhi
uucagauaucccau

SEQ ID NO: 3625558 - RNA, 22 nt, Salmonella enterica enterica serovar Typhi
uucagauaucccaugaaacucg

SEQ ID NO: 3625559 - RNA, 18 nt, Salmonella enterica enterica serovar Typhi
uucagauggccaaugaug

SEQ ID NO: 3625560 - RNA, 23 nt, Salmonella enterica enterica serovar Typhi
uucagcaauuacccgguguuuuu

SEQ ID NO: 3625561 - RNA, 22 nt, Salmonella enterica enterica serovar Typhi
uucagcagcgcccagccaaagc

SEQ ID NO: 3625562 - RNA, 12 nt, Salmonella enterica enterica serovar Typhi
uucagcaucauc

SEQ ID NO: 3625563 - RNA, 14 nt, Salmonella enterica enterica serovar Typhi
uucagccagacgcu

SEQ ID NO: 3625564 - RNA, 13 nt, Salmonella enterica enterica serovar Typhi
uucagccaggugg

SEQ ID NO: 3625565 - RNA, 19 nt, Salmonella enterica enterica serovar Typhi
uucagccagguggcaauau

SEQ ID NO: 3625566 - RNA, 14 nt, Salmonella enterica enterica serovar Typhi
uucagcccaggcuu

SEQ ID NO: 3625567 - RNA, 18 nt, Salmonella enterica enterica serovar Typhi
uucagcccguucucgccg

SEQ ID NO: 3625568 - RNA, 17 nt, Salmonella enterica enterica serovar Typhi
uucagccugugcaacca

SEQ ID NO: 3625569 - RNA, 17 nt, Salmonella enterica enterica serovar Typhi
uucagcgacaggcuguc

SEQ ID NO: 3625570 - RNA, 18 nt, Salmonella enterica enterica serovar Typhi
uucagcgcgauaaauacc

SEQ ID NO: 3625571 - RNA, 17 nt, Salmonella enterica enterica serovar Typhi
uucagcggcagcucugc

SEQ ID NO: 3625572 - RNA, 22 nt, Salmonella enterica enterica serovar Typhi
uucagcggcuugucauccugcu

SEQ ID NO: 3625573 - RNA, 23 nt, Salmonella enterica enterica serovar Typhi
uucagcggcuugucauccugcuc

SEQ ID NO: 3625574 - RNA, 18 nt, Salmonella enterica enterica serovar Typhi
uucagcguacagaagguu

SEQ ID NO: 3625575 - RNA, 14 nt, Salmonella enterica enterica serovar Typhi
uucagcucuucaau

SEQ ID NO: 3625576 - RNA, 23 nt, Salmonella enterica enterica serovar Typhi
uucagcugcggcugaaccacccu

SEQ ID NO: 3625577 - RNA, 15 nt, Salmonella enterica enterica serovar Typhi
uucagcuucugucag

SEQ ID NO: 3625578 - RNA, 22 nt, Salmonella enterica enterica serovar Typhi
uucaggacgagagacugauaau

SEQ ID NO: 3625579 - RNA, 23 nt, Salmonella enterica enterica serovar Typhi
uucaggauaauaucgcuggccau

SEQ ID NO: 3625580 - RNA, 19 nt, Salmonella enterica enterica serovar Typhi
uucaggauuuacugagcgc

SEQ ID NO: 3625581 - RNA, 18 nt, Salmonella enterica enterica serovar Typhi
uucaggcaaaaaaaaacc

SEQ ID NO: 3625582 - RNA, 22 nt, Salmonella enterica enterica serovar Typhi
uucagggauacgaucguauccc

SEQ ID NO: 3625583 - RNA, 16 nt, Salmonella enterica enterica serovar Typhi
uucagggugaacaugg

SEQ ID NO: 3625584 - RNA, 22 nt, Salmonella enterica enterica serovar Typhi
uucaggucuggauuacaaaaau

SEQ ID NO: 3625585 - RNA, 19 nt, Salmonella enterica enterica serovar Typhi
uucaguaagcguaccauuc

SEQ ID NO: 3625586 - RNA, 21 nt, Salmonella enterica enterica serovar Typhi
uucagucuacuacacacuuac

SEQ ID NO: 3625587 - RNA, 12 nt, Salmonella enterica enterica serovar Typhi
uucagugacgcg

SEQ ID NO: 3625588 - RNA, 13 nt, Salmonella enterica enterica serovar Typhi
uucagugccaucc

SEQ ID NO: 3625589 - RNA, 18 nt, Salmonella enterica enterica serovar Typhi
uucagugccauccauauu

SEQ ID NO: 3625590 - RNA, 20 nt, Salmonella enterica enterica serovar Typhi
uucaguuucggcccccccca

SEQ ID NO: 3625591 - RNA, 13 nt, Salmonella enterica enterica serovar Typhi
uucauaaaagauc

SEQ ID NO: 3625592 - RNA, 17 nt, Salmonella enterica enterica serovar Typhi
uucauaaagugccaggg

SEQ ID NO: 3625593 - RNA, 14 nt, Salmonella enterica enterica serovar Typhi
uucauaaauguacu

SEQ ID NO: 3625594 - RNA, 16 nt, Salmonella enterica enterica serovar Typhi
uucauaacaccaauac

SEQ ID NO: 3625595 - RNA, 21 nt, Salmonella enterica enterica serovar Typhi
uucauaauaagcgcucaggca

SEQ ID NO: 3625596 - RNA, 21 nt, Salmonella enterica enterica serovar Typhi
uuccaguucauaagucaucca

SEQ ID NO: 3625597 - RNA, 20 nt, Salmonella enterica enterica serovar Typhi
uuccaguugcgcuacuuuau

SEQ ID NO: 3625598 - RNA, 12 nt, Salmonella enterica enterica serovar Typhi
uuccaucggcau

SEQ ID NO: 3625599 - RNA, 13 nt, Salmonella enterica enterica serovar Typhi
uuccauucccgcc

SEQ ID NO: 3625600 - RNA, 12 nt, Salmonella enterica enterica serovar Typhi
uuccauugcugc

SEQ ID NO: 3625601 - RNA, 11 nt, Salmonella enterica enterica serovar Typhi
uuccauuuuuc

SEQ ID NO: 3625602 - RNA, 16 nt, Salmonella enterica enterica serovar Typhi
uucccaagucacgccc

SEQ ID NO: 3625603 - RNA, 14 nt, Salmonella enterica enterica serovar Typhi
uucccaauaguuua

SEQ ID NO: 3625604 - RNA, 14 nt, Salmonella enterica enterica serovar Typhi
uucccacagucggc

SEQ ID NO: 3625605 - RNA, 14 nt, Salmonella enterica enterica serovar Typhi
uucccacugcgccg

SEQ ID NO: 3625606 - RNA, 23 nt, Salmonella enterica enterica serovar Typhi
uucccagguuuuggucagcucac

SEQ ID NO: 3625607 - RNA, 24 nt, Salmonella enterica enterica serovar Typhi
uucccaguauugcaccugggaauc

SEQ ID NO: 3625608 - RNA, 22 nt, Salmonella enterica enterica serovar Typhi
uucccagugcgcggucauaucu

SEQ ID NO: 3625609 - RNA, 22 nt, Salmonella enterica enterica serovar Typhi
uucccauauuuuuucugccagu

SEQ ID NO: 3625610 - RNA, 16 nt, Salmonella enterica enterica serovar Typhi
uucccaucgcuuugca

SEQ ID NO: 3625611 - RNA, 20 nt, Salmonella enterica enterica serovar Typhi
uucccaucgcuuugcagaaa

SEQ ID NO: 3625612 - RNA, 19 nt, Salmonella enterica enterica serovar Typhi
uucccauugggccagcagc

SEQ ID NO: 3625613 - RNA, 23 nt, Salmonella enterica enterica serovar Typhi
uucccauugggccagcagcgcau

SEQ ID NO: 3625614 - RNA, 19 nt, Salmonella enterica enterica serovar Typhi
uuccccaaugaucaauggc

SEQ ID NO: 3625615 - RNA, 13 nt, Salmonella enterica enterica serovar Typhi
uuccccacgccau

SEQ ID NO: 3625616 - RNA, 13 nt, Salmonella enterica enterica serovar Typhi
uuccccagcaccg

SEQ ID NO: 3625617 - RNA, 12 nt, Salmonella enterica enterica serovar Typhi
uuccccguggcc

SEQ ID NO: 3625618 - RNA, 16 nt, Salmonella enterica enterica serovar Typhi
uuccccugaugcguau

SEQ ID NO: 3625619 - RNA, 15 nt, Salmonella enterica enterica serovar Typhi
uuccccugccagacg

SEQ ID NO: 3625620 - RNA, 22 nt, Salmonella enterica enterica serovar Typhi
uuccccuguaacugcaccuuuu

SEQ ID NO: 3625621 - RNA, 15 nt, Salmonella enterica enterica serovar Typhi
uuccccuucuguaag

SEQ ID NO: 3625622 - RNA, 23 nt, Salmonella enterica enterica serovar Typhi
uucccgagccggguuauagccuu

SEQ ID NO: 3625623 - RNA, 11 nt, Salmonella enterica enterica serovar Typhi
uucccgagcga

SEQ ID NO: 3625624 - RNA, 21 nt, Salmonella enterica enterica serovar Typhi
uucccgcaaacuggccacagc

SEQ ID NO: 3625625 - RNA, 23 nt, Salmonella enterica enterica serovar Typhi
uucccgcaccgcgaugcugcucu

SEQ ID NO: 3625626 - RNA, 17 nt, Salmonella enterica enterica serovar Typhi
uucccgccagcugcgcg

SEQ ID NO: 3625627 - RNA, 18 nt, Salmonella enterica enterica serovar Typhi
uucccgccgccauugcca

SEQ ID NO: 3625628 - RNA, 17 nt, Salmonella enterica enterica serovar Typhi
uucccgcuauccaucau

SEQ ID NO: 3625629 - RNA, 16 nt, Salmonella enterica enterica serovar Typhi
uucccggaaaaguauu

SEQ ID NO: 3625630 - RNA, 19 nt, Salmonella enterica enterica serovar Typhi
uucccggcaugccauaauc

SEQ ID NO: 3625631 - RNA, 21 nt, Salmonella enterica enterica serovar Typhi
uucccggcuaaccuguaucug

SEQ ID NO: 3625632 - RNA, 15 nt, Salmonella enterica enterica serovar Typhi
uucccucauauuugu

SEQ ID NO: 3625633 - RNA, 22 nt, Salmonella enterica enterica serovar Typhi
uucccugaccuuccauccacau

SEQ ID NO: 3625634 - RNA, 11 nt, Salmonella enterica enterica serovar Typhi
uucccuggccg

SEQ ID NO: 3625635 - RNA, 16 nt, Salmonella enterica enterica serovar Typhi
uucccuuccagcgacg

SEQ ID NO: 3625636 - RNA, 17 nt, Salmonella enterica enterica serovar Typhi
uucccuuuuuaaaauga

SEQ ID NO: 3625637 - RNA, 20 nt, Salmonella enterica enterica serovar Typhi
uuccgcaggggauucugcca

SEQ ID NO: 3625638 - RNA, 15 nt, Salmonella enterica enterica serovar Typhi
uuccgccaccacgcc

SEQ ID NO: 3625639 - RNA, 16 nt, Salmonella enterica enterica serovar Typhi
uuccgccaccacgccc

SEQ ID NO: 3625640 - RNA, 23 nt, Salmonella enterica enterica serovar Typhi
uuccgccaccagauagucaucac

SEQ ID NO: 3625641 - RNA, 14 nt, Salmonella enterica enterica serovar Typhi
uuccgccagauaca

SEQ ID NO: 3625642 - RNA, 19 nt, Salmonella enterica enterica serovar Typhi
uuccgccaugaaaaaaacg

SEQ ID NO: 3625643 - RNA, 13 nt, Salmonella enterica enterica serovar Typhi
uuccgccccgccu

SEQ ID NO: 3625644 - RNA, 19 nt, Salmonella enterica enterica serovar Typhi
uuccgcccgcgcucccgcc

SEQ ID NO: 3625645 - RNA, 20 nt, Salmonella enterica enterica serovar Typhi
uuccgccgucgugccugacg

SEQ ID NO: 3625646 - RNA, 14 nt, Salmonella enterica enterica serovar Typhi
uuccgcgcaaauac

SEQ ID NO: 3625647 - RNA, 15 nt, Salmonella enterica enterica serovar Typhi
uuccgcuggaauaaa

SEQ ID NO: 3625648 - RNA, 17 nt, Salmonella enterica enterica serovar Typhi
uuccgcuggugcguaac

SEQ ID NO: 3625649 - RNA, 18 nt, Salmonella enterica enterica serovar Typhi
uuccgcuuuuccugccag

SEQ ID NO: 3625650 - RNA, 13 nt, Salmonella enterica enterica serovar Typhi
uuccggaugcggg

SEQ ID NO: 3625651 - RNA, 18 nt, Salmonella enterica enterica serovar Typhi
uuccggcacucugcgcca

SEQ ID NO: 3625652 - RNA, 12 nt, Salmonella enterica enterica serovar Typhi
uuccggcagacg

SEQ ID NO: 3625653 - RNA, 17 nt, Salmonella enterica enterica serovar Typhi
uuccggcggucagccag

SEQ ID NO: 3625654 - RNA, 18 nt, Salmonella enterica enterica serovar Typhi
uuccggcggucagccagc

SEQ ID NO: 3625655 - RNA, 17 nt, Salmonella enterica enterica serovar Typhi
uuccggcgugauaaaac

SEQ ID NO: 3625656 - RNA, 17 nt, Salmonella enterica enterica serovar Typhi
uuccggcucgccaaacg

SEQ ID NO: 3625657 - RNA, 21 nt, Salmonella enterica enterica serovar Typhi
uuccgggauguuaauuucauc

SEQ ID NO: 3625658 - RNA, 21 nt, Salmonella enterica enterica serovar Typhi
uuccgggcgcaccaguucccc

SEQ ID NO: 3625659 - RNA, 15 nt, Salmonella enterica enterica serovar Typhi
uuccggguccagacg

SEQ ID NO: 3625660 - RNA, 20 nt, Salmonella enterica enterica serovar Typhi
uuccgguuaauacgccggug

SEQ ID NO: 3625661 - RNA, 14 nt, Salmonella enterica enterica serovar Typhi
uuccgucaugguga

SEQ ID NO: 3625662 - RNA, 18 nt, Salmonella enterica enterica serovar Typhi
uuccgucauggugaugau

SEQ ID NO: 3625663 - RNA, 14 nt, Salmonella enterica enterica serovar Typhi
uuccguccaccugg

SEQ ID NO: 3625664 - RNA, 13 nt, Salmonella enterica enterica serovar Typhi
uuccguuagcucu

SEQ ID NO: 3625665 - RNA, 15 nt, Salmonella enterica enterica serovar Typhi
uuccuaacccuucau

SEQ ID NO: 3625666 - RNA, 16 nt, Salmonella enterica enterica serovar Typhi
uuccucagaaagcguu

SEQ ID NO: 3625667 - RNA, 19 nt, Salmonella enterica enterica serovar Typhi
uuccucgaaacgcugcgcu

SEQ ID NO: 3625668 - RNA, 17 nt, Salmonella enterica enterica serovar Typhi
uuccucgucgcgcgccg

SEQ ID NO: 3625669 - RNA, 21 nt, Salmonella enterica enterica serovar Typhi
uuccugacuguaauuucgcug

SEQ ID NO: 3625670 - RNA, 17 nt, Salmonella enterica enterica serovar Typhi
uuccugaucaaucaacu

SEQ ID NO: 3625671 - RNA, 16 nt, Salmonella enterica enterica serovar Typhi
uuccugauccgccuua

SEQ ID NO: 3625672 - RNA, 16 nt, Salmonella enterica enterica serovar Typhi
uuccugauuaauauga

SEQ ID NO: 3625673 - RNA, 15 nt, Salmonella enterica enterica serovar Typhi
uuccugcguugacca

SEQ ID NO: 3625674 - RNA, 12 nt, Salmonella enterica enterica serovar Typhi
uuccugcugcca

SEQ ID NO: 3625675 - RNA, 13 nt, Salmonella enterica enterica serovar Typhi
uuccugcugcgcc

SEQ ID NO: 3625676 - RNA, 17 nt, Salmonella enterica enterica serovar Typhi
uuccugcugcgccagcg

SEQ ID NO: 3625677 - RNA, 14 nt, Salmonella enterica enterica serovar Typhi
uuccuggcuugcca

SEQ ID NO: 3625678 - RNA, 16 nt, Salmonella enterica enterica serovar Typhi
uuccuggucugccaga

SEQ ID NO: 3625679 - RNA, 23 nt, Salmonella enterica enterica serovar Typhi
uuccuguauaauuauuuguuuac

SEQ ID NO: 3625680 - RNA, 11 nt, Salmonella enterica enterica serovar Typhi
uuccugucaac

SEQ ID NO: 3625681 - RNA, 18 nt, Salmonella enterica enterica serovar Typhi
uuccugucucuauuaacc

SEQ ID NO: 3625682 - RNA, 15 nt, Salmonella enterica enterica serovar Typhi
uucguucucugaaua

SEQ ID NO: 3625683 - RNA, 18 nt, Salmonella enterica enterica serovar Typhi
uucuaaagacaugaucuu

SEQ ID NO: 3625684 - RNA, 15 nt, Salmonella enterica enterica serovar Typhi
uucuaacgaaacaga

SEQ ID NO: 3625685 - RNA, 19 nt, Salmonella enterica enterica serovar Typhi
uucuaccacccagccagac

SEQ ID NO: 3625686 - RNA, 23 nt, Salmonella enterica enterica serovar Typhi
uucuacuucaauuuuccagauag

SEQ ID NO: 3625687 - RNA, 17 nt, Salmonella enterica enterica serovar Typhi
uucuauacugcuacgca

SEQ ID NO: 3625688 - RNA, 20 nt, Salmonella enterica enterica serovar Typhi
uucuaucguuauauauacuu

SEQ ID NO: 3625689 - RNA, 16 nt, Salmonella enterica enterica serovar Typhi
uucuaugccaggcgca

SEQ ID NO: 3625690 - RNA, 13 nt, Salmonella enterica enterica serovar Typhi
uucuauuaaauca

SEQ ID NO: 3625691 - RNA, 18 nt, Salmonella enterica enterica serovar Typhi
uucuauuaaaucagauaa

SEQ ID NO: 3625692 - RNA, 15 nt, Salmonella enterica enterica serovar Typhi
uucucaaaggcuuug

SEQ ID NO: 3625693 - RNA, 19 nt, Salmonella enterica enterica serovar Typhi
uucucaauacgauauucug

SEQ ID NO: 3625694 - RNA, 16 nt, Salmonella enterica enterica serovar Typhi
uucucacggucuccug

SEQ ID NO: 3625695 - RNA, 16 nt, Salmonella enterica enterica serovar Typhi
uucucagccagaucca

SEQ ID NO: 3625696 - RNA, 14 nt, Salmonella enterica enterica serovar Typhi
uucuccagcagacg

SEQ ID NO: 3625697 - RNA, 20 nt, Salmonella enterica enterica serovar Typhi
uucuccaggcgaauccccau

SEQ ID NO: 3625698 - RNA, 20 nt, Salmonella enterica enterica serovar Typhi
uucuccauggucagacgcuc

SEQ ID NO: 3625699 - RNA, 22 nt, Salmonella enterica enterica serovar Typhi
uucuccccuucaucaguaacug

SEQ ID NO: 3625700 - RNA, 17 nt, Salmonella enterica enterica serovar Typhi
uucucccgccagaugca

SEQ ID NO: 3625701 - RNA, 23 nt, Salmonella enterica enterica serovar Typhi
uucucccgccagaugcagcggca

SEQ ID NO: 3625702 - RNA, 15 nt, Salmonella enterica enterica serovar Typhi
uucucccuacugcuu

SEQ ID NO: 3625703 - RNA, 22 nt, Salmonella enterica enterica serovar Typhi
uucuccgggauagcaaucucgc

SEQ ID NO: 3625704 - RNA, 22 nt, Salmonella enterica enterica serovar Typhi
uucuccugcgccagccggauac

SEQ ID NO: 3625705 - RNA, 13 nt, Salmonella enterica enterica serovar Typhi
uucucgauaucuu

SEQ ID NO: 3625706 - RNA, 20 nt, Salmonella enterica enterica serovar Typhi
uucucgcaggccaaacagcg

SEQ ID NO: 3625707 - RNA, 18 nt, Salmonella enterica enterica serovar Typhi
uucucgcccgccagaucg

SEQ ID NO: 3625708 - RNA, 23 nt, Salmonella enterica enterica serovar Typhi
uucucgccgccauuuuauccagg

SEQ ID NO: 3625709 - RNA, 17 nt, Salmonella enterica enterica serovar Typhi
uucucgcguccccagcc

SEQ ID NO: 3625710 - RNA, 17 nt, Salmonella enterica enterica serovar Typhi
uucucggcuuuccagcu

SEQ ID NO: 3625711 - RNA, 12 nt, Salmonella enterica enterica serovar Typhi
uucucgugcgca

SEQ ID NO: 3625712 - RNA, 19 nt, Salmonella enterica enterica serovar Typhi
uucucguguagccaguacg

SEQ ID NO: 3625713 - RNA, 18 nt, Salmonella enterica enterica serovar Typhi
uucucucucguucccgcc

SEQ ID NO: 3625714 - RNA, 15 nt, Salmonella enterica enterica serovar Typhi
uucucugucgccgcc

SEQ ID NO: 3625715 - RNA, 18 nt, Salmonella enterica enterica serovar Typhi
uucucuucguuauuuucc

SEQ ID NO: 3625716 - RNA, 22 nt, Salmonella enterica enterica serovar Typhi
uucucuucuaccacgcugccgc

SEQ ID NO: 3625717 - RNA, 15 nt, Salmonella enterica enterica serovar Typhi
uucucuucuucaaug

SEQ ID NO: 3625718 - RNA, 16 nt, Salmonella enterica enterica serovar Typhi
uucucuugccugcgca

SEQ ID NO: 3625719 - RNA, 14 nt, Salmonella enterica enterica serovar Typhi
uucucuuuuauuau

SEQ ID NO: 3625720 - RNA, 19 nt, Salmonella enterica enterica serovar Typhi
uucugaacuguaaccggcg

SEQ ID NO: 3625721 - RNA, 21 nt, Salmonella enterica enterica serovar Typhi
uucugaagcguaacagcgcua

SEQ ID NO: 3625722 - RNA, 18 nt, Salmonella enterica enterica serovar Typhi
uucugaauaaauugaauu

SEQ ID NO: 3625723 - RNA, 18 nt, Salmonella enterica enterica serovar Typhi
uucugaauuucacgcuuc

SEQ ID NO: 3625724 - RNA, 18 nt, Salmonella enterica enterica serovar Typhi
uucugaccaguugcaggc

SEQ ID NO: 3625725 - RNA, 17 nt, Salmonella enterica enterica serovar Typhi
uucugauaacgcaggcg

SEQ ID NO: 3625726 - RNA, 13 nt, Salmonella enterica enterica serovar Typhi
uucugcaggccaa

SEQ ID NO: 3625727 - RNA, 23 nt, Salmonella enterica enterica serovar Typhi
uucugcaggcgggugcgcagccc

SEQ ID NO: 3625728 - RNA, 13 nt, Salmonella enterica enterica serovar Typhi
uucugccagguuc

SEQ ID NO: 3625729 - RNA, 13 nt, Salmonella enterica enterica serovar Typhi
uucugccuuuuuu

SEQ ID NO: 3625730 - RNA, 18 nt, Salmonella enterica enterica serovar Typhi
uucugcgccagccagcuc

SEQ ID NO: 3625731 - RNA, 19 nt, Salmonella enterica enterica serovar Typhi
uucugcgccauuuccagcc

SEQ ID NO: 3625732 - RNA, 19 nt, Salmonella enterica enterica serovar Typhi
uucugcgguaaucugccag

SEQ ID NO: 3625733 - RNA, 16 nt, Salmonella enterica enterica serovar Typhi
uucugcgucgcgcaug

SEQ ID NO: 3625734 - RNA, 14 nt, Salmonella enterica enterica serovar Typhi
uucugcucaaugau

SEQ ID NO: 3625735 - RNA, 14 nt, Salmonella enterica enterica serovar Typhi
uucugcuccagacg

SEQ ID NO: 3625736 - RNA, 16 nt, Salmonella enterica enterica serovar Typhi
uucugcucgguaaaaa

SEQ ID NO: 3625737 - RNA, 15 nt, Salmonella enterica enterica serovar Typhi
uucugcuuccagaau

SEQ ID NO: 3625738 - RNA, 16 nt, Salmonella enterica enterica serovar Typhi
uucuggcaacagccau

SEQ ID NO: 3625739 - RNA, 14 nt, Salmonella enterica enterica serovar Typhi
uucuggcaauaagg

SEQ ID NO: 3625740 - RNA, 18 nt, Salmonella enterica enterica serovar Typhi
uucuggcauuggcaucug

SEQ ID NO: 3625741 - RNA, 19 nt, Salmonella enterica enterica serovar Typhi
uucuggcauuggcaucugu

SEQ ID NO: 3625742 - RNA, 20 nt, Salmonella enterica enterica serovar Typhi
uucuggccccugagcaauca

SEQ ID NO: 3625743 - RNA, 15 nt, Salmonella enterica enterica serovar Typhi
uucuggcgcagauac

SEQ ID NO: 3625744 - RNA, 20 nt, Salmonella enterica enterica serovar Typhi
uucuggcgcagauacgcguc

SEQ ID NO: 3625745 - RNA, 12 nt, Salmonella enterica enterica serovar Typhi
uucuggcgcuga

SEQ ID NO: 3625746 - RNA, 15 nt, Salmonella enterica enterica serovar Typhi
uucuguaauacgcug

SEQ ID NO: 3625747 - RNA, 17 nt, Salmonella enterica enterica serovar Typhi
uucuguaauacgcugua

SEQ ID NO: 3625748 - RNA, 18 nt, Salmonella enterica enterica serovar Typhi
uucuguaauuugaaauug

SEQ ID NO: 3625749 - RNA, 17 nt, Salmonella enterica enterica serovar Typhi
uucuguaggcugugcaa

SEQ ID NO: 3625750 - RNA, 15 nt, Salmonella enterica enterica serovar Typhi
uucugucgccaccac

SEQ ID NO: 3625751 - RNA, 21 nt, Salmonella enterica enterica serovar Typhi
uucugugauccguaaucgcuu

SEQ ID NO: 3625752 - RNA, 18 nt, Salmonella enterica enterica serovar Typhi
uucuuaacccacaagaaa

SEQ ID NO: 3625753 - RNA, 13 nt, Salmonella enterica enterica serovar Typhi
uucuuaaccccuu

SEQ ID NO: 3625754 - RNA, 22 nt, Salmonella enterica enterica serovar Typhi
uucuuaauacccauuucuucuu

SEQ ID NO: 3625755 - RNA, 14 nt, Salmonella enterica enterica serovar Typhi
uucuuaauuccuca

SEQ ID NO: 3625756 - RNA, 15 nt, Salmonella enterica enterica serovar Typhi
uucuuacuaauaaau

SEQ ID NO: 3625757 - RNA, 17 nt, Salmonella enterica enterica serovar Typhi
uucuuaucccacagcgu

SEQ ID NO: 3625758 - RNA, 12 nt, Salmonella enterica enterica serovar Typhi
uucuuauuuauu

SEQ ID NO: 3625759 - RNA, 17 nt, Salmonella enterica enterica serovar Typhi
uucuucaagccaggcuu

SEQ ID NO: 3625760 - RNA, 20 nt, Salmonella enterica enterica serovar Typhi
uucuucaagcguuuccagag

SEQ ID NO: 3625761 - RNA, 23 nt, Salmonella enterica enterica serovar Typhi
uucuucaucaaagaaauacccuu

SEQ ID NO: 3625762 - RNA, 13 nt, Salmonella enterica enterica serovar Typhi
uucuucaucuuca

SEQ ID NO: 3625763 - RNA, 15 nt, Salmonella enterica enterica serovar Typhi
uucuuccagcggcag

SEQ ID NO: 3625764 - RNA, 14 nt, Salmonella enterica enterica serovar Typhi
uucuuccauuccca

SEQ ID NO: 3625765 - RNA, 17 nt, Salmonella enterica enterica serovar Typhi
uucuuccgucagcgaau

SEQ ID NO: 3625766 - RNA, 12 nt, Salmonella enterica enterica serovar Typhi
uucuuccucucg

SEQ ID NO: 3625767 - RNA, 23 nt, Salmonella enterica enterica serovar Typhi
uucuucgcgcauuucuguugcaa

SEQ ID NO: 3625768 - RNA, 19 nt, Salmonella enterica enterica serovar Typhi
uugcaccgcuaaaaaacag

SEQ ID NO: 3625769 - RNA, 15 nt, Salmonella enterica enterica serovar Typhi
uugcacggcaucuuu

SEQ ID NO: 3625770 - RNA, 16 nt, Salmonella enterica enterica serovar Typhi
uugcagacgugcaaua

SEQ ID NO: 3625771 - RNA, 15 nt, Salmonella enterica enterica serovar Typhi
uugcagauaccagcg

SEQ ID NO: 3625772 - RNA, 22 nt, Salmonella enterica enterica serovar Typhi
uugcagcagcgagauggcuuuu

SEQ ID NO: 3625773 - RNA, 20 nt, Salmonella enterica enterica serovar Typhi
uugcagccacguugcgcgcg

SEQ ID NO: 3625774 - RNA, 17 nt, Salmonella enterica enterica serovar Typhi
uugcagcgcggccagcg

SEQ ID NO: 3625775 - RNA, 18 nt, Salmonella enterica enterica serovar Typhi
uugcagcgguaaacacca

SEQ ID NO: 3625776 - RNA, 20 nt, Salmonella enterica enterica serovar Typhi
uugcagcgguaaacaccacc

SEQ ID NO: 3625777 - RNA, 15 nt, Salmonella enterica enterica serovar Typhi
uugcagcuccuuuua

SEQ ID NO: 3625778 - RNA, 20 nt, Salmonella enterica enterica serovar Typhi
uugcagguuacucacugccg

SEQ ID NO: 3625779 - RNA, 15 nt, Salmonella enterica enterica serovar Typhi
uugcaguacaggcau

SEQ ID NO: 3625780 - RNA, 23 nt, Salmonella enterica enterica serovar Typhi
uugcaguuuuaccguaaaaugcu

SEQ ID NO: 3625781 - RNA, 13 nt, Salmonella enterica enterica serovar Typhi
uugcauaaagaac

SEQ ID NO: 3625782 - RNA, 13 nt, Salmonella enterica enterica serovar Typhi
uugcauaaauaau

SEQ ID NO: 3625783 - RNA, 21 nt, Salmonella enterica enterica serovar Typhi
uugcauagaucuuugggccgg

SEQ ID NO: 3625784 - RNA, 23 nt, Salmonella enterica enterica serovar Typhi
uugcauauaaggcccauacccca

SEQ ID NO: 3625785 - RNA, 14 nt, Salmonella enterica enterica serovar Typhi
uugcaugaccaucc

SEQ ID NO: 3625786 - RNA, 22 nt, Salmonella enterica enterica serovar Typhi
uugcaugguagucguuauaauc

SEQ ID NO: 3625787 - RNA, 16 nt, Salmonella enterica enterica serovar Typhi
uugcauuucgaccgca

SEQ ID NO: 3625788 - RNA, 15 nt, Salmonella enterica enterica serovar Typhi
uugccacauuucccg

SEQ ID NO: 3625789 - RNA, 16 nt, Salmonella enterica enterica serovar Typhi
uugccacgccauacgu

SEQ ID NO: 3625790 - RNA, 20 nt, Salmonella enterica enterica serovar Typhi
uugccagagagaugccgccg

SEQ ID NO: 3625791 - RNA, 19 nt, Salmonella enterica enterica serovar Typhi
uugccagagccccaaugcu

SEQ ID NO: 3625792 - RNA, 18 nt, Salmonella enterica enterica serovar Typhi
uugccagaggcagcacau

SEQ ID NO: 3625793 - RNA, 17 nt, Salmonella enterica enterica serovar Typhi
uugccagcggccagggc

SEQ ID NO: 3625794 - RNA, 22 nt, Salmonella enterica enterica serovar Typhi
uugccauaaauacaauucaacu

SEQ ID NO: 3625795 - RNA, 12 nt, Salmonella enterica enterica serovar Typhi
uugccauacgcc

SEQ ID NO: 3625796 - RNA, 16 nt, Salmonella enterica enterica serovar Typhi
uugccauacgcccacg

SEQ ID NO: 3625797 - RNA, 15 nt, Salmonella enterica enterica serovar Typhi
uugccauauugccgc

SEQ ID NO: 3625798 - RNA, 19 nt, Salmonella enterica enterica serovar Typhi
uugccaugaugagcgccau

SEQ ID NO: 3625799 - RNA, 20 nt, Salmonella enterica enterica serovar Typhi
uugccauucgccagcccgau

SEQ ID NO: 3625800 - RNA, 18 nt, Salmonella enterica enterica serovar Typhi
uugccauugcgacgauau

SEQ ID NO: 3625801 - RNA, 24 nt, Salmonella enterica enterica serovar Typhi
uugccccgcuuucagcguugcagc

SEQ ID NO: 3625802 - RNA, 22 nt, Salmonella enterica enterica serovar Typhi
uugccccucccugaaucauauu

SEQ ID NO: 3625803 - RNA, 17 nt, Salmonella enterica enterica serovar Typhi
uugcccgguggcgcugc

SEQ ID NO: 3625804 - RNA, 21 nt, Salmonella enterica enterica serovar Typhi
uugcccguauugaagcgauau

SEQ ID NO: 3625805 - RNA, 13 nt, Salmonella enterica enterica serovar Typhi
uugcccuccagcc

SEQ ID NO: 3625806 - RNA, 14 nt, Salmonella enterica enterica serovar Typhi
uugcccuuuuguuu

SEQ ID NO: 3625807 - RNA, 19 nt, Salmonella enterica enterica serovar Typhi
uugccgaguggaaucagcc

SEQ ID NO: 3625808 - RNA, 22 nt, Salmonella enterica enterica serovar Typhi
uugccgcaauugguaauuaaag

SEQ ID NO: 3625809 - RNA, 14 nt, Salmonella enterica enterica serovar Typhi
uugccgcaggcaac

SEQ ID NO: 3625810 - RNA, 12 nt, Salmonella enterica enterica serovar Typhi
uugccgccauca

SEQ ID NO: 3625811 - RNA, 23 nt, Salmonella enterica enterica serovar Typhi
uugccgccuugguugccgcauaa

SEQ ID NO: 3625812 - RNA, 20 nt, Salmonella enterica enterica serovar Typhi
uugccggauggcacugcgcu

SEQ ID NO: 3625813 - RNA, 13 nt, Salmonella enterica enterica serovar Typhi
uugccggauggcg

SEQ ID NO: 3625814 - RNA, 14 nt, Salmonella enterica enterica serovar Typhi
uugccggcaucauu

SEQ ID NO: 3625815 - RNA, 16 nt, Salmonella enterica enterica serovar Typhi
uugccgggcugaccgc

SEQ ID NO: 3625816 - RNA, 21 nt, Salmonella enterica enterica serovar Typhi
uugccgguuuuuuuuugccug

SEQ ID NO: 3625817 - RNA, 21 nt, Salmonella enterica enterica serovar Typhi
uugccgucacagagagcguau

SEQ ID NO: 3625818 - RNA, 15 nt, Salmonella enterica enterica serovar Typhi
uugccguuaacugcu

SEQ ID NO: 3625819 - RNA, 18 nt, Salmonella enterica enterica serovar Typhi
uugccguuaacugcugcu

SEQ ID NO: 3625820 - RNA, 19 nt, Salmonella enterica enterica serovar Typhi
uugccucgucuugauuuca

SEQ ID NO: 3625821 - RNA, 16 nt, Salmonella enterica enterica serovar Typhi
uugccugcggauuugc

SEQ ID NO: 3625822 - RNA, 18 nt, Salmonella enterica enterica serovar Typhi
uugccuggguuggucaca

SEQ ID NO: 3625823 - RNA, 15 nt, Salmonella enterica enterica serovar Typhi
uugccuucuguuuuu

SEQ ID NO: 3625824 - RNA, 19 nt, Salmonella enterica enterica serovar Typhi
uugcgaacauuucagcgcc

SEQ ID NO: 3625825 - RNA, 22 nt, Salmonella enterica enterica serovar Typhi
uugcgaauggccuccagcagca

SEQ ID NO: 3625826 - RNA, 19 nt, Salmonella enterica enterica serovar Typhi
uugcgacuguucaucaaag

SEQ ID NO: 3625827 - RNA, 15 nt, Salmonella enterica enterica serovar Typhi
uugcgauaauacacg

SEQ ID NO: 3625828 - RNA, 15 nt, Salmonella enterica enterica serovar Typhi
uugcgauuagcccgg

SEQ ID NO: 3625829 - RNA, 16 nt, Salmonella enterica enterica serovar Typhi
uugcgcaaccuccgcg

SEQ ID NO: 3625830 - RNA, 21 nt, Salmonella enterica enterica serovar Typhi
uugcgcagcaacgucucgaca

SEQ ID NO: 3625831 - RNA, 19 nt, Salmonella enterica enterica serovar Typhi
uugcgcaggguaucaucgc

SEQ ID NO: 3625832 - RNA, 16 nt, Salmonella enterica enterica serovar Typhi
uugcgcauauuccggc

SEQ ID NO: 3625833 - RNA, 20 nt, Salmonella enterica enterica serovar Typhi
uugcgccaccuuaaucgacu

SEQ ID NO: 3625834 - RNA, 15 nt, Salmonella enterica enterica serovar Typhi
uugcgccacggaugg

SEQ ID NO: 3625835 - RNA, 18 nt, Salmonella enterica enterica serovar Typhi
uugcgccacggauggccu

SEQ ID NO: 3625836 - RNA, 12 nt, Salmonella enterica enterica serovar Typhi
uugcgccagacc

SEQ ID NO: 3625837 - RNA, 16 nt, Salmonella enterica enterica serovar Typhi
uugcgccagcccggcg

SEQ ID NO: 3625838 - RNA, 15 nt, Salmonella enterica enterica serovar Typhi
uugcgcccagauaau

SEQ ID NO: 3625839 - RNA, 23 nt, Salmonella enterica enterica serovar Typhi
uugcgcccgcucuuauugcucuu

SEQ ID NO: 3625840 - RNA, 21 nt, Salmonella enterica enterica serovar Typhi
uugcgccgugccuggcgcugg

SEQ ID NO: 3625841 - RNA, 20 nt, Salmonella enterica enterica serovar Typhi
uugcgcguucggguuuuccu

SEQ ID NO: 3625842 - RNA, 23 nt, Salmonella enterica enterica serovar Typhi
uugcgcucaccuuuuuauuuacu

SEQ ID NO: 3625843 - RNA, 18 nt, Salmonella enterica enterica serovar Typhi
uugcgcucgcgccagaug

SEQ ID NO: 3625844 - RNA, 14 nt, Salmonella enterica enterica serovar Typhi
uugcgcucugccag

SEQ ID NO: 3625845 - RNA, 12 nt, Salmonella enterica enterica serovar Typhi
uugcgcugcgca

SEQ ID NO: 3625846 - RNA, 16 nt, Salmonella enterica enterica serovar Typhi
uugcggaucgaucucg

SEQ ID NO: 3625847 - RNA, 15 nt, Salmonella enterica enterica serovar Typhi
uugcggcacacagcc

SEQ ID NO: 3625848 - RNA, 18 nt, Salmonella enterica enterica serovar Typhi
uugcggcaucagauggcg

SEQ ID NO: 3625849 - RNA, 21 nt, Salmonella enterica enterica serovar Typhi
uugcggcggggauaaucagca

SEQ ID NO: 3625850 - RNA, 20 nt, Salmonella enterica enterica serovar Typhi
uugcgggccucguuaaaauc

SEQ ID NO: 3625851 - RNA, 15 nt, Salmonella enterica enterica serovar Typhi
uugcguaagcagcug

SEQ ID NO: 3625852 - RNA, 15 nt, Salmonella enterica enterica serovar Typhi
uugcguaaugauuaa

SEQ ID NO: 3625853 - RNA, 17 nt, Salmonella enterica enterica serovar Typhi
uuguacagcuugccguc

SEQ ID NO: 3625854 - RNA, 13 nt, Salmonella enterica enterica serovar Typhi
uuguacaggauau

SEQ ID NO: 3625855 - RNA, 18 nt, Salmonella enterica enterica serovar Typhi
uuguacggcggcauuaaa

SEQ ID NO: 3625856 - RNA, 18 nt, Salmonella enterica enterica serovar Typhi
uuguagcggcaacagcac

SEQ ID NO: 3625857 - RNA, 21 nt, Salmonella enterica enterica serovar Typhi
uuguagcugcgccagcgugcu

SEQ ID NO: 3625858 - RNA, 16 nt, Salmonella enterica enterica serovar Typhi
uuguaggccugauagc

SEQ ID NO: 3625859 - RNA, 17 nt, Salmonella enterica enterica serovar Typhi
uuguaggcuuccagaag

SEQ ID NO: 3625860 - RNA, 15 nt, Salmonella enterica enterica serovar Typhi
uugucagcauaaagc

SEQ ID NO: 3625861 - RNA, 13 nt, Salmonella enterica enterica serovar Typhi
uugucagcuuucu

SEQ ID NO: 3625862 - RNA, 16 nt, Salmonella enterica enterica serovar Typhi
uugucaucagaucaug

SEQ ID NO: 3625863 - RNA, 19 nt, Salmonella enterica enterica serovar Typhi
uugucaucaguaugagcga

SEQ ID NO: 3625864 - RNA, 15 nt, Salmonella enterica enterica serovar Typhi
uugucaucagucuca

SEQ ID NO: 3625865 - RNA, 17 nt, Salmonella enterica enterica serovar Typhi
uugucaucagucucaaa

SEQ ID NO: 3625866 - RNA, 17 nt, Salmonella enterica enterica serovar Typhi
uuguccagcggccauga

SEQ ID NO: 3625867 - RNA, 17 nt, Salmonella enterica enterica serovar Typhi
uuguccauaaaaugaug

SEQ ID NO: 3625868 - RNA, 13 nt, Salmonella enterica enterica serovar Typhi
uugucccgccuug

SEQ ID NO: 3625869 - RNA, 20 nt, Salmonella enterica enterica serovar Typhi
uuguccgaugcagacaaaau

SEQ ID NO: 3625870 - RNA, 22 nt, Salmonella enterica enterica serovar Typhi
uuguccggcguuuuagcgccau

SEQ ID NO: 3625871 - RNA, 22 nt, Salmonella enterica enterica serovar Typhi
uuguccucaucauucgguuagg

SEQ ID NO: 3625872 - RNA, 17 nt, Salmonella enterica enterica serovar Typhi
uugucgaucaucagacc

SEQ ID NO: 3625873 - RNA, 15 nt, Salmonella enterica enterica serovar Typhi
uugucgccaauaauu

SEQ ID NO: 3625874 - RNA, 20 nt, Salmonella enterica enterica serovar Typhi
uugucucaaaaaauaucucu

SEQ ID NO: 3625875 - RNA, 15 nt, Salmonella enterica enterica serovar Typhi
uugucuccucaugcc

SEQ ID NO: 3625876 - RNA, 14 nt, Salmonella enterica enterica serovar Typhi
uugucugaccgggc

SEQ ID NO: 3625877 - RNA, 22 nt, Salmonella enterica enterica serovar Typhi
uugucugaugacucucggccua

SEQ ID NO: 3625878 - RNA, 13 nt, Salmonella enterica enterica serovar Typhi
uugucuuaaauau

SEQ ID NO: 3625879 - RNA, 21 nt, Salmonella enterica enterica serovar Typhi
uugucuucaccuugcugcgca

SEQ ID NO: 3625880 - RNA, 13 nt, Salmonella enterica enterica serovar Typhi
uugucuucgaugc

SEQ ID NO: 3625881 - RNA, 15 nt, Salmonella enterica enterica serovar Typhi
uugucuuuuccagua

SEQ ID NO: 3625882 - RNA, 18 nt, Salmonella enterica enterica serovar Typhi
uugucuuuuggcugcgcg

SEQ ID NO: 3625883 - RNA, 16 nt, Salmonella enterica enterica serovar Typhi
uugugagaaaagcaga

SEQ ID NO: 3625884 - RNA, 22 nt, Salmonella enterica enterica serovar Typhi
uugugaguaauaaucacauuau

SEQ ID NO: 3625885 - RNA, 15 nt, Salmonella enterica enterica serovar Typhi
uugugaguucauaaa

SEQ ID NO: 3625886 - RNA, 13 nt, Salmonella enterica enterica serovar Typhi
uugugauaauacu

SEQ ID NO: 3625887 - RNA, 23 nt, Salmonella enterica enterica serovar Typhi
uugugauacgcgucaaauagaga

SEQ ID NO: 3625888 - RNA, 21 nt, Salmonella enterica enterica serovar Typhi
uugugcccgcgaucgcuucca

SEQ ID NO: 3625889 - RNA, 23 nt, Salmonella enterica enterica serovar Typhi
uugugccgacaucgcucccggca

SEQ ID NO: 3625890 - RNA, 20 nt, Salmonella enterica enterica serovar Typhi
uugugcugguggugccgacg

SEQ ID NO: 3625891 - RNA, 22 nt, Salmonella enterica enterica serovar Typhi
uugugcuuauggguuuccucca

SEQ ID NO: 3625892 - RNA, 12 nt, Salmonella enterica enterica serovar Typhi
uugugcuuuagc

SEQ ID NO: 3625893 - RNA, 17 nt, Salmonella enterica enterica serovar Typhi
uuguggcgaccagcaga

SEQ ID NO: 3625894 - RNA, 13 nt, Salmonella enterica enterica serovar Typhi
uuguguaaucuuu

SEQ ID NO: 3625895 - RNA, 17 nt, Salmonella enterica enterica serovar Typhi
uugugucaaaaaguugu

SEQ ID NO: 3625896 - RNA, 16 nt, Salmonella enterica enterica serovar Typhi
uuguuacucaauaaaa

SEQ ID NO: 3625897 - RNA, 15 nt, Salmonella enterica enterica serovar Typhi
uuguucagugccauc

SEQ ID NO: 3625898 - RNA, 13 nt, Salmonella enterica enterica serovar Typhi
uuguucauaucga

SEQ ID NO: 3625899 - RNA, 15 nt, Salmonella enterica enterica serovar Typhi
uuguucaugcaauuc

SEQ ID NO: 3625900 - RNA, 14 nt, Salmonella enterica enterica serovar Typhi
uuguuccagcagcu

SEQ ID NO: 3625901 - RNA, 16 nt, Salmonella enterica enterica serovar Typhi
uuguucgucuuuugaa

SEQ ID NO: 3625902 - RNA, 19 nt, Salmonella enterica enterica serovar Typhi
uuguucuuucaccauuaag

SEQ ID NO: 3625903 - RNA, 20 nt, Salmonella enterica enterica serovar Typhi
uuguuguuaauuugauuuau

SEQ ID NO: 3625904 - RNA, 13 nt, Salmonella enterica enterica serovar Typhi
uuguuuaaaaacc

SEQ ID NO: 3625905 - RNA, 17 nt, Salmonella enterica enterica serovar Typhi
uuguuuauccugcaaau

SEQ ID NO: 3625906 - RNA, 17 nt, Salmonella enterica enterica serovar Typhi
uuguuuauuaugcguuu

SEQ ID NO: 3625907 - RNA, 18 nt, Salmonella enterica enterica serovar Typhi
uuguuuguggcaaaguac

SEQ ID NO: 3625908 - RNA, 15 nt, Salmonella enterica enterica serovar Typhi
uuuaaaacauaucca

SEQ ID NO: 3625909 - RNA, 16 nt, Salmonella enterica enterica serovar Typhi
uuuaaaauccggcugc

SEQ ID NO: 3625910 - RNA, 12 nt, Salmonella enterica enterica serovar Typhi
uuuaaaaugacc

SEQ ID NO: 3625911 - RNA, 16 nt, Salmonella enterica enterica serovar Typhi
uuuaaaauuccaauau

SEQ ID NO: 3625912 - RNA, 13 nt, Salmonella enterica enterica serovar Typhi
uuuaaacaacaua

SEQ ID NO: 3625913 - RNA, 22 nt, Salmonella enterica enterica serovar Typhi
uuuaaaccaugcgagaucggca

SEQ ID NO: 3625914 - RNA, 18 nt, Salmonella enterica enterica serovar Typhi
uuuaaagaucucuaacuu

SEQ ID NO: 3625915 - RNA, 16 nt, Salmonella enterica enterica serovar Typhi
uuuaaauuguuauacc

SEQ ID NO: 3625916 - RNA, 16 nt, Salmonella enterica enterica serovar Typhi
uuuaaccucuuuuuca

SEQ ID NO: 3625917 - RNA, 21 nt, Salmonella enterica enterica serovar Typhi
uuuaacgcaaccgucucacca

SEQ ID NO: 3625918 - RNA, 20 nt, Salmonella enterica enterica serovar Typhi
uuuaacuaauggcaauaaua

SEQ ID NO: 3625919 - RNA, 16 nt, Salmonella enterica enterica serovar Typhi
uuuaagccgauugaau

SEQ ID NO: 3625920 - RNA, 18 nt, Salmonella enterica enterica serovar Typhi
uuuaagccgauugaauaa

SEQ ID NO: 3625921 - RNA, 17 nt, Salmonella enterica enterica serovar Typhi
uuuaagcgccuccacaa

SEQ ID NO: 3625922 - RNA, 17 nt, Salmonella enterica enterica serovar Typhi
uuuaagcuggcgaacgu

SEQ ID NO: 3625923 - RNA, 20 nt, Salmonella enterica enterica serovar Typhi
uuuaagcuuaaugauaauug

SEQ ID NO: 3625924 - RNA, 23 nt, Salmonella enterica enterica serovar Typhi
uuuaaggaauaacgcgcuuuuuu

SEQ ID NO: 3625925 - RNA, 16 nt, Salmonella enterica enterica serovar Typhi
uuuaaggcggcaaaga

SEQ ID NO: 3625926 - RNA, 16 nt, Salmonella enterica enterica serovar Typhi
uuuaaggcugauuccg

SEQ ID NO: 3625927 - RNA, 13 nt, Salmonella enterica enterica serovar Typhi
uuuaauaaagaaa

SEQ ID NO: 3625928 - RNA, 21 nt, Salmonella enterica enterica serovar Typhi
uuuaauacgcugucgaugaua

SEQ ID NO: 3625929 - RNA, 20 nt, Salmonella enterica enterica serovar Typhi
uuuaauauaugaaccaagau

SEQ ID NO: 3625930 - RNA, 12 nt, Salmonella enterica enterica serovar Typhi
uuuaaucaccug

SEQ ID NO: 3625931 - RNA, 20 nt, Salmonella enterica enterica serovar Typhi
uuuaaugcccgguauuuuuu

SEQ ID NO: 3625932 - RNA, 18 nt, Salmonella enterica enterica serovar Typhi
uuuaauguugccguggca

SEQ ID NO: 3625933 - RNA, 15 nt, Salmonella enterica enterica serovar Typhi
uuuaauuaauccauu

SEQ ID NO: 3625934 - RNA, 23 nt, Salmonella enterica enterica serovar Typhi
uuuaauuccaccagcuuaucuga

SEQ ID NO: 3625935 - RNA, 22 nt, Salmonella enterica enterica serovar Typhi
uuuacaaaauuggguaguaaua

SEQ ID NO: 3625936 - RNA, 23 nt, Salmonella enterica enterica serovar Typhi
uuuacaaccguggcguuuucauu

SEQ ID NO: 3625937 - RNA, 22 nt, Salmonella enterica enterica serovar Typhi
uuuaccauuacgcuauaaaguu

SEQ ID NO: 3625938 - RNA, 13 nt, Salmonella enterica enterica serovar Typhi
uuuaccauucagc

SEQ ID NO: 3625939 - RNA, 21 nt, Salmonella enterica enterica serovar Typhi
uuucagcguaccgaagaacau

SEQ ID NO: 3625940 - RNA, 23 nt, Salmonella enterica enterica serovar Typhi
uuucagcucgcaggccauaaaac

SEQ ID NO: 3625941 - RNA, 16 nt, Salmonella enterica enterica serovar Typhi
uuucagugauaaagcc

SEQ ID NO: 3625942 - RNA, 18 nt, Salmonella enterica enterica serovar Typhi
uuucauaauaagcgcuca

SEQ ID NO: 3625943 - RNA, 15 nt, Salmonella enterica enterica serovar Typhi
uuucauagaaccacu

SEQ ID NO: 3625944 - RNA, 23 nt, Salmonella enterica enterica serovar Typhi
uuucauauuauuauauagacucc

SEQ ID NO: 3625945 - RNA, 12 nt, Salmonella enterica enterica serovar Typhi
uuucaucaccau

SEQ ID NO: 3625946 - RNA, 11 nt, Salmonella enterica enterica serovar Typhi
uuucauccucu

SEQ ID NO: 3625947 - RNA, 24 nt, Salmonella enterica enterica serovar Typhi
uuucaucgagcgugucagugccau

SEQ ID NO: 3625948 - RNA, 19 nt, Salmonella enterica enterica serovar Typhi
uuucaucgccgauuccugc

SEQ ID NO: 3625949 - RNA, 15 nt, Salmonella enterica enterica serovar Typhi
uuucaugauauucug

SEQ ID NO: 3625950 - RNA, 16 nt, Salmonella enterica enterica serovar Typhi
uuucaugauauucugu

SEQ ID NO: 3625951 - RNA, 16 nt, Salmonella enterica enterica serovar Typhi
uuucaugccauacucc

SEQ ID NO: 3625952 - RNA, 14 nt, Salmonella enterica enterica serovar Typhi
uuucauuacgcuuc

SEQ ID NO: 3625953 - RNA, 14 nt, Salmonella enterica enterica serovar Typhi
uuucauucagaccc

SEQ ID NO: 3625954 - RNA, 16 nt, Salmonella enterica enterica serovar Typhi
uuucauuucgaucugu

SEQ ID NO: 3625955 - RNA, 16 nt, Salmonella enterica enterica serovar Typhi
uuucauuucugccugc

SEQ ID NO: 3625956 - RNA, 23 nt, Salmonella enterica enterica serovar Typhi
uuuccaaaauccagggaaaccau

SEQ ID NO: 3625957 - RNA, 23 nt, Salmonella enterica enterica serovar Typhi
uuuccagcacgaccuuuucuuca

SEQ ID NO: 3625958 - RNA, 23 nt, Salmonella enterica enterica serovar Typhi
uuuccagcacggcauaagccuca

SEQ ID NO: 3625959 - RNA, 18 nt, Salmonella enterica enterica serovar Typhi
uuuccagcauuagcgcca

SEQ ID NO: 3625960 - RNA, 20 nt, Salmonella enterica enterica serovar Typhi
uuuccagccccuucgcuguc

SEQ ID NO: 3625961 - RNA, 17 nt, Salmonella enterica enterica serovar Typhi
uuuccagcucagaaaua

SEQ ID NO: 3625962 - RNA, 22 nt, Salmonella enterica enterica serovar Typhi
uuuccagcuccagccgcugccu

SEQ ID NO: 3625963 - RNA, 19 nt, Salmonella enterica enterica serovar Typhi
uuuccaguagucgcgccau

SEQ ID NO: 3625964 - RNA, 19 nt, Salmonella enterica enterica serovar Typhi
uuuccaguugcggcaucag

SEQ ID NO: 3625965 - RNA, 20 nt, Salmonella enterica enterica serovar Typhi
uuuccaguugcggcaucaga

SEQ ID NO: 3625966 - RNA, 22 nt, Salmonella enterica enterica serovar Typhi
uuuccauucacacaauuuucuu

SEQ ID NO: 3625967 - RNA, 13 nt, Salmonella enterica enterica serovar Typhi
uuuccauuuuuca

SEQ ID NO: 3625968 - RNA, 15 nt, Salmonella enterica enterica serovar Typhi
uuucccaagucacgc

SEQ ID NO: 3625969 - RNA, 13 nt, Salmonella enterica enterica serovar Typhi
uuucccacuguuc

SEQ ID NO: 3625970 - RNA, 13 nt, Salmonella enterica enterica serovar Typhi
uuucccaguggcg

SEQ ID NO: 3625971 - RNA, 19 nt, Salmonella enterica enterica serovar Typhi
uuucccccuccauacccua

SEQ ID NO: 3625972 - RNA, 18 nt, Salmonella enterica enterica serovar Typhi
uuucccucauauuuguau

SEQ ID NO: 3625973 - RNA, 20 nt, Salmonella enterica enterica serovar Typhi
uuucccugaugauagcgcca

SEQ ID NO: 3625974 - RNA, 15 nt, Salmonella enterica enterica serovar Typhi
uuucccuucugaaau

SEQ ID NO: 3625975 - RNA, 18 nt, Salmonella enterica enterica serovar Typhi
uuucccuuuuuaaaauga

SEQ ID NO: 3625976 - RNA, 18 nt, Salmonella enterica enterica serovar Typhi
uuuccgcagccagaauca

SEQ ID NO: 3625977 - RNA, 10 nt, Salmonella enterica enterica serovar Typhi
uuuccgccau

SEQ ID NO: 3625978 - RNA, 17 nt, Salmonella enterica enterica serovar Typhi
uuuccgccaugaaaaaa

SEQ ID NO: 3625979 - RNA, 18 nt, Salmonella enterica enterica serovar Typhi
uuuccgcuagggcaucag

SEQ ID NO: 3625980 - RNA, 14 nt, Salmonella enterica enterica serovar Typhi
uuuccggaaugaga

SEQ ID NO: 3625981 - RNA, 19 nt, Salmonella enterica enterica serovar Typhi
uuuccggcagcgcauaagc

SEQ ID NO: 3625982 - RNA, 21 nt, Salmonella enterica enterica serovar Typhi
uuuccgggauguuaauuucau

SEQ ID NO: 3625983 - RNA, 23 nt, Salmonella enterica enterica serovar Typhi
uuuccggucgcgcaaucgguaaa

SEQ ID NO: 3625984 - RNA, 17 nt, Salmonella enterica enterica serovar Typhi
uuuccguauugcaaugc

SEQ ID NO: 3625985 - RNA, 17 nt, Salmonella enterica enterica serovar Typhi
uuuccguugugaacagc

SEQ ID NO: 3625986 - RNA, 22 nt, Salmonella enterica enterica serovar Typhi
uuuccguuuguaacauauuuuu

SEQ ID NO: 3625987 - RNA, 22 nt, Salmonella enterica enterica serovar Typhi
uuuccucccauacccagguuug

SEQ ID NO: 3625988 - RNA, 13 nt, Salmonella enterica enterica serovar Typhi
uuuccugaaaaaa

SEQ ID NO: 3625989 - RNA, 18 nt, Salmonella enterica enterica serovar Typhi
uuuccugaugauauuucu

SEQ ID NO: 3625990 - RNA, 19 nt, Salmonella enterica enterica serovar Typhi
uuuccugaugauauuucuu

SEQ ID NO: 3625991 - RNA, 13 nt, Salmonella enterica enterica serovar Typhi
uuuccugcaacau

SEQ ID NO: 3625992 - RNA, 21 nt, Salmonella enterica enterica serovar Typhi
uuuccugccuucugaaaguuu

SEQ ID NO: 3625993 - RNA, 22 nt, Salmonella enterica enterica serovar Typhi
uuuccuguguuacgccaauaau

SEQ ID NO: 3625994 - RNA, 21 nt, Salmonella enterica enterica serovar Typhi
uuuccuuucugcgccagcggc

SEQ ID NO: 3625995 - RNA, 20 nt, Salmonella enterica enterica serovar Typhi
uuucgaaacaggaaaaacau

SEQ ID NO: 3625996 - RNA, 23 nt, Salmonella enterica enterica serovar Typhi
uuucgaccgcaggcucuuuuucu

SEQ ID NO: 3625997 - RNA, 21 nt, Salmonella enterica enterica serovar Typhi
uuucgacgauaaaaaaaguau

SEQ ID NO: 3625998 - RNA, 17 nt, Salmonella enterica enterica serovar Typhi
uuucgcaaacacccgac

SEQ ID NO: 3625999 - RNA, 15 nt, Salmonella enterica enterica serovar Typhi
uuucgcaaacugauc

SEQ ID NO: 3626000 - RNA, 21 nt, Salmonella enterica enterica serovar Typhi
uuucgcaaacugaucgaggac

SEQ ID NO: 3626001 - RNA, 20 nt, Salmonella enterica enterica serovar Typhi
uuucgccacgcucacuuuuc

SEQ ID NO: 3626002 - RNA, 12 nt, Salmonella enterica enterica serovar Typhi
uuucgccagcau

SEQ ID NO: 3626003 - RNA, 21 nt, Salmonella enterica enterica serovar Typhi
uuucgccagcgcaucgauaua

SEQ ID NO: 3626004 - RNA, 13 nt, Salmonella enterica enterica serovar Typhi
uuucgcccacauc

SEQ ID NO: 3626005 - RNA, 16 nt, Salmonella enterica enterica serovar Typhi
uuucgccccacuggcc

SEQ ID NO: 3626006 - RNA, 17 nt, Salmonella enterica enterica serovar Typhi
uuucgccccacuggccc

SEQ ID NO: 3626007 - RNA, 18 nt, Salmonella enterica enterica serovar Typhi
uuucgccccacuggcccc

SEQ ID NO: 3626008 - RNA, 19 nt, Salmonella enterica enterica serovar Typhi
uuucgcccggcgccagcuc

SEQ ID NO: 3626009 - RNA, 18 nt, Salmonella enterica enterica serovar Typhi
uuucgccgccauccggca

SEQ ID NO: 3626010 - RNA, 20 nt, Salmonella enterica enterica serovar Typhi
uuucgccguaaaacaacagc

SEQ ID NO: 3626011 - RNA, 14 nt, Salmonella enterica enterica serovar Typhi
uuucgccguccaga

SEQ ID NO: 3626012 - RNA, 16 nt, Salmonella enterica enterica serovar Typhi
uuucgcucgcuuugcc

SEQ ID NO: 3626013 - RNA, 22 nt, Salmonella enterica enterica serovar Typhi
uuucggcaaagcacugcugcug

SEQ ID NO: 3626014 - RNA, 17 nt, Salmonella enterica enterica serovar Typhi
uuucguacauguccaga

SEQ ID NO: 3626015 - RNA, 19 nt, Salmonella enterica enterica serovar Typhi
uuucguacauguccagauc

SEQ ID NO: 3626016 - RNA, 18 nt, Salmonella enterica enterica serovar Typhi
uuucguagggccgcguau

SEQ ID NO: 3626017 - RNA, 23 nt, Salmonella enterica enterica serovar Typhi
uuucuacaccuucuucgccaacu

SEQ ID NO: 3626018 - RNA, 16 nt, Salmonella enterica enterica serovar Typhi
uuucuacuacaacugu

SEQ ID NO: 3626019 - RNA, 17 nt, Salmonella enterica enterica serovar Typhi
uuucuacuacaacuguc

SEQ ID NO: 3626020 - RNA, 16 nt, Salmonella enterica enterica serovar Typhi
uuucucaaacacuucu

SEQ ID NO: 3626021 - RNA, 13 nt, Salmonella enterica enterica serovar Typhi
uuucucaauacga

SEQ ID NO: 3626022 - RNA, 11 nt, Salmonella enterica enterica serovar Typhi
uuucucagcca

SEQ ID NO: 3626023 - RNA, 12 nt, Salmonella enterica enterica serovar Typhi
uuucucaucaag

SEQ ID NO: 3626024 - RNA, 15 nt, Salmonella enterica enterica serovar Typhi
uuugcuuauccggcc

SEQ ID NO: 3626025 - RNA, 16 nt, Salmonella enterica enterica serovar Typhi
uuugcuuauccggccu

SEQ ID NO: 3626026 - RNA, 20 nt, Salmonella enterica enterica serovar Typhi
uuugcuucaauaaguuagcu

SEQ ID NO: 3626027 - RNA, 14 nt, Salmonella enterica enterica serovar Typhi
uuugcuucucgccu

SEQ ID NO: 3626028 - RNA, 18 nt, Salmonella enterica enterica serovar Typhi
uuugcuucucgccuucgg

SEQ ID NO: 3626029 - RNA, 15 nt, Salmonella enterica enterica serovar Typhi
uuugcuuuauuuguu

SEQ ID NO: 3626030 - RNA, 12 nt, Salmonella enterica enterica serovar Typhi
uuugcuuuguag

SEQ ID NO: 3626031 - RNA, 21 nt, Salmonella enterica enterica serovar Typhi
uuuggcaaucaaauccagcuc

SEQ ID NO: 3626032 - RNA, 24 nt, Salmonella enterica enterica serovar Typhi
uuuggcaucaaaguuauuuaccac

SEQ ID NO: 3626033 - RNA, 15 nt, Salmonella enterica enterica serovar Typhi
uuuggcgauuuucag

SEQ ID NO: 3626034 - RNA, 21 nt, Salmonella enterica enterica serovar Typhi
uuuggcgcgaaauguauuuuu

SEQ ID NO: 3626035 - RNA, 21 nt, Salmonella enterica enterica serovar Typhi
uuuggcggcaagaucauccgg

SEQ ID NO: 3626036 - RNA, 17 nt, Salmonella enterica enterica serovar Typhi
uuuggcgggcuuauccc

SEQ ID NO: 3626037 - RNA, 17 nt, Salmonella enterica enterica serovar Typhi
uuuggcuuaaauaaucu

SEQ ID NO: 3626038 - RNA, 21 nt, Salmonella enterica enterica serovar Typhi
uuugggaauuagcgaaucaca

SEQ ID NO: 3626039 - RNA, 18 nt, Salmonella enterica enterica serovar Typhi
uuugggcagauaucggaa

SEQ ID NO: 3626040 - RNA, 20 nt, Salmonella enterica enterica serovar Typhi
uuuggguaaauaccaggcac

SEQ ID NO: 3626041 - RNA, 20 nt, Salmonella enterica enterica serovar Typhi
uuuggucggagccaauaauc

SEQ ID NO: 3626042 - RNA, 18 nt, Salmonella enterica enterica serovar Typhi
uuugguuacuauuuuuca

SEQ ID NO: 3626043 - RNA, 15 nt, Salmonella enterica enterica serovar Typhi
uuuguacagcuugcc

SEQ ID NO: 3626044 - RNA, 16 nt, Salmonella enterica enterica serovar Typhi
uuuguacuucagagcu

SEQ ID NO: 3626045 - RNA, 17 nt, Salmonella enterica enterica serovar Typhi
uuugucgucaugcgcca

SEQ ID NO: 3626046 - RNA, 13 nt, Salmonella enterica enterica serovar Typhi
uuugugaguucau

SEQ ID NO: 3626047 - RNA, 18 nt, Salmonella enterica enterica serovar Typhi
uuugugaguucauaaaag

SEQ ID NO: 3626048 - RNA, 16 nt, Salmonella enterica enterica serovar Typhi
uuuguggcguguggcu

SEQ ID NO: 3626049 - RNA, 22 nt, Salmonella enterica enterica serovar Typhi
uuuguucagacacauucuguga

SEQ ID NO: 3626050 - RNA, 22 nt, Salmonella enterica enterica serovar Typhi
uuuguugaucugguucacagau

SEQ ID NO: 3626051 - RNA, 14 nt, Salmonella enterica enterica serovar Typhi
uuuguugauuuuau

SEQ ID NO: 3626052 - RNA, 21 nt, Salmonella enterica enterica serovar Typhi
uuuguugcuccagcaucacau

SEQ ID NO: 3626053 - RNA, 12 nt, Salmonella enterica enterica serovar Typhi
uuuguuuaaaaa

SEQ ID NO: 3626054 - RNA, 18 nt, Salmonella enterica enterica serovar Typhi
uuuguuuaucauccugac

SEQ ID NO: 3626055 - RNA, 13 nt, Salmonella enterica enterica serovar Typhi
uuuuaaaaaaccg

SEQ ID NO: 3626056 - RNA, 14 nt, Salmonella enterica enterica serovar Typhi
uuuuaaaauguuuu

SEQ ID NO: 3626057 - RNA, 15 nt, Salmonella enterica enterica serovar Typhi
uuuuaaacgccugau

SEQ ID NO: 3626058 - RNA, 16 nt, Salmonella enterica enterica serovar Typhi
uuuuaaacgccugauc

SEQ ID NO: 3626059 - RNA, 22 nt, Salmonella enterica enterica serovar Typhi
uuuuaaauaacuuuuaauuuuu

SEQ ID NO: 3626060 - RNA, 13 nt, Salmonella enterica enterica serovar Typhi
uuuuaaauguuuu

SEQ ID NO: 3626061 - RNA, 17 nt, Salmonella enterica enterica serovar Typhi
uuuuaaauguuuuuuca

SEQ ID NO: 3626062 - RNA, 12 nt, Salmonella enterica enterica serovar Typhi
uuuuaaccauca

SEQ ID NO: 3626063 - RNA, 17 nt, Salmonella enterica enterica serovar Typhi
uuuuaauuuucuguaau

SEQ ID NO: 3626064 - RNA, 23 nt, Salmonella enterica enterica serovar Typhi
uuuuaccccccaugaauuacagc

SEQ ID NO: 3626065 - RNA, 23 nt, Salmonella enterica enterica serovar Typhi
uuuuaccucacggugacgcguca

SEQ ID NO: 3626066 - RNA, 23 nt, Salmonella enterica enterica serovar Typhi
uuuuacgagaaccaacugccaaa

SEQ ID NO: 3626067 - RNA, 20 nt, Salmonella enterica enterica serovar Typhi
uuuuacgccacggcaauuua

SEQ ID NO: 3626068 - RNA, 19 nt, Salmonella enterica enterica serovar Typhi
uuuuacuuucaaaauacug

SEQ ID NO: 3626069 - RNA, 15 nt, Salmonella enterica enterica serovar Typhi
uuuuacuuucauucc

SEQ ID NO: 3626070 - RNA, 16 nt, Salmonella enterica enterica serovar Typhi
uuuuacuuuuuuaaau

SEQ ID NO: 3626071 - RNA, 13 nt, Salmonella enterica enterica serovar Typhi
uuuuagaaaauaa

SEQ ID NO: 3626072 - RNA, 21 nt, Salmonella enterica enterica serovar Typhi
uuuuagcaaugaugaugaagg

SEQ ID NO: 3626073 - RNA, 20 nt, Salmonella enterica enterica serovar Typhi
uuuuagccuguuauucaauu

SEQ ID NO: 3626074 - RNA, 17 nt, Salmonella enterica enterica serovar Typhi
uuuuagcguuucaucgg

SEQ ID NO: 3626075 - RNA, 20 nt, Salmonella enterica enterica serovar Typhi
uuuuagcuuaaaaaauccug

SEQ ID NO: 3626076 - RNA, 15 nt, Salmonella enterica enterica serovar Typhi
uuuuaggcuauaaaa

SEQ ID NO: 3626077 - RNA, 13 nt, Salmonella enterica enterica serovar Typhi
uuuuauauuuuua

SEQ ID NO: 3626078 - RNA, 20 nt, Salmonella enterica enterica serovar Typhi
uuuuaucgacagauuuugca

SEQ ID NO: 3626079 - RNA, 16 nt, Salmonella enterica enterica serovar Typhi
uuuuaucgauaauauc

SEQ ID NO: 3626080 - RNA, 20 nt, Salmonella enterica enterica serovar Typhi
uuuuaugcacgcuauaacgu

SEQ ID NO: 3626081 - RNA, 16 nt, Salmonella enterica enterica serovar Typhi
uuuuaugcguuuaauu

SEQ ID NO: 3626082 - RNA, 20 nt, Salmonella enterica enterica serovar Typhi
uuuuaugcguuuaauugaau

SEQ ID NO: 3626083 - RNA, 23 nt, Salmonella enterica enterica serovar Typhi
uuuuauggaaucggcuaguaaua

SEQ ID NO: 3626084 - RNA, 17 nt, Salmonella enterica enterica serovar Typhi
uuuuaugucauuuauuu

SEQ ID NO: 3626085 - RNA, 21 nt, Salmonella enterica enterica serovar Typhi
uuuuauuauuuugauacucau

SEQ ID NO: 3626086 - RNA, 17 nt, Salmonella enterica enterica serovar Typhi
uuuuauuuuuauauucc

SEQ ID NO: 3626087 - RNA, 14 nt, Salmonella enterica enterica serovar Typhi
uuuuauuuuucaau

SEQ ID NO: 3626088 - RNA, 13 nt, Salmonella enterica enterica serovar Typhi
uuuucaaaaacaa

SEQ ID NO: 3626089 - RNA, 21 nt, Salmonella enterica enterica serovar Typhi
uuuucaaaugaucguuuuuug

SEQ ID NO: 3626090 - RNA, 19 nt, Salmonella enterica enterica serovar Typhi
uuuucaacggcaucaauaa

SEQ ID NO: 3626091 - RNA, 22 nt, Salmonella enterica enterica serovar Typhi
uuuucaauaauaaaacgacuca

SEQ ID NO: 3626092 - RNA, 17 nt, Salmonella enterica enterica serovar Typhi
uuuucaaugcacgccac

SEQ ID NO: 3626093 - RNA, 20 nt, Salmonella enterica enterica serovar Typhi
uuuucaaugucgcaaucggc

SEQ ID NO: 3626094 - RNA, 15 nt, Salmonella enterica enterica serovar Typhi
uuuucacuaaucccc

SEQ ID NO: 3626095 - RNA, 23 nt, Salmonella enterica enterica serovar Typhi
uuuucacuaauccccauuuuuuu

SEQ ID NO: 3626096 - RNA, 16 nt, Salmonella enterica enterica serovar Typhi
uuuucagcaaauacag

SEQ ID NO: 3626097 - RNA, 23 nt, Salmonella enterica enterica serovar Typhi
uuuucagccugaagccagcaauc

SEQ ID NO: 3626098 - RNA, 15 nt, Salmonella enterica enterica serovar Typhi
uuuucaggcacagaa

SEQ ID NO: 3626099 - RNA, 11 nt, Salmonella enterica enterica serovar Typhi
uuuucaggccg

SEQ ID NO: 3626100 - RNA, 12 nt, Salmonella enterica enterica serovar Typhi
uuuucaugaauc

SEQ ID NO: 3626101 - RNA, 18 nt, Salmonella enterica enterica serovar Typhi
uuuuccacagacccagua

SEQ ID NO: 3626102 - RNA, 11 nt, Salmonella enterica enterica serovar Typhi
uuuuccagcac

SEQ ID NO: 3626103 - RNA, 22 nt, Salmonella enterica enterica serovar Typhi
uuuuccagcgccgccagaauca

SEQ ID NO: 3626104 - RNA, 13 nt, Salmonella enterica enterica serovar Typhi
uuuuccagcgcga

SEQ ID NO: 3626105 - RNA, 12 nt, Salmonella enterica enterica serovar Typhi
uuuuccagcuca

SEQ ID NO: 3626106 - RNA, 18 nt, Salmonella enterica enterica serovar Typhi
uuuuccaggugcugccac

SEQ ID NO: 3626107 - RNA, 13 nt, Salmonella enterica enterica serovar Typhi
uuuuccaucacgu

SEQ ID NO: 3626108 - RNA, 22 nt, Salmonella enterica enterica serovar Typhi
uuuuccauucacacaauuuucu

SEQ ID NO: 3626109 - RNA, 14 nt, Salmonella enterica enterica serovar Typhi
uuuucccaacugua

SEQ ID NO: 3626110 - RNA, 14 nt, Salmonella enterica enterica serovar Typhi
ugcuaucccaggcg

SEQ ID NO: 3626111 - RNA, 15 nt, Salmonella enterica enterica serovar Typhi
ugcuauccgccgcca

SEQ ID NO: 3626112 - RNA, 18 nt, Salmonella enterica enterica serovar Typhi
ugcuaugauaagccugac

SEQ ID NO: 3626113 - RNA, 22 nt, Salmonella enterica enterica serovar Typhi
ugcucaaccaguaccgggccuc

SEQ ID NO: 3626114 - RNA, 17 nt, Salmonella enterica enterica serovar Typhi
ugcucaaccaugauaac

SEQ ID NO: 3626115 - RNA, 16 nt, Salmonella enterica enterica serovar Typhi
ugcucaacuuccagag

SEQ ID NO: 3626116 - RNA, 18 nt, Salmonella enterica enterica serovar Typhi
ugcucaauaagccaugug

SEQ ID NO: 3626117 - RNA, 13 nt, Salmonella enterica enterica serovar Typhi
ugcucaauauuau

SEQ ID NO: 3626118 - RNA, 17 nt, Salmonella enterica enterica serovar Typhi
ugcucaaucacuuuugc

SEQ ID NO: 3626119 - RNA, 11 nt, Salmonella enterica enterica serovar Typhi
ugcucaaugau

SEQ ID NO: 3626120 - RNA, 23 nt, Salmonella enterica enterica serovar Typhi
ugcucaauuauacgcuggugcag

SEQ ID NO: 3626121 - RNA, 10 nt, Salmonella enterica enterica serovar Typhi
ugcucaccca

SEQ ID NO: 3626122 - RNA, 23 nt, Salmonella enterica enterica serovar Typhi
ugcucacccauuuuauccucuuc

SEQ ID NO: 3626123 - RNA, 18 nt, Salmonella enterica enterica serovar Typhi
ugcucagccaaacuccuc

SEQ ID NO: 3626124 - RNA, 12 nt, Salmonella enterica enterica serovar Typhi
ugcucagccccu

SEQ ID NO: 3626125 - RNA, 19 nt, Salmonella enterica enterica serovar Typhi
ugcucagcuuguagaaagg

SEQ ID NO: 3626126 - RNA, 16 nt, Salmonella enterica enterica serovar Typhi
ugcucaggaucaauuc

SEQ ID NO: 3626127 - RNA, 21 nt, Salmonella enterica enterica serovar Typhi
ugcucagggcauccgccgccg

SEQ ID NO: 3626128 - RNA, 13 nt, Salmonella enterica enterica serovar Typhi
ugcucauauugug

SEQ ID NO: 3626129 - RNA, 18 nt, Salmonella enterica enterica serovar Typhi
ugcucaucgacagaacgg

SEQ ID NO: 3626130 - RNA, 23 nt, Salmonella enterica enterica serovar Typhi
ugcucaucgucuuucuccaugcu

SEQ ID NO: 3626131 - RNA, 18 nt, Salmonella enterica enterica serovar Typhi
ugcucaugcgagguauac

SEQ ID NO: 3626132 - RNA, 16 nt, Salmonella enterica enterica serovar Typhi
ugcuccaguuguucca

SEQ ID NO: 3626133 - RNA, 17 nt, Salmonella enterica enterica serovar Typhi
ugcuccaugacguucaa

SEQ ID NO: 3626134 - RNA, 12 nt, Salmonella enterica enterica serovar Typhi
ugcuccaugauc

SEQ ID NO: 3626135 - RNA, 14 nt, Salmonella enterica enterica serovar Typhi
ugcuccaugcuguc

SEQ ID NO: 3626136 - RNA, 13 nt, Salmonella enterica enterica serovar Typhi
ugcucccacagcu

SEQ ID NO: 3626137 - RNA, 20 nt, Salmonella enterica enterica serovar Typhi
ugcuccccaaccgccagcca

SEQ ID NO: 3626138 - RNA, 14 nt, Salmonella enterica enterica serovar Typhi
ugcucccccaguug

SEQ ID NO: 3626139 - RNA, 14 nt, Salmonella enterica enterica serovar Typhi
ugcuccgccagcaa

SEQ ID NO: 3626140 - RNA, 23 nt, Salmonella enterica enterica serovar Typhi
ugcuccggcuuaaugcccggccc

SEQ ID NO: 3626141 - RNA, 12 nt, Salmonella enterica enterica serovar Typhi
ugcuccgggcca

SEQ ID NO: 3626142 - RNA, 14 nt, Salmonella enterica enterica serovar Typhi
ugcuccgggccaug

SEQ ID NO: 3626143 - RNA, 17 nt, Salmonella enterica enterica serovar Typhi
ugcuccugcggcgugga

SEQ ID NO: 3626144 - RNA, 14 nt, Salmonella enterica enterica serovar Typhi
ugcucgacaauaaa

SEQ ID NO: 3626145 - RNA, 18 nt, Salmonella enterica enterica serovar Typhi
ugcucgccauaaaucccg

SEQ ID NO: 3626146 - RNA, 21 nt, Salmonella enterica enterica serovar Typhi
ugcucgcuaugaaaacgcagc

SEQ ID NO: 3626147 - RNA, 22 nt, Salmonella enterica enterica serovar Typhi
ugcucguaaagcaucagacuac

SEQ ID NO: 3626148 - RNA, 17 nt, Salmonella enterica enterica serovar Typhi
ugcucucccagcugagc

SEQ ID NO: 3626149 - RNA, 19 nt, Salmonella enterica enterica serovar Typhi
ugcucucccagcugagcua

SEQ ID NO: 3626150 - RNA, 23 nt, Salmonella enterica enterica serovar Typhi
ugcucucccagcugagcuaauca

SEQ ID NO: 3626151 - RNA, 14 nt, Salmonella enterica enterica serovar Typhi
ugcucuccuggcau

SEQ ID NO: 3626152 - RNA, 19 nt, Salmonella enterica enterica serovar Typhi
ugcucuccuggcauggcuc

SEQ ID NO: 3626153 - RNA, 15 nt, Salmonella enterica enterica serovar Typhi
ugcucugccagcgcc

SEQ ID NO: 3626154 - RNA, 16 nt, Salmonella enterica enterica serovar Typhi
ugcucuucguggaacu

SEQ ID NO: 3626155 - RNA, 17 nt, Salmonella enterica enterica serovar Typhi
ugcucuucuuccggcga

SEQ ID NO: 3626156 - RNA, 13 nt, Salmonella enterica enterica serovar Typhi
ugcucuuuaacaa

SEQ ID NO: 3626157 - RNA, 22 nt, Salmonella enterica enterica serovar Typhi
ugcugaaaaagaacaauaauca

SEQ ID NO: 3626158 - RNA, 13 nt, Salmonella enterica enterica serovar Typhi
ugcugaaagaaga

SEQ ID NO: 3626159 - RNA, 15 nt, Salmonella enterica enterica serovar Typhi
ugcugaaaugauaag

SEQ ID NO: 3626160 - RNA, 20 nt, Salmonella enterica enterica serovar Typhi
ugcugaaaugauaagugaua

SEQ ID NO: 3626161 - RNA, 12 nt, Salmonella enterica enterica serovar Typhi
ugcugaacagcc

SEQ ID NO: 3626162 - RNA, 16 nt, Salmonella enterica enterica serovar Typhi
ugcugaagauaaaauu

SEQ ID NO: 3626163 - RNA, 17 nt, Salmonella enterica enterica serovar Typhi
ugcugaauagccagccc

SEQ ID NO: 3626164 - RNA, 18 nt, Salmonella enterica enterica serovar Typhi
ugcugacaaucugcugga

SEQ ID NO: 3626165 - RNA, 17 nt, Salmonella enterica enterica serovar Typhi
ugcugacacccucugcg

SEQ ID NO: 3626166 - RNA, 20 nt, Salmonella enterica enterica serovar Typhi
ugcugacaucucuuuuaauu

SEQ ID NO: 3626167 - RNA, 15 nt, Salmonella enterica enterica serovar Typhi
ugcugaccuuaaucc

SEQ ID NO: 3626168 - RNA, 17 nt, Salmonella enterica enterica serovar Typhi
ugcugaccuuaauccag

SEQ ID NO: 3626169 - RNA, 20 nt, Salmonella enterica enterica serovar Typhi
ugcugaccuuaauccagcag

SEQ ID NO: 3626170 - RNA, 18 nt, Salmonella enterica enterica serovar Typhi
ugcugacggagcuggcac

SEQ ID NO: 3626171 - RNA, 19 nt, Salmonella enterica enterica serovar Typhi
ugcugacguagauucugau

SEQ ID NO: 3626172 - RNA, 15 nt, Salmonella enterica enterica serovar Typhi
ugcugauaauacugc

SEQ ID NO: 3626173 - RNA, 23 nt, Salmonella enterica enterica serovar Typhi
ugcugauaguccaguacccgcac

SEQ ID NO: 3626174 - RNA, 13 nt, Salmonella enterica enterica serovar Typhi
ugcugauccugua

SEQ ID NO: 3626175 - RNA, 23 nt, Salmonella enterica enterica serovar Typhi
ugcugaucgugauaggccagacg

SEQ ID NO: 3626176 - RNA, 19 nt, Salmonella enterica enterica serovar Typhi
ugcugaucuggcugcguaa

SEQ ID NO: 3626177 - RNA, 22 nt, Salmonella enterica enterica serovar Typhi
ugcugaugacuaauggcauuuc

SEQ ID NO: 3626178 - RNA, 14 nt, Salmonella enterica enterica serovar Typhi
ugcugaugcugguu

SEQ ID NO: 3626179 - RNA, 20 nt, Salmonella enterica enterica serovar Typhi
ugcugaugcuguaggccggg

SEQ ID NO: 3626180 - RNA, 17 nt, Salmonella enterica enterica serovar Typhi
ugcugauggccuuugug

SEQ ID NO: 3626181 - RNA, 16 nt, Salmonella enterica enterica serovar Typhi
ugcugcacauucaggu

SEQ ID NO: 3626182 - RNA, 16 nt, Salmonella enterica enterica serovar Typhi
ugcugcacgucgcgcu

SEQ ID NO: 3626183 - RNA, 14 nt, Salmonella enterica enterica serovar Typhi
ugcugccagcgccg

SEQ ID NO: 3626184 - RNA, 15 nt, Salmonella enterica enterica serovar Typhi
ugcugccagcgccgc

SEQ ID NO: 3626185 - RNA, 15 nt, Salmonella enterica enterica serovar Typhi
ugcugccauuuuauc

SEQ ID NO: 3626186 - RNA, 15 nt, Salmonella enterica enterica serovar Typhi
ugcugcccgccgccg

SEQ ID NO: 3626187 - RNA, 20 nt, Salmonella enterica enterica serovar Typhi
ugcugccgcagcacccgcuc

SEQ ID NO: 3626188 - RNA, 15 nt, Salmonella enterica enterica serovar Typhi
ugcugccuacugccc

SEQ ID NO: 3626189 - RNA, 14 nt, Salmonella enterica enterica serovar Typhi
ugcugccucaucaa

SEQ ID NO: 3626190 - RNA, 14 nt, Salmonella enterica enterica serovar Typhi
ugcugcgcauccgc

SEQ ID NO: 3626191 - RNA, 13 nt, Salmonella enterica enterica serovar Typhi
ugcugcgccagcc

SEQ ID NO: 3626192 - RNA, 22 nt, Salmonella enterica enterica serovar Typhi
ugcuggauucucucccaggcau

SEQ ID NO: 3626193 - RNA, 18 nt, Salmonella enterica enterica serovar Typhi
ugcuggccuguucaagug

SEQ ID NO: 3626194 - RNA, 20 nt, Salmonella enterica enterica serovar Typhi
ugcuggcgaaccaccagccg

SEQ ID NO: 3626195 - RNA, 23 nt, Salmonella enterica enterica serovar Typhi
ugcuggcgcgucacaacagccgg

SEQ ID NO: 3626196 - RNA, 13 nt, Salmonella enterica enterica serovar Typhi
ugcuggcggccgu

SEQ ID NO: 3626197 - RNA, 22 nt, Salmonella enterica enterica serovar Typhi
ugcugggcgauagcguaaagua

SEQ ID NO: 3626198 - RNA, 21 nt, Salmonella enterica enterica serovar Typhi
ugcugguaccuuuguggcagg

SEQ ID NO: 3626199 - RNA, 22 nt, Salmonella enterica enterica serovar Typhi
ugcugguagagcaucgcggcau

SEQ ID NO: 3626200 - RNA, 19 nt, Salmonella enterica enterica serovar Typhi
ugcuggugaagacgcugca

SEQ ID NO: 3626201 - RNA, 14 nt, Salmonella enterica enterica serovar Typhi
ugcuggugcaucug

SEQ ID NO: 3626202 - RNA, 15 nt, Salmonella enterica enterica serovar Typhi
ugcuggugcgccugu

SEQ ID NO: 3626203 - RNA, 14 nt, Salmonella enterica enterica serovar Typhi
ugcugguugucuca

SEQ ID NO: 3626204 - RNA, 14 nt, Salmonella enterica enterica serovar Typhi
ugcuguaaaauauc

SEQ ID NO: 3626205 - RNA, 17 nt, Salmonella enterica enterica serovar Typhi
ugcuguaaguuuccguc

SEQ ID NO: 3626206 - RNA, 16 nt, Salmonella enterica enterica serovar Typhi
ugcuguaauuuauaaa

SEQ ID NO: 3626207 - RNA, 13 nt, Salmonella enterica enterica serovar Typhi
ugcuguagcacau

SEQ ID NO: 3626208 - RNA, 22 nt, Salmonella enterica enterica serovar Typhi
ugcuguagcugcccggauaacc

SEQ ID NO: 3626209 - RNA, 22 nt, Salmonella enterica enterica serovar Typhi
ugcuguauaaacucagcaauau

SEQ ID NO: 3626210 - RNA, 23 nt, Salmonella enterica enterica serovar Typhi
ugcugucgcaauuuaccuauuuc

SEQ ID NO: 3626211 - RNA, 14 nt, Salmonella enterica enterica serovar Typhi
ugcugucuauuguc

SEQ ID NO: 3626212 - RNA, 17 nt, Salmonella enterica enterica serovar Typhi
ugcugucuauugucccg

SEQ ID NO: 3626213 - RNA, 20 nt, Salmonella enterica enterica serovar Typhi
ugcugugacaucgccccggc

SEQ ID NO: 3626214 - RNA, 21 nt, Salmonella enterica enterica serovar Typhi
ugcugugcagacugcacuucc

SEQ ID NO: 3626215 - RNA, 23 nt, Salmonella enterica enterica serovar Typhi
ugcuguuaccguaagcgggaugg

SEQ ID NO: 3626216 - RNA, 21 nt, Salmonella enterica enterica serovar Typhi
ugcuguuccagugggcggaua

SEQ ID NO: 3626217 - RNA, 21 nt, Salmonella enterica enterica serovar Typhi
ugcuguuucaguaaaucccgc

SEQ ID NO: 3626218 - RNA, 22 nt, Salmonella enterica enterica serovar Typhi
ugcuguuucaguaaaucccgca

SEQ ID NO: 3626219 - RNA, 21 nt, Salmonella enterica enterica serovar Typhi
ugcuguuuuuuguugauuuua

SEQ ID NO: 3626220 - RNA, 13 nt, Salmonella enterica enterica serovar Typhi
ugcuuaacuucug

SEQ ID NO: 3626221 - RNA, 20 nt, Salmonella enterica enterica serovar Typhi
ugcuuaccaucuggccuacg

SEQ ID NO: 3626222 - RNA, 19 nt, Salmonella enterica enterica serovar Typhi
ugcuuaccguuuaccucau

SEQ ID NO: 3626223 - RNA, 19 nt, Salmonella enterica enterica serovar Typhi
ugcuuaccuuguucuucca

SEQ ID NO: 3626224 - RNA, 19 nt, Salmonella enterica enterica serovar Typhi
ugcuuacggcaaacugaaa

SEQ ID NO: 3626225 - RNA, 13 nt, Salmonella enterica enterica serovar Typhi
ugcuuaucacgua

SEQ ID NO: 3626226 - RNA, 17 nt, Salmonella enterica enterica serovar Typhi
ugcuuaugaucgcccag

SEQ ID NO: 3626227 - RNA, 18 nt, Salmonella enterica enterica serovar Typhi
ugcuuauugucgccgccg

SEQ ID NO: 3626228 - RNA, 18 nt, Salmonella enterica enterica serovar Typhi
ugcuucaacggugcugag

SEQ ID NO: 3626229 - RNA, 23 nt, Salmonella enterica enterica serovar Typhi
ugcuucaccgcgccaaacguggc

SEQ ID NO: 3626230 - RNA, 20 nt, Salmonella enterica enterica serovar Typhi
ugcuucaccucagcaaaauc

SEQ ID NO: 3626231 - RNA, 20 nt, Salmonella enterica enterica serovar Typhi
ugcuucagacaacgccgccu

SEQ ID NO: 3626232 - RNA, 18 nt, Salmonella enterica enterica serovar Typhi
ugcuucagguuaagugac

SEQ ID NO: 3626233 - RNA, 22 nt, Salmonella enterica enterica serovar Typhi
ugcuucaugcacaaaacccgca

SEQ ID NO: 3626234 - RNA, 16 nt, Salmonella enterica enterica serovar Typhi
ugcuuccaguagccua

SEQ ID NO: 3626235 - RNA, 20 nt, Salmonella enterica enterica serovar Typhi
ugcuuccgaccgcagcagag

SEQ ID NO: 3626236 - RNA, 15 nt, Salmonella enterica enterica serovar Typhi
ugcuucgauggccuc

SEQ ID NO: 3626237 - RNA, 23 nt, Salmonella enterica enterica serovar Typhi
ugcuucgccacgaccuacaccgu

SEQ ID NO: 3626238 - RNA, 20 nt, Salmonella enterica enterica serovar Typhi
ugcuucguggcaaucagcaa

SEQ ID NO: 3626239 - RNA, 17 nt, Salmonella enterica enterica serovar Typhi
ugcuucuugaguuggca

SEQ ID NO: 3626240 - RNA, 15 nt, Salmonella enterica enterica serovar Typhi
ugcuugagcaggcag

SEQ ID NO: 3626241 - RNA, 14 nt, Salmonella enterica enterica serovar Typhi
ugcuuuaaaugccu

SEQ ID NO: 3626242 - RNA, 19 nt, Salmonella enterica enterica serovar Typhi
ugcuuuaaaugccuguuua

SEQ ID NO: 3626243 - RNA, 14 nt, Salmonella enterica enterica serovar Typhi
ugcuuuaauauuca

SEQ ID NO: 3626244 - RNA, 13 nt, Salmonella enterica enterica serovar Typhi
ugcuuuauaaaaa

SEQ ID NO: 3626245 - RNA, 15 nt, Salmonella enterica enterica serovar Typhi
ugcuuucuggaugau

SEQ ID NO: 3626246 - RNA, 22 nt, Salmonella enterica enterica serovar Typhi
ugcuuugaucacccacaccaca

SEQ ID NO: 3626247 - RNA, 21 nt, Salmonella enterica enterica serovar Typhi
ugcuuuuucagcgaggaaaac

SEQ ID NO: 3626248 - RNA, 17 nt, Salmonella enterica enterica serovar Typhi
uggaaaaagaccaauac

SEQ ID NO: 3626249 - RNA, 22 nt, Salmonella enterica enterica serovar Typhi
uggaaaaaucuguaggcccggu

SEQ ID NO: 3626250 - RNA, 21 nt, Salmonella enterica enterica serovar Typhi
uggaaaacagcauaauaaagc

SEQ ID NO: 3626251 - RNA, 22 nt, Salmonella enterica enterica serovar Typhi
uggaaaacagcauaauaaagca

SEQ ID NO: 3626252 - RNA, 15 nt, Salmonella enterica enterica serovar Typhi
uggaaaacuccagca

SEQ ID NO: 3626253 - RNA, 13 nt, Salmonella enterica enterica serovar Typhi
uggaaaagaaaac

SEQ ID NO: 3626254 - RNA, 21 nt, Salmonella enterica enterica serovar Typhi
uggaaacagccaaucauaaac

SEQ ID NO: 3626255 - RNA, 16 nt, Salmonella enterica enterica serovar Typhi
uggaaacuaugcaaaa

SEQ ID NO: 3626256 - RNA, 18 nt, Salmonella enterica enterica serovar Typhi
uggaaaggaugcagcauc

SEQ ID NO: 3626257 - RNA, 19 nt, Salmonella enterica enterica serovar Typhi
uggaaauaaucuguagauu

SEQ ID NO: 3626258 - RNA, 15 nt, Salmonella enterica enterica serovar Typhi
uggaaauauucucag

SEQ ID NO: 3626259 - RNA, 14 nt, Salmonella enterica enterica serovar Typhi
uggaaaugcguggc

SEQ ID NO: 3626260 - RNA, 15 nt, Salmonella enterica enterica serovar Typhi
uggaaauucagggug

SEQ ID NO: 3626261 - RNA, 23 nt, Salmonella enterica enterica serovar Typhi
uggaacagauguuuacgcugcuc

SEQ ID NO: 3626262 - RNA, 22 nt, Salmonella enterica enterica serovar Typhi
uggaaccaggcgcgaugcgacu

SEQ ID NO: 3626263 - RNA, 15 nt, Salmonella enterica enterica serovar Typhi
uggaacgcauccagc

SEQ ID NO: 3626264 - RNA, 14 nt, Salmonella enterica enterica serovar Typhi
uggaagaaaauaua

SEQ ID NO: 3626265 - RNA, 19 nt, Salmonella enterica enterica serovar Typhi
uggaagaacuuccccauca

SEQ ID NO: 3626266 - RNA, 17 nt, Salmonella enterica enterica serovar Typhi
uggaagcgaucaagaca

SEQ ID NO: 3626267 - RNA, 14 nt, Salmonella enterica enterica serovar Typhi
uggaagcuguuaau

SEQ ID NO: 3626268 - RNA, 19 nt, Salmonella enterica enterica serovar Typhi
uggaaguaugccucgcgca

SEQ ID NO: 3626269 - RNA, 20 nt, Salmonella enterica enterica serovar Typhi
uggaaguugaagaaaaaccc

SEQ ID NO: 3626270 - RNA, 18 nt, Salmonella enterica enterica serovar Typhi
uggaauaaacgguaagag

SEQ ID NO: 3626271 - RNA, 22 nt, Salmonella enterica enterica serovar Typhi
uggaaucaauuucccuucaauc

SEQ ID NO: 3626272 - RNA, 16 nt, Salmonella enterica enterica serovar Typhi
uggaaucauccaccag

SEQ ID NO: 3626273 - RNA, 14 nt, Salmonella enterica enterica serovar Typhi
uggaaugagcaucu

SEQ ID NO: 3626274 - RNA, 15 nt, Salmonella enterica enterica serovar Typhi
uggaaugcccacucc

SEQ ID NO: 3626275 - RNA, 15 nt, Salmonella enterica enterica serovar Typhi
uggacaaaaaaggaa

SEQ ID NO: 3626276 - RNA, 23 nt, Salmonella enterica enterica serovar Typhi
uggacaaaaaaggaaaaugacgc

SEQ ID NO: 3626277 - RNA, 17 nt, Salmonella enterica enterica serovar Typhi
uggacaaggaucguuac

SEQ ID NO: 3626278 - RNA, 15 nt, Salmonella enterica enterica serovar Typhi
uggacagauuuccac

SEQ ID NO: 3626279 - RNA, 16 nt, Salmonella enterica enterica serovar Typhi
uggacagauuuccacg

SEQ ID NO: 3626280 - RNA, 14 nt, Salmonella enterica enterica serovar Typhi
uggaccagccaggc

SEQ ID NO: 3626281 - RNA, 23 nt, Salmonella enterica enterica serovar Typhi
ugagcgucacgccaucagggacg

SEQ ID NO: 3626282 - RNA, 22 nt, Salmonella enterica enterica serovar Typhi
ugagcguccagucgggcgugcc

SEQ ID NO: 3626283 - RNA, 14 nt, Salmonella enterica enterica serovar Typhi
ugagcgucgccaga

SEQ ID NO: 3626284 - RNA, 19 nt, Salmonella enterica enterica serovar Typhi
ugagcguuacgggaacaga

SEQ ID NO: 3626285 - RNA, 22 nt, Salmonella enterica enterica serovar Typhi
ugagcguuagcgccauccggca

SEQ ID NO: 3626286 - RNA, 11 nt, Salmonella enterica enterica serovar Typhi
ugagcuaauca

SEQ ID NO: 3626287 - RNA, 13 nt, Salmonella enterica enterica serovar Typhi
ugagcucauccag

SEQ ID NO: 3626288 - RNA, 13 nt, Salmonella enterica enterica serovar Typhi
ugagcucuuucug

SEQ ID NO: 3626289 - RNA, 22 nt, Salmonella enterica enterica serovar Typhi
ugagcugcugcuugcuuuucau

SEQ ID NO: 3626290 - RNA, 16 nt, Salmonella enterica enterica serovar Typhi
ugagcuucaccgccag

SEQ ID NO: 3626291 - RNA, 16 nt, Salmonella enterica enterica serovar Typhi
ugaggccgcucgccau

SEQ ID NO: 3626292 - RNA, 17 nt, Salmonella enterica enterica serovar Typhi
ugaggccguuauuguca

SEQ ID NO: 3626293 - RNA, 12 nt, Salmonella enterica enterica serovar Typhi
ugaggcgcagcc

SEQ ID NO: 3626294 - RNA, 18 nt, Salmonella enterica enterica serovar Typhi
ugaggcgcugcgacgcgg

SEQ ID NO: 3626295 - RNA, 17 nt, Salmonella enterica enterica serovar Typhi
ugaggcguugcuccagc

SEQ ID NO: 3626296 - RNA, 19 nt, Salmonella enterica enterica serovar Typhi
ugaggcuuugagcgucagc

SEQ ID NO: 3626297 - RNA, 11 nt, Salmonella enterica enterica serovar Typhi
ugagggcgaua

SEQ ID NO: 3626298 - RNA, 21 nt, Salmonella enterica enterica serovar Typhi
ugagggcgauaauccgcucca

SEQ ID NO: 3626299 - RNA, 20 nt, Salmonella enterica enterica serovar Typhi
ugagguugagauccugaucc

SEQ ID NO: 3626300 - RNA, 15 nt, Salmonella enterica enterica serovar Typhi
ugagguuucagcacc

SEQ ID NO: 3626301 - RNA, 16 nt, Salmonella enterica enterica serovar Typhi
ugagguuucagcaccu

SEQ ID NO: 3626302 - RNA, 18 nt, Salmonella enterica enterica serovar Typhi
ugaguaaacgcucaagca

SEQ ID NO: 3626303 - RNA, 13 nt, Salmonella enterica enterica serovar Typhi
ugaguaacguuaa

SEQ ID NO: 3626304 - RNA, 17 nt, Salmonella enterica enterica serovar Typhi
ugaguaucgggauggcg

SEQ ID NO: 3626305 - RNA, 20 nt, Salmonella enterica enterica serovar Typhi
ugaguauuaacgugauggcg

SEQ ID NO: 3626306 - RNA, 16 nt, Salmonella enterica enterica serovar Typhi
ugaguauuggcaagaa

SEQ ID NO: 3626307 - RNA, 15 nt, Salmonella enterica enterica serovar Typhi
ugagucauccuuccc

SEQ ID NO: 3626308 - RNA, 19 nt, Salmonella enterica enterica serovar Typhi
ugaguccauaccguuucaa

SEQ ID NO: 3626309 - RNA, 16 nt, Salmonella enterica enterica serovar Typhi
ugaguccccgggagca

SEQ ID NO: 3626310 - RNA, 23 nt, Salmonella enterica enterica serovar Typhi
ugagucgacugguaggccugaua

SEQ ID NO: 3626311 - RNA, 15 nt, Salmonella enterica enterica serovar Typhi
ugagucuugccuguc

SEQ ID NO: 3626312 - RNA, 14 nt, Salmonella enterica enterica serovar Typhi
ugaguguuacucuu

SEQ ID NO: 3626313 - RNA, 15 nt, Salmonella enterica enterica serovar Typhi
ugaguuaacgacugc

SEQ ID NO: 3626314 - RNA, 17 nt, Salmonella enterica enterica serovar Typhi
ugaguuugacugccaga

SEQ ID NO: 3626315 - RNA, 18 nt, Salmonella enterica enterica serovar Typhi
ugaguuugucauccagac

SEQ ID NO: 3626316 - RNA, 20 nt, Salmonella enterica enterica serovar Typhi
ugaguuuuccgccauuggcg

SEQ ID NO: 3626317 - RNA, 18 nt, Salmonella enterica enterica serovar Typhi
ugauaaaaaacaguacgg

SEQ ID NO: 3626318 - RNA, 22 nt, Salmonella enterica enterica serovar Typhi
ugauaaaacauuccaucgccau

SEQ ID NO: 3626319 - RNA, 20 nt, Salmonella enterica enterica serovar Typhi
ugauaaaauaaacacuaaau

SEQ ID NO: 3626320 - RNA, 22 nt, Salmonella enterica enterica serovar Typhi
ugauaaacgcaaugucaucagg

SEQ ID NO: 3626321 - RNA, 13 nt, Salmonella enterica enterica serovar Typhi
ugauaaagcgcuc

SEQ ID NO: 3626322 - RNA, 20 nt, Salmonella enterica enterica serovar Typhi
ugauaaagcuuucaucuuua

SEQ ID NO: 3626323 - RNA, 11 nt, Salmonella enterica enterica serovar Typhi
ugauaaauauc

SEQ ID NO: 3626324 - RNA, 18 nt, Salmonella enterica enterica serovar Typhi
ugauaaaucgucggcagg

SEQ ID NO: 3626325 - RNA, 13 nt, Salmonella enterica enterica serovar Typhi
ugauaagagaaaa

SEQ ID NO: 3626326 - RNA, 14 nt, Salmonella enterica enterica serovar Typhi
ugauaagagaaaau

SEQ ID NO: 3626327 - RNA, 18 nt, Salmonella enterica enterica serovar Typhi
ugauaagcgcagcgccau

SEQ ID NO: 3626328 - RNA, 18 nt, Salmonella enterica enterica serovar Typhi
ugauaagcuaguaaagaa

SEQ ID NO: 3626329 - RNA, 23 nt, Salmonella enterica enterica serovar Typhi
ugauaauaguggugcgcauccgg

SEQ ID NO: 3626330 - RNA, 15 nt, Salmonella enterica enterica serovar Typhi
ugauaaucaauggcc

SEQ ID NO: 3626331 - RNA, 23 nt, Salmonella enterica enterica serovar Typhi
ugauaaucaauggccuugccagc

SEQ ID NO: 3626332 - RNA, 12 nt, Salmonella enterica enterica serovar Typhi
ugauaaucagcg

SEQ ID NO: 3626333 - RNA, 17 nt, Salmonella enterica enterica serovar Typhi
ugauaaugucaacuuaa

SEQ ID NO: 3626334 - RNA, 22 nt, Salmonella enterica enterica serovar Typhi
ugauaauguuggauuauacauu

SEQ ID NO: 3626335 - RNA, 22 nt, Salmonella enterica enterica serovar Typhi
ugauacagaaaaccggcaaaua

SEQ ID NO: 3626336 - RNA, 23 nt, Salmonella enterica enterica serovar Typhi
ugauacagccaaaucagcaggac

SEQ ID NO: 3626337 - RNA, 16 nt, Salmonella enterica enterica serovar Typhi
ugauacaggaauaacc

SEQ ID NO: 3626338 - RNA, 17 nt, Salmonella enterica enterica serovar Typhi
ugauaccacaucaauag

SEQ ID NO: 3626339 - RNA, 15 nt, Salmonella enterica enterica serovar Typhi
ugauaccccagcgau

SEQ ID NO: 3626340 - RNA, 20 nt, Salmonella enterica enterica serovar Typhi
ugauaccgauagcgcggaau

SEQ ID NO: 3626341 - RNA, 14 nt, Salmonella enterica enterica serovar Typhi
ugauaccuauuuaa

SEQ ID NO: 3626342 - RNA, 15 nt, Salmonella enterica enterica serovar Typhi
ugauaccuauuuaau

SEQ ID NO: 3626343 - RNA, 16 nt, Salmonella enterica enterica serovar Typhi
ugauaccuauuuaaua

SEQ ID NO: 3626344 - RNA, 20 nt, Salmonella enterica enterica serovar Typhi
ugauaccuuuaaccucuuuu

SEQ ID NO: 3626345 - RNA, 19 nt, Salmonella enterica enterica serovar Typhi
ugauacgcggcugaugcag

SEQ ID NO: 3626346 - RNA, 23 nt, Salmonella enterica enterica serovar Typhi
ugauacggaaauagcgccauccu

SEQ ID NO: 3626347 - RNA, 19 nt, Salmonella enterica enterica serovar Typhi
ugauacgggaagucauuag

SEQ ID NO: 3626348 - RNA, 14 nt, Salmonella enterica enterica serovar Typhi
ugauacucaucaua

SEQ ID NO: 3626349 - RNA, 23 nt, Salmonella enterica enterica serovar Typhi
ugauagagguuaccgggcuaaac

SEQ ID NO: 3626350 - RNA, 23 nt, Salmonella enterica enterica serovar Typhi
ugauagcaaucauccugauuuua

SEQ ID NO: 3626351 - RNA, 18 nt, Salmonella enterica enterica serovar Typhi
ugauagccguucuccagc

SEQ ID NO: 3626352 - RNA, 15 nt, Salmonella enterica enterica serovar Typhi
ugauagcgaggcagc

SEQ ID NO: 3626353 - RNA, 14 nt, Salmonella enterica enterica serovar Typhi
ugauagggcagcag

SEQ ID NO: 3626354 - RNA, 18 nt, Salmonella enterica enterica serovar Typhi
ugauagggcgccuguuua

SEQ ID NO: 3626355 - RNA, 21 nt, Salmonella enterica enterica serovar Typhi
ugauagguucaauaugccagg

SEQ ID NO: 3626356 - RNA, 19 nt, Salmonella enterica enterica serovar Typhi
ugauagucauugacagcaa

SEQ ID NO: 3626357 - RNA, 13 nt, Salmonella enterica enterica serovar Typhi
ugauaguccauca

SEQ ID NO: 3626358 - RNA, 18 nt, Salmonella enterica enterica serovar Typhi
ugauaguuuaaauccagc

SEQ ID NO: 3626359 - RNA, 14 nt, Salmonella enterica enterica serovar Typhi
ugauauaaacgggc

SEQ ID NO: 3626360 - RNA, 20 nt, Salmonella enterica enterica serovar Typhi
ugauauaccguccagacucc

SEQ ID NO: 3626361 - RNA, 18 nt, Salmonella enterica enterica serovar Typhi
ugauauccacgcgcacca

SEQ ID NO: 3626362 - RNA, 20 nt, Salmonella enterica enterica serovar Typhi
ugauaugcaguucaucaucc

SEQ ID NO: 3626363 - RNA, 19 nt, Salmonella enterica enterica serovar Typhi
ugauaugcucgacaauaaa

SEQ ID NO: 3626364 - RNA, 23 nt, Salmonella enterica enterica serovar Typhi
ugauauuacuaauaaaauucacu

SEQ ID NO: 3626365 - RNA, 22 nt, Salmonella enterica enterica serovar Typhi
ugauauugccgaccgccagcag

SEQ ID NO: 3626366 - RNA, 23 nt, Salmonella enterica enterica serovar Typhi
ugauauugcguaagcagcugcuu

SEQ ID NO: 3626367 - RNA, 17 nt, Salmonella enterica enterica serovar Typhi
ugauauuuuuacugauu

SEQ ID NO: 3626368 - RNA, 14 nt, Salmonella enterica enterica serovar Typhi
ugaucaauuugccu

SEQ ID NO: 3626369 - RNA, 23 nt, Salmonella enterica enterica serovar Typhi
ugaucacgguacgcaucaccagg

SEQ ID NO: 3626370 - RNA, 16 nt, Salmonella enterica enterica serovar Typhi
ugaucacuuccgccac

SEQ ID NO: 3626371 - RNA, 21 nt, Salmonella enterica enterica serovar Typhi
ugaucacuuuugggccgcgua

SEQ ID NO: 3626372 - RNA, 23 nt, Salmonella enterica enterica serovar Typhi
ugaucagcaaaauaguguugaau

SEQ ID NO: 3626373 - RNA, 19 nt, Salmonella enterica enterica serovar Typhi
ugaucaggaaaucuuccag

SEQ ID NO: 3626374 - RNA, 20 nt, Salmonella enterica enterica serovar Typhi
ugaucaggaaaucuuccagu

SEQ ID NO: 3626375 - RNA, 13 nt, Salmonella enterica enterica serovar Typhi
ugaucaggcaaaa

SEQ ID NO: 3626376 - RNA, 14 nt, Salmonella enterica enterica serovar Typhi
ugaucaggcuaaag

SEQ ID NO: 3626377 - RNA, 14 nt, Salmonella enterica enterica serovar Typhi
ugaucauacugccg

SEQ ID NO: 3626378 - RNA, 14 nt, Salmonella enterica enterica serovar Typhi
ugccagcgccguca

SEQ ID NO: 3626379 - RNA, 15 nt, Salmonella enterica enterica serovar Typhi
ugccagcgcucugca

SEQ ID NO: 3626380 - RNA, 18 nt, Salmonella enterica enterica serovar Typhi
ugccagcggccagggcgu

SEQ ID NO: 3626381 - RNA, 19 nt, Salmonella enterica enterica serovar Typhi
ugccagcguaagucugaua

SEQ ID NO: 3626382 - RNA, 14 nt, Salmonella enterica enterica serovar Typhi
ugccagcgucgcug

SEQ ID NO: 3626383 - RNA, 19 nt, Salmonella enterica enterica serovar Typhi
ugccagcgucgcugauugc

SEQ ID NO: 3626384 - RNA, 17 nt, Salmonella enterica enterica serovar Typhi
ugccagcucguuauuuc

SEQ ID NO: 3626385 - RNA, 18 nt, Salmonella enterica enterica serovar Typhi
ugccaggaagucagcuuc

SEQ ID NO: 3626386 - RNA, 23 nt, Salmonella enterica enterica serovar Typhi
ugccaggaagucagcuuccugca

SEQ ID NO: 3626387 - RNA, 12 nt, Salmonella enterica enterica serovar Typhi
ugccaguaacgu

SEQ ID NO: 3626388 - RNA, 17 nt, Salmonella enterica enterica serovar Typhi
ugccaguaacucaucgc

SEQ ID NO: 3626389 - RNA, 20 nt, Salmonella enterica enterica serovar Typhi
ugccaguacagcagcgacgc

SEQ ID NO: 3626390 - RNA, 23 nt, Salmonella enterica enterica serovar Typhi
ugccaguaguugaauaaccucaa

SEQ ID NO: 3626391 - RNA, 23 nt, Salmonella enterica enterica serovar Typhi
ugccagucaauaagcuugcuuuc

SEQ ID NO: 3626392 - RNA, 17 nt, Salmonella enterica enterica serovar Typhi
ugccaguucauuccgcc

SEQ ID NO: 3626393 - RNA, 16 nt, Salmonella enterica enterica serovar Typhi
ugccaguuucucaaag

SEQ ID NO: 3626394 - RNA, 19 nt, Salmonella enterica enterica serovar Typhi
ugccaguuucucaaagcug

SEQ ID NO: 3626395 - RNA, 18 nt, Salmonella enterica enterica serovar Typhi
ugccauaaaaacaauaaa

SEQ ID NO: 3626396 - RNA, 15 nt, Salmonella enterica enterica serovar Typhi
ugccauaaaaugcug

SEQ ID NO: 3626397 - RNA, 17 nt, Salmonella enterica enterica serovar Typhi
ugccauacacgcggcga

SEQ ID NO: 3626398 - RNA, 18 nt, Salmonella enterica enterica serovar Typhi
ugccauauuguucaguuu

SEQ ID NO: 3626399 - RNA, 20 nt, Salmonella enterica enterica serovar Typhi
ugccauauuguucaguuuca

SEQ ID NO: 3626400 - RNA, 14 nt, Salmonella enterica enterica serovar Typhi
ugccaucagcaccu

SEQ ID NO: 3626401 - RNA, 12 nt, Salmonella enterica enterica serovar Typhi
ugccaucaucag

SEQ ID NO: 3626402 - RNA, 13 nt, Salmonella enterica enterica serovar Typhi
ugccaucauccag

SEQ ID NO: 3626403 - RNA, 22 nt, Salmonella enterica enterica serovar Typhi
ugccaucauuaauuuacugaua

SEQ ID NO: 3626404 - RNA, 16 nt, Salmonella enterica enterica serovar Typhi
ugccaucccauguuga

SEQ ID NO: 3626405 - RNA, 18 nt, Salmonella enterica enterica serovar Typhi
ugccaucgaccgauuggg

SEQ ID NO: 3626406 - RNA, 18 nt, Salmonella enterica enterica serovar Typhi
ugccaucgacgcgcauca

SEQ ID NO: 3626407 - RNA, 20 nt, Salmonella enterica enterica serovar Typhi
ugccaucgcuuaacccugcc

SEQ ID NO: 3626408 - RNA, 17 nt, Salmonella enterica enterica serovar Typhi
ugccaucgcuucuacag

SEQ ID NO: 3626409 - RNA, 11 nt, Salmonella enterica enterica serovar Typhi
ugccaugcugg

SEQ ID NO: 3626410 - RNA, 23 nt, Salmonella enterica enterica serovar Typhi
ugccauuaucaccauucccagcg

SEQ ID NO: 3626411 - RNA, 16 nt, Salmonella enterica enterica serovar Typhi
ugccauucgcccaguc

SEQ ID NO: 3626412 - RNA, 14 nt, Salmonella enterica enterica serovar Typhi
ugccauugcgacga

SEQ ID NO: 3626413 - RNA, 18 nt, Salmonella enterica enterica serovar Typhi
ugccauuguuccggcgac

SEQ ID NO: 3626414 - RNA, 20 nt, Salmonella enterica enterica serovar Typhi
ugcccaccggcccacgcagu

SEQ ID NO: 3626415 - RNA, 15 nt, Salmonella enterica enterica serovar Typhi
ugcccaccugaaaaa

SEQ ID NO: 3626416 - RNA, 20 nt, Salmonella enterica enterica serovar Typhi
ugcccaccugaaaaagggua

SEQ ID NO: 3626417 - RNA, 16 nt, Salmonella enterica enterica serovar Typhi
ugcccaccuucgcgga

SEQ ID NO: 3626418 - RNA, 18 nt, Salmonella enterica enterica serovar Typhi
ugcccagcaucccgcugg

SEQ ID NO: 3626419 - RNA, 19 nt, Salmonella enterica enterica serovar Typhi
ugcccagcgccuucuucac

SEQ ID NO: 3626420 - RNA, 11 nt, Salmonella enterica enterica serovar Typhi
ugcccagguua

SEQ ID NO: 3626421 - RNA, 18 nt, Salmonella enterica enterica serovar Typhi
ugcccaguuuacccagcg

SEQ ID NO: 3626422 - RNA, 23 nt, Salmonella enterica enterica serovar Typhi
ugcccaguuuacccagcgaaugc

SEQ ID NO: 3626423 - RNA, 18 nt, Salmonella enterica enterica serovar Typhi
ugcccaucauucaacgca

SEQ ID NO: 3626424 - RNA, 17 nt, Salmonella enterica enterica serovar Typhi
ugcccaucgcgccauga

SEQ ID NO: 3626425 - RNA, 23 nt, Salmonella enterica enterica serovar Typhi
ugcccaucgcgccaugauucauc

SEQ ID NO: 3626426 - RNA, 18 nt, Salmonella enterica enterica serovar Typhi
ugcccauucuucgucguc

SEQ ID NO: 3626427 - RNA, 15 nt, Salmonella enterica enterica serovar Typhi
ugcccauuuccugca

SEQ ID NO: 3626428 - RNA, 22 nt, Salmonella enterica enterica serovar Typhi
ugccccacgauacgccccugcu

SEQ ID NO: 3626429 - RNA, 19 nt, Salmonella enterica enterica serovar Typhi
ugcccccauacgcgcgcca

SEQ ID NO: 3626430 - RNA, 23 nt, Salmonella enterica enterica serovar Typhi
ugcccccaucacuuuacccacau

SEQ ID NO: 3626431 - RNA, 15 nt, Salmonella enterica enterica serovar Typhi
ugccccucccugaau

SEQ ID NO: 3626432 - RNA, 21 nt, Salmonella enterica enterica serovar Typhi
ugccccugaccgaagguuacc

SEQ ID NO: 3626433 - RNA, 21 nt, Salmonella enterica enterica serovar Typhi
ugccccuuccgccacggcuuu

SEQ ID NO: 3626434 - RNA, 19 nt, Salmonella enterica enterica serovar Typhi
ugcccgaaagcaauacugu

SEQ ID NO: 3626435 - RNA, 18 nt, Salmonella enterica enterica serovar Typhi
ugcccgauagugcaagcu

SEQ ID NO: 3626436 - RNA, 14 nt, Salmonella enterica enterica serovar Typhi
ugcccgaugcgccc

SEQ ID NO: 3626437 - RNA, 16 nt, Salmonella enterica enterica serovar Typhi
ugcccgauggcgcugc

SEQ ID NO: 3626438 - RNA, 18 nt, Salmonella enterica enterica serovar Typhi
ugcccgcgaucgcuucca

SEQ ID NO: 3626439 - RNA, 23 nt, Salmonella enterica enterica serovar Typhi
ugcccggauacgggaucgauaau

SEQ ID NO: 3626440 - RNA, 21 nt, Salmonella enterica enterica serovar Typhi
ugcccggcaugucgccagcca

SEQ ID NO: 3626441 - RNA, 19 nt, Salmonella enterica enterica serovar Typhi
ugcccggcgcggcaucauc

SEQ ID NO: 3626442 - RNA, 17 nt, Salmonella enterica enterica serovar Typhi
ugcccggcggcgcgaug

SEQ ID NO: 3626443 - RNA, 17 nt, Salmonella enterica enterica serovar Typhi
ugcccggggugaacaaa

SEQ ID NO: 3626444 - RNA, 13 nt, Salmonella enterica enterica serovar Typhi
ugcccguuccagg

SEQ ID NO: 3626445 - RNA, 22 nt, Salmonella enterica enterica serovar Typhi
ugcccguuugcgagacggcgaa

SEQ ID NO: 3626446 - RNA, 15 nt, Salmonella enterica enterica serovar Typhi
ugcccucggaaaacu

SEQ ID NO: 3626447 - RNA, 17 nt, Salmonella enterica enterica serovar Typhi
ugcccugacucgcaccg

SEQ ID NO: 3626448 - RNA, 22 nt, Salmonella enterica enterica serovar Typhi
ugcccugcuugucgaucaucag

SEQ ID NO: 3626449 - RNA, 17 nt, Salmonella enterica enterica serovar Typhi
ugcccuggaauuuuucc

SEQ ID NO: 3626450 - RNA, 16 nt, Salmonella enterica enterica serovar Typhi
ugcccuuaucuggaug

SEQ ID NO: 3626451 - RNA, 20 nt, Salmonella enterica enterica serovar Typhi
ugcccuuaucuggaugagga

SEQ ID NO: 3626452 - RNA, 16 nt, Salmonella enterica enterica serovar Typhi
ugcccuuccagcagcc

SEQ ID NO: 3626453 - RNA, 22 nt, Salmonella enterica enterica serovar Typhi
ugcccuucgacaaucagcacca

SEQ ID NO: 3626454 - RNA, 19 nt, Salmonella enterica enterica serovar Typhi
ugcccuucgaccgucagca

SEQ ID NO: 3626455 - RNA, 20 nt, Salmonella enterica enterica serovar Typhi
ugcccuucuuuaauacgcgu

SEQ ID NO: 3626456 - RNA, 13 nt, Salmonella enterica enterica serovar Typhi
ugcccuuucuuau

SEQ ID NO: 3626457 - RNA, 23 nt, Salmonella enterica enterica serovar Typhi
ugcccuuuuugcauucgcuccuc

SEQ ID NO: 3626458 - RNA, 23 nt, Salmonella enterica enterica serovar Typhi
ugccgaagucaaaggccaguaag

SEQ ID NO: 3626459 - RNA, 17 nt, Salmonella enterica enterica serovar Typhi
ugccgacagaacugauu

SEQ ID NO: 3626460 - RNA, 13 nt, Salmonella enterica enterica serovar Typhi
ugccgacaggcag

SEQ ID NO: 3626461 - RNA, 18 nt, Salmonella enterica enterica serovar Typhi
ugccgaccgccagcagag

SEQ ID NO: 3626462 - RNA, 21 nt, Salmonella enterica enterica serovar Typhi
ugccgagcaacagaaaccaua

SEQ ID NO: 3626463 - RNA, 20 nt, Salmonella enterica enterica serovar Typhi
ugccgauaauaaacgcgcca

SEQ ID NO: 3626464 - RNA, 18 nt, Salmonella enterica enterica serovar Typhi
ugccgauagucuccgcca

SEQ ID NO: 3626465 - RNA, 18 nt, Salmonella enterica enterica serovar Typhi
ugccgaucaccagcgcau

SEQ ID NO: 3626466 - RNA, 17 nt, Salmonella enterica enterica serovar Typhi
ugccgaugaaagagcgc

SEQ ID NO: 3626467 - RNA, 16 nt, Salmonella enterica enterica serovar Typhi
ugccgaugaacgacgc

SEQ ID NO: 3626468 - RNA, 21 nt, Salmonella enterica enterica serovar Typhi
ugccgauggcuaaagcgcugg

SEQ ID NO: 3626469 - RNA, 16 nt, Salmonella enterica enterica serovar Typhi
ugccgauggcuauuac

SEQ ID NO: 3626470 - RNA, 23 nt, Salmonella enterica enterica serovar Typhi
ugccgauuuaccucucaccagua

SEQ ID NO: 3626471 - RNA, 14 nt, Salmonella enterica enterica serovar Typhi
ugccgcacucccca

SEQ ID NO: 3626472 - RNA, 19 nt, Salmonella enterica enterica serovar Typhi
ugccgcagccacauuguau

SEQ ID NO: 3626473 - RNA, 12 nt, Salmonella enterica enterica serovar Typhi
ugccgcaggcaa

SEQ ID NO: 3626474 - RNA, 19 nt, Salmonella enterica enterica serovar Typhi
ugccgcaucuucgcccggc

SEQ ID NO: 3626475 - RNA, 15 nt, Salmonella enterica enterica serovar Typhi
ugccgccagcaguug

SEQ ID NO: 3626476 - RNA, 21 nt, Salmonella enterica enterica serovar Typhi
ugccgccaguuguucaacaua

SEQ ID NO: 3626477 - RNA, 13 nt, Salmonella enterica enterica serovar Typhi
ugccgccaucgcu

SEQ ID NO: 3626478 - RNA, 20 nt, Salmonella enterica enterica serovar Typhi
ugccgccauucgcuuccgcc

SEQ ID NO: 3626479 - RNA, 16 nt, Salmonella enterica enterica serovar Typhi
ugccgcccaggccaug

SEQ ID NO: 3626480 - RNA, 15 nt, Salmonella enterica enterica serovar Typhi
ugccgcccaggccug

SEQ ID NO: 3626481 - RNA, 16 nt, Salmonella enterica enterica serovar Typhi
ugccgcccauccagag

SEQ ID NO: 3626482 - RNA, 19 nt, Salmonella enterica enterica serovar Typhi
ugccgcccaucgccacagc

SEQ ID NO: 3626483 - RNA, 21 nt, Salmonella enterica enterica serovar Typhi
ugccgcccugaaagccgaccc

SEQ ID NO: 3626484 - RNA, 18 nt, Salmonella enterica enterica serovar Typhi
ugccgccgacaaccagcg

SEQ ID NO: 3626485 - RNA, 19 nt, Salmonella enterica enterica serovar Typhi
ugccgccgcgaugcaucuu

SEQ ID NO: 3626486 - RNA, 13 nt, Salmonella enterica enterica serovar Typhi
ugccgccggacca

SEQ ID NO: 3626487 - RNA, 19 nt, Salmonella enterica enterica serovar Typhi
ugccgccggaccaucuucc

SEQ ID NO: 3626488 - RNA, 16 nt, Salmonella enterica enterica serovar Typhi
ugccgccgucgcggcu

SEQ ID NO: 3626489 - RNA, 22 nt, Salmonella enterica enterica serovar Typhi
ugccgccuccagcauacugaug

SEQ ID NO: 3626490 - RNA, 17 nt, Salmonella enterica enterica serovar Typhi
ugccgcgcccagcgccg

SEQ ID NO: 3626491 - RNA, 16 nt, Salmonella enterica enterica serovar Typhi
ugccgcugcuggcguu

SEQ ID NO: 3626492 - RNA, 17 nt, Salmonella enterica enterica serovar Typhi
ugccgcuggcguauucg

SEQ ID NO: 3626493 - RNA, 22 nt, Salmonella enterica enterica serovar Typhi
ugccgcuggugcuacgggcgcu

SEQ ID NO: 3626494 - RNA, 16 nt, Salmonella enterica enterica serovar Typhi
ugccgcuuauccggcc

SEQ ID NO: 3626495 - RNA, 20 nt, Salmonella enterica enterica serovar Typhi
ugccgcuuuugccgcgacuu

SEQ ID NO: 3626496 - RNA, 20 nt, Salmonella enterica enterica serovar Typhi
ugccggaaaucgcggcgaug

SEQ ID NO: 3626497 - RNA, 16 nt, Salmonella enterica enterica serovar Typhi
ugccggaacucagcua

SEQ ID NO: 3626498 - RNA, 14 nt, Salmonella enterica enterica serovar Typhi
ugccggaagcgauu

SEQ ID NO: 3626499 - RNA, 13 nt, Salmonella enterica enterica serovar Typhi
ugccggaagggau

SEQ ID NO: 3626500 - RNA, 14 nt, Salmonella enterica enterica serovar Typhi
ugccggacgccacc

SEQ ID NO: 3626501 - RNA, 14 nt, Salmonella enterica enterica serovar Typhi
ugccggacgcggcu

SEQ ID NO: 3626502 - RNA, 20 nt, Salmonella enterica enterica serovar Typhi
ugccggaucaggcguugugc

SEQ ID NO: 3626503 - RNA, 13 nt, Salmonella enterica enterica serovar Typhi
ugccggauggcac

SEQ ID NO: 3626504 - RNA, 16 nt, Salmonella enterica enterica serovar Typhi
ugccggauggcggcuu

SEQ ID NO: 3626505 - RNA, 23 nt, Salmonella enterica enterica serovar Typhi
ugccggauggcgguauaacugcc

SEQ ID NO: 3626506 - RNA, 13 nt, Salmonella enterica enterica serovar Typhi
ugccggauggcgu

SEQ ID NO: 3626507 - RNA, 15 nt, Salmonella enterica enterica serovar Typhi
ugccggcgaccaugc

SEQ ID NO: 3626508 - RNA, 13 nt, Salmonella enterica enterica serovar Typhi
ugccggcuuacca

SEQ ID NO: 3626509 - RNA, 17 nt, Salmonella enterica enterica serovar Typhi
ugccggcuuuccgcacc

SEQ ID NO: 3626510 - RNA, 13 nt, Salmonella enterica enterica serovar Typhi
ugccgggaaaacg

SEQ ID NO: 3626511 - RNA, 16 nt, Salmonella enterica enterica serovar Typhi
ugccgggaaaacggcc

SEQ ID NO: 3626512 - RNA, 15 nt, Salmonella enterica enterica serovar Typhi
ugccgggcaaaaaac

SEQ ID NO: 3626513 - RNA, 12 nt, Salmonella enterica enterica serovar Typhi
ugccgggcgcug

SEQ ID NO: 3626514 - RNA, 13 nt, Salmonella enterica enterica serovar Typhi
ugccggucggcgu

SEQ ID NO: 3626515 - RNA, 17 nt, Salmonella enterica enterica serovar Typhi
ugccggugcgagaaaaa

SEQ ID NO: 3626516 - RNA, 18 nt, Salmonella enterica enterica serovar Typhi
ugccggugcgagaaaaag

SEQ ID NO: 3626517 - RNA, 14 nt, Salmonella enterica enterica serovar Typhi
ugccggugguggug

SEQ ID NO: 3626518 - RNA, 19 nt, Salmonella enterica enterica serovar Typhi
ugccgguuuuagcaaugau

SEQ ID NO: 3626519 - RNA, 22 nt, Salmonella enterica enterica serovar Typhi
ugccguaaauugaguggacauc

SEQ ID NO: 3626520 - RNA, 17 nt, Salmonella enterica enterica serovar Typhi
ugccguagaacagcaug

SEQ ID NO: 3626521 - RNA, 14 nt, Salmonella enterica enterica serovar Typhi
ugccguaggcaacg

SEQ ID NO: 3626522 - RNA, 18 nt, Salmonella enterica enterica serovar Typhi
ugccguaggcaacgaccc

SEQ ID NO: 3626523 - RNA, 18 nt, Salmonella enterica enterica serovar Typhi
ugccguaggcgacgccaa

SEQ ID NO: 3626524 - RNA, 17 nt, Salmonella enterica enterica serovar Typhi
ugccguauaauccagcu

SEQ ID NO: 3626525 - RNA, 21 nt, Salmonella enterica enterica serovar Typhi
ugccgucaaacaagccgccaa

SEQ ID NO: 3626526 - RNA, 20 nt, Salmonella enterica enterica serovar Typhi
ugccgucaacacgcagaccc

SEQ ID NO: 3626527 - RNA, 15 nt, Salmonella enterica enterica serovar Typhi
ugccgucauccagca

SEQ ID NO: 3626528 - RNA, 20 nt, Salmonella enterica enterica serovar Typhi
ugccguccauccggcguaau

SEQ ID NO: 3626529 - RNA, 20 nt, Salmonella enterica enterica serovar Typhi
ugccgucgaugucgccgccg

SEQ ID NO: 3626530 - RNA, 21 nt, Salmonella enterica enterica serovar Typhi
ugccgucgccggaaugcgaau

SEQ ID NO: 3626531 - RNA, 13 nt, Salmonella enterica enterica serovar Typhi
ugccgucguacuc

SEQ ID NO: 3626532 - RNA, 20 nt, Salmonella enterica enterica serovar Typhi
ugccgucguacucaccaguc

SEQ ID NO: 3626533 - RNA, 16 nt, Salmonella enterica enterica serovar Typhi
ugccgugaaaacgaau

SEQ ID NO: 3626534 - RNA, 18 nt, Salmonella enterica enterica serovar Typhi
ugccgugaauauucagau

SEQ ID NO: 3626535 - RNA, 16 nt, Salmonella enterica enterica serovar Typhi
ugccgugaggcugaag

SEQ ID NO: 3626536 - RNA, 18 nt, Salmonella enterica enterica serovar Typhi
ugccgugcauguccagac

SEQ ID NO: 3626537 - RNA, 22 nt, Salmonella enterica enterica serovar Typhi
ugccgugcgccgacaucgccac

SEQ ID NO: 3626538 - RNA, 14 nt, Salmonella enterica enterica serovar Typhi
ugccguuaacugcu

SEQ ID NO: 3626539 - RNA, 14 nt, Salmonella enterica enterica serovar Typhi
ugccguuggcgcga

SEQ ID NO: 3626540 - RNA, 18 nt, Salmonella enterica enterica serovar Typhi
ugccguuguugucaauau

SEQ ID NO: 3626541 - RNA, 12 nt, Salmonella enterica enterica serovar Typhi
ugccguuuucaa

SEQ ID NO: 3626542 - RNA, 14 nt, Salmonella enterica enterica serovar Typhi
ugccuaaaccgaca

SEQ ID NO: 3626543 - RNA, 17 nt, Salmonella enterica enterica serovar Typhi
ugccuaaaccuucgcuu

SEQ ID NO: 3626544 - RNA, 14 nt, Salmonella enterica enterica serovar Typhi
ugccuaaagaaaaa

SEQ ID NO: 3626545 - RNA, 15 nt, Salmonella enterica enterica serovar Typhi
ugccuaaagaaaaac

SEQ ID NO: 3626546 - RNA, 18 nt, Salmonella enterica enterica serovar Typhi
ugccuaagauggcgccuu

SEQ ID NO: 3626547 - RNA, 19 nt, Salmonella enterica enterica serovar Typhi
ugccucaacaaguccuucu

SEQ ID NO: 3626548 - RNA, 17 nt, Salmonella enterica enterica serovar Typhi
ugccucccguuucagug

SEQ ID NO: 3626549 - RNA, 18 nt, Salmonella enterica enterica serovar Typhi
ugccucgcgcaccauaau

SEQ ID NO: 3626550 - RNA, 20 nt, Salmonella enterica enterica serovar Typhi
ugccucggguggcaucugau

SEQ ID NO: 3626551 - RNA, 18 nt, Salmonella enterica enterica serovar Typhi
ugccucuggccaguuuca

SEQ ID NO: 3626552 - RNA, 23 nt, Salmonella enterica enterica serovar Typhi
ugccugaaggcgcuaugcuuacc

SEQ ID NO: 3626553 - RNA, 21 nt, Salmonella enterica enterica serovar Typhi
ugccugaguucuccgcugacg

SEQ ID NO: 3626554 - RNA, 20 nt, Salmonella enterica enterica serovar Typhi
ugccugauggcguagcgcca

SEQ ID NO: 3626555 - RNA, 14 nt, Salmonella enterica enterica serovar Typhi
ugccugccgccucc

SEQ ID NO: 3626556 - RNA, 15 nt, Salmonella enterica enterica serovar Typhi
ugccugccgccucca

SEQ ID NO: 3626557 - RNA, 15 nt, Salmonella enterica enterica serovar Typhi
ugccugcgccauguu

SEQ ID NO: 3626558 - RNA, 22 nt, Salmonella enterica enterica serovar Typhi
ugccugcgcuuacggccaugga

SEQ ID NO: 3626559 - RNA, 14 nt, Salmonella enterica enterica serovar Typhi
ugccugcuccgcca

SEQ ID NO: 3626560 - RNA, 20 nt, Salmonella enterica enterica serovar Typhi
ugccugcugcggauaacguu

SEQ ID NO: 3626561 - RNA, 21 nt, Salmonella enterica enterica serovar Typhi
ugccuggcaacaugaccagcg

SEQ ID NO: 3626562 - RNA, 22 nt, Salmonella enterica enterica serovar Typhi
ugccuggcaacaugaccagcgc

SEQ ID NO: 3626563 - RNA, 15 nt, Salmonella enterica enterica serovar Typhi
ugccuggccuccggc

SEQ ID NO: 3626564 - RNA, 15 nt, Salmonella enterica enterica serovar Typhi
ugccuggcucauucu

SEQ ID NO: 3626565 - RNA, 16 nt, Salmonella enterica enterica serovar Typhi
ugccuggguuccaggc

SEQ ID NO: 3626566 - RNA, 13 nt, Salmonella enterica enterica serovar Typhi
ugccugucacgca

SEQ ID NO: 3626567 - RNA, 13 nt, Salmonella enterica enterica serovar Typhi
ugccuguccggag

SEQ ID NO: 3626568 - RNA, 15 nt, Salmonella enterica enterica serovar Typhi
ugccuucaaauauau

SEQ ID NO: 3626569 - RNA, 16 nt, Salmonella enterica enterica serovar Typhi
ugccuucauccgcacg

SEQ ID NO: 3626570 - RNA, 21 nt, Salmonella enterica enterica serovar Typhi
ugccuuccacggcgaucacuu

SEQ ID NO: 3626571 - RNA, 18 nt, Salmonella enterica enterica serovar Typhi
ugccuucgccgccgcuga

SEQ ID NO: 3626572 - RNA, 15 nt, Salmonella enterica enterica serovar Typhi
ugccuucugaaaguu

SEQ ID NO: 3626573 - RNA, 18 nt, Salmonella enterica enterica serovar Typhi
ugccuuuaacaaauuaaa

SEQ ID NO: 3626574 - RNA, 14 nt, Salmonella enterica enterica serovar Typhi
ugccuuuacuguug

SEQ ID NO: 3626575 - RNA, 16 nt, Salmonella enterica enterica serovar Typhi
ugccuuuauuucaagc

SEQ ID NO: 3626576 - RNA, 22 nt, Salmonella enterica enterica serovar Typhi
ugccuuuuacaauaaccggcag

SEQ ID NO: 3626577 - RNA, 23 nt, Salmonella enterica enterica serovar Typhi
ugccuuuuugcagcgcggccagc

SEQ ID NO: 3626578 - RNA, 20 nt, Salmonella enterica enterica serovar Typhi
ugccuuuuuuaauuccggag

SEQ ID NO: 3626579 - RNA, 14 nt, Salmonella enterica enterica serovar Typhi
ugcgaaagccucuu

SEQ ID NO: 3626580 - RNA, 20 nt, Salmonella enterica enterica serovar Typhi
ugcgaacagcgcuccacgcg

SEQ ID NO: 3626581 - RNA, 15 nt, Salmonella enterica enterica serovar Typhi
ugcgaagaccgcauc

SEQ ID NO: 3626582 - RNA, 15 nt, Salmonella enterica enterica serovar Typhi
ugcgaauaaacacau

SEQ ID NO: 3626583 - RNA, 16 nt, Salmonella enterica enterica serovar Typhi
ugcgaauaaacacaua

SEQ ID NO: 3626584 - RNA, 16 nt, Salmonella enterica enterica serovar Typhi
ugcgaauaacaucauc

SEQ ID NO: 3626585 - RNA, 18 nt, Salmonella enterica enterica serovar Typhi
ugcgaauaacaucauccg

SEQ ID NO: 3626586 - RNA, 22 nt, Salmonella enterica enterica serovar Typhi
ugcgaauaacaucauccggcug

SEQ ID NO: 3626587 - RNA, 14 nt, Salmonella enterica enterica serovar Typhi
ugcgaaucuucauc

SEQ ID NO: 3626588 - RNA, 22 nt, Salmonella enterica enterica serovar Typhi
ugcgacaacaaguccaaguaug

SEQ ID NO: 3626589 - RNA, 14 nt, Salmonella enterica enterica serovar Typhi
ugcgacaagcucau

SEQ ID NO: 3626590 - RNA, 15 nt, Salmonella enterica enterica serovar Typhi
ugcgacaucagccag

SEQ ID NO: 3626591 - RNA, 21 nt, Salmonella enterica enterica serovar Typhi
ugcgacaucagccagccgcca

SEQ ID NO: 3626592 - RNA, 21 nt, Salmonella enterica enterica serovar Typhi
ugcgaccacggguagagcuuu

SEQ ID NO: 3626593 - RNA, 13 nt, Salmonella enterica enterica serovar Typhi
ugcgacgccagau

SEQ ID NO: 3626594 - RNA, 14 nt, Salmonella enterica enterica serovar Typhi
ugcgacgccaggcg

SEQ ID NO: 3626595 - RNA, 20 nt, Salmonella enterica enterica serovar Typhi
ugcgacgccaggcgccacga

SEQ ID NO: 3626596 - RNA, 11 nt, Salmonella enterica enterica serovar Typhi
ugcgagaaaaa

SEQ ID NO: 3626597 - RNA, 18 nt, Salmonella enterica enterica serovar Typhi
ugcgagcaguucagcagc

SEQ ID NO: 3626598 - RNA, 17 nt, Salmonella enterica enterica serovar Typhi
ugcgagcuuuccaccag

SEQ ID NO: 3626599 - RNA, 23 nt, Salmonella enterica enterica serovar Typhi
ugcgaggcgcgcucauuuuauug

SEQ ID NO: 3626600 - RNA, 15 nt, Salmonella enterica enterica serovar Typhi
ugcgaggggccaaaa

SEQ ID NO: 3626601 - RNA, 16 nt, Salmonella enterica enterica serovar Typhi
ugcgaggggccaaaac

SEQ ID NO: 3626602 - RNA, 17 nt, Salmonella enterica enterica serovar Typhi
ugcgaggucaccgggcg

SEQ ID NO: 3626603 - RNA, 18 nt, Salmonella enterica enterica serovar Typhi
ugcgagucgucaguucca

SEQ ID NO: 3626604 - RNA, 16 nt, Salmonella enterica enterica serovar Typhi
ugcgauagcccggcau

SEQ ID NO: 3626605 - RNA, 23 nt, Salmonella enterica enterica serovar Typhi
ugcgaucguaaucacccgcuucc

SEQ ID NO: 3626606 - RNA, 19 nt, Salmonella enterica enterica serovar Typhi
ugcgaucucauaccaggug

SEQ ID NO: 3626607 - RNA, 19 nt, Salmonella enterica enterica serovar Typhi
ugcgaucuccuuuaaugaa

SEQ ID NO: 3626608 - RNA, 19 nt, Salmonella enterica enterica serovar Typhi
ugcgaucugugucguccag

SEQ ID NO: 3626609 - RNA, 21 nt, Salmonella enterica enterica serovar Typhi
ugcgaucugugucguccaggc

SEQ ID NO: 3626610 - RNA, 14 nt, Salmonella enterica enterica serovar Typhi
ugcgauggccgcug

SEQ ID NO: 3626611 - RNA, 16 nt, Salmonella enterica enterica serovar Typhi
ugcgauggccgcugac

SEQ ID NO: 3626612 - RNA, 12 nt, Salmonella enterica enterica serovar Typhi
ugcgcaaacgua

SEQ ID NO: 3626613 - RNA, 12 nt, Salmonella enterica enterica serovar Typhi
ugcgcaaaugcc

SEQ ID NO: 3626614 - RNA, 15 nt, Salmonella enterica enterica serovar Typhi
ugcgcaaccuccgcg

SEQ ID NO: 3626615 - RNA, 22 nt, Salmonella enterica enterica serovar Typhi
ugcgcaacguuucuuucaucag

SEQ ID NO: 3626616 - RNA, 14 nt, Salmonella enterica enterica serovar Typhi
ugcgcaagaaacau

SEQ ID NO: 3626617 - RNA, 21 nt, Salmonella enterica enterica serovar Typhi
ugcgcaagcacugaaugcuga

SEQ ID NO: 3626618 - RNA, 15 nt, Salmonella enterica enterica serovar Typhi
ugcgcaauuccagca

SEQ ID NO: 3626619 - RNA, 15 nt, Salmonella enterica enterica serovar Typhi
ugcgcacgccagcgg

SEQ ID NO: 3626620 - RNA, 12 nt, Salmonella enterica enterica serovar Typhi
ugcgcacucaga

SEQ ID NO: 3626621 - RNA, 12 nt, Salmonella enterica enterica serovar Typhi
ugcgcagccagu

SEQ ID NO: 3626622 - RNA, 21 nt, Salmonella enterica enterica serovar Typhi
ugcgcagccccagcgccagcc

SEQ ID NO: 3626623 - RNA, 18 nt, Salmonella enterica enterica serovar Typhi
ugcgcagcguuuccagac

SEQ ID NO: 3626624 - RNA, 20 nt, Salmonella enterica enterica serovar Typhi
ugcgcaguuuaaaucacagg

SEQ ID NO: 3626625 - RNA, 16 nt, Salmonella enterica enterica serovar Typhi
ugcgcaucaccguuac

SEQ ID NO: 3626626 - RNA, 21 nt, Salmonella enterica enterica serovar Typhi
ugcgcauccgcggcgcuuugc

SEQ ID NO: 3626627 - RNA, 22 nt, Salmonella enterica enterica serovar Typhi
ugcgcaucgcuacacgcguaaa

SEQ ID NO: 3626628 - RNA, 14 nt, Salmonella enterica enterica serovar Typhi
ugcgccaaaucggu

SEQ ID NO: 3626629 - RNA, 20 nt, Salmonella enterica enterica serovar Typhi
ugcgccaacgaagagaccug

SEQ ID NO: 3626630 - RNA, 19 nt, Salmonella enterica enterica serovar Typhi
ugcgccaacugcauuucau

SEQ ID NO: 3626631 - RNA, 13 nt, Salmonella enterica enterica serovar Typhi
ugcgccaccagcg

SEQ ID NO: 3626632 - RNA, 20 nt, Salmonella enterica enterica serovar Typhi
ugcgccaccagcgcaguaaa

SEQ ID NO: 3626633 - RNA, 11 nt, Salmonella enterica enterica serovar Typhi
ugcgccacgac

SEQ ID NO: 3626634 - RNA, 23 nt, Salmonella enterica enterica serovar Typhi
ugcgccacgacuaucgucacccu

SEQ ID NO: 3626635 - RNA, 22 nt, Salmonella enterica enterica serovar Typhi
ugauccacagguuaucgccgcc

SEQ ID NO: 3626636 - RNA, 12 nt, Salmonella enterica enterica serovar Typhi
ugaucccaaugu

SEQ ID NO: 3626637 - RNA, 11 nt, Salmonella enterica enterica serovar Typhi
ugaucccacca

SEQ ID NO: 3626638 - RNA, 12 nt, Salmonella enterica enterica serovar Typhi
ugaucccaccag

SEQ ID NO: 3626639 - RNA, 14 nt, Salmonella enterica enterica serovar Typhi
ugauccgaugcgcu

SEQ ID NO: 3626640 - RNA, 23 nt, Salmonella enterica enterica serovar Typhi
ugauccgcccccuccaguagcag

SEQ ID NO: 3626641 - RNA, 20 nt, Salmonella enterica enterica serovar Typhi
ugauccguucgaucagcugg

SEQ ID NO: 3626642 - RNA, 22 nt, Salmonella enterica enterica serovar Typhi
ugauccugcaacagcaccagca

SEQ ID NO: 3626643 - RNA, 14 nt, Salmonella enterica enterica serovar Typhi
ugaucgaaaaugcg

SEQ ID NO: 3626644 - RNA, 16 nt, Salmonella enterica enterica serovar Typhi
ugaucgaauucauuac

SEQ ID NO: 3626645 - RNA, 22 nt, Salmonella enterica enterica serovar Typhi
ugaucgaggucgccaaauuuag

SEQ ID NO: 3626646 - RNA, 17 nt, Salmonella enterica enterica serovar Typhi
ugaucgauccgcaucag

SEQ ID NO: 3626647 - RNA, 20 nt, Salmonella enterica enterica serovar Typhi
ugaucgcgagaguaagccca

SEQ ID NO: 3626648 - RNA, 13 nt, Salmonella enterica enterica serovar Typhi
ugaucgcgcagac

SEQ ID NO: 3626649 - RNA, 23 nt, Salmonella enterica enterica serovar Typhi
ugaucgcggucgcguuauagccg

SEQ ID NO: 3626650 - RNA, 17 nt, Salmonella enterica enterica serovar Typhi
ugaucgcuggugcccgg

SEQ ID NO: 3626651 - RNA, 12 nt, Salmonella enterica enterica serovar Typhi
ugaucggcuggc

SEQ ID NO: 3626652 - RNA, 13 nt, Salmonella enterica enterica serovar Typhi
ugaucggcuggcg

SEQ ID NO: 3626653 - RNA, 18 nt, Salmonella enterica enterica serovar Typhi
ugaucggguuuuccugaa

SEQ ID NO: 3626654 - RNA, 17 nt, Salmonella enterica enterica serovar Typhi
ugaucguaggcggcgga

SEQ ID NO: 3626655 - RNA, 17 nt, Salmonella enterica enterica serovar Typhi
ugaucgucgcgaucgcg

SEQ ID NO: 3626656 - RNA, 23 nt, Salmonella enterica enterica serovar Typhi
ugaucgugccaugaccauucaca

SEQ ID NO: 3626657 - RNA, 15 nt, Salmonella enterica enterica serovar Typhi
ugaucguuucauuuu

SEQ ID NO: 3626658 - RNA, 16 nt, Salmonella enterica enterica serovar Typhi
ugaucucuugcauaau

SEQ ID NO: 3626659 - RNA, 13 nt, Salmonella enterica enterica serovar Typhi
ugaucuggccaau

SEQ ID NO: 3626660 - RNA, 19 nt, Salmonella enterica enterica serovar Typhi
ugaucuggccaauuuuuca

SEQ ID NO: 3626661 - RNA, 20 nt, Salmonella enterica enterica serovar Typhi
ugaucuggccaauuuuucac

SEQ ID NO: 3626662 - RNA, 19 nt, Salmonella enterica enterica serovar Typhi
ugaucuuaccucuccugaa

SEQ ID NO: 3626663 - RNA, 18 nt, Salmonella enterica enterica serovar Typhi
ugaucuucaaccucuaua

SEQ ID NO: 3626664 - RNA, 22 nt, Salmonella enterica enterica serovar Typhi
ugaucuucaaccucuauaacuu

SEQ ID NO: 3626665 - RNA, 20 nt, Salmonella enterica enterica serovar Typhi
ugaucuucauaaauagccag

SEQ ID NO: 3626666 - RNA, 12 nt, Salmonella enterica enterica serovar Typhi
ugaucuuucugg

SEQ ID NO: 3626667 - RNA, 17 nt, Salmonella enterica enterica serovar Typhi
ugaugagcaggccaggg

SEQ ID NO: 3626668 - RNA, 13 nt, Salmonella enterica enterica serovar Typhi
ugaugaucuucag

SEQ ID NO: 3626669 - RNA, 13 nt, Salmonella enterica enterica serovar Typhi
ugaugaugccagg

SEQ ID NO: 3626670 - RNA, 22 nt, Salmonella enterica enterica serovar Typhi
ugaugccccagaacaacgggaa

SEQ ID NO: 3626671 - RNA, 21 nt, Salmonella enterica enterica serovar Typhi
ugaugcccucuuccagcgcca

SEQ ID NO: 3626672 - RNA, 18 nt, Salmonella enterica enterica serovar Typhi
ugaugcgccugucuccag

SEQ ID NO: 3626673 - RNA, 18 nt, Salmonella enterica enterica serovar Typhi
ugaugcgcggaauagcgg

SEQ ID NO: 3626674 - RNA, 18 nt, Salmonella enterica enterica serovar Typhi
ugaugcguuuguuggaga

SEQ ID NO: 3626675 - RNA, 20 nt, Salmonella enterica enterica serovar Typhi
ugaugcuguaggccggguaa

SEQ ID NO: 3626676 - RNA, 19 nt, Salmonella enterica enterica serovar Typhi
ugauggagguuguuuuauu

SEQ ID NO: 3626677 - RNA, 15 nt, Salmonella enterica enterica serovar Typhi
ugauggccacaucgu

SEQ ID NO: 3626678 - RNA, 14 nt, Salmonella enterica enterica serovar Typhi
ugauggccuggcgg

SEQ ID NO: 3626679 - RNA, 13 nt, Salmonella enterica enterica serovar Typhi
ugauggccuuugu

SEQ ID NO: 3626680 - RNA, 17 nt, Salmonella enterica enterica serovar Typhi
ugauggcgaacagcccc

SEQ ID NO: 3626681 - RNA, 20 nt, Salmonella enterica enterica serovar Typhi
ugauggcgcgacgcuuauca

SEQ ID NO: 3626682 - RNA, 13 nt, Salmonella enterica enterica serovar Typhi
ugauggcgcgcca

SEQ ID NO: 3626683 - RNA, 18 nt, Salmonella enterica enterica serovar Typhi
ugauggcgcuaagccagc

SEQ ID NO: 3626684 - RNA, 20 nt, Salmonella enterica enterica serovar Typhi
ugauggcgcuacgcuuauca

SEQ ID NO: 3626685 - RNA, 21 nt, Salmonella enterica enterica serovar Typhi
ugauggcuggcgucgccaaag

SEQ ID NO: 3626686 - RNA, 21 nt, Salmonella enterica enterica serovar Typhi
ugauguagcuugaaagcgcaa

SEQ ID NO: 3626687 - RNA, 14 nt, Salmonella enterica enterica serovar Typhi
ugauguccagcgcg

SEQ ID NO: 3626688 - RNA, 13 nt, Salmonella enterica enterica serovar Typhi
ugaugugauggug

SEQ ID NO: 3626689 - RNA, 17 nt, Salmonella enterica enterica serovar Typhi
ugauguguuucagcagc

SEQ ID NO: 3626690 - RNA, 17 nt, Salmonella enterica enterica serovar Typhi
ugauguuuuuaaaagaa

SEQ ID NO: 3626691 - RNA, 18 nt, Salmonella enterica enterica serovar Typhi
ugauguuuuuaaaagaag

SEQ ID NO: 3626692 - RNA, 17 nt, Salmonella enterica enterica serovar Typhi
ugauuaaaagucaacug

SEQ ID NO: 3626693 - RNA, 16 nt, Salmonella enterica enterica serovar Typhi
ugauuaaaauaaauga

SEQ ID NO: 3626694 - RNA, 19 nt, Salmonella enterica enterica serovar Typhi
ugauuaaguuuuuuuaaaa

SEQ ID NO: 3626695 - RNA, 17 nt, Salmonella enterica enterica serovar Typhi
ugauuaauccgcggaua

SEQ ID NO: 3626696 - RNA, 15 nt, Salmonella enterica enterica serovar Typhi
ugauuacaaagggca

SEQ ID NO: 3626697 - RNA, 14 nt, Salmonella enterica enterica serovar Typhi
ugauuacagccggu

SEQ ID NO: 3626698 - RNA, 20 nt, Salmonella enterica enterica serovar Typhi
ugauuacggaacaaaacgga

SEQ ID NO: 3626699 - RNA, 21 nt, Salmonella enterica enterica serovar Typhi
ugauuacggaacaaaacggaa

SEQ ID NO: 3626700 - RNA, 22 nt, Salmonella enterica enterica serovar Typhi
ugauuacguuuucccugagcgc

SEQ ID NO: 3626701 - RNA, 20 nt, Salmonella enterica enterica serovar Typhi
ugauuagaaacccauauucc

SEQ ID NO: 3626702 - RNA, 19 nt, Salmonella enterica enterica serovar Typhi
ugauuaucacccacaggag

SEQ ID NO: 3626703 - RNA, 21 nt, Salmonella enterica enterica serovar Typhi
ugauuaucacccacaggagcc

SEQ ID NO: 3626704 - RNA, 18 nt, Salmonella enterica enterica serovar Typhi
ugauuauuguuaaaaaga

SEQ ID NO: 3626705 - RNA, 19 nt, Salmonella enterica enterica serovar Typhi
ugauucauucccauacugc

SEQ ID NO: 3626706 - RNA, 21 nt, Salmonella enterica enterica serovar Typhi
ugauucguuuaaguaagguaa

SEQ ID NO: 3626707 - RNA, 20 nt, Salmonella enterica enterica serovar Typhi
ugauugacuaucagccgcga

SEQ ID NO: 3626708 - RNA, 13 nt, Salmonella enterica enterica serovar Typhi
ugauugauuuugu

SEQ ID NO: 3626709 - RNA, 22 nt, Salmonella enterica enterica serovar Typhi
ugauugcauaucgcuaaaccaa

SEQ ID NO: 3626710 - RNA, 17 nt, Salmonella enterica enterica serovar Typhi
ugauugccggaugacgc

SEQ ID NO: 3626711 - RNA, 15 nt, Salmonella enterica enterica serovar Typhi
ugauugcgacaggcu

SEQ ID NO: 3626712 - RNA, 16 nt, Salmonella enterica enterica serovar Typhi
ugauugcgacaggcug

SEQ ID NO: 3626713 - RNA, 22 nt, Salmonella enterica enterica serovar Typhi
ugauugcuggcagaugaacaua

SEQ ID NO: 3626714 - RNA, 20 nt, Salmonella enterica enterica serovar Typhi
ugauuuaaaaaaggccgcuu

SEQ ID NO: 3626715 - RNA, 17 nt, Salmonella enterica enterica serovar Typhi
ugauuuacuccaaaaau

SEQ ID NO: 3626716 - RNA, 20 nt, Salmonella enterica enterica serovar Typhi
ugauuucaggugcuuaucug

SEQ ID NO: 3626717 - RNA, 19 nt, Salmonella enterica enterica serovar Typhi
ugauuucgacgauaaaaaa

SEQ ID NO: 3626718 - RNA, 20 nt, Salmonella enterica enterica serovar Typhi
ugauuucgccccacuggccc

SEQ ID NO: 3626719 - RNA, 17 nt, Salmonella enterica enterica serovar Typhi
ugauuuguuuuuuauau

SEQ ID NO: 3626720 - RNA, 19 nt, Salmonella enterica enterica serovar Typhi
ugauuuguuuuuuauauuu

SEQ ID NO: 3626721 - RNA, 16 nt, Salmonella enterica enterica serovar Typhi
ugauuuuacuaaugaa

SEQ ID NO: 3626722 - RNA, 13 nt, Salmonella enterica enterica serovar Typhi
ugauuuucuuauu

SEQ ID NO: 3626723 - RNA, 23 nt, Salmonella enterica enterica serovar Typhi
ugauuuuuaccgccgguuuaucc

SEQ ID NO: 3626724 - RNA, 13 nt, Salmonella enterica enterica serovar Typhi
ugcaaaagaaaaa

SEQ ID NO: 3626725 - RNA, 14 nt, Salmonella enterica enterica serovar Typhi
ugcaaaagaaaaaa

SEQ ID NO: 3626726 - RNA, 16 nt, Salmonella enterica enterica serovar Typhi
ugcaaaauuuguggug

SEQ ID NO: 3626727 - RNA, 20 nt, Salmonella enterica enterica serovar Typhi
ugcaaaccggguaacaacau

SEQ ID NO: 3626728 - RNA, 21 nt, Salmonella enterica enterica serovar Typhi
ugcaaaccggguaacaacauu

SEQ ID NO: 3626729 - RNA, 11 nt, Salmonella enterica enterica serovar Typhi
ugcaaacguag

SEQ ID NO: 3626730 - RNA, 16 nt, Salmonella enterica enterica serovar Typhi
ugcaaaguuauuacau

SEQ ID NO: 3626731 - RNA, 17 nt, Salmonella enterica enterica serovar Typhi
ugcaaauaccacaucag

SEQ ID NO: 3626732 - RNA, 20 nt, Salmonella enterica enterica serovar Typhi
ugcaaauacugcuuuuccgg

SEQ ID NO: 3626733 - RNA, 14 nt, Salmonella enterica enterica serovar Typhi
ugcaaaucaccaca

SEQ ID NO: 3626734 - RNA, 21 nt, Salmonella enterica enterica serovar Typhi
ugcaaauccaucucaggccga

SEQ ID NO: 3626735 - RNA, 16 nt, Salmonella enterica enterica serovar Typhi
ugcaaaucugccguca

SEQ ID NO: 3626736 - RNA, 14 nt, Salmonella enterica enterica serovar Typhi
ugcaaaugucagau

SEQ ID NO: 3626737 - RNA, 22 nt, Salmonella enterica enterica serovar Typhi
ugcaacagaagaguuaacuucu

SEQ ID NO: 3626738 - RNA, 13 nt, Salmonella enterica enterica serovar Typhi
ugcaacagcacca

SEQ ID NO: 3626739 - RNA, 19 nt, Salmonella enterica enterica serovar Typhi
ugcaacagcaccagcaggu

SEQ ID NO: 3626740 - RNA, 24 nt, Salmonella enterica enterica serovar Typhi
ugcaacaucuuaccggugcgauuc

SEQ ID NO: 3626741 - RNA, 16 nt, Salmonella enterica enterica serovar Typhi
ugcaacaugcccaguu

SEQ ID NO: 3626742 - RNA, 15 nt, Salmonella enterica enterica serovar Typhi
ugcaacauuccuugc

SEQ ID NO: 3626743 - RNA, 20 nt, Salmonella enterica enterica serovar Typhi
ugcaacauugcaggucugga

SEQ ID NO: 3626744 - RNA, 14 nt, Salmonella enterica enterica serovar Typhi
ugcaaccccuugcg

SEQ ID NO: 3626745 - RNA, 19 nt, Salmonella enterica enterica serovar Typhi
ugcaaccccuugcggugca

SEQ ID NO: 3626746 - RNA, 17 nt, Salmonella enterica enterica serovar Typhi
ugcaaccgcucuuuugc

SEQ ID NO: 3626747 - RNA, 21 nt, Salmonella enterica enterica serovar Typhi
ugcaacgaucccuaauaaaau

SEQ ID NO: 3626748 - RNA, 16 nt, Salmonella enterica enterica serovar Typhi
ugcaacuauuaauucu

SEQ ID NO: 3626749 - RNA, 15 nt, Salmonella enterica enterica serovar Typhi
ugcaacuccacaaau

SEQ ID NO: 3626750 - RNA, 17 nt, Salmonella enterica enterica serovar Typhi
ugcaacugcgcggcaau

SEQ ID NO: 3626751 - RNA, 20 nt, Salmonella enterica enterica serovar Typhi
ugcaagaaauguccauaaau

SEQ ID NO: 3626752 - RNA, 17 nt, Salmonella enterica enterica serovar Typhi
ugcaagaacgggcugcg

SEQ ID NO: 3626753 - RNA, 19 nt, Salmonella enterica enterica serovar Typhi
ugcaaguugcaagucacca

SEQ ID NO: 3626754 - RNA, 20 nt, Salmonella enterica enterica serovar Typhi
ugcaauaccgggauuguaua

SEQ ID NO: 3626755 - RNA, 15 nt, Salmonella enterica enterica serovar Typhi
ugcaauagcgcgucg

SEQ ID NO: 3626756 - RNA, 20 nt, Salmonella enterica enterica serovar Typhi
ugcaaucagcgaaggcaacu

SEQ ID NO: 3626757 - RNA, 16 nt, Salmonella enterica enterica serovar Typhi
ugcaauguucaauauc

SEQ ID NO: 3626758 - RNA, 21 nt, Salmonella enterica enterica serovar Typhi
ugcaauguucaauaucaaauu

SEQ ID NO: 3626759 - RNA, 19 nt, Salmonella enterica enterica serovar Typhi
ugcaauuccggcgaaaaac

SEQ ID NO: 3626760 - RNA, 20 nt, Salmonella enterica enterica serovar Typhi
ugcaauuccggcgaaaaacc

SEQ ID NO: 3626761 - RNA, 17 nt, Salmonella enterica enterica serovar Typhi
ugcaauucggcggcaau

SEQ ID NO: 3626762 - RNA, 20 nt, Salmonella enterica enterica serovar Typhi
ugcaauuguuccugcgucgg

SEQ ID NO: 3626763 - RNA, 13 nt, Salmonella enterica enterica serovar Typhi
ugcacaaaauacu

SEQ ID NO: 3626764 - RNA, 24 nt, Salmonella enterica enterica serovar Typhi
ugcacaacacgcuuuucagcgcca

SEQ ID NO: 3626765 - RNA, 22 nt, Salmonella enterica enterica serovar Typhi
ugcacaacauuccgcuuccaga

SEQ ID NO: 3626766 - RNA, 16 nt, Salmonella enterica enterica serovar Typhi
ugcacaauaccaauaa

SEQ ID NO: 3626767 - RNA, 18 nt, Salmonella enterica enterica serovar Typhi
ugcacagucugcagaccu

SEQ ID NO: 3626768 - RNA, 20 nt, Salmonella enterica enterica serovar Typhi
ugcaccaacgauaaauuuuc

SEQ ID NO: 3626769 - RNA, 17 nt, Salmonella enterica enterica serovar Typhi
ugcaccacuuuguuuuu

SEQ ID NO: 3626770 - RNA, 16 nt, Salmonella enterica enterica serovar Typhi
ugcaccaucucuuacu

SEQ ID NO: 3626771 - RNA, 16 nt, Salmonella enterica enterica serovar Typhi
ugcacccgccuuaccc

SEQ ID NO: 3626772 - RNA, 17 nt, Salmonella enterica enterica serovar Typhi
ugcacccggagagaaac

SEQ ID NO: 3626773 - RNA, 20 nt, Salmonella enterica enterica serovar Typhi
ugcacgcacgacagugcuau

SEQ ID NO: 3626774 - RNA, 17 nt, Salmonella enterica enterica serovar Typhi
ugcacgccacauugacc

SEQ ID NO: 3626775 - RNA, 15 nt, Salmonella enterica enterica serovar Typhi
ugcacgccaggguaa

SEQ ID NO: 3626776 - RNA, 20 nt, Salmonella enterica enterica serovar Typhi
ugcacgccaggguaauacug

SEQ ID NO: 3626777 - RNA, 21 nt, Salmonella enterica enterica serovar Typhi
ugcacgccaggguaauacugg

SEQ ID NO: 3626778 - RNA, 16 nt, Salmonella enterica enterica serovar Typhi
ugcacgcgauuugcag

SEQ ID NO: 3626779 - RNA, 16 nt, Salmonella enterica enterica serovar Typhi
ugcacgcgcggcgcca

SEQ ID NO: 3626780 - RNA, 16 nt, Salmonella enterica enterica serovar Typhi
ugcacgguugaagcga

SEQ ID NO: 3626781 - RNA, 16 nt, Salmonella enterica enterica serovar Typhi
ugcacuccaauauacu

SEQ ID NO: 3626782 - RNA, 14 nt, Salmonella enterica enterica serovar Typhi
ugcacugcaccugg

SEQ ID NO: 3626783 - RNA, 15 nt, Salmonella enterica enterica serovar Typhi
ugcacugcugauagu

SEQ ID NO: 3626784 - RNA, 18 nt, Salmonella enterica enterica serovar Typhi
ugcacuucaugccgaaca

SEQ ID NO: 3626785 - RNA, 16 nt, Salmonella enterica enterica serovar Typhi
ugcagaccucugcuuu

SEQ ID NO: 3626786 - RNA, 21 nt, Salmonella enterica enterica serovar Typhi
ugcagacgcucguauccgagc

SEQ ID NO: 3626787 - RNA, 18 nt, Salmonella enterica enterica serovar Typhi
ugcagacugcacuuccug

SEQ ID NO: 3626788 - RNA, 14 nt, Salmonella enterica enterica serovar Typhi
ugcagauaccagcg

SEQ ID NO: 3626789 - RNA, 15 nt, Salmonella enterica enterica serovar Typhi
ugcagaucaagcggg

SEQ ID NO: 3626790 - RNA, 22 nt, Salmonella enterica enterica serovar Typhi
ugcagaucaagcgggggcgccu

SEQ ID NO: 3626791 - RNA, 14 nt, Salmonella enterica enterica serovar Typhi
ugcagaugcucagg

SEQ ID NO: 3626792 - RNA, 18 nt, Salmonella enterica enterica serovar Typhi
ugcagauuacugagcagu

SEQ ID NO: 3626793 - RNA, 15 nt, Salmonella enterica enterica serovar Typhi
ugcagauuuugcucc

SEQ ID NO: 3626794 - RNA, 18 nt, Salmonella enterica enterica serovar Typhi
ugcagcaaauaaucguag

SEQ ID NO: 3626795 - RNA, 23 nt, Salmonella enterica enterica serovar Typhi
ugcagcaacugauucaaaaggug

SEQ ID NO: 3626796 - RNA, 11 nt, Salmonella enterica enterica serovar Typhi
ugcagcaagaa

SEQ ID NO: 3626797 - RNA, 16 nt, Salmonella enterica enterica serovar Typhi
ugcagcaagcggcugu

SEQ ID NO: 3626798 - RNA, 18 nt, Salmonella enterica enterica serovar Typhi
ugcagcauugggauggau

SEQ ID NO: 3626799 - RNA, 18 nt, Salmonella enterica enterica serovar Typhi
ugcagccauagcgcgccg

SEQ ID NO: 3626800 - RNA, 14 nt, Salmonella enterica enterica serovar Typhi
ugcagcgccaucca

SEQ ID NO: 3626801 - RNA, 17 nt, Salmonella enterica enterica serovar Typhi
ugcagcgccauccacgg

SEQ ID NO: 3626802 - RNA, 13 nt, Salmonella enterica enterica serovar Typhi
ugcagcgccgccu

SEQ ID NO: 3626803 - RNA, 16 nt, Salmonella enterica enterica serovar Typhi
ugcagcgccgccugua

SEQ ID NO: 3626804 - RNA, 21 nt, Salmonella enterica enterica serovar Typhi
ugcagcgccuggcgguaugaa

SEQ ID NO: 3626805 - RNA, 22 nt, Salmonella enterica enterica serovar Typhi
ugcagcgcguccaauagccccu

SEQ ID NO: 3626806 - RNA, 16 nt, Salmonella enterica enterica serovar Typhi
ugcagcgcuguccaga

SEQ ID NO: 3626807 - RNA, 14 nt, Salmonella enterica enterica serovar Typhi
ugcagcguuuccag

SEQ ID NO: 3626808 - RNA, 16 nt, Salmonella enterica enterica serovar Typhi
ugcagcguuuccagcc

SEQ ID NO: 3626809 - RNA, 18 nt, Salmonella enterica enterica serovar Typhi
ugcaggaaaaacuguccc

SEQ ID NO: 3626810 - RNA, 13 nt, Salmonella enterica enterica serovar Typhi
ugcaggaaggucu

SEQ ID NO: 3626811 - RNA, 20 nt, Salmonella enterica enterica serovar Typhi
ugcaggacagacagacguug

SEQ ID NO: 3626812 - RNA, 19 nt, Salmonella enterica enterica serovar Typhi
ugcaggacuuaccuugagu

SEQ ID NO: 3626813 - RNA, 17 nt, Salmonella enterica enterica serovar Typhi
ugcaggauucgaaccug

SEQ ID NO: 3626814 - RNA, 18 nt, Salmonella enterica enterica serovar Typhi
ugcaggccaagcagcgcc

SEQ ID NO: 3626815 - RNA, 14 nt, Salmonella enterica enterica serovar Typhi
ugcaggccggauaa

SEQ ID NO: 3626816 - RNA, 22 nt, Salmonella enterica enterica serovar Typhi
ugcaggccggauaaggcagcaa

SEQ ID NO: 3626817 - RNA, 17 nt, Salmonella enterica enterica serovar Typhi
ugcaggcgggaagcuuc

SEQ ID NO: 3626818 - RNA, 22 nt, Salmonella enterica enterica serovar Typhi
ugcagggacuuauuaaaaauag

SEQ ID NO: 3626819 - RNA, 15 nt, Salmonella enterica enterica serovar Typhi
ugcagguaacgacua

SEQ ID NO: 3626820 - RNA, 14 nt, Salmonella enterica enterica serovar Typhi
ugcaguacaggcau

SEQ ID NO: 3626821 - RNA, 19 nt, Salmonella enterica enterica serovar Typhi
ugcaguacaggcauuguca

SEQ ID NO: 3626822 - RNA, 19 nt, Salmonella enterica enterica serovar Typhi
ugcagucgcggaauaauca

SEQ ID NO: 3626823 - RNA, 17 nt, Salmonella enterica enterica serovar Typhi
ugcagucgguagcuuuu

SEQ ID NO: 3626824 - RNA, 17 nt, Salmonella enterica enterica serovar Typhi
ugcagugaaccaucggc

SEQ ID NO: 3626825 - RNA, 19 nt, Salmonella enterica enterica serovar Typhi
ugcagugaaccaucggcaa

SEQ ID NO: 3626826 - RNA, 14 nt, Salmonella enterica enterica serovar Typhi
ugcaguuccgcaau

SEQ ID NO: 3626827 - RNA, 14 nt, Salmonella enterica enterica serovar Typhi
ugcauaaaaaaacg

SEQ ID NO: 3626828 - RNA, 19 nt, Salmonella enterica enterica serovar Typhi
ugcauaaagauuggcaucu

SEQ ID NO: 3626829 - RNA, 23 nt, Salmonella enterica enterica serovar Typhi
ugcauaaucgccgacuaauuauu

SEQ ID NO: 3626830 - RNA, 12 nt, Salmonella enterica enterica serovar Typhi
ugcauaauggug

SEQ ID NO: 3626831 - RNA, 15 nt, Salmonella enterica enterica serovar Typhi
ugcauaauugcugac

SEQ ID NO: 3626832 - RNA, 15 nt, Salmonella enterica enterica serovar Typhi
ugcauacggaugaaa

SEQ ID NO: 3626833 - RNA, 23 nt, Salmonella enterica enterica serovar Typhi
ugcauacggaugaaauacucuuc

SEQ ID NO: 3626834 - RNA, 15 nt, Salmonella enterica enterica serovar Typhi
ugcauagccccagcg

SEQ ID NO: 3626835 - RNA, 16 nt, Salmonella enterica enterica serovar Typhi
ugcauagccccagcgc

SEQ ID NO: 3626836 - RNA, 22 nt, Salmonella enterica enterica serovar Typhi
ugcauaucgccuugcugcggca

SEQ ID NO: 3626837 - RNA, 13 nt, Salmonella enterica enterica serovar Typhi
ugcauauuguauu

SEQ ID NO: 3626838 - RNA, 16 nt, Salmonella enterica enterica serovar Typhi
ugcauauuguauuggu

SEQ ID NO: 3626839 - RNA, 22 nt, Salmonella enterica enterica serovar Typhi
ugcaucguuugcaguuccgcaa

SEQ ID NO: 3626840 - RNA, 17 nt, Salmonella enterica enterica serovar Typhi
ugcaucucuucaaacaa

SEQ ID NO: 3626841 - RNA, 19 nt, Salmonella enterica enterica serovar Typhi
ugcaucugggggaagauaa

SEQ ID NO: 3626842 - RNA, 21 nt, Salmonella enterica enterica serovar Typhi
ugcaucuuaucaggccgacaa

SEQ ID NO: 3626843 - RNA, 18 nt, Salmonella enterica enterica serovar Typhi
ugcaugcgcuggacuggg

SEQ ID NO: 3626844 - RNA, 22 nt, Salmonella enterica enterica serovar Typhi
ugcaugggauacgccagcagac

SEQ ID NO: 3626845 - RNA, 14 nt, Salmonella enterica enterica serovar Typhi
ugcaugguagucgu

SEQ ID NO: 3626846 - RNA, 13 nt, Salmonella enterica enterica serovar Typhi
ugcauuaccggga

SEQ ID NO: 3626847 - RNA, 20 nt, Salmonella enterica enterica serovar Typhi
ugcauucaggccucugcuuu

SEQ ID NO: 3626848 - RNA, 11 nt, Salmonella enterica enterica serovar Typhi
ugcauuccgcg

SEQ ID NO: 3626849 - RNA, 16 nt, Salmonella enterica enterica serovar Typhi
ugcauuccgcgcaaau

SEQ ID NO: 3626850 - RNA, 15 nt, Salmonella enterica enterica serovar Typhi
ugcauucgcccgcaa

SEQ ID NO: 3626851 - RNA, 16 nt, Salmonella enterica enterica serovar Typhi
ugcauuuaucaaucug

SEQ ID NO: 3626852 - RNA, 17 nt, Salmonella enterica enterica serovar Typhi
ugcauuucuuguugacg

SEQ ID NO: 3626853 - RNA, 20 nt, Salmonella enterica enterica serovar Typhi
ugcauuugauuuguuuuuua

SEQ ID NO: 3626854 - RNA, 15 nt, Salmonella enterica enterica serovar Typhi
ugcauuugcgcauau

SEQ ID NO: 3626855 - RNA, 17 nt, Salmonella enterica enterica serovar Typhi
ugcauuuucaccuggau

SEQ ID NO: 3626856 - RNA, 21 nt, Salmonella enterica enterica serovar Typhi
ugccaaaagguuagguuaaau

SEQ ID NO: 3626857 - RNA, 13 nt, Salmonella enterica enterica serovar Typhi
ugccaaacugcug

SEQ ID NO: 3626858 - RNA, 16 nt, Salmonella enterica enterica serovar Typhi
ugccaaacugcuggaa

SEQ ID NO: 3626859 - RNA, 18 nt, Salmonella enterica enterica serovar Typhi
ugccaaauguauacuccc

SEQ ID NO: 3626860 - RNA, 14 nt, Salmonella enterica enterica serovar Typhi
ugccaaccaccgcg

SEQ ID NO: 3626861 - RNA, 17 nt, Salmonella enterica enterica serovar Typhi
ugccaagcaacacggcg

SEQ ID NO: 3626862 - RNA, 21 nt, Salmonella enterica enterica serovar Typhi
ugccaagcguaguacguucca

SEQ ID NO: 3626863 - RNA, 18 nt, Salmonella enterica enterica serovar Typhi
ugccaaguaauaaagaga

SEQ ID NO: 3626864 - RNA, 14 nt, Salmonella enterica enterica serovar Typhi
ugccaaucuccagc

SEQ ID NO: 3626865 - RNA, 13 nt, Salmonella enterica enterica serovar Typhi
ugccaaugaaaua

SEQ ID NO: 3626866 - RNA, 14 nt, Salmonella enterica enterica serovar Typhi
ugccaaugaaauaa

SEQ ID NO: 3626867 - RNA, 22 nt, Salmonella enterica enterica serovar Typhi
ugccacaaccgcccccaacuga

SEQ ID NO: 3626868 - RNA, 23 nt, Salmonella enterica enterica serovar Typhi
ugccacaacgccugaugcugcgc

SEQ ID NO: 3626869 - RNA, 16 nt, Salmonella enterica enterica serovar Typhi
ugccacaauaucaucg

SEQ ID NO: 3626870 - RNA, 14 nt, Salmonella enterica enterica serovar Typhi
ugccacacccugag

SEQ ID NO: 3626871 - RNA, 17 nt, Salmonella enterica enterica serovar Typhi
ugccacacucucuccag

SEQ ID NO: 3626872 - RNA, 18 nt, Salmonella enterica enterica serovar Typhi
ugccacagccucagcacg

SEQ ID NO: 3626873 - RNA, 17 nt, Salmonella enterica enterica serovar Typhi
ugccacaggccaacaua

SEQ ID NO: 3626874 - RNA, 18 nt, Salmonella enterica enterica serovar Typhi
ugccacgaacgauauaaa

SEQ ID NO: 3626875 - RNA, 22 nt, Salmonella enterica enterica serovar Typhi
ugccacgucacgcaacaggccg

SEQ ID NO: 3626876 - RNA, 16 nt, Salmonella enterica enterica serovar Typhi
ugccacuauagaugau

SEQ ID NO: 3626877 - RNA, 19 nt, Salmonella enterica enterica serovar Typhi
ugccacuauagaugaugga

SEQ ID NO: 3626878 - RNA, 13 nt, Salmonella enterica enterica serovar Typhi
ugccacuccgcca

SEQ ID NO: 3626879 - RNA, 12 nt, Salmonella enterica enterica serovar Typhi
ugccacuggccu

SEQ ID NO: 3626880 - RNA, 20 nt, Salmonella enterica enterica serovar Typhi
ugccacuggguuucccauug

SEQ ID NO: 3626881 - RNA, 16 nt, Salmonella enterica enterica serovar Typhi
ugccacuguucagaaa

SEQ ID NO: 3626882 - RNA, 14 nt, Salmonella enterica enterica serovar Typhi
ugccagaagagaau

SEQ ID NO: 3626883 - RNA, 17 nt, Salmonella enterica enterica serovar Typhi
ugccagacgggccaggc

SEQ ID NO: 3626884 - RNA, 11 nt, Salmonella enterica enterica serovar Typhi
ugccagagaga

SEQ ID NO: 3626885 - RNA, 17 nt, Salmonella enterica enterica serovar Typhi
ugccagauuuuccaggc

SEQ ID NO: 3626886 - RNA, 13 nt, Salmonella enterica enterica serovar Typhi
ugccagcaccagc

SEQ ID NO: 3626887 - RNA, 16 nt, Salmonella enterica enterica serovar Typhi
ugccagcaccagcagu

SEQ ID NO: 3626888 - RNA, 19 nt, Salmonella enterica enterica serovar Typhi
ugccagcagaugaacggca

SEQ ID NO: 3626889 - RNA, 14 nt, Salmonella enterica enterica serovar Typhi
ugccagcauuaacc

SEQ ID NO: 3626890 - RNA, 13 nt, Salmonella enterica enterica serovar Typhi
ugccagccauagc

SEQ ID NO: 3626891 - RNA, 19 nt, Salmonella enterica enterica serovar Typhi
ugccagcgcccuauccagc

SEQ ID NO: 3626892 - RNA, 14 nt, Salmonella enterica enterica serovar Typhi
ugccagcgccgccg

SEQ ID NO: 3626893 - RNA, 19 nt, Salmonella enterica enterica serovar Typhi
ugaaauucuaugccaggcg

SEQ ID NO: 3626894 - RNA, 21 nt, Salmonella enterica enterica serovar Typhi
ugaaauugaucacaaaaucau

SEQ ID NO: 3626895 - RNA, 16 nt, Salmonella enterica enterica serovar Typhi
ugaaauuucuuuucca

SEQ ID NO: 3626896 - RNA, 17 nt, Salmonella enterica enterica serovar Typhi
ugaaauuucuuuuccag

SEQ ID NO: 3626897 - RNA, 17 nt, Salmonella enterica enterica serovar Typhi
ugaacagcgucauccag

SEQ ID NO: 3626898 - RNA, 18 nt, Salmonella enterica enterica serovar Typhi
ugaacauacguuuaaagc

SEQ ID NO: 3626899 - RNA, 20 nt, Salmonella enterica enterica serovar Typhi
ugaacauacguuuaaagcgc

SEQ ID NO: 3626900 - RNA, 23 nt, Salmonella enterica enterica serovar Typhi
ugaacauaugaaggauacggaau

SEQ ID NO: 3626901 - RNA, 15 nt, Salmonella enterica enterica serovar Typhi
ugaacaugcgcagaa

SEQ ID NO: 3626902 - RNA, 15 nt, Salmonella enterica enterica serovar Typhi
ugaacauugccccuc

SEQ ID NO: 3626903 - RNA, 22 nt, Salmonella enterica enterica serovar Typhi
ugaaccacggagagacaguuca

SEQ ID NO: 3626904 - RNA, 21 nt, Salmonella enterica enterica serovar Typhi
ugaaccagcggcaccagcacg

SEQ ID NO: 3626905 - RNA, 23 nt, Salmonella enterica enterica serovar Typhi
ugaaccaucggcaaacgccgccu

SEQ ID NO: 3626906 - RNA, 20 nt, Salmonella enterica enterica serovar Typhi
ugaacccgaccgucuuuguc

SEQ ID NO: 3626907 - RNA, 22 nt, Salmonella enterica enterica serovar Typhi
ugaacccguaagcccuauuagg

SEQ ID NO: 3626908 - RNA, 17 nt, Salmonella enterica enterica serovar Typhi
ugaaccggguaguuuug

SEQ ID NO: 3626909 - RNA, 14 nt, Salmonella enterica enterica serovar Typhi
ugaacgaagcauuu

SEQ ID NO: 3626910 - RNA, 21 nt, Salmonella enterica enterica serovar Typhi
ugaacgauguaucgcgcggau

SEQ ID NO: 3626911 - RNA, 13 nt, Salmonella enterica enterica serovar Typhi
ugaacgccaggcc

SEQ ID NO: 3626912 - RNA, 16 nt, Salmonella enterica enterica serovar Typhi
ugaacggcucaaaaua

SEQ ID NO: 3626913 - RNA, 22 nt, Salmonella enterica enterica serovar Typhi
ugaacuacgccccggcgcgcca

SEQ ID NO: 3626914 - RNA, 19 nt, Salmonella enterica enterica serovar Typhi
ugaacuacggcccuggcuc

SEQ ID NO: 3626915 - RNA, 20 nt, Salmonella enterica enterica serovar Typhi
ugaacuacggcccuggcuca

SEQ ID NO: 3626916 - RNA, 13 nt, Salmonella enterica enterica serovar Typhi
ugaacucccggcg

SEQ ID NO: 3626917 - RNA, 20 nt, Salmonella enterica enterica serovar Typhi
ugaacucuaugcaaaagaaa

SEQ ID NO: 3626918 - RNA, 23 nt, Salmonella enterica enterica serovar Typhi
ugaacucuaugcaaaagaaaaaa

SEQ ID NO: 3626919 - RNA, 19 nt, Salmonella enterica enterica serovar Typhi
ugaacuuuuugcaggagcu

SEQ ID NO: 3626920 - RNA, 12 nt, Salmonella enterica enterica serovar Typhi
ugaagacaacgu

SEQ ID NO: 3626921 - RNA, 18 nt, Salmonella enterica enterica serovar Typhi
ugaagauaaacagcagcg

SEQ ID NO: 3626922 - RNA, 21 nt, Salmonella enterica enterica serovar Typhi
ugaagauggucuguaccacca

SEQ ID NO: 3626923 - RNA, 15 nt, Salmonella enterica enterica serovar Typhi
ugaagauguagacca

SEQ ID NO: 3626924 - RNA, 18 nt, Salmonella enterica enterica serovar Typhi
ugaagauguagucgccuu

SEQ ID NO: 3626925 - RNA, 19 nt, Salmonella enterica enterica serovar Typhi
ugaagauuauucucgcacu

SEQ ID NO: 3626926 - RNA, 19 nt, Salmonella enterica enterica serovar Typhi
ugaagcagauacugcgcgu

SEQ ID NO: 3626927 - RNA, 16 nt, Salmonella enterica enterica serovar Typhi
ugaagcauaaaaagac

SEQ ID NO: 3626928 - RNA, 19 nt, Salmonella enterica enterica serovar Typhi
ugaagccaucaaauuugau

SEQ ID NO: 3626929 - RNA, 22 nt, Salmonella enterica enterica serovar Typhi
ugaagccaucaaauuugauagu

SEQ ID NO: 3626930 - RNA, 22 nt, Salmonella enterica enterica serovar Typhi
ugaagcgauuuauccaccgcca

SEQ ID NO: 3626931 - RNA, 14 nt, Salmonella enterica enterica serovar Typhi
ugaagcgcaguguu

SEQ ID NO: 3626932 - RNA, 17 nt, Salmonella enterica enterica serovar Typhi
ugaagcgcguucguccc

SEQ ID NO: 3626933 - RNA, 15 nt, Salmonella enterica enterica serovar Typhi
ugaagcguuccagua

SEQ ID NO: 3626934 - RNA, 15 nt, Salmonella enterica enterica serovar Typhi
ugaagcuaaccgcgc

SEQ ID NO: 3626935 - RNA, 15 nt, Salmonella enterica enterica serovar Typhi
ugaagcuggagccac

SEQ ID NO: 3626936 - RNA, 20 nt, Salmonella enterica enterica serovar Typhi
ugaagcuguuuugucggcca

SEQ ID NO: 3626937 - RNA, 17 nt, Salmonella enterica enterica serovar Typhi
ugaaggcaaaacaccau

SEQ ID NO: 3626938 - RNA, 19 nt, Salmonella enterica enterica serovar Typhi
ugaaggccaaguuuagaaa

SEQ ID NO: 3626939 - RNA, 19 nt, Salmonella enterica enterica serovar Typhi
ugaaggcgcuaugcuuacc

SEQ ID NO: 3626940 - RNA, 21 nt, Salmonella enterica enterica serovar Typhi
ugaagggcggcuggauaaaag

SEQ ID NO: 3626941 - RNA, 15 nt, Salmonella enterica enterica serovar Typhi
ugaagguuuuucccg

SEQ ID NO: 3626942 - RNA, 15 nt, Salmonella enterica enterica serovar Typhi
ugaagucgaaauuuu

SEQ ID NO: 3626943 - RNA, 22 nt, Salmonella enterica enterica serovar Typhi
ugaagugugcaaacgauaaaag

SEQ ID NO: 3626944 - RNA, 18 nt, Salmonella enterica enterica serovar Typhi
ugaaguguuccugagcca

SEQ ID NO: 3626945 - RNA, 16 nt, Salmonella enterica enterica serovar Typhi
ugaaguuauccagcgc

SEQ ID NO: 3626946 - RNA, 18 nt, Salmonella enterica enterica serovar Typhi
ugaaguuaucgaagguca

SEQ ID NO: 3626947 - RNA, 13 nt, Salmonella enterica enterica serovar Typhi
ugaauaaaccaga

SEQ ID NO: 3626948 - RNA, 13 nt, Salmonella enterica enterica serovar Typhi
ugaauaaauccuu

SEQ ID NO: 3626949 - RNA, 15 nt, Salmonella enterica enterica serovar Typhi
ugaauaacagcacca

SEQ ID NO: 3626950 - RNA, 21 nt, Salmonella enterica enterica serovar Typhi
ugaauaaucgucgugguuuaa

SEQ ID NO: 3626951 - RNA, 14 nt, Salmonella enterica enterica serovar Typhi
ugaauaaugaccuc

SEQ ID NO: 3626952 - RNA, 16 nt, Salmonella enterica enterica serovar Typhi
ugaauaauuucuucuu

SEQ ID NO: 3626953 - RNA, 18 nt, Salmonella enterica enterica serovar Typhi
ugaauaauuucuucuuua

SEQ ID NO: 3626954 - RNA, 18 nt, Salmonella enterica enterica serovar Typhi
ugaauaccaagucucagg

SEQ ID NO: 3626955 - RNA, 12 nt, Salmonella enterica enterica serovar Typhi
ugaauaccagcg

SEQ ID NO: 3626956 - RNA, 12 nt, Salmonella enterica enterica serovar Typhi
ugaauagccagc

SEQ ID NO: 3626957 - RNA, 21 nt, Salmonella enterica enterica serovar Typhi
ugaauagccagcccccugcca

SEQ ID NO: 3626958 - RNA, 14 nt, Salmonella enterica enterica serovar Typhi
ugaauagcgcugcg

SEQ ID NO: 3626959 - RNA, 17 nt, Salmonella enterica enterica serovar Typhi
ugaauaucaaaccacgc

SEQ ID NO: 3626960 - RNA, 16 nt, Salmonella enterica enterica serovar Typhi
ugaauauccgccgccc

SEQ ID NO: 3626961 - RNA, 22 nt, Salmonella enterica enterica serovar Typhi
ugaauaucgagcggcaguagca

SEQ ID NO: 3626962 - RNA, 20 nt, Salmonella enterica enterica serovar Typhi
ugaauaugaucugcacaaca

SEQ ID NO: 3626963 - RNA, 18 nt, Salmonella enterica enterica serovar Typhi
ugaauauggccagucccc

SEQ ID NO: 3626964 - RNA, 17 nt, Salmonella enterica enterica serovar Typhi
ugaauauucaauggguu

SEQ ID NO: 3626965 - RNA, 17 nt, Salmonella enterica enterica serovar Typhi
ugaauauucggcuccag

SEQ ID NO: 3626966 - RNA, 13 nt, Salmonella enterica enterica serovar Typhi
ugaauauuuugcu

SEQ ID NO: 3626967 - RNA, 21 nt, Salmonella enterica enterica serovar Typhi
ugaaucagauacggcuccagc

SEQ ID NO: 3626968 - RNA, 13 nt, Salmonella enterica enterica serovar Typhi
ugaaucagcaucu

SEQ ID NO: 3626969 - RNA, 18 nt, Salmonella enterica enterica serovar Typhi
ugaaucagggaugccccu

SEQ ID NO: 3626970 - RNA, 15 nt, Salmonella enterica enterica serovar Typhi
ugaauccaggccaga

SEQ ID NO: 3626971 - RNA, 16 nt, Salmonella enterica enterica serovar Typhi
ugaauccaggccagau

SEQ ID NO: 3626972 - RNA, 21 nt, Salmonella enterica enterica serovar Typhi
ugaaucccccugccacaaccg

SEQ ID NO: 3626973 - RNA, 22 nt, Salmonella enterica enterica serovar Typhi
ugaaucccuguucaaaagccug

SEQ ID NO: 3626974 - RNA, 15 nt, Salmonella enterica enterica serovar Typhi
ugaaucgccgucagu

SEQ ID NO: 3626975 - RNA, 18 nt, Salmonella enterica enterica serovar Typhi
ugaaucggcaccuggagc

SEQ ID NO: 3626976 - RNA, 21 nt, Salmonella enterica enterica serovar Typhi
ugaaucucagauaauagcugc

SEQ ID NO: 3626977 - RNA, 18 nt, Salmonella enterica enterica serovar Typhi
ugaaugagucggaccauc

SEQ ID NO: 3626978 - RNA, 20 nt, Salmonella enterica enterica serovar Typhi
ugacgccccauguggccagc

SEQ ID NO: 3626979 - RNA, 11 nt, Salmonella enterica enterica serovar Typhi
ugacgccgcca

SEQ ID NO: 3626980 - RNA, 18 nt, Salmonella enterica enterica serovar Typhi
ugacgccgcuguuuucac

SEQ ID NO: 3626981 - RNA, 18 nt, Salmonella enterica enterica serovar Typhi
ugacgcgaauuauagaac

SEQ ID NO: 3626982 - RNA, 12 nt, Salmonella enterica enterica serovar Typhi
ugacgcgcauac

SEQ ID NO: 3626983 - RNA, 15 nt, Salmonella enterica enterica serovar Typhi
ugacgcgucauaaug

SEQ ID NO: 3626984 - RNA, 16 nt, Salmonella enterica enterica serovar Typhi
ugacgcucuccuccaa

SEQ ID NO: 3626985 - RNA, 11 nt, Salmonella enterica enterica serovar Typhi
ugacgcugccc

SEQ ID NO: 3626986 - RNA, 18 nt, Salmonella enterica enterica serovar Typhi
ugacgcuucgcuuauccg

SEQ ID NO: 3626987 - RNA, 16 nt, Salmonella enterica enterica serovar Typhi
ugacgcuuugcauuau

SEQ ID NO: 3626988 - RNA, 14 nt, Salmonella enterica enterica serovar Typhi
ugacggaaaccagc

SEQ ID NO: 3626989 - RNA, 16 nt, Salmonella enterica enterica serovar Typhi
ugacggaaaccagcau

SEQ ID NO: 3626990 - RNA, 17 nt, Salmonella enterica enterica serovar Typhi
ucgccuguaccgggcag

SEQ ID NO: 3626991 - RNA, 20 nt, Salmonella enterica enterica serovar Typhi
ucgccuguaccgggcagaca

SEQ ID NO: 3626992 - RNA, 22 nt, Salmonella enterica enterica serovar Typhi
ucgccuuaacucuuaaaucaug

SEQ ID NO: 3626993 - RNA, 16 nt, Salmonella enterica enterica serovar Typhi
ucgccuuacccggccu

SEQ ID NO: 3626994 - RNA, 13 nt, Salmonella enterica enterica serovar Typhi
ucgccuucauccg

SEQ ID NO: 3626995 - RNA, 17 nt, Salmonella enterica enterica serovar Typhi
ucgccuucauccgcaua

SEQ ID NO: 3626996 - RNA, 17 nt, Salmonella enterica enterica serovar Typhi
ucgccuucuucaucuuc

SEQ ID NO: 3626997 - RNA, 15 nt, Salmonella enterica enterica serovar Typhi
ucgccuuucaccagc

SEQ ID NO: 3626998 - RNA, 16 nt, Salmonella enterica enterica serovar Typhi
ucgccuuucaccagcg

SEQ ID NO: 3626999 - RNA, 22 nt, Salmonella enterica enterica serovar Typhi
ucgcgaauagugcaggaaggcg

SEQ ID NO: 3627000 - RNA, 17 nt, Salmonella enterica enterica serovar Typhi
ucgcgaaucgcuucacg

SEQ ID NO: 3627001 - RNA, 17 nt, Salmonella enterica enterica serovar Typhi
ucgcgacguccgccaac

SEQ ID NO: 3627002 - RNA, 20 nt, Salmonella enterica enterica serovar Typhi
ucgcgagaaaauagaggaaa

SEQ ID NO: 3627003 - RNA, 13 nt, Salmonella enterica enterica serovar Typhi
ucgcgauaacguu

SEQ ID NO: 3627004 - RNA, 20 nt, Salmonella enterica enterica serovar Typhi
ucgcgauaaucaacucuccu

SEQ ID NO: 3627005 - RNA, 17 nt, Salmonella enterica enterica serovar Typhi
ucgcgaucacagacaga

SEQ ID NO: 3627006 - RNA, 14 nt, Salmonella enterica enterica serovar Typhi
ucgcgauccgccag

SEQ ID NO: 3627007 - RNA, 20 nt, Salmonella enterica enterica serovar Typhi
ucgcgauccucauacagccc

SEQ ID NO: 3627008 - RNA, 15 nt, Salmonella enterica enterica serovar Typhi
ucgcgauucgggccg

SEQ ID NO: 3627009 - RNA, 13 nt, Salmonella enterica enterica serovar Typhi
ucgcgauuuagcg

SEQ ID NO: 3627010 - RNA, 19 nt, Salmonella enterica enterica serovar Typhi
ucgcgcagauagagcgccu

SEQ ID NO: 3627011 - RNA, 12 nt, Salmonella enterica enterica serovar Typhi
ucgcgcagcagg

SEQ ID NO: 3627012 - RNA, 16 nt, Salmonella enterica enterica serovar Typhi
ucgcgcagcgugaaac

SEQ ID NO: 3627013 - RNA, 19 nt, Salmonella enterica enterica serovar Typhi
ucgcgcagcgugaaacgcc

SEQ ID NO: 3627014 - RNA, 14 nt, Salmonella enterica enterica serovar Typhi
ucgcgcaggcggaa

SEQ ID NO: 3627015 - RNA, 15 nt, Salmonella enterica enterica serovar Typhi
ucgcgcauccgggcc

SEQ ID NO: 3627016 - RNA, 16 nt, Salmonella enterica enterica serovar Typhi
ucgcgcauccgggccg

SEQ ID NO: 3627017 - RNA, 20 nt, Salmonella enterica enterica serovar Typhi
ucgcgcauccgggccgcuag

SEQ ID NO: 3627018 - RNA, 17 nt, Salmonella enterica enterica serovar Typhi
ucgcgcauggcagggcg

SEQ ID NO: 3627019 - RNA, 22 nt, Salmonella enterica enterica serovar Typhi
ucgcgcauugcgauaugcuguu

SEQ ID NO: 3627020 - RNA, 18 nt, Salmonella enterica enterica serovar Typhi
ucgcgccaaaagaggcag

SEQ ID NO: 3627021 - RNA, 19 nt, Salmonella enterica enterica serovar Typhi
ucgcgccaaaagaggcagc

SEQ ID NO: 3627022 - RNA, 17 nt, Salmonella enterica enterica serovar Typhi
ucgcgccagcgaccacc

SEQ ID NO: 3627023 - RNA, 18 nt, Salmonella enterica enterica serovar Typhi
ucgcgccauuugccagau

SEQ ID NO: 3627024 - RNA, 24 nt, Salmonella enterica enterica serovar Typhi
ucgcgcccaaugcuuagucagccu

SEQ ID NO: 3627025 - RNA, 19 nt, Salmonella enterica enterica serovar Typhi
ucgcgcccuccuccagcgu

SEQ ID NO: 3627026 - RNA, 17 nt, Salmonella enterica enterica serovar Typhi
ucgcgccgugcccagca

SEQ ID NO: 3627027 - RNA, 19 nt, Salmonella enterica enterica serovar Typhi
ucgcgccgugcccagcauc

SEQ ID NO: 3627028 - RNA, 20 nt, Salmonella enterica enterica serovar Typhi
ucgcgcgcaaaugcaauuca

SEQ ID NO: 3627029 - RNA, 22 nt, Salmonella enterica enterica serovar Typhi
ucgcgcggcgguucauccugcg

SEQ ID NO: 3627030 - RNA, 16 nt, Salmonella enterica enterica serovar Typhi
ucgcgcguccacggcg

SEQ ID NO: 3627031 - RNA, 22 nt, Salmonella enterica enterica serovar Typhi
ucgcgcguggugcuuagcuggc

SEQ ID NO: 3627032 - RNA, 17 nt, Salmonella enterica enterica serovar Typhi
ucgcgcucaagcgaaaa

SEQ ID NO: 3627033 - RNA, 17 nt, Salmonella enterica enterica serovar Typhi
ucgcgcucuuccgccag

SEQ ID NO: 3627034 - RNA, 16 nt, Salmonella enterica enterica serovar Typhi
ucgcgcugcgcaggcg

SEQ ID NO: 3627035 - RNA, 19 nt, Salmonella enterica enterica serovar Typhi
ucgcgcugucugccggcgu

SEQ ID NO: 3627036 - RNA, 13 nt, Salmonella enterica enterica serovar Typhi
ucgcgcuuauccg

SEQ ID NO: 3627037 - RNA, 15 nt, Salmonella enterica enterica serovar Typhi
ucgcgcuuauccgca

SEQ ID NO: 3627038 - RNA, 20 nt, Salmonella enterica enterica serovar Typhi
ucgcggaagcgaccggcguc

SEQ ID NO: 3627039 - RNA, 17 nt, Salmonella enterica enterica serovar Typhi
ucgcggcugguacggcg

SEQ ID NO: 3627040 - RNA, 15 nt, Salmonella enterica enterica serovar Typhi
ucgcgguaaaaagcu

SEQ ID NO: 3627041 - RNA, 18 nt, Salmonella enterica enterica serovar Typhi
ucgcgguaacggccuggc

SEQ ID NO: 3627042 - RNA, 19 nt, Salmonella enterica enterica serovar Typhi
ucgcgguaacggccuggcu

SEQ ID NO: 3627043 - RNA, 16 nt, Salmonella enterica enterica serovar Typhi
ucgcgguacuucugac

SEQ ID NO: 3627044 - RNA, 16 nt, Salmonella enterica enterica serovar Typhi
ucgcggucggcgcagu

SEQ ID NO: 3627045 - RNA, 16 nt, Salmonella enterica enterica serovar Typhi
ucgcggugaucccagg

SEQ ID NO: 3627046 - RNA, 17 nt, Salmonella enterica enterica serovar Typhi
ucgcggugaucccaggc

SEQ ID NO: 3627047 - RNA, 17 nt, Salmonella enterica enterica serovar Typhi
ucgcgguggguagcggc

SEQ ID NO: 3627048 - RNA, 17 nt, Salmonella enterica enterica serovar Typhi
ucgcgguugacgcugcu

SEQ ID NO: 3627049 - RNA, 19 nt, Salmonella enterica enterica serovar Typhi
ucgcgguuucguggcgcug

SEQ ID NO: 3627050 - RNA, 24 nt, Salmonella enterica enterica serovar Typhi
ucgcguacaggauguccaggcgac

SEQ ID NO: 3627051 - RNA, 20 nt, Salmonella enterica enterica serovar Typhi
ucgcgucaauauuaaugcug

SEQ ID NO: 3627052 - RNA, 21 nt, Salmonella enterica enterica serovar Typhi
ucgcgugacgcaguaauacgc

SEQ ID NO: 3627053 - RNA, 12 nt, Salmonella enterica enterica serovar Typhi
ucgcguuacggc

SEQ ID NO: 3627054 - RNA, 18 nt, Salmonella enterica enterica serovar Typhi
ucgcguuauagccgccaa

SEQ ID NO: 3627055 - RNA, 17 nt, Salmonella enterica enterica serovar Typhi
ucgcguucuggaaguga

SEQ ID NO: 3627056 - RNA, 13 nt, Salmonella enterica enterica serovar Typhi
ucgcguuguaauc

SEQ ID NO: 3627057 - RNA, 18 nt, Salmonella enterica enterica serovar Typhi
ucgcguuuuucgaaaauu

SEQ ID NO: 3627058 - RNA, 20 nt, Salmonella enterica enterica serovar Typhi
ucgcuaacccaggccggaug

SEQ ID NO: 3627059 - RNA, 18 nt, Salmonella enterica enterica serovar Typhi
ucgcuaauuggcuuaccu

SEQ ID NO: 3627060 - RNA, 21 nt, Salmonella enterica enterica serovar Typhi
ucgcuacacgcguaaacuucc

SEQ ID NO: 3627061 - RNA, 20 nt, Salmonella enterica enterica serovar Typhi
ucgcuaccacagaaaucgcc

SEQ ID NO: 3627062 - RNA, 20 nt, Salmonella enterica enterica serovar Typhi
ucgcuaccuucuucccauau

SEQ ID NO: 3627063 - RNA, 16 nt, Salmonella enterica enterica serovar Typhi
ucgcuaccuuuuuuca

SEQ ID NO: 3627064 - RNA, 19 nt, Salmonella enterica enterica serovar Typhi
ucgcuaccuuuuuucagua

SEQ ID NO: 3627065 - RNA, 16 nt, Salmonella enterica enterica serovar Typhi
ucgcuauauacccccu

SEQ ID NO: 3627066 - RNA, 14 nt, Salmonella enterica enterica serovar Typhi
ucgcuauccagcag

SEQ ID NO: 3627067 - RNA, 23 nt, Salmonella enterica enterica serovar Typhi
ucgcuaucugacagccaaacugc

SEQ ID NO: 3627068 - RNA, 19 nt, Salmonella enterica enterica serovar Typhi
ucgcuaucuuugagcagau

SEQ ID NO: 3627069 - RNA, 18 nt, Salmonella enterica enterica serovar Typhi
ucgcucaggacagguucc

SEQ ID NO: 3627070 - RNA, 16 nt, Salmonella enterica enterica serovar Typhi
ucgcucaugcgcgucc

SEQ ID NO: 3627071 - RNA, 16 nt, Salmonella enterica enterica serovar Typhi
ucgcuccggaacgcga

SEQ ID NO: 3627072 - RNA, 20 nt, Salmonella enterica enterica serovar Typhi
ucgcuccucagcgcuuacca

SEQ ID NO: 3627073 - RNA, 16 nt, Salmonella enterica enterica serovar Typhi
ucgcucgcgccacgca

SEQ ID NO: 3627074 - RNA, 14 nt, Salmonella enterica enterica serovar Typhi
ucgcucgcggcaga

SEQ ID NO: 3627075 - RNA, 21 nt, Salmonella enterica enterica serovar Typhi
ucgcucucgugccaguaacgu

SEQ ID NO: 3627076 - RNA, 21 nt, Salmonella enterica enterica serovar Typhi
uagacaauugcugcguaacug

SEQ ID NO: 3627077 - RNA, 20 nt, Salmonella enterica enterica serovar Typhi
uagacagcggcuaauuuauu

SEQ ID NO: 3627078 - RNA, 21 nt, Salmonella enterica enterica serovar Typhi
uagacaguuuuuucguuccag

SEQ ID NO: 3627079 - RNA, 22 nt, Salmonella enterica enterica serovar Typhi
uagacaguuuuuucguuccaga

SEQ ID NO: 3627080 - RNA, 21 nt, Salmonella enterica enterica serovar Typhi
uagaccacgccaucaacagcg

SEQ ID NO: 3627081 - RNA, 16 nt, Salmonella enterica enterica serovar Typhi
uagaccagcggcccgc

SEQ ID NO: 3627082 - RNA, 15 nt, Salmonella enterica enterica serovar Typhi
uagaccugaaaucag

SEQ ID NO: 3627083 - RNA, 17 nt, Salmonella enterica enterica serovar Typhi
uagaccugaaaucagcc

SEQ ID NO: 3627084 - RNA, 22 nt, Salmonella enterica enterica serovar Typhi
uagaccugcuccaugacguuca

SEQ ID NO: 3627085 - RNA, 23 nt, Salmonella enterica enterica serovar Typhi
uagacgagcgaaaaacugucgcc

SEQ ID NO: 3627086 - RNA, 15 nt, Salmonella enterica enterica serovar Typhi
uagacgaugcaggcc

SEQ ID NO: 3627087 - RNA, 23 nt, Salmonella enterica enterica serovar Typhi
uagacgucgcguacaauugcuuc

SEQ ID NO: 3627088 - RNA, 16 nt, Salmonella enterica enterica serovar Typhi
uagacuucacuuuccc

SEQ ID NO: 3627089 - RNA, 12 nt, Salmonella enterica enterica serovar Typhi
uagagaaaucaa

SEQ ID NO: 3627090 - RNA, 13 nt, Salmonella enterica enterica serovar Typhi
uagagaaaucaac

SEQ ID NO: 3627091 - RNA, 15 nt, Salmonella enterica enterica serovar Typhi
uagagagggccgcaa

SEQ ID NO: 3627092 - RNA, 17 nt, Salmonella enterica enterica serovar Typhi
uagagaguaaaaccggc

SEQ ID NO: 3627093 - RNA, 18 nt, Salmonella enterica enterica serovar Typhi
uagagcaggucaaagacg

SEQ ID NO: 3627094 - RNA, 20 nt, Salmonella enterica enterica serovar Typhi
uagagcaggucaaagacgaa

SEQ ID NO: 3627095 - RNA, 18 nt, Salmonella enterica enterica serovar Typhi
uagagcguggucauuagg

SEQ ID NO: 3627096 - RNA, 17 nt, Salmonella enterica enterica serovar Typhi
uagagugcuucugcaaa

SEQ ID NO: 3627097 - RNA, 16 nt, Salmonella enterica enterica serovar Typhi
uagauaccuacuuuau

SEQ ID NO: 3627098 - RNA, 23 nt, Salmonella enterica enterica serovar Typhi
uagauaccuacuuuauuuuucgc

SEQ ID NO: 3627099 - RNA, 22 nt, Salmonella enterica enterica serovar Typhi
uagauauaacccaguucaaauc

SEQ ID NO: 3627100 - RNA, 17 nt, Salmonella enterica enterica serovar Typhi
uagauauagcuuuucaa

SEQ ID NO: 3627101 - RNA, 13 nt, Salmonella enterica enterica serovar Typhi
uagauauuaauau

SEQ ID NO: 3627102 - RNA, 12 nt, Salmonella enterica enterica serovar Typhi
uagaugcgucgc

SEQ ID NO: 3627103 - RNA, 20 nt, Salmonella enterica enterica serovar Typhi
uagauguuaaaguuuuucau

SEQ ID NO: 3627104 - RNA, 13 nt, Salmonella enterica enterica serovar Typhi
uagcaaaaaagcg

SEQ ID NO: 3627105 - RNA, 21 nt, Salmonella enterica enterica serovar Typhi
uagcaaagcguacaugaauaa

SEQ ID NO: 3627106 - RNA, 22 nt, Salmonella enterica enterica serovar Typhi
uagcaacccacuuucggaaaaa

SEQ ID NO: 3627107 - RNA, 16 nt, Salmonella enterica enterica serovar Typhi
uagcaaucauaaagcg

SEQ ID NO: 3627108 - RNA, 14 nt, Salmonella enterica enterica serovar Typhi
uagcaauuaauaaa

SEQ ID NO: 3627109 - RNA, 18 nt, Salmonella enterica enterica serovar Typhi
uagcaauuaauaaacaau

SEQ ID NO: 3627110 - RNA, 14 nt, Salmonella enterica enterica serovar Typhi
uagcacaaagaauu

SEQ ID NO: 3627111 - RNA, 12 nt, Salmonella enterica enterica serovar Typhi
uagcaccagacc

SEQ ID NO: 3627112 - RNA, 16 nt, Salmonella enterica enterica serovar Typhi
uagcaccagaccgaca

SEQ ID NO: 3627113 - RNA, 14 nt, Salmonella enterica enterica serovar Typhi
uagcaccaggccaa

SEQ ID NO: 3627114 - RNA, 14 nt, Salmonella enterica enterica serovar Typhi
uagcaccauaaacg

SEQ ID NO: 3627115 - RNA, 23 nt, Salmonella enterica enterica serovar Typhi
uagcaccucgcaauauucaugcc

SEQ ID NO: 3627116 - RNA, 15 nt, Salmonella enterica enterica serovar Typhi
uagcacuuuaaacac

SEQ ID NO: 3627117 - RNA, 14 nt, Salmonella enterica enterica serovar Typhi
uagcagacagccga

SEQ ID NO: 3627118 - RNA, 15 nt, Salmonella enterica enterica serovar Typhi
uagcagaccgguacg

SEQ ID NO: 3627119 - RNA, 23 nt, Salmonella enterica enterica serovar Typhi
uagcaggauauuuugcucauauu

SEQ ID NO: 3627120 - RNA, 17 nt, Salmonella enterica enterica serovar Typhi
uagcaucaggacauggu

SEQ ID NO: 3627121 - RNA, 14 nt, Salmonella enterica enterica serovar Typhi
uagcauccagaccc

SEQ ID NO: 3627122 - RNA, 12 nt, Salmonella enterica enterica serovar Typhi
uagcauccagca

SEQ ID NO: 3627123 - RNA, 20 nt, Salmonella enterica enterica serovar Typhi
uagcaucgacccuugcgacc

SEQ ID NO: 3627124 - RNA, 20 nt, Salmonella enterica enterica serovar Typhi
uagcauuaagcugauauuuu

SEQ ID NO: 3627125 - RNA, 23 nt, Salmonella enterica enterica serovar Typhi
uagcauuaagcugauauuuuacu

SEQ ID NO: 3627126 - RNA, 14 nt, Salmonella enterica enterica serovar Typhi
uagcauugccguca

SEQ ID NO: 3627127 - RNA, 23 nt, Salmonella enterica enterica serovar Typhi
uagcauuuccgcaucguuaucau

SEQ ID NO: 3627128 - RNA, 16 nt, Salmonella enterica enterica serovar Typhi
uagcauuuuuacucag

SEQ ID NO: 3627129 - RNA, 20 nt, Salmonella enterica enterica serovar Typhi
uagccaaacucugaaaaaau

SEQ ID NO: 3627130 - RNA, 19 nt, Salmonella enterica enterica serovar Typhi
uagccaaagauuagcccca

SEQ ID NO: 3627131 - RNA, 20 nt, Salmonella enterica enterica serovar Typhi
uagccaaagcgguaauuaau

SEQ ID NO: 3627132 - RNA, 15 nt, Salmonella enterica enterica serovar Typhi
uagccaacacauaag

SEQ ID NO: 3627133 - RNA, 18 nt, Salmonella enterica enterica serovar Typhi
uagccacagcgcgcgaca

SEQ ID NO: 3627134 - RNA, 15 nt, Salmonella enterica enterica serovar Typhi
uagccacagcgguua

SEQ ID NO: 3627135 - RNA, 16 nt, Salmonella enterica enterica serovar Typhi
uagccacucacggcaa

SEQ ID NO: 3627136 - RNA, 21 nt, Salmonella enterica enterica serovar Typhi
uagccagccaaacaauauccc

SEQ ID NO: 3627137 - RNA, 22 nt, Salmonella enterica enterica serovar Typhi
uagccagccauggcccuuuugc

SEQ ID NO: 3627138 - RNA, 17 nt, Salmonella enterica enterica serovar Typhi
uagccagcgauccugcg

SEQ ID NO: 3627139 - RNA, 19 nt, Salmonella enterica enterica serovar Typhi
uagccaucaaaguagaugu

SEQ ID NO: 3627140 - RNA, 15 nt, Salmonella enterica enterica serovar Typhi
uagccauuuaaugau

SEQ ID NO: 3627141 - RNA, 20 nt, Salmonella enterica enterica serovar Typhi
uagcccagcgccgcaucgcg

SEQ ID NO: 3627142 - RNA, 21 nt, Salmonella enterica enterica serovar Typhi
uagcccauauaacguuuucag

SEQ ID NO: 3627143 - RNA, 17 nt, Salmonella enterica enterica serovar Typhi
uagcccauauuggcaau

SEQ ID NO: 3627144 - RNA, 17 nt, Salmonella enterica enterica serovar Typhi
uagccccagcgcaaacg

SEQ ID NO: 3627145 - RNA, 19 nt, Salmonella enterica enterica serovar Typhi
uagcccgcuucacgcgcgg

SEQ ID NO: 3627146 - RNA, 15 nt, Salmonella enterica enterica serovar Typhi
uagcccguacgaucu

SEQ ID NO: 3627147 - RNA, 23 nt, Salmonella enterica enterica serovar Typhi
uagccgacggccauaaaccccga

SEQ ID NO: 3627148 - RNA, 16 nt, Salmonella enterica enterica serovar Typhi
uagccgccccccguca

SEQ ID NO: 3627149 - RNA, 21 nt, Salmonella enterica enterica serovar Typhi
uagccgcgcgccgccucuuca

SEQ ID NO: 3627150 - RNA, 19 nt, Salmonella enterica enterica serovar Typhi
uagccgcgcgucagcgugu

SEQ ID NO: 3627151 - RNA, 14 nt, Salmonella enterica enterica serovar Typhi
uagccggauaaaau

SEQ ID NO: 3627152 - RNA, 18 nt, Salmonella enterica enterica serovar Typhi
uagccgguaacuuucccg

SEQ ID NO: 3627153 - RNA, 12 nt, Salmonella enterica enterica serovar Typhi
uagccguggcug

SEQ ID NO: 3627154 - RNA, 15 nt, Salmonella enterica enterica serovar Typhi
uagccguucaugcac

SEQ ID NO: 3627155 - RNA, 18 nt, Salmonella enterica enterica serovar Typhi
uagccguucaugcacucg

SEQ ID NO: 3627156 - RNA, 14 nt, Salmonella enterica enterica serovar Typhi
uagccguucuccag

SEQ ID NO: 3627157 - RNA, 21 nt, Salmonella enterica enterica serovar Typhi
uagccuaaugacggacgcaga

SEQ ID NO: 3627158 - RNA, 21 nt, Salmonella enterica enterica serovar Typhi
uagccucaagagaugcagaca

SEQ ID NO: 3627159 - RNA, 22 nt, Salmonella enterica enterica serovar Typhi
uagccuucccggggaacagaag

SEQ ID NO: 3627160 - RNA, 23 nt, Salmonella enterica enterica serovar Typhi
uagccuuuauugaugacauuaau

SEQ ID NO: 3627161 - RNA, 15 nt, Salmonella enterica enterica serovar Typhi
ucgcucuuccaguug

SEQ ID NO: 3627162 - RNA, 21 nt, Salmonella enterica enterica serovar Typhi
ucgcugacgccgaccaccgcc

SEQ ID NO: 3627163 - RNA, 22 nt, Salmonella enterica enterica serovar Typhi
ucgcugacgccgaccaccgccc

SEQ ID NO: 3627164 - RNA, 17 nt, Salmonella enterica enterica serovar Typhi
ucgcugauacgcuggca

SEQ ID NO: 3627165 - RNA, 15 nt, Salmonella enterica enterica serovar Typhi
ucgcugcugcuuuuu

SEQ ID NO: 3627166 - RNA, 15 nt, Salmonella enterica enterica serovar Typhi
ucgcuggacauuaag

SEQ ID NO: 3627167 - RNA, 17 nt, Salmonella enterica enterica serovar Typhi
ucgcuggccguuaugca

SEQ ID NO: 3627168 - RNA, 18 nt, Salmonella enterica enterica serovar Typhi
ucgcuguauuucccucuc

SEQ ID NO: 3627169 - RNA, 14 nt, Salmonella enterica enterica serovar Typhi
ucgcuguccgggua

SEQ ID NO: 3627170 - RNA, 13 nt, Salmonella enterica enterica serovar Typhi
ucgcuguggccag

SEQ ID NO: 3627171 - RNA, 15 nt, Salmonella enterica enterica serovar Typhi
ucgcuguggccaggc

SEQ ID NO: 3627172 - RNA, 19 nt, Salmonella enterica enterica serovar Typhi
ucgcugugguuuauccgca

SEQ ID NO: 3627173 - RNA, 12 nt, Salmonella enterica enterica serovar Typhi
ucgcuguuaacc

SEQ ID NO: 3627174 - RNA, 20 nt, Salmonella enterica enterica serovar Typhi
ucgcuuaaacauauacugcu

SEQ ID NO: 3627175 - RNA, 23 nt, Salmonella enterica enterica serovar Typhi
ucgcuuaaauggcgaaagugaac

SEQ ID NO: 3627176 - RNA, 22 nt, Salmonella enterica enterica serovar Typhi
ucgcuuaacggcccaggcaucg

SEQ ID NO: 3627177 - RNA, 13 nt, Salmonella enterica enterica serovar Typhi
ucgcuuaccaggc

SEQ ID NO: 3627178 - RNA, 19 nt, Salmonella enterica enterica serovar Typhi
ucgcuuaucuggccuacgg

SEQ ID NO: 3627179 - RNA, 23 nt, Salmonella enterica enterica serovar Typhi
ucgcuucugccgccaguugcuca

SEQ ID NO: 3627180 - RNA, 22 nt, Salmonella enterica enterica serovar Typhi
ucgcuuuacccgggccaucuuu

SEQ ID NO: 3627181 - RNA, 15 nt, Salmonella enterica enterica serovar Typhi
ucgcuuuuacucuuc

SEQ ID NO: 3627182 - RNA, 19 nt, Salmonella enterica enterica serovar Typhi
ucggaaacuauccuggccu

SEQ ID NO: 3627183 - RNA, 20 nt, Salmonella enterica enterica serovar Typhi
ucggaaaucuguuccagcga

SEQ ID NO: 3627184 - RNA, 18 nt, Salmonella enterica enterica serovar Typhi
ucggaacaguaaagcgca

SEQ ID NO: 3627185 - RNA, 18 nt, Salmonella enterica enterica serovar Typhi
ucggaacgcgacucccag

SEQ ID NO: 3627186 - RNA, 15 nt, Salmonella enterica enterica serovar Typhi
ucggaacgcuguaug

SEQ ID NO: 3627187 - RNA, 19 nt, Salmonella enterica enterica serovar Typhi
ucggaagacuggcgcagca

SEQ ID NO: 3627188 - RNA, 21 nt, Salmonella enterica enterica serovar Typhi
ucggaauauugguaccgagga

SEQ ID NO: 3627189 - RNA, 16 nt, Salmonella enterica enterica serovar Typhi
ucggaauuuccgggug

SEQ ID NO: 3627190 - RNA, 22 nt, Salmonella enterica enterica serovar Typhi
ucggacaacguaccggcaaccg

SEQ ID NO: 3627191 - RNA, 21 nt, Salmonella enterica enterica serovar Typhi
ucggacacgacguggacgcug

SEQ ID NO: 3627192 - RNA, 17 nt, Salmonella enterica enterica serovar Typhi
ucggaccuccgcguacc

SEQ ID NO: 3627193 - RNA, 13 nt, Salmonella enterica enterica serovar Typhi
ucggacucaucgg

SEQ ID NO: 3627194 - RNA, 15 nt, Salmonella enterica enterica serovar Typhi
ucggagaaauagacg

SEQ ID NO: 3627195 - RNA, 23 nt, Salmonella enterica enterica serovar Typhi
ucggagaaauagacgagcgaaaa

SEQ ID NO: 3627196 - RNA, 18 nt, Salmonella enterica enterica serovar Typhi
ucggagauuucauccucu

SEQ ID NO: 3627197 - RNA, 20 nt, Salmonella enterica enterica serovar Typhi
ucggagauuucauccucuug

SEQ ID NO: 3627198 - RNA, 16 nt, Salmonella enterica enterica serovar Typhi
ucggagguucgaaucc

SEQ ID NO: 3627199 - RNA, 20 nt, Salmonella enterica enterica serovar Typhi
ucggagguuuucucauccag

SEQ ID NO: 3627200 - RNA, 20 nt, Salmonella enterica enterica serovar Typhi
ucggcaaacgccgccuggau

SEQ ID NO: 3627201 - RNA, 21 nt, Salmonella enterica enterica serovar Typhi
ucggcaaagaccaauaaaacg

SEQ ID NO: 3627202 - RNA, 19 nt, Salmonella enterica enterica serovar Typhi
ucggcaaagcacugcugcu

SEQ ID NO: 3627203 - RNA, 13 nt, Salmonella enterica enterica serovar Typhi
ucggcaaagccca

SEQ ID NO: 3627204 - RNA, 16 nt, Salmonella enterica enterica serovar Typhi
ucggcaaauucuuuuc

SEQ ID NO: 3627205 - RNA, 19 nt, Salmonella enterica enterica serovar Typhi
ucggcaagaauuucaauca

SEQ ID NO: 3627206 - RNA, 21 nt, Salmonella enterica enterica serovar Typhi
ucggcaauaugcuguuuaugg

SEQ ID NO: 3627207 - RNA, 17 nt, Salmonella enterica enterica serovar Typhi
ucggcaauauugccgca

SEQ ID NO: 3627208 - RNA, 21 nt, Salmonella enterica enterica serovar Typhi
ucggcaauuuccggcgacgua

SEQ ID NO: 3627209 - RNA, 18 nt, Salmonella enterica enterica serovar Typhi
ucggcagcaauacgcccg

SEQ ID NO: 3627210 - RNA, 13 nt, Salmonella enterica enterica serovar Typhi
ucggcagcgccag

SEQ ID NO: 3627211 - RNA, 19 nt, Salmonella enterica enterica serovar Typhi
ucggcagcgccagugacgc

SEQ ID NO: 3627212 - RNA, 12 nt, Salmonella enterica enterica serovar Typhi
ucggcagcgcga

SEQ ID NO: 3627213 - RNA, 17 nt, Salmonella enterica enterica serovar Typhi
ucggcagcuuccagcaa

SEQ ID NO: 3627214 - RNA, 11 nt, Salmonella enterica enterica serovar Typhi
ucggcaggccg

SEQ ID NO: 3627215 - RNA, 16 nt, Salmonella enterica enterica serovar Typhi
ucggcagucacuuuca

SEQ ID NO: 3627216 - RNA, 21 nt, Salmonella enterica enterica serovar Typhi
ucggcauacaccgccagcguc

SEQ ID NO: 3627217 - RNA, 23 nt, Salmonella enterica enterica serovar Typhi
ucggcauacaccgccagcgucug

SEQ ID NO: 3627218 - RNA, 20 nt, Salmonella enterica enterica serovar Typhi
ucggcauagcgggagauuga

SEQ ID NO: 3627219 - RNA, 21 nt, Salmonella enterica enterica serovar Typhi
ucggcaucgggauuuacaacc

SEQ ID NO: 3627220 - RNA, 18 nt, Salmonella enterica enterica serovar Typhi
ucggcaucuguagcggcg

SEQ ID NO: 3627221 - RNA, 16 nt, Salmonella enterica enterica serovar Typhi
ucggcaugccacuggg

SEQ ID NO: 3627222 - RNA, 18 nt, Salmonella enterica enterica serovar Typhi
ucggccaaccgccacaau

SEQ ID NO: 3627223 - RNA, 17 nt, Salmonella enterica enterica serovar Typhi
ucggccacgggcgcguu

SEQ ID NO: 3627224 - RNA, 20 nt, Salmonella enterica enterica serovar Typhi
ucggccacguccguuacccc

SEQ ID NO: 3627225 - RNA, 17 nt, Salmonella enterica enterica serovar Typhi
ucggccagcaagcggcg

SEQ ID NO: 3627226 - RNA, 14 nt, Salmonella enterica enterica serovar Typhi
ucggccagcaggcg

SEQ ID NO: 3627227 - RNA, 20 nt, Salmonella enterica enterica serovar Typhi
ucggccagcgaaaaccagcg

SEQ ID NO: 3627228 - RNA, 16 nt, Salmonella enterica enterica serovar Typhi
ucggccauauccagcc

SEQ ID NO: 3627229 - RNA, 14 nt, Salmonella enterica enterica serovar Typhi
ucggccauuuuuuu

SEQ ID NO: 3627230 - RNA, 17 nt, Salmonella enterica enterica serovar Typhi
ucggcgacgucccggca

SEQ ID NO: 3627231 - RNA, 22 nt, Salmonella enterica enterica serovar Typhi
ucggcgacguccguuagcuggc

SEQ ID NO: 3627232 - RNA, 20 nt, Salmonella enterica enterica serovar Typhi
ucggcgacuggaacaggcca

SEQ ID NO: 3627233 - RNA, 13 nt, Salmonella enterica enterica serovar Typhi
ucggcgauaaacc

SEQ ID NO: 3627234 - RNA, 18 nt, Salmonella enterica enterica serovar Typhi
ucggcgauuuccagcgcc

SEQ ID NO: 3627235 - RNA, 17 nt, Salmonella enterica enterica serovar Typhi
ucggcgccagccacaag

SEQ ID NO: 3627236 - RNA, 23 nt, Salmonella enterica enterica serovar Typhi
ucggcgcgaaacaggucggcaug

SEQ ID NO: 3627237 - RNA, 13 nt, Salmonella enterica enterica serovar Typhi
ucggcgcgcuggc

SEQ ID NO: 3627238 - RNA, 17 nt, Salmonella enterica enterica serovar Typhi
ucggcggucgcggcaau

SEQ ID NO: 3627239 - RNA, 18 nt, Salmonella enterica enterica serovar Typhi
ucggcguaacccagugca

SEQ ID NO: 3627240 - RNA, 19 nt, Salmonella enterica enterica serovar Typhi
ucggcguaacccagugcaa

SEQ ID NO: 3627241 - RNA, 20 nt, Salmonella enterica enterica serovar Typhi
ucggcgucaacguuuuucag

SEQ ID NO: 3627242 - RNA, 18 nt, Salmonella enterica enterica serovar Typhi
ucggcgucgcgaauaauu

SEQ ID NO: 3627243 - RNA, 18 nt, Salmonella enterica enterica serovar Typhi
ucggcgucugcgcgcugg

SEQ ID NO: 3627244 - RNA, 13 nt, Salmonella enterica enterica serovar Typhi
ucggcgucuggag

SEQ ID NO: 3627245 - RNA, 17 nt, Salmonella enterica enterica serovar Typhi
ucggcuaguaauaccag

SEQ ID NO: 3627246 - RNA, 22 nt, Salmonella enterica enterica serovar Typhi
ucggcuggcauuuuuauuuaac

SEQ ID NO: 3627247 - RNA, 16 nt, Salmonella enterica enterica serovar Typhi
ucggcuucucccaaca

SEQ ID NO: 3627248 - RNA, 14 nt, Salmonella enterica enterica serovar Typhi
ucggcuuucaccuu

SEQ ID NO: 3627249 - RNA, 23 nt, Salmonella enterica enterica serovar Typhi
ucggcuuuguaucagcauuuaca

SEQ ID NO: 3627250 - RNA, 18 nt, Salmonella enterica enterica serovar Typhi
ucggcuuuuguucccgca

SEQ ID NO: 3627251 - RNA, 14 nt, Salmonella enterica enterica serovar Typhi
ucggcuuuuuucaa

SEQ ID NO: 3627252 - RNA, 23 nt, Salmonella enterica enterica serovar Typhi
ucggcuuuuuuuuaugccucuua

SEQ ID NO: 3627253 - RNA, 19 nt, Salmonella enterica enterica serovar Typhi
ucgggagcagugauuaugc

SEQ ID NO: 3627254 - RNA, 18 nt, Salmonella enterica enterica serovar Typhi
ucgggauauaugcaaaac

SEQ ID NO: 3627255 - RNA, 20 nt, Salmonella enterica enterica serovar Typhi
ucgggaugcauaaaaaaacg

SEQ ID NO: 3627256 - RNA, 20 nt, Salmonella enterica enterica serovar Typhi
ucgggauguggugcggcuua

SEQ ID NO: 3627257 - RNA, 23 nt, Salmonella enterica enterica serovar Typhi
ucgggauugccgccgcgcuggug

SEQ ID NO: 3627258 - RNA, 22 nt, Salmonella enterica enterica serovar Typhi
ucgggcaauccauuaauggcgc

SEQ ID NO: 3627259 - RNA, 16 nt, Salmonella enterica enterica serovar Typhi
ucgggcagacuuucug

SEQ ID NO: 3627260 - RNA, 23 nt, Salmonella enterica enterica serovar Typhi
ucgggcaggcuuccacgcacgcc

SEQ ID NO: 3627261 - RNA, 19 nt, Salmonella enterica enterica serovar Typhi
ucgggcagggaugacagaa

SEQ ID NO: 3627262 - RNA, 19 nt, Salmonella enterica enterica serovar Typhi
ucgggccagcucuuuucug

SEQ ID NO: 3627263 - RNA, 18 nt, Salmonella enterica enterica serovar Typhi
ucggggauucgccagcgu

SEQ ID NO: 3627264 - RNA, 17 nt, Salmonella enterica enterica serovar Typhi
ucggguaaagguuugcu

SEQ ID NO: 3627265 - RNA, 22 nt, Salmonella enterica enterica serovar Typhi
ucggguaaggcguagccgccac

SEQ ID NO: 3627266 - RNA, 17 nt, Salmonella enterica enterica serovar Typhi
ucgggucgaauuccagu

SEQ ID NO: 3627267 - RNA, 19 nt, Salmonella enterica enterica serovar Typhi
ucgggugauaaaauaaaca

SEQ ID NO: 3627268 - RNA, 13 nt, Salmonella enterica enterica serovar Typhi
ucggguuuuccug

SEQ ID NO: 3627269 - RNA, 16 nt, Salmonella enterica enterica serovar Typhi
ucggguuuuccugaau

SEQ ID NO: 3627270 - RNA, 14 nt, Salmonella enterica enterica serovar Typhi
ucgguaaagaaacc

SEQ ID NO: 3627271 - RNA, 20 nt, Salmonella enterica enterica serovar Typhi
ucgguaagucugauaacggc

SEQ ID NO: 3627272 - RNA, 15 nt, Salmonella enterica enterica serovar Typhi
ucgguaaugggcgau

SEQ ID NO: 3627273 - RNA, 22 nt, Salmonella enterica enterica serovar Typhi
ucgguauaugaaucaucagaau

SEQ ID NO: 3627274 - RNA, 15 nt, Salmonella enterica enterica serovar Typhi
ucggucaguuugccc

SEQ ID NO: 3627275 - RNA, 22 nt, Salmonella enterica enterica serovar Typhi
ucggucaucagggcguaagcgc

SEQ ID NO: 3627276 - RNA, 17 nt, Salmonella enterica enterica serovar Typhi
ucggucgagcuuuugcu

SEQ ID NO: 3627277 - RNA, 15 nt, Salmonella enterica enterica serovar Typhi
ucggucuuuuucgca

SEQ ID NO: 3627278 - RNA, 19 nt, Salmonella enterica enterica serovar Typhi
ucggugaagaaaaagaagc

SEQ ID NO: 3627279 - RNA, 23 nt, Salmonella enterica enterica serovar Typhi
ucggugcgguuacguccggcauu

SEQ ID NO: 3627280 - RNA, 18 nt, Salmonella enterica enterica serovar Typhi
ucgguggaaaccgcagaa

SEQ ID NO: 3627281 - RNA, 15 nt, Salmonella enterica enterica serovar Typhi
ucgguggauaaauuu

SEQ ID NO: 3627282 - RNA, 23 nt, Salmonella enterica enterica serovar Typhi
ucgguguucacaauuguggucgu

SEQ ID NO: 3627283 - RNA, 15 nt, Salmonella enterica enterica serovar Typhi
ucgguuaauugccgg

SEQ ID NO: 3627284 - RNA, 12 nt, Salmonella enterica enterica serovar Typhi
ucgguugaacca

SEQ ID NO: 3627285 - RNA, 23 nt, Salmonella enterica enterica serovar Typhi
ucgguuucgcggcguucauggca

SEQ ID NO: 3627286 - RNA, 20 nt, Salmonella enterica enterica serovar Typhi
ucguaaacacgacgccgccg

SEQ ID NO: 3627287 - RNA, 17 nt, Salmonella enterica enterica serovar Typhi
ucguaacaggucacgac

SEQ ID NO: 3627288 - RNA, 22 nt, Salmonella enterica enterica serovar Typhi
ucguaacgcauauccagcagau

SEQ ID NO: 3627289 - RNA, 22 nt, Salmonella enterica enterica serovar Typhi
ucguaagccgcauuacaaacag

SEQ ID NO: 3627290 - RNA, 16 nt, Salmonella enterica enterica serovar Typhi
ucguaaucuaaaauua

SEQ ID NO: 3627291 - RNA, 20 nt, Salmonella enterica enterica serovar Typhi
ucguaccgcguuuaacgcag

SEQ ID NO: 3627292 - RNA, 11 nt, Salmonella enterica enterica serovar Typhi
ucguaccuuca

SEQ ID NO: 3627293 - RNA, 18 nt, Salmonella enterica enterica serovar Typhi
ucguacgccuaaaugaac

SEQ ID NO: 3627294 - RNA, 14 nt, Salmonella enterica enterica serovar Typhi
ucguacguuuuucc

SEQ ID NO: 3627295 - RNA, 14 nt, Salmonella enterica enterica serovar Typhi
ucguagaacaccac

SEQ ID NO: 3627296 - RNA, 15 nt, Salmonella enterica enterica serovar Typhi
ucguagacucaggcg

SEQ ID NO: 3627297 - RNA, 16 nt, Salmonella enterica enterica serovar Typhi
ucguagccaccaucuu

SEQ ID NO: 3627298 - RNA, 18 nt, Salmonella enterica enterica serovar Typhi
ucguagccaccaucuuuu

SEQ ID NO: 3627299 - RNA, 15 nt, Salmonella enterica enterica serovar Typhi
ucguagccgcgcgcc

SEQ ID NO: 3627300 - RNA, 21 nt, Salmonella enterica enterica serovar Typhi
ucguagcgaauaaucccggcg

SEQ ID NO: 3627301 - RNA, 15 nt, Salmonella enterica enterica serovar Typhi
ucguauccccagucu

SEQ ID NO: 3627302 - RNA, 20 nt, Salmonella enterica enterica serovar Typhi
ucguauccccagucuuccug

SEQ ID NO: 3627303 - RNA, 12 nt, Salmonella enterica enterica serovar Typhi
ucguauuauugg

SEQ ID NO: 3627304 - RNA, 14 nt, Salmonella enterica enterica serovar Typhi
ucguauuauuggug

SEQ ID NO: 3627305 - RNA, 19 nt, Salmonella enterica enterica serovar Typhi
ucguauuggggaucgggca

SEQ ID NO: 3627306 - RNA, 21 nt, Salmonella enterica enterica serovar Typhi
ucgucaaacaguucagacacc

SEQ ID NO: 3627307 - RNA, 19 nt, Salmonella enterica enterica serovar Typhi
ucgucaaugugaauccagg

SEQ ID NO: 3627308 - RNA, 22 nt, Salmonella enterica enterica serovar Typhi
ucgucacaauaugguuauccag

SEQ ID NO: 3627309 - RNA, 13 nt, Salmonella enterica enterica serovar Typhi
ucgucacagaccc

SEQ ID NO: 3627310 - RNA, 12 nt, Salmonella enterica enterica serovar Typhi
ucgucaccagca

SEQ ID NO: 3627311 - RNA, 19 nt, Salmonella enterica enterica serovar Typhi
ucgucaccggaucgcugag

SEQ ID NO: 3627312 - RNA, 21 nt, Salmonella enterica enterica serovar Typhi
ucgucacgacggcgaccggca

SEQ ID NO: 3627313 - RNA, 21 nt, Salmonella enterica enterica serovar Typhi
ucgucagacggacaucagagg

SEQ ID NO: 3627314 - RNA, 21 nt, Salmonella enterica enterica serovar Typhi
ucgucaggccgccgcaaaagc

SEQ ID NO: 3627315 - RNA, 12 nt, Salmonella enterica enterica serovar Typhi
ucgucaguucca

SEQ ID NO: 3627316 - RNA, 20 nt, Salmonella enterica enterica serovar Typhi
ucgucauaaauacacgaggc

SEQ ID NO: 3627317 - RNA, 21 nt, Salmonella enterica enterica serovar Typhi
ucgucauagcguugauaugcu

SEQ ID NO: 3627318 - RNA, 23 nt, Salmonella enterica enterica serovar Typhi
ucgucauagugagcgacuucaaa

SEQ ID NO: 3627319 - RNA, 13 nt, Salmonella enterica enterica serovar Typhi
ucgucauggcgua

SEQ ID NO: 3627320 - RNA, 19 nt, Salmonella enterica enterica serovar Typhi
ucgucauuaacgggaaacu

SEQ ID NO: 3627321 - RNA, 15 nt, Salmonella enterica enterica serovar Typhi
ucgucauuaaugccu

SEQ ID NO: 3627322 - RNA, 13 nt, Salmonella enterica enterica serovar Typhi
ucuaucaccgccu

SEQ ID NO: 3627323 - RNA, 14 nt, Salmonella enterica enterica serovar Typhi
ucuaucaccgccuc

SEQ ID NO: 3627324 - RNA, 21 nt, Salmonella enterica enterica serovar Typhi
ucuauccacuggguaaggcgc

SEQ ID NO: 3627325 - RNA, 23 nt, Salmonella enterica enterica serovar Typhi
ucuaucgccagcgcguuuuccau

SEQ ID NO: 3627326 - RNA, 14 nt, Salmonella enterica enterica serovar Typhi
ucuaucgccuggag

SEQ ID NO: 3627327 - RNA, 17 nt, Salmonella enterica enterica serovar Typhi
ucuaugaaugccggaug

SEQ ID NO: 3627328 - RNA, 13 nt, Salmonella enterica enterica serovar Typhi
ucuaugcaaaaga

SEQ ID NO: 3627329 - RNA, 14 nt, Salmonella enterica enterica serovar Typhi
ucuaugcgcuaugu

SEQ ID NO: 3627330 - RNA, 11 nt, Salmonella enterica enterica serovar Typhi
ucuauuauuga

SEQ ID NO: 3627331 - RNA, 12 nt, Salmonella enterica enterica serovar Typhi
uaggccggauaa

SEQ ID NO: 3627332 - RNA, 18 nt, Salmonella enterica enterica serovar Typhi
uaggccggauaagcaacg

SEQ ID NO: 3627333 - RNA, 17 nt, Salmonella enterica enterica serovar Typhi
uaggccggauaagcggc

SEQ ID NO: 3627334 - RNA, 20 nt, Salmonella enterica enterica serovar Typhi
uaggccggauaagcggcagc

SEQ ID NO: 3627335 - RNA, 20 nt, Salmonella enterica enterica serovar Typhi
uaggccggauaaggcauuca

SEQ ID NO: 3627336 - RNA, 20 nt, Salmonella enterica enterica serovar Typhi
uaggccggauaaggcgcagc

SEQ ID NO: 3627337 - RNA, 21 nt, Salmonella enterica enterica serovar Typhi
uaggccggauaaggcgcuagc

SEQ ID NO: 3627338 - RNA, 19 nt, Salmonella enterica enterica serovar Typhi
uaggccggauaaggcguua

SEQ ID NO: 3627339 - RNA, 17 nt, Salmonella enterica enterica serovar Typhi
uaggccggaugagcguu

SEQ ID NO: 3627340 - RNA, 22 nt, Salmonella enterica enterica serovar Typhi
uaggccugauaagcgcagcgcc

SEQ ID NO: 3627341 - RNA, 18 nt, Salmonella enterica enterica serovar Typhi
uaggccugauaagcguag

SEQ ID NO: 3627342 - RNA, 18 nt, Salmonella enterica enterica serovar Typhi
uaggccugguaagcguag

SEQ ID NO: 3627343 - RNA, 17 nt, Salmonella enterica enterica serovar Typhi
uaggcgaggaaaacauu

SEQ ID NO: 3627344 - RNA, 15 nt, Salmonella enterica enterica serovar Typhi
uaggcgccgccgaca

SEQ ID NO: 3627345 - RNA, 13 nt, Salmonella enterica enterica serovar Typhi
uaggcgcgaaaug

SEQ ID NO: 3627346 - RNA, 19 nt, Salmonella enterica enterica serovar Typhi
uaggcguugaacauuucau

SEQ ID NO: 3627347 - RNA, 18 nt, Salmonella enterica enterica serovar Typhi
uaggcuauaaaaaucauc

SEQ ID NO: 3627348 - RNA, 14 nt, Salmonella enterica enterica serovar Typhi
uagggacaucggag

SEQ ID NO: 3627349 - RNA, 13 nt, Salmonella enterica enterica serovar Typhi
uagggcaucagac

SEQ ID NO: 3627350 - RNA, 21 nt, Salmonella enterica enterica serovar Typhi
uagguaagauauuuuguuuua

SEQ ID NO: 3627351 - RNA, 22 nt, Salmonella enterica enterica serovar Typhi
uagguacggggcaucuauuuaa

SEQ ID NO: 3627352 - RNA, 14 nt, Salmonella enterica enterica serovar Typhi
uagguauccagcag

SEQ ID NO: 3627353 - RNA, 23 nt, Salmonella enterica enterica serovar Typhi
uagguuaaauagcaggcaaugau

SEQ ID NO: 3627354 - RNA, 22 nt, Salmonella enterica enterica serovar Typhi
uagguucgguaugccuuccaga

SEQ ID NO: 3627355 - RNA, 21 nt, Salmonella enterica enterica serovar Typhi
uaguaaaccgguugcuccguu

SEQ ID NO: 3627356 - RNA, 18 nt, Salmonella enterica enterica serovar Typhi
uaguaaagaaauuuugca

SEQ ID NO: 3627357 - RNA, 16 nt, Salmonella enterica enterica serovar Typhi
uaguaaauagaaaaua

SEQ ID NO: 3627358 - RNA, 11 nt, Salmonella enterica enterica serovar Typhi
uaguaaauagg

SEQ ID NO: 3627359 - RNA, 16 nt, Salmonella enterica enterica serovar Typhi
uaguaauaaagcguag

SEQ ID NO: 3627360 - RNA, 15 nt, Salmonella enterica enterica serovar Typhi
uaguaaucaggcgag

SEQ ID NO: 3627361 - RNA, 15 nt, Salmonella enterica enterica serovar Typhi
uaguaaucauacgcg

SEQ ID NO: 3627362 - RNA, 15 nt, Salmonella enterica enterica serovar Typhi
uaguaaugcaugguc

SEQ ID NO: 3627363 - RNA, 22 nt, Salmonella enterica enterica serovar Typhi
uaguacccucugcaccagaacu

SEQ ID NO: 3627364 - RNA, 19 nt, Salmonella enterica enterica serovar Typhi
uaguaccgaacagccaggc

SEQ ID NO: 3627365 - RNA, 16 nt, Salmonella enterica enterica serovar Typhi
uaguacgcgcgccggu

SEQ ID NO: 3627366 - RNA, 23 nt, Salmonella enterica enterica serovar Typhi
uaguacguuccagcguuuccgga

SEQ ID NO: 3627367 - RNA, 22 nt, Salmonella enterica enterica serovar Typhi
uaguauccccggcaaccuuaaa

SEQ ID NO: 3627368 - RNA, 22 nt, Salmonella enterica enterica serovar Typhi
uaguaucgcucuauauccugcc

SEQ ID NO: 3627369 - RNA, 13 nt, Salmonella enterica enterica serovar Typhi
uagucaaauugaa

SEQ ID NO: 3627370 - RNA, 22 nt, Salmonella enterica enterica serovar Typhi
uagucaggaucgcuggcgcguu

SEQ ID NO: 3627371 - RNA, 24 nt, Salmonella enterica enterica serovar Typhi
uagucaggaucgcuggcgcguuca

SEQ ID NO: 3627372 - RNA, 16 nt, Salmonella enterica enterica serovar Typhi
uagucauaauuaaaaa

SEQ ID NO: 3627373 - RNA, 16 nt, Salmonella enterica enterica serovar Typhi
uagucauauuaucgcg

SEQ ID NO: 3627374 - RNA, 20 nt, Salmonella enterica enterica serovar Typhi
uagucaucgccuucauccgc

SEQ ID NO: 3627375 - RNA, 17 nt, Salmonella enterica enterica serovar Typhi
uagucauugacagcaag

SEQ ID NO: 3627376 - RNA, 11 nt, Salmonella enterica enterica serovar Typhi
uaguccagcau

SEQ ID NO: 3627377 - RNA, 21 nt, Salmonella enterica enterica serovar Typhi
uagucccuccgcuuccacucu

SEQ ID NO: 3627378 - RNA, 20 nt, Salmonella enterica enterica serovar Typhi
uaguccgccagcaccugaua

SEQ ID NO: 3627379 - RNA, 21 nt, Salmonella enterica enterica serovar Typhi
uaguccucagcgaauaucucu

SEQ ID NO: 3627380 - RNA, 22 nt, Salmonella enterica enterica serovar Typhi
uaguccucgcgcgggaaaucgu

SEQ ID NO: 3627381 - RNA, 23 nt, Salmonella enterica enterica serovar Typhi
uagucgauggucucguugccauu

SEQ ID NO: 3627382 - RNA, 15 nt, Salmonella enterica enterica serovar Typhi
uagucgucuauuucc

SEQ ID NO: 3627383 - RNA, 13 nt, Salmonella enterica enterica serovar Typhi
uagucguugcgcc

SEQ ID NO: 3627384 - RNA, 17 nt, Salmonella enterica enterica serovar Typhi
uagucucccuccugcuc

SEQ ID NO: 3627385 - RNA, 22 nt, Salmonella enterica enterica serovar Typhi
uagucuuaauuugcuguuuuuu

SEQ ID NO: 3627386 - RNA, 23 nt, Salmonella enterica enterica serovar Typhi
uagucuuguuacucaauaaaagu

SEQ ID NO: 3627387 - RNA, 22 nt, Salmonella enterica enterica serovar Typhi
uagugcaggaaggcgugcagcg

SEQ ID NO: 3627388 - RNA, 19 nt, Salmonella enterica enterica serovar Typhi
uagugcaggcgcggucugg

SEQ ID NO: 3627389 - RNA, 15 nt, Salmonella enterica enterica serovar Typhi
uagugcgauaugugg

SEQ ID NO: 3627390 - RNA, 20 nt, Salmonella enterica enterica serovar Typhi
uagugcuucucuucaaacuc

SEQ ID NO: 3627391 - RNA, 14 nt, Salmonella enterica enterica serovar Typhi
uaguggauggccca

SEQ ID NO: 3627392 - RNA, 17 nt, Salmonella enterica enterica serovar Typhi
uaguguucgcggcuggu

SEQ ID NO: 3627393 - RNA, 11 nt, Salmonella enterica enterica serovar Typhi
uaguuaaaaaa

SEQ ID NO: 3627394 - RNA, 15 nt, Salmonella enterica enterica serovar Typhi
uaguuauaaauuuau

SEQ ID NO: 3627395 - RNA, 21 nt, Salmonella enterica enterica serovar Typhi
uaguuauaaauuuauuuuuug

SEQ ID NO: 3627396 - RNA, 21 nt, Salmonella enterica enterica serovar Typhi
uaguuaucacguuccuuuacu

SEQ ID NO: 3627397 - RNA, 20 nt, Salmonella enterica enterica serovar Typhi
uaguucaaguuuagaaaaaa

SEQ ID NO: 3627398 - RNA, 23 nt, Salmonella enterica enterica serovar Typhi
uaguucagcgcagagugaccagc

SEQ ID NO: 3627399 - RNA, 22 nt, Salmonella enterica enterica serovar Typhi
uaguugacgccccauguggcca

SEQ ID NO: 3627400 - RNA, 18 nt, Salmonella enterica enterica serovar Typhi
uaguuggcggugaggcug

SEQ ID NO: 3627401 - RNA, 22 nt, Salmonella enterica enterica serovar Typhi
uaguugucggcggucgcggcaa

SEQ ID NO: 3627402 - RNA, 12 nt, Salmonella enterica enterica serovar Typhi
uaguuguuuuau

SEQ ID NO: 3627403 - RNA, 21 nt, Salmonella enterica enterica serovar Typhi
uaguuuagcgagcguucugca

SEQ ID NO: 3627404 - RNA, 14 nt, Salmonella enterica enterica serovar Typhi
uaguuucaccuucu

SEQ ID NO: 3627405 - RNA, 21 nt, Salmonella enterica enterica serovar Typhi
uaguuucuggccucuuaucag

SEQ ID NO: 3627406 - RNA, 18 nt, Salmonella enterica enterica serovar Typhi
uauaaaaaacauauaauu

SEQ ID NO: 3627407 - RNA, 22 nt, Salmonella enterica enterica serovar Typhi
uauaaaaaccgacgaaagauaa

SEQ ID NO: 3627408 - RNA, 18 nt, Salmonella enterica enterica serovar Typhi
uauaaaaauagcuggcug

SEQ ID NO: 3627409 - RNA, 22 nt, Salmonella enterica enterica serovar Typhi
uauaaaacgggccacugcuggc

SEQ ID NO: 3627410 - RNA, 14 nt, Salmonella enterica enterica serovar Typhi
uauaaaauauuugg

SEQ ID NO: 3627411 - RNA, 20 nt, Salmonella enterica enterica serovar Typhi
uauaaauaaccgguaacugu

SEQ ID NO: 3627412 - RNA, 12 nt, Salmonella enterica enterica serovar Typhi
uauaaauaucau

SEQ ID NO: 3627413 - RNA, 19 nt, Salmonella enterica enterica serovar Typhi
uauaaauauuaaugaauaa

SEQ ID NO: 3627414 - RNA, 21 nt, Salmonella enterica enterica serovar Typhi
uauaaauauuaaugaauaaau

SEQ ID NO: 3627415 - RNA, 14 nt, Salmonella enterica enterica serovar Typhi
uaucacugguuaua

SEQ ID NO: 3627416 - RNA, 15 nt, Salmonella enterica enterica serovar Typhi
uaucagacaaucugu

SEQ ID NO: 3627417 - RNA, 14 nt, Salmonella enterica enterica serovar Typhi
uaucagaccgacaa

SEQ ID NO: 3627418 - RNA, 13 nt, Salmonella enterica enterica serovar Typhi
uaucagacucagg

SEQ ID NO: 3627419 - RNA, 19 nt, Salmonella enterica enterica serovar Typhi
uaucagccauuaaccagau

SEQ ID NO: 3627420 - RNA, 18 nt, Salmonella enterica enterica serovar Typhi
uaucagcgcguuuuccau

SEQ ID NO: 3627421 - RNA, 19 nt, Salmonella enterica enterica serovar Typhi
uaucagcguccggagcagc

SEQ ID NO: 3627422 - RNA, 14 nt, Salmonella enterica enterica serovar Typhi
uaucagcuugccgu

SEQ ID NO: 3627423 - RNA, 20 nt, Salmonella enterica enterica serovar Typhi
uaucaggaucaaaaucgcgc

SEQ ID NO: 3627424 - RNA, 18 nt, Salmonella enterica enterica serovar Typhi
uaucaggccgacaaauga

SEQ ID NO: 3627425 - RNA, 17 nt, Salmonella enterica enterica serovar Typhi
uaucaggccuacaaggc

SEQ ID NO: 3627426 - RNA, 14 nt, Salmonella enterica enterica serovar Typhi
uaucaggccuacac

SEQ ID NO: 3627427 - RNA, 17 nt, Salmonella enterica enterica serovar Typhi
uaucaggccuaccaguc

SEQ ID NO: 3627428 - RNA, 23 nt, Salmonella enterica enterica serovar Typhi
uaucaguccccacauuacgccca

SEQ ID NO: 3627429 - RNA, 16 nt, Salmonella enterica enterica serovar Typhi
uaucauagugccggug

SEQ ID NO: 3627430 - RNA, 16 nt, Salmonella enterica enterica serovar Typhi
uaucaugcugcgguua

SEQ ID NO: 3627431 - RNA, 20 nt, Salmonella enterica enterica serovar Typhi
uaucaugugaucuauauauu

SEQ ID NO: 3627432 - RNA, 15 nt, Salmonella enterica enterica serovar Typhi
uaucauuaucgccaa

SEQ ID NO: 3627433 - RNA, 17 nt, Salmonella enterica enterica serovar Typhi
uaucauuaugggcagca

SEQ ID NO: 3627434 - RNA, 12 nt, Salmonella enterica enterica serovar Typhi
uaucauuuccac

SEQ ID NO: 3627435 - RNA, 13 nt, Salmonella enterica enterica serovar Typhi
uaucauuuccaca

SEQ ID NO: 3627436 - RNA, 12 nt, Salmonella enterica enterica serovar Typhi
uauccacccggu

SEQ ID NO: 3627437 - RNA, 22 nt, Salmonella enterica enterica serovar Typhi
uauccacugucgggcaaaaugc

SEQ ID NO: 3627438 - RNA, 16 nt, Salmonella enterica enterica serovar Typhi
uauccagcaguaaaua

SEQ ID NO: 3627439 - RNA, 18 nt, Salmonella enterica enterica serovar Typhi
uauccagcgcccgcuuca

SEQ ID NO: 3627440 - RNA, 20 nt, Salmonella enterica enterica serovar Typhi
uauccagcgcguaaauaccu

SEQ ID NO: 3627441 - RNA, 17 nt, Salmonella enterica enterica serovar Typhi
uauccagcggcaaaggc

SEQ ID NO: 3627442 - RNA, 17 nt, Salmonella enterica enterica serovar Typhi
uauccaggccagcuccg

SEQ ID NO: 3627443 - RNA, 19 nt, Salmonella enterica enterica serovar Typhi
uauccagucagcguuacug

SEQ ID NO: 3627444 - RNA, 14 nt, Salmonella enterica enterica serovar Typhi
uauccaguugcgcc

SEQ ID NO: 3627445 - RNA, 13 nt, Salmonella enterica enterica serovar Typhi
uauccaguuucug

SEQ ID NO: 3627446 - RNA, 19 nt, Salmonella enterica enterica serovar Typhi
uauccaguuucugacguaa

SEQ ID NO: 3627447 - RNA, 16 nt, Salmonella enterica enterica serovar Typhi
uauccauaauuuuccc

SEQ ID NO: 3627448 - RNA, 18 nt, Salmonella enterica enterica serovar Typhi
uaucccaaacgucguaaa

SEQ ID NO: 3627449 - RNA, 18 nt, Salmonella enterica enterica serovar Typhi
uauccccagucuuccugc

SEQ ID NO: 3627450 - RNA, 22 nt, Salmonella enterica enterica serovar Typhi
uauccccgcuggcgcggggauc

SEQ ID NO: 3627451 - RNA, 17 nt, Salmonella enterica enterica serovar Typhi
uaucccgcccgaucuca

SEQ ID NO: 3627452 - RNA, 13 nt, Salmonella enterica enterica serovar Typhi
uaucccgguauuc

SEQ ID NO: 3627453 - RNA, 20 nt, Salmonella enterica enterica serovar Typhi
uaucccuuccucauuuuugc

SEQ ID NO: 3627454 - RNA, 15 nt, Salmonella enterica enterica serovar Typhi
uauccgcaacugaaa

SEQ ID NO: 3627455 - RNA, 14 nt, Salmonella enterica enterica serovar Typhi
uauccgcauucuaa

SEQ ID NO: 3627456 - RNA, 18 nt, Salmonella enterica enterica serovar Typhi
uauccgccagcgcaacgc

SEQ ID NO: 3627457 - RNA, 16 nt, Salmonella enterica enterica serovar Typhi
uauccgccgcaaauuc

SEQ ID NO: 3627458 - RNA, 20 nt, Salmonella enterica enterica serovar Typhi
uauccgcgaguguaaagauu

SEQ ID NO: 3627459 - RNA, 18 nt, Salmonella enterica enterica serovar Typhi
uauccgcuauuaccagua

SEQ ID NO: 3627460 - RNA, 20 nt, Salmonella enterica enterica serovar Typhi
uauccggccuauagcuaaug

SEQ ID NO: 3627461 - RNA, 17 nt, Salmonella enterica enterica serovar Typhi
uauccggccugcaggca

SEQ ID NO: 3627462 - RNA, 21 nt, Salmonella enterica enterica serovar Typhi
uauccgugcgcaauuccagca

SEQ ID NO: 3627463 - RNA, 19 nt, Salmonella enterica enterica serovar Typhi
uauccguuauuuaauucuu

SEQ ID NO: 3627464 - RNA, 15 nt, Salmonella enterica enterica serovar Typhi
uauccugcccuuuac

SEQ ID NO: 3627465 - RNA, 14 nt, Salmonella enterica enterica serovar Typhi
uauccugcuugccu

SEQ ID NO: 3627466 - RNA, 15 nt, Salmonella enterica enterica serovar Typhi
uauccuggcagucca

SEQ ID NO: 3627467 - RNA, 12 nt, Salmonella enterica enterica serovar Typhi
uauccuggccug

SEQ ID NO: 3627468 - RNA, 17 nt, Salmonella enterica enterica serovar Typhi
uauccuggccugauaag

SEQ ID NO: 3627469 - RNA, 19 nt, Salmonella enterica enterica serovar Typhi
uauccuggcgcguagaucu

SEQ ID NO: 3627470 - RNA, 18 nt, Salmonella enterica enterica serovar Typhi
uauccuguaacucaucug

SEQ ID NO: 3627471 - RNA, 12 nt, Salmonella enterica enterica serovar Typhi
uauccuuaucag

SEQ ID NO: 3627472 - RNA, 18 nt, Salmonella enterica enterica serovar Typhi
uauccuuaucagacucag

SEQ ID NO: 3627473 - RNA, 14 nt, Salmonella enterica enterica serovar Typhi
uaucgaaagagcaa

SEQ ID NO: 3627474 - RNA, 22 nt, Salmonella enterica enterica serovar Typhi
uaucgaauggggaaauaaauau

SEQ ID NO: 3627475 - RNA, 18 nt, Salmonella enterica enterica serovar Typhi
uaucgacgcuauuuuuca

SEQ ID NO: 3627476 - RNA, 13 nt, Salmonella enterica enterica serovar Typhi
uaucgauaaucaa

SEQ ID NO: 3627477 - RNA, 17 nt, Salmonella enterica enterica serovar Typhi
uaucgccaagcgguaag

SEQ ID NO: 3627478 - RNA, 17 nt, Salmonella enterica enterica serovar Typhi
uaucgccauauacgcca

SEQ ID NO: 3627479 - RNA, 14 nt, Salmonella enterica enterica serovar Typhi
uaucgccauuauuc

SEQ ID NO: 3627480 - RNA, 24 nt, Salmonella enterica enterica serovar Typhi
uaucgccggcagacgauagcgggu

SEQ ID NO: 3627481 - RNA, 19 nt, Salmonella enterica enterica serovar Typhi
uaucgccguucaaacggua

SEQ ID NO: 3627482 - RNA, 14 nt, Salmonella enterica enterica serovar Typhi
uaucgccucccugc

SEQ ID NO: 3627483 - RNA, 10 nt, Salmonella enterica enterica serovar Typhi
uaucgcuauc

SEQ ID NO: 3627484 - RNA, 22 nt, Salmonella enterica enterica serovar Typhi
uaucgcugcuaaacgagccguc

SEQ ID NO: 3627485 - RNA, 17 nt, Salmonella enterica enterica serovar Typhi
uaucgcugucggucaga

SEQ ID NO: 3627486 - RNA, 21 nt, Salmonella enterica enterica serovar Typhi
uaucgcugucggucagauuca

SEQ ID NO: 3627487 - RNA, 16 nt, Salmonella enterica enterica serovar Typhi
uaucgcuuggcguuaa

SEQ ID NO: 3627488 - RNA, 23 nt, Salmonella enterica enterica serovar Typhi
uaucggcguguuucaucucauca

SEQ ID NO: 3627489 - RNA, 14 nt, Salmonella enterica enterica serovar Typhi
uaucgguaagcgcc

SEQ ID NO: 3627490 - RNA, 13 nt, Salmonella enterica enterica serovar Typhi
uaucgucaauacg

SEQ ID NO: 3627491 - RNA, 17 nt, Salmonella enterica enterica serovar Typhi
uaucguuuacguuauca

SEQ ID NO: 3627492 - RNA, 22 nt, Salmonella enterica enterica serovar Typhi
uaucuauuucuuagcgccagca

SEQ ID NO: 3627493 - RNA, 17 nt, Salmonella enterica enterica serovar Typhi
uaucucacggaaugacu

SEQ ID NO: 3627494 - RNA, 14 nt, Salmonella enterica enterica serovar Typhi
uaucucuauugcuu

SEQ ID NO: 3627495 - RNA, 20 nt, Salmonella enterica enterica serovar Typhi
uaucucuauugcuuauuaga

SEQ ID NO: 3627496 - RNA, 22 nt, Salmonella enterica enterica serovar Typhi
uaucugaaaguaagcuauuccu

SEQ ID NO: 3627497 - RNA, 21 nt, Salmonella enterica enterica serovar Typhi
uaucugacauauacaaaccac

SEQ ID NO: 3627498 - RNA, 17 nt, Salmonella enterica enterica serovar Typhi
uaucugaccaugccagc

SEQ ID NO: 3627499 - RNA, 13 nt, Salmonella enterica enterica serovar Typhi
uaucugaccuaca

SEQ ID NO: 3627500 - RNA, 14 nt, Salmonella enterica enterica serovar Typhi
uaucugaugaacua

SEQ ID NO: 3627501 - RNA, 12 nt, Salmonella enterica enterica serovar Typhi
uaucugcccuuu

SEQ ID NO: 3627502 - RNA, 15 nt, Salmonella enterica enterica serovar Typhi
uaucugcccuuucuu

SEQ ID NO: 3627503 - RNA, 23 nt, Salmonella enterica enterica serovar Typhi
uaucugccgcgcccgccaucgcc

SEQ ID NO: 3627504 - RNA, 18 nt, Salmonella enterica enterica serovar Typhi
uaucugcuccgccagcaa

SEQ ID NO: 3627505 - RNA, 18 nt, Salmonella enterica enterica serovar Typhi
uaucuggauacccccuau

SEQ ID NO: 3627506 - RNA, 19 nt, Salmonella enterica enterica serovar Typhi
uaucuguaauuauaaauau

SEQ ID NO: 3627507 - RNA, 15 nt, Salmonella enterica enterica serovar Typhi
uaucuguaauugacg

SEQ ID NO: 3627508 - RNA, 23 nt, Salmonella enterica enterica serovar Typhi
uaucugucugcuguaauuuauaa

SEQ ID NO: 3627509 - RNA, 21 nt, Salmonella enterica enterica serovar Typhi
uaucuguugauaaaacacucu

SEQ ID NO: 3627510 - RNA, 17 nt, Salmonella enterica enterica serovar Typhi
uaucuucauguucuaac

SEQ ID NO: 3627511 - RNA, 18 nt, Salmonella enterica enterica serovar Typhi
uaucuuccacgguaaaac

SEQ ID NO: 3627512 - RNA, 14 nt, Salmonella enterica enterica serovar Typhi
uaucuuccagcgcg

SEQ ID NO: 3627513 - RNA, 17 nt, Salmonella enterica enterica serovar Typhi
uaucuucccgauaacug

SEQ ID NO: 3627514 - RNA, 21 nt, Salmonella enterica enterica serovar Typhi
uaucuucccgauaacugaagg

SEQ ID NO: 3627515 - RNA, 23 nt, Salmonella enterica enterica serovar Typhi
uaucuuccggugugaccagcgcg

SEQ ID NO: 3627516 - RNA, 20 nt, Salmonella enterica enterica serovar Typhi
uaucuucugcugcucccuca

SEQ ID NO: 3627517 - RNA, 22 nt, Salmonella enterica enterica serovar Typhi
uaucuugagucaaaagauugau

SEQ ID NO: 3627518 - RNA, 13 nt, Salmonella enterica enterica serovar Typhi
uaucuugauauca

SEQ ID NO: 3627519 - RNA, 13 nt, Salmonella enterica enterica serovar Typhi
uaucuugcuuuau

SEQ ID NO: 3627520 - RNA, 17 nt, Salmonella enterica enterica serovar Typhi
uaucuuuaugucaguaa

SEQ ID NO: 3627521 - RNA, 22 nt, Salmonella enterica enterica serovar Typhi
uaucuuuauugaaaagcagcca

SEQ ID NO: 3627522 - RNA, 14 nt, Salmonella enterica enterica serovar Typhi
uaucuuucagcgcc

SEQ ID NO: 3627523 - RNA, 13 nt, Salmonella enterica enterica serovar Typhi
uaucuuucuuuuu

SEQ ID NO: 3627524 - RNA, 20 nt, Salmonella enterica enterica serovar Typhi
uaucuuuuuuagucuccugc

SEQ ID NO: 3627525 - RNA, 22 nt, Salmonella enterica enterica serovar Typhi
uaugaaaccccaaaucagcaaa

SEQ ID NO: 3627526 - RNA, 16 nt, Salmonella enterica enterica serovar Typhi
uaugaaagccaucgcu

SEQ ID NO: 3627527 - RNA, 15 nt, Salmonella enterica enterica serovar Typhi
uaugaaauucuugcc

SEQ ID NO: 3627528 - RNA, 20 nt, Salmonella enterica enterica serovar Typhi
uaugaaauucuugcccgcug

SEQ ID NO: 3627529 - RNA, 17 nt, Salmonella enterica enterica serovar Typhi
uaugaagagaaacauac

SEQ ID NO: 3627530 - RNA, 17 nt, Salmonella enterica enterica serovar Typhi
uaugaaguuucauacgg

SEQ ID NO: 3627531 - RNA, 15 nt, Salmonella enterica enterica serovar Typhi
uaugacaacauaaag

SEQ ID NO: 3627532 - RNA, 15 nt, Salmonella enterica enterica serovar Typhi
uaugaccaauggcgc

SEQ ID NO: 3627533 - RNA, 23 nt, Salmonella enterica enterica serovar Typhi
uaugaccccuccggccagcgcca

SEQ ID NO: 3627534 - RNA, 17 nt, Salmonella enterica enterica serovar Typhi
uaugaccgagucuacau

SEQ ID NO: 3627535 - RNA, 13 nt, Salmonella enterica enterica serovar Typhi
uaugacguaagcg

SEQ ID NO: 3627536 - RNA, 15 nt, Salmonella enterica enterica serovar Typhi
uaugacguaagcggc

SEQ ID NO: 3627537 - RNA, 20 nt, Salmonella enterica enterica serovar Typhi
uaugagcgggccgucaggcc

SEQ ID NO: 3627538 - RNA, 22 nt, Salmonella enterica enterica serovar Typhi
uaugagguugucuuugcugccg

SEQ ID NO: 3627539 - RNA, 24 nt, Salmonella enterica enterica serovar Typhi
uaugauaagccugacuacgucaga

SEQ ID NO: 3627540 - RNA, 23 nt, Salmonella enterica enterica serovar Typhi
uaugauagccguucuccagcguu

SEQ ID NO: 3627541 - RNA, 20 nt, Salmonella enterica enterica serovar Typhi
uaugaucgacaaugaucaga

SEQ ID NO: 3627542 - RNA, 12 nt, Salmonella enterica enterica serovar Typhi
uaugauuuaaaa

SEQ ID NO: 3627543 - RNA, 15 nt, Salmonella enterica enterica serovar Typhi
uaugauuuuaacauc

SEQ ID NO: 3627544 - RNA, 16 nt, Salmonella enterica enterica serovar Typhi
uaugauuuucuuauua

SEQ ID NO: 3627545 - RNA, 14 nt, Salmonella enterica enterica serovar Typhi
uaugcaaaacguag

SEQ ID NO: 3627546 - RNA, 18 nt, Salmonella enterica enterica serovar Typhi
uaugcagaaauggucagc

SEQ ID NO: 3627547 - RNA, 15 nt, Salmonella enterica enterica serovar Typhi
uaugcaucgcgguca

SEQ ID NO: 3627548 - RNA, 21 nt, Salmonella enterica enterica serovar Typhi
uaugccagauauuuucggcau

SEQ ID NO: 3627549 - RNA, 18 nt, Salmonella enterica enterica serovar Typhi
uaugccccgacaucagau

SEQ ID NO: 3627550 - RNA, 21 nt, Salmonella enterica enterica serovar Typhi
uaugcccggaugauuaucauc

SEQ ID NO: 3627551 - RNA, 23 nt, Salmonella enterica enterica serovar Typhi
uaugcccggaugauuaucaucua

SEQ ID NO: 3627552 - RNA, 21 nt, Salmonella enterica enterica serovar Typhi
uaugccggauaguuacccggc

SEQ ID NO: 3627553 - RNA, 20 nt, Salmonella enterica enterica serovar Typhi
uaugccggaugacgcuaacg

SEQ ID NO: 3627554 - RNA, 21 nt, Salmonella enterica enterica serovar Typhi
uaugccugccagcauuaaccc

SEQ ID NO: 3627555 - RNA, 19 nt, Salmonella enterica enterica serovar Typhi
uaugccuggggucgucagc

SEQ ID NO: 3627556 - RNA, 19 nt, Salmonella enterica enterica serovar Typhi
uaugcgacugaaaaucaaa

SEQ ID NO: 3627557 - RNA, 21 nt, Salmonella enterica enterica serovar Typhi
uaugcgacugaaaaucaaaaa

SEQ ID NO: 3627558 - RNA, 15 nt, Salmonella enterica enterica serovar Typhi
uaugcgcauagauau

SEQ ID NO: 3627559 - RNA, 19 nt, Salmonella enterica enterica serovar Typhi
uaugcgcaugggcauaauc

SEQ ID NO: 3627560 - RNA, 12 nt, Salmonella enterica enterica serovar Typhi
uaugcgccaacu

SEQ ID NO: 3627561 - RNA, 14 nt, Salmonella enterica enterica serovar Typhi
uaugcgccuguuag

SEQ ID NO: 3627562 - RNA, 14 nt, Salmonella enterica enterica serovar Typhi
uaugcgcuuccagc

SEQ ID NO: 3627563 - RNA, 18 nt, Salmonella enterica enterica serovar Typhi
uaugcgcuuccagcauga

SEQ ID NO: 3627564 - RNA, 16 nt, Salmonella enterica enterica serovar Typhi
uaugcgcuuuuuucag

SEQ ID NO: 3627565 - RNA, 15 nt, Salmonella enterica enterica serovar Typhi
uaugcggcgccauca

SEQ ID NO: 3627566 - RNA, 19 nt, Salmonella enterica enterica serovar Typhi
uaugcgggggcaguaaauu

SEQ ID NO: 3627567 - RNA, 22 nt, Salmonella enterica enterica serovar Typhi
uaugcggucguauuaccaaccc

SEQ ID NO: 3627568 - RNA, 14 nt, Salmonella enterica enterica serovar Typhi
uaugcgguucuccc

SEQ ID NO: 3627569 - RNA, 21 nt, Salmonella enterica enterica serovar Typhi
uaugcgucaaaguugcaucaa

SEQ ID NO: 3627570 - RNA, 20 nt, Salmonella enterica enterica serovar Typhi
uaugcguuuuuaucuuucuu

SEQ ID NO: 3627571 - RNA, 20 nt, Salmonella enterica enterica serovar Typhi
uaugcucccggggauuucuu

SEQ ID NO: 3627572 - RNA, 18 nt, Salmonella enterica enterica serovar Typhi
uauggagucaugaauguc

SEQ ID NO: 3627573 - RNA, 13 nt, Salmonella enterica enterica serovar Typhi
uauggcaggcgaa

SEQ ID NO: 3627574 - RNA, 17 nt, Salmonella enterica enterica serovar Typhi
uaugggauaacgcagaa

SEQ ID NO: 3627575 - RNA, 22 nt, Salmonella enterica enterica serovar Typhi
uaugggauaacgcagaagacag

SEQ ID NO: 3627576 - RNA, 16 nt, Salmonella enterica enterica serovar Typhi
uauggguguagcucau

SEQ ID NO: 3627577 - RNA, 17 nt, Salmonella enterica enterica serovar Typhi
uauggguguagcucaua

SEQ ID NO: 3627578 - RNA, 21 nt, Salmonella enterica enterica serovar Typhi
uauggguuuccuccaucagcg

SEQ ID NO: 3627579 - RNA, 17 nt, Salmonella enterica enterica serovar Typhi
uaugguacacauauggg

SEQ ID NO: 3627580 - RNA, 17 nt, Salmonella enterica enterica serovar Typhi
uauggugaguaauaaca

SEQ ID NO: 3627581 - RNA, 19 nt, Salmonella enterica enterica serovar Typhi
uauguaauuugcaaaccau

SEQ ID NO: 3627582 - RNA, 18 nt, Salmonella enterica enterica serovar Typhi
uauguacgccaagcugca

SEQ ID NO: 3627583 - RNA, 22 nt, Salmonella enterica enterica serovar Typhi
uauguaggccugauaagguaaa

SEQ ID NO: 3627584 - RNA, 15 nt, Salmonella enterica enterica serovar Typhi
uaugugacaaucacu

SEQ ID NO: 3627585 - RNA, 23 nt, Salmonella enterica enterica serovar Typhi
uaugugacaaucacucucuugua

SEQ ID NO: 3627586 - RNA, 20 nt, Salmonella enterica enterica serovar Typhi
uauuuagccguucaugcacu

SEQ ID NO: 3627587 - RNA, 16 nt, Salmonella enterica enterica serovar Typhi
uauuuauaucaggcaa

SEQ ID NO: 3627588 - RNA, 12 nt, Salmonella enterica enterica serovar Typhi
uauuuauuuaaa

SEQ ID NO: 3627589 - RNA, 12 nt, Salmonella enterica enterica serovar Typhi
uauuuauuuaau

SEQ ID NO: 3627590 - RNA, 13 nt, Salmonella enterica enterica serovar Typhi
uauuucaguacag

SEQ ID NO: 3627591 - RNA, 17 nt, Salmonella enterica enterica serovar Typhi
uauuuccaccuucucuu

SEQ ID NO: 3627592 - RNA, 15 nt, Salmonella enterica enterica serovar Typhi
uauuuccagaaauca

SEQ ID NO: 3627593 - RNA, 17 nt, Salmonella enterica enterica serovar Typhi
uauuuccauuuuucaga

SEQ ID NO: 3627594 - RNA, 22 nt, Salmonella enterica enterica serovar Typhi
uauuucgacaagaagauuucuu

SEQ ID NO: 3627595 - RNA, 18 nt, Salmonella enterica enterica serovar Typhi
uauuucgacuuucuucgg

SEQ ID NO: 3627596 - RNA, 14 nt, Salmonella enterica enterica serovar Typhi
uauuucgccuauca

SEQ ID NO: 3627597 - RNA, 21 nt, Salmonella enterica enterica serovar Typhi
uauuucuaucagguaacauau

SEQ ID NO: 3627598 - RNA, 15 nt, Salmonella enterica enterica serovar Typhi
uauuucugaaaaacc

SEQ ID NO: 3627599 - RNA, 19 nt, Salmonella enterica enterica serovar Typhi
uauuucugugagugcgcca

SEQ ID NO: 3627600 - RNA, 22 nt, Salmonella enterica enterica serovar Typhi
uauuucuuagcacccaccauca

SEQ ID NO: 3627601 - RNA, 13 nt, Salmonella enterica enterica serovar Typhi
uauuugaauuuua

SEQ ID NO: 3627602 - RNA, 13 nt, Salmonella enterica enterica serovar Typhi
uauuugcauuuuc

SEQ ID NO: 3627603 - RNA, 13 nt, Salmonella enterica enterica serovar Typhi
uauuugcccuguu

SEQ ID NO: 3627604 - RNA, 14 nt, Salmonella enterica enterica serovar Typhi
uauuuggagagcau

SEQ ID NO: 3627605 - RNA, 17 nt, Salmonella enterica enterica serovar Typhi
uauuuguguauuuuuuu

SEQ ID NO: 3627606 - RNA, 22 nt, Salmonella enterica enterica serovar Typhi
uauuuguuuaccgcgauagaaa

SEQ ID NO: 3627607 - RNA, 16 nt, Salmonella enterica enterica serovar Typhi
uauuuuauucgccauu

SEQ ID NO: 3627608 - RNA, 12 nt, Salmonella enterica enterica serovar Typhi
uauuuuauuuuu

SEQ ID NO: 3627609 - RNA, 16 nt, Salmonella enterica enterica serovar Typhi
uauuuucaaaaacaag

SEQ ID NO: 3627610 - RNA, 14 nt, Salmonella enterica enterica serovar Typhi
uauuuuccaucacg

SEQ ID NO: 3627611 - RNA, 18 nt, Salmonella enterica enterica serovar Typhi
uauuuuccguuagccaau

SEQ ID NO: 3627612 - RNA, 22 nt, Salmonella enterica enterica serovar Typhi
uauuuuccugaaaaaauucccg

SEQ ID NO: 3627613 - RNA, 20 nt, Salmonella enterica enterica serovar Typhi
uauuuucuccggcaguccau

SEQ ID NO: 3627614 - RNA, 20 nt, Salmonella enterica enterica serovar Typhi
uauuuugguguaacagcaac

SEQ ID NO: 3627615 - RNA, 18 nt, Salmonella enterica enterica serovar Typhi
uauuuuucagcuucuguc

SEQ ID NO: 3627616 - RNA, 16 nt, Salmonella enterica enterica serovar Typhi
uauuuuucucagccag

SEQ ID NO: 3627617 - RNA, 15 nt, Salmonella enterica enterica serovar Typhi
ucaaaaaaaaccaga

SEQ ID NO: 3627618 - RNA, 13 nt, Salmonella enterica enterica serovar Typhi
ucaaaaaaaauag

SEQ ID NO: 3627619 - RNA, 21 nt, Salmonella enterica enterica serovar Typhi
ucaaaaaaaauagccauugcu

SEQ ID NO: 3627620 - RNA, 11 nt, Salmonella enterica enterica serovar Typhi
ucaaaaaagag

SEQ ID NO: 3627621 - RNA, 13 nt, Salmonella enterica enterica serovar Typhi
ucaaaaaagagaa

SEQ ID NO: 3627622 - RNA, 22 nt, Salmonella enterica enterica serovar Typhi
ucaaaaaagcgacgcugucaau

SEQ ID NO: 3627623 - RNA, 14 nt, Salmonella enterica enterica serovar Typhi
ucaaaaaauaucuc

SEQ ID NO: 3627624 - RNA, 14 nt, Salmonella enterica enterica serovar Typhi
ucaaaaaaucagca

SEQ ID NO: 3627625 - RNA, 18 nt, Salmonella enterica enterica serovar Typhi
ucaaaaaguugucuuccu

SEQ ID NO: 3627626 - RNA, 14 nt, Salmonella enterica enterica serovar Typhi
ucaaaaauaaaaac

SEQ ID NO: 3627627 - RNA, 15 nt, Salmonella enterica enterica serovar Typhi
ucaaaacaggucugu

SEQ ID NO: 3627628 - RNA, 23 nt, Salmonella enterica enterica serovar Typhi
ucaaaaccagcgcggauaaaaaa

SEQ ID NO: 3627629 - RNA, 23 nt, Salmonella enterica enterica serovar Typhi
ucaaaacccagcccaauacgcca

SEQ ID NO: 3627630 - RNA, 18 nt, Salmonella enterica enterica serovar Typhi
ucaaaaccgaccccgcuc

SEQ ID NO: 3627631 - RNA, 21 nt, Salmonella enterica enterica serovar Typhi
ucaaaaccgggcagggaauac

SEQ ID NO: 3627632 - RNA, 18 nt, Salmonella enterica enterica serovar Typhi
ucaaaagauugauuuauu

SEQ ID NO: 3627633 - RNA, 16 nt, Salmonella enterica enterica serovar Typhi
ucaaaaggugagaaaa

SEQ ID NO: 3627634 - RNA, 17 nt, Salmonella enterica enterica serovar Typhi
ucaaaagugaucauggu

SEQ ID NO: 3627635 - RNA, 14 nt, Salmonella enterica enterica serovar Typhi
ucaaaaucgcgccc

SEQ ID NO: 3627636 - RNA, 21 nt, Salmonella enterica enterica serovar Typhi
ucaaaauggaaaauaauaauc

SEQ ID NO: 3627637 - RNA, 17 nt, Salmonella enterica enterica serovar Typhi
ucaaacacaaauuucga

SEQ ID NO: 3627638 - RNA, 23 nt, Salmonella enterica enterica serovar Typhi
ucaaacaggcggcuguugguuua

SEQ ID NO: 3627639 - RNA, 16 nt, Salmonella enterica enterica serovar Typhi
ucaaacaggcugucug

SEQ ID NO: 3627640 - RNA, 20 nt, Salmonella enterica enterica serovar Typhi
ucaaacaggcugucugccau

SEQ ID NO: 3627641 - RNA, 21 nt, Salmonella enterica enterica serovar Typhi
ucaaacaggcugucugccaug

SEQ ID NO: 3627642 - RNA, 16 nt, Salmonella enterica enterica serovar Typhi
ucaaaccagcuuuuca

SEQ ID NO: 3627643 - RNA, 18 nt, Salmonella enterica enterica serovar Typhi
ucaaaccagcuuuucauu

SEQ ID NO: 3627644 - RNA, 20 nt, Salmonella enterica enterica serovar Typhi
ucaaacccuuccagacagcu

SEQ ID NO: 3627645 - RNA, 14 nt, Salmonella enterica enterica serovar Typhi
ucaaacccuuccgc

SEQ ID NO: 3627646 - RNA, 14 nt, Salmonella enterica enterica serovar Typhi
ucaaacgcgccgcu

SEQ ID NO: 3627647 - RNA, 22 nt, Salmonella enterica enterica serovar Typhi
ucaaacgugccuggauaaaucg

SEQ ID NO: 3627648 - RNA, 21 nt, Salmonella enterica enterica serovar Typhi
ucaaacuccccugucguuaau

SEQ ID NO: 3627649 - RNA, 23 nt, Salmonella enterica enterica serovar Typhi
ucaaacucgcugccgaccuggcu

SEQ ID NO: 3627650 - RNA, 19 nt, Salmonella enterica enterica serovar Typhi
ucaaacucuuccgggcuga

SEQ ID NO: 3627651 - RNA, 20 nt, Salmonella enterica enterica serovar Typhi
ucaaacuugcccagcgccuu

SEQ ID NO: 3627652 - RNA, 15 nt, Salmonella enterica enterica serovar Typhi
ucaaacuuuuaaauu

SEQ ID NO: 3627653 - RNA, 18 nt, Salmonella enterica enterica serovar Typhi
ucaaacuuuuaaauugaa

SEQ ID NO: 3627654 - RNA, 13 nt, Salmonella enterica enterica serovar Typhi
ucaaacuuuuaua

SEQ ID NO: 3627655 - RNA, 20 nt, Salmonella enterica enterica serovar Typhi
ucaaacuuuuauaaauauag

SEQ ID NO: 3627656 - RNA, 18 nt, Salmonella enterica enterica serovar Typhi
ucaaagaaaacaucagcc

SEQ ID NO: 3627657 - RNA, 22 nt, Salmonella enterica enterica serovar Typhi
ucaaagaacagggggcgcauca

SEQ ID NO: 3627658 - RNA, 21 nt, Salmonella enterica enterica serovar Typhi
ucaaagaagcggaaaccccag

SEQ ID NO: 3627659 - RNA, 13 nt, Salmonella enterica enterica serovar Typhi
ucaaagaccuccg

SEQ ID NO: 3627660 - RNA, 18 nt, Salmonella enterica enterica serovar Typhi
ucaaagccacacugcauc

SEQ ID NO: 3627661 - RNA, 18 nt, Salmonella enterica enterica serovar Typhi
ucaaagcguaccgucugg

SEQ ID NO: 3627662 - RNA, 20 nt, Salmonella enterica enterica serovar Typhi
ucaaagggcccguggaaaaa

SEQ ID NO: 3627663 - RNA, 16 nt, Salmonella enterica enterica serovar Typhi
ucaaaguuauuuacca

SEQ ID NO: 3627664 - RNA, 19 nt, Salmonella enterica enterica serovar Typhi
ucaaaguuauuuaccacgg

SEQ ID NO: 3627665 - RNA, 23 nt, Salmonella enterica enterica serovar Typhi
ucaaauaagacauggaguuccag

SEQ ID NO: 3627666 - RNA, 17 nt, Salmonella enterica enterica serovar Typhi
ucaaauaccuuuucauu

SEQ ID NO: 3627667 - RNA, 22 nt, Salmonella enterica enterica serovar Typhi
ucaaauacgcgauaaaaaccca

SEQ ID NO: 3627668 - RNA, 14 nt, Salmonella enterica enterica serovar Typhi
ucaaauagagaaaa

SEQ ID NO: 3627669 - RNA, 15 nt, Salmonella enterica enterica serovar Typhi
ucaaauagagaaaau

SEQ ID NO: 3627670 - RNA, 16 nt, Salmonella enterica enterica serovar Typhi
ucaaauagagaaaaua

SEQ ID NO: 3627671 - RNA, 22 nt, Salmonella enterica enterica serovar Typhi
ucaaauagagaaaauaacaaua

SEQ ID NO: 3627672 - RNA, 19 nt, Salmonella enterica enterica serovar Typhi
ucaagguagcgugucuacc

SEQ ID NO: 3627673 - RNA, 13 nt, Salmonella enterica enterica serovar Typhi
ucaaguacagcuu

SEQ ID NO: 3627674 - RNA, 15 nt, Salmonella enterica enterica serovar Typhi
ucaaguuuagaaaaa

SEQ ID NO: 3627675 - RNA, 16 nt, Salmonella enterica enterica serovar Typhi
ucaauaaacagcuccg

SEQ ID NO: 3627676 - RNA, 16 nt, Salmonella enterica enterica serovar Typhi
ucaauaaacuggagca

SEQ ID NO: 3627677 - RNA, 16 nt, Salmonella enterica enterica serovar Typhi
ucaauaaccgccagca

SEQ ID NO: 3627678 - RNA, 12 nt, Salmonella enterica enterica serovar Typhi
ucaauaacgaag

SEQ ID NO: 3627679 - RNA, 13 nt, Salmonella enterica enterica serovar Typhi
ucaauaauauuau

SEQ ID NO: 3627680 - RNA, 19 nt, Salmonella enterica enterica serovar Typhi
ucaauaauauuaucauaau

SEQ ID NO: 3627681 - RNA, 21 nt, Salmonella enterica enterica serovar Typhi
ucaauaauggcgcgaaaacag

SEQ ID NO: 3627682 - RNA, 18 nt, Salmonella enterica enterica serovar Typhi
ucaauacagagauauuaa

SEQ ID NO: 3627683 - RNA, 20 nt, Salmonella enterica enterica serovar Typhi
ucaauacgagugacauuauu

SEQ ID NO: 3627684 - RNA, 22 nt, Salmonella enterica enterica serovar Typhi
ucaauacgagugacauuauuca

SEQ ID NO: 3627685 - RNA, 15 nt, Salmonella enterica enterica serovar Typhi
ucaauacgcauaaug

SEQ ID NO: 3627686 - RNA, 18 nt, Salmonella enterica enterica serovar Typhi
ucaauagagcgcagcaaa

SEQ ID NO: 3627687 - RNA, 15 nt, Salmonella enterica enterica serovar Typhi
ucaauaguuaauuaa

SEQ ID NO: 3627688 - RNA, 16 nt, Salmonella enterica enterica serovar Typhi
ucaauaucauagugcc

SEQ ID NO: 3627689 - RNA, 13 nt, Salmonella enterica enterica serovar Typhi
ucaauauccugcg

SEQ ID NO: 3627690 - RNA, 19 nt, Salmonella enterica enterica serovar Typhi
ucaauauucacuucgccca

SEQ ID NO: 3627691 - RNA, 18 nt, Salmonella enterica enterica serovar Typhi
ucaauauugaacauuuuu

SEQ ID NO: 3627692 - RNA, 19 nt, Salmonella enterica enterica serovar Typhi
ucaaucaacuccauaauuu

SEQ ID NO: 3627693 - RNA, 22 nt, Salmonella enterica enterica serovar Typhi
ucaaucacugaugccacacccu

SEQ ID NO: 3627694 - RNA, 12 nt, Salmonella enterica enterica serovar Typhi
ucaaucaggcua

SEQ ID NO: 3627695 - RNA, 16 nt, Salmonella enterica enterica serovar Typhi
ucaaucaucagaagaa

SEQ ID NO: 3627696 - RNA, 17 nt, Salmonella enterica enterica serovar Typhi
ucaaucaucauaucccg

SEQ ID NO: 3627697 - RNA, 20 nt, Salmonella enterica enterica serovar Typhi
ucaauccaacgaaacucagc

SEQ ID NO: 3627698 - RNA, 16 nt, Salmonella enterica enterica serovar Typhi
ucaaucgccugcugua

SEQ ID NO: 3627699 - RNA, 17 nt, Salmonella enterica enterica serovar Typhi
ucaaucggcgauagagu

SEQ ID NO: 3627700 - RNA, 18 nt, Salmonella enterica enterica serovar Typhi
ucaaucgucguuccgcca

SEQ ID NO: 3627701 - RNA, 14 nt, Salmonella enterica enterica serovar Typhi
ucaaucuucccgca

SEQ ID NO: 3627702 - RNA, 16 nt, Salmonella enterica enterica serovar Typhi
ucaaugcccagcgcaa

SEQ ID NO: 3627703 - RNA, 24 nt, Salmonella enterica enterica serovar Typhi
ucaaugcccaggcgccgcucauca

SEQ ID NO: 3627704 - RNA, 23 nt, Salmonella enterica enterica serovar Typhi
ucaaugccgucggcaauuaacau

SEQ ID NO: 3627705 - RNA, 17 nt, Salmonella enterica enterica serovar Typhi
ucaauggccuugccagc

SEQ ID NO: 3627706 - RNA, 23 nt, Salmonella enterica enterica serovar Typhi
ucaauggcgcgaagugccagguu

SEQ ID NO: 3627707 - RNA, 16 nt, Salmonella enterica enterica serovar Typhi
ucaauggguuaugggu

SEQ ID NO: 3627708 - RNA, 24 nt, Salmonella enterica enterica serovar Typhi
ucaauguauuguucaugcaauucc

SEQ ID NO: 3627709 - RNA, 14 nt, Salmonella enterica enterica serovar Typhi
ucaauuccacaggc

SEQ ID NO: 3627710 - RNA, 17 nt, Salmonella enterica enterica serovar Typhi
ucaauuccuggaacuga

SEQ ID NO: 3627711 - RNA, 19 nt, Salmonella enterica enterica serovar Typhi
ucaauuccuuuuaauuuaa

SEQ ID NO: 3627712 - RNA, 14 nt, Salmonella enterica enterica serovar Typhi
ucaauucuuuaauu

SEQ ID NO: 3627713 - RNA, 19 nt, Salmonella enterica enterica serovar Typhi
ucaauugugugcacugcac

SEQ ID NO: 3627714 - RNA, 15 nt, Salmonella enterica enterica serovar Typhi
ucaauuucauauuau

SEQ ID NO: 3627715 - RNA, 11 nt, Salmonella enterica enterica serovar Typhi
ucaauuuccag

SEQ ID NO: 3627716 - RNA, 12 nt, Salmonella enterica enterica serovar Typhi
ucaauuuccagu

SEQ ID NO: 3627717 - RNA, 13 nt, Salmonella enterica enterica serovar Typhi
ucaauuuuucgcc

SEQ ID NO: 3627718 - RNA, 13 nt, Salmonella enterica enterica serovar Typhi
ucacaaaaucauu

SEQ ID NO: 3627719 - RNA, 15 nt, Salmonella enterica enterica serovar Typhi
ucacaaacaauuucc

SEQ ID NO: 3627720 - RNA, 22 nt, Salmonella enterica enterica serovar Typhi
ucacaaacaauuucccccacuu

SEQ ID NO: 3627721 - RNA, 13 nt, Salmonella enterica enterica serovar Typhi
ucacaaaccagac

SEQ ID NO: 3627722 - RNA, 20 nt, Salmonella enterica enterica serovar Typhi
ucacaaaggccagcagcagc

SEQ ID NO: 3627723 - RNA, 14 nt, Salmonella enterica enterica serovar Typhi
ucacaaauuaaaaa

SEQ ID NO: 3627724 - RNA, 20 nt, Salmonella enterica enterica serovar Typhi
ucacaaauuugaauaaaacg

SEQ ID NO: 3627725 - RNA, 15 nt, Salmonella enterica enterica serovar Typhi
ucacaagcuguuucu

SEQ ID NO: 3627726 - RNA, 13 nt, Salmonella enterica enterica serovar Typhi
ucacaaggaauga

SEQ ID NO: 3627727 - RNA, 15 nt, Salmonella enterica enterica serovar Typhi
ucacaauaacgccgg

SEQ ID NO: 3627728 - RNA, 14 nt, Salmonella enterica enterica serovar Typhi
ucacaaucagccac

SEQ ID NO: 3627729 - RNA, 17 nt, Salmonella enterica enterica serovar Typhi
ucacaaucgcgccugcc

SEQ ID NO: 3627730 - RNA, 17 nt, Salmonella enterica enterica serovar Typhi
ucacaaucguucucagg

SEQ ID NO: 3627731 - RNA, 19 nt, Salmonella enterica enterica serovar Typhi
ucacacauaagcacaccau

SEQ ID NO: 3627732 - RNA, 14 nt, Salmonella enterica enterica serovar Typhi
ucacacauaucgcc

SEQ ID NO: 3627733 - RNA, 16 nt, Salmonella enterica enterica serovar Typhi
ucacacauaucgccag

SEQ ID NO: 3627734 - RNA, 21 nt, Salmonella enterica enterica serovar Typhi
ucacaccaacgcuggcccggc

SEQ ID NO: 3627735 - RNA, 22 nt, Salmonella enterica enterica serovar Typhi
ucacaccggcggagucgguaca

SEQ ID NO: 3627736 - RNA, 16 nt, Salmonella enterica enterica serovar Typhi
ucacacgcucacccag

SEQ ID NO: 3627737 - RNA, 15 nt, Salmonella enterica enterica serovar Typhi
ucacacugcgccgcc

SEQ ID NO: 3627738 - RNA, 20 nt, Salmonella enterica enterica serovar Typhi
ucacacugcgccgccagcga

SEQ ID NO: 3627739 - RNA, 22 nt, Salmonella enterica enterica serovar Typhi
ucacagacaucggagauuucau

SEQ ID NO: 3627740 - RNA, 19 nt, Salmonella enterica enterica serovar Typhi
ucacagccacacugcugug

SEQ ID NO: 3627741 - RNA, 17 nt, Salmonella enterica enterica serovar Typhi
ucacagcgguuacgcua

SEQ ID NO: 3627742 - RNA, 22 nt, Salmonella enterica enterica serovar Typhi
ucacagcgguuacgcuauagcu

SEQ ID NO: 3627743 - RNA, 15 nt, Salmonella enterica enterica serovar Typhi
ucacaggcuucgaca

SEQ ID NO: 3627744 - RNA, 21 nt, Salmonella enterica enterica serovar Typhi
ucacauaacaaaaccagcauc

SEQ ID NO: 3627745 - RNA, 17 nt, Salmonella enterica enterica serovar Typhi
ucacauacagcacuucc

SEQ ID NO: 3627746 - RNA, 17 nt, Salmonella enterica enterica serovar Typhi
ucacauauucaauaaua

SEQ ID NO: 3627747 - RNA, 17 nt, Salmonella enterica enterica serovar Typhi
ucacaucaaagccccau

SEQ ID NO: 3627748 - RNA, 11 nt, Salmonella enterica enterica serovar Typhi
ucacaucauua

SEQ ID NO: 3627749 - RNA, 22 nt, Salmonella enterica enterica serovar Typhi
ucacaucgccggagaucagcag

SEQ ID NO: 3627750 - RNA, 15 nt, Salmonella enterica enterica serovar Typhi
ucacaucgcgcagca

SEQ ID NO: 3627751 - RNA, 20 nt, Salmonella enterica enterica serovar Typhi
ucacaucguaaaucagcgug

SEQ ID NO: 3627752 - RNA, 20 nt, Salmonella enterica enterica serovar Typhi
ucacaugcgggagcaaaaua

SEQ ID NO: 3627753 - RNA, 18 nt, Salmonella enterica enterica serovar Typhi
ucacaugcuuauccagcu

SEQ ID NO: 3627754 - RNA, 13 nt, Salmonella enterica enterica serovar Typhi
ucacgcuugcccg

SEQ ID NO: 3627755 - RNA, 19 nt, Salmonella enterica enterica serovar Typhi
ucacggcaucugcggcaug

SEQ ID NO: 3627756 - RNA, 17 nt, Salmonella enterica enterica serovar Typhi
ucacggccaaagcgcga

SEQ ID NO: 3627757 - RNA, 17 nt, Salmonella enterica enterica serovar Typhi
ucacggcgaaucgccug

SEQ ID NO: 3627758 - RNA, 21 nt, Salmonella enterica enterica serovar Typhi
ucacggcgauaaaugucagga

SEQ ID NO: 3627759 - RNA, 17 nt, Salmonella enterica enterica serovar Typhi
ucacgggcguagucagc

SEQ ID NO: 3627760 - RNA, 23 nt, Salmonella enterica enterica serovar Typhi
ucacgguauucguuaccagcauc

SEQ ID NO: 3627761 - RNA, 16 nt, Salmonella enterica enterica serovar Typhi
ucacgguucgcaauca

SEQ ID NO: 3627762 - RNA, 15 nt, Salmonella enterica enterica serovar Typhi
ucacgguuucaacuu

SEQ ID NO: 3627763 - RNA, 15 nt, Salmonella enterica enterica serovar Typhi
ucacguagcggcgcg

SEQ ID NO: 3627764 - RNA, 19 nt, Salmonella enterica enterica serovar Typhi
ucacguagcguaucagacu

SEQ ID NO: 3627765 - RNA, 17 nt, Salmonella enterica enterica serovar Typhi
ucacgucagcgaccauu

SEQ ID NO: 3627766 - RNA, 17 nt, Salmonella enterica enterica serovar Typhi
ucacgucgcccaccgca

SEQ ID NO: 3627767 - RNA, 22 nt, Salmonella enterica enterica serovar Typhi
ucacgucgcgaagcugugcguu

SEQ ID NO: 3627768 - RNA, 13 nt, Salmonella enterica enterica serovar Typhi
ucacguuccccag

SEQ ID NO: 3627769 - RNA, 15 nt, Salmonella enterica enterica serovar Typhi
ucacguuccccagca

SEQ ID NO: 3627770 - RNA, 19 nt, Salmonella enterica enterica serovar Typhi
ucacguugacgcaaacugc

SEQ ID NO: 3627771 - RNA, 20 nt, Salmonella enterica enterica serovar Typhi
ucacguuuugcagcgccauc

SEQ ID NO: 3627772 - RNA, 14 nt, Salmonella enterica enterica serovar Typhi
ucacguuuuuacuc

SEQ ID NO: 3627773 - RNA, 12 nt, Salmonella enterica enterica serovar Typhi
ucacuaauuuga

SEQ ID NO: 3627774 - RNA, 19 nt, Salmonella enterica enterica serovar Typhi
ucacuacccggaggcaaua

SEQ ID NO: 3627775 - RNA, 14 nt, Salmonella enterica enterica serovar Typhi
ucacuaccgccauc

SEQ ID NO: 3627776 - RNA, 22 nt, Salmonella enterica enterica serovar Typhi
ucacuaggcguuagaauaacgu

SEQ ID NO: 3627777 - RNA, 15 nt, Salmonella enterica enterica serovar Typhi
ucacuaucacacugg

SEQ ID NO: 3627778 - RNA, 22 nt, Salmonella enterica enterica serovar Typhi
ucacuaugcuaauccgcugauu

SEQ ID NO: 3627779 - RNA, 13 nt, Salmonella enterica enterica serovar Typhi
ucacuauuugugc

SEQ ID NO: 3627780 - RNA, 18 nt, Salmonella enterica enterica serovar Typhi
ucacuccuuagauuaauc

SEQ ID NO: 3627781 - RNA, 16 nt, Salmonella enterica enterica serovar Typhi
ucacugaaccugccuu

SEQ ID NO: 3627782 - RNA, 19 nt, Salmonella enterica enterica serovar Typhi
ucacugacuauccacagcg

SEQ ID NO: 3627783 - RNA, 18 nt, Salmonella enterica enterica serovar Typhi
ucacugccgacgcccuca

SEQ ID NO: 3627784 - RNA, 18 nt, Salmonella enterica enterica serovar Typhi
ucacugccguacaaaccg

SEQ ID NO: 3627785 - RNA, 17 nt, Salmonella enterica enterica serovar Typhi
ucacuggcggcaagcug

SEQ ID NO: 3627786 - RNA, 12 nt, Salmonella enterica enterica serovar Typhi
ucacuuauaaau

SEQ ID NO: 3627787 - RNA, 14 nt, Salmonella enterica enterica serovar Typhi
ucacuucaucauca

SEQ ID NO: 3627788 - RNA, 13 nt, Salmonella enterica enterica serovar Typhi
ucacuucauccgg

SEQ ID NO: 3627789 - RNA, 15 nt, Salmonella enterica enterica serovar Typhi
ucacuuguucaauau

SEQ ID NO: 3627790 - RNA, 19 nt, Salmonella enterica enterica serovar Typhi
ucacuuucagauuuuuaau

SEQ ID NO: 3627791 - RNA, 19 nt, Salmonella enterica enterica serovar Typhi
ucacuuuugccgguugcca

SEQ ID NO: 3627792 - RNA, 16 nt, Salmonella enterica enterica serovar Typhi
ucagaaaaccuuugcu

SEQ ID NO: 3627793 - RNA, 23 nt, Salmonella enterica enterica serovar Typhi
ucagaaacaacacaaaucgggcg

SEQ ID NO: 3627794 - RNA, 15 nt, Salmonella enterica enterica serovar Typhi
ucagaaauaaaacca

SEQ ID NO: 3627795 - RNA, 19 nt, Salmonella enterica enterica serovar Typhi
ucagaaaucggcagcaccc

SEQ ID NO: 3627796 - RNA, 21 nt, Salmonella enterica enterica serovar Typhi
ucagaaccugcgauaccggac

SEQ ID NO: 3627797 - RNA, 15 nt, Salmonella enterica enterica serovar Typhi
ucagaacugauaguu

SEQ ID NO: 3627798 - RNA, 15 nt, Salmonella enterica enterica serovar Typhi
ucagaagaagacaac

SEQ ID NO: 3627799 - RNA, 18 nt, Salmonella enterica enterica serovar Typhi
ucagaagcuucgcgaacu

SEQ ID NO: 3627800 - RNA, 12 nt, Salmonella enterica enterica serovar Typhi
ucagaauaaugc

SEQ ID NO: 3627801 - RNA, 13 nt, Salmonella enterica enterica serovar Typhi
ucagaauaaugcu

SEQ ID NO: 3627802 - RNA, 20 nt, Salmonella enterica enterica serovar Typhi
ucagaauacagaauccggcg

SEQ ID NO: 3627803 - RNA, 20 nt, Salmonella enterica enterica serovar Typhi
ucagaauaccgcguccuucu

SEQ ID NO: 3627804 - RNA, 19 nt, Salmonella enterica enterica serovar Typhi
ucagaauauccgguacacc

SEQ ID NO: 3627805 - RNA, 15 nt, Salmonella enterica enterica serovar Typhi
ucagaauaugccagg

SEQ ID NO: 3627806 - RNA, 22 nt, Salmonella enterica enterica serovar Typhi
ucagacacaauauugcugugcu

SEQ ID NO: 3627807 - RNA, 19 nt, Salmonella enterica enterica serovar Typhi
ucagacaccagcccuggcu

SEQ ID NO: 3627808 - RNA, 23 nt, Salmonella enterica enterica serovar Typhi
ucagaccagaaucccacggagaa

SEQ ID NO: 3627809 - RNA, 19 nt, Salmonella enterica enterica serovar Typhi
ucagaccauaguccaugcc

SEQ ID NO: 3627810 - RNA, 18 nt, Salmonella enterica enterica serovar Typhi
ucagaccgagacccagcg

SEQ ID NO: 3627811 - RNA, 18 nt, Salmonella enterica enterica serovar Typhi
ucagaccgauaaauaccg

SEQ ID NO: 3627812 - RNA, 23 nt, Salmonella enterica enterica serovar Typhi
ucagacgaccauccaccagaacc

SEQ ID NO: 3627813 - RNA, 21 nt, Salmonella enterica enterica serovar Typhi
ucagacgccgcgcugcggcgu

SEQ ID NO: 3627814 - RNA, 16 nt, Salmonella enterica enterica serovar Typhi
ucagacgcgcagugug

SEQ ID NO: 3627815 - RNA, 16 nt, Salmonella enterica enterica serovar Typhi
ucagacgcucagccuu

SEQ ID NO: 3627816 - RNA, 19 nt, Salmonella enterica enterica serovar Typhi
ucagacgcucagccuuaua

SEQ ID NO: 3627817 - RNA, 13 nt, Salmonella enterica enterica serovar Typhi
ucagacgcugguu

SEQ ID NO: 3627818 - RNA, 15 nt, Salmonella enterica enterica serovar Typhi
ucagacgcugguugu

SEQ ID NO: 3627819 - RNA, 17 nt, Salmonella enterica enterica serovar Typhi
ucagacggacaucagag

SEQ ID NO: 3627820 - RNA, 15 nt, Salmonella enterica enterica serovar Typhi
ucagacggcugaccu

SEQ ID NO: 3627821 - RNA, 20 nt, Salmonella enterica enterica serovar Typhi
ucagagcguccacgccauca

SEQ ID NO: 3627822 - RNA, 18 nt, Salmonella enterica enterica serovar Typhi
ucagauacggcuccagca

SEQ ID NO: 3627823 - RNA, 23 nt, Salmonella enterica enterica serovar Typhi
ucagauaggcgcgaaaugucccg

SEQ ID NO: 3627824 - RNA, 19 nt, Salmonella enterica enterica serovar Typhi
ucagauaucccaugaaacu

SEQ ID NO: 3627825 - RNA, 16 nt, Salmonella enterica enterica serovar Typhi
ucagauccuucauuca

SEQ ID NO: 3627826 - RNA, 17 nt, Salmonella enterica enterica serovar Typhi
ucagaucgccgccggua

SEQ ID NO: 3627827 - RNA, 17 nt, Salmonella enterica enterica serovar Typhi
ucagaucuuauaugagc

SEQ ID NO: 3627828 - RNA, 19 nt, Salmonella enterica enterica serovar Typhi
ucagauguccaccgauuuc

SEQ ID NO: 3627829 - RNA, 21 nt, Salmonella enterica enterica serovar Typhi
ucagauguccaccgauuucau

SEQ ID NO: 3627830 - RNA, 20 nt, Salmonella enterica enterica serovar Typhi
ucagcaaacggcuggauaac

SEQ ID NO: 3627831 - RNA, 13 nt, Salmonella enterica enterica serovar Typhi
ucagcaaaugaac

SEQ ID NO: 3627832 - RNA, 18 nt, Salmonella enterica enterica serovar Typhi
ucagcaacccuuuuucaa

SEQ ID NO: 3627833 - RNA, 19 nt, Salmonella enterica enterica serovar Typhi
ucagcaacggaagcugacc

SEQ ID NO: 3627834 - RNA, 20 nt, Salmonella enterica enterica serovar Typhi
ucagcaauuucucgcccgcc

SEQ ID NO: 3627835 - RNA, 21 nt, Salmonella enterica enterica serovar Typhi
ucagcaauuucucgcccgcca

SEQ ID NO: 3627836 - RNA, 20 nt, Salmonella enterica enterica serovar Typhi
ucagcaauuuuguuaaaucc

SEQ ID NO: 3627837 - RNA, 15 nt, Salmonella enterica enterica serovar Typhi
ucagcacaaaauccc

SEQ ID NO: 3627838 - RNA, 21 nt, Salmonella enterica enterica serovar Typhi
ucagcacaaaaucccacauac

SEQ ID NO: 3627839 - RNA, 17 nt, Salmonella enterica enterica serovar Typhi
ucaggcauuguugcguu

SEQ ID NO: 3627840 - RNA, 13 nt, Salmonella enterica enterica serovar Typhi
ucaggccauuaac

SEQ ID NO: 3627841 - RNA, 15 nt, Salmonella enterica enterica serovar Typhi
ucaggccgauuucau

SEQ ID NO: 3627842 - RNA, 12 nt, Salmonella enterica enterica serovar Typhi
ucaggccgccag

SEQ ID NO: 3627843 - RNA, 18 nt, Salmonella enterica enterica serovar Typhi
ucaggccgccgcacaggc

SEQ ID NO: 3627844 - RNA, 17 nt, Salmonella enterica enterica serovar Typhi
ucaggccuauagacacc

SEQ ID NO: 3627845 - RNA, 19 nt, Salmonella enterica enterica serovar Typhi
ucaggccuauagacaccuu

SEQ ID NO: 3627846 - RNA, 22 nt, Salmonella enterica enterica serovar Typhi
ucaggccuauagacaccuuaua

SEQ ID NO: 3627847 - RNA, 15 nt, Salmonella enterica enterica serovar Typhi
ucaggccugccugau

SEQ ID NO: 3627848 - RNA, 16 nt, Salmonella enterica enterica serovar Typhi
ucaggcgagacgcgcc

SEQ ID NO: 3627849 - RNA, 19 nt, Salmonella enterica enterica serovar Typhi
ucaggcgauagccguccau

SEQ ID NO: 3627850 - RNA, 16 nt, Salmonella enterica enterica serovar Typhi
ucaggcgcgcgcugug

SEQ ID NO: 3627851 - RNA, 14 nt, Salmonella enterica enterica serovar Typhi
ucaggcggauauau

SEQ ID NO: 3627852 - RNA, 22 nt, Salmonella enterica enterica serovar Typhi
ucaggcguagagaggcauccgc

SEQ ID NO: 3627853 - RNA, 12 nt, Salmonella enterica enterica serovar Typhi
ucaggcgugaug

SEQ ID NO: 3627854 - RNA, 18 nt, Salmonella enterica enterica serovar Typhi
ucaggcucgcaaauaauc

SEQ ID NO: 3627855 - RNA, 21 nt, Salmonella enterica enterica serovar Typhi
ucaggcucgucgccuuccagc

SEQ ID NO: 3627856 - RNA, 22 nt, Salmonella enterica enterica serovar Typhi
ucaggcucgucgccuuccagcg

SEQ ID NO: 3627857 - RNA, 18 nt, Salmonella enterica enterica serovar Typhi
ucaggcuguuguucuuuu

SEQ ID NO: 3627858 - RNA, 12 nt, Salmonella enterica enterica serovar Typhi
ucaggcuuucca

SEQ ID NO: 3627859 - RNA, 12 nt, Salmonella enterica enterica serovar Typhi
ucagggaaaaau

SEQ ID NO: 3627860 - RNA, 21 nt, Salmonella enterica enterica serovar Typhi
ucagggacgauaggcgcguca

SEQ ID NO: 3627861 - RNA, 19 nt, Salmonella enterica enterica serovar Typhi
ucagggcaaaaaugaucac

SEQ ID NO: 3627862 - RNA, 22 nt, Salmonella enterica enterica serovar Typhi
ucagggcaaaaaugaucacuuc

SEQ ID NO: 3627863 - RNA, 22 nt, Salmonella enterica enterica serovar Typhi
ucagggcgcggcgcaacuuuuu

SEQ ID NO: 3627864 - RNA, 17 nt, Salmonella enterica enterica serovar Typhi
ucagggcggaacagcgg

SEQ ID NO: 3627865 - RNA, 18 nt, Salmonella enterica enterica serovar Typhi
ucagggguccccacggga

SEQ ID NO: 3627866 - RNA, 14 nt, Salmonella enterica enterica serovar Typhi
ucaggguaucuaac

SEQ ID NO: 3627867 - RNA, 19 nt, Salmonella enterica enterica serovar Typhi
ucaggguuuucuaccgcag

SEQ ID NO: 3627868 - RNA, 15 nt, Salmonella enterica enterica serovar Typhi
ucagguauugguaug

SEQ ID NO: 3627869 - RNA, 16 nt, Salmonella enterica enterica serovar Typhi
ucagguauuuccugcu

SEQ ID NO: 3627870 - RNA, 17 nt, Salmonella enterica enterica serovar Typhi
ucaggucgcuaaaaccc

SEQ ID NO: 3627871 - RNA, 16 nt, Salmonella enterica enterica serovar Typhi
ucagguuuucuaucgc

SEQ ID NO: 3627872 - RNA, 20 nt, Salmonella enterica enterica serovar Typhi
ucagguuuuuaagcugccca

SEQ ID NO: 3627873 - RNA, 21 nt, Salmonella enterica enterica serovar Typhi
ucagguuuuuugugaguucau

SEQ ID NO: 3627874 - RNA, 15 nt, Salmonella enterica enterica serovar Typhi
ucagguuuuuuucau

SEQ ID NO: 3627875 - RNA, 23 nt, Salmonella enterica enterica serovar Typhi
ucaguaaaagcccgcccagcauu

SEQ ID NO: 3627876 - RNA, 18 nt, Salmonella enterica enterica serovar Typhi
ucaguaaaggaugccacu

SEQ ID NO: 3627877 - RNA, 15 nt, Salmonella enterica enterica serovar Typhi
ucaguaaccagggag

SEQ ID NO: 3627878 - RNA, 21 nt, Salmonella enterica enterica serovar Typhi
ucaguaagcguaccauuccau

SEQ ID NO: 3627879 - RNA, 20 nt, Salmonella enterica enterica serovar Typhi
ucaguaauguccagauuacg

SEQ ID NO: 3627880 - RNA, 19 nt, Salmonella enterica enterica serovar Typhi
ucaguacgcuuuggcaggc

SEQ ID NO: 3627881 - RNA, 21 nt, Salmonella enterica enterica serovar Typhi
ucaguacgcuuuggcaggccu

SEQ ID NO: 3627882 - RNA, 20 nt, Salmonella enterica enterica serovar Typhi
ucaguagccgccgcaggaca

SEQ ID NO: 3627883 - RNA, 21 nt, Salmonella enterica enterica serovar Typhi
ucaguagccgccgcaggacag

SEQ ID NO: 3627884 - RNA, 23 nt, Salmonella enterica enterica serovar Typhi
ucaguaugaucaugcccggcaaa

SEQ ID NO: 3627885 - RNA, 17 nt, Salmonella enterica enterica serovar Typhi
ucaguaugaugaccugg

SEQ ID NO: 3627886 - RNA, 16 nt, Salmonella enterica enterica serovar Typhi
ucagucagucccgggc

SEQ ID NO: 3627887 - RNA, 16 nt, Salmonella enterica enterica serovar Typhi
ucaguccccacauuac

SEQ ID NO: 3627888 - RNA, 23 nt, Salmonella enterica enterica serovar Typhi
ucaguccccagcguaccacgccg

SEQ ID NO: 3627889 - RNA, 22 nt, Salmonella enterica enterica serovar Typhi
ucagugauaaagcacagcccca

SEQ ID NO: 3627890 - RNA, 14 nt, Salmonella enterica enterica serovar Typhi
ucaguggaaaacag

SEQ ID NO: 3627891 - RNA, 15 nt, Salmonella enterica enterica serovar Typhi
ucaguggaaaacagc

SEQ ID NO: 3627892 - RNA, 22 nt, Salmonella enterica enterica serovar Typhi
ucaguggcggcaaaaaauauag

SEQ ID NO: 3627893 - RNA, 21 nt, Salmonella enterica enterica serovar Typhi
ucagugugguuucaagcggca

SEQ ID NO: 3627894 - RNA, 21 nt, Salmonella enterica enterica serovar Typhi
ucaguguuuccauacauuuuu

SEQ ID NO: 3627895 - RNA, 22 nt, Salmonella enterica enterica serovar Typhi
ucaguuaacgcguaaucuucca

SEQ ID NO: 3627896 - RNA, 22 nt, Salmonella enterica enterica serovar Typhi
ucaguucgccacgaucggcaau

SEQ ID NO: 3627897 - RNA, 21 nt, Salmonella enterica enterica serovar Typhi
ucaguucggagaucagcggau

SEQ ID NO: 3627898 - RNA, 14 nt, Salmonella enterica enterica serovar Typhi
ucaguugguuagaa

SEQ ID NO: 3627899 - RNA, 13 nt, Salmonella enterica enterica serovar Typhi
ucaguuucggccc

SEQ ID NO: 3627900 - RNA, 18 nt, Salmonella enterica enterica serovar Typhi
ucaguuuuggcaaucaca

SEQ ID NO: 3627901 - RNA, 22 nt, Salmonella enterica enterica serovar Typhi
ucauaaaacccguuaaauacca

SEQ ID NO: 3627902 - RNA, 18 nt, Salmonella enterica enterica serovar Typhi
ucauaaauagccagcauc

SEQ ID NO: 3627903 - RNA, 22 nt, Salmonella enterica enterica serovar Typhi
ucauaaauguacugcaauaacc

SEQ ID NO: 3627904 - RNA, 13 nt, Salmonella enterica enterica serovar Typhi
ucauaaauugcag

SEQ ID NO: 3627905 - RNA, 19 nt, Salmonella enterica enterica serovar Typhi
ucauaacaccaauacguga

SEQ ID NO: 3627906 - RNA, 15 nt, Salmonella enterica enterica serovar Typhi
ucauaagucauccag

SEQ ID NO: 3627907 - RNA, 16 nt, Salmonella enterica enterica serovar Typhi
ucauaauaaacugcau

SEQ ID NO: 3627908 - RNA, 22 nt, Salmonella enterica enterica serovar Typhi
ucauaauauuauccuuuaauua

SEQ ID NO: 3627909 - RNA, 16 nt, Salmonella enterica enterica serovar Typhi
ucauaaucgcgauacu

SEQ ID NO: 3627910 - RNA, 23 nt, Salmonella enterica enterica serovar Typhi
ucauaaucgcgauacugccgccc

SEQ ID NO: 3627911 - RNA, 16 nt, Salmonella enterica enterica serovar Typhi
ucauaaugaauacgcu

SEQ ID NO: 3627912 - RNA, 21 nt, Salmonella enterica enterica serovar Typhi
ucauaaugacgauaaauaaga

SEQ ID NO: 3627913 - RNA, 15 nt, Salmonella enterica enterica serovar Typhi
ucauaauuaaaaagg

SEQ ID NO: 3627914 - RNA, 19 nt, Salmonella enterica enterica serovar Typhi
ucauaccggauauggcaaa

SEQ ID NO: 3627915 - RNA, 22 nt, Salmonella enterica enterica serovar Typhi
ucauacugaagauaaacagcag

SEQ ID NO: 3627916 - RNA, 20 nt, Salmonella enterica enterica serovar Typhi
ucauagacgcgguuaucucu

SEQ ID NO: 3627917 - RNA, 14 nt, Salmonella enterica enterica serovar Typhi
ucauagacugcgcu

SEQ ID NO: 3627918 - RNA, 22 nt, Salmonella enterica enterica serovar Typhi
ucauagacugcgcuuaacgcuu

SEQ ID NO: 3627919 - RNA, 16 nt, Salmonella enterica enterica serovar Typhi
ucauagccgacccgca

SEQ ID NO: 3627920 - RNA, 20 nt, Salmonella enterica enterica serovar Typhi
ucauagccgcuuuccgccgc

SEQ ID NO: 3627921 - RNA, 16 nt, Salmonella enterica enterica serovar Typhi
ucauagcggcuaccgc

SEQ ID NO: 3627922 - RNA, 21 nt, Salmonella enterica enterica serovar Typhi
ucauagugccggugacaugaa

SEQ ID NO: 3627923 - RNA, 13 nt, Salmonella enterica enterica serovar Typhi
ucauauaagaaau

SEQ ID NO: 3627924 - RNA, 17 nt, Salmonella enterica enterica serovar Typhi
ucaugcaauaaucacug

SEQ ID NO: 3627925 - RNA, 21 nt, Salmonella enterica enterica serovar Typhi
ucaugcauuaaugggcgaaaa

SEQ ID NO: 3627926 - RNA, 15 nt, Salmonella enterica enterica serovar Typhi
ucaugcccggcaaac

SEQ ID NO: 3627927 - RNA, 19 nt, Salmonella enterica enterica serovar Typhi
ucaugccgaccagggcauc

SEQ ID NO: 3627928 - RNA, 22 nt, Salmonella enterica enterica serovar Typhi
ucaugccuucuuugccuuuuuc

SEQ ID NO: 3627929 - RNA, 18 nt, Salmonella enterica enterica serovar Typhi
ucaugcgagguauacgcc

SEQ ID NO: 3627930 - RNA, 13 nt, Salmonella enterica enterica serovar Typhi
ucaugcgccgcga

SEQ ID NO: 3627931 - RNA, 23 nt, Salmonella enterica enterica serovar Typhi
ucaugcgcgucccggcagugcau

SEQ ID NO: 3627932 - RNA, 16 nt, Salmonella enterica enterica serovar Typhi
ucaugcggucuucacu

SEQ ID NO: 3627933 - RNA, 13 nt, Salmonella enterica enterica serovar Typhi
ucaugcuaaaagc

SEQ ID NO: 3627934 - RNA, 23 nt, Salmonella enterica enterica serovar Typhi
ucaugcugcgguuauaauaauaa

SEQ ID NO: 3627935 - RNA, 22 nt, Salmonella enterica enterica serovar Typhi
ucaugcuggcgaugaguaaaau

SEQ ID NO: 3627936 - RNA, 16 nt, Salmonella enterica enterica serovar Typhi
ucaugcuggucagcaa

SEQ ID NO: 3627937 - RNA, 23 nt, Salmonella enterica enterica serovar Typhi
ucaugcuguauaaacucagcaau

SEQ ID NO: 3627938 - RNA, 18 nt, Salmonella enterica enterica serovar Typhi
ucauggacagauuuccac

SEQ ID NO: 3627939 - RNA, 20 nt, Salmonella enterica enterica serovar Typhi
ucauggacagauuuccacga

SEQ ID NO: 3627940 - RNA, 14 nt, Salmonella enterica enterica serovar Typhi
ucaugggaaaucac

SEQ ID NO: 3627941 - RNA, 18 nt, Salmonella enterica enterica serovar Typhi
ucaugguacucaacauca

SEQ ID NO: 3627942 - RNA, 19 nt, Salmonella enterica enterica serovar Typhi
ucaugguagucaaauucca

SEQ ID NO: 3627943 - RNA, 15 nt, Salmonella enterica enterica serovar Typhi
ucauggugaugaucg

SEQ ID NO: 3627944 - RNA, 23 nt, Salmonella enterica enterica serovar Typhi
ucauguuauaagcgcgcagguag

SEQ ID NO: 3627945 - RNA, 19 nt, Salmonella enterica enterica serovar Typhi
ucauguugcggguuucuga

SEQ ID NO: 3627946 - RNA, 21 nt, Salmonella enterica enterica serovar Typhi
ucauguugcggguuucugaau

SEQ ID NO: 3627947 - RNA, 12 nt, Salmonella enterica enterica serovar Typhi
ucauuaaaaugc

SEQ ID NO: 3627948 - RNA, 14 nt, Salmonella enterica enterica serovar Typhi
ucauuaaaauugaa

SEQ ID NO: 3627949 - RNA, 22 nt, Salmonella enterica enterica serovar Typhi
ucauuaacgacaacuucuaauu

SEQ ID NO: 3627950 - RNA, 18 nt, Salmonella enterica enterica serovar Typhi
ucauuaacguaggccgga

SEQ ID NO: 3627951 - RNA, 20 nt, Salmonella enterica enterica serovar Typhi
ucauuaauuauacugucgcu

SEQ ID NO: 3627952 - RNA, 21 nt, Salmonella enterica enterica serovar Typhi
ucauuaauuuacugauaaagg

SEQ ID NO: 3627953 - RNA, 22 nt, Salmonella enterica enterica serovar Typhi
ucauuaauuuucacgcucugac

SEQ ID NO: 3627954 - RNA, 12 nt, Salmonella enterica enterica serovar Typhi
ucauuacaggcg

SEQ ID NO: 3627955 - RNA, 16 nt, Salmonella enterica enterica serovar Typhi
ucauuaccaacguaaa

SEQ ID NO: 3627956 - RNA, 14 nt, Salmonella enterica enterica serovar Typhi
ucauuaccaguuga

SEQ ID NO: 3627957 - RNA, 18 nt, Salmonella enterica enterica serovar Typhi
ucauuacccaauaaugaa

SEQ ID NO: 3627958 - RNA, 22 nt, Salmonella enterica enterica serovar Typhi
ucauuaccuacgcgauaaaaaa

SEQ ID NO: 3627959 - RNA, 18 nt, Salmonella enterica enterica serovar Typhi
ucauuaccuuuuccggcg

SEQ ID NO: 3627960 - RNA, 19 nt, Salmonella enterica enterica serovar Typhi
ucauuacgaaguuuaauuc

SEQ ID NO: 3627961 - RNA, 18 nt, Salmonella enterica enterica serovar Typhi
ucauuacuuauauuuauu

SEQ ID NO: 3627962 - RNA, 13 nt, Salmonella enterica enterica serovar Typhi
ucauuagcgcggu

SEQ ID NO: 3627963 - RNA, 17 nt, Salmonella enterica enterica serovar Typhi
ucauuaggcguaauuau

SEQ ID NO: 3627964 - RNA, 22 nt, Salmonella enterica enterica serovar Typhi
ucauuaucaauagcuucaauga

SEQ ID NO: 3627965 - RNA, 17 nt, Salmonella enterica enterica serovar Typhi
ucauuaugcauugccau

SEQ ID NO: 3627966 - RNA, 18 nt, Salmonella enterica enterica serovar Typhi
ucauuauuuuuaaauaac

SEQ ID NO: 3627967 - RNA, 19 nt, Salmonella enterica enterica serovar Typhi
ucauucacccaauaaauaa

SEQ ID NO: 3627968 - RNA, 17 nt, Salmonella enterica enterica serovar Typhi
ucauucagaucaaaaau

SEQ ID NO: 3627969 - RNA, 15 nt, Salmonella enterica enterica serovar Typhi
ucauucccgccaaua

SEQ ID NO: 3627970 - RNA, 24 nt, Salmonella enterica enterica serovar Typhi
ucauuccgaggguggacaugauaa

SEQ ID NO: 3627971 - RNA, 21 nt, Salmonella enterica enterica serovar Typhi
ucauucgggaugcauaaaaaa

SEQ ID NO: 3627972 - RNA, 20 nt, Salmonella enterica enterica serovar Typhi
ucauucgggucaaugccguc

SEQ ID NO: 3627973 - RNA, 18 nt, Salmonella enterica enterica serovar Typhi
ucauugacccgaucgcua

SEQ ID NO: 3627974 - RNA, 20 nt, Salmonella enterica enterica serovar Typhi
ucauugacccucccugcgcu

SEQ ID NO: 3627975 - RNA, 14 nt, Salmonella enterica enterica serovar Typhi
ucauugaccggaaa

SEQ ID NO: 3627976 - RNA, 20 nt, Salmonella enterica enterica serovar Typhi
ucauugaggcgcgaaaaaua

SEQ ID NO: 3627977 - RNA, 21 nt, Salmonella enterica enterica serovar Typhi
ucauugccguuaacugcugcu

SEQ ID NO: 3627978 - RNA, 20 nt, Salmonella enterica enterica serovar Typhi
ucauugccuguaucgcuauc

SEQ ID NO: 3627979 - RNA, 18 nt, Salmonella enterica enterica serovar Typhi
ucauugcgaucuccuuua

SEQ ID NO: 3627980 - RNA, 20 nt, Salmonella enterica enterica serovar Typhi
ucauugcgccagcuuucggc

SEQ ID NO: 3627981 - RNA, 18 nt, Salmonella enterica enterica serovar Typhi
ucauugcgcuaaaaucca

SEQ ID NO: 3627982 - RNA, 19 nt, Salmonella enterica enterica serovar Typhi
ucauugcgcuaaaauccac

SEQ ID NO: 3627983 - RNA, 20 nt, Salmonella enterica enterica serovar Typhi
ucauuggaagagacacgcug

SEQ ID NO: 3627984 - RNA, 21 nt, Salmonella enterica enterica serovar Typhi
ucauuggaagagacacgcuga

SEQ ID NO: 3627985 - RNA, 17 nt, Salmonella enterica enterica serovar Typhi
ucauuggauuaacggca

SEQ ID NO: 3627986 - RNA, 18 nt, Salmonella enterica enterica serovar Typhi
ucauuggggaaccuggca

SEQ ID NO: 3627987 - RNA, 22 nt, Salmonella enterica enterica serovar Typhi
ucauuuaccagugcuaaaauua

SEQ ID NO: 3627988 - RNA, 15 nt, Salmonella enterica enterica serovar Typhi
ucauuucgaucuguu

SEQ ID NO: 3627989 - RNA, 23 nt, Salmonella enterica enterica serovar Typhi
ucauuugcgagaaaaaguguccg

SEQ ID NO: 3627990 - RNA, 17 nt, Salmonella enterica enterica serovar Typhi
ucauuugcgcuuuuaau

SEQ ID NO: 3627991 - RNA, 21 nt, Salmonella enterica enterica serovar Typhi
ucauuuucaugauauucuguc

SEQ ID NO: 3627992 - RNA, 20 nt, Salmonella enterica enterica serovar Typhi
ucauuuuguugcuccagcau

SEQ ID NO: 3627993 - RNA, 16 nt, Salmonella enterica enterica serovar Typhi
uccaaagcgaagcugc

SEQ ID NO: 3627994 - RNA, 14 nt, Salmonella enterica enterica serovar Typhi
uccaaauaaggacu

SEQ ID NO: 3627995 - RNA, 22 nt, Salmonella enterica enterica serovar Typhi
uccaacacaucgacaugcagau

SEQ ID NO: 3627996 - RNA, 16 nt, Salmonella enterica enterica serovar Typhi
uccaacagaaggcuuc

SEQ ID NO: 3627997 - RNA, 23 nt, Salmonella enterica enterica serovar Typhi
uccaacagaaggcuucacgccac

SEQ ID NO: 3627998 - RNA, 12 nt, Salmonella enterica enterica serovar Typhi
uccaacauagcu

SEQ ID NO: 3627999 - RNA, 13 nt, Salmonella enterica enterica serovar Typhi
uccaacccuugcu

SEQ ID NO: 3628000 - RNA, 14 nt, Salmonella enterica enterica serovar Typhi
uccaacgugcagau

SEQ ID NO: 3628001 - RNA, 17 nt, Salmonella enterica enterica serovar Typhi
uccaacuggcuuucauc

SEQ ID NO: 3628002 - RNA, 18 nt, Salmonella enterica enterica serovar Typhi
uccaacuguuaucauaga

SEQ ID NO: 3628003 - RNA, 13 nt, Salmonella enterica enterica serovar Typhi
uccaaguauugau

SEQ ID NO: 3628004 - RNA, 15 nt, Salmonella enterica enterica serovar Typhi
uccaauagacuucac

SEQ ID NO: 3628005 - RNA, 20 nt, Salmonella enterica enterica serovar Typhi
uccaauagacuucacuuucc

SEQ ID NO: 3628006 - RNA, 19 nt, Salmonella enterica enterica serovar Typhi
uccaauagagcaguuaaua

SEQ ID NO: 3628007 - RNA, 13 nt, Salmonella enterica enterica serovar Typhi
uccaauauuuauu

SEQ ID NO: 3628008 - RNA, 20 nt, Salmonella enterica enterica serovar Typhi
uccaauauuuauuuaauguu

SEQ ID NO: 3628009 - RNA, 18 nt, Salmonella enterica enterica serovar Typhi
uccagcgcucaaucagcg

SEQ ID NO: 3628010 - RNA, 22 nt, Salmonella enterica enterica serovar Typhi
uccagcggccaguguacauagc

SEQ ID NO: 3628011 - RNA, 20 nt, Salmonella enterica enterica serovar Typhi
uccagcgguugcgcuucggc

SEQ ID NO: 3628012 - RNA, 15 nt, Salmonella enterica enterica serovar Typhi
uccagcgucgggccg

SEQ ID NO: 3628013 - RNA, 18 nt, Salmonella enterica enterica serovar Typhi
uccagcguuaaaauaccg

SEQ ID NO: 3628014 - RNA, 20 nt, Salmonella enterica enterica serovar Typhi
uccagcuaaguuuguaaaau

SEQ ID NO: 3628015 - RNA, 14 nt, Salmonella enterica enterica serovar Typhi
uccagcuacuggcc

SEQ ID NO: 3628016 - RNA, 16 nt, Salmonella enterica enterica serovar Typhi
uccagcucauuuuuac

SEQ ID NO: 3628017 - RNA, 13 nt, Salmonella enterica enterica serovar Typhi
uccagcuccagcc

SEQ ID NO: 3628018 - RNA, 14 nt, Salmonella enterica enterica serovar Typhi
uccagcuccaucca

SEQ ID NO: 3628019 - RNA, 20 nt, Salmonella enterica enterica serovar Typhi
uccagcucgcgauaggccuc

SEQ ID NO: 3628020 - RNA, 14 nt, Salmonella enterica enterica serovar Typhi
uccagcucuucuuc

SEQ ID NO: 3628021 - RNA, 20 nt, Salmonella enterica enterica serovar Typhi
uccagcucuuugguccauaa

SEQ ID NO: 3628022 - RNA, 19 nt, Salmonella enterica enterica serovar Typhi
uccagcugcgacagcgaac

SEQ ID NO: 3628023 - RNA, 12 nt, Salmonella enterica enterica serovar Typhi
uccagcuggcug

SEQ ID NO: 3628024 - RNA, 23 nt, Salmonella enterica enterica serovar Typhi
uccagcugguauaggccaggcua

SEQ ID NO: 3628025 - RNA, 17 nt, Salmonella enterica enterica serovar Typhi
uccagcuguaccaucac

SEQ ID NO: 3628026 - RNA, 22 nt, Salmonella enterica enterica serovar Typhi
uccaggaaguaaauuauuccuu

SEQ ID NO: 3628027 - RNA, 24 nt, Salmonella enterica enterica serovar Typhi
uccaggcucgauaaucaucacgcu

SEQ ID NO: 3628028 - RNA, 20 nt, Salmonella enterica enterica serovar Typhi
uccagggauugauggccagc

SEQ ID NO: 3628029 - RNA, 21 nt, Salmonella enterica enterica serovar Typhi
uccagggcugcuggccuucca

SEQ ID NO: 3628030 - RNA, 19 nt, Salmonella enterica enterica serovar Typhi
uccaggguucacugccagu

SEQ ID NO: 3628031 - RNA, 16 nt, Salmonella enterica enterica serovar Typhi
uccagguaacauacaa

SEQ ID NO: 3628032 - RNA, 20 nt, Salmonella enterica enterica serovar Typhi
uccagguucaucacuuucac

SEQ ID NO: 3628033 - RNA, 23 nt, Salmonella enterica enterica serovar Typhi
uccagguugugguuaaacacauc

SEQ ID NO: 3628034 - RNA, 22 nt, Salmonella enterica enterica serovar Typhi
uccagguuucuggcaacagcca

SEQ ID NO: 3628035 - RNA, 14 nt, Salmonella enterica enterica serovar Typhi
uccaguaacgcguc

SEQ ID NO: 3628036 - RNA, 18 nt, Salmonella enterica enterica serovar Typhi
uccaguaauucccggcag

SEQ ID NO: 3628037 - RNA, 22 nt, Salmonella enterica enterica serovar Typhi
uccaguaauucccggcaggcgu

SEQ ID NO: 3628038 - RNA, 19 nt, Salmonella enterica enterica serovar Typhi
uccaguacuuucuuuugau

SEQ ID NO: 3628039 - RNA, 14 nt, Salmonella enterica enterica serovar Typhi
uccagucagcguua

SEQ ID NO: 3628040 - RNA, 16 nt, Salmonella enterica enterica serovar Typhi
uccaguguuguucucu

SEQ ID NO: 3628041 - RNA, 18 nt, Salmonella enterica enterica serovar Typhi
uccaguguuguucucuga

SEQ ID NO: 3628042 - RNA, 13 nt, Salmonella enterica enterica serovar Typhi
uccaguucgagcc

SEQ ID NO: 3628043 - RNA, 20 nt, Salmonella enterica enterica serovar Typhi
uccaguucguucugcgucgc

SEQ ID NO: 3628044 - RNA, 14 nt, Salmonella enterica enterica serovar Typhi
uccaguugcauaca

SEQ ID NO: 3628045 - RNA, 16 nt, Salmonella enterica enterica serovar Typhi
uccaguugcauacaua

SEQ ID NO: 3628046 - RNA, 18 nt, Salmonella enterica enterica serovar Typhi
uccaguugcuuaccuugu

SEQ ID NO: 3628047 - RNA, 21 nt, Salmonella enterica enterica serovar Typhi
uccaguuugcgggaaauacca

SEQ ID NO: 3628048 - RNA, 13 nt, Salmonella enterica enterica serovar Typhi
uccaguuuuuucc

SEQ ID NO: 3628049 - RNA, 14 nt, Salmonella enterica enterica serovar Typhi
uccauaaauaacau

SEQ ID NO: 3628050 - RNA, 16 nt, Salmonella enterica enterica serovar Typhi
uccauaaauaacauuu

SEQ ID NO: 3628051 - RNA, 20 nt, Salmonella enterica enterica serovar Typhi
uccauacacugcauaaauau

SEQ ID NO: 3628052 - RNA, 22 nt, Salmonella enterica enterica serovar Typhi
uccauaccggacuccaggcaac

SEQ ID NO: 3628053 - RNA, 23 nt, Salmonella enterica enterica serovar Typhi
uccauaccguuucaacugccccu

SEQ ID NO: 3628054 - RNA, 19 nt, Salmonella enterica enterica serovar Typhi
uccauauaacagaauaagc

SEQ ID NO: 3628055 - RNA, 12 nt, Salmonella enterica enterica serovar Typhi
uccauauuuauc

SEQ ID NO: 3628056 - RNA, 22 nt, Salmonella enterica enterica serovar Typhi
uccaucacguuggggaauaaau

SEQ ID NO: 3628057 - RNA, 13 nt, Salmonella enterica enterica serovar Typhi
uccaucacuccuu

SEQ ID NO: 3628058 - RNA, 13 nt, Salmonella enterica enterica serovar Typhi
uccaucagccagg

SEQ ID NO: 3628059 - RNA, 17 nt, Salmonella enterica enterica serovar Typhi
uccaucagcgcuuugau

SEQ ID NO: 3628060 - RNA, 15 nt, Salmonella enterica enterica serovar Typhi
uccauccauugcgcc

SEQ ID NO: 3628061 - RNA, 13 nt, Salmonella enterica enterica serovar Typhi
uccauccggcgua

SEQ ID NO: 3628062 - RNA, 19 nt, Salmonella enterica enterica serovar Typhi
uccaucgggcucggcgcuu

SEQ ID NO: 3628063 - RNA, 19 nt, Salmonella enterica enterica serovar Typhi
uccaucgguucucugccau

SEQ ID NO: 3628064 - RNA, 20 nt, Salmonella enterica enterica serovar Typhi
uccaucgguucucugccauc

SEQ ID NO: 3628065 - RNA, 18 nt, Salmonella enterica enterica serovar Typhi
uccaugacgaccacagcc

SEQ ID NO: 3628066 - RNA, 20 nt, Salmonella enterica enterica serovar Typhi
uccaugacgaccacagccgu

SEQ ID NO: 3628067 - RNA, 17 nt, Salmonella enterica enterica serovar Typhi
uccaugagaagaaaaag

SEQ ID NO: 3628068 - RNA, 13 nt, Salmonella enterica enterica serovar Typhi
uccaugccagcgc

SEQ ID NO: 3628069 - RNA, 13 nt, Salmonella enterica enterica serovar Typhi
uccaugcccacac

SEQ ID NO: 3628070 - RNA, 13 nt, Salmonella enterica enterica serovar Typhi
uccaugccggcuu

SEQ ID NO: 3628071 - RNA, 22 nt, Salmonella enterica enterica serovar Typhi
uccaugcgauacguaggccuga

SEQ ID NO: 3628072 - RNA, 13 nt, Salmonella enterica enterica serovar Typhi
uccaugcuucgau

SEQ ID NO: 3628073 - RNA, 14 nt, Salmonella enterica enterica serovar Typhi
uccauggcaaaauu

SEQ ID NO: 3628074 - RNA, 23 nt, Salmonella enterica enterica serovar Typhi
uccauggucagacgcucagccuu

SEQ ID NO: 3628075 - RNA, 20 nt, Salmonella enterica enterica serovar Typhi
uccauggucucuuuuuuagg

SEQ ID NO: 3628076 - RNA, 15 nt, Salmonella enterica enterica serovar Typhi
uccauguaaacucca

SEQ ID NO: 3628077 - RNA, 20 nt, Salmonella enterica enterica serovar Typhi
uccauguuuccccuucuggu

SEQ ID NO: 3628078 - RNA, 21 nt, Salmonella enterica enterica serovar Typhi
uccauuaaaugcgccagcggc

SEQ ID NO: 3628079 - RNA, 20 nt, Salmonella enterica enterica serovar Typhi
uccauuaaauuacuuguuga

SEQ ID NO: 3628080 - RNA, 20 nt, Salmonella enterica enterica serovar Typhi
uccauuaagucgaugaauga

SEQ ID NO: 3628081 - RNA, 19 nt, Salmonella enterica enterica serovar Typhi
uccauuacucucauguuca

SEQ ID NO: 3628082 - RNA, 16 nt, Salmonella enterica enterica serovar Typhi
uccauuagcgccugau

SEQ ID NO: 3628083 - RNA, 16 nt, Salmonella enterica enterica serovar Typhi
uccauugcgagaaaaa

SEQ ID NO: 3628084 - RNA, 18 nt, Salmonella enterica enterica serovar Typhi
uccauugcgagaaaaaac

SEQ ID NO: 3628085 - RNA, 17 nt, Salmonella enterica enterica serovar Typhi
uccauuuuaaauacacc

SEQ ID NO: 3628086 - RNA, 21 nt, Salmonella enterica enterica serovar Typhi
uccauuuuggggaaaauaccg

SEQ ID NO: 3628087 - RNA, 12 nt, Salmonella enterica enterica serovar Typhi
uccauuuuucag

SEQ ID NO: 3628088 - RNA, 20 nt, Salmonella enterica enterica serovar Typhi
uccauuuuucagauaacgaa

SEQ ID NO: 3628089 - RNA, 17 nt, Salmonella enterica enterica serovar Typhi
ucccaacaaugccacgc

SEQ ID NO: 3628090 - RNA, 18 nt, Salmonella enterica enterica serovar Typhi
ucccaacaaugccacgcc

SEQ ID NO: 3628091 - RNA, 20 nt, Salmonella enterica enterica serovar Typhi
ucccaaccaguaugaccguu

SEQ ID NO: 3628092 - RNA, 17 nt, Salmonella enterica enterica serovar Typhi
ucccaaugcggaaacca

SEQ ID NO: 3628093 - RNA, 13 nt, Salmonella enterica enterica serovar Typhi
ucccaaugcuuuc

SEQ ID NO: 3628094 - RNA, 21 nt, Salmonella enterica enterica serovar Typhi
ucccgccgguucaauaaauca

SEQ ID NO: 3628095 - RNA, 17 nt, Salmonella enterica enterica serovar Typhi
ucccgccuugcggcgcc

SEQ ID NO: 3628096 - RNA, 20 nt, Salmonella enterica enterica serovar Typhi
ucccgcgcagugcagcggau

SEQ ID NO: 3628097 - RNA, 13 nt, Salmonella enterica enterica serovar Typhi
ucccgcgcggucg

SEQ ID NO: 3628098 - RNA, 17 nt, Salmonella enterica enterica serovar Typhi
ucccgcgcuucauccga

SEQ ID NO: 3628099 - RNA, 21 nt, Salmonella enterica enterica serovar Typhi
ucccgcguucgcgcaguucau

SEQ ID NO: 3628100 - RNA, 12 nt, Salmonella enterica enterica serovar Typhi
ucccgcuggcug

SEQ ID NO: 3628101 - RNA, 15 nt, Salmonella enterica enterica serovar Typhi
ucccgcuggcuggcg

SEQ ID NO: 3628102 - RNA, 17 nt, Salmonella enterica enterica serovar Typhi
ucccgcuggcuggcguu

SEQ ID NO: 3628103 - RNA, 21 nt, Salmonella enterica enterica serovar Typhi
ucccggaacaaaagaaagcaa

SEQ ID NO: 3628104 - RNA, 21 nt, Salmonella enterica enterica serovar Typhi
ucccggcaauuaccgccagcg

SEQ ID NO: 3628105 - RNA, 14 nt, Salmonella enterica enterica serovar Typhi
ucccggcagugcau

SEQ ID NO: 3628106 - RNA, 17 nt, Salmonella enterica enterica serovar Typhi
ucccggcgauuaauaaa

SEQ ID NO: 3628107 - RNA, 12 nt, Salmonella enterica enterica serovar Typhi
ucccggcgugug

SEQ ID NO: 3628108 - RNA, 18 nt, Salmonella enterica enterica serovar Typhi
ucccggcuuaaauggcgc

SEQ ID NO: 3628109 - RNA, 22 nt, Salmonella enterica enterica serovar Typhi
ucccggcuuaaauuuuuaauaa

SEQ ID NO: 3628110 - RNA, 16 nt, Salmonella enterica enterica serovar Typhi
ucccgggcgauaaacc

SEQ ID NO: 3628111 - RNA, 23 nt, Salmonella enterica enterica serovar Typhi
ucccgggcgauaaaccagcccca

SEQ ID NO: 3628112 - RNA, 23 nt, Salmonella enterica enterica serovar Typhi
ucccgguuaucgaacagcuuacc

SEQ ID NO: 3628113 - RNA, 22 nt, Salmonella enterica enterica serovar Typhi
ucccgguuuaugcgguucuccc

SEQ ID NO: 3628114 - RNA, 15 nt, Salmonella enterica enterica serovar Typhi
ucccguagcgucaac

SEQ ID NO: 3628115 - RNA, 20 nt, Salmonella enterica enterica serovar Typhi
ucccguagcgucaacacgag

SEQ ID NO: 3628116 - RNA, 16 nt, Salmonella enterica enterica serovar Typhi
ucccguaucuucaugu

SEQ ID NO: 3628117 - RNA, 19 nt, Salmonella enterica enterica serovar Typhi
ucccgucauugcgcgcaug

SEQ ID NO: 3628118 - RNA, 17 nt, Salmonella enterica enterica serovar Typhi
ucccguuucagccccuu

SEQ ID NO: 3628119 - RNA, 13 nt, Salmonella enterica enterica serovar Typhi
ucccguuucagug

SEQ ID NO: 3628120 - RNA, 17 nt, Salmonella enterica enterica serovar Typhi
ucccuaagccggcaggc

SEQ ID NO: 3628121 - RNA, 13 nt, Salmonella enterica enterica serovar Typhi
ucccuaauaaaau

SEQ ID NO: 3628122 - RNA, 17 nt, Salmonella enterica enterica serovar Typhi
ucccucacgcgucacaa

SEQ ID NO: 3628123 - RNA, 14 nt, Salmonella enterica enterica serovar Typhi
ucccuccugcucca

SEQ ID NO: 3628124 - RNA, 14 nt, Salmonella enterica enterica serovar Typhi
ucccucgaaguauu

SEQ ID NO: 3628125 - RNA, 11 nt, Salmonella enterica enterica serovar Typhi
ucccucuccag

SEQ ID NO: 3628126 - RNA, 13 nt, Salmonella enterica enterica serovar Typhi
ucccucuccgccg

SEQ ID NO: 3628127 - RNA, 13 nt, Salmonella enterica enterica serovar Typhi
ucccugaagaaaa

SEQ ID NO: 3628128 - RNA, 19 nt, Salmonella enterica enterica serovar Typhi
ucccugagucuugccuguc

SEQ ID NO: 3628129 - RNA, 15 nt, Salmonella enterica enterica serovar Typhi
ucccugcauucuuuc

SEQ ID NO: 3628130 - RNA, 21 nt, Salmonella enterica enterica serovar Typhi
ucccugccagugaaaguuuuc

SEQ ID NO: 3628131 - RNA, 16 nt, Salmonella enterica enterica serovar Typhi
ucccuggauaaaauau

SEQ ID NO: 3628132 - RNA, 12 nt, Salmonella enterica enterica serovar Typhi
ucccuguucaaa

SEQ ID NO: 3628133 - RNA, 20 nt, Salmonella enterica enterica serovar Typhi
ucccuuccgccaccagguuc

SEQ ID NO: 3628134 - RNA, 16 nt, Salmonella enterica enterica serovar Typhi
ucccuucucgcuaaua

SEQ ID NO: 3628135 - RNA, 12 nt, Salmonella enterica enterica serovar Typhi
ucccuucuuuua

SEQ ID NO: 3628136 - RNA, 14 nt, Salmonella enterica enterica serovar Typhi
ucccuucuuuuacu

SEQ ID NO: 3628137 - RNA, 15 nt, Salmonella enterica enterica serovar Typhi
ucccuucuuuuacug

SEQ ID NO: 3628138 - RNA, 17 nt, Salmonella enterica enterica serovar Typhi
uccgaaacaaucaccug

SEQ ID NO: 3628139 - RNA, 14 nt, Salmonella enterica enterica serovar Typhi
uccgaaauaaaucg

SEQ ID NO: 3628140 - RNA, 15 nt, Salmonella enterica enterica serovar Typhi
uccgaacucaugccg

SEQ ID NO: 3628141 - RNA, 21 nt, Salmonella enterica enterica serovar Typhi
uccgaauauuuagcuuuucgg

SEQ ID NO: 3628142 - RNA, 22 nt, Salmonella enterica enterica serovar Typhi
uccgacagugaacggcauaauc

SEQ ID NO: 3628143 - RNA, 16 nt, Salmonella enterica enterica serovar Typhi
uccgacaugacgucgc

SEQ ID NO: 3628144 - RNA, 13 nt, Salmonella enterica enterica serovar Typhi
uccgacauuagcg

SEQ ID NO: 3628145 - RNA, 19 nt, Salmonella enterica enterica serovar Typhi
uccgaccacggccacagcc

SEQ ID NO: 3628146 - RNA, 12 nt, Salmonella enterica enterica serovar Typhi
uccgacgccugu

SEQ ID NO: 3628147 - RNA, 21 nt, Salmonella enterica enterica serovar Typhi
uccgacguuugcguaaagcug

SEQ ID NO: 3628148 - RNA, 18 nt, Salmonella enterica enterica serovar Typhi
uccgacugaccagacaga

SEQ ID NO: 3628149 - RNA, 22 nt, Salmonella enterica enterica serovar Typhi
uccgagacgguaagaauaauaa

SEQ ID NO: 3628150 - RNA, 18 nt, Salmonella enterica enterica serovar Typhi
uccgagacucaaagaaaa

SEQ ID NO: 3628151 - RNA, 19 nt, Salmonella enterica enterica serovar Typhi
uccgaggcguaucccagua

SEQ ID NO: 3628152 - RNA, 23 nt, Salmonella enterica enterica serovar Typhi
uccgaggcguaucccaguaaaua

SEQ ID NO: 3628153 - RNA, 21 nt, Salmonella enterica enterica serovar Typhi
uccgauggagugcaaucccgg

SEQ ID NO: 3628154 - RNA, 19 nt, Salmonella enterica enterica serovar Typhi
uccgauuucaugcgcagca

SEQ ID NO: 3628155 - RNA, 22 nt, Salmonella enterica enterica serovar Typhi
uccgcaaagacaacgaccagug

SEQ ID NO: 3628156 - RNA, 11 nt, Salmonella enterica enterica serovar Typhi
uccgcaacaag

SEQ ID NO: 3628157 - RNA, 19 nt, Salmonella enterica enterica serovar Typhi
uccgcaacugaaaccaggc

SEQ ID NO: 3628158 - RNA, 15 nt, Salmonella enterica enterica serovar Typhi
uccgcaauccuggcu

SEQ ID NO: 3628159 - RNA, 16 nt, Salmonella enterica enterica serovar Typhi
uccgcaauuaauuuau

SEQ ID NO: 3628160 - RNA, 16 nt, Salmonella enterica enterica serovar Typhi
uccgcaauuuccugau

SEQ ID NO: 3628161 - RNA, 17 nt, Salmonella enterica enterica serovar Typhi
uccgcacauaaucaccg

SEQ ID NO: 3628162 - RNA, 20 nt, Salmonella enterica enterica serovar Typhi
uccgcacgccugcauaaagg

SEQ ID NO: 3628163 - RNA, 21 nt, Salmonella enterica enterica serovar Typhi
uccgcacgccugcauaaagga

SEQ ID NO: 3628164 - RNA, 15 nt, Salmonella enterica enterica serovar Typhi
uccgcagauccagca

SEQ ID NO: 3628165 - RNA, 22 nt, Salmonella enterica enterica serovar Typhi
uccgcagauccagcacggccuu

SEQ ID NO: 3628166 - RNA, 12 nt, Salmonella enterica enterica serovar Typhi
uccgcagccaga

SEQ ID NO: 3628167 - RNA, 17 nt, Salmonella enterica enterica serovar Typhi
uccgcagccgacgcauu

SEQ ID NO: 3628168 - RNA, 15 nt, Salmonella enterica enterica serovar Typhi
uccgcaggagagcca

SEQ ID NO: 3628169 - RNA, 15 nt, Salmonella enterica enterica serovar Typhi
uccgcaggcaacaca

SEQ ID NO: 3628170 - RNA, 17 nt, Salmonella enterica enterica serovar Typhi
uccgcaucagcaacgcg

SEQ ID NO: 3628171 - RNA, 14 nt, Salmonella enterica enterica serovar Typhi
uccgcauucuaaau

SEQ ID NO: 3628172 - RNA, 16 nt, Salmonella enterica enterica serovar Typhi
uccgccacgcucgcug

SEQ ID NO: 3628173 - RNA, 12 nt, Salmonella enterica enterica serovar Typhi
uccgccacggcu

SEQ ID NO: 3628174 - RNA, 19 nt, Salmonella enterica enterica serovar Typhi
uccgccagauacaaaucuc

SEQ ID NO: 3628175 - RNA, 15 nt, Salmonella enterica enterica serovar Typhi
uccgccagcaacacu

SEQ ID NO: 3628176 - RNA, 16 nt, Salmonella enterica enterica serovar Typhi
uccgccagcaacacuu

SEQ ID NO: 3628177 - RNA, 18 nt, Salmonella enterica enterica serovar Typhi
uccgccagcaaugccgcc

SEQ ID NO: 3628178 - RNA, 16 nt, Salmonella enterica enterica serovar Typhi
uccgccaggcccauga

SEQ ID NO: 3628179 - RNA, 20 nt, Salmonella enterica enterica serovar Typhi
uccgccaggcggguggugag

SEQ ID NO: 3628180 - RNA, 23 nt, Salmonella enterica enterica serovar Typhi
uccgccaucgccucgauaaacau

SEQ ID NO: 3628181 - RNA, 22 nt, Salmonella enterica enterica serovar Typhi
uccgccaugaaaaaaacgcauu

SEQ ID NO: 3628182 - RNA, 15 nt, Salmonella enterica enterica serovar Typhi
uccgccaugguuggg

SEQ ID NO: 3628183 - RNA, 17 nt, Salmonella enterica enterica serovar Typhi
uccgcccaagaacauga

SEQ ID NO: 3628184 - RNA, 18 nt, Salmonella enterica enterica serovar Typhi
uccgcccaagaacaugac

SEQ ID NO: 3628185 - RNA, 13 nt, Salmonella enterica enterica serovar Typhi
uccgccccgcugg

SEQ ID NO: 3628186 - RNA, 16 nt, Salmonella enterica enterica serovar Typhi
uccgccgcaauagcca

SEQ ID NO: 3628187 - RNA, 14 nt, Salmonella enterica enterica serovar Typhi
uccgccgccgccau

SEQ ID NO: 3628188 - RNA, 16 nt, Salmonella enterica enterica serovar Typhi
uccgccgccgccaucg

SEQ ID NO: 3628189 - RNA, 15 nt, Salmonella enterica enterica serovar Typhi
uccgccugaaucgcc

SEQ ID NO: 3628190 - RNA, 21 nt, Salmonella enterica enterica serovar Typhi
uccgccugauaaaacgcaggc

SEQ ID NO: 3628191 - RNA, 17 nt, Salmonella enterica enterica serovar Typhi
uccgccugaucuuucug

SEQ ID NO: 3628192 - RNA, 11 nt, Salmonella enterica enterica serovar Typhi
uccgccugcug

SEQ ID NO: 3628193 - RNA, 20 nt, Salmonella enterica enterica serovar Typhi
uccgccuggaacccaggcac

SEQ ID NO: 3628194 - RNA, 22 nt, Salmonella enterica enterica serovar Typhi
uccgccuggaacccaggcaccu

SEQ ID NO: 3628195 - RNA, 17 nt, Salmonella enterica enterica serovar Typhi
uccgccuuugacgccgg

SEQ ID NO: 3628196 - RNA, 23 nt, Salmonella enterica enterica serovar Typhi
uccgcgauaucaaucaccucuuc

SEQ ID NO: 3628197 - RNA, 17 nt, Salmonella enterica enterica serovar Typhi
uccgcgcaauaugcggc

SEQ ID NO: 3628198 - RNA, 19 nt, Salmonella enterica enterica serovar Typhi
uccgcgcaauaugcggcgc

SEQ ID NO: 3628199 - RNA, 17 nt, Salmonella enterica enterica serovar Typhi
uccgcgccgagugcuug

SEQ ID NO: 3628200 - RNA, 19 nt, Salmonella enterica enterica serovar Typhi
uccgcgccgagugcuugca

SEQ ID NO: 3628201 - RNA, 12 nt, Salmonella enterica enterica serovar Typhi
uccgcgccgccg

SEQ ID NO: 3628202 - RNA, 18 nt, Salmonella enterica enterica serovar Typhi
uccgcgccgccgccgaag

SEQ ID NO: 3628203 - RNA, 12 nt, Salmonella enterica enterica serovar Typhi
uccgcgcugaug

SEQ ID NO: 3628204 - RNA, 14 nt, Salmonella enterica enterica serovar Typhi
uccgcggcaaaccc

SEQ ID NO: 3628205 - RNA, 15 nt, Salmonella enterica enterica serovar Typhi
uccgcgguguccugc

SEQ ID NO: 3628206 - RNA, 23 nt, Salmonella enterica enterica serovar Typhi
uccgcguuagcaagaccgggcug

SEQ ID NO: 3628207 - RNA, 18 nt, Salmonella enterica enterica serovar Typhi
uccgcguuuaucgcauac

SEQ ID NO: 3628208 - RNA, 14 nt, Salmonella enterica enterica serovar Typhi
uccgcuagggcauc

SEQ ID NO: 3628209 - RNA, 17 nt, Salmonella enterica enterica serovar Typhi
uccgcuagggcaucaga

SEQ ID NO: 3628210 - RNA, 16 nt, Salmonella enterica enterica serovar Typhi
uccgcuauuaccagua

SEQ ID NO: 3628211 - RNA, 20 nt, Salmonella enterica enterica serovar Typhi
uccgcuauuaccaguaauga

SEQ ID NO: 3628212 - RNA, 15 nt, Salmonella enterica enterica serovar Typhi
uccgcuccacauccu

SEQ ID NO: 3628213 - RNA, 18 nt, Salmonella enterica enterica serovar Typhi
uccgcuggcguccagccc

SEQ ID NO: 3628214 - RNA, 23 nt, Salmonella enterica enterica serovar Typhi
uccgcuggcguccagcccgucca

SEQ ID NO: 3628215 - RNA, 15 nt, Salmonella enterica enterica serovar Typhi
uccgcuguuaugcac

SEQ ID NO: 3628216 - RNA, 20 nt, Salmonella enterica enterica serovar Typhi
uccgcuucaccuuucgccgc

SEQ ID NO: 3628217 - RNA, 19 nt, Salmonella enterica enterica serovar Typhi
uccgcuucgcgggaccaaa

SEQ ID NO: 3628218 - RNA, 19 nt, Salmonella enterica enterica serovar Typhi
uccgcuuuuccugccagca

SEQ ID NO: 3628219 - RNA, 16 nt, Salmonella enterica enterica serovar Typhi
uccgcuuuugguuuuu

SEQ ID NO: 3628220 - RNA, 20 nt, Salmonella enterica enterica serovar Typhi
uccgcuuuuuuauuguuucu

SEQ ID NO: 3628221 - RNA, 18 nt, Salmonella enterica enterica serovar Typhi
uccggacguacccaggcg

SEQ ID NO: 3628222 - RNA, 14 nt, Salmonella enterica enterica serovar Typhi
uccggagccugugu

SEQ ID NO: 3628223 - RNA, 21 nt, Salmonella enterica enterica serovar Typhi
uccggaucaucuuuuaccgcc

SEQ ID NO: 3628224 - RNA, 15 nt, Salmonella enterica enterica serovar Typhi
uccggaugccccauc

SEQ ID NO: 3628225 - RNA, 20 nt, Salmonella enterica enterica serovar Typhi
uccggauucgcggcaaacac

SEQ ID NO: 3628226 - RNA, 14 nt, Salmonella enterica enterica serovar Typhi
uccggcaaacucag

SEQ ID NO: 3628227 - RNA, 19 nt, Salmonella enterica enterica serovar Typhi
uccggcaaacucagcggcu

SEQ ID NO: 3628228 - RNA, 21 nt, Salmonella enterica enterica serovar Typhi
uccggcaacggguuagacuca

SEQ ID NO: 3628229 - RNA, 21 nt, Salmonella enterica enterica serovar Typhi
uccggcaagucagaccagucg

SEQ ID NO: 3628230 - RNA, 13 nt, Salmonella enterica enterica serovar Typhi
uccggcacacagc

SEQ ID NO: 3628231 - RNA, 18 nt, Salmonella enterica enterica serovar Typhi
uccggcacgauaaauugc

SEQ ID NO: 3628232 - RNA, 19 nt, Salmonella enterica enterica serovar Typhi
uccggcacgauaaauugcc

SEQ ID NO: 3628233 - RNA, 23 nt, Salmonella enterica enterica serovar Typhi
uccggcacgauaaauugccugau

SEQ ID NO: 3628234 - RNA, 12 nt, Salmonella enterica enterica serovar Typhi
uccggcaggcaa

SEQ ID NO: 3628235 - RNA, 19 nt, Salmonella enterica enterica serovar Typhi
uccggcauaaaaagccucu

SEQ ID NO: 3628236 - RNA, 21 nt, Salmonella enterica enterica serovar Typhi
uccggcauaauaugcaacacg

SEQ ID NO: 3628237 - RNA, 16 nt, Salmonella enterica enterica serovar Typhi
uccggcauccagcgcu

SEQ ID NO: 3628238 - RNA, 12 nt, Salmonella enterica enterica serovar Typhi
uccggccagcgc

SEQ ID NO: 3628239 - RNA, 17 nt, Salmonella enterica enterica serovar Typhi
uccggccagcgccagcg

SEQ ID NO: 3628240 - RNA, 23 nt, Salmonella enterica enterica serovar Typhi
uccggcccggagguaaauuaacg

SEQ ID NO: 3628241 - RNA, 17 nt, Salmonella enterica enterica serovar Typhi
uccggcccgugccagcu

SEQ ID NO: 3628242 - RNA, 20 nt, Salmonella enterica enterica serovar Typhi
uccggccuacgcgucaauua

SEQ ID NO: 3628243 - RNA, 15 nt, Salmonella enterica enterica serovar Typhi
uccggccuacucuug

SEQ ID NO: 3628244 - RNA, 14 nt, Salmonella enterica enterica serovar Typhi
uccggccugcaggc

SEQ ID NO: 3628245 - RNA, 16 nt, Salmonella enterica enterica serovar Typhi
uccggccugcagggaa

SEQ ID NO: 3628246 - RNA, 13 nt, Salmonella enterica enterica serovar Typhi
uccggccugcaug

SEQ ID NO: 3628247 - RNA, 14 nt, Salmonella enterica enterica serovar Typhi
uccggcgauagcgg

SEQ ID NO: 3628248 - RNA, 19 nt, Salmonella enterica enterica serovar Typhi
uccggcgcggcgcgcaugc

SEQ ID NO: 3628249 - RNA, 23 nt, Salmonella enterica enterica serovar Typhi
uccggcgcgguauuucgccgccg

SEQ ID NO: 3628250 - RNA, 22 nt, Salmonella enterica enterica serovar Typhi
uccggcgcguucaugcgaaugc

SEQ ID NO: 3628251 - RNA, 18 nt, Salmonella enterica enterica serovar Typhi
uccggcgcucacgcugac

SEQ ID NO: 3628252 - RNA, 21 nt, Salmonella enterica enterica serovar Typhi
uccggcgcugaugacgcgccg

SEQ ID NO: 3628253 - RNA, 14 nt, Salmonella enterica enterica serovar Typhi
uccggcgcugcgcg

SEQ ID NO: 3628254 - RNA, 17 nt, Salmonella enterica enterica serovar Typhi
uccggcgcugcgcggcg

SEQ ID NO: 3628255 - RNA, 17 nt, Salmonella enterica enterica serovar Typhi
uccggcgcuggcgcacg

SEQ ID NO: 3628256 - RNA, 16 nt, Salmonella enterica enterica serovar Typhi
uccggcgcuuccugca

SEQ ID NO: 3628257 - RNA, 19 nt, Salmonella enterica enterica serovar Typhi
uccggcgggagcucuacca

SEQ ID NO: 3628258 - RNA, 17 nt, Salmonella enterica enterica serovar Typhi
uccggcggucagccagc

SEQ ID NO: 3628259 - RNA, 23 nt, Salmonella enterica enterica serovar Typhi
uccggcggugcagguugccugau

SEQ ID NO: 3628260 - RNA, 21 nt, Salmonella enterica enterica serovar Typhi
uccggcgugucagggcggaac

SEQ ID NO: 3628261 - RNA, 17 nt, Salmonella enterica enterica serovar Typhi
uccggcuacgguuuuaa

SEQ ID NO: 3628262 - RNA, 16 nt, Salmonella enterica enterica serovar Typhi
uccggcuaugccggag

SEQ ID NO: 3628263 - RNA, 18 nt, Salmonella enterica enterica serovar Typhi
uccggcugcaccagcguu

SEQ ID NO: 3628264 - RNA, 11 nt, Salmonella enterica enterica serovar Typhi
uccggcugccu

SEQ ID NO: 3628265 - RNA, 16 nt, Salmonella enterica enterica serovar Typhi
uccugccugacaauga

SEQ ID NO: 3628266 - RNA, 19 nt, Salmonella enterica enterica serovar Typhi
uccugcgcugucaccagca

SEQ ID NO: 3628267 - RNA, 20 nt, Salmonella enterica enterica serovar Typhi
uccugcucaugcgagguaua

SEQ ID NO: 3628268 - RNA, 21 nt, Salmonella enterica enterica serovar Typhi
uccugcuccugcggcguggaa

SEQ ID NO: 3628269 - RNA, 21 nt, Salmonella enterica enterica serovar Typhi
uccugcuggcaaaacgcaucc

SEQ ID NO: 3628270 - RNA, 12 nt, Salmonella enterica enterica serovar Typhi
uccugcuguggu

SEQ ID NO: 3628271 - RNA, 14 nt, Salmonella enterica enterica serovar Typhi
uccuggauuugcug

SEQ ID NO: 3628272 - RNA, 13 nt, Salmonella enterica enterica serovar Typhi
uccuggauuuuac

SEQ ID NO: 3628273 - RNA, 15 nt, Salmonella enterica enterica serovar Typhi
uccuggccaggcuuc

SEQ ID NO: 3628274 - RNA, 20 nt, Salmonella enterica enterica serovar Typhi
uccuggcguuaucaucguaa

SEQ ID NO: 3628275 - RNA, 22 nt, Salmonella enterica enterica serovar Typhi
uccuggcugucggcagaaccug

SEQ ID NO: 3628276 - RNA, 16 nt, Salmonella enterica enterica serovar Typhi
uccuggcuuaccugcu

SEQ ID NO: 3628277 - RNA, 14 nt, Salmonella enterica enterica serovar Typhi
uccuggcuugccag

SEQ ID NO: 3628278 - RNA, 15 nt, Salmonella enterica enterica serovar Typhi
uccuggcuugccaga

SEQ ID NO: 3628279 - RNA, 21 nt, Salmonella enterica enterica serovar Typhi
uccugggcaaaauagcccggc

SEQ ID NO: 3628280 - RNA, 20 nt, Salmonella enterica enterica serovar Typhi
uccugguaacggcacugcuu

SEQ ID NO: 3628281 - RNA, 15 nt, Salmonella enterica enterica serovar Typhi
uccuggugugguuau

SEQ ID NO: 3628282 - RNA, 19 nt, Salmonella enterica enterica serovar Typhi
uccuguaaaaaauccagcg

SEQ ID NO: 3628283 - RNA, 22 nt, Salmonella enterica enterica serovar Typhi
uccuguaacaacuguuuuucac

SEQ ID NO: 3628284 - RNA, 22 nt, Salmonella enterica enterica serovar Typhi
uccuguagcgucuuuugaguga

SEQ ID NO: 3628285 - RNA, 12 nt, Salmonella enterica enterica serovar Typhi
uccugucccugc

SEQ ID NO: 3628286 - RNA, 13 nt, Salmonella enterica enterica serovar Typhi
uccugucccugcc

SEQ ID NO: 3628287 - RNA, 15 nt, Salmonella enterica enterica serovar Typhi
uccugugcuuugauu

SEQ ID NO: 3628288 - RNA, 14 nt, Salmonella enterica enterica serovar Typhi
uccugugucggcag

SEQ ID NO: 3628289 - RNA, 19 nt, Salmonella enterica enterica serovar Typhi
uccuguuuuuucagcgcgc

SEQ ID NO: 3628290 - RNA, 13 nt, Salmonella enterica enterica serovar Typhi
uccuuaaucagcu

SEQ ID NO: 3628291 - RNA, 22 nt, Salmonella enterica enterica serovar Typhi
uccuuacagcuucgguccggcg

SEQ ID NO: 3628292 - RNA, 18 nt, Salmonella enterica enterica serovar Typhi
uccuuauuaaagccccuu

SEQ ID NO: 3628293 - RNA, 22 nt, Salmonella enterica enterica serovar Typhi
uccuuauuuacgguuggccagc

SEQ ID NO: 3628294 - RNA, 14 nt, Salmonella enterica enterica serovar Typhi
uccuucaauuuuac

SEQ ID NO: 3628295 - RNA, 13 nt, Salmonella enterica enterica serovar Typhi
uccuucauucaga

SEQ ID NO: 3628296 - RNA, 15 nt, Salmonella enterica enterica serovar Typhi
uccuucgcuuccugg

SEQ ID NO: 3628297 - RNA, 17 nt, Salmonella enterica enterica serovar Typhi
uccuucggugccauauu

SEQ ID NO: 3628298 - RNA, 20 nt, Salmonella enterica enterica serovar Typhi
uccuucguuacuuucauaau

SEQ ID NO: 3628299 - RNA, 10 nt, Salmonella enterica enterica serovar Typhi
uccuucuucc

SEQ ID NO: 3628300 - RNA, 13 nt, Salmonella enterica enterica serovar Typhi
uccuucuuccauu

SEQ ID NO: 3628301 - RNA, 16 nt, Salmonella enterica enterica serovar Typhi
uccuucuucgccguca

SEQ ID NO: 3628302 - RNA, 14 nt, Salmonella enterica enterica serovar Typhi
uccuugagugguuu

SEQ ID NO: 3628303 - RNA, 19 nt, Salmonella enterica enterica serovar Typhi
uccuugcacgccaaaaagu

SEQ ID NO: 3628304 - RNA, 14 nt, Salmonella enterica enterica serovar Typhi
uccuugcagccaga

SEQ ID NO: 3628305 - RNA, 22 nt, Salmonella enterica enterica serovar Typhi
uccuugcagccagaacucaucu

SEQ ID NO: 3628306 - RNA, 23 nt, Salmonella enterica enterica serovar Typhi
uccuugcccuguuucgcaggccg

SEQ ID NO: 3628307 - RNA, 20 nt, Salmonella enterica enterica serovar Typhi
uccuuuaaugaagcaacugu

SEQ ID NO: 3628308 - RNA, 21 nt, Salmonella enterica enterica serovar Typhi
uccuuuacugcgccagccugc

SEQ ID NO: 3628309 - RNA, 21 nt, Salmonella enterica enterica serovar Typhi
uccuuuuaccggcgaagucgc

SEQ ID NO: 3628310 - RNA, 13 nt, Salmonella enterica enterica serovar Typhi
uccuuuuucaggc

SEQ ID NO: 3628311 - RNA, 18 nt, Salmonella enterica enterica serovar Typhi
ucgaaacaggaaaaacau

SEQ ID NO: 3628312 - RNA, 23 nt, Salmonella enterica enterica serovar Typhi
ucgaaaccaucgucgucccgcga

SEQ ID NO: 3628313 - RNA, 15 nt, Salmonella enterica enterica serovar Typhi
ucgaaacgcugcgcu

SEQ ID NO: 3628314 - RNA, 16 nt, Salmonella enterica enterica serovar Typhi
ucgaaagagcaaauac

SEQ ID NO: 3628315 - RNA, 22 nt, Salmonella enterica enterica serovar Typhi
ucgaaagagcaaauacuggaaa

SEQ ID NO: 3628316 - RNA, 20 nt, Salmonella enterica enterica serovar Typhi
ucgaacagguuguugauguu

SEQ ID NO: 3628317 - RNA, 14 nt, Salmonella enterica enterica serovar Typhi
ucgaacaucugcgu

SEQ ID NO: 3628318 - RNA, 11 nt, Salmonella enterica enterica serovar Typhi
ucgaacgccgc

SEQ ID NO: 3628319 - RNA, 19 nt, Salmonella enterica enterica serovar Typhi
ucgaacgccgccugcgcca

SEQ ID NO: 3628320 - RNA, 23 nt, Salmonella enterica enterica serovar Typhi
ucgaacgccgccugcgccagcgc

SEQ ID NO: 3628321 - RNA, 19 nt, Salmonella enterica enterica serovar Typhi
ucgaacgcuuccgggcuca

SEQ ID NO: 3628322 - RNA, 17 nt, Salmonella enterica enterica serovar Typhi
ucgaacgguaacaggaa

SEQ ID NO: 3628323 - RNA, 19 nt, Salmonella enterica enterica serovar Typhi
ucgaacucuucgcaaccgg

SEQ ID NO: 3628324 - RNA, 17 nt, Salmonella enterica enterica serovar Typhi
ucgaacuugaccagcac

SEQ ID NO: 3628325 - RNA, 15 nt, Salmonella enterica enterica serovar Typhi
ucgaagaccuggccg

SEQ ID NO: 3628326 - RNA, 16 nt, Salmonella enterica enterica serovar Typhi
ucgaagagcacuuugg

SEQ ID NO: 3628327 - RNA, 19 nt, Salmonella enterica enterica serovar Typhi
ucgaagccgaccaccaucc

SEQ ID NO: 3628328 - RNA, 16 nt, Salmonella enterica enterica serovar Typhi
ucgaaucgccucaacc

SEQ ID NO: 3628329 - RNA, 17 nt, Salmonella enterica enterica serovar Typhi
ucgaaucuuauaaaucg

SEQ ID NO: 3628330 - RNA, 14 nt, Salmonella enterica enterica serovar Typhi
ucgacaaaggcaag

SEQ ID NO: 3628331 - RNA, 11 nt, Salmonella enterica enterica serovar Typhi
ucgacaagcua

SEQ ID NO: 3628332 - RNA, 16 nt, Salmonella enterica enterica serovar Typhi
ucgacaagcuaauccc

SEQ ID NO: 3628333 - RNA, 19 nt, Salmonella enterica enterica serovar Typhi
ucgacaauaaauugcgacc

SEQ ID NO: 3628334 - RNA, 15 nt, Salmonella enterica enterica serovar Typhi
ucgacaauccgccac

SEQ ID NO: 3628335 - RNA, 16 nt, Salmonella enterica enterica serovar Typhi
ucgacaauguccgcca

SEQ ID NO: 3628336 - RNA, 20 nt, Salmonella enterica enterica serovar Typhi
ucgacagaacggauauccag

SEQ ID NO: 3628337 - RNA, 14 nt, Salmonella enterica enterica serovar Typhi
ucgacagccacacg

SEQ ID NO: 3628338 - RNA, 20 nt, Salmonella enterica enterica serovar Typhi
ucgacagccagcauuuccag

SEQ ID NO: 3628339 - RNA, 21 nt, Salmonella enterica enterica serovar Typhi
ucgacagccagcauuuccagc

SEQ ID NO: 3628340 - RNA, 22 nt, Salmonella enterica enterica serovar Typhi
ucgacagccagcauuuccagcu

SEQ ID NO: 3628341 - RNA, 15 nt, Salmonella enterica enterica serovar Typhi
ucgacaggaguauag

SEQ ID NO: 3628342 - RNA, 14 nt, Salmonella enterica enterica serovar Typhi
ucgacaggcguaaa

SEQ ID NO: 3628343 - RNA, 16 nt, Salmonella enterica enterica serovar Typhi
ucgacaguucccggca

SEQ ID NO: 3628344 - RNA, 22 nt, Salmonella enterica enterica serovar Typhi
ucgacauaauuuccggccagua

SEQ ID NO: 3628345 - RNA, 19 nt, Salmonella enterica enterica serovar Typhi
ucgacauaguacccucugc

SEQ ID NO: 3628346 - RNA, 14 nt, Salmonella enterica enterica serovar Typhi
ucgacaugcguacc

SEQ ID NO: 3628347 - RNA, 15 nt, Salmonella enterica enterica serovar Typhi
ucgacaugggcggga

SEQ ID NO: 3628348 - RNA, 23 nt, Salmonella enterica enterica serovar Typhi
ucgacaugggcgggauccugcaa

SEQ ID NO: 3628349 - RNA, 19 nt, Salmonella enterica enterica serovar Typhi
ucgacauuagcaucccgca

SEQ ID NO: 3628350 - RNA, 17 nt, Salmonella enterica enterica serovar Typhi
ucgaccagcagcgggcu

SEQ ID NO: 3628351 - RNA, 20 nt, Salmonella enterica enterica serovar Typhi
ucgcauucuucagcgcgucc

SEQ ID NO: 3628352 - RNA, 16 nt, Salmonella enterica enterica serovar Typhi
ucgccaaaauggcgaa

SEQ ID NO: 3628353 - RNA, 16 nt, Salmonella enterica enterica serovar Typhi
ucgccaaaccagaccc

SEQ ID NO: 3628354 - RNA, 14 nt, Salmonella enterica enterica serovar Typhi
ucgccaaagcagcu

SEQ ID NO: 3628355 - RNA, 18 nt, Salmonella enterica enterica serovar Typhi
ucgccaaagcagcugcug

SEQ ID NO: 3628356 - RNA, 15 nt, Salmonella enterica enterica serovar Typhi
ucgccaaagcgcugc

SEQ ID NO: 3628357 - RNA, 20 nt, Salmonella enterica enterica serovar Typhi
ucgccaaagucauugcugcc

SEQ ID NO: 3628358 - RNA, 21 nt, Salmonella enterica enterica serovar Typhi
ucgccaaauuuagugcucagc

SEQ ID NO: 3628359 - RNA, 16 nt, Salmonella enterica enterica serovar Typhi
ucgccaagaucgccaa

SEQ ID NO: 3628360 - RNA, 21 nt, Salmonella enterica enterica serovar Typhi
ucgccaauaauuaguuuuacc

SEQ ID NO: 3628361 - RNA, 15 nt, Salmonella enterica enterica serovar Typhi
ucgccaaugccgcag

SEQ ID NO: 3628362 - RNA, 16 nt, Salmonella enterica enterica serovar Typhi
ucgccaauuaaauauc

SEQ ID NO: 3628363 - RNA, 19 nt, Salmonella enterica enterica serovar Typhi
ucgccacaugcggcaggcu

SEQ ID NO: 3628364 - RNA, 16 nt, Salmonella enterica enterica serovar Typhi
ucgccaccacauucag

SEQ ID NO: 3628365 - RNA, 15 nt, Salmonella enterica enterica serovar Typhi
ucgccaccaccagcg

SEQ ID NO: 3628366 - RNA, 23 nt, Salmonella enterica enterica serovar Typhi
ucgccacccggcuuuuuuauugc

SEQ ID NO: 3628367 - RNA, 13 nt, Salmonella enterica enterica serovar Typhi
ucgccaccgcauu

SEQ ID NO: 3628368 - RNA, 21 nt, Salmonella enterica enterica serovar Typhi
ucgccaccgcauuuucagcuu

SEQ ID NO: 3628369 - RNA, 18 nt, Salmonella enterica enterica serovar Typhi
ucgccaccgcgcgcuuaa

SEQ ID NO: 3628370 - RNA, 19 nt, Salmonella enterica enterica serovar Typhi
ucgccaccgcuacaaucca

SEQ ID NO: 3628371 - RNA, 18 nt, Salmonella enterica enterica serovar Typhi
ucgccacucuggcgacgc

SEQ ID NO: 3628372 - RNA, 15 nt, Salmonella enterica enterica serovar Typhi
ucgccagcagcgcga

SEQ ID NO: 3628373 - RNA, 19 nt, Salmonella enterica enterica serovar Typhi
ucgccagccauucaccacu

SEQ ID NO: 3628374 - RNA, 14 nt, Salmonella enterica enterica serovar Typhi
ucgccagccccagc

SEQ ID NO: 3628375 - RNA, 18 nt, Salmonella enterica enterica serovar Typhi
ucgccagcccgaucaucu

SEQ ID NO: 3628376 - RNA, 19 nt, Salmonella enterica enterica serovar Typhi
ucgccagccugaacaucuu

SEQ ID NO: 3628377 - RNA, 15 nt, Salmonella enterica enterica serovar Typhi
ucgccagcguuagca

SEQ ID NO: 3628378 - RNA, 21 nt, Salmonella enterica enterica serovar Typhi
ucgccagcuucucaaaaucgc

SEQ ID NO: 3628379 - RNA, 10 nt, Salmonella enterica enterica serovar Typhi
ucgccaggcc

SEQ ID NO: 3628380 - RNA, 19 nt, Salmonella enterica enterica serovar Typhi
ucgccagucgcagcaaacg

SEQ ID NO: 3628381 - RNA, 16 nt, Salmonella enterica enterica serovar Typhi
ucgccauaaagcugua

SEQ ID NO: 3628382 - RNA, 20 nt, Salmonella enterica enterica serovar Typhi
ucgccauaaagcuguaccug

SEQ ID NO: 3628383 - RNA, 21 nt, Salmonella enterica enterica serovar Typhi
ucgccauaaaucagauccacg

SEQ ID NO: 3628384 - RNA, 16 nt, Salmonella enterica enterica serovar Typhi
ucgccauacaucgcgu

SEQ ID NO: 3628385 - RNA, 12 nt, Salmonella enterica enterica serovar Typhi
ucgccauaucuu

SEQ ID NO: 3628386 - RNA, 13 nt, Salmonella enterica enterica serovar Typhi
ucgccaucaccag

SEQ ID NO: 3628387 - RNA, 13 nt, Salmonella enterica enterica serovar Typhi
ucgccauccagau

SEQ ID NO: 3628388 - RNA, 18 nt, Salmonella enterica enterica serovar Typhi
ucgccauuccaagaauga

SEQ ID NO: 3628389 - RNA, 15 nt, Salmonella enterica enterica serovar Typhi
ucgccauucccgcga

SEQ ID NO: 3628390 - RNA, 19 nt, Salmonella enterica enterica serovar Typhi
ucgccauugcaauaccggc

SEQ ID NO: 3628391 - RNA, 22 nt, Salmonella enterica enterica serovar Typhi
ucgcccaccgcauagacgugcg

SEQ ID NO: 3628392 - RNA, 15 nt, Salmonella enterica enterica serovar Typhi
ucgcccacgcccaga

SEQ ID NO: 3628393 - RNA, 22 nt, Salmonella enterica enterica serovar Typhi
ucgcccacgcccagagcgcggc

SEQ ID NO: 3628394 - RNA, 19 nt, Salmonella enterica enterica serovar Typhi
ucgcccagcacuaacagca

SEQ ID NO: 3628395 - RNA, 14 nt, Salmonella enterica enterica serovar Typhi
ucgccccaaucgcc

SEQ ID NO: 3628396 - RNA, 19 nt, Salmonella enterica enterica serovar Typhi
ucgccccggcgagugccug

SEQ ID NO: 3628397 - RNA, 16 nt, Salmonella enterica enterica serovar Typhi
ucgcccgcaccgccga

SEQ ID NO: 3628398 - RNA, 18 nt, Salmonella enterica enterica serovar Typhi
ucgcccgccgcaaaaaau

SEQ ID NO: 3628399 - RNA, 20 nt, Salmonella enterica enterica serovar Typhi
ucgcccgccgcaaaaaauac

SEQ ID NO: 3628400 - RNA, 20 nt, Salmonella enterica enterica serovar Typhi
ucgcccgcguuguccccuca

SEQ ID NO: 3628401 - RNA, 20 nt, Salmonella enterica enterica serovar Typhi
ucgcccguaccgcggcgcug

SEQ ID NO: 3628402 - RNA, 14 nt, Salmonella enterica enterica serovar Typhi
ucgcccugcaauuc

SEQ ID NO: 3628403 - RNA, 18 nt, Salmonella enterica enterica serovar Typhi
ucgcccuucaucuuccag

SEQ ID NO: 3628404 - RNA, 19 nt, Salmonella enterica enterica serovar Typhi
ucgcccuucaucuuccagu

SEQ ID NO: 3628405 - RNA, 23 nt, Salmonella enterica enterica serovar Typhi
ucgccgaucacaaagucagcgcg

SEQ ID NO: 3628406 - RNA, 15 nt, Salmonella enterica enterica serovar Typhi
ucgccgccaggaacg

SEQ ID NO: 3628407 - RNA, 18 nt, Salmonella enterica enterica serovar Typhi
ucgccgccaucggcgcgu

SEQ ID NO: 3628408 - RNA, 19 nt, Salmonella enterica enterica serovar Typhi
ucgccgccaucggcgcgua

SEQ ID NO: 3628409 - RNA, 18 nt, Salmonella enterica enterica serovar Typhi
ucgccgcccaaccagccc

SEQ ID NO: 3628410 - RNA, 13 nt, Salmonella enterica enterica serovar Typhi
ucgccgccgcgag

SEQ ID NO: 3628411 - RNA, 21 nt, Salmonella enterica enterica serovar Typhi
ucgccgcgacgcgcgagcgca

SEQ ID NO: 3628412 - RNA, 13 nt, Salmonella enterica enterica serovar Typhi
ucgccgcgccgga

SEQ ID NO: 3628413 - RNA, 23 nt, Salmonella enterica enterica serovar Typhi
ucgccgcgccggacuccagcaac

SEQ ID NO: 3628414 - RNA, 18 nt, Salmonella enterica enterica serovar Typhi
ucgccgcgcgaagaggau

SEQ ID NO: 3628415 - RNA, 21 nt, Salmonella enterica enterica serovar Typhi
ucgccgcgcggaucgccaucg

SEQ ID NO: 3628416 - RNA, 16 nt, Salmonella enterica enterica serovar Typhi
ucgccgcggcgcuggc

SEQ ID NO: 3628417 - RNA, 19 nt, Salmonella enterica enterica serovar Typhi
ucgccgcggcgcuggccuu

SEQ ID NO: 3628418 - RNA, 18 nt, Salmonella enterica enterica serovar Typhi
ucgccgcguuuaaguccc

SEQ ID NO: 3628419 - RNA, 23 nt, Salmonella enterica enterica serovar Typhi
ucgccgcugauucguuuuuacac

SEQ ID NO: 3628420 - RNA, 18 nt, Salmonella enterica enterica serovar Typhi
ucgccggaaagaaacgcc

SEQ ID NO: 3628421 - RNA, 22 nt, Salmonella enterica enterica serovar Typhi
ucgccggagaaaaagaccgaca

SEQ ID NO: 3628422 - RNA, 23 nt, Salmonella enterica enterica serovar Typhi
ucgccggagaauccuuccaguag

SEQ ID NO: 3628423 - RNA, 13 nt, Salmonella enterica enterica serovar Typhi
ucgccggauggcg

SEQ ID NO: 3628424 - RNA, 15 nt, Salmonella enterica enterica serovar Typhi
ucgccggauggcggc

SEQ ID NO: 3628425 - RNA, 17 nt, Salmonella enterica enterica serovar Typhi
ucgccggauggcggcga

SEQ ID NO: 3628426 - RNA, 23 nt, Salmonella enterica enterica serovar Typhi
ucgccggcagacgauagcgggug

SEQ ID NO: 3628427 - RNA, 23 nt, Salmonella enterica enterica serovar Typhi
ucgccgguagcuucagcggcgcg

SEQ ID NO: 3628428 - RNA, 23 nt, Salmonella enterica enterica serovar Typhi
ucgccguaaaacaacagcggcgu

SEQ ID NO: 3628429 - RNA, 18 nt, Salmonella enterica enterica serovar Typhi
ucgccgucguucagccag

SEQ ID NO: 3628430 - RNA, 22 nt, Salmonella enterica enterica serovar Typhi
ucgccguuaaaccguuaugaau

SEQ ID NO: 3628431 - RNA, 18 nt, Salmonella enterica enterica serovar Typhi
ucgccguuaacuggcgca

SEQ ID NO: 3628432 - RNA, 22 nt, Salmonella enterica enterica serovar Typhi
ucgccguuaacuggcgcaucug

SEQ ID NO: 3628433 - RNA, 13 nt, Salmonella enterica enterica serovar Typhi
ucgccuaaaugac

SEQ ID NO: 3628434 - RNA, 14 nt, Salmonella enterica enterica serovar Typhi
ucgccuaaaugacc

SEQ ID NO: 3628435 - RNA, 14 nt, Salmonella enterica enterica serovar Typhi
ucgccuccagcgau

SEQ ID NO: 3628436 - RNA, 20 nt, Salmonella enterica enterica serovar Typhi
guaaucaucaccguuuucca

SEQ ID NO: 3628437 - RNA, 20 nt, Salmonella enterica enterica serovar Typhi
guaaucaucgcgaucgccaa

SEQ ID NO: 3628438 - RNA, 22 nt, Salmonella enterica enterica serovar Typhi
guaauccccauaugauugagcg

SEQ ID NO: 3628439 - RNA, 14 nt, Salmonella enterica enterica serovar Typhi
guaaucgccugaau

SEQ ID NO: 3628440 - RNA, 13 nt, Salmonella enterica enterica serovar Typhi
guaaucuaaaauu

SEQ ID NO: 3628441 - RNA, 14 nt, Salmonella enterica enterica serovar Typhi
guaaucuauucagc

SEQ ID NO: 3628442 - RNA, 15 nt, Salmonella enterica enterica serovar Typhi
guaaucugacagaua

SEQ ID NO: 3628443 - RNA, 13 nt, Salmonella enterica enterica serovar Typhi
guaaucuuccacc

SEQ ID NO: 3628444 - RNA, 20 nt, Salmonella enterica enterica serovar Typhi
guaaucuucgcggcugccgu

SEQ ID NO: 3628445 - RNA, 15 nt, Salmonella enterica enterica serovar Typhi
guaguuauaaauuua

SEQ ID NO: 3628446 - RNA, 19 nt, Salmonella enterica enterica serovar Typhi
guaguuccuguagcgugac

SEQ ID NO: 3628447 - RNA, 16 nt, Salmonella enterica enterica serovar Typhi
guauaaaauggcaaag

SEQ ID NO: 3628448 - RNA, 17 nt, Salmonella enterica enterica serovar Typhi
guauaaacucagcaaua

SEQ ID NO: 3628449 - RNA, 12 nt, Salmonella enterica enterica serovar Typhi
guauaaaucacg

SEQ ID NO: 3628450 - RNA, 19 nt, Salmonella enterica enterica serovar Typhi
guauaaaucccggugggga

SEQ ID NO: 3628451 - RNA, 13 nt, Salmonella enterica enterica serovar Typhi
guauaacucagcg

SEQ ID NO: 3628452 - RNA, 18 nt, Salmonella enterica enterica serovar Typhi
guauaaucccgcggcgga

SEQ ID NO: 3628453 - RNA, 17 nt, Salmonella enterica enterica serovar Typhi
guauacgccacguuauc

SEQ ID NO: 3628454 - RNA, 14 nt, Salmonella enterica enterica serovar Typhi
guauagaaauagcc

SEQ ID NO: 3628455 - RNA, 13 nt, Salmonella enterica enterica serovar Typhi
guauagccaggca

SEQ ID NO: 3628456 - RNA, 14 nt, Salmonella enterica enterica serovar Typhi
guauagccaggcag

SEQ ID NO: 3628457 - RNA, 14 nt, Salmonella enterica enterica serovar Typhi
guauaggccaggcu

SEQ ID NO: 3628458 - RNA, 18 nt, Salmonella enterica enterica serovar Typhi
guaucaaacccuuccaga

SEQ ID NO: 3628459 - RNA, 14 nt, Salmonella enterica enterica serovar Typhi
guaucacgcgugcg

SEQ ID NO: 3628460 - RNA, 16 nt, Salmonella enterica enterica serovar Typhi
guaucacuguaaaagg

SEQ ID NO: 3628461 - RNA, 15 nt, Salmonella enterica enterica serovar Typhi
guaucaucagauccu

SEQ ID NO: 3628462 - RNA, 15 nt, Salmonella enterica enterica serovar Typhi
guaucaucgauuuua

SEQ ID NO: 3628463 - RNA, 11 nt, Salmonella enterica enterica serovar Typhi
guaucaucgcu

SEQ ID NO: 3628464 - RNA, 21 nt, Salmonella enterica enterica serovar Typhi
guaucaucgcuuaacggccca

SEQ ID NO: 3628465 - RNA, 16 nt, Salmonella enterica enterica serovar Typhi
guaucauguuccggca

SEQ ID NO: 3628466 - RNA, 21 nt, Salmonella enterica enterica serovar Typhi
guauccacccgguuuaccauu

SEQ ID NO: 3628467 - RNA, 16 nt, Salmonella enterica enterica serovar Typhi
guauccauaauuuucc

SEQ ID NO: 3628468 - RNA, 14 nt, Salmonella enterica enterica serovar Typhi
guauccauugccag

SEQ ID NO: 3628469 - RNA, 18 nt, Salmonella enterica enterica serovar Typhi
guauccccagucuuccug

SEQ ID NO: 3628470 - RNA, 13 nt, Salmonella enterica enterica serovar Typhi
guaucccgccagc

SEQ ID NO: 3628471 - RNA, 17 nt, Salmonella enterica enterica serovar Typhi
guaucccgccagcggcg

SEQ ID NO: 3628472 - RNA, 17 nt, Salmonella enterica enterica serovar Typhi
guauccgccaccaugau

SEQ ID NO: 3628473 - RNA, 12 nt, Salmonella enterica enterica serovar Typhi
guauccgccaua

SEQ ID NO: 3628474 - RNA, 19 nt, Salmonella enterica enterica serovar Typhi
guauccggccugcagggaa

SEQ ID NO: 3628475 - RNA, 13 nt, Salmonella enterica enterica serovar Typhi
guauccuccugcc

SEQ ID NO: 3628476 - RNA, 16 nt, Salmonella enterica enterica serovar Typhi
guauccugaaccagcg

SEQ ID NO: 3628477 - RNA, 14 nt, Salmonella enterica enterica serovar Typhi
guauccuuccagcc

SEQ ID NO: 3628478 - RNA, 23 nt, Salmonella enterica enterica serovar Typhi
guaucgccggcagacgauagcgg

SEQ ID NO: 3628479 - RNA, 19 nt, Salmonella enterica enterica serovar Typhi
guaucuccugaaacccgcc

SEQ ID NO: 3628480 - RNA, 19 nt, Salmonella enterica enterica serovar Typhi
guaucugucccagccuucc

SEQ ID NO: 3628481 - RNA, 22 nt, Salmonella enterica enterica serovar Typhi
guaucugucccagccuuccugg

SEQ ID NO: 3628482 - RNA, 11 nt, Salmonella enterica enterica serovar Typhi
guaucuuccag

SEQ ID NO: 3628483 - RNA, 22 nt, Salmonella enterica enterica serovar Typhi
guaucuucgccguguucuuacc

SEQ ID NO: 3628484 - RNA, 19 nt, Salmonella enterica enterica serovar Typhi
guaugacacccguguguua

SEQ ID NO: 3628485 - RNA, 12 nt, Salmonella enterica enterica serovar Typhi
guaugauagcga

SEQ ID NO: 3628486 - RNA, 15 nt, Salmonella enterica enterica serovar Typhi
guaugcagccaggcc

SEQ ID NO: 3628487 - RNA, 17 nt, Salmonella enterica enterica serovar Typhi
guaugcagccaggccau

SEQ ID NO: 3628488 - RNA, 16 nt, Salmonella enterica enterica serovar Typhi
guaugcagugggccgg

SEQ ID NO: 3628489 - RNA, 19 nt, Salmonella enterica enterica serovar Typhi
guaugccgcacaaaauuuu

SEQ ID NO: 3628490 - RNA, 22 nt, Salmonella enterica enterica serovar Typhi
guaugccucgcgcaccauaaua

SEQ ID NO: 3628491 - RNA, 14 nt, Salmonella enterica enterica serovar Typhi
guaugcgauacccc

SEQ ID NO: 3628492 - RNA, 16 nt, Salmonella enterica enterica serovar Typhi
guaugcggucaaaagc

SEQ ID NO: 3628493 - RNA, 15 nt, Salmonella enterica enterica serovar Typhi
guaugcugucgccgg

SEQ ID NO: 3628494 - RNA, 22 nt, Salmonella enterica enterica serovar Typhi
guauguuaggguagaaaaaggu

SEQ ID NO: 3628495 - RNA, 12 nt, Salmonella enterica enterica serovar Typhi
guauuaaauaca

SEQ ID NO: 3628496 - RNA, 18 nt, Salmonella enterica enterica serovar Typhi
guauuaacagcuucuucu

SEQ ID NO: 3628497 - RNA, 16 nt, Salmonella enterica enterica serovar Typhi
guauuaaggcagccau

SEQ ID NO: 3628498 - RNA, 18 nt, Salmonella enterica enterica serovar Typhi
guauuacaagcaguuaau

SEQ ID NO: 3628499 - RNA, 23 nt, Salmonella enterica enterica serovar Typhi
guauucaacgccaucuuccucac

SEQ ID NO: 3628500 - RNA, 22 nt, Salmonella enterica enterica serovar Typhi
guauucauaugcucuccuggca

SEQ ID NO: 3628501 - RNA, 20 nt, Salmonella enterica enterica serovar Typhi
guauuccagucgcuccacca

SEQ ID NO: 3628502 - RNA, 18 nt, Salmonella enterica enterica serovar Typhi
guauucgguggaaaccgc

SEQ ID NO: 3628503 - RNA, 16 nt, Salmonella enterica enterica serovar Typhi
guauucgugcaucagg

SEQ ID NO: 3628504 - RNA, 20 nt, Salmonella enterica enterica serovar Typhi
guauucucaaccagccgauc

SEQ ID NO: 3628505 - RNA, 18 nt, Salmonella enterica enterica serovar Typhi
guauucucccgucagcaa

SEQ ID NO: 3628506 - RNA, 20 nt, Salmonella enterica enterica serovar Typhi
guauucugcgccagccagcu

SEQ ID NO: 3628507 - RNA, 21 nt, Salmonella enterica enterica serovar Typhi
guauucugcgccagccagcuc

SEQ ID NO: 3628508 - RNA, 12 nt, Salmonella enterica enterica serovar Typhi
guauugauuuuu

SEQ ID NO: 3628509 - RNA, 16 nt, Salmonella enterica enterica serovar Typhi
guauugcuuucaauuu

SEQ ID NO: 3628510 - RNA, 13 nt, Salmonella enterica enterica serovar Typhi
guauuggcaagaa

SEQ ID NO: 3628511 - RNA, 11 nt, Salmonella enterica enterica serovar Typhi
guauuuauucu

SEQ ID NO: 3628512 - RNA, 17 nt, Salmonella enterica enterica serovar Typhi
guauuucacuuuugccg

SEQ ID NO: 3628513 - RNA, 16 nt, Salmonella enterica enterica serovar Typhi
guauuucgcagcgguc

SEQ ID NO: 3628514 - RNA, 17 nt, Salmonella enterica enterica serovar Typhi
guauuucugaaaaaccg

SEQ ID NO: 3628515 - RNA, 18 nt, Salmonella enterica enterica serovar Typhi
guauuucugaaaaaccgu

SEQ ID NO: 3628516 - RNA, 19 nt, Salmonella enterica enterica serovar Typhi
gucaaaaaguugucuuccu

SEQ ID NO: 3628517 - RNA, 11 nt, Salmonella enterica enterica serovar Typhi
gucaaaaauaa

SEQ ID NO: 3628518 - RNA, 20 nt, Salmonella enterica enterica serovar Typhi
gucaaaaccaaacagcgaca

SEQ ID NO: 3628519 - RNA, 14 nt, Salmonella enterica enterica serovar Typhi
gucaaaacuuauuu

SEQ ID NO: 3628520 - RNA, 13 nt, Salmonella enterica enterica serovar Typhi
gucaaaaugauca

SEQ ID NO: 3628521 - RNA, 19 nt, Salmonella enterica enterica serovar Typhi
gucaaacaguucagacacc

SEQ ID NO: 3628522 - RNA, 22 nt, Salmonella enterica enterica serovar Typhi
gucaaacaguuccugugcggaa

SEQ ID NO: 3628523 - RNA, 13 nt, Salmonella enterica enterica serovar Typhi
gucaaacgcuauc

SEQ ID NO: 3628524 - RNA, 18 nt, Salmonella enterica enterica serovar Typhi
gucaaacuuuuauaaaua

SEQ ID NO: 3628525 - RNA, 23 nt, Salmonella enterica enterica serovar Typhi
gucaaagaaaacuuucauuucac

SEQ ID NO: 3628526 - RNA, 17 nt, Salmonella enterica enterica serovar Typhi
gucaaauagagaaaaua

SEQ ID NO: 3628527 - RNA, 12 nt, Salmonella enterica enterica serovar Typhi
gucaaauccauc

SEQ ID NO: 3628528 - RNA, 22 nt, Salmonella enterica enterica serovar Typhi
gucaaaugggaucuucaaugaa

SEQ ID NO: 3628529 - RNA, 17 nt, Salmonella enterica enterica serovar Typhi
gucaacacgcagaccca

SEQ ID NO: 3628530 - RNA, 13 nt, Salmonella enterica enterica serovar Typhi
gucaacaucaucc

SEQ ID NO: 3628531 - RNA, 13 nt, Salmonella enterica enterica serovar Typhi
gucaacgccaagc

SEQ ID NO: 3628532 - RNA, 18 nt, Salmonella enterica enterica serovar Typhi
gucaacgguaaaauggcu

SEQ ID NO: 3628533 - RNA, 18 nt, Salmonella enterica enterica serovar Typhi
gucaacguuaacugcugc

SEQ ID NO: 3628534 - RNA, 15 nt, Salmonella enterica enterica serovar Typhi
gucaacguuuuucag

SEQ ID NO: 3628535 - RNA, 19 nt, Salmonella enterica enterica serovar Typhi
gucaacucuuucaggcgag

SEQ ID NO: 3628536 - RNA, 17 nt, Salmonella enterica enterica serovar Typhi
gucaacuuaaacguucg

SEQ ID NO: 3628537 - RNA, 17 nt, Salmonella enterica enterica serovar Typhi
gucaagaucgcgcagca

SEQ ID NO: 3628538 - RNA, 17 nt, Salmonella enterica enterica serovar Typhi
gucaauaaacuggagca

SEQ ID NO: 3628539 - RNA, 18 nt, Salmonella enterica enterica serovar Typhi
gucaauaaagacuggccc

SEQ ID NO: 3628540 - RNA, 16 nt, Salmonella enterica enterica serovar Typhi
gucaauacaucacgca

SEQ ID NO: 3628541 - RNA, 16 nt, Salmonella enterica enterica serovar Typhi
gucaaucgccugcugu

SEQ ID NO: 3628542 - RNA, 17 nt, Salmonella enterica enterica serovar Typhi
gucaaucgccugcugua

SEQ ID NO: 3628543 - RNA, 17 nt, Salmonella enterica enterica serovar Typhi
gucaaugugaauccagg

SEQ ID NO: 3628544 - RNA, 18 nt, Salmonella enterica enterica serovar Typhi
gucacaaagcccaccgcg

SEQ ID NO: 3628545 - RNA, 12 nt, Salmonella enterica enterica serovar Typhi
gucacaacagcc

SEQ ID NO: 3628546 - RNA, 17 nt, Salmonella enterica enterica serovar Typhi
gucacaauacuuccgcu

SEQ ID NO: 3628547 - RNA, 22 nt, Salmonella enterica enterica serovar Typhi
gucacaauaugguuauccagca

SEQ ID NO: 3628548 - RNA, 20 nt, Salmonella enterica enterica serovar Typhi
gucacagguucgaaucccgu

SEQ ID NO: 3628549 - RNA, 13 nt, Salmonella enterica enterica serovar Typhi
gucaccagcagca

SEQ ID NO: 3628550 - RNA, 20 nt, Salmonella enterica enterica serovar Typhi
gucaccagcagcauuucaaa

SEQ ID NO: 3628551 - RNA, 14 nt, Salmonella enterica enterica serovar Typhi
gucaccaugacgca

SEQ ID NO: 3628552 - RNA, 18 nt, Salmonella enterica enterica serovar Typhi
gucaccgacacgcauaug

SEQ ID NO: 3628553 - RNA, 15 nt, Salmonella enterica enterica serovar Typhi
gucaccguauugcca

SEQ ID NO: 3628554 - RNA, 14 nt, Salmonella enterica enterica serovar Typhi
gucaccgugccagu

SEQ ID NO: 3628555 - RNA, 17 nt, Salmonella enterica enterica serovar Typhi
gucaccucuuucgccgc

SEQ ID NO: 3628556 - RNA, 16 nt, Salmonella enterica enterica serovar Typhi
gucacgacguauuaaa

SEQ ID NO: 3628557 - RNA, 16 nt, Salmonella enterica enterica serovar Typhi
gucacgauagcgccgg

SEQ ID NO: 3628558 - RNA, 17 nt, Salmonella enterica enterica serovar Typhi
gucacuuacuuucuugc

SEQ ID NO: 3628559 - RNA, 11 nt, Salmonella enterica enterica serovar Typhi
gucacuucaac

SEQ ID NO: 3628560 - RNA, 23 nt, Salmonella enterica enterica serovar Typhi
gucagaccuucaacccagcagca

SEQ ID NO: 3628561 - RNA, 15 nt, Salmonella enterica enterica serovar Typhi
gucagacggacauca

SEQ ID NO: 3628562 - RNA, 17 nt, Salmonella enterica enterica serovar Typhi
gucagauccuucauuca

SEQ ID NO: 3628563 - RNA, 13 nt, Salmonella enterica enterica serovar Typhi
gucagauccuuuu

SEQ ID NO: 3628564 - RNA, 22 nt, Salmonella enterica enterica serovar Typhi
gucagauccuuuuucugcgcca

SEQ ID NO: 3628565 - RNA, 12 nt, Salmonella enterica enterica serovar Typhi
gucagaucguau

SEQ ID NO: 3628566 - RNA, 19 nt, Salmonella enterica enterica serovar Typhi
gucagaucguaugcgccug

SEQ ID NO: 3628567 - RNA, 17 nt, Salmonella enterica enterica serovar Typhi
gucagaugcguuuucug

SEQ ID NO: 3628568 - RNA, 19 nt, Salmonella enterica enterica serovar Typhi
gucagaugcguuuucugca

SEQ ID NO: 3628569 - RNA, 15 nt, Salmonella enterica enterica serovar Typhi
gucagcaguuuuauc

SEQ ID NO: 3628570 - RNA, 19 nt, Salmonella enterica enterica serovar Typhi
gucagcauaauauccugca

SEQ ID NO: 3628571 - RNA, 18 nt, Salmonella enterica enterica serovar Typhi
gucagccccguacaaggu

SEQ ID NO: 3628572 - RNA, 22 nt, Salmonella enterica enterica serovar Typhi
gucagccccguacaaggucggc

SEQ ID NO: 3628573 - RNA, 13 nt, Salmonella enterica enterica serovar Typhi
gucagcgcauacc

SEQ ID NO: 3628574 - RNA, 23 nt, Salmonella enterica enterica serovar Typhi
gucagcgcauaccggccacgagc

SEQ ID NO: 3628575 - RNA, 15 nt, Salmonella enterica enterica serovar Typhi
gucagcgcggcuucc

SEQ ID NO: 3628576 - RNA, 21 nt, Salmonella enterica enterica serovar Typhi
gucagcgcuugccgcagcgca

SEQ ID NO: 3628577 - RNA, 14 nt, Salmonella enterica enterica serovar Typhi
gucagcggcgcgcc

SEQ ID NO: 3628578 - RNA, 22 nt, Salmonella enterica enterica serovar Typhi
gucagcggcugacacucaucca

SEQ ID NO: 3628579 - RNA, 18 nt, Salmonella enterica enterica serovar Typhi
gucagcgucuauagauga

SEQ ID NO: 3628580 - RNA, 15 nt, Salmonella enterica enterica serovar Typhi
gucagcuccgguauc

SEQ ID NO: 3628581 - RNA, 22 nt, Salmonella enterica enterica serovar Typhi
gucagcucgguggcgguaucaa

SEQ ID NO: 3628582 - RNA, 16 nt, Salmonella enterica enterica serovar Typhi
gucaggagccaccggc

SEQ ID NO: 3628583 - RNA, 23 nt, Salmonella enterica enterica serovar Typhi
gucaggagccaccggcagggcca

SEQ ID NO: 3628584 - RNA, 17 nt, Salmonella enterica enterica serovar Typhi
gucaggaggccugaaua

SEQ ID NO: 3628585 - RNA, 14 nt, Salmonella enterica enterica serovar Typhi
gucaggauuuucgc

SEQ ID NO: 3628586 - RNA, 21 nt, Salmonella enterica enterica serovar Typhi
gucaggcaacaggauguccug

SEQ ID NO: 3628587 - RNA, 18 nt, Salmonella enterica enterica serovar Typhi
gucaggccgccgcaaaag

SEQ ID NO: 3628588 - RNA, 19 nt, Salmonella enterica enterica serovar Typhi
gucaggccgccgcacaggc

SEQ ID NO: 3628589 - RNA, 16 nt, Salmonella enterica enterica serovar Typhi
gucaggcgagcgccuu

SEQ ID NO: 3628590 - RNA, 22 nt, Salmonella enterica enterica serovar Typhi
gucaggcuacccgcaauaccaa

SEQ ID NO: 3628591 - RNA, 23 nt, Salmonella enterica enterica serovar Typhi
gucagggucuuauuucuccugcg

SEQ ID NO: 3628592 - RNA, 19 nt, Salmonella enterica enterica serovar Typhi
gucagguaagcuauuacaa

SEQ ID NO: 3628593 - RNA, 20 nt, Salmonella enterica enterica serovar Typhi
gucaggugggaccaccgcgc

SEQ ID NO: 3628594 - RNA, 15 nt, Salmonella enterica enterica serovar Typhi
gucagguuuucuauc

SEQ ID NO: 3628595 - RNA, 13 nt, Salmonella enterica enterica serovar Typhi
gucagguuuuuug

SEQ ID NO: 3628596 - RNA, 15 nt, Salmonella enterica enterica serovar Typhi
gucaguaauaugaau

SEQ ID NO: 3628597 - RNA, 18 nt, Salmonella enterica enterica serovar Typhi
gucaguaccagcgagaua

SEQ ID NO: 3628598 - RNA, 21 nt, Salmonella enterica enterica serovar Typhi
gucaguacgcccgugacgcca

SEQ ID NO: 3628599 - RNA, 23 nt, Salmonella enterica enterica serovar Typhi
gucaguacgcgcguauccgccgg

SEQ ID NO: 3628600 - RNA, 18 nt, Salmonella enterica enterica serovar Typhi
gucaguacgucgcauacu

SEQ ID NO: 3628601 - RNA, 22 nt, Salmonella enterica enterica serovar Typhi
gucagucgccagaaggcaggcu

SEQ ID NO: 3628602 - RNA, 22 nt, Salmonella enterica enterica serovar Typhi
gucagucgcucuaucgccugga

SEQ ID NO: 3628603 - RNA, 19 nt, Salmonella enterica enterica serovar Typhi
gucagugagcccuccucca

SEQ ID NO: 3628604 - RNA, 14 nt, Salmonella enterica enterica serovar Typhi
gucaguggaaaaca

SEQ ID NO: 3628605 - RNA, 20 nt, Salmonella enterica enterica serovar Typhi
gucaguguuuccauacauuu

SEQ ID NO: 3628606 - RNA, 14 nt, Salmonella enterica enterica serovar Typhi
gucaguuccauaau

SEQ ID NO: 3628607 - RNA, 14 nt, Salmonella enterica enterica serovar Typhi
gucaguucgccacg

SEQ ID NO: 3628608 - RNA, 23 nt, Salmonella enterica enterica serovar Typhi
gucauaacgcuuuguacagacaa

SEQ ID NO: 3628609 - RNA, 14 nt, Salmonella enterica enterica serovar Typhi
gucauaauuaaaaa

SEQ ID NO: 3628610 - RNA, 16 nt, Salmonella enterica enterica serovar Typhi
gucauacugugcguga

SEQ ID NO: 3628611 - RNA, 16 nt, Salmonella enterica enterica serovar Typhi
gucauagcaaugauua

SEQ ID NO: 3628612 - RNA, 15 nt, Salmonella enterica enterica serovar Typhi
gucauaucauccagc

SEQ ID NO: 3628613 - RNA, 20 nt, Salmonella enterica enterica serovar Typhi
gucaucaaauuaucuguuga

SEQ ID NO: 3628614 - RNA, 22 nt, Salmonella enterica enterica serovar Typhi
gucaucaaauuaucuguugaua

SEQ ID NO: 3628615 - RNA, 18 nt, Salmonella enterica enterica serovar Typhi
gucaucaucaaguaccgu

SEQ ID NO: 3628616 - RNA, 15 nt, Salmonella enterica enterica serovar Typhi
gucaucauuacaggc

SEQ ID NO: 3628617 - RNA, 12 nt, Salmonella enterica enterica serovar Typhi
gucaucccgaac

SEQ ID NO: 3628618 - RNA, 22 nt, Salmonella enterica enterica serovar Typhi
gucaucccgguuucccgcguga

SEQ ID NO: 3628619 - RNA, 16 nt, Salmonella enterica enterica serovar Typhi
gucauccggcaaucag

SEQ ID NO: 3628620 - RNA, 16 nt, Salmonella enterica enterica serovar Typhi
gucauccggcauaaga

SEQ ID NO: 3628621 - RNA, 21 nt, Salmonella enterica enterica serovar Typhi
gucaucgaaggcaucuucaga

SEQ ID NO: 3628622 - RNA, 19 nt, Salmonella enterica enterica serovar Typhi
gucaucgcccaucugauaa

SEQ ID NO: 3628623 - RNA, 16 nt, Salmonella enterica enterica serovar Typhi
gucaucgccuucaucc

SEQ ID NO: 3628624 - RNA, 23 nt, Salmonella enterica enterica serovar Typhi
gucaucgcucaucucaagcccca

SEQ ID NO: 3628625 - RNA, 20 nt, Salmonella enterica enterica serovar Typhi
gucaucggcacguaguaaug

SEQ ID NO: 3628626 - RNA, 17 nt, Salmonella enterica enterica serovar Typhi
gucaugacgcuggaagu

SEQ ID NO: 3628627 - RNA, 17 nt, Salmonella enterica enterica serovar Typhi
gucaugccaucauuaau

SEQ ID NO: 3628628 - RNA, 19 nt, Salmonella enterica enterica serovar Typhi
gucaugccaucauuaauuu

SEQ ID NO: 3628629 - RNA, 22 nt, Salmonella enterica enterica serovar Typhi
gucaugccuucauagagaaguc

SEQ ID NO: 3628630 - RNA, 13 nt, Salmonella enterica enterica serovar Typhi
gucaugcgccacg

SEQ ID NO: 3628631 - RNA, 15 nt, Salmonella enterica enterica serovar Typhi
gucaugcuaaaacag

SEQ ID NO: 3628632 - RNA, 17 nt, Salmonella enterica enterica serovar Typhi
gucaugcuaaaacagau

SEQ ID NO: 3628633 - RNA, 22 nt, Salmonella enterica enterica serovar Typhi
gucauggcgccaccagcgauuu

SEQ ID NO: 3628634 - RNA, 16 nt, Salmonella enterica enterica serovar Typhi
gucauggguagccguu

SEQ ID NO: 3628635 - RNA, 17 nt, Salmonella enterica enterica serovar Typhi
gucauggguagccguuu

SEQ ID NO: 3628636 - RNA, 12 nt, Salmonella enterica enterica serovar Typhi
gucauuaaaaug

SEQ ID NO: 3628637 - RNA, 19 nt, Salmonella enterica enterica serovar Typhi
gucauuacgguauuuauca

SEQ ID NO: 3628638 - RNA, 14 nt, Salmonella enterica enterica serovar Typhi
gucauucaggucua

SEQ ID NO: 3628639 - RNA, 22 nt, Salmonella enterica enterica serovar Typhi
gucauuccugcguugaccagcg

SEQ ID NO: 3628640 - RNA, 14 nt, Salmonella enterica enterica serovar Typhi
gucauugacagcaa

SEQ ID NO: 3628641 - RNA, 17 nt, Salmonella enterica enterica serovar Typhi
gucauugcgcgcaugca

SEQ ID NO: 3628642 - RNA, 15 nt, Salmonella enterica enterica serovar Typhi
gucauuguaaaaccg

SEQ ID NO: 3628643 - RNA, 21 nt, Salmonella enterica enterica serovar Typhi
gucauuuaccagugcuaaaau

SEQ ID NO: 3628644 - RNA, 21 nt, Salmonella enterica enterica serovar Typhi
gucauuuucuuucaucaaacg

SEQ ID NO: 3628645 - RNA, 16 nt, Salmonella enterica enterica serovar Typhi
guccacauccagcgcc

SEQ ID NO: 3628646 - RNA, 17 nt, Salmonella enterica enterica serovar Typhi
guccacauccagcgcca

SEQ ID NO: 3628647 - RNA, 24 nt, Salmonella enterica enterica serovar Typhi
guccacauccagcgccagcgccac

SEQ ID NO: 3628648 - RNA, 19 nt, Salmonella enterica enterica serovar Typhi
guccaccgauuucaucgcu

SEQ ID NO: 3628649 - RNA, 19 nt, Salmonella enterica enterica serovar Typhi
guccacgacaauauccucg

SEQ ID NO: 3628650 - RNA, 20 nt, Salmonella enterica enterica serovar Typhi
guccacguucaaaucgauga

SEQ ID NO: 3628651 - RNA, 13 nt, Salmonella enterica enterica serovar Typhi
guccacuuucugu

SEQ ID NO: 3628652 - RNA, 19 nt, Salmonella enterica enterica serovar Typhi
guccagauagggccaggcg

SEQ ID NO: 3628653 - RNA, 15 nt, Salmonella enterica enterica serovar Typhi
guccagaugcugggc

SEQ ID NO: 3628654 - RNA, 21 nt, Salmonella enterica enterica serovar Typhi
guccagauuacgcauggucaa

SEQ ID NO: 3628655 - RNA, 22 nt, Salmonella enterica enterica serovar Typhi
guccagauugagacaaauaacu

SEQ ID NO: 3628656 - RNA, 20 nt, Salmonella enterica enterica serovar Typhi
guccagcagacucauggaca

SEQ ID NO: 3628657 - RNA, 21 nt, Salmonella enterica enterica serovar Typhi
guccagcauccaugccagcgc

SEQ ID NO: 3628658 - RNA, 20 nt, Salmonella enterica enterica serovar Typhi
guccagcgcggguucuuucc

SEQ ID NO: 3628659 - RNA, 13 nt, Salmonella enterica enterica serovar Typhi
guccagcgcguga

SEQ ID NO: 3628660 - RNA, 14 nt, Salmonella enterica enterica serovar Typhi
guccagcggcagcu

SEQ ID NO: 3628661 - RNA, 15 nt, Salmonella enterica enterica serovar Typhi
guccagggaaaaaua

SEQ ID NO: 3628662 - RNA, 13 nt, Salmonella enterica enterica serovar Typhi
guccauauucagu

SEQ ID NO: 3628663 - RNA, 14 nt, Salmonella enterica enterica serovar Typhi
guccauauucaguu

SEQ ID NO: 3628664 - RNA, 17 nt, Salmonella enterica enterica serovar Typhi
guccaugacgaccacag

SEQ ID NO: 3628665 - RNA, 21 nt, Salmonella enterica enterica serovar Typhi
guccaugaugaagauauucac

SEQ ID NO: 3628666 - RNA, 16 nt, Salmonella enterica enterica serovar Typhi
guccauugcgagaaaa

SEQ ID NO: 3628667 - RNA, 18 nt, Salmonella enterica enterica serovar Typhi
guccauugcgagaaaaaa

SEQ ID NO: 3628668 - RNA, 18 nt, Salmonella enterica enterica serovar Typhi
guccauuuauugcaggua

SEQ ID NO: 3628669 - RNA, 24 nt, Salmonella enterica enterica serovar Typhi
guccauuuauugcagguauugagu

SEQ ID NO: 3628670 - RNA, 14 nt, Salmonella enterica enterica serovar Typhi
guccauuuuuuauc

SEQ ID NO: 3628671 - RNA, 19 nt, Salmonella enterica enterica serovar Typhi
guccauuuuuuaucugaca

SEQ ID NO: 3628672 - RNA, 20 nt, Salmonella enterica enterica serovar Typhi
gucccaccagcgcggcacac

SEQ ID NO: 3628673 - RNA, 11 nt, Salmonella enterica enterica serovar Typhi
gucccagccuu

SEQ ID NO: 3628674 - RNA, 15 nt, Salmonella enterica enterica serovar Typhi
gucccagccuuccug

SEQ ID NO: 3628675 - RNA, 16 nt, Salmonella enterica enterica serovar Typhi
gucccagccuuccugg

SEQ ID NO: 3628676 - RNA, 16 nt, Salmonella enterica enterica serovar Typhi
gucccagugucaacug

SEQ ID NO: 3628677 - RNA, 17 nt, Salmonella enterica enterica serovar Typhi
guccccggcgacgugaa

SEQ ID NO: 3628678 - RNA, 15 nt, Salmonella enterica enterica serovar Typhi
guccccguucugacc

SEQ ID NO: 3628679 - RNA, 22 nt, Salmonella enterica enterica serovar Typhi
guccccucaaacaggcugucug

SEQ ID NO: 3628680 - RNA, 13 nt, Salmonella enterica enterica serovar Typhi
gucccgccgguuc

SEQ ID NO: 3628681 - RNA, 17 nt, Salmonella enterica enterica serovar Typhi
gucccggcaauacugga

SEQ ID NO: 3628682 - RNA, 20 nt, Salmonella enterica enterica serovar Typhi
gucccggcgucauacugcca

SEQ ID NO: 3628683 - RNA, 18 nt, Salmonella enterica enterica serovar Typhi
gucccuccgcuuccacuc

SEQ ID NO: 3628684 - RNA, 21 nt, Salmonella enterica enterica serovar Typhi
gucccuuucccuuccagcgac

SEQ ID NO: 3628685 - RNA, 14 nt, Salmonella enterica enterica serovar Typhi
guccgacagcaaga

SEQ ID NO: 3628686 - RNA, 14 nt, Salmonella enterica enterica serovar Typhi
guccgacauuagcg

SEQ ID NO: 3628687 - RNA, 19 nt, Salmonella enterica enterica serovar Typhi
guccgacgaaaaagccaaa

SEQ ID NO: 3628688 - RNA, 15 nt, Salmonella enterica enterica serovar Typhi
guccgcacgccugca

SEQ ID NO: 3628689 - RNA, 20 nt, Salmonella enterica enterica serovar Typhi
guccgcauucuugccgcauc

SEQ ID NO: 3628690 - RNA, 13 nt, Salmonella enterica enterica serovar Typhi
guccgcccgccuc

SEQ ID NO: 3628691 - RNA, 16 nt, Salmonella enterica enterica serovar Typhi
guccgccuuugacgcc

SEQ ID NO: 3628692 - RNA, 22 nt, Salmonella enterica enterica serovar Typhi
guccgcucacgauaaugaaccu

SEQ ID NO: 3628693 - RNA, 17 nt, Salmonella enterica enterica serovar Typhi
guccggagcagcuuagc

SEQ ID NO: 3628694 - RNA, 14 nt, Salmonella enterica enterica serovar Typhi
guccggaucgacgg

SEQ ID NO: 3628695 - RNA, 16 nt, Salmonella enterica enterica serovar Typhi
guccggcacgcgcagc

SEQ ID NO: 3628696 - RNA, 17 nt, Salmonella enterica enterica serovar Typhi
guccggcccgcuaucac

SEQ ID NO: 3628697 - RNA, 19 nt, Salmonella enterica enterica serovar Typhi
guccggcgaaaaccgagca

SEQ ID NO: 3628698 - RNA, 17 nt, Salmonella enterica enterica serovar Typhi
guccggcgcuaaccagc

SEQ ID NO: 3628699 - RNA, 16 nt, Salmonella enterica enterica serovar Typhi
guccgguccgguggcg

SEQ ID NO: 3628700 - RNA, 14 nt, Salmonella enterica enterica serovar Typhi
guccgguguccauc

SEQ ID NO: 3628701 - RNA, 22 nt, Salmonella enterica enterica serovar Typhi
guccguauuauccacccccgca

SEQ ID NO: 3628702 - RNA, 22 nt, Salmonella enterica enterica serovar Typhi
guccuauugcaacgccgaugcu

SEQ ID NO: 3628703 - RNA, 20 nt, Salmonella enterica enterica serovar Typhi
guccucacacugauggcaga

SEQ ID NO: 3628704 - RNA, 14 nt, Salmonella enterica enterica serovar Typhi
guccuccauggcuu

SEQ ID NO: 3628705 - RNA, 19 nt, Salmonella enterica enterica serovar Typhi
guccucuuucccuuuuuaa

SEQ ID NO: 3628706 - RNA, 20 nt, Salmonella enterica enterica serovar Typhi
guccugaucaaggcgcaaaa

SEQ ID NO: 3628707 - RNA, 14 nt, Salmonella enterica enterica serovar Typhi
guccugauccggcu

SEQ ID NO: 3628708 - RNA, 23 nt, Salmonella enterica enterica serovar Typhi
guccugcaaggcaucgucggcga

SEQ ID NO: 3628709 - RNA, 20 nt, Salmonella enterica enterica serovar Typhi
guccugcgggaacaugcaua

SEQ ID NO: 3628710 - RNA, 21 nt, Salmonella enterica enterica serovar Typhi
guccuuaaccagcucgcugau

SEQ ID NO: 3628711 - RNA, 18 nt, Salmonella enterica enterica serovar Typhi
guccuucacaaacuucuc

SEQ ID NO: 3628712 - RNA, 17 nt, Salmonella enterica enterica serovar Typhi
guccuugcgaagaccgc

SEQ ID NO: 3628713 - RNA, 21 nt, Salmonella enterica enterica serovar Typhi
guccuuuaucugcccuuucuu

SEQ ID NO: 3628714 - RNA, 14 nt, Salmonella enterica enterica serovar Typhi
gucgaacgguaaca

SEQ ID NO: 3628715 - RNA, 22 nt, Salmonella enterica enterica serovar Typhi
gucgaacugaauagucggcugc

SEQ ID NO: 3628716 - RNA, 18 nt, Salmonella enterica enterica serovar Typhi
gucgaacuuacgacgcgc

SEQ ID NO: 3628717 - RNA, 21 nt, Salmonella enterica enterica serovar Typhi
gucgacauaauuuccggccag

SEQ ID NO: 3628718 - RNA, 14 nt, Salmonella enterica enterica serovar Typhi
gucgacaugcgcau

SEQ ID NO: 3628719 - RNA, 14 nt, Salmonella enterica enterica serovar Typhi
gucgaccagcggcu

SEQ ID NO: 3628720 - RNA, 20 nt, Salmonella enterica enterica serovar Typhi
gucgaccaguccuuccgccg

SEQ ID NO: 3628721 - RNA, 21 nt, Salmonella enterica enterica serovar Typhi
gucgagaaaccgcucgccgcc

SEQ ID NO: 3628722 - RNA, 23 nt, Salmonella enterica enterica serovar Typhi
gucgagaauguggguauccacgc

SEQ ID NO: 3628723 - RNA, 20 nt, Salmonella enterica enterica serovar Typhi
gucgagcaucuccagcgcau

SEQ ID NO: 3628724 - RNA, 18 nt, Salmonella enterica enterica serovar Typhi
gucgagcucaguccagcc

SEQ ID NO: 3628725 - RNA, 23 nt, Salmonella enterica enterica serovar Typhi
gucgauacucacgacuuucacca

SEQ ID NO: 3628726 - RNA, 16 nt, Salmonella enterica enterica serovar Typhi
gucgauagaucgccac

SEQ ID NO: 3628727 - RNA, 14 nt, Salmonella enterica enterica serovar Typhi
gucgaucucggcca

SEQ ID NO: 3628728 - RNA, 15 nt, Salmonella enterica enterica serovar Typhi
gucgaucucggccac

SEQ ID NO: 3628729 - RNA, 13 nt, Salmonella enterica enterica serovar Typhi
gucgaugauuuuc

SEQ ID NO: 3628730 - RNA, 15 nt, Salmonella enterica enterica serovar Typhi
gucgaugucgccgcc

SEQ ID NO: 3628731 - RNA, 17 nt, Salmonella enterica enterica serovar Typhi
gucgcaagacgaaaaau

SEQ ID NO: 3628732 - RNA, 22 nt, Salmonella enterica enterica serovar Typhi
gucgcaagacgaaaaaugaaua

SEQ ID NO: 3628733 - RNA, 22 nt, Salmonella enterica enterica serovar Typhi
gucgcagccacccuggcauaug

SEQ ID NO: 3628734 - RNA, 20 nt, Salmonella enterica enterica serovar Typhi
gucgcagcggcggucugcgc

SEQ ID NO: 3628735 - RNA, 13 nt, Salmonella enterica enterica serovar Typhi
gucgcauccggca

SEQ ID NO: 3628736 - RNA, 16 nt, Salmonella enterica enterica serovar Typhi
gucgcauggcuaaaag

SEQ ID NO: 3628737 - RNA, 16 nt, Salmonella enterica enterica serovar Typhi
gucgccaagcugugga

SEQ ID NO: 3628738 - RNA, 12 nt, Salmonella enterica enterica serovar Typhi
gucgccagcaua

SEQ ID NO: 3628739 - RNA, 16 nt, Salmonella enterica enterica serovar Typhi
gucgccaggaucgccg

SEQ ID NO: 3628740 - RNA, 16 nt, Salmonella enterica enterica serovar Typhi
gucgcccagccauaau

SEQ ID NO: 3628741 - RNA, 14 nt, Salmonella enterica enterica serovar Typhi
gucgcccaugcgau

SEQ ID NO: 3628742 - RNA, 20 nt, Salmonella enterica enterica serovar Typhi
gucgcccggaaauggguauc

SEQ ID NO: 3628743 - RNA, 12 nt, Salmonella enterica enterica serovar Typhi
gucgccgcccgu

SEQ ID NO: 3628744 - RNA, 11 nt, Salmonella enterica enterica serovar Typhi
gucgccgccgu

SEQ ID NO: 3628745 - RNA, 15 nt, Salmonella enterica enterica serovar Typhi
gucgccggggcgcug

SEQ ID NO: 3628746 - RNA, 16 nt, Salmonella enterica enterica serovar Typhi
gucgccggggcgcugg

SEQ ID NO: 3628747 - RNA, 14 nt, Salmonella enterica enterica serovar Typhi
gucgccuuccagcg

SEQ ID NO: 3628748 - RNA, 23 nt, Salmonella enterica enterica serovar Typhi
gucgccuuccagcgacuccggau

SEQ ID NO: 3628749 - RNA, 18 nt, Salmonella enterica enterica serovar Typhi
gucgccuuccugcaggcg

SEQ ID NO: 3628750 - RNA, 22 nt, Salmonella enterica enterica serovar Typhi
gucgcgccaaaagaggcagcaa

SEQ ID NO: 3628751 - RNA, 18 nt, Salmonella enterica enterica serovar Typhi
gucgcgccauuccgcaga

SEQ ID NO: 3628752 - RNA, 22 nt, Salmonella enterica enterica serovar Typhi
gucgcgccgcguuucucgccgg

SEQ ID NO: 3628753 - RNA, 14 nt, Salmonella enterica enterica serovar Typhi
gucgcgcgccgcaa

SEQ ID NO: 3628754 - RNA, 13 nt, Salmonella enterica enterica serovar Typhi
gucgcgcgcgcca

SEQ ID NO: 3628755 - RNA, 12 nt, Salmonella enterica enterica serovar Typhi
gucgcgcuuacg

SEQ ID NO: 3628756 - RNA, 20 nt, Salmonella enterica enterica serovar Typhi
gucgcgcuuucaaucgucag

SEQ ID NO: 3628757 - RNA, 19 nt, Salmonella enterica enterica serovar Typhi
gucgcggauaugcagcagc

SEQ ID NO: 3628758 - RNA, 22 nt, Salmonella enterica enterica serovar Typhi
gucgcggcaucguagucaggca

SEQ ID NO: 3628759 - RNA, 14 nt, Salmonella enterica enterica serovar Typhi
gucgcgucagguuu

SEQ ID NO: 3628760 - RNA, 17 nt, Salmonella enterica enterica serovar Typhi
gucgcuauccagcagua

SEQ ID NO: 3628761 - RNA, 23 nt, Salmonella enterica enterica serovar Typhi
gucgcucacauucauugccgcca

SEQ ID NO: 3628762 - RNA, 17 nt, Salmonella enterica enterica serovar Typhi
gucgcugauugccgcca

SEQ ID NO: 3628763 - RNA, 23 nt, Salmonella enterica enterica serovar Typhi
gucggaaaucuguuccagcgagc

SEQ ID NO: 3628764 - RNA, 14 nt, Salmonella enterica enterica serovar Typhi
gucggagccaauaa

SEQ ID NO: 3628765 - RNA, 16 nt, Salmonella enterica enterica serovar Typhi
gucggagccaauaauc

SEQ ID NO: 3628766 - RNA, 12 nt, Salmonella enterica enterica serovar Typhi
gucggcgccauc

SEQ ID NO: 3628767 - RNA, 19 nt, Salmonella enterica enterica serovar Typhi
gucggcgccaucaugcagc

SEQ ID NO: 3628768 - RNA, 22 nt, Salmonella enterica enterica serovar Typhi
gucggcgccggcgucgaucagc

SEQ ID NO: 3628769 - RNA, 21 nt, Salmonella enterica enterica serovar Typhi
gucggcuuacgccuuauccgg

SEQ ID NO: 3628770 - RNA, 15 nt, Salmonella enterica enterica serovar Typhi
gucggcuuuuguucc

SEQ ID NO: 3628771 - RNA, 13 nt, Salmonella enterica enterica serovar Typhi
gucgggaauugcc

SEQ ID NO: 3628772 - RNA, 15 nt, Salmonella enterica enterica serovar Typhi
gucgggccaaucgga

SEQ ID NO: 3628773 - RNA, 23 nt, Salmonella enterica enterica serovar Typhi
gucgggggcgacaaacagcgccc

SEQ ID NO: 3628774 - RNA, 20 nt, Salmonella enterica enterica serovar Typhi
gucggguauuuuagcgguaa

SEQ ID NO: 3628775 - RNA, 15 nt, Salmonella enterica enterica serovar Typhi
gucggguucgcgcgc

SEQ ID NO: 3628776 - RNA, 18 nt, Salmonella enterica enterica serovar Typhi
gucgguuucauaacgcac

SEQ ID NO: 3628777 - RNA, 16 nt, Salmonella enterica enterica serovar Typhi
gucguaaaacugcacc

SEQ ID NO: 3628778 - RNA, 22 nt, Salmonella enterica enterica serovar Typhi
gucguaccggcgcucagccaga

SEQ ID NO: 3628779 - RNA, 19 nt, Salmonella enterica enterica serovar Typhi
gucguacucaccaguccgg

SEQ ID NO: 3628780 - RNA, 17 nt, Salmonella enterica enterica serovar Typhi
gucguauuuauuuucug

SEQ ID NO: 3628781 - RNA, 14 nt, Salmonella enterica enterica serovar Typhi
gucgucauggcgua

SEQ ID NO: 3628782 - RNA, 21 nt, Salmonella enterica enterica serovar Typhi
gucguccgcgcccaucuccag

SEQ ID NO: 3628783 - RNA, 19 nt, Salmonella enterica enterica serovar Typhi
gucgucgauuuucugcuca

SEQ ID NO: 3628784 - RNA, 21 nt, Salmonella enterica enterica serovar Typhi
gucgucgauuuucugcucaau

SEQ ID NO: 3628785 - RNA, 23 nt, Salmonella enterica enterica serovar Typhi
gucgucugaaagcgacucaucca

SEQ ID NO: 3628786 - RNA, 19 nt, Salmonella enterica enterica serovar Typhi
gucgugacuaauagccaaa

SEQ ID NO: 3628787 - RNA, 18 nt, Salmonella enterica enterica serovar Typhi
gucgugcaaccgccugca

SEQ ID NO: 3628788 - RNA, 14 nt, Salmonella enterica enterica serovar Typhi
gucgugccugcggu

SEQ ID NO: 3628789 - RNA, 14 nt, Salmonella enterica enterica serovar Typhi
gucgugccuuccgc

SEQ ID NO: 3628790 - RNA, 15 nt, Salmonella enterica enterica serovar Typhi
gucguggguucgaau

SEQ ID NO: 3628791 - RNA, 19 nt, Salmonella enterica enterica serovar Typhi
gucgugucauagucggcgc

SEQ ID NO: 3628792 - RNA, 22 nt, Salmonella enterica enterica serovar Typhi
gucguuacugcucguagcguuu

SEQ ID NO: 3628793 - RNA, 19 nt, Salmonella enterica enterica serovar Typhi
gucguuguaguuaucgccg

SEQ ID NO: 3628794 - RNA, 19 nt, Salmonella enterica enterica serovar Typhi
gucguuuguaggccggaug

SEQ ID NO: 3628795 - RNA, 19 nt, Salmonella enterica enterica serovar Typhi
gucguuuucacuuguucaa

SEQ ID NO: 3628796 - RNA, 16 nt, Salmonella enterica enterica serovar Typhi
gucuaucgcuccuccc

SEQ ID NO: 3628797 - RNA, 11 nt, Salmonella enterica enterica serovar Typhi
gucuauuuauu

SEQ ID NO: 3628798 - RNA, 14 nt, Salmonella enterica enterica serovar Typhi
gucucaaaaaauau

SEQ ID NO: 3628799 - RNA, 21 nt, Salmonella enterica enterica serovar Typhi
gucucacccguuuucuccuuc

SEQ ID NO: 3628800 - RNA, 20 nt, Salmonella enterica enterica serovar Typhi
gucucagauggaaaaaaaga

SEQ ID NO: 3628801 - RNA, 15 nt, Salmonella enterica enterica serovar Typhi
gucucagguucgaau

SEQ ID NO: 3628802 - RNA, 13 nt, Salmonella enterica enterica serovar Typhi
gucucauccggca

SEQ ID NO: 3628803 - RNA, 19 nt, Salmonella enterica enterica serovar Typhi
gucucaucggucgcaucca

SEQ ID NO: 3628804 - RNA, 18 nt, Salmonella enterica enterica serovar Typhi
gucucauuauuaaauuaa

SEQ ID NO: 3628805 - RNA, 20 nt, Salmonella enterica enterica serovar Typhi
gucuccagcucauuuuuaca

SEQ ID NO: 3628806 - RNA, 16 nt, Salmonella enterica enterica serovar Typhi
gucucccaaaugaaaa

SEQ ID NO: 3628807 - RNA, 17 nt, Salmonella enterica enterica serovar Typhi
gucucccaaaugaaaaa

SEQ ID NO: 3628808 - RNA, 22 nt, Salmonella enterica enterica serovar Typhi
gucucccgugacguuuugcgcg

SEQ ID NO: 3628809 - RNA, 19 nt, Salmonella enterica enterica serovar Typhi
gucuccucgccagcuaccg

SEQ ID NO: 3628810 - RNA, 14 nt, Salmonella enterica enterica serovar Typhi
gucucgacauuagc

SEQ ID NO: 3628811 - RNA, 14 nt, Salmonella enterica enterica serovar Typhi
gucucggccuggcc

SEQ ID NO: 3628812 - RNA, 18 nt, Salmonella enterica enterica serovar Typhi
gucucucccgaucuucug

SEQ ID NO: 3628813 - RNA, 13 nt, Salmonella enterica enterica serovar Typhi
gucucucccucaa

SEQ ID NO: 3628814 - RNA, 17 nt, Salmonella enterica enterica serovar Typhi
gucucugagaucaaaca

SEQ ID NO: 3628815 - RNA, 20 nt, Salmonella enterica enterica serovar Typhi
gucucuucaugcauaaccgc

SEQ ID NO: 3628816 - RNA, 14 nt, Salmonella enterica enterica serovar Typhi
gucucuucuuccgc

SEQ ID NO: 3628817 - RNA, 23 nt, Salmonella enterica enterica serovar Typhi
gucucuuuagaaaaagaaaccuc

SEQ ID NO: 3628818 - RNA, 16 nt, Salmonella enterica enterica serovar Typhi
gucucuuuauugaaaa

SEQ ID NO: 3628819 - RNA, 16 nt, Salmonella enterica enterica serovar Typhi
gucugaaaacucacgc

SEQ ID NO: 3628820 - RNA, 13 nt, Salmonella enterica enterica serovar Typhi
gucugaaaauaau

SEQ ID NO: 3628821 - RNA, 22 nt, Salmonella enterica enterica serovar Typhi
gucugaaggcguaugaaugaaa

SEQ ID NO: 3628822 - RNA, 21 nt, Salmonella enterica enterica serovar Typhi
gucugaauauuaaaguucagc

SEQ ID NO: 3628823 - RNA, 14 nt, Salmonella enterica enterica serovar Typhi
gucugaaucugcuc

SEQ ID NO: 3628824 - RNA, 20 nt, Salmonella enterica enterica serovar Typhi
gucugacaacuauugcugcc

SEQ ID NO: 3628825 - RNA, 16 nt, Salmonella enterica enterica serovar Typhi
gucugagcgcaaacau

SEQ ID NO: 3628826 - RNA, 15 nt, Salmonella enterica enterica serovar Typhi
gucugauggcgcugc

SEQ ID NO: 3628827 - RNA, 15 nt, Salmonella enterica enterica serovar Typhi
gucugcaagagaaau

SEQ ID NO: 3628828 - RNA, 19 nt, Salmonella enterica enterica serovar Typhi
gucugccaugccuuugacu

SEQ ID NO: 3628829 - RNA, 20 nt, Salmonella enterica enterica serovar Typhi
gucugcccggcaaccugagc

SEQ ID NO: 3628830 - RNA, 14 nt, Salmonella enterica enterica serovar Typhi
gucugcgcgcuggu

SEQ ID NO: 3628831 - RNA, 16 nt, Salmonella enterica enterica serovar Typhi
gucugcgcgcuggugu

SEQ ID NO: 3628832 - RNA, 15 nt, Salmonella enterica enterica serovar Typhi
gucugcgcugggccg

SEQ ID NO: 3628833 - RNA, 22 nt, Salmonella enterica enterica serovar Typhi
gucugcugaucguuuuugucca

SEQ ID NO: 3628834 - RNA, 15 nt, Salmonella enterica enterica serovar Typhi
gucugcuucgucugg

SEQ ID NO: 3628835 - RNA, 20 nt, Salmonella enterica enterica serovar Typhi
gucuggcagcggcaguaaau

SEQ ID NO: 3628836 - RNA, 16 nt, Salmonella enterica enterica serovar Typhi
gucuggcgcuaaaauc

SEQ ID NO: 3628837 - RNA, 19 nt, Salmonella enterica enterica serovar Typhi
gucuggcgugccgggcugg

SEQ ID NO: 3628838 - RNA, 11 nt, Salmonella enterica enterica serovar Typhi
gucuggucagc

SEQ ID NO: 3628839 - RNA, 15 nt, Salmonella enterica enterica serovar Typhi
gucuggugauccagc

SEQ ID NO: 3628840 - RNA, 13 nt, Salmonella enterica enterica serovar Typhi
gucugguggucua

SEQ ID NO: 3628841 - RNA, 22 nt, Salmonella enterica enterica serovar Typhi
gucuguaccaccagaaucgcca

SEQ ID NO: 3628842 - RNA, 23 nt, Salmonella enterica enterica serovar Typhi
gucuguaccaccagaaucgccag

SEQ ID NO: 3628843 - RNA, 20 nt, Salmonella enterica enterica serovar Typhi
gucugucggacucaggguga

SEQ ID NO: 3628844 - RNA, 15 nt, Salmonella enterica enterica serovar Typhi
gucugucgguaaaga

SEQ ID NO: 3628845 - RNA, 14 nt, Salmonella enterica enterica serovar Typhi
gucuguguugaaua

SEQ ID NO: 3628846 - RNA, 21 nt, Salmonella enterica enterica serovar Typhi
gucuguuucaacgcauccagc

SEQ ID NO: 3628847 - RNA, 22 nt, Salmonella enterica enterica serovar Typhi
gucuguuuugccuugccacgca

SEQ ID NO: 3628848 - RNA, 22 nt, Salmonella enterica enterica serovar Typhi
gucuuaaacagcgaucacgccg

SEQ ID NO: 3628849 - RNA, 17 nt, Salmonella enterica enterica serovar Typhi
gucuuaaagaaaaagaa

SEQ ID NO: 3628850 - RNA, 17 nt, Salmonella enterica enterica serovar Typhi
gucuuaaaugccgccgg

SEQ ID NO: 3628851 - RNA, 19 nt, Salmonella enterica enterica serovar Typhi
gucuuauccggccuccaaa

SEQ ID NO: 3628852 - RNA, 17 nt, Salmonella enterica enterica serovar Typhi
gucuuauuucuccugcg

SEQ ID NO: 3628853 - RNA, 21 nt, Salmonella enterica enterica serovar Typhi
gucuucaacguuccuucagga

SEQ ID NO: 3628854 - RNA, 16 nt, Salmonella enterica enterica serovar Typhi
gucuucacucaccaca

SEQ ID NO: 3628855 - RNA, 23 nt, Salmonella enterica enterica serovar Typhi
gucuucacucugggauuugcgaa

SEQ ID NO: 3628856 - RNA, 19 nt, Salmonella enterica enterica serovar Typhi
gucuucaucagccagcauc

SEQ ID NO: 3628857 - RNA, 20 nt, Salmonella enterica enterica serovar Typhi
gucuucaucagccagcaucg

SEQ ID NO: 3628858 - RNA, 11 nt, Salmonella enterica enterica serovar Typhi
gucuuccagca

SEQ ID NO: 3628859 - RNA, 21 nt, Salmonella enterica enterica serovar Typhi
gucuuccagcauucuauuguu

SEQ ID NO: 3628860 - RNA, 15 nt, Salmonella enterica enterica serovar Typhi
gucuucccagguuuc

SEQ ID NO: 3628861 - RNA, 15 nt, Salmonella enterica enterica serovar Typhi
gucuuccgacacuga

SEQ ID NO: 3628862 - RNA, 13 nt, Salmonella enterica enterica serovar Typhi
gucuuccugcggu

SEQ ID NO: 3628863 - RNA, 21 nt, Salmonella enterica enterica serovar Typhi
gucuucgcacugcccuucccg

SEQ ID NO: 3628864 - RNA, 13 nt, Salmonella enterica enterica serovar Typhi
gucuucugccagc

SEQ ID NO: 3628865 - RNA, 23 nt, Salmonella enterica enterica serovar Typhi
gucuugauuucaggugcuuaucu

SEQ ID NO: 3628866 - RNA, 12 nt, Salmonella enterica enterica serovar Typhi
gucuugccuguc

SEQ ID NO: 3628867 - RNA, 17 nt, Salmonella enterica enterica serovar Typhi
gucuugcgcguccgccu

SEQ ID NO: 3628868 - RNA, 22 nt, Salmonella enterica enterica serovar Typhi
gucuugucaggcucuaauaacu

SEQ ID NO: 3628869 - RNA, 23 nt, Salmonella enterica enterica serovar Typhi
gucuuuccgacccuuaugucauu

SEQ ID NO: 3628870 - RNA, 22 nt, Salmonella enterica enterica serovar Typhi
gucuuugcguuuacuuacaaau

SEQ ID NO: 3628871 - RNA, 16 nt, Salmonella enterica enterica serovar Typhi
gucuuuguugccuucg

SEQ ID NO: 3628872 - RNA, 17 nt, Salmonella enterica enterica serovar Typhi
gucuuuguugccuucga

SEQ ID NO: 3628873 - RNA, 12 nt, Salmonella enterica enterica serovar Typhi
gucuuuuauccc

SEQ ID NO: 3628874 - RNA, 13 nt, Salmonella enterica enterica serovar Typhi
gucuuuucugucg

SEQ ID NO: 3628875 - RNA, 13 nt, Salmonella enterica enterica serovar Typhi
gucuuuuucucaa

SEQ ID NO: 3628876 - RNA, 23 nt, Salmonella enterica enterica serovar Typhi
gugaaaaagcggcuguagccagc

SEQ ID NO: 3628877 - RNA, 17 nt, Salmonella enterica enterica serovar Typhi
gugaaaagggaugcuga

SEQ ID NO: 3628878 - RNA, 19 nt, Salmonella enterica enterica serovar Typhi
gugaaacagguuuaaacga

SEQ ID NO: 3628879 - RNA, 11 nt, Salmonella enterica enterica serovar Typhi
gugaaauaaau

SEQ ID NO: 3628880 - RNA, 20 nt, Salmonella enterica enterica serovar Typhi
gugaacaaaggcagccaaca

SEQ ID NO: 3628881 - RNA, 21 nt, Salmonella enterica enterica serovar Typhi
gugaacauggguuucuugccg

SEQ ID NO: 3628882 - RNA, 19 nt, Salmonella enterica enterica serovar Typhi
gugaacauuacaauguaca

SEQ ID NO: 3628883 - RNA, 21 nt, Salmonella enterica enterica serovar Typhi
gugaaccagcaucccacgaau

SEQ ID NO: 3628884 - RNA, 12 nt, Salmonella enterica enterica serovar Typhi
gugaaccauggc

SEQ ID NO: 3628885 - RNA, 17 nt, Salmonella enterica enterica serovar Typhi
gugaacgcacgcagcca

SEQ ID NO: 3628886 - RNA, 19 nt, Salmonella enterica enterica serovar Typhi
gugaacgcacgcagccaac

SEQ ID NO: 3628887 - RNA, 18 nt, Salmonella enterica enterica serovar Typhi
gugaacgccaaauacguc

SEQ ID NO: 3628888 - RNA, 17 nt, Salmonella enterica enterica serovar Typhi
gugaacgccuccauuuu

SEQ ID NO: 3628889 - RNA, 17 nt, Salmonella enterica enterica serovar Typhi
gugaacgguugagcuuu

SEQ ID NO: 3628890 - RNA, 13 nt, Salmonella enterica enterica serovar Typhi
gugaacugcgccu

SEQ ID NO: 3628891 - RNA, 19 nt, Salmonella enterica enterica serovar Typhi
gugaagaaucuguauaaaa

SEQ ID NO: 3628892 - RNA, 19 nt, Salmonella enterica enterica serovar Typhi
gugaagacacaacgugcca

SEQ ID NO: 3628893 - RNA, 14 nt, Salmonella enterica enterica serovar Typhi
gugaagacgcugca

SEQ ID NO: 3628894 - RNA, 14 nt, Salmonella enterica enterica serovar Typhi
gugaagccaucaaa

SEQ ID NO: 3628895 - RNA, 20 nt, Salmonella enterica enterica serovar Typhi
gugaagcgaucggcgucauu

SEQ ID NO: 3628896 - RNA, 12 nt, Salmonella enterica enterica serovar Typhi
gugaaggcaaaa

SEQ ID NO: 3628897 - RNA, 21 nt, Salmonella enterica enterica serovar Typhi
gugaaggcaaaacaccauauu

SEQ ID NO: 3628898 - RNA, 18 nt, Salmonella enterica enterica serovar Typhi
gugaaggccaaguuuaga

SEQ ID NO: 3628899 - RNA, 13 nt, Salmonella enterica enterica serovar Typhi
gugaauaaauccu

SEQ ID NO: 3628900 - RNA, 16 nt, Salmonella enterica enterica serovar Typhi
gugaauaccaaagccc

SEQ ID NO: 3628901 - RNA, 16 nt, Salmonella enterica enterica serovar Typhi
gugaauaccagcggca

SEQ ID NO: 3628902 - RNA, 18 nt, Salmonella enterica enterica serovar Typhi
gugaauagguauguagua

SEQ ID NO: 3628903 - RNA, 17 nt, Salmonella enterica enterica serovar Typhi
gugaauaugacgggcaa

SEQ ID NO: 3628904 - RNA, 18 nt, Salmonella enterica enterica serovar Typhi
gugaauaugaucugcaca

SEQ ID NO: 3628905 - RNA, 13 nt, Salmonella enterica enterica serovar Typhi
gugaauauucaga

SEQ ID NO: 3628906 - RNA, 21 nt, Salmonella enterica enterica serovar Typhi
gugaaucaucaucauccgcgc

SEQ ID NO: 3628907 - RNA, 14 nt, Salmonella enterica enterica serovar Typhi
gugaauguccugcg

SEQ ID NO: 3628908 - RNA, 20 nt, Salmonella enterica enterica serovar Typhi
gugaauuaugaccaauguua

SEQ ID NO: 3628909 - RNA, 13 nt, Salmonella enterica enterica serovar Typhi
gugaauuucugcu

SEQ ID NO: 3628910 - RNA, 16 nt, Salmonella enterica enterica serovar Typhi
gugacaaucuccuccg

SEQ ID NO: 3628911 - RNA, 15 nt, Salmonella enterica enterica serovar Typhi
gugacauuauucacc

SEQ ID NO: 3628912 - RNA, 13 nt, Salmonella enterica enterica serovar Typhi
gugaccagcaguu

SEQ ID NO: 3628913 - RNA, 20 nt, Salmonella enterica enterica serovar Typhi
gugaccccggccucgcccgc

SEQ ID NO: 3628914 - RNA, 15 nt, Salmonella enterica enterica serovar Typhi
gugacccgccgccag

SEQ ID NO: 3628915 - RNA, 18 nt, Salmonella enterica enterica serovar Typhi
gugacccgccgccagcac

SEQ ID NO: 3628916 - RNA, 14 nt, Salmonella enterica enterica serovar Typhi
gugaccgauaaaaa

SEQ ID NO: 3628917 - RNA, 17 nt, Salmonella enterica enterica serovar Typhi
gugaccgccuuaaaauu

SEQ ID NO: 3628918 - RNA, 21 nt, Salmonella enterica enterica serovar Typhi
gugaccgguaagcccauggca

SEQ ID NO: 3628919 - RNA, 16 nt, Salmonella enterica enterica serovar Typhi
gugacgcaggccgggu

SEQ ID NO: 3628920 - RNA, 13 nt, Salmonella enterica enterica serovar Typhi
gugacgccaggca

SEQ ID NO: 3628921 - RNA, 20 nt, Salmonella enterica enterica serovar Typhi
gugacgccaugcaaaaaaga

SEQ ID NO: 3628922 - RNA, 17 nt, Salmonella enterica enterica serovar Typhi
gugacggaaaccagcau

SEQ ID NO: 3628923 - RNA, 21 nt, Salmonella enterica enterica serovar Typhi
gugacggaggcgggcgcgcag

SEQ ID NO: 3628924 - RNA, 19 nt, Salmonella enterica enterica serovar Typhi
gugacggaggucauuccug

SEQ ID NO: 3628925 - RNA, 21 nt, Salmonella enterica enterica serovar Typhi
gugacggcaaaguuccagguu

SEQ ID NO: 3628926 - RNA, 22 nt, Salmonella enterica enterica serovar Typhi
gugacggcggaaauuagcccgc

SEQ ID NO: 3628927 - RNA, 14 nt, Salmonella enterica enterica serovar Typhi
gugacgguaucgug

SEQ ID NO: 3628928 - RNA, 22 nt, Salmonella enterica enterica serovar Typhi
gugacgguaucgugacgcgaau

SEQ ID NO: 3628929 - RNA, 18 nt, Salmonella enterica enterica serovar Typhi
gugacgucaagaucgcgc

SEQ ID NO: 3628930 - RNA, 16 nt, Salmonella enterica enterica serovar Typhi
gugacuaaaagacgcc

SEQ ID NO: 3628931 - RNA, 17 nt, Salmonella enterica enterica serovar Typhi
gugacuaauagccaaaa

SEQ ID NO: 3628932 - RNA, 18 nt, Salmonella enterica enterica serovar Typhi
gugacuaauagccaaaag

SEQ ID NO: 3628933 - RNA, 15 nt, Salmonella enterica enterica serovar Typhi
gugacuuugcccuuu

SEQ ID NO: 3628934 - RNA, 14 nt, Salmonella enterica enterica serovar Typhi
gugagcaucggcga

SEQ ID NO: 3628935 - RNA, 14 nt, Salmonella enterica enterica serovar Typhi
gugagcucuuucug

SEQ ID NO: 3628936 - RNA, 21 nt, Salmonella enterica enterica serovar Typhi
gugaggcagauaugcgggcuc

SEQ ID NO: 3628937 - RNA, 18 nt, Salmonella enterica enterica serovar Typhi
gugaguaacgggcagcgg

SEQ ID NO: 3628938 - RNA, 15 nt, Salmonella enterica enterica serovar Typhi
gugaguacgcaggag

SEQ ID NO: 3628939 - RNA, 20 nt, Salmonella enterica enterica serovar Typhi
gugaguggcggcgcgcaggc

SEQ ID NO: 3628940 - RNA, 16 nt, Salmonella enterica enterica serovar Typhi
gugauaaagcagacca

SEQ ID NO: 3628941 - RNA, 22 nt, Salmonella enterica enterica serovar Typhi
gugauaaauacgcugcggccug

SEQ ID NO: 3628942 - RNA, 23 nt, Salmonella enterica enterica serovar Typhi
gugauaucgguaagcgccugcug

SEQ ID NO: 3628943 - RNA, 18 nt, Salmonella enterica enterica serovar Typhi
gugaucggagaaauagac

SEQ ID NO: 3628944 - RNA, 14 nt, Salmonella enterica enterica serovar Typhi
gugaugcaucagaa

SEQ ID NO: 3628945 - RNA, 18 nt, Salmonella enterica enterica serovar Typhi
gugaugcaucagaacaaa

SEQ ID NO: 3628946 - RNA, 18 nt, Salmonella enterica enterica serovar Typhi
gugaugccaaacaucgcu

SEQ ID NO: 3628947 - RNA, 20 nt, Salmonella enterica enterica serovar Typhi
gugaugccagccauagccca

SEQ ID NO: 3628948 - RNA, 20 nt, Salmonella enterica enterica serovar Typhi
gugaugggcaaugccauauu

SEQ ID NO: 3628949 - RNA, 13 nt, Salmonella enterica enterica serovar Typhi
gugaugugccggu

SEQ ID NO: 3628950 - RNA, 13 nt, Salmonella enterica enterica serovar Typhi
gugaugugcuggc

SEQ ID NO: 3628951 - RNA, 16 nt, Salmonella enterica enterica serovar Typhi
gugauuaacagcgcca

SEQ ID NO: 3628952 - RNA, 23 nt, Salmonella enterica enterica serovar Typhi
gugauuaacagcgccaucaggaa

SEQ ID NO: 3628953 - RNA, 15 nt, Salmonella enterica enterica serovar Typhi
gugauuacaaaaugu

SEQ ID NO: 3628954 - RNA, 15 nt, Salmonella enterica enterica serovar Typhi
gugauucaucacguu

SEQ ID NO: 3628955 - RNA, 22 nt, Salmonella enterica enterica serovar Typhi
gugauuggcuggacauguuccg

SEQ ID NO: 3628956 - RNA, 18 nt, Salmonella enterica enterica serovar Typhi
gugauuuacuccaaaaau

SEQ ID NO: 3628957 - RNA, 19 nt, Salmonella enterica enterica serovar Typhi
gugauuucaugcggugcau

SEQ ID NO: 3628958 - RNA, 23 nt, Salmonella enterica enterica serovar Typhi
gugcaaucccggaacagcggagc

SEQ ID NO: 3628959 - RNA, 23 nt, Salmonella enterica enterica serovar Typhi
gugcaauccugucgucaccagca

SEQ ID NO: 3628960 - RNA, 20 nt, Salmonella enterica enterica serovar Typhi
gugcaaugucaugacugguu

SEQ ID NO: 3628961 - RNA, 15 nt, Salmonella enterica enterica serovar Typhi
gugcacuggucaucg

SEQ ID NO: 3628962 - RNA, 15 nt, Salmonella enterica enterica serovar Typhi
gugcagaccucugca

SEQ ID NO: 3628963 - RNA, 16 nt, Salmonella enterica enterica serovar Typhi
gugcagcaagcggcug

SEQ ID NO: 3628964 - RNA, 17 nt, Salmonella enterica enterica serovar Typhi
gugcagcaagcggcugu

SEQ ID NO: 3628965 - RNA, 14 nt, Salmonella enterica enterica serovar Typhi
gugcagcgugccgg

SEQ ID NO: 3628966 - RNA, 17 nt, Salmonella enterica enterica serovar Typhi
gugcagcguuuccagcc

SEQ ID NO: 3628967 - RNA, 16 nt, Salmonella enterica enterica serovar Typhi
gugcaggaucaaccgg

SEQ ID NO: 3628968 - RNA, 20 nt, Salmonella enterica enterica serovar Typhi
gugcaggauuuguaucacaa

SEQ ID NO: 3628969 - RNA, 15 nt, Salmonella enterica enterica serovar Typhi
gugcaggcugagcgu

SEQ ID NO: 3628970 - RNA, 19 nt, Salmonella enterica enterica serovar Typhi
gugcauaaagauuggcauc

SEQ ID NO: 3628971 - RNA, 20 nt, Salmonella enterica enterica serovar Typhi
gugcaucaggaaauccugga

SEQ ID NO: 3628972 - RNA, 20 nt, Salmonella enterica enterica serovar Typhi
gugcauccggacgccagugc

SEQ ID NO: 3628973 - RNA, 13 nt, Salmonella enterica enterica serovar Typhi
gugcaucggcaca

SEQ ID NO: 3628974 - RNA, 14 nt, Salmonella enterica enterica serovar Typhi
gugcaucggcacag

SEQ ID NO: 3628975 - RNA, 13 nt, Salmonella enterica enterica serovar Typhi
gugcaucuccucg

SEQ ID NO: 3628976 - RNA, 20 nt, Salmonella enterica enterica serovar Typhi
gugcauuauuuuagugaaaa

SEQ ID NO: 3628977 - RNA, 15 nt, Salmonella enterica enterica serovar Typhi
gugcauuccaggugu

SEQ ID NO: 3628978 - RNA, 14 nt, Salmonella enterica enterica serovar Typhi
gugccaaggcaucu

SEQ ID NO: 3628979 - RNA, 12 nt, Salmonella enterica enterica serovar Typhi
gugccaccagcc

SEQ ID NO: 3628980 - RNA, 12 nt, Salmonella enterica enterica serovar Typhi
gugccaguaauc

SEQ ID NO: 3628981 - RNA, 16 nt, Salmonella enterica enterica serovar Typhi
gugccaugaccauuca

SEQ ID NO: 3628982 - RNA, 13 nt, Salmonella enterica enterica serovar Typhi
gugccaugaguaa

SEQ ID NO: 3628983 - RNA, 12 nt, Salmonella enterica enterica serovar Typhi
gugcccaucggc

SEQ ID NO: 3628984 - RNA, 19 nt, Salmonella enterica enterica serovar Typhi
gugcccgcgaucgcuucca

SEQ ID NO: 3628985 - RNA, 23 nt, Salmonella enterica enterica serovar Typhi
gugccgaaaucaucaauggcgau

SEQ ID NO: 3628986 - RNA, 23 nt, Salmonella enterica enterica serovar Typhi
gugccgaccagcgguugcauaaa

SEQ ID NO: 3628987 - RNA, 20 nt, Salmonella enterica enterica serovar Typhi
gugccgacgccagccauuaa

SEQ ID NO: 3628988 - RNA, 21 nt, Salmonella enterica enterica serovar Typhi
gugccgauggcgcuccugaau

SEQ ID NO: 3628989 - RNA, 19 nt, Salmonella enterica enterica serovar Typhi
gugccgccaggcaaauucu

SEQ ID NO: 3628990 - RNA, 12 nt, Salmonella enterica enterica serovar Typhi
gugccgcuggug

SEQ ID NO: 3628991 - RNA, 19 nt, Salmonella enterica enterica serovar Typhi
gugccgguaaagggcggga

SEQ ID NO: 3628992 - RNA, 13 nt, Salmonella enterica enterica serovar Typhi
gugccgucaucca

SEQ ID NO: 3628993 - RNA, 23 nt, Salmonella enterica enterica serovar Typhi
gugccgugagcgcguaggccaga

SEQ ID NO: 3628994 - RNA, 15 nt, Salmonella enterica enterica serovar Typhi
gugccugacagcaau

SEQ ID NO: 3628995 - RNA, 17 nt, Salmonella enterica enterica serovar Typhi
gugccugacagcaauga

SEQ ID NO: 3628996 - RNA, 19 nt, Salmonella enterica enterica serovar Typhi
gugccugacagcaaugagc

SEQ ID NO: 3628997 - RNA, 13 nt, Salmonella enterica enterica serovar Typhi
gugccugcuccgc

SEQ ID NO: 3628998 - RNA, 14 nt, Salmonella enterica enterica serovar Typhi
gugccuggauaaau

SEQ ID NO: 3628999 - RNA, 16 nt, Salmonella enterica enterica serovar Typhi
gugccuguguucgugg

SEQ ID NO: 3629000 - RNA, 14 nt, Salmonella enterica enterica serovar Typhi
gugccuuccgcaau

SEQ ID NO: 3629001 - RNA, 21 nt, Salmonella enterica enterica serovar Typhi
gugcgacaacaaugaaacggu

SEQ ID NO: 3629002 - RNA, 14 nt, Salmonella enterica enterica serovar Typhi
gugcgacaccacgc

SEQ ID NO: 3629003 - RNA, 21 nt, Salmonella enterica enterica serovar Typhi
gugcgacaucgacaaaauagu

SEQ ID NO: 3629004 - RNA, 13 nt, Salmonella enterica enterica serovar Typhi
gugcgagaaaaag

SEQ ID NO: 3629005 - RNA, 17 nt, Salmonella enterica enterica serovar Typhi
gugcgauucagcgcagg

SEQ ID NO: 3629006 - RNA, 19 nt, Salmonella enterica enterica serovar Typhi
gugcgauucagcgcaggca

SEQ ID NO: 3629007 - RNA, 13 nt, Salmonella enterica enterica serovar Typhi
gugcgcauccgga

SEQ ID NO: 3629008 - RNA, 22 nt, Salmonella enterica enterica serovar Typhi
gugcgccagccuuaucccaucc

SEQ ID NO: 3629009 - RNA, 18 nt, Salmonella enterica enterica serovar Typhi
gugcgccccuugcagcaa

SEQ ID NO: 3629010 - RNA, 17 nt, Salmonella enterica enterica serovar Typhi
gugcgccguccugcaag

SEQ ID NO: 3629011 - RNA, 20 nt, Salmonella enterica enterica serovar Typhi
gugcgccguccugcaaggca

SEQ ID NO: 3629012 - RNA, 16 nt, Salmonella enterica enterica serovar Typhi
gugcgcgggaggcggu

SEQ ID NO: 3629013 - RNA, 22 nt, Salmonella enterica enterica serovar Typhi
gugcgcggucauaucuggacgg

SEQ ID NO: 3629014 - RNA, 15 nt, Salmonella enterica enterica serovar Typhi
gugcgcuguggucgu

SEQ ID NO: 3629015 - RNA, 19 nt, Salmonella enterica enterica serovar Typhi
gugcgcuguggucgucugg

SEQ ID NO: 3629016 - RNA, 14 nt, Salmonella enterica enterica serovar Typhi
gugcggacguagcg

SEQ ID NO: 3629017 - RNA, 16 nt, Salmonella enterica enterica serovar Typhi
gugcggcaaccaccag

SEQ ID NO: 3629018 - RNA, 20 nt, Salmonella enterica enterica serovar Typhi
gugcggcauauucaggagca

SEQ ID NO: 3629019 - RNA, 22 nt, Salmonella enterica enterica serovar Typhi
gugcggcauauucaggagcaug

SEQ ID NO: 3629020 - RNA, 18 nt, Salmonella enterica enterica serovar Typhi
gugcggcgcacugccuga

SEQ ID NO: 3629021 - RNA, 14 nt, Salmonella enterica enterica serovar Typhi
gugcggcggacgcc

SEQ ID NO: 3629022 - RNA, 13 nt, Salmonella enterica enterica serovar Typhi
gugcggcuuaucg

SEQ ID NO: 3629023 - RNA, 19 nt, Salmonella enterica enterica serovar Typhi
gugcgggaggaauaaaaga

SEQ ID NO: 3629024 - RNA, 13 nt, Salmonella enterica enterica serovar Typhi
gugcguaaaauau

SEQ ID NO: 3629025 - RNA, 14 nt, Salmonella enterica enterica serovar Typhi
gugcguaaacaggc

SEQ ID NO: 3629026 - RNA, 24 nt, Salmonella enterica enterica serovar Typhi
gugcgugacccacaguuucauauc

SEQ ID NO: 3629027 - RNA, 13 nt, Salmonella enterica enterica serovar Typhi
gugcguucuucca

SEQ ID NO: 3629028 - RNA, 14 nt, Salmonella enterica enterica serovar Typhi
gugcguucuuccac

SEQ ID NO: 3629029 - RNA, 15 nt, Salmonella enterica enterica serovar Typhi
gugcguucuuccacu

SEQ ID NO: 3629030 - RNA, 14 nt, Salmonella enterica enterica serovar Typhi
gugcuacgggcgcu

SEQ ID NO: 3629031 - RNA, 20 nt, Salmonella enterica enterica serovar Typhi
gugcuacgggcgcugucgcc

SEQ ID NO: 3629032 - RNA, 16 nt, Salmonella enterica enterica serovar Typhi
gugcucagccccuggg

SEQ ID NO: 3629033 - RNA, 18 nt, Salmonella enterica enterica serovar Typhi
gugcucgauauauuuucc

SEQ ID NO: 3629034 - RNA, 19 nt, Salmonella enterica enterica serovar Typhi
gugcugccacaucgccagc

SEQ ID NO: 3629035 - RNA, 13 nt, Salmonella enterica enterica serovar Typhi
gugcuggcggccg

SEQ ID NO: 3629036 - RNA, 14 nt, Salmonella enterica enterica serovar Typhi
gugcuggcggccgu

SEQ ID NO: 3629037 - RNA, 18 nt, Salmonella enterica enterica serovar Typhi
gugcuguaccgcguccug

SEQ ID NO: 3629038 - RNA, 13 nt, Salmonella enterica enterica serovar Typhi
gugcuuccagcuc

SEQ ID NO: 3629039 - RNA, 16 nt, Salmonella enterica enterica serovar Typhi
gugcuuccagcuccau

SEQ ID NO: 3629040 - RNA, 16 nt, Salmonella enterica enterica serovar Typhi
gugcuugagcugcggu

SEQ ID NO: 3629041 - RNA, 17 nt, Salmonella enterica enterica serovar Typhi
gugcuugcguuucuaga

SEQ ID NO: 3629042 - RNA, 20 nt, Salmonella enterica enterica serovar Typhi
guggaaaacagcauaauaaa

SEQ ID NO: 3629043 - RNA, 13 nt, Salmonella enterica enterica serovar Typhi
guggaaggcauua

SEQ ID NO: 3629044 - RNA, 22 nt, Salmonella enterica enterica serovar Typhi
guggaaugccccagguuauaga

SEQ ID NO: 3629045 - RNA, 23 nt, Salmonella enterica enterica serovar Typhi
guggacaaucaggcugcggauga

SEQ ID NO: 3629046 - RNA, 14 nt, Salmonella enterica enterica serovar Typhi
guggacaucgccau

SEQ ID NO: 3629047 - RNA, 17 nt, Salmonella enterica enterica serovar Typhi
guggagggguauuuauc

SEQ ID NO: 3629048 - RNA, 23 nt, Salmonella enterica enterica serovar Typhi
guggaugcgcuaucgauggcagu

SEQ ID NO: 3629049 - RNA, 16 nt, Salmonella enterica enterica serovar Typhi
guggauuuauggcguc

SEQ ID NO: 3629050 - RNA, 14 nt, Salmonella enterica enterica serovar Typhi
guggcaaaauccaa

SEQ ID NO: 3629051 - RNA, 15 nt, Salmonella enterica enterica serovar Typhi
guggcaaaauccaac

SEQ ID NO: 3629052 - RNA, 11 nt, Salmonella enterica enterica serovar Typhi
guggcaaauac

SEQ ID NO: 3629053 - RNA, 22 nt, Salmonella enterica enterica serovar Typhi
guggcaacgcuggcggcguccg

SEQ ID NO: 3629054 - RNA, 14 nt, Salmonella enterica enterica serovar Typhi
guggcaaucagcaa

SEQ ID NO: 3629055 - RNA, 12 nt, Salmonella enterica enterica serovar Typhi
guggcaucauca

SEQ ID NO: 3629056 - RNA, 21 nt, Salmonella enterica enterica serovar Typhi
guggccagcaugcccgccagc
